United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 57

SEQ ID NO: 2578692 - RNA, 18 nt, Human
aagccaggagcaaauguu

SEQ ID NO: 2578693 - RNA, 24 nt, Human
aagccaggaauuucccaggacccu

SEQ ID NO: 2578694 - RNA, 21 nt, Human
aagccaggcagguagccaggg

SEQ ID NO: 2578695 - RNA, 22 nt, Human
aagauacagccugcaaguggua

SEQ ID NO: 2578696 - RNA, 16 nt, Human
aagauaauaauauaug

SEQ ID NO: 2578697 - RNA, 23 nt, Human
aagccaggaauuucccaggaccc

SEQ ID NO: 2578698 - RNA, 17 nt, Human
aagauacaguuacucag

SEQ ID NO: 2578699 - RNA, 20 nt, Human
aagauacagaacucuuucaa

SEQ ID NO: 2578700 - RNA, 22 nt, Human
aagauacagaacucuuucaaaa

SEQ ID NO: 2578701 - RNA, 12 nt, Human
aagauaauuaua

SEQ ID NO: 2578702 - RNA, 15 nt, Human
aagauaauaauauau

SEQ ID NO: 2578703 - RNA, 19 nt, Human
aagauaauauuaaggaaga

SEQ ID NO: 2578704 - RNA, 21 nt, Human
aagauaauauuaaggaagaca

SEQ ID NO: 2578705 - RNA, 14 nt, Human
aagauaaaugugcu

SEQ ID NO: 2578706 - RNA, 19 nt, Human
aagauaacaagaucuuuca

SEQ ID NO: 2578707 - RNA, 20 nt, Human
aagauaacaagaucuuucag

SEQ ID NO: 2578708 - RNA, 21 nt, Human
aagauaacaagaucuuucagg

SEQ ID NO: 2578709 - RNA, 21 nt, Human
aagauaaguguauuuuucaau

SEQ ID NO: 2578710 - RNA, 15 nt, Human
aagauaacuugagca

SEQ ID NO: 2578711 - RNA, 22 nt, Human
aagauaacaagaucuuucagga

SEQ ID NO: 2578712 - RNA, 10 nt, Human
aagccuuugu

SEQ ID NO: 2578713 - RNA, 15 nt, Human
aagccuuuccauaag

SEQ ID NO: 2578714 - RNA, 14 nt, Human
aagccuuuccauaa

SEQ ID NO: 2578715 - RNA, 16 nt, Human
aagccuuuuuccccaa

SEQ ID NO: 2578716 - RNA, 18 nt, Human
aagcgaucacuuccuaua

SEQ ID NO: 2578717 - RNA, 18 nt, Human
aagcgaggucaacagaga

SEQ ID NO: 2578718 - RNA, 14 nt, Human
aagcgauucuccug

SEQ ID NO: 2578719 - RNA, 20 nt, Human
aagcgaugaauuuggagacu

SEQ ID NO: 2578720 - RNA, 21 nt, Human
aagcgaugaauuuggagacuc

SEQ ID NO: 2578721 - RNA, 14 nt, Human
aagcggcuggcagc

SEQ ID NO: 2578722 - RNA, 15 nt, Human
aagcgugagccacug

SEQ ID NO: 2578723 - RNA, 23 nt, Human
aagcgugaaggccgagaagcaag

SEQ ID NO: 2578724 - RNA, 22 nt, Human
aagcuacugugugugugaauga

SEQ ID NO: 2578725 - RNA, 19 nt, Human
aagcuacugugugugugaa

SEQ ID NO: 2578726 - RNA, 16 nt, Human
aagcuagaaccuggag

SEQ ID NO: 2578727 - RNA, 17 nt, Human
aagcgugagacgccacc

SEQ ID NO: 2578728 - RNA, 23 nt, Human
aagcuacugugugugugaaugaa

SEQ ID NO: 2578729 - RNA, 13 nt, Human
aagcuagaaauga

SEQ ID NO: 2578730 - RNA, 22 nt, Human
aaggcaggugccuccaggugug

SEQ ID NO: 2578731 - RNA, 19 nt, Human
aaggcauaucagucucuga

SEQ ID NO: 2578732 - RNA, 13 nt, Human
aagcugcacccuc

SEQ ID NO: 2578733 - RNA, 19 nt, Human
aagcugcacccucaggcag

SEQ ID NO: 2578734 - RNA, 12 nt, Human
aaggacuugaaa

SEQ ID NO: 2578735 - RNA, 17 nt, Human
aaggacuugaaagcauc

SEQ ID NO: 2578736 - RNA, 19 nt, Human
aaggacuugaaagcaucca

SEQ ID NO: 2578737 - RNA, 22 nt, Human
aaggacuugaaagcauccaugu

SEQ ID NO: 2578738 - RNA, 10 nt, Human
aagcuagaau

SEQ ID NO: 2578739 - RNA, 19 nt, Human
aagcuagaaggccacaugu

SEQ ID NO: 2578740 - RNA, 17 nt, Human
aagcuagaaggccacau

SEQ ID NO: 2578741 - RNA, 17 nt, Human
aagcuagaaccuggagg

SEQ ID NO: 2578742 - RNA, 20 nt, Human
aagcugcaaaucagccaugu

SEQ ID NO: 2578743 - RNA, 15 nt, Human
aaggcaaggcuguca

SEQ ID NO: 2578744 - RNA, 21 nt, Human
aaggcaagaggggguggaggg

SEQ ID NO: 2578745 - RNA, 19 nt, Human
aaggcagggagggccuggg

SEQ ID NO: 2578746 - RNA, 22 nt, Human
aaggcagggagggccugggccc

SEQ ID NO: 2578747 - RNA, 20 nt, Human
aaggcaggugccuccaggug

SEQ ID NO: 2578748 - RNA, 17 nt, Human
aaggcaggugccuccag

SEQ ID NO: 2578749 - RNA, 16 nt, Human
aaggcaggugccucca

SEQ ID NO: 2578750 - RNA, 14 nt, Human
aaggcaggugccuc

SEQ ID NO: 2578751 - RNA, 17 nt, Human
aaggacuugacuugcaa

SEQ ID NO: 2578752 - RNA, 15 nt, Human
aaggagaaggaagga

SEQ ID NO: 2578753 - RNA, 19 nt, Human
aaggagaaacagagacagg

SEQ ID NO: 2578754 - RNA, 18 nt, Human
aaggcaaauguguacaug

SEQ ID NO: 2578755 - RNA, 13 nt, Human
aaggcaaggcugu

SEQ ID NO: 2578756 - RNA, 18 nt, Human
aaggcaagcacuuguggg

SEQ ID NO: 2578757 - RNA, 19 nt, Human
aaggcaagaggggguggag

SEQ ID NO: 2578758 - RNA, 13 nt, Human
aaggcaagagggg

SEQ ID NO: 2578759 - RNA, 15 nt, Human
aagaccacguuucua

SEQ ID NO: 2578760 - RNA, 17 nt, Human
aagaccacguuucuaaa

SEQ ID NO: 2578761 - RNA, 18 nt, Human
aagacauuuauacucuuu

SEQ ID NO: 2578762 - RNA, 14 nt, Human
aagacauugucaau

SEQ ID NO: 2578763 - RNA, 19 nt, Human
aagacaugcacuaugagga

SEQ ID NO: 2578764 - RNA, 21 nt, Human
aagacaugauuuccuugaaug

SEQ ID NO: 2578765 - RNA, 18 nt, Human
aagaccaccacuucgaaa

SEQ ID NO: 2578766 - RNA, 19 nt, Human
aagaccaccaccucagagu

SEQ ID NO: 2578767 - RNA, 16 nt, Human
aagaccaccaccucag

SEQ ID NO: 2578768 - RNA, 17 nt, Human
aagaccacaaaaauuga

SEQ ID NO: 2578769 - RNA, 17 nt, Human
aagacauugucaauaaa

SEQ ID NO: 2578770 - RNA, 12 nt, Human
aagacuuuucuu

SEQ ID NO: 2578771 - RNA, 21 nt, Human
aagacuuuuccaacccucauc

SEQ ID NO: 2578772 - RNA, 19 nt, Human
aagacuuuucuuucagcca

SEQ ID NO: 2578773 - RNA, 13 nt, Human
aagagaaaaaaua

SEQ ID NO: 2578774 - RNA, 14 nt, Human
aagacaugauuucc

SEQ ID NO: 2578775 - RNA, 15 nt, Human
aagacaugauuuccu

SEQ ID NO: 2578776 - RNA, 16 nt, Human
aagacaugauuuccuu

SEQ ID NO: 2578777 - RNA, 20 nt, Human
aagacaugauuuccuugaau

SEQ ID NO: 2578778 - RNA, 15 nt, Human
aagacaugaauauga

SEQ ID NO: 2578779 - RNA, 13 nt, Human
aagacaugaacca

SEQ ID NO: 2578780 - RNA, 18 nt, Human
aagacaugaaugcacacu

SEQ ID NO: 2578781 - RNA, 21 nt, Human
aagacauccauaaagaagcaa

SEQ ID NO: 2578782 - RNA, 17 nt, Human
aagacauccauaaagaa

SEQ ID NO: 2578783 - RNA, 23 nt, Human
aagacauacuccuuccaucaaau

SEQ ID NO: 2578784 - RNA, 22 nt, Human
aagacauaacguuuuuccuuua

SEQ ID NO: 2578785 - RNA, 21 nt, Human
aagacauaacguuuuuccuuu

SEQ ID NO: 2578786 - RNA, 20 nt, Human
aagacauaacguuuuuccuu

SEQ ID NO: 2578787 - RNA, 19 nt, Human
aagacauaacguuuuuccu

SEQ ID NO: 2578788 - RNA, 18 nt, Human
aagacauaacguuuuucc

SEQ ID NO: 2578789 - RNA, 14 nt, Human
aagacauaacguuu

SEQ ID NO: 2578790 - RNA, 16 nt, Human
aagacagaugccccag

SEQ ID NO: 2578791 - RNA, 17 nt, Human
aagacagaugccccaga

SEQ ID NO: 2578792 - RNA, 20 nt, Human
aagacagaugccccagagcu

SEQ ID NO: 2578793 - RNA, 22 nt, Human
aagacagaugccccagagcugu

SEQ ID NO: 2578794 - RNA, 23 nt, Human
aagacaccagagcagaugcagag

SEQ ID NO: 2578795 - RNA, 13 nt, Human
aagacagaagccu

SEQ ID NO: 2578796 - RNA, 12 nt, Human
aagacagaagcc

SEQ ID NO: 2578797 - RNA, 23 nt, Human
aagacagauacuccuccaagguu

SEQ ID NO: 2578798 - RNA, 12 nt, Human
aagacagagucu

SEQ ID NO: 2578799 - RNA, 16 nt, Human
aagacagagcugggau

SEQ ID NO: 2578800 - RNA, 15 nt, Human
aagacagagcuggga

SEQ ID NO: 2578801 - RNA, 21 nt, Human
aagagaggaguucaaugaucu

SEQ ID NO: 2578802 - RNA, 20 nt, Human
aagagaggaguucaaugauc

SEQ ID NO: 2578803 - RNA, 19 nt, Human
aagagaggaguucaaugau

SEQ ID NO: 2578804 - RNA, 18 nt, Human
aagagaggaguucaauga

SEQ ID NO: 2578805 - RNA, 17 nt, Human
aagagaggaguucaaug

SEQ ID NO: 2578806 - RNA, 16 nt, Human
aagagaggaguucaau

SEQ ID NO: 2578807 - RNA, 15 nt, Human
aagagaggaguucaa

SEQ ID NO: 2578808 - RNA, 14 nt, Human
aagagaggaguuca

SEQ ID NO: 2578809 - RNA, 16 nt, Human
aagagagaaaauaaaa

SEQ ID NO: 2578810 - RNA, 17 nt, Human
aagagagaaaauaaaaa

SEQ ID NO: 2578811 - RNA, 11 nt, Human
aagagaggagu

SEQ ID NO: 2578812 - RNA, 19 nt, Human
aagagaggagaggagagag

SEQ ID NO: 2578813 - RNA, 18 nt, Human
aagagagaaaauaaaaag

SEQ ID NO: 2578814 - RNA, 21 nt, Human
aagagauauuuuaaaaugaga

SEQ ID NO: 2578815 - RNA, 20 nt, Human
aagagauauuuuaaaaugag

SEQ ID NO: 2578816 - RNA, 12 nt, Human
aagagauauuuu

SEQ ID NO: 2578817 - RNA, 11 nt, Human
aagagagguua

SEQ ID NO: 2578818 - RNA, 22 nt, Human
aagagaggaguucaaugaucua

SEQ ID NO: 2578819 - RNA, 20 nt, Human
aagagagucauaaaccuuaa

SEQ ID NO: 2578820 - RNA, 14 nt, Human
aagagagucauaaa

SEQ ID NO: 2578821 - RNA, 12 nt, Human
aagagagaaaaa

SEQ ID NO: 2578822 - RNA, 18 nt, Human
aagagacuggagcaucug

SEQ ID NO: 2578823 - RNA, 14 nt, Human
aagagacuggagca

SEQ ID NO: 2578824 - RNA, 16 nt, Human
aagagacucuggccuc

SEQ ID NO: 2578825 - RNA, 15 nt, Human
aagagacucuggccu

SEQ ID NO: 2578826 - RNA, 18 nt, Human
aagagaccuaccucaggu

SEQ ID NO: 2578827 - RNA, 17 nt, Human
aagagaccuaccucagg

SEQ ID NO: 2578828 - RNA, 16 nt, Human
aagagaccuaccucag

SEQ ID NO: 2578829 - RNA, 21 nt, Human
aagagaccuaccucagguugc

SEQ ID NO: 2578830 - RNA, 18 nt, Human
aagagaaagugauuucua

SEQ ID NO: 2578831 - RNA, 22 nt, Human
aagagacagucaccccaggacu

SEQ ID NO: 2578832 - RNA, 18 nt, Human
aagagagaaaacuuauuu

SEQ ID NO: 2578833 - RNA, 16 nt, Human
aagagagaaaaacaaa

SEQ ID NO: 2578834 - RNA, 12 nt, Human
aagagagaaaau

SEQ ID NO: 2578835 - RNA, 13 nt, Human
aagagagaaaaua

SEQ ID NO: 2578836 - RNA, 15 nt, Human
aagagagaaaauaaa

SEQ ID NO: 2578837 - RNA, 14 nt, Human
aagagagaaaauaa

SEQ ID NO: 2578838 - RNA, 14 nt, Human
aagagaaaagaaaa

SEQ ID NO: 2578839 - RNA, 15 nt, Human
aagagaaaagaaaaa

SEQ ID NO: 2578840 - RNA, 16 nt, Human
aagagaaaagaaaaaa

SEQ ID NO: 2578841 - RNA, 12 nt, Human
aagagaaaagaa

SEQ ID NO: 2578842 - RNA, 13 nt, Human
aagagaaaagaaa

SEQ ID NO: 2578843 - RNA, 11 nt, Human
aagagaaaaga

SEQ ID NO: 2578844 - RNA, 22 nt, Human
aagagaaaaaaaguuugccaga

SEQ ID NO: 2578845 - RNA, 17 nt, Human
aagacuuuuccaacccu

SEQ ID NO: 2578846 - RNA, 12 nt, Human
aagaccagacua

SEQ ID NO: 2578847 - RNA, 22 nt, Human
aagaaccaaaaguuuuccugag

SEQ ID NO: 2578848 - RNA, 11 nt, Human
aagaacaugug

SEQ ID NO: 2578849 - RNA, 17 nt, Human
aagaaccagucccccca

SEQ ID NO: 2578850 - RNA, 20 nt, Human
aagaaccaguccccccaccc

SEQ ID NO: 2578851 - RNA, 17 nt, Human
aagaacggggcucuucu

SEQ ID NO: 2578852 - RNA, 14 nt, Human
aagaaccuggaacu

SEQ ID NO: 2578853 - RNA, 23 nt, Human
aagaacggggcucuucucauuuc

SEQ ID NO: 2578854 - RNA, 22 nt, Human
aagaacggggcucuucucauuu

SEQ ID NO: 2578855 - RNA, 21 nt, Human
aagaacggggcucuucucauu

SEQ ID NO: 2578856 - RNA, 18 nt, Human
aagaacggggcucuucuc

SEQ ID NO: 2578857 - RNA, 21 nt, Human
aagaacuacaaacaaaauuuc

SEQ ID NO: 2578858 - RNA, 20 nt, Human
aagaacuacaaacaaaauuu

SEQ ID NO: 2578859 - RNA, 14 nt, Human
aagaacuagcauaa

SEQ ID NO: 2578860 - RNA, 20 nt, Human
aacgcaggcccccaggugcc

SEQ ID NO: 2578861 - RNA, 16 nt, Human
aacgcagcccugcuuu

SEQ ID NO: 2578862 - RNA, 12 nt, Human
aacgcagcccug

SEQ ID NO: 2578863 - RNA, 22 nt, Human
aagaacauggacuuguauauuu

SEQ ID NO: 2578864 - RNA, 21 nt, Human
aagaacauggacuuguauauu

SEQ ID NO: 2578865 - RNA, 19 nt, Human
aagaacauggacuuguaua

SEQ ID NO: 2578866 - RNA, 18 nt, Human
aagaacauggacuuguau

SEQ ID NO: 2578867 - RNA, 17 nt, Human
aacgccuccccugcccc

SEQ ID NO: 2578868 - RNA, 22 nt, Human
aacgccccagauaccagccccu

SEQ ID NO: 2578869 - RNA, 18 nt, Human
aacgccuccccugcccca

SEQ ID NO: 2578870 - RNA, 23 nt, Human
aacgcauggaguguguauuguuc

SEQ ID NO: 2578871 - RNA, 21 nt, Human
aacgcauggaguguguauugu

SEQ ID NO: 2578872 - RNA, 22 nt, Human
aacgcauggaguguguauuguu

SEQ ID NO: 2578873 - RNA, 18 nt, Human
aacgcauggaguguguau

SEQ ID NO: 2578874 - RNA, 13 nt, Human
aacgcauggagug

SEQ ID NO: 2578875 - RNA, 13 nt, Human
aagaacugaaauc

SEQ ID NO: 2578876 - RNA, 12 nt, Human
aagaacugaaau

SEQ ID NO: 2578877 - RNA, 11 nt, Human
aagaacugaaa

SEQ ID NO: 2578878 - RNA, 23 nt, Human
aagaacuauaugugaauccucuu

SEQ ID NO: 2578879 - RNA, 15 nt, Human
aagaacugaaaucau

SEQ ID NO: 2578880 - RNA, 22 nt, Human
aagaacugcaggcccuggccuc

SEQ ID NO: 2578881 - RNA, 18 nt, Human
aagaacugcaggcccugg

SEQ ID NO: 2578882 - RNA, 12 nt, Human
aagaacugcuuu

SEQ ID NO: 2578883 - RNA, 23 nt, Human
aagaacugcaggcccuggccucc

SEQ ID NO: 2578884 - RNA, 20 nt, Human
aagaacuguguuucaaguuc

SEQ ID NO: 2578885 - RNA, 15 nt, Human
aagaacuugcaugga

SEQ ID NO: 2578886 - RNA, 19 nt, Human
aagaagaccagacugugga

SEQ ID NO: 2578887 - RNA, 17 nt, Human
aagaagacauguuuuag

SEQ ID NO: 2578888 - RNA, 15 nt, Human
aagaagacauguuuu

SEQ ID NO: 2578889 - RNA, 14 nt, Human
aagaagacauguuu

SEQ ID NO: 2578890 - RNA, 21 nt, Human
aagaagaccagacuguggaga

SEQ ID NO: 2578891 - RNA, 12 nt, Human
aagacaacauua

SEQ ID NO: 2578892 - RNA, 20 nt, Human
aagaagacugcauuauauuu

SEQ ID NO: 2578893 - RNA, 21 nt, Human
aagacaaggaaaaaauaacaa

SEQ ID NO: 2578894 - RNA, 15 nt, Human
aagaagaacuugcau

SEQ ID NO: 2578895 - RNA, 13 nt, Human
aagaagaagggca

SEQ ID NO: 2578896 - RNA, 21 nt, Human
aagaagaaaauugcugugccu

SEQ ID NO: 2578897 - RNA, 16 nt, Human
aagaagaaacgucuau

SEQ ID NO: 2578898 - RNA, 15 nt, Human
aagaagacugcauua

SEQ ID NO: 2578899 - RNA, 12 nt, Human
aagaagacauga

SEQ ID NO: 2578900 - RNA, 13 nt, Human
aagaagacauguu

SEQ ID NO: 2578901 - RNA, 17 nt, Human
aagaagacauggagacu

SEQ ID NO: 2578902 - RNA, 16 nt, Human
aagaagacaugaacca

SEQ ID NO: 2578903 - RNA, 15 nt, Human
aagacaagacuucag

SEQ ID NO: 2578904 - RNA, 13 nt, Human
aagacaagcugca

SEQ ID NO: 2578905 - RNA, 13 nt, Human
aagacaauauaau

SEQ ID NO: 2578906 - RNA, 16 nt, Human
aagacaauccauguaa

SEQ ID NO: 2578907 - RNA, 15 nt, Human
aagacaacauuaaaa

SEQ ID NO: 2578908 - RNA, 21 nt, Human
aagacaacauuaaaacaauau

SEQ ID NO: 2578909 - RNA, 22 nt, Human
aagacaaugacuuacuguacau

SEQ ID NO: 2578910 - RNA, 19 nt, Human
aagacaaugugaaaagaaa

SEQ ID NO: 2578911 - RNA, 22 nt, Human
aagacaccagagcagaugcaga

SEQ ID NO: 2578912 - RNA, 21 nt, Human
aagacaccagagcagaugcag

SEQ ID NO: 2578913 - RNA, 20 nt, Human
aagacaccagagcagaugca

SEQ ID NO: 2578914 - RNA, 16 nt, Human
aagacaccagagcaga

SEQ ID NO: 2578915 - RNA, 15 nt, Human
aagacaccagagcag

SEQ ID NO: 2578916 - RNA, 14 nt, Human
aagacaccagagca

SEQ ID NO: 2578917 - RNA, 13 nt, Human
aagacaccagagc

SEQ ID NO: 2578918 - RNA, 14 nt, Human
aagacacugaaaua

SEQ ID NO: 2578919 - RNA, 21 nt, Human
aagacacugaaauauacacac

SEQ ID NO: 2578920 - RNA, 22 nt, Human
aagacacugaaauauacacaca

SEQ ID NO: 2578921 - RNA, 20 nt, Human
aagacaaugugaaaagaaaa

SEQ ID NO: 2578922 - RNA, 19 nt, Human
aagacaauucuuuauacaa

SEQ ID NO: 2578923 - RNA, 15 nt, Human
aagacaauucuuuau

SEQ ID NO: 2578924 - RNA, 12 nt, Human
aagacaauucuu

SEQ ID NO: 2578925 - RNA, 11 nt, Human
aagacaauucu

SEQ ID NO: 2578926 - RNA, 23 nt, Human
aagacaauggcuuacuccaggag

SEQ ID NO: 2578927 - RNA, 19 nt, Human
aagaguugagugauagagc

SEQ ID NO: 2578928 - RNA, 23 nt, Human
aagaguucuuaaggauugugaua

SEQ ID NO: 2578929 - RNA, 13 nt, Human
aagaguguagaag

SEQ ID NO: 2578930 - RNA, 12 nt, Human
aagaguguagaa

SEQ ID NO: 2578931 - RNA, 15 nt, Human
aagaguguacugggg

SEQ ID NO: 2578932 - RNA, 14 nt, Human
aagaguguacuggg

SEQ ID NO: 2578933 - RNA, 13 nt, Human
aagaguguacugg

SEQ ID NO: 2578934 - RNA, 18 nt, Human
aagaguguagaagcauuc

SEQ ID NO: 2578935 - RNA, 16 nt, Human
aagaguguagaagcau

SEQ ID NO: 2578936 - RNA, 15 nt, Human
aagaguguagaagca

SEQ ID NO: 2578937 - RNA, 14 nt, Human
aagaguguagaagc

SEQ ID NO: 2578938 - RNA, 19 nt, Human
aagaguguagaucagagca

SEQ ID NO: 2578939 - RNA, 22 nt, Human
aagaguguagaagcauuccuuc

SEQ ID NO: 2578940 - RNA, 23 nt, Human
aagaguguccuaggaguauccuc

SEQ ID NO: 2578941 - RNA, 20 nt, Human
aagaguaggaagacuuugga

SEQ ID NO: 2578942 - RNA, 16 nt, Human
aagaguaguaauagag

SEQ ID NO: 2578943 - RNA, 19 nt, Human
aagaguaguugauguugca

SEQ ID NO: 2578944 - RNA, 23 nt, Human
aagaguaguugauguugcauuuu

SEQ ID NO: 2578945 - RNA, 22 nt, Human
aagaguaguugauguugcauuu

SEQ ID NO: 2578946 - RNA, 15 nt, Human
aagaguccucugaau

SEQ ID NO: 2578947 - RNA, 16 nt, Human
aaauggccauuugcuu

SEQ ID NO: 2578948 - RNA, 13 nt, Human
aaauggccauuug

SEQ ID NO: 2578949 - RNA, 20 nt, Human
aaauguuauuuuuuaauuau

SEQ ID NO: 2578950 - RNA, 21 nt, Human
aaauguuauuuuuuaauuauu

SEQ ID NO: 2578951 - RNA, 22 nt, Human
aaauguugacaugggacauuug

SEQ ID NO: 2578952 - RNA, 17 nt, Human
aaauguucaucaaugaa

SEQ ID NO: 2578953 - RNA, 15 nt, Human
aaauguucagaaggu

SEQ ID NO: 2578954 - RNA, 21 nt, Human
aaauguucagaagguugcucu

SEQ ID NO: 2578955 - RNA, 13 nt, Human
aaauguucacuuu

SEQ ID NO: 2578956 - RNA, 16 nt, Human
aaauguucacuuuuga

SEQ ID NO: 2578957 - RNA, 13 nt, Human
aaauguucaucaa

SEQ ID NO: 2578958 - RNA, 14 nt, Human
aaauucuguuucuu

SEQ ID NO: 2578959 - RNA, 15 nt, Human
aaauucuguuucuug

SEQ ID NO: 2578960 - RNA, 21 nt, Human
aaauguuuuucugccagggag

SEQ ID NO: 2578961 - RNA, 23 nt, Human
aaauguuuuucugccagggagcu

SEQ ID NO: 2578962 - RNA, 13 nt, Human
aaauucuguuucu

SEQ ID NO: 2578963 - RNA, 17 nt, Human
aaauguuuuucuaugua

SEQ ID NO: 2578964 - RNA, 16 nt, Human
aaauguuuuucugcca

SEQ ID NO: 2578965 - RNA, 23 nt, Human
aaauguugacaugggacauuugc

SEQ ID NO: 2578966 - RNA, 18 nt, Human
aaauguuggauuuauaaa

SEQ ID NO: 2578967 - RNA, 19 nt, Human
aaauguugagaaucccaaa

SEQ ID NO: 2578968 - RNA, 23 nt, Human
aaauguugaauaaaaauauguac

SEQ ID NO: 2578969 - RNA, 21 nt, Human
aaauguuggauuuauaaaugc

SEQ ID NO: 2578970 - RNA, 20 nt, Human
aaauguuggauuuauaaaug

SEQ ID NO: 2578971 - RNA, 19 nt, Human
aaauguuggauuuauaaau

SEQ ID NO: 2578972 - RNA, 18 nt, Human
aaauguuuuagcaauuua

SEQ ID NO: 2578973 - RNA, 13 nt, Human
aaagccuguuccc

SEQ ID NO: 2578974 - RNA, 17 nt, Human
aaagccuguauucucaa

SEQ ID NO: 2578975 - RNA, 20 nt, Human
aaaggaugcccaaagaugca

SEQ ID NO: 2578976 - RNA, 19 nt, Human
aaaggaugugauauauaag

SEQ ID NO: 2578977 - RNA, 17 nt, Human
aaaggaugugauauaua

SEQ ID NO: 2578978 - RNA, 14 nt, Human
aaaggaugugauau

SEQ ID NO: 2578979 - RNA, 12 nt, Human
aaaggaugugau

SEQ ID NO: 2578980 - RNA, 14 nt, Human
aaaggaugcacaga

SEQ ID NO: 2578981 - RNA, 20 nt, Human
aaagccuguuccccucacug

SEQ ID NO: 2578982 - RNA, 19 nt, Human
aaaggauguaaacagugcc

SEQ ID NO: 2578983 - RNA, 20 nt, Human
aaaggauguaaacagugccu

SEQ ID NO: 2578984 - RNA, 21 nt, Human
aaaggauguaaacagugccug

SEQ ID NO: 2578985 - RNA, 23 nt, Human
aaaggaugugauauauaagugua

SEQ ID NO: 2578986 - RNA, 13 nt, Human
aaaggaugugauu

SEQ ID NO: 2578987 - RNA, 18 nt, Human
aaaggauucauguggaau

SEQ ID NO: 2578988 - RNA, 16 nt, Human
aaaggauguugguguu

SEQ ID NO: 2578989 - RNA, 23 nt, Human
aaaucucaaauuuggauugcuaa

SEQ ID NO: 2578990 - RNA, 18 nt, Human
aaaucucaauauuucaga

SEQ ID NO: 2578991 - RNA, 17 nt, Human
aaauauuuuuuuguaga

SEQ ID NO: 2578992 - RNA, 22 nt, Human
aaauauuuuuuauauauacagu

SEQ ID NO: 2578993 - RNA, 21 nt, Human
aaauauuuuuucuuuucuauu

SEQ ID NO: 2578994 - RNA, 22 nt, Human
aaauauuuuuggucauuguaau

SEQ ID NO: 2578995 - RNA, 23 nt, Human
aaauauuuuuauagauuugaccu

SEQ ID NO: 2578996 - RNA, 12 nt, Human
aaauauuuuugg

SEQ ID NO: 2578997 - RNA, 21 nt, Human
aaauauuuuuuuguagaugaa

SEQ ID NO: 2578998 - RNA, 20 nt, Human
aaauauuuuuuuguagauga

SEQ ID NO: 2578999 - RNA, 14 nt, Human
aaaucuuuuugcuu

SEQ ID NO: 2579000 - RNA, 13 nt, Human
aaaucuuuuugcu

SEQ ID NO: 2579001 - RNA, 23 nt, Human
aaaucuuucuuucuuagaaauuu

SEQ ID NO: 2579002 - RNA, 22 nt, Human
aaaucuuuuaaaaauucaaaug

SEQ ID NO: 2579003 - RNA, 22 nt, Human
aaaucuuucuuucuuagaaauu

SEQ ID NO: 2579004 - RNA, 22 nt, Human
aaaucucagaauuccuuuucua

SEQ ID NO: 2579005 - RNA, 15 nt, Human
aaaucucagcaauga

SEQ ID NO: 2579006 - RNA, 16 nt, Human
aaaucucaauucuucc

SEQ ID NO: 2579007 - RNA, 17 nt, Human
aaaucucaccccauccc

SEQ ID NO: 2579008 - RNA, 14 nt, Human
aaaucuuuucuauu

SEQ ID NO: 2579009 - RNA, 11 nt, Human
aaaucuuuuac

SEQ ID NO: 2579010 - RNA, 18 nt, Human
aaaucuuuuagucauuau

SEQ ID NO: 2579011 - RNA, 20 nt, Human
aaaugcugcgcccuucccca

SEQ ID NO: 2579012 - RNA, 19 nt, Human
aaaugcuguaacuuucuga

SEQ ID NO: 2579013 - RNA, 21 nt, Human
aaaugcugcgcccuuccccag

SEQ ID NO: 2579014 - RNA, 22 nt, Human
aaaugcugguuuuucaguuuuc

SEQ ID NO: 2579015 - RNA, 19 nt, Human
aaaugcuuugugugauuga

SEQ ID NO: 2579016 - RNA, 22 nt, Human
aaauggagguccuucugcugga

SEQ ID NO: 2579017 - RNA, 13 nt, Human
aaauggauacugg

SEQ ID NO: 2579018 - RNA, 21 nt, Human
aaaugcuuuaaaaacuauuua

SEQ ID NO: 2579019 - RNA, 19 nt, Human
aaaugcuuuaaaaacuauu

SEQ ID NO: 2579020 - RNA, 18 nt, Human
aaaugcuuuaugcaaacc

SEQ ID NO: 2579021 - RNA, 22 nt, Human
aaaugcuuuaaaaacuauuuaa

SEQ ID NO: 2579022 - RNA, 19 nt, Human
aaauagaguauaugcacuu

SEQ ID NO: 2579023 - RNA, 17 nt, Human
aaauagaguauaugcac

SEQ ID NO: 2579024 - RNA, 15 nt, Human
aaauagcauguauug

SEQ ID NO: 2579025 - RNA, 14 nt, Human
aaauagcauguauu

SEQ ID NO: 2579026 - RNA, 18 nt, Human
aaauagcauguauugugu

SEQ ID NO: 2579027 - RNA, 16 nt, Human
aaauagcauguauugu

SEQ ID NO: 2579028 - RNA, 21 nt, Human
aaauagcauguauugugucuu

SEQ ID NO: 2579029 - RNA, 12 nt, Human
aaauauuuaaga

SEQ ID NO: 2579030 - RNA, 21 nt, Human
aaauagauaagaguagaaacu

SEQ ID NO: 2579031 - RNA, 16 nt, Human
aaauagcaauccuaaa

SEQ ID NO: 2579032 - RNA, 19 nt, Human
aaauagaguuugcuauuag

SEQ ID NO: 2579033 - RNA, 10 nt, Human
aaauauuuau

SEQ ID NO: 2579034 - RNA, 19 nt, Human
aaauauuuauaaaacuucu

SEQ ID NO: 2579035 - RNA, 12 nt, Human
aaauauuuaucu

SEQ ID NO: 2579036 - RNA, 15 nt, Human
aaauauuuacauaug

SEQ ID NO: 2579037 - RNA, 17 nt, Human
aaauauuuacauaugaa

SEQ ID NO: 2579038 - RNA, 19 nt, Human
aaauauuuacauaugaaau

SEQ ID NO: 2579039 - RNA, 16 nt, Human
aaauauuuagcaaaua

SEQ ID NO: 2579040 - RNA, 21 nt, Human
aaauauuuacauaugaaauuu

SEQ ID NO: 2579041 - RNA, 21 nt, Human
aaauauuuauuuuaauaaugu

SEQ ID NO: 2579042 - RNA, 15 nt, Human
aaauauuuauuuauu

SEQ ID NO: 2579043 - RNA, 15 nt, Human
aaauauuuauguaaa

SEQ ID NO: 2579044 - RNA, 13 nt, Human
aaauauuucaaga

SEQ ID NO: 2579045 - RNA, 12 nt, Human
aaauauuucaag

SEQ ID NO: 2579046 - RNA, 14 nt, Human
aaauauuucaagac

SEQ ID NO: 2579047 - RNA, 12 nt, Human
aaauauuuccuu

SEQ ID NO: 2579048 - RNA, 22 nt, Human
aaauauuuugaaucaauaauau

SEQ ID NO: 2579049 - RNA, 22 nt, Human
aaauauuuguacauaguuauuu

SEQ ID NO: 2579050 - RNA, 14 nt, Human
aaauauuuguacau

SEQ ID NO: 2579051 - RNA, 15 nt, Human
aaauauuuguacaua

SEQ ID NO: 2579052 - RNA, 12 nt, Human
aaauauuuggag

SEQ ID NO: 2579053 - RNA, 14 nt, Human
aaauauuuccuuaa

SEQ ID NO: 2579054 - RNA, 15 nt, Human
aaauauuuuuauaga

SEQ ID NO: 2579055 - RNA, 14 nt, Human
aaauauuuuuagua

SEQ ID NO: 2579056 - RNA, 22 nt, Human
aaauauuuugucuaaaaugccu

SEQ ID NO: 2579057 - RNA, 17 nt, Human
aaauauuuugucuaaaa

SEQ ID NO: 2579058 - RNA, 16 nt, Human
aaauauuuugucuaaa

SEQ ID NO: 2579059 - RNA, 15 nt, Human
aaauauuuugucuaa

SEQ ID NO: 2579060 - RNA, 14 nt, Human
aaauauuuugucua

SEQ ID NO: 2579061 - RNA, 12 nt, Human
aaauauuuuguc

SEQ ID NO: 2579062 - RNA, 16 nt, Human
aaauauuuugcuaguu

SEQ ID NO: 2579063 - RNA, 12 nt, Human
aaccuuuuuaaa

SEQ ID NO: 2579064 - RNA, 23 nt, Human
aaccuuuugagugccuuacacaa

SEQ ID NO: 2579065 - RNA, 16 nt, Human
aaccuuuugagugccu

SEQ ID NO: 2579066 - RNA, 18 nt, Human
aaccuuuguuugcaucug

SEQ ID NO: 2579067 - RNA, 15 nt, Human
aaccuaaaaaagaua

SEQ ID NO: 2579068 - RNA, 14 nt, Human
aaccuaaaaaagau

SEQ ID NO: 2579069 - RNA, 13 nt, Human
aaccuaaaaaaga

SEQ ID NO: 2579070 - RNA, 22 nt, Human
aaccguuauuauaauuguauca

SEQ ID NO: 2579071 - RNA, 17 nt, Human
aaccguuuugaagcuac

SEQ ID NO: 2579072 - RNA, 18 nt, Human
aaccguuuugaagcuacu

SEQ ID NO: 2579073 - RNA, 21 nt, Human
aaccuaaaauaauugguucuu

SEQ ID NO: 2579074 - RNA, 16 nt, Human
aaccuaaaaaagauau

SEQ ID NO: 2579075 - RNA, 20 nt, Human
aaccuaaaauaauugguucu

SEQ ID NO: 2579076 - RNA, 15 nt, Human
aaccguuauuauaau

SEQ ID NO: 2579077 - RNA, 16 nt, Human
aaccgucuguuaugcu

SEQ ID NO: 2579078 - RNA, 18 nt, Human
aaccgucuguuaugcugu

SEQ ID NO: 2579079 - RNA, 22 nt, Human
aaccgucuguuaugcugugaca

SEQ ID NO: 2579080 - RNA, 21 nt, Human
aacccuccuaucaccuccccu

SEQ ID NO: 2579081 - RNA, 21 nt, Human
aacccucucaggugaccaaaa

SEQ ID NO: 2579082 - RNA, 15 nt, Human
aaccgucaauaggca

SEQ ID NO: 2579083 - RNA, 23 nt, Human
aaccggggagcccccgccccgcc

SEQ ID NO: 2579084 - RNA, 16 nt, Human
aacccucccucagccc

SEQ ID NO: 2579085 - RNA, 17 nt, Human
aacccucccucagcccc

SEQ ID NO: 2579086 - RNA, 18 nt, Human
aacccucccucagccccu

SEQ ID NO: 2579087 - RNA, 19 nt, Human
aacccucccucagccccuc

SEQ ID NO: 2579088 - RNA, 20 nt, Human
aacccucccucagccccucu

SEQ ID NO: 2579089 - RNA, 21 nt, Human
aacccucccucagccccucuu

SEQ ID NO: 2579090 - RNA, 23 nt, Human
aacccucccucagccccucuugc

SEQ ID NO: 2579091 - RNA, 19 nt, Human
aacccuccuaucaccuccc

SEQ ID NO: 2579092 - RNA, 12 nt, Human
aacccucagagc

SEQ ID NO: 2579093 - RNA, 19 nt, Human
aacccucagagccaccccu

SEQ ID NO: 2579094 - RNA, 13 nt, Human
aacccucccucag

SEQ ID NO: 2579095 - RNA, 14 nt, Human
aacccucccucagc

SEQ ID NO: 2579096 - RNA, 15 nt, Human
aacccucccucagcc

SEQ ID NO: 2579097 - RNA, 23 nt, Human
aacauggccuuugcuugaaagaa

SEQ ID NO: 2579098 - RNA, 20 nt, Human
aacauggagaaacccugucu

SEQ ID NO: 2579099 - RNA, 23 nt, Human
aacaugggguuggcugggcccag

SEQ ID NO: 2579100 - RNA, 20 nt, Human
aacaugguuacaaucauugc

SEQ ID NO: 2579101 - RNA, 18 nt, Human
aacauggugucuggauuc

SEQ ID NO: 2579102 - RNA, 22 nt, Human
aacaugguaaacgcugucccua

SEQ ID NO: 2579103 - RNA, 23 nt, Human
aaauucuucuccacuuucuagcc

SEQ ID NO: 2579104 - RNA, 15 nt, Human
aaauucuugcaaagu

SEQ ID NO: 2579105 - RNA, 23 nt, Human
aaauucuucugaacucaaacuga

SEQ ID NO: 2579106 - RNA, 20 nt, Human
aacagccgcuccugucugcc

SEQ ID NO: 2579107 - RNA, 21 nt, Human
aacagccgcuccugucugcca

SEQ ID NO: 2579108 - RNA, 22 nt, Human
aacagccgucagccaaauguaa

SEQ ID NO: 2579109 - RNA, 13 nt, Human
aacagccucacag

SEQ ID NO: 2579110 - RNA, 14 nt, Human
aacagccucacaga

SEQ ID NO: 2579111 - RNA, 14 nt, Human
aacaggcaagugaa

SEQ ID NO: 2579112 - RNA, 11 nt, Human
aacaggcccag

SEQ ID NO: 2579113 - RNA, 11 nt, Human
aacaggcagau

SEQ ID NO: 2579114 - RNA, 16 nt, Human
aacagcauugcuuucu

SEQ ID NO: 2579115 - RNA, 20 nt, Human
aacagcauugcuuucugaaa

SEQ ID NO: 2579116 - RNA, 15 nt, Human
aacagccaacaggug

SEQ ID NO: 2579117 - RNA, 17 nt, Human
aacagcauugcuuucug

SEQ ID NO: 2579118 - RNA, 16 nt, Human
aacagccaacaggugg

SEQ ID NO: 2579119 - RNA, 18 nt, Human
aacagccacuacauuacu

SEQ ID NO: 2579120 - RNA, 23 nt, Human
aacaggcccagcauugcugguuc

SEQ ID NO: 2579121 - RNA, 13 nt, Human
aacaggcccagca

SEQ ID NO: 2579122 - RNA, 12 nt, Human
aacaggcccagc

SEQ ID NO: 2579123 - RNA, 18 nt, Human
aacaggcuacucuccucg

SEQ ID NO: 2579124 - RNA, 20 nt, Human
aacaggcucaauauuccuga

SEQ ID NO: 2579125 - RNA, 22 nt, Human
aacaucuguccugugaaagacu

SEQ ID NO: 2579126 - RNA, 15 nt, Human
aacaucuuuucuugc

SEQ ID NO: 2579127 - RNA, 11 nt, Human
aacaucuuuuc

SEQ ID NO: 2579128 - RNA, 21 nt, Human
aacaggcucaauauuccugaa

SEQ ID NO: 2579129 - RNA, 22 nt, Human
aacauggccuuugcuugaaaga

SEQ ID NO: 2579130 - RNA, 18 nt, Human
aacauggacuuguauauu

SEQ ID NO: 2579131 - RNA, 16 nt, Human
aacauggacuuguaua

SEQ ID NO: 2579132 - RNA, 15 nt, Human
aacauggacuuguau

SEQ ID NO: 2579133 - RNA, 21 nt, Human
aacaugaggggacauuuuggu

SEQ ID NO: 2579134 - RNA, 20 nt, Human
aacauggacuuguauauuug

SEQ ID NO: 2579135 - RNA, 19 nt, Human
aacauggacuuguauauuu

SEQ ID NO: 2579136 - RNA, 23 nt, Human
aacauggacuuguauauuuguac

SEQ ID NO: 2579137 - RNA, 19 nt, Human
aacauggagaaacccuguc

SEQ ID NO: 2579138 - RNA, 20 nt, Human
aacaugacccuaaaucuuga

SEQ ID NO: 2579139 - RNA, 18 nt, Human
aacaugaggggacauuuu

SEQ ID NO: 2579140 - RNA, 21 nt, Human
aacaugaagucguugugaggg

SEQ ID NO: 2579141 - RNA, 17 nt, Human
aaagaucaaaauaaaaa

SEQ ID NO: 2579142 - RNA, 16 nt, Human
aaagaucaaaauaaaa

SEQ ID NO: 2579143 - RNA, 15 nt, Human
aaagaucaaaauaaa

SEQ ID NO: 2579144 - RNA, 14 nt, Human
aaagaucaaaauaa

SEQ ID NO: 2579145 - RNA, 22 nt, Human
aaagaucacuuguuguuuuacu

SEQ ID NO: 2579146 - RNA, 20 nt, Human
aaagaucaaaauaaaaagug

SEQ ID NO: 2579147 - RNA, 15 nt, Human
aaagaucauguaaaa

SEQ ID NO: 2579148 - RNA, 18 nt, Human
aaagaucuguccucagcc

SEQ ID NO: 2579149 - RNA, 19 nt, Human
aaagaucuguccucagccu

SEQ ID NO: 2579150 - RNA, 20 nt, Human
aaagaucuguccucagccuu

SEQ ID NO: 2579151 - RNA, 16 nt, Human
aaagaucuguuuugaa

SEQ ID NO: 2579152 - RNA, 21 nt, Human
aaagaucuguccucagccuug

SEQ ID NO: 2579153 - RNA, 13 nt, Human
aaagaucuguuuu

SEQ ID NO: 2579154 - RNA, 10 nt, Human
aaagaaaaaa

SEQ ID NO: 2579155 - RNA, 17 nt, Human
aaacuuuuuuuugagaa

SEQ ID NO: 2579156 - RNA, 16 nt, Human
aaagaaaaaaaaagaa

SEQ ID NO: 2579157 - RNA, 13 nt, Human
aaagaaaaaaaau

SEQ ID NO: 2579158 - RNA, 18 nt, Human
aaagaaaaaaaagaaagc

SEQ ID NO: 2579159 - RNA, 18 nt, Human
aaagaaaaaagagaaaag

SEQ ID NO: 2579160 - RNA, 20 nt, Human
aaagauauuuugcuuuguga

SEQ ID NO: 2579161 - RNA, 16 nt, Human
aaagauauuuuuaucu

SEQ ID NO: 2579162 - RNA, 18 nt, Human
aaagaaaaaauaauugau

SEQ ID NO: 2579163 - RNA, 15 nt, Human
aaagcauuguaaaug

SEQ ID NO: 2579164 - RNA, 17 nt, Human
aaagcauuguaaaugug

SEQ ID NO: 2579165 - RNA, 14 nt, Human
aaagcauguacagu

SEQ ID NO: 2579166 - RNA, 13 nt, Human
aaagcauguacag

SEQ ID NO: 2579167 - RNA, 12 nt, Human
aaagcauguaca

SEQ ID NO: 2579168 - RNA, 11 nt, Human
aaagcauguac

SEQ ID NO: 2579169 - RNA, 21 nt, Human
aaagcauguacaguguucugu

SEQ ID NO: 2579170 - RNA, 22 nt, Human
aaagcauucaauuuauucaaga

SEQ ID NO: 2579171 - RNA, 16 nt, Human
aaagcauguacagugu

SEQ ID NO: 2579172 - RNA, 15 nt, Human
aaagcauguacagug

SEQ ID NO: 2579173 - RNA, 13 nt, Human
aaagcaugucuca

SEQ ID NO: 2579174 - RNA, 18 nt, Human
aaagccugggugacauuu

SEQ ID NO: 2579175 - RNA, 17 nt, Human
aaagccugggugacauu

SEQ ID NO: 2579176 - RNA, 24 nt, Human
aaagccucugugucacuggcugcc

SEQ ID NO: 2579177 - RNA, 18 nt, Human
aaagccugcaauuucaua

SEQ ID NO: 2579178 - RNA, 21 nt, Human
aaagccucugugucacuggcu

SEQ ID NO: 2579179 - RNA, 13 nt, Human
aaagccucugugu

SEQ ID NO: 2579180 - RNA, 16 nt, Human
aaagccucugcugcca

SEQ ID NO: 2579181 - RNA, 13 nt, Human
aaagccugcaauu

SEQ ID NO: 2579182 - RNA, 17 nt, Human
aaagccagugacuccag

SEQ ID NO: 2579183 - RNA, 19 nt, Human
aaagccagugacuccagga

SEQ ID NO: 2579184 - RNA, 18 nt, Human
aaagcauuccaacaaagg

SEQ ID NO: 2579185 - RNA, 16 nt, Human
aaacccagcucugguc

SEQ ID NO: 2579186 - RNA, 12 nt, Human
aaacccagcucu

SEQ ID NO: 2579187 - RNA, 23 nt, Human
aaacccaccuuguuggagccugc

SEQ ID NO: 2579188 - RNA, 15 nt, Human
aaaccgccaaggcug

SEQ ID NO: 2579189 - RNA, 16 nt, Human
aaaccgccaaggcugg

SEQ ID NO: 2579190 - RNA, 19 nt, Human
aaacucuguugcaagugca

SEQ ID NO: 2579191 - RNA, 22 nt, Human
aaacucugggaaauaagagaga

SEQ ID NO: 2579192 - RNA, 23 nt, Human
aaaccgccagcgaacuugacaau

SEQ ID NO: 2579193 - RNA, 12 nt, Human
aaacccagagag

SEQ ID NO: 2579194 - RNA, 15 nt, Human
aaacccagacugaac

SEQ ID NO: 2579195 - RNA, 11 nt, Human
aaacccagaga

SEQ ID NO: 2579196 - RNA, 23 nt, Human
aaacugauuuuuuuuuccuucag

SEQ ID NO: 2579197 - RNA, 22 nt, Human
aaacugauuuuuuuuuccuuca

SEQ ID NO: 2579198 - RNA, 12 nt, Human
aaacucuuaaaa

SEQ ID NO: 2579199 - RNA, 23 nt, Human
aaacucuuaaaacccaagugccu

SEQ ID NO: 2579200 - RNA, 9 nt, Human
aaagaaaaa

SEQ ID NO: 2579201 - RNA, 11 nt, Human
aaagaaaaaaa

SEQ ID NO: 2579202 - RNA, 15 nt, Human
aaacugcacugucaa

SEQ ID NO: 2579203 - RNA, 15 nt, Human
aaacucuuaucucag

SEQ ID NO: 2579204 - RNA, 13 nt, Human
aaacucuuaucuc

SEQ ID NO: 2579205 - RNA, 20 nt, Human
aaacucuguugcaagugcaa

SEQ ID NO: 2579206 - RNA, 16 nt, Human
aaacucuuaucucagu

SEQ ID NO: 2579207 - RNA, 12 nt, Human
aaaccagggagc

SEQ ID NO: 2579208 - RNA, 15 nt, Human
aaaccauaaacuuca

SEQ ID NO: 2579209 - RNA, 13 nt, Human
aaaccauaaacuu

SEQ ID NO: 2579210 - RNA, 15 nt, Human
aaacccaauccaaau

SEQ ID NO: 2579211 - RNA, 19 nt, Human
aaaccaguguuagggaagg

SEQ ID NO: 2579212 - RNA, 19 nt, Human
aaaccaguguagccuugcc

SEQ ID NO: 2579213 - RNA, 18 nt, Human
aaaaucucaaauuucuaa

SEQ ID NO: 2579214 - RNA, 15 nt, Human
aaaaucucaaauuuc

SEQ ID NO: 2579215 - RNA, 16 nt, Human
aaaaucucaaauuucu

SEQ ID NO: 2579216 - RNA, 21 nt, Human
aaaaucauuucugcaucagcu

SEQ ID NO: 2579217 - RNA, 21 nt, Human
aaaaucuaccuucuguaguuu

SEQ ID NO: 2579218 - RNA, 20 nt, Human
aaaaucuaccuucuguaguu

SEQ ID NO: 2579219 - RNA, 18 nt, Human
aaaaucuaccuucuguag

SEQ ID NO: 2579220 - RNA, 17 nt, Human
aaaaucuaccuucugua

SEQ ID NO: 2579221 - RNA, 20 nt, Human
aaaaucuauuuuguaacuuu

SEQ ID NO: 2579222 - RNA, 11 nt, Human
aaaaucauuuc

SEQ ID NO: 2579223 - RNA, 12 nt, Human
aaaaucauuucu

SEQ ID NO: 2579224 - RNA, 10 nt, Human
aaaaucauuu

SEQ ID NO: 2579225 - RNA, 22 nt, Human
aaaaucagccaauuauguuaaa

SEQ ID NO: 2579226 - RNA, 24 nt, Human
aaaaucagccaauuauguuaaacu

SEQ ID NO: 2579227 - RNA, 22 nt, Human
aaaaucauugauugucagcuac

SEQ ID NO: 2579228 - RNA, 21 nt, Human
aaaaucagccaauuauguuaa

SEQ ID NO: 2579229 - RNA, 16 nt, Human
aaaauaaaacuuuuua

SEQ ID NO: 2579230 - RNA, 13 nt, Human
aaaaucagccugc

SEQ ID NO: 2579231 - RNA, 17 nt, Human
aaaaucagccugcucca

SEQ ID NO: 2579232 - RNA, 21 nt, Human
aaaaucagccugcuccagcug

SEQ ID NO: 2579233 - RNA, 16 nt, Human
aaaauaaaaaguuaaa

SEQ ID NO: 2579234 - RNA, 19 nt, Human
aaaauaaaaaguuaaaaag

SEQ ID NO: 2579235 - RNA, 13 nt, Human
aaaauaaaaaugg

SEQ ID NO: 2579236 - RNA, 15 nt, Human
aaaauaaaaaguuaa

SEQ ID NO: 2579237 - RNA, 14 nt, Human
aaaauaaaaaguua

SEQ ID NO: 2579238 - RNA, 22 nt, Human
aaaauaaaacauuuuaaaugga

SEQ ID NO: 2579239 - RNA, 16 nt, Human
aaaauaaaacauuuua

SEQ ID NO: 2579240 - RNA, 15 nt, Human
aaaauaaaacauuuu

SEQ ID NO: 2579241 - RNA, 14 nt, Human
aaaauaaaacauuu

SEQ ID NO: 2579242 - RNA, 13 nt, Human
aaaauaaaacauu

SEQ ID NO: 2579243 - RNA, 18 nt, Human
aaaauaaaaauaaauuca

SEQ ID NO: 2579244 - RNA, 14 nt, Human
aaaauaaaacuuuu

SEQ ID NO: 2579245 - RNA, 23 nt, Human
aaaaguuggguuuucuccauuca

SEQ ID NO: 2579246 - RNA, 17 nt, Human
aaaagugacacagcagc

SEQ ID NO: 2579247 - RNA, 15 nt, Human
aaaagugacacagca

SEQ ID NO: 2579248 - RNA, 14 nt, Human
aaaagugacacagc

SEQ ID NO: 2579249 - RNA, 13 nt, Human
aaaagugacacag

SEQ ID NO: 2579250 - RNA, 23 nt, Human
aaaagucuucacucucugaagau

SEQ ID NO: 2579251 - RNA, 19 nt, Human
aaaagucuucacucucuga

SEQ ID NO: 2579252 - RNA, 15 nt, Human
aaaagucaaaaggug

SEQ ID NO: 2579253 - RNA, 19 nt, Human
aaaagucagacugcuggga

SEQ ID NO: 2579254 - RNA, 23 nt, Human
aaaagaucuguuuugaaggcaaa

SEQ ID NO: 2579255 - RNA, 14 nt, Human
aaaagauauaagug

SEQ ID NO: 2579256 - RNA, 13 nt, Human
aaaagauauaagu

SEQ ID NO: 2579257 - RNA, 12 nt, Human
aaaagauauaag

SEQ ID NO: 2579258 - RNA, 20 nt, Human
aaaagauacgacuuuauuuu

SEQ ID NO: 2579259 - RNA, 17 nt, Human
aaaagauaaauauuaua

SEQ ID NO: 2579260 - RNA, 23 nt, Human
aaaagauauaagugcuguauaaa

SEQ ID NO: 2579261 - RNA, 19 nt, Human
aaaagauauaagugcugua

SEQ ID NO: 2579262 - RNA, 18 nt, Human
aaaagauauaagugcugu

SEQ ID NO: 2579263 - RNA, 15 nt, Human
aaaagauauaagugc

SEQ ID NO: 2579264 - RNA, 22 nt, Human
aaaagauauauuaaaaauauaa

SEQ ID NO: 2579265 - RNA, 21 nt, Human
aaaagauauauuaaaaauaua

SEQ ID NO: 2579266 - RNA, 16 nt, Human
aaaagauauauuaaaa

SEQ ID NO: 2579267 - RNA, 11 nt, Human
aaaagauauau

SEQ ID NO: 2579268 - RNA, 16 nt, Human
aaaagauccuuuuuaa

SEQ ID NO: 2579269 - RNA, 13 nt, Human
aaaagaucgcagu

SEQ ID NO: 2579270 - RNA, 16 nt, Human
aaaagagauauuuuaa

SEQ ID NO: 2579271 - RNA, 14 nt, Human
aaaagagauauuuu

SEQ ID NO: 2579272 - RNA, 21 nt, Human
aaaagagagaaaacuuauuug

SEQ ID NO: 2579273 - RNA, 19 nt, Human
aaaagagagaaaacuuauu

SEQ ID NO: 2579274 - RNA, 16 nt, Human
aaaagagaugaugaaa

SEQ ID NO: 2579275 - RNA, 19 nt, Human
aaaagagaugaugaaaaua

SEQ ID NO: 2579276 - RNA, 13 nt, Human
aaaagagaaaaga

SEQ ID NO: 2579277 - RNA, 14 nt, Human
aaaagagaaaagaa

SEQ ID NO: 2579278 - RNA, 16 nt, Human
aaaagagaaaagaaaa

SEQ ID NO: 2579279 - RNA, 16 nt, Human
aaaagacucaguguuc

SEQ ID NO: 2579280 - RNA, 20 nt, Human
aaaagauaaagaugaucuac

SEQ ID NO: 2579281 - RNA, 18 nt, Human
aaaagauaaagaugaucu

SEQ ID NO: 2579282 - RNA, 17 nt, Human
aaaagauaaagaugauc

SEQ ID NO: 2579283 - RNA, 14 nt, Human
aaaagauaaagaug

SEQ ID NO: 2579284 - RNA, 14 nt, Human
aaaagauaaauauu

SEQ ID NO: 2579285 - RNA, 13 nt, Human
aaaagauaaagau

SEQ ID NO: 2579286 - RNA, 17 nt, Human
aaaagagguuuuucuua

SEQ ID NO: 2579287 - RNA, 21 nt, Human
aaaagagguuuuucuuaaaua

SEQ ID NO: 2579288 - RNA, 22 nt, Human
aaaagagguuuuucuuaaauaa

SEQ ID NO: 2579289 - RNA, 16 nt, Human
aaaagagauuucaaga

SEQ ID NO: 2579290 - RNA, 19 nt, Human
aaaagagauggccugagaa

SEQ ID NO: 2579291 - RNA, 21 nt, Human
aaaagagauauuuuaaaauga

SEQ ID NO: 2579292 - RNA, 22 nt, Human
aaaagaggaaagaaugaaagag

SEQ ID NO: 2579293 - RNA, 14 nt, Human
aaaagagauuucaa

SEQ ID NO: 2579294 - RNA, 12 nt, Human
aaaagagggggg

SEQ ID NO: 2579295 - RNA, 15 nt, Human
aaaagaggggcuggg

SEQ ID NO: 2579296 - RNA, 17 nt, Human
aaaagaaagaaaaucag

SEQ ID NO: 2579297 - RNA, 15 nt, Human
aaaagaaaauaaaaa

SEQ ID NO: 2579298 - RNA, 16 nt, Human
aaaagaaaagucaagg

SEQ ID NO: 2579299 - RNA, 14 nt, Human
aaaagaaaauaaaa

SEQ ID NO: 2579300 - RNA, 22 nt, Human
aaaagaaaaaaaaagaaaaaag

SEQ ID NO: 2579301 - RNA, 12 nt, Human
aaaagaauauuu

SEQ ID NO: 2579302 - RNA, 11 nt, Human
aaaagaaggaa

SEQ ID NO: 2579303 - RNA, 16 nt, Human
aaaagaacaguaaaca

SEQ ID NO: 2579304 - RNA, 17 nt, Human
aaaagaacacuagaguc

SEQ ID NO: 2579305 - RNA, 10 nt, Human
aaaagaaagc

SEQ ID NO: 2579306 - RNA, 17 nt, Human
aaaagaacaauauugac

SEQ ID NO: 2579307 - RNA, 20 nt, Human
aaaagacaaggaaaaaauaa

SEQ ID NO: 2579308 - RNA, 13 nt, Human
aaaagaauauuuu

SEQ ID NO: 2579309 - RNA, 13 nt, Human
aaaagaaggaaaa

SEQ ID NO: 2579310 - RNA, 16 nt, Human
aaaagaauacagaaag

SEQ ID NO: 2579311 - RNA, 11 nt, Human
aaaagaaugau

SEQ ID NO: 2579312 - RNA, 19 nt, Human
aaaagacaauucuuuauac

SEQ ID NO: 2579313 - RNA, 14 nt, Human
aaaagacaauucuu

SEQ ID NO: 2579314 - RNA, 13 nt, Human
aaaagacaauucu

SEQ ID NO: 2579315 - RNA, 20 nt, Human
aaaagaaugggcaguuacau

SEQ ID NO: 2579316 - RNA, 16 nt, Human
aaaagaaugggcaguu

SEQ ID NO: 2579317 - RNA, 13 nt, Human
aaaagacuccaaa

SEQ ID NO: 2579318 - RNA, 13 nt, Human
aaaagaccagacu

SEQ ID NO: 2579319 - RNA, 13 nt, Human
aaaagacagggcu

SEQ ID NO: 2579320 - RNA, 15 nt, Human
aaaacagacucaggu

SEQ ID NO: 2579321 - RNA, 16 nt, Human
aaaacagcauugcuuu

SEQ ID NO: 2579322 - RNA, 20 nt, Human
aaaacagcauugcuuucuga

SEQ ID NO: 2579323 - RNA, 18 nt, Human
aaaacagccucacagaag

SEQ ID NO: 2579324 - RNA, 13 nt, Human
aaaacuuuucuca

SEQ ID NO: 2579325 - RNA, 11 nt, Human
aaaacuuugga

SEQ ID NO: 2579326 - RNA, 20 nt, Human
aaaacuuuccucgccugaca

SEQ ID NO: 2579327 - RNA, 16 nt, Human
aaaagaaaaaaaaaga

SEQ ID NO: 2579328 - RNA, 17 nt, Human
aaaagaaaaaaaaagaa

SEQ ID NO: 2579329 - RNA, 18 nt, Human
aaaagaaaaaaaaagaaa

SEQ ID NO: 2579330 - RNA, 19 nt, Human
aaaagaaaaaaaaagaaaa

SEQ ID NO: 2579331 - RNA, 11 nt, Human
aaaagaaaaag

SEQ ID NO: 2579332 - RNA, 9 nt, Human
aaaagaaaa

SEQ ID NO: 2579333 - RNA, 11 nt, Human
aaaagaaaaaa

SEQ ID NO: 2579334 - RNA, 12 nt, Human
aaaagaaaaaaa

SEQ ID NO: 2579335 - RNA, 15 nt, Human
aaaacuuuucucaga

SEQ ID NO: 2579336 - RNA, 17 nt, Human
aaaacuuuuuauauuuu

SEQ ID NO: 2579337 - RNA, 20 nt, Human
aaaacuuuuuauauuuuaua

SEQ ID NO: 2579338 - RNA, 19 nt, Human
aaaacacuguucucugccc

SEQ ID NO: 2579339 - RNA, 13 nt, Human
aaaacacugugca

SEQ ID NO: 2579340 - RNA, 21 nt, Human
aaaacacuaaaaauaaaaaug

SEQ ID NO: 2579341 - RNA, 22 nt, Human
aaaacaccuagcuuuauucuuc

SEQ ID NO: 2579342 - RNA, 22 nt, Human
aaaacagaacaucauuagaaca

SEQ ID NO: 2579343 - RNA, 21 nt, Human
aaaacagaacaucauuagaac

SEQ ID NO: 2579344 - RNA, 18 nt, Human
aaaacagaacaucauuag

SEQ ID NO: 2579345 - RNA, 17 nt, Human
aaaacagacacuggcau

SEQ ID NO: 2579346 - RNA, 13 nt, Human
aaaacagaagccu

SEQ ID NO: 2579347 - RNA, 18 nt, Human
aaaacacugccaucuuag

SEQ ID NO: 2579348 - RNA, 14 nt, Human
aaaacacuaguuuu

SEQ ID NO: 2579349 - RNA, 17 nt, Human
aaaacacauuuuucuua

SEQ ID NO: 2579350 - RNA, 15 nt, Human
aaaacaccuagcuuu

SEQ ID NO: 2579351 - RNA, 14 nt, Human
cugcauuuaaaaga

SEQ ID NO: 2579352 - RNA, 13 nt, Human
cugcauuggcuuu

SEQ ID NO: 2579353 - RNA, 17 nt, Human
cugcccuuaccugccag

SEQ ID NO: 2579354 - RNA, 16 nt, Human
cugcccuuaccugcca

SEQ ID NO: 2579355 - RNA, 12 nt, Human
cugcccuuaccu

SEQ ID NO: 2579356 - RNA, 21 nt, Human
cugcccuguuguguauagaug

SEQ ID NO: 2579357 - RNA, 19 nt, Human
cugcccuguuguguauaga

SEQ ID NO: 2579358 - RNA, 19 nt, Human
cugccccuccucucugccc

SEQ ID NO: 2579359 - RNA, 19 nt, Human
cugcccugugggcccccaa

SEQ ID NO: 2579360 - RNA, 17 nt, Human
cugccccuccucucugc

SEQ ID NO: 2579361 - RNA, 18 nt, Human
cugccccuccucucugcc

SEQ ID NO: 2579362 - RNA, 17 nt, Human
cugccccucccuucaac

SEQ ID NO: 2579363 - RNA, 14 nt, Human
cugccccucccuuc

SEQ ID NO: 2579364 - RNA, 13 nt, Human
cugccccucccuu

SEQ ID NO: 2579365 - RNA, 22 nt, Human
cugccccgugcagacuggaggg

SEQ ID NO: 2579366 - RNA, 18 nt, Human
cugccccgugcagacugg

SEQ ID NO: 2579367 - RNA, 19 nt, Human
cugccccgugcagacugga

SEQ ID NO: 2579368 - RNA, 19 nt, Human
cugccauccagguucagcu

SEQ ID NO: 2579369 - RNA, 18 nt, Human
cugccauccagguucagc

SEQ ID NO: 2579370 - RNA, 16 nt, Human
cugccauccagguuca

SEQ ID NO: 2579371 - RNA, 16 nt, Human
cugccauauucuguug

SEQ ID NO: 2579372 - RNA, 18 nt, Human
cugcccccacuuccuguu

SEQ ID NO: 2579373 - RNA, 16 nt, Human
cugcccccacuuccug

SEQ ID NO: 2579374 - RNA, 14 nt, Human
cugcccccacuucc

SEQ ID NO: 2579375 - RNA, 21 nt, Human
cugcccccacgagggucagga

SEQ ID NO: 2579376 - RNA, 12 nt, Human
cugcccccacga

SEQ ID NO: 2579377 - RNA, 15 nt, Human
cugcccccaccccgg

SEQ ID NO: 2579378 - RNA, 16 nt, Human
cugcccccagccccgg

SEQ ID NO: 2579379 - RNA, 17 nt, Human
cugccauccagggaugc

SEQ ID NO: 2579380 - RNA, 15 nt, Human
cugcccccaaauaag

SEQ ID NO: 2579381 - RNA, 14 nt, Human
cugcccccaaauaa

SEQ ID NO: 2579382 - RNA, 22 nt, Human
cugccccauuuauccaccucca

SEQ ID NO: 2579383 - RNA, 21 nt, Human
cugccccauuuauccaccucc

SEQ ID NO: 2579384 - RNA, 22 nt, Human
cugcccccaccacggccacugg

SEQ ID NO: 2579385 - RNA, 22 nt, Human
cugcccccaaauaagaagggau

SEQ ID NO: 2579386 - RNA, 19 nt, Human
cugcccccaccacggccac

SEQ ID NO: 2579387 - RNA, 18 nt, Human
cugccccgcccccagucc

SEQ ID NO: 2579388 - RNA, 17 nt, Human
cugccccgcccccaguc

SEQ ID NO: 2579389 - RNA, 16 nt, Human
cugccccgcccccagu

SEQ ID NO: 2579390 - RNA, 14 nt, Human
cugccccgccccca

SEQ ID NO: 2579391 - RNA, 23 nt, Human
cugccccggggaggggcgcucgc

SEQ ID NO: 2579392 - RNA, 23 nt, Human
cugccccgcccccaguccccacc

SEQ ID NO: 2579393 - RNA, 18 nt, Human
cugccccgucaccaucuc

SEQ ID NO: 2579394 - RNA, 19 nt, Human
cugccccgucaccaucuca

SEQ ID NO: 2579395 - RNA, 21 nt, Human
cugccccgucaccaucucagg

SEQ ID NO: 2579396 - RNA, 23 nt, Human
cugccccgucaccaucucaggcc

SEQ ID NO: 2579397 - RNA, 22 nt, Human
cugccccgucucaugaggggcc

SEQ ID NO: 2579398 - RNA, 15 nt, Human
cugccccgugcagac

SEQ ID NO: 2579399 - RNA, 17 nt, Human
cugccccgugcagacug

SEQ ID NO: 2579400 - RNA, 22 nt, Human
cugcccccuucucccacacugc

SEQ ID NO: 2579401 - RNA, 23 nt, Human
cugcccccuucucccacacugcu

SEQ ID NO: 2579402 - RNA, 15 nt, Human
cugccccgcccagcu

SEQ ID NO: 2579403 - RNA, 16 nt, Human
cugccccgcccagcug

SEQ ID NO: 2579404 - RNA, 17 nt, Human
cugccccgcccagcugc

SEQ ID NO: 2579405 - RNA, 18 nt, Human
cugcccccggcccccugg

SEQ ID NO: 2579406 - RNA, 17 nt, Human
cugcccccggcccccug

SEQ ID NO: 2579407 - RNA, 16 nt, Human
cugcccccggcccccu

SEQ ID NO: 2579408 - RNA, 16 nt, Human
cugcccccaggacugg

SEQ ID NO: 2579409 - RNA, 15 nt, Human
cugcccccaggacug

SEQ ID NO: 2579410 - RNA, 14 nt, Human
cugcccccaggacu

SEQ ID NO: 2579411 - RNA, 13 nt, Human
cugcccccaggac

SEQ ID NO: 2579412 - RNA, 18 nt, Human
cugcccccaggacugggc

SEQ ID NO: 2579413 - RNA, 17 nt, Human
cugcccccaggacuggg

SEQ ID NO: 2579414 - RNA, 12 nt, Human
cugccccccagc

SEQ ID NO: 2579415 - RNA, 19 nt, Human
cugcccccaggacugggcc

SEQ ID NO: 2579416 - RNA, 19 nt, Human
cugccccccagccucuggc

SEQ ID NO: 2579417 - RNA, 16 nt, Human
cugccccccagccucu

SEQ ID NO: 2579418 - RNA, 13 nt, Human
cugccccccagcc

SEQ ID NO: 2579419 - RNA, 21 nt, Human
cugccccccagccucuggcau

SEQ ID NO: 2579420 - RNA, 23 nt, Human
cugcccccagcucuucuccccag

SEQ ID NO: 2579421 - RNA, 23 nt, Human
cugccauaaaacauuaagaaaau

SEQ ID NO: 2579422 - RNA, 22 nt, Human
cugccauaaaacauuaagaaaa

SEQ ID NO: 2579423 - RNA, 20 nt, Human
cugccauaaaacauuaagaa

SEQ ID NO: 2579424 - RNA, 13 nt, Human
cugccauaaaaca

SEQ ID NO: 2579425 - RNA, 12 nt, Human
cugccaguuuug

SEQ ID NO: 2579426 - RNA, 13 nt, Human
cugccaguuuugu

SEQ ID NO: 2579427 - RNA, 15 nt, Human
cugccaguguggaac

SEQ ID NO: 2579428 - RNA, 23 nt, Human
cugccagugccuuaccuccugcc

SEQ ID NO: 2579429 - RNA, 21 nt, Human
cugccagugccuuaccuccug

SEQ ID NO: 2579430 - RNA, 22 nt, Human
cugccagugccuuaccuccugc

SEQ ID NO: 2579431 - RNA, 21 nt, Human
cugccagugacagacaggcuc

SEQ ID NO: 2579432 - RNA, 19 nt, Human
cugccagugacagacaggc

SEQ ID NO: 2579433 - RNA, 23 nt, Human
cugccagugacagacaggcucuu

SEQ ID NO: 2579434 - RNA, 12 nt, Human
cugccagugccu

SEQ ID NO: 2579435 - RNA, 13 nt, Human
cugccagugccuu

SEQ ID NO: 2579436 - RNA, 14 nt, Human
cugccagugccuua

SEQ ID NO: 2579437 - RNA, 17 nt, Human
cugccagugccuuaccu

SEQ ID NO: 2579438 - RNA, 18 nt, Human
cugccagugccuuaccuc

SEQ ID NO: 2579439 - RNA, 20 nt, Human
cugccagugccuuaccuccu

SEQ ID NO: 2579440 - RNA, 17 nt, Human
cugccagucccccugcc

SEQ ID NO: 2579441 - RNA, 21 nt, Human
cugccagucccccugccccag

SEQ ID NO: 2579442 - RNA, 20 nt, Human
cugccagucccccugcccca

SEQ ID NO: 2579443 - RNA, 16 nt, Human
cugccagugacagaca

SEQ ID NO: 2579444 - RNA, 12 nt, Human
cugccagugaca

SEQ ID NO: 2579445 - RNA, 21 nt, Human
cugccaguccuagcugcacag

SEQ ID NO: 2579446 - RNA, 18 nt, Human
cugccaguccuagcugca

SEQ ID NO: 2579447 - RNA, 18 nt, Human
cugccagucucacugugg

SEQ ID NO: 2579448 - RNA, 17 nt, Human
cugccaguccuagcugc

SEQ ID NO: 2579449 - RNA, 16 nt, Human
cugccaguccuagcug

SEQ ID NO: 2579450 - RNA, 22 nt, Human
cugccagucccccugccccagg

SEQ ID NO: 2579451 - RNA, 22 nt, Human
cugccagggacagagggggugg

SEQ ID NO: 2579452 - RNA, 20 nt, Human
cugccagggacagagggggu

SEQ ID NO: 2579453 - RNA, 17 nt, Human
cugcauuuaaaagauac

SEQ ID NO: 2579454 - RNA, 18 nt, Human
cugcauuuaaaagauaca

SEQ ID NO: 2579455 - RNA, 23 nt, Human
cugccagggacagaggggguggc

SEQ ID NO: 2579456 - RNA, 19 nt, Human
cugccagggagacagagcu

SEQ ID NO: 2579457 - RNA, 18 nt, Human
cugccagggagacagagc

SEQ ID NO: 2579458 - RNA, 17 nt, Human
cugccagggagacagag

SEQ ID NO: 2579459 - RNA, 16 nt, Human
cugccagggagacaga

SEQ ID NO: 2579460 - RNA, 12 nt, Human
cugccagggagc

SEQ ID NO: 2579461 - RNA, 13 nt, Human
cugccagggagcu

SEQ ID NO: 2579462 - RNA, 11 nt, Human
cugccagggca

SEQ ID NO: 2579463 - RNA, 12 nt, Human
cugccagggcag

SEQ ID NO: 2579464 - RNA, 13 nt, Human
cugccagggcagg

SEQ ID NO: 2579465 - RNA, 15 nt, Human
cugccagggcagggc

SEQ ID NO: 2579466 - RNA, 16 nt, Human
cugccagggcagggcc

SEQ ID NO: 2579467 - RNA, 23 nt, Human
cugccagggagacagagcucaca

SEQ ID NO: 2579468 - RNA, 11 nt, Human
cugccagggcc

SEQ ID NO: 2579469 - RNA, 21 nt, Human
cugcaaccugauugugucucu

SEQ ID NO: 2579470 - RNA, 19 nt, Human
cugcaaccugauugugucu

SEQ ID NO: 2579471 - RNA, 14 nt, Human
cugcaaccugauug

SEQ ID NO: 2579472 - RNA, 22 nt, Human
cugcaaccuccgccucuugggu

SEQ ID NO: 2579473 - RNA, 15 nt, Human
cugcaaaugucauca

SEQ ID NO: 2579474 - RNA, 12 nt, Human
cugcaacaggcu

SEQ ID NO: 2579475 - RNA, 20 nt, Human
cugcaaccuccgccucuugg

SEQ ID NO: 2579476 - RNA, 16 nt, Human
cugcaaauccuugugg

SEQ ID NO: 2579477 - RNA, 19 nt, Human
cugcaaauccuugugggaa

SEQ ID NO: 2579478 - RNA, 21 nt, Human
cugcaaaucagccaugugcug

SEQ ID NO: 2579479 - RNA, 17 nt, Human
cugcaaccuucgccacc

SEQ ID NO: 2579480 - RNA, 19 nt, Human
cugcaaccuucgccaccug

SEQ ID NO: 2579481 - RNA, 20 nt, Human
cugcaaccuucgccaccugg

SEQ ID NO: 2579482 - RNA, 22 nt, Human
cugcaaccuucgccaccugggu

SEQ ID NO: 2579483 - RNA, 22 nt, Human
cugcaaccugauugugucucuu

SEQ ID NO: 2579484 - RNA, 13 nt, Human
cugcaaccuccgc

SEQ ID NO: 2579485 - RNA, 15 nt, Human
cugcaaccuguugau

SEQ ID NO: 2579486 - RNA, 20 nt, Human
cugcaacuuuaagcagcucu

SEQ ID NO: 2579487 - RNA, 19 nt, Human
cugcaacuuuaagcagcuc

SEQ ID NO: 2579488 - RNA, 17 nt, Human
cugcaacuuuaagcagc

SEQ ID NO: 2579489 - RNA, 17 nt, Human
cugcaacggcuuagacu

SEQ ID NO: 2579490 - RNA, 19 nt, Human
cugcaacuuguaaaugugg

SEQ ID NO: 2579491 - RNA, 18 nt, Human
cugcaagaauugaagcag

SEQ ID NO: 2579492 - RNA, 23 nt, Human
cugcaacucaaggacuuugcagc

SEQ ID NO: 2579493 - RNA, 15 nt, Human
cugcaacucaaggac

SEQ ID NO: 2579494 - RNA, 14 nt, Human
cugcaacuucugcc

SEQ ID NO: 2579495 - RNA, 18 nt, Human
cugcaacuuguaaaugug

SEQ ID NO: 2579496 - RNA, 15 nt, Human
cugcaacuucugccu

SEQ ID NO: 2579497 - RNA, 16 nt, Human
cugcaagggcucccca

SEQ ID NO: 2579498 - RNA, 22 nt, Human
cugcaagggcagaacacuaacc

SEQ ID NO: 2579499 - RNA, 20 nt, Human
cugcaaggccuuucugugug

SEQ ID NO: 2579500 - RNA, 18 nt, Human
cugcaaggccuuucugug

SEQ ID NO: 2579501 - RNA, 22 nt, Human
cugcaagggcuccccacugccu

SEQ ID NO: 2579502 - RNA, 17 nt, Human
cugcaagggcuccccac

SEQ ID NO: 2579503 - RNA, 17 nt, Human
cugcaaggucuuugguu

SEQ ID NO: 2579504 - RNA, 17 nt, Human
cugcaaggccuuucugu

SEQ ID NO: 2579505 - RNA, 16 nt, Human
cugcaaggccuuucug

SEQ ID NO: 2579506 - RNA, 13 nt, Human
cugcaaggccuuu

SEQ ID NO: 2579507 - RNA, 13 nt, Human
cugcaagccugcg

SEQ ID NO: 2579508 - RNA, 14 nt, Human
cugcaagccugcgu

SEQ ID NO: 2579509 - RNA, 12 nt, Human
cugcaagggagu

SEQ ID NO: 2579510 - RNA, 20 nt, Human
cugcaagaauugaagcagga

SEQ ID NO: 2579511 - RNA, 21 nt, Human
cugcaacuuuaagcagcucuu

SEQ ID NO: 2579512 - RNA, 21 nt, Human
cugcaagaaaaugauguguac

SEQ ID NO: 2579513 - RNA, 13 nt, Human
cugcaagagccuu

SEQ ID NO: 2579514 - RNA, 14 nt, Human
cugcaagagccuug

SEQ ID NO: 2579515 - RNA, 15 nt, Human
cugcaagagccuugg

SEQ ID NO: 2579516 - RNA, 17 nt, Human
cugcaagagccuuggug

SEQ ID NO: 2579517 - RNA, 18 nt, Human
cugcaagagccuuggugu

SEQ ID NO: 2579518 - RNA, 19 nt, Human
cugcaagagccuugguguc

SEQ ID NO: 2579519 - RNA, 23 nt, Human
cugcaagagccuugguguccacc

SEQ ID NO: 2579520 - RNA, 19 nt, Human
cugcaagauucugaaacau

SEQ ID NO: 2579521 - RNA, 21 nt, Human
cugcaagagccuuggugucca

SEQ ID NO: 2579522 - RNA, 12 nt, Human
cugcaagccugc

SEQ ID NO: 2579523 - RNA, 19 nt, Human
cugcaagccgacuacaccu

SEQ ID NO: 2579524 - RNA, 19 nt, Human
cugcaagcagggcucugcc

SEQ ID NO: 2579525 - RNA, 18 nt, Human
cugcaagcagggcucugc

SEQ ID NO: 2579526 - RNA, 14 nt, Human
cugcaagcagggcu

SEQ ID NO: 2579527 - RNA, 20 nt, Human
cugcaagauucugaaacauu

SEQ ID NO: 2579528 - RNA, 20 nt, Human
cugcaagcacaucugcauuu

SEQ ID NO: 2579529 - RNA, 23 nt, Human
cugcaccgggccacagagaaagu

SEQ ID NO: 2579530 - RNA, 21 nt, Human
cugcaagucagaggauggcca

SEQ ID NO: 2579531 - RNA, 19 nt, Human
cugcaagucagaggauggc

SEQ ID NO: 2579532 - RNA, 16 nt, Human
cugcaagucagaggau

SEQ ID NO: 2579533 - RNA, 15 nt, Human
cugcaagucagagga

SEQ ID NO: 2579534 - RNA, 20 nt, Human
cugcaccgggccacagagaa

SEQ ID NO: 2579535 - RNA, 18 nt, Human
cugcaagguuuaggcugg

SEQ ID NO: 2579536 - RNA, 20 nt, Human
cugcaagguuuaggcuggug

SEQ ID NO: 2579537 - RNA, 22 nt, Human
cugcaagguuuaggcugguggc

SEQ ID NO: 2579538 - RNA, 23 nt, Human
cugcaagguuuaggcugguggcc

SEQ ID NO: 2579539 - RNA, 14 nt, Human
cugcaagucagagg

SEQ ID NO: 2579540 - RNA, 13 nt, Human
cugcaagucagag

SEQ ID NO: 2579541 - RNA, 12 nt, Human
cugcaagucaga

SEQ ID NO: 2579542 - RNA, 21 nt, Human
cugcaccuccccccacugcag

SEQ ID NO: 2579543 - RNA, 22 nt, Human
cugcaccuccccccacugcagg

SEQ ID NO: 2579544 - RNA, 13 nt, Human
cugcaccugccag

SEQ ID NO: 2579545 - RNA, 16 nt, Human
cugcaccugccagccu

SEQ ID NO: 2579546 - RNA, 17 nt, Human
cugcaccugccagccug

SEQ ID NO: 2579547 - RNA, 18 nt, Human
cugcaccugccagccugg

SEQ ID NO: 2579548 - RNA, 19 nt, Human
cugcaccugccagccuggc

SEQ ID NO: 2579549 - RNA, 14 nt, Human
cugcaccugugcag

SEQ ID NO: 2579550 - RNA, 13 nt, Human
cugcaccugugca

SEQ ID NO: 2579551 - RNA, 20 nt, Human
cugcaccugccagccuggcu

SEQ ID NO: 2579552 - RNA, 17 nt, Human
cugcaccuccccccacu

SEQ ID NO: 2579553 - RNA, 18 nt, Human
cugcaccuccccccacug

SEQ ID NO: 2579554 - RNA, 19 nt, Human
cugcaccuccccccacugc

SEQ ID NO: 2579555 - RNA, 20 nt, Human
cugcaccuccccccacugca

SEQ ID NO: 2579556 - RNA, 11 nt, Human
cugcaccuccc

SEQ ID NO: 2579557 - RNA, 14 nt, Human
cugcaccucccccc

SEQ ID NO: 2579558 - RNA, 17 nt, Human
cugcaccguacugugga

SEQ ID NO: 2579559 - RNA, 22 nt, Human
cugcaaaggguaucaggugcug

SEQ ID NO: 2579560 - RNA, 14 nt, Human
cugcaaaggacaga

SEQ ID NO: 2579561 - RNA, 16 nt, Human
cugcaaaggacagauc

SEQ ID NO: 2579562 - RNA, 15 nt, Human
cugcaaaggaaauac

SEQ ID NO: 2579563 - RNA, 23 nt, Human
cugcaaaggacagauccagggac

SEQ ID NO: 2579564 - RNA, 13 nt, Human
cugcaaaggacug

SEQ ID NO: 2579565 - RNA, 22 nt, Human
cugcaaaggacuguuuuuuccu

SEQ ID NO: 2579566 - RNA, 23 nt, Human
cugcaaagguaauaauacagcca

SEQ ID NO: 2579567 - RNA, 16 nt, Human
cugaugguacaggaaa

SEQ ID NO: 2579568 - RNA, 17 nt, Human
cugcaaagcccagcuug

SEQ ID NO: 2579569 - RNA, 18 nt, Human
cugcaaagcccagcuuga

SEQ ID NO: 2579570 - RNA, 21 nt, Human
cugcaaaggguaucaggugcu

SEQ ID NO: 2579571 - RNA, 23 nt, Human
cugaugggcaacccccagccugc

SEQ ID NO: 2579572 - RNA, 22 nt, Human
cugaugggcaacccccagccug

SEQ ID NO: 2579573 - RNA, 24 nt, Human
cugaugggcaacccccagccugcu

SEQ ID NO: 2579574 - RNA, 18 nt, Human
cugauggcuucuccaggg

SEQ ID NO: 2579575 - RNA, 12 nt, Human
cugauggcuucu

SEQ ID NO: 2579576 - RNA, 19 nt, Human
cugauggcuucuccagggu

SEQ ID NO: 2579577 - RNA, 22 nt, Human
cugauggcaggauggccuggcc

SEQ ID NO: 2579578 - RNA, 19 nt, Human
cugauggcaggauggccug

SEQ ID NO: 2579579 - RNA, 17 nt, Human
cugauggcaggauggcc

SEQ ID NO: 2579580 - RNA, 16 nt, Human
cugauggcaggauggc

SEQ ID NO: 2579581 - RNA, 22 nt, Human
cugauggcacuuagcuaucaga

SEQ ID NO: 2579582 - RNA, 21 nt, Human
cugaugggcaacccccagccu

SEQ ID NO: 2579583 - RNA, 18 nt, Human
cugaugggcaacccccag

SEQ ID NO: 2579584 - RNA, 19 nt, Human
cugaugcuucuucagagac

SEQ ID NO: 2579585 - RNA, 18 nt, Human
cugaugcuucuucagaga

SEQ ID NO: 2579586 - RNA, 20 nt, Human
cugaugcuucuucagagacu

SEQ ID NO: 2579587 - RNA, 15 nt, Human
cugauggaccuguca

SEQ ID NO: 2579588 - RNA, 14 nt, Human
cugauggacaagga

SEQ ID NO: 2579589 - RNA, 18 nt, Human
cugaugcuuuuagcucaa

SEQ ID NO: 2579590 - RNA, 22 nt, Human
cugaugcuuugcuucaaaucca

SEQ ID NO: 2579591 - RNA, 17 nt, Human
cugaugcuuugcuucaa

SEQ ID NO: 2579592 - RNA, 17 nt, Human
cugaugcuucuucagag

SEQ ID NO: 2579593 - RNA, 16 nt, Human
cugaugcuucuucaga

SEQ ID NO: 2579594 - RNA, 19 nt, Human
cugaugcugggcugggugc

SEQ ID NO: 2579595 - RNA, 18 nt, Human
cugaugcugggcugggug

SEQ ID NO: 2579596 - RNA, 17 nt, Human
cugaugcugggcugggu

SEQ ID NO: 2579597 - RNA, 16 nt, Human
cugaugcugggcuggg

SEQ ID NO: 2579598 - RNA, 15 nt, Human
cugaugcugggcugg

SEQ ID NO: 2579599 - RNA, 14 nt, Human
cugaugcugggcug

SEQ ID NO: 2579600 - RNA, 13 nt, Human
cugaugcugggcu

SEQ ID NO: 2579601 - RNA, 12 nt, Human
cugaugcugaca

SEQ ID NO: 2579602 - RNA, 14 nt, Human
cugaugcugccccu

SEQ ID NO: 2579603 - RNA, 23 nt, Human
cugaugcucccuccccugcccug

SEQ ID NO: 2579604 - RNA, 24 nt, Human
cugaugcucccuccccugcccugg

SEQ ID NO: 2579605 - RNA, 19 nt, Human
cugaugccaaguuguuuga

SEQ ID NO: 2579606 - RNA, 23 nt, Human
cugaugcagucacguggaggagc

SEQ ID NO: 2579607 - RNA, 20 nt, Human
cugaugauuuguuuuuguau

SEQ ID NO: 2579608 - RNA, 17 nt, Human
cugaugaugugccuggg

SEQ ID NO: 2579609 - RNA, 20 nt, Human
cugaugauuucuugaaaagg

SEQ ID NO: 2579610 - RNA, 12 nt, Human
cugaugcucccu

SEQ ID NO: 2579611 - RNA, 14 nt, Human
cugaugcucccucc

SEQ ID NO: 2579612 - RNA, 15 nt, Human
cugaugcucccuccc

SEQ ID NO: 2579613 - RNA, 17 nt, Human
cugaugcucccuccccu

SEQ ID NO: 2579614 - RNA, 18 nt, Human
cugaugcucccuccccug

SEQ ID NO: 2579615 - RNA, 19 nt, Human
cugaugcucccuccccugc

SEQ ID NO: 2579616 - RNA, 21 nt, Human
cugaugcucccuccccugccc

SEQ ID NO: 2579617 - RNA, 22 nt, Human
cugaugcucccuccccugcccu

SEQ ID NO: 2579618 - RNA, 14 nt, Human
cucuuaugggcugg

SEQ ID NO: 2579619 - RNA, 23 nt, Human
cucuuaucucagucaugcauaaa

SEQ ID NO: 2579620 - RNA, 22 nt, Human
cucuuaucucagucaugcauaa

SEQ ID NO: 2579621 - RNA, 21 nt, Human
cucuuaucucagucaugcaua

SEQ ID NO: 2579622 - RNA, 15 nt, Human
cucuuaucucaguca

SEQ ID NO: 2579623 - RNA, 11 nt, Human
cucuuaucuca

SEQ ID NO: 2579624 - RNA, 22 nt, Human
cucuuauagaauauuuauuacc

SEQ ID NO: 2579625 - RNA, 15 nt, Human
cucuuaugggcuggg

SEQ ID NO: 2579626 - RNA, 15 nt, Human
cugaugacagagcga

SEQ ID NO: 2579627 - RNA, 16 nt, Human
cugaugacagagcgag

SEQ ID NO: 2579628 - RNA, 16 nt, Human
cucuuauucaguaaaa

SEQ ID NO: 2579629 - RNA, 17 nt, Human
cugaugacagagcgaga

SEQ ID NO: 2579630 - RNA, 23 nt, Human
cugcacuauagccuaggugacag

SEQ ID NO: 2579631 - RNA, 22 nt, Human
cugcacuauagccuaggugaca

SEQ ID NO: 2579632 - RNA, 20 nt, Human
cugcacuacuccucugcagu

SEQ ID NO: 2579633 - RNA, 19 nt, Human
cugcacuacuccucugcag

SEQ ID NO: 2579634 - RNA, 14 nt, Human
cugcacuacugaca

SEQ ID NO: 2579635 - RNA, 16 nt, Human
cugcacuacugacaug

SEQ ID NO: 2579636 - RNA, 23 nt, Human
cugcacuacuccucugcagugcc

SEQ ID NO: 2579637 - RNA, 13 nt, Human
cugcacuccagcc

SEQ ID NO: 2579638 - RNA, 17 nt, Human
cugcacuccagccugag

SEQ ID NO: 2579639 - RNA, 20 nt, Human
cugcacuccagccugagcga

SEQ ID NO: 2579640 - RNA, 16 nt, Human
cugcacuccagccuga

SEQ ID NO: 2579641 - RNA, 15 nt, Human
cugcacuccagccug

SEQ ID NO: 2579642 - RNA, 22 nt, Human
cugcacgaauggaagaggcacc

SEQ ID NO: 2579643 - RNA, 18 nt, Human
cugcacggugggccuugc

SEQ ID NO: 2579644 - RNA, 20 nt, Human
cugcacggugggccuugcug

SEQ ID NO: 2579645 - RNA, 19 nt, Human
cugcacggugggccuugcu

SEQ ID NO: 2579646 - RNA, 12 nt, Human
cugcacgucaug

SEQ ID NO: 2579647 - RNA, 18 nt, Human
cugcacuacuccucugca

SEQ ID NO: 2579648 - RNA, 16 nt, Human
cugcacuacuccucug

SEQ ID NO: 2579649 - RNA, 16 nt, Human
cugcacuaauuugaug

SEQ ID NO: 2579650 - RNA, 20 nt, Human
cugcacuauagccuagguga

SEQ ID NO: 2579651 - RNA, 18 nt, Human
cugcacuauagccuaggu

SEQ ID NO: 2579652 - RNA, 17 nt, Human
cugcacuauagccuagg

SEQ ID NO: 2579653 - RNA, 16 nt, Human
cugcacuauagccuag

SEQ ID NO: 2579654 - RNA, 18 nt, Human
cugcagccuccuccugac

SEQ ID NO: 2579655 - RNA, 17 nt, Human
cugcagccuccuccuga

SEQ ID NO: 2579656 - RNA, 16 nt, Human
cugcagccuccuccug

SEQ ID NO: 2579657 - RNA, 13 nt, Human
cugcagccuccuc

SEQ ID NO: 2579658 - RNA, 18 nt, Human
cugcagccuccuucuccu

SEQ ID NO: 2579659 - RNA, 20 nt, Human
cugcagccuccuccugacca

SEQ ID NO: 2579660 - RNA, 11 nt, Human
cugcagccugg

SEQ ID NO: 2579661 - RNA, 14 nt, Human
cugcagccuggagg

SEQ ID NO: 2579662 - RNA, 15 nt, Human
cugcagccuggaggc

SEQ ID NO: 2579663 - RNA, 21 nt, Human
cugcagcugaccucuguuguc

SEQ ID NO: 2579664 - RNA, 12 nt, Human
cugcagcugacc

SEQ ID NO: 2579665 - RNA, 23 nt, Human
cugcagcuguuuuaguuaaauuu

SEQ ID NO: 2579666 - RNA, 14 nt, Human
cugcagcugaccuc

SEQ ID NO: 2579667 - RNA, 13 nt, Human
cugcagcugaccu

SEQ ID NO: 2579668 - RNA, 17 nt, Human
cugcagcucacccagcc

SEQ ID NO: 2579669 - RNA, 20 nt, Human
cugcagccuggaggccgggu

SEQ ID NO: 2579670 - RNA, 18 nt, Human
cugcagccuuugccuccc

SEQ ID NO: 2579671 - RNA, 20 nt, Human
cugcagccuuugccuccccg

SEQ ID NO: 2579672 - RNA, 20 nt, Human
cugcagcggccacacuguac

SEQ ID NO: 2579673 - RNA, 23 nt, Human
cugcagccucaaccuccugggcu

SEQ ID NO: 2579674 - RNA, 19 nt, Human
cugcacuccagccugggug

SEQ ID NO: 2579675 - RNA, 24 nt, Human
cugcagccucaaccuccugggcua

SEQ ID NO: 2579676 - RNA, 20 nt, Human
cugcacuccagccugggcga

SEQ ID NO: 2579677 - RNA, 18 nt, Human
cugcacuccagccugggu

SEQ ID NO: 2579678 - RNA, 14 nt, Human
cugcacucaagcuu

SEQ ID NO: 2579679 - RNA, 14 nt, Human
cugcacuccagccu

SEQ ID NO: 2579680 - RNA, 18 nt, Human
cugcacuccagccugggc

SEQ ID NO: 2579681 - RNA, 19 nt, Human
cugcacuccagccugggcg

SEQ ID NO: 2579682 - RNA, 16 nt, Human
cugcacuccagccugg

SEQ ID NO: 2579683 - RNA, 17 nt, Human
cugcacuccagccuggg

SEQ ID NO: 2579684 - RNA, 20 nt, Human
cugcaggcagccaggccaca

SEQ ID NO: 2579685 - RNA, 19 nt, Human
cugcaggcagccaggccac

SEQ ID NO: 2579686 - RNA, 18 nt, Human
cugcaggcagccaggcca

SEQ ID NO: 2579687 - RNA, 17 nt, Human
cugcaggcagccaggcc

SEQ ID NO: 2579688 - RNA, 16 nt, Human
cugcaggcagccaggc

SEQ ID NO: 2579689 - RNA, 15 nt, Human
cugcaggcagccagg

SEQ ID NO: 2579690 - RNA, 14 nt, Human
cugcaggcagccag

SEQ ID NO: 2579691 - RNA, 13 nt, Human
cugcaggcagcca

SEQ ID NO: 2579692 - RNA, 21 nt, Human
cugcagcuuuacaugcaauuu

SEQ ID NO: 2579693 - RNA, 14 nt, Human
cugcagcuuuacau

SEQ ID NO: 2579694 - RNA, 12 nt, Human
cugcagcuuuac

SEQ ID NO: 2579695 - RNA, 17 nt, Human
cugcaggaaauggcugu

SEQ ID NO: 2579696 - RNA, 17 nt, Human
cugcagcuguuuuaguu

SEQ ID NO: 2579697 - RNA, 12 nt, Human
cugcagcuuugu

SEQ ID NO: 2579698 - RNA, 14 nt, Human
cugcaggaccugcc

SEQ ID NO: 2579699 - RNA, 15 nt, Human
cugcaggaccugccu

SEQ ID NO: 2579700 - RNA, 16 nt, Human
cugcaggaccugccug

SEQ ID NO: 2579701 - RNA, 17 nt, Human
cugcaggaccugccugu

SEQ ID NO: 2579702 - RNA, 18 nt, Human
cugcaggaccugccugua

SEQ ID NO: 2579703 - RNA, 21 nt, Human
cugcaggaccugccuguagcc

SEQ ID NO: 2579704 - RNA, 20 nt, Human
cugcaggcaccuuaguggcu

SEQ ID NO: 2579705 - RNA, 12 nt, Human
cugcaggcaccu

SEQ ID NO: 2579706 - RNA, 21 nt, Human
cugcaggauugauuaugcaga

SEQ ID NO: 2579707 - RNA, 20 nt, Human
cugcaggauugauuaugcag

SEQ ID NO: 2579708 - RNA, 22 nt, Human
cugcaggaccugccuguagccc

SEQ ID NO: 2579709 - RNA, 19 nt, Human
cugcaggacuugagaagac

SEQ ID NO: 2579710 - RNA, 23 nt, Human
cugcaggacuugagaagaccuca

SEQ ID NO: 2579711 - RNA, 16 nt, Human
cugcaggaguuaaaaa

SEQ ID NO: 2579712 - RNA, 19 nt, Human
cugcaggcccuggccuccc

SEQ ID NO: 2579713 - RNA, 18 nt, Human
cugcaggcccuggccucc

SEQ ID NO: 2579714 - RNA, 17 nt, Human
cugcaggcccuggccuc

SEQ ID NO: 2579715 - RNA, 16 nt, Human
cugcaggcccuggccu

SEQ ID NO: 2579716 - RNA, 15 nt, Human
cugcaggcccuggcc

SEQ ID NO: 2579717 - RNA, 14 nt, Human
cugcaggcccuggc

SEQ ID NO: 2579718 - RNA, 13 nt, Human
cugcaggcccugg

SEQ ID NO: 2579719 - RNA, 22 nt, Human
cugcaggccccgcuuguccagc

SEQ ID NO: 2579720 - RNA, 23 nt, Human
cugcaggccccgcuuguccagcg

SEQ ID NO: 2579721 - RNA, 15 nt, Human
cugcaggcagacacg

SEQ ID NO: 2579722 - RNA, 14 nt, Human
cugcaggcagacac

SEQ ID NO: 2579723 - RNA, 13 nt, Human
cugcaggcagaca

SEQ ID NO: 2579724 - RNA, 12 nt, Human
cugcaggcagac

SEQ ID NO: 2579725 - RNA, 17 nt, Human
cugcaggcagacacgga

SEQ ID NO: 2579726 - RNA, 11 nt, Human
cugcaggcagg

SEQ ID NO: 2579727 - RNA, 12 nt, Human
cugcaggcaggg

SEQ ID NO: 2579728 - RNA, 15 nt, Human
cugcaggccaagagc

SEQ ID NO: 2579729 - RNA, 19 nt, Human
cugcaggccaagagcagag

SEQ ID NO: 2579730 - RNA, 21 nt, Human
cugcaggccaagagcagaggc

SEQ ID NO: 2579731 - RNA, 17 nt, Human
cugcaggcaucacagcu

SEQ ID NO: 2579732 - RNA, 11 nt, Human
cugcaggcccc

SEQ ID NO: 2579733 - RNA, 14 nt, Human
cugcaggccccgcu

SEQ ID NO: 2579734 - RNA, 20 nt, Human
cugcaggccccgcuugucca

SEQ ID NO: 2579735 - RNA, 18 nt, Human
cugcaggccaggccagcu

SEQ ID NO: 2579736 - RNA, 23 nt, Human
cugcaggccaggccagcugccuc

SEQ ID NO: 2579737 - RNA, 22 nt, Human
cugcaggccaagagcagaggca

SEQ ID NO: 2579738 - RNA, 23 nt, Human
cugcaggccaagagcagaggcag

SEQ ID NO: 2579739 - RNA, 24 nt, Human
cugcaggccaagagcagaggcagc

SEQ ID NO: 2579740 - RNA, 17 nt, Human
cugcaggccaggccagc

SEQ ID NO: 2579741 - RNA, 19 nt, Human
cuggugcuauaggcuggag

SEQ ID NO: 2579742 - RNA, 21 nt, Human
cuggugcuauaggcuggagaa

SEQ ID NO: 2579743 - RNA, 20 nt, Human
cuggugcuauaggcuggaga

SEQ ID NO: 2579744 - RNA, 22 nt, Human
cuggugcuauaggcuggagaag

SEQ ID NO: 2579745 - RNA, 23 nt, Human
cuggugcccuaaccucugaguca

SEQ ID NO: 2579746 - RNA, 21 nt, Human
cuggugccucaccccuugcca

SEQ ID NO: 2579747 - RNA, 12 nt, Human
cuggugccucac

SEQ ID NO: 2579748 - RNA, 17 nt, Human
cuggugccagccuuccu

SEQ ID NO: 2579749 - RNA, 14 nt, Human
cuggugccagccuu

SEQ ID NO: 2579750 - RNA, 13 nt, Human
cuggugccagccu

SEQ ID NO: 2579751 - RNA, 20 nt, Human
cuggugcccuaaccucugag

SEQ ID NO: 2579752 - RNA, 21 nt, Human
cuggugccagccuuccucugc

SEQ ID NO: 2579753 - RNA, 14 nt, Human
cuggugcccggaga

SEQ ID NO: 2579754 - RNA, 15 nt, Human
cuggguguggcgcag

SEQ ID NO: 2579755 - RNA, 12 nt, Human
cuggugcagugg

SEQ ID NO: 2579756 - RNA, 15 nt, Human
cuggugccaauuuca

SEQ ID NO: 2579757 - RNA, 16 nt, Human
cuggugccaauuucaa

SEQ ID NO: 2579758 - RNA, 18 nt, Human
cuggugccaauuucaagu

SEQ ID NO: 2579759 - RNA, 20 nt, Human
cuggugccaauuucaaguuc

SEQ ID NO: 2579760 - RNA, 14 nt, Human
cuggugcauuacag

SEQ ID NO: 2579761 - RNA, 15 nt, Human
cuggugcauuacaga

SEQ ID NO: 2579762 - RNA, 16 nt, Human
cuggugcauuacagag

SEQ ID NO: 2579763 - RNA, 17 nt, Human
cuggugcauuacagaga

SEQ ID NO: 2579764 - RNA, 18 nt, Human
cuggugcauuacagagag

SEQ ID NO: 2579765 - RNA, 19 nt, Human
cuggugcauuacagagagg

SEQ ID NO: 2579766 - RNA, 14 nt, Human
cuggguguggcgca

SEQ ID NO: 2579767 - RNA, 19 nt, Human
cuggguggucugcaggcag

SEQ ID NO: 2579768 - RNA, 21 nt, Human
cuggguggucugcaggcaggg

SEQ ID NO: 2579769 - RNA, 21 nt, Human
cuggguggcaccagcagccug

SEQ ID NO: 2579770 - RNA, 16 nt, Human
cugggugguacccucu

SEQ ID NO: 2579771 - RNA, 19 nt, Human
cugggugguacccucugga

SEQ ID NO: 2579772 - RNA, 15 nt, Human
cugggugcuggcugc

SEQ ID NO: 2579773 - RNA, 13 nt, Human
cuggguggucugc

SEQ ID NO: 2579774 - RNA, 20 nt, Human
cugggcagcuaccauuuccc

SEQ ID NO: 2579775 - RNA, 11 nt, Human
cugggcagcua

SEQ ID NO: 2579776 - RNA, 17 nt, Human
cugggcagccaggcugc

SEQ ID NO: 2579777 - RNA, 15 nt, Human
cugggcagccaggcu

SEQ ID NO: 2579778 - RNA, 16 nt, Human
cugggcagccaggcug

SEQ ID NO: 2579779 - RNA, 18 nt, Human
cugggcagccaggcugcc

SEQ ID NO: 2579780 - RNA, 20 nt, Human
cugggcagaggaaagcaaag

SEQ ID NO: 2579781 - RNA, 17 nt, Human
cugggcagcauagcaag

SEQ ID NO: 2579782 - RNA, 18 nt, Human
cugggcagcauagcaaga

SEQ ID NO: 2579783 - RNA, 16 nt, Human
cugggcagaggaaagc

SEQ ID NO: 2579784 - RNA, 13 nt, Human
cugggcagaggaa

SEQ ID NO: 2579785 - RNA, 12 nt, Human
cugggcagagga

SEQ ID NO: 2579786 - RNA, 18 nt, Human
cugggcaucuguucuggu

SEQ ID NO: 2579787 - RNA, 17 nt, Human
cugggcaucuguucugg

SEQ ID NO: 2579788 - RNA, 15 nt, Human
cugggcaucuguucu

SEQ ID NO: 2579789 - RNA, 14 nt, Human
cugggcaucuguuc

SEQ ID NO: 2579790 - RNA, 15 nt, Human
cugggcauccucagg

SEQ ID NO: 2579791 - RNA, 23 nt, Human
cugggcauagaugcaggugagcc

SEQ ID NO: 2579792 - RNA, 16 nt, Human
cugggcauagaugcag

SEQ ID NO: 2579793 - RNA, 17 nt, Human
cugggcaggacucagcu

SEQ ID NO: 2579794 - RNA, 20 nt, Human
cugggcagguuggugggggc

SEQ ID NO: 2579795 - RNA, 21 nt, Human
cugggcagcuguuagagucca

SEQ ID NO: 2579796 - RNA, 12 nt, Human
cugggcauugcu

SEQ ID NO: 2579797 - RNA, 13 nt, Human
cugggcauugcuu

SEQ ID NO: 2579798 - RNA, 20 nt, Human
cugggccauucuccacagca

SEQ ID NO: 2579799 - RNA, 21 nt, Human
cugggccauucuccacagcaa

SEQ ID NO: 2579800 - RNA, 19 nt, Human
cugggccauucuccacagc

SEQ ID NO: 2579801 - RNA, 17 nt, Human
cugggcccaacccuguc

SEQ ID NO: 2579802 - RNA, 14 nt, Human
cugggcccaacccu

SEQ ID NO: 2579803 - RNA, 22 nt, Human
cugggccauucuccacagcaac

SEQ ID NO: 2579804 - RNA, 19 nt, Human
cugggcccaacccugucug

SEQ ID NO: 2579805 - RNA, 18 nt, Human
cugggcccaacccugucu

SEQ ID NO: 2579806 - RNA, 23 nt, Human
cuggggacggggggccccaguca

SEQ ID NO: 2579807 - RNA, 22 nt, Human
cuggggacggggggccccaguc

SEQ ID NO: 2579808 - RNA, 19 nt, Human
cuggggacggggggcccca

SEQ ID NO: 2579809 - RNA, 17 nt, Human
cuggggacggggggccc

SEQ ID NO: 2579810 - RNA, 22 nt, Human
cuggggaccugguacccuccug

SEQ ID NO: 2579811 - RNA, 20 nt, Human
cuggggaccugguacccucc

SEQ ID NO: 2579812 - RNA, 14 nt, Human
cugggcccagaagg

SEQ ID NO: 2579813 - RNA, 23 nt, Human
cugggcccagaagguugugauga

SEQ ID NO: 2579814 - RNA, 16 nt, Human
cuggggacagcaaggg

SEQ ID NO: 2579815 - RNA, 13 nt, Human
cuggggagaaagu

SEQ ID NO: 2579816 - RNA, 20 nt, Human
cuggggccucggagccucau

SEQ ID NO: 2579817 - RNA, 18 nt, Human
cuggggccuggaccugcc

SEQ ID NO: 2579818 - RNA, 19 nt, Human
cuggggccuggaccugccu

SEQ ID NO: 2579819 - RNA, 17 nt, Human
cuggggccuggaccugc

SEQ ID NO: 2579820 - RNA, 16 nt, Human
cuggggccuggaccug

SEQ ID NO: 2579821 - RNA, 23 nt, Human
cuggggccucggagccucauccg

SEQ ID NO: 2579822 - RNA, 14 nt, Human
cuggggccuggacc

SEQ ID NO: 2579823 - RNA, 12 nt, Human
cuggggccucuu

SEQ ID NO: 2579824 - RNA, 18 nt, Human
cuggguggcaccagcagc

SEQ ID NO: 2579825 - RNA, 20 nt, Human
cuggguggcaccagcagccu

SEQ ID NO: 2579826 - RNA, 19 nt, Human
cugggugcgaccccaucug

SEQ ID NO: 2579827 - RNA, 21 nt, Human
cugggugcccaagcucagaag

SEQ ID NO: 2579828 - RNA, 20 nt, Human
cugggugcccaagcucagaa

SEQ ID NO: 2579829 - RNA, 20 nt, Human
cugggugcaugaucuugagc

SEQ ID NO: 2579830 - RNA, 22 nt, Human
cugggugcgaccccaucugccc

SEQ ID NO: 2579831 - RNA, 21 nt, Human
cugggugcgaccccaucugcc

SEQ ID NO: 2579832 - RNA, 23 nt, Human
cugggugcgaccccaucugccca

SEQ ID NO: 2579833 - RNA, 14 nt, Human
cugggugcucccua

SEQ ID NO: 2579834 - RNA, 23 nt, Human
cuggguggacauggccccuguga

SEQ ID NO: 2579835 - RNA, 15 nt, Human
cugggugcucccuac

SEQ ID NO: 2579836 - RNA, 18 nt, Human
cuggggcgggccccucau

SEQ ID NO: 2579837 - RNA, 15 nt, Human
cuggggcgggccccu

SEQ ID NO: 2579838 - RNA, 16 nt, Human
cuggggcguggggagg

SEQ ID NO: 2579839 - RNA, 16 nt, Human
cugggucuuucauggg

SEQ ID NO: 2579840 - RNA, 15 nt, Human
cuggggcguggggag

SEQ ID NO: 2579841 - RNA, 14 nt, Human
cuggggcgugggga

SEQ ID NO: 2579842 - RNA, 22 nt, Human
cugggugacagagcaagacucu

SEQ ID NO: 2579843 - RNA, 13 nt, Human
cugggugacagag

SEQ ID NO: 2579844 - RNA, 21 nt, Human
cugggugccccguccacggcu

SEQ ID NO: 2579845 - RNA, 14 nt, Human
cugggugacauuug

SEQ ID NO: 2579846 - RNA, 23 nt, Human
cugggugacagagcaagacucug

SEQ ID NO: 2579847 - RNA, 17 nt, Human
cugggugacagagugag

SEQ ID NO: 2579848 - RNA, 18 nt, Human
cugggagaaauugacaga

SEQ ID NO: 2579849 - RNA, 14 nt, Human
cuggcccugccuuc

SEQ ID NO: 2579850 - RNA, 12 nt, Human
cuggcccugccu

SEQ ID NO: 2579851 - RNA, 12 nt, Human
cuggcccuuccu

SEQ ID NO: 2579852 - RNA, 13 nt, Human
cuggcccugugcc

SEQ ID NO: 2579853 - RNA, 12 nt, Human
cuggcccuggcu

SEQ ID NO: 2579854 - RNA, 17 nt, Human
cuggccgaggguccugg

SEQ ID NO: 2579855 - RNA, 21 nt, Human
cuggccgaggguccuggcucc

SEQ ID NO: 2579856 - RNA, 23 nt, Human
cuggcuagaggccagccccaccc

SEQ ID NO: 2579857 - RNA, 19 nt, Human
cuggccgaggguccuggcu

SEQ ID NO: 2579858 - RNA, 20 nt, Human
cuggccgaggguccuggcuc

SEQ ID NO: 2579859 - RNA, 13 nt, Human
cuggcuaugcauu

SEQ ID NO: 2579860 - RNA, 14 nt, Human
cuggcuaugcauuu

SEQ ID NO: 2579861 - RNA, 22 nt, Human
cuggcuagaguccucacuccca

SEQ ID NO: 2579862 - RNA, 20 nt, Human
cuggcuagaguccucacucc

SEQ ID NO: 2579863 - RNA, 21 nt, Human
cuggcuagaguccucacuccc

SEQ ID NO: 2579864 - RNA, 16 nt, Human
cuggcuagaguccuca

SEQ ID NO: 2579865 - RNA, 17 nt, Human
cuggcuagaguccucac

SEQ ID NO: 2579866 - RNA, 18 nt, Human
cuggcuagaguccucacu

SEQ ID NO: 2579867 - RNA, 19 nt, Human
cuggcuagaguccucacuc

SEQ ID NO: 2579868 - RNA, 15 nt, Human
cuggcuaugcauuug

SEQ ID NO: 2579869 - RNA, 16 nt, Human
cuggcuaugcauuuga

SEQ ID NO: 2579870 - RNA, 22 nt, Human
cuggcuaugcauuugaaaauuu

SEQ ID NO: 2579871 - RNA, 22 nt, Human
cugggagaaccaaaaagaggcu

SEQ ID NO: 2579872 - RNA, 17 nt, Human
cugggagaaaugaaaaa

SEQ ID NO: 2579873 - RNA, 18 nt, Human
cugggacuugcaaaaagg

SEQ ID NO: 2579874 - RNA, 21 nt, Human
cugggacguggcucagccagc

SEQ ID NO: 2579875 - RNA, 23 nt, Human
cugggacguggcucagccagcac

SEQ ID NO: 2579876 - RNA, 16 nt, Human
cugggagaaaugaaaa

SEQ ID NO: 2579877 - RNA, 16 nt, Human
cugggacuacaggcac

SEQ ID NO: 2579878 - RNA, 15 nt, Human
cugggacuacaggca

SEQ ID NO: 2579879 - RNA, 13 nt, Human
cugggacuacagg

SEQ ID NO: 2579880 - RNA, 18 nt, Human
cugggacguggcucagcc

SEQ ID NO: 2579881 - RNA, 16 nt, Human
cugggaccacgugaga

SEQ ID NO: 2579882 - RNA, 20 nt, Human
cugggacguggcucagccag

SEQ ID NO: 2579883 - RNA, 14 nt, Human
cugggaccacguga

SEQ ID NO: 2579884 - RNA, 22 nt, Human
cugggaccacagguucaugcca

SEQ ID NO: 2579885 - RNA, 22 nt, Human
cugggacaugggaaaggggaag

SEQ ID NO: 2579886 - RNA, 18 nt, Human
cugggacaugggaaaggg

SEQ ID NO: 2579887 - RNA, 14 nt, Human
cugggacaugggaa

SEQ ID NO: 2579888 - RNA, 12 nt, Human
cuggcuccucaa

SEQ ID NO: 2579889 - RNA, 20 nt, Human
cuggcuccguccaggagccu

SEQ ID NO: 2579890 - RNA, 23 nt, Human
cuggcucccucuuggucuuccca

SEQ ID NO: 2579891 - RNA, 24 nt, Human
cuggcucccucuuggucuucccag

SEQ ID NO: 2579892 - RNA, 14 nt, Human
cuggcuccugaggg

SEQ ID NO: 2579893 - RNA, 15 nt, Human
cuggcuccugagggg

SEQ ID NO: 2579894 - RNA, 16 nt, Human
cuggcuccugaggggc

SEQ ID NO: 2579895 - RNA, 17 nt, Human
cuggcuccugaggggca

SEQ ID NO: 2579896 - RNA, 22 nt, Human
cuggcucccucuuggucuuccc

SEQ ID NO: 2579897 - RNA, 15 nt, Human
cugcugucucagccu

SEQ ID NO: 2579898 - RNA, 14 nt, Human
cugcugucucagcc

SEQ ID NO: 2579899 - RNA, 20 nt, Human
cugcugucuaaccugugacc

SEQ ID NO: 2579900 - RNA, 20 nt, Human
cugcuuaacuucacauauug

SEQ ID NO: 2579901 - RNA, 14 nt, Human
cugcugugugccuu

SEQ ID NO: 2579902 - RNA, 22 nt, Human
cugcugugauuccacuacaccu

SEQ ID NO: 2579903 - RNA, 16 nt, Human
cugcugugauuccacu

SEQ ID NO: 2579904 - RNA, 19 nt, Human
cugcugugcugugcccaag

SEQ ID NO: 2579905 - RNA, 23 nt, Human
cugcugugaauuuguguaaggau

SEQ ID NO: 2579906 - RNA, 16 nt, Human
cugcugaaggcucauu

SEQ ID NO: 2579907 - RNA, 14 nt, Human
cugcucacauaucu

SEQ ID NO: 2579908 - RNA, 19 nt, Human
cugcucacuaccuccucag

SEQ ID NO: 2579909 - RNA, 16 nt, Human
cugcucacuaccuccu

SEQ ID NO: 2579910 - RNA, 12 nt, Human
cugcugaaggcu

SEQ ID NO: 2579911 - RNA, 19 nt, Human
cugcucacauaucugucau

SEQ ID NO: 2579912 - RNA, 16 nt, Human
cugcucacauaucugu

SEQ ID NO: 2579913 - RNA, 14 nt, Human
cugcugaaggcucg

SEQ ID NO: 2579914 - RNA, 13 nt, Human
cugcugaaggcuc

SEQ ID NO: 2579915 - RNA, 15 nt, Human
cugcugaaggcucga

SEQ ID NO: 2579916 - RNA, 12 nt, Human
cugcugacagug

SEQ ID NO: 2579917 - RNA, 21 nt, Human
cugcucacuaccuccucaggg

SEQ ID NO: 2579918 - RNA, 20 nt, Human
cugcucacuaccuccucagg

SEQ ID NO: 2579919 - RNA, 11 nt, Human
cugcugacagu

SEQ ID NO: 2579920 - RNA, 19 nt, Human
cugcugagucccaggcuga

SEQ ID NO: 2579921 - RNA, 23 nt, Human
cugcugagucccaggcugagccu

SEQ ID NO: 2579922 - RNA, 15 nt, Human
cugcugacaguguug

SEQ ID NO: 2579923 - RNA, 13 nt, Human
cugcugacagugu

SEQ ID NO: 2579924 - RNA, 20 nt, Human
cuggaugauggucuucagcc

SEQ ID NO: 2579925 - RNA, 22 nt, Human
cuggaugcagccucacaguccu

SEQ ID NO: 2579926 - RNA, 23 nt, Human
cuggaugaagauucuccugugcu

SEQ ID NO: 2579927 - RNA, 13 nt, Human
cuggaugaagauu

SEQ ID NO: 2579928 - RNA, 13 nt, Human
cuggaugaaauuu

SEQ ID NO: 2579929 - RNA, 22 nt, Human
cuggaugaaauaacuccuucuu

SEQ ID NO: 2579930 - RNA, 13 nt, Human
cuggaugagacuu

SEQ ID NO: 2579931 - RNA, 14 nt, Human
cuggaugcauuucu

SEQ ID NO: 2579932 - RNA, 18 nt, Human
cuggauggagcccaggcg

SEQ ID NO: 2579933 - RNA, 17 nt, Human
cuggauggagcccaggc

SEQ ID NO: 2579934 - RNA, 16 nt, Human
cuggauggagcccagg

SEQ ID NO: 2579935 - RNA, 15 nt, Human
cuggauggagcccag

SEQ ID NO: 2579936 - RNA, 11 nt, Human
cuggauggagc

SEQ ID NO: 2579937 - RNA, 16 nt, Human
cuggaugcuccuucca

SEQ ID NO: 2579938 - RNA, 23 nt, Human
cuggauggagcccaggcgggagc

SEQ ID NO: 2579939 - RNA, 17 nt, Human
cuggaguucugguuccu

SEQ ID NO: 2579940 - RNA, 16 nt, Human
cuggaguucugguucc

SEQ ID NO: 2579941 - RNA, 15 nt, Human
cuggaguugaucugg

SEQ ID NO: 2579942 - RNA, 16 nt, Human
cuggaguugaucugga

SEQ ID NO: 2579943 - RNA, 17 nt, Human
cuggaguugaucuggaa

SEQ ID NO: 2579944 - RNA, 15 nt, Human
cuggaucuccccacu

SEQ ID NO: 2579945 - RNA, 14 nt, Human
cuggaucugugagg

SEQ ID NO: 2579946 - RNA, 23 nt, Human
cuggaucuccucaaguccccaag

SEQ ID NO: 2579947 - RNA, 20 nt, Human
cuggaucugggacccuuucc

SEQ ID NO: 2579948 - RNA, 21 nt, Human
cuggaucugggacccuuuccu

SEQ ID NO: 2579949 - RNA, 21 nt, Human
cuggagacagccccagagcag

SEQ ID NO: 2579950 - RNA, 20 nt, Human
cuggagacagccccagagca

SEQ ID NO: 2579951 - RNA, 19 nt, Human
cuggagacagccccagagc

SEQ ID NO: 2579952 - RNA, 17 nt, Human
cuggagacagccccaga

SEQ ID NO: 2579953 - RNA, 16 nt, Human
cuggagacagccccag

SEQ ID NO: 2579954 - RNA, 15 nt, Human
cuggagacagcccca

SEQ ID NO: 2579955 - RNA, 14 nt, Human
cuggagacagcccc

SEQ ID NO: 2579956 - RNA, 13 nt, Human
cuggagacagccc

SEQ ID NO: 2579957 - RNA, 15 nt, Human
cuggaguucugguuc

SEQ ID NO: 2579958 - RNA, 13 nt, Human
cuggagaagcuga

SEQ ID NO: 2579959 - RNA, 22 nt, Human
cuggagaagcucccaggaacaa

SEQ ID NO: 2579960 - RNA, 20 nt, Human
cuggagaagcucccaggaac

SEQ ID NO: 2579961 - RNA, 19 nt, Human
cuggagaagcucccaggaa

SEQ ID NO: 2579962 - RNA, 15 nt, Human
cuggagaagcuccca

SEQ ID NO: 2579963 - RNA, 19 nt, Human
cuggagaagcucacccaau

SEQ ID NO: 2579964 - RNA, 18 nt, Human
cuggagaagcucacccaa

SEQ ID NO: 2579965 - RNA, 21 nt, Human
cuggagaagcagugagccgca

SEQ ID NO: 2579966 - RNA, 17 nt, Human
cuggagaagcugaugcu

SEQ ID NO: 2579967 - RNA, 15 nt, Human
cuggagaagcugaug

SEQ ID NO: 2579968 - RNA, 19 nt, Human
cuggagaagcugaugcuuu

SEQ ID NO: 2579969 - RNA, 22 nt, Human
cuggagaagucuuagacuugaa

SEQ ID NO: 2579970 - RNA, 11 nt, Human
cuggagacagc

SEQ ID NO: 2579971 - RNA, 23 nt, Human
cuggacugugugcucaggagccc

SEQ ID NO: 2579972 - RNA, 23 nt, Human
cugcuuaucaauaaaccuguuug

SEQ ID NO: 2579973 - RNA, 13 nt, Human
cuggacuugagcu

SEQ ID NO: 2579974 - RNA, 16 nt, Human
cuggagaagagaggag

SEQ ID NO: 2579975 - RNA, 18 nt, Human
cugcuuaggagagaccga

SEQ ID NO: 2579976 - RNA, 15 nt, Human
cuggacuugagcuug

SEQ ID NO: 2579977 - RNA, 19 nt, Human
cuggagaagagaggagagg

SEQ ID NO: 2579978 - RNA, 18 nt, Human
cuggagaagagaggagag

SEQ ID NO: 2579979 - RNA, 20 nt, Human
cuggagaagagaggagagga

SEQ ID NO: 2579980 - RNA, 14 nt, Human
cuggagaagcagug

SEQ ID NO: 2579981 - RNA, 22 nt, Human
cuggacugugugcucaggagcc

SEQ ID NO: 2579982 - RNA, 19 nt, Human
cuggacugugugcucagga

SEQ ID NO: 2579983 - RNA, 23 nt, Human
cugcuuaccagauaaugcuacuu

SEQ ID NO: 2579984 - RNA, 22 nt, Human
cugcuuacaauucccugcuguc

SEQ ID NO: 2579985 - RNA, 20 nt, Human
cugcuuagaauccaaacuug

SEQ ID NO: 2579986 - RNA, 16 nt, Human
cugcuuaggagagacc

SEQ ID NO: 2579987 - RNA, 15 nt, Human
cugcuuaggagagac

SEQ ID NO: 2579988 - RNA, 20 nt, Human
cugcuuacaauucccugcug

SEQ ID NO: 2579989 - RNA, 18 nt, Human
cugcuuacaauucccugc

SEQ ID NO: 2579990 - RNA, 14 nt, Human
cugcuuaaugaaaa

SEQ ID NO: 2579991 - RNA, 14 nt, Human
cuguugcugccuca

SEQ ID NO: 2579992 - RNA, 15 nt, Human
cuguugcugccucau

SEQ ID NO: 2579993 - RNA, 16 nt, Human
cuguugcugccucaug

SEQ ID NO: 2579994 - RNA, 17 nt, Human
cuguugcugccucaugc

SEQ ID NO: 2579995 - RNA, 15 nt, Human
cuguugcuuacaauu

SEQ ID NO: 2579996 - RNA, 19 nt, Human
cuuaccucggugccuuccu

SEQ ID NO: 2579997 - RNA, 21 nt, Human
cuuaccucggugccuuccucu

SEQ ID NO: 2579998 - RNA, 19 nt, Human
cuuagauguauauauuucc

SEQ ID NO: 2579999 - RNA, 13 nt, Human
cuuaccugccagg

SEQ ID NO: 2580000 - RNA, 17 nt, Human
cuuaccuccugcccagg

SEQ ID NO: 2580001 - RNA, 18 nt, Human
cuuaccuccugcccagga

SEQ ID NO: 2580002 - RNA, 19 nt, Human
cuuaccuccugcccaggag

SEQ ID NO: 2580003 - RNA, 20 nt, Human
cuuaccuccugcccaggaga

SEQ ID NO: 2580004 - RNA, 15 nt, Human
cuuaccucuuccgga

SEQ ID NO: 2580005 - RNA, 20 nt, Human
cuuagauuagcucuggacca

SEQ ID NO: 2580006 - RNA, 18 nt, Human
cuuagauuagcucuggac

SEQ ID NO: 2580007 - RNA, 17 nt, Human
cuuagauuagcucugga

SEQ ID NO: 2580008 - RNA, 16 nt, Human
cuuagauuagcucugg

SEQ ID NO: 2580009 - RNA, 21 nt, Human
cuuagauuagcucuggaccag

SEQ ID NO: 2580010 - RNA, 14 nt, Human
cuuagauguucuaa

SEQ ID NO: 2580011 - RNA, 18 nt, Human
cuuagauguucuaagucu

SEQ ID NO: 2580012 - RNA, 20 nt, Human
cuuagauguuccaguaaucu

SEQ ID NO: 2580013 - RNA, 13 nt, Human
cuuaccucuuccg

SEQ ID NO: 2580014 - RNA, 21 nt, Human
cuuagcacuaccacuccugcc

SEQ ID NO: 2580015 - RNA, 14 nt, Human
cuuagcagaugcug

SEQ ID NO: 2580016 - RNA, 16 nt, Human
cuuagcagcuaucucu

SEQ ID NO: 2580017 - RNA, 18 nt, Human
cuuaccuaccacaugcca

SEQ ID NO: 2580018 - RNA, 22 nt, Human
cuuaccuaaacagauauaaaug

SEQ ID NO: 2580019 - RNA, 20 nt, Human
cuuaccgugagcgacaaaga

SEQ ID NO: 2580020 - RNA, 19 nt, Human
cuuaccuaaacagauauaa

SEQ ID NO: 2580021 - RNA, 18 nt, Human
cuuaccuaaacagauaua

SEQ ID NO: 2580022 - RNA, 17 nt, Human
cuuacccucaccuguca

SEQ ID NO: 2580023 - RNA, 16 nt, Human
cuuacagccucugacu

SEQ ID NO: 2580024 - RNA, 20 nt, Human
cuuaccccuuagccucccug

SEQ ID NO: 2580025 - RNA, 15 nt, Human
cuuacccuuagggag

SEQ ID NO: 2580026 - RNA, 13 nt, Human
cuuaccucggugc

SEQ ID NO: 2580027 - RNA, 13 nt, Human
cuuaccuccugcc

SEQ ID NO: 2580028 - RNA, 21 nt, Human
cuuaccuaaacagauauaaau

SEQ ID NO: 2580029 - RNA, 14 nt, Human
cuuaccuccugccc

SEQ ID NO: 2580030 - RNA, 15 nt, Human
cuuaccuccugccca

SEQ ID NO: 2580031 - RNA, 16 nt, Human
cuuaccuccugcccag

SEQ ID NO: 2580032 - RNA, 18 nt, Human
cuuacccucauguucuua

SEQ ID NO: 2580033 - RNA, 19 nt, Human
cuuacccucauguucuuaa

SEQ ID NO: 2580034 - RNA, 17 nt, Human
cuuacccucauguucuu

SEQ ID NO: 2580035 - RNA, 14 nt, Human
cuuacagcugggug

SEQ ID NO: 2580036 - RNA, 23 nt, Human
cuuacccaucugcaccccccugg

SEQ ID NO: 2580037 - RNA, 15 nt, Human
cuuacagccucugac

SEQ ID NO: 2580038 - RNA, 20 nt, Human
cuguugggccaggagccucc

SEQ ID NO: 2580039 - RNA, 17 nt, Human
cuguugggccaggagcc

SEQ ID NO: 2580040 - RNA, 16 nt, Human
cuguugggccaggagc

SEQ ID NO: 2580041 - RNA, 22 nt, Human
cuguuggacccgcucuggacca

SEQ ID NO: 2580042 - RNA, 19 nt, Human
cuguuggacccgcucugga

SEQ ID NO: 2580043 - RNA, 18 nt, Human
cuguuggacccgcucugg

SEQ ID NO: 2580044 - RNA, 16 nt, Human
cuguugcuuacaauuu

SEQ ID NO: 2580045 - RNA, 19 nt, Human
cuguuggauuuguuuaaaa

SEQ ID NO: 2580046 - RNA, 20 nt, Human
cuguuggacccgcucuggac

SEQ ID NO: 2580047 - RNA, 22 nt, Human
cuguuggauuuguuuaaaagga

SEQ ID NO: 2580048 - RNA, 18 nt, Human
cuguugggguggguauaa

SEQ ID NO: 2580049 - RNA, 17 nt, Human
cuguugggguggguaua

SEQ ID NO: 2580050 - RNA, 20 nt, Human
cuuaaaauauuccugcauuu

SEQ ID NO: 2580051 - RNA, 18 nt, Human
cuuaaaauauuccugcau

SEQ ID NO: 2580052 - RNA, 24 nt, Human
cuuaaaauguucacuuuugacaaa

SEQ ID NO: 2580053 - RNA, 14 nt, Human
cuuaaaauauuuua

SEQ ID NO: 2580054 - RNA, 17 nt, Human
cuuaaaauauauuucag

SEQ ID NO: 2580055 - RNA, 13 nt, Human
cuuaaaauauuuu

SEQ ID NO: 2580056 - RNA, 16 nt, Human
cuuaaagauuuaucaa

SEQ ID NO: 2580057 - RNA, 20 nt, Human
cuuaaagauuuaucaaauca

SEQ ID NO: 2580058 - RNA, 19 nt, Human
cuuaaagauuuaucaaauc

SEQ ID NO: 2580059 - RNA, 13 nt, Human
cuuaaacaaaaau

SEQ ID NO: 2580060 - RNA, 19 nt, Human
cuuaaacaaaaauuaaaau

SEQ ID NO: 2580061 - RNA, 20 nt, Human
cuuaaaggcaccaucuaaua

SEQ ID NO: 2580062 - RNA, 23 nt, Human
cuuaaaggcugugguaguacucc

SEQ ID NO: 2580063 - RNA, 18 nt, Human
cuuaaagcugccuguagu

SEQ ID NO: 2580064 - RNA, 23 nt, Human
cuuaaagcugccuguaguuagga

SEQ ID NO: 2580065 - RNA, 14 nt, Human
cuuaaagucaguaa

SEQ ID NO: 2580066 - RNA, 21 nt, Human
cuuaaaggugucuuccuccca

SEQ ID NO: 2580067 - RNA, 16 nt, Human
cuuaaaggugucuucc

SEQ ID NO: 2580068 - RNA, 18 nt, Human
cuuaaaggugucuuccuc

SEQ ID NO: 2580069 - RNA, 21 nt, Human
cuuaaaggcugugguaguacu

SEQ ID NO: 2580070 - RNA, 13 nt, Human
cuuacacaauggu

SEQ ID NO: 2580071 - RNA, 19 nt, Human
cuuacacaucucagacccu

SEQ ID NO: 2580072 - RNA, 13 nt, Human
cuuacacacaaaa

SEQ ID NO: 2580073 - RNA, 11 nt, Human
cuuacacccac

SEQ ID NO: 2580074 - RNA, 17 nt, Human
cuuacacuuacuguugu

SEQ ID NO: 2580075 - RNA, 20 nt, Human
cuuacacccacaguggaaag

SEQ ID NO: 2580076 - RNA, 14 nt, Human
cuguucagcuccag

SEQ ID NO: 2580077 - RNA, 16 nt, Human
cugugucuguguuuua

SEQ ID NO: 2580078 - RNA, 13 nt, Human
cuguucagcucca

SEQ ID NO: 2580079 - RNA, 22 nt, Human
cuguucagcuacucccacuccc

SEQ ID NO: 2580080 - RNA, 19 nt, Human
cugugucuugcaauggcag

SEQ ID NO: 2580081 - RNA, 16 nt, Human
cugugucuugcaaugg

SEQ ID NO: 2580082 - RNA, 15 nt, Human
cuguucacucuacuu

SEQ ID NO: 2580083 - RNA, 17 nt, Human
cuguucacuuuuccucc

SEQ ID NO: 2580084 - RNA, 18 nt, Human
cuguucacuuuuccuccc

SEQ ID NO: 2580085 - RNA, 16 nt, Human
cuguucacuuuuccuc

SEQ ID NO: 2580086 - RNA, 13 nt, Human
cugugucuguguu

SEQ ID NO: 2580087 - RNA, 23 nt, Human
cugugacauggugccugagaggc

SEQ ID NO: 2580088 - RNA, 22 nt, Human
cugugacauggugccugagagg

SEQ ID NO: 2580089 - RNA, 21 nt, Human
cugugacauggugccugagag

SEQ ID NO: 2580090 - RNA, 20 nt, Human
cugugacauggugccugaga

SEQ ID NO: 2580091 - RNA, 19 nt, Human
cugugacauggugccugag

SEQ ID NO: 2580092 - RNA, 18 nt, Human
cugugacauggugccuga

SEQ ID NO: 2580093 - RNA, 17 nt, Human
cugugacauggugccug

SEQ ID NO: 2580094 - RNA, 16 nt, Human
cugugacauggugccu

SEQ ID NO: 2580095 - RNA, 13 nt, Human
cugugacauguaa

SEQ ID NO: 2580096 - RNA, 24 nt, Human
cugugacauggugccugagaggca

SEQ ID NO: 2580097 - RNA, 15 nt, Human
cugugaccaaugucu

SEQ ID NO: 2580098 - RNA, 16 nt, Human
cugugaccaaugucuu

SEQ ID NO: 2580099 - RNA, 17 nt, Human
cugugaccaaugucuug

SEQ ID NO: 2580100 - RNA, 14 nt, Human
cugugaccagcacu

SEQ ID NO: 2580101 - RNA, 18 nt, Human
cugugaccaggaaggaag

SEQ ID NO: 2580102 - RNA, 23 nt, Human
cugugaccaggaaggaagucagc

SEQ ID NO: 2580103 - RNA, 16 nt, Human
cugugcgugaaacaca

SEQ ID NO: 2580104 - RNA, 14 nt, Human
cugugcgugaaaca

SEQ ID NO: 2580105 - RNA, 17 nt, Human
cugugcguuacuaauug

SEQ ID NO: 2580106 - RNA, 17 nt, Human
cugugcuacuuugccuu

SEQ ID NO: 2580107 - RNA, 16 nt, Human
cugugcuacuuugccu

SEQ ID NO: 2580108 - RNA, 14 nt, Human
cugugcuacuuugc

SEQ ID NO: 2580109 - RNA, 18 nt, Human
cugugcuaauaacagugc

SEQ ID NO: 2580110 - RNA, 21 nt, Human
cugugcuagggaaacuucccg

SEQ ID NO: 2580111 - RNA, 18 nt, Human
cugugcuacuuugccuuu

SEQ ID NO: 2580112 - RNA, 13 nt, Human
cugugcuaugaau

SEQ ID NO: 2580113 - RNA, 12 nt, Human
cugugcucagga

SEQ ID NO: 2580114 - RNA, 15 nt, Human
cugugcucaggacuc

SEQ ID NO: 2580115 - RNA, 16 nt, Human
cugugcucaggacuca

SEQ ID NO: 2580116 - RNA, 22 nt, Human
cugugcuagggaaacuucccgu

SEQ ID NO: 2580117 - RNA, 15 nt, Human
cugugcuaugaauuu

SEQ ID NO: 2580118 - RNA, 16 nt, Human
cugugcuaugaauuuu

SEQ ID NO: 2580119 - RNA, 22 nt, Human
cugugacuucagcucuguuuua

SEQ ID NO: 2580120 - RNA, 16 nt, Human
cugugacuucuccagg

SEQ ID NO: 2580121 - RNA, 14 nt, Human
cugugacugauguu

SEQ ID NO: 2580122 - RNA, 12 nt, Human
cugugagacagu

SEQ ID NO: 2580123 - RNA, 21 nt, Human
cugugacuucuccaggucuca

SEQ ID NO: 2580124 - RNA, 19 nt, Human
cugugagacagugggaaau

SEQ ID NO: 2580125 - RNA, 15 nt, Human
cugugagacaguggg

SEQ ID NO: 2580126 - RNA, 14 nt, Human
cugugagaccccca

SEQ ID NO: 2580127 - RNA, 13 nt, Human
cugugaccugugg

SEQ ID NO: 2580128 - RNA, 14 nt, Human
cugugaccuguggg

SEQ ID NO: 2580129 - RNA, 15 nt, Human
cugugaccugugggg

SEQ ID NO: 2580130 - RNA, 23 nt, Human
cugugaccagucugacccuuaca

SEQ ID NO: 2580131 - RNA, 20 nt, Human
cugugaccagcacugucuca

SEQ ID NO: 2580132 - RNA, 17 nt, Human
cugugacuucagcucug

SEQ ID NO: 2580133 - RNA, 14 nt, Human
cugugacucuuuuu

SEQ ID NO: 2580134 - RNA, 16 nt, Human
cugugaccugugggga

SEQ ID NO: 2580135 - RNA, 22 nt, Human
cugugcugagucugaaggcugg

SEQ ID NO: 2580136 - RNA, 20 nt, Human
cugugcugagucugaaggcu

SEQ ID NO: 2580137 - RNA, 11 nt, Human
cugugcugccc

SEQ ID NO: 2580138 - RNA, 20 nt, Human
cugugcugcccgucuucagc

SEQ ID NO: 2580139 - RNA, 22 nt, Human
cugugcugcccgucuucagccu

SEQ ID NO: 2580140 - RNA, 20 nt, Human
cuguguacauaacugaaaau

SEQ ID NO: 2580141 - RNA, 22 nt, Human
cuguguacauaacugaaaaugu

SEQ ID NO: 2580142 - RNA, 17 nt, Human
cuguguacauaacugaa

SEQ ID NO: 2580143 - RNA, 19 nt, Human
cuguguacauaacugaaaa

SEQ ID NO: 2580144 - RNA, 16 nt, Human
cuguguacaaagaaau

SEQ ID NO: 2580145 - RNA, 15 nt, Human
cuguguacaaagaaa

SEQ ID NO: 2580146 - RNA, 21 nt, Human
cuguguacagaauucugcuac

SEQ ID NO: 2580147 - RNA, 14 nt, Human
cuguguacaaagaa

SEQ ID NO: 2580148 - RNA, 19 nt, Human
cuguguaaucauuucuugg

SEQ ID NO: 2580149 - RNA, 22 nt, Human
cuguguaacagcuccuugggag

SEQ ID NO: 2580150 - RNA, 18 nt, Human
cuguguaacagcuccuug

SEQ ID NO: 2580151 - RNA, 19 nt, Human
cuguguaacagcuccuugg

SEQ ID NO: 2580152 - RNA, 19 nt, Human
cugugucagguggggcagc

SEQ ID NO: 2580153 - RNA, 20 nt, Human
cugugucagcauagaaguaa

SEQ ID NO: 2580154 - RNA, 21 nt, Human
cugugucagguggggcagcuu

SEQ ID NO: 2580155 - RNA, 19 nt, Human
cugugucucccuucauccu

SEQ ID NO: 2580156 - RNA, 14 nt, Human
cugugucucccuuc

SEQ ID NO: 2580157 - RNA, 14 nt, Human
cugugucuugcaau

SEQ ID NO: 2580158 - RNA, 17 nt, Human
cugugucucuuuucucu

SEQ ID NO: 2580159 - RNA, 22 nt, Human
cuuccaugucggccucuaaccc

SEQ ID NO: 2580160 - RNA, 18 nt, Human
cuuccaugucggccucua

SEQ ID NO: 2580161 - RNA, 19 nt, Human
cuuccauggcccucauuaa

SEQ ID NO: 2580162 - RNA, 14 nt, Human
cuuccauguggaga

SEQ ID NO: 2580163 - RNA, 12 nt, Human
cuuccaugugga

SEQ ID NO: 2580164 - RNA, 20 nt, Human
cuuccaugucgccucugcau

SEQ ID NO: 2580165 - RNA, 19 nt, Human
cuuccaugucgccucugca

SEQ ID NO: 2580166 - RNA, 18 nt, Human
cuuccaugucgccucugc

SEQ ID NO: 2580167 - RNA, 17 nt, Human
cuuccaugucgccucug

SEQ ID NO: 2580168 - RNA, 20 nt, Human
cuuccagugaggcucugccc

SEQ ID NO: 2580169 - RNA, 19 nt, Human
cuuccagugaggcucugcc

SEQ ID NO: 2580170 - RNA, 17 nt, Human
cuuccagugaggcucug

SEQ ID NO: 2580171 - RNA, 18 nt, Human
cuuccagugaggcucugc

SEQ ID NO: 2580172 - RNA, 17 nt, Human
cuuccauggacuuuguu

SEQ ID NO: 2580173 - RNA, 16 nt, Human
cuuccauggacuuugu

SEQ ID NO: 2580174 - RNA, 16 nt, Human
cuuccauggcccucau

SEQ ID NO: 2580175 - RNA, 21 nt, Human
cuuccaugagaacagcagggu

SEQ ID NO: 2580176 - RNA, 14 nt, Human
cuuccaugauucua

SEQ ID NO: 2580177 - RNA, 17 nt, Human
cuuccaugauucuauuu

SEQ ID NO: 2580178 - RNA, 16 nt, Human
cuuccaugucgccucu

SEQ ID NO: 2580179 - RNA, 15 nt, Human
cuuccaugucgccuc

SEQ ID NO: 2580180 - RNA, 19 nt, Human
cuucaucucccaccuagca

SEQ ID NO: 2580181 - RNA, 20 nt, Human
cuucaucucccaccuagcag

SEQ ID NO: 2580182 - RNA, 17 nt, Human
cuucaucuccagggagu

SEQ ID NO: 2580183 - RNA, 13 nt, Human
cuucaucuccagg

SEQ ID NO: 2580184 - RNA, 13 nt, Human
cuucaucucccac

SEQ ID NO: 2580185 - RNA, 22 nt, Human
cuucaucucccaaagugcuggg

SEQ ID NO: 2580186 - RNA, 16 nt, Human
cuucauccuccucaga

SEQ ID NO: 2580187 - RNA, 11 nt, Human
cuucauccucu

SEQ ID NO: 2580188 - RNA, 15 nt, Human
cuucaucgaaucuac

SEQ ID NO: 2580189 - RNA, 17 nt, Human
cuucaucgaaucuacua

SEQ ID NO: 2580190 - RNA, 19 nt, Human
cuucaucguggggcucuca

SEQ ID NO: 2580191 - RNA, 23 nt, Human
cuucaugcugucuacacuaagag

SEQ ID NO: 2580192 - RNA, 17 nt, Human
cuucaugcucagcccug

SEQ ID NO: 2580193 - RNA, 19 nt, Human
cuucaugcucagcccugac

SEQ ID NO: 2580194 - RNA, 21 nt, Human
cuucaugcauggaaauucccu

SEQ ID NO: 2580195 - RNA, 23 nt, Human
cuucaugcauggaaauucccuuc

SEQ ID NO: 2580196 - RNA, 15 nt, Human
cuucaugccagcuac

SEQ ID NO: 2580197 - RNA, 14 nt, Human
cuucaugccagcua

SEQ ID NO: 2580198 - RNA, 16 nt, Human
cuucaugccagcuacu

SEQ ID NO: 2580199 - RNA, 15 nt, Human
cuucaugcucagccc

SEQ ID NO: 2580200 - RNA, 23 nt, Human
cuucagagacuccugcaggcagc

SEQ ID NO: 2580201 - RNA, 17 nt, Human
cuucaguuaagccuuug

SEQ ID NO: 2580202 - RNA, 17 nt, Human
cuucaguguauggaaau

SEQ ID NO: 2580203 - RNA, 13 nt, Human
cuucagugggaga

SEQ ID NO: 2580204 - RNA, 15 nt, Human
cuucagugggagaaa

SEQ ID NO: 2580205 - RNA, 18 nt, Human
cuucaguggcagcugcuu

SEQ ID NO: 2580206 - RNA, 13 nt, Human
cuucaucccucug

SEQ ID NO: 2580207 - RNA, 20 nt, Human
cuucaguguauggaaauaaa

SEQ ID NO: 2580208 - RNA, 18 nt, Human
cuucaguuaagccuuugg

SEQ ID NO: 2580209 - RNA, 15 nt, Human
cuucauccuccucag

SEQ ID NO: 2580210 - RNA, 19 nt, Human
cuucauccggcagccugga

SEQ ID NO: 2580211 - RNA, 17 nt, Human
cuucaucccacaaucuu

SEQ ID NO: 2580212 - RNA, 18 nt, Human
cuucagugggagaaaaca

SEQ ID NO: 2580213 - RNA, 22 nt, Human
cuucagagacuccugcaggcag

SEQ ID NO: 2580214 - RNA, 21 nt, Human
cuucagagacuccugcaggca

SEQ ID NO: 2580215 - RNA, 16 nt, Human
cuucagagacuccugc

SEQ ID NO: 2580216 - RNA, 19 nt, Human
cuucagacuuugcuuccca

SEQ ID NO: 2580217 - RNA, 18 nt, Human
cuucagacuuugcuuccc

SEQ ID NO: 2580218 - RNA, 20 nt, Human
cuucagacagagaggacugu

SEQ ID NO: 2580219 - RNA, 15 nt, Human
cuucagacuuugcuu

SEQ ID NO: 2580220 - RNA, 14 nt, Human
cuucagacuuugcu

SEQ ID NO: 2580221 - RNA, 21 nt, Human
cuucacuuuaauucucaugug

SEQ ID NO: 2580222 - RNA, 16 nt, Human
cuucacuuuaauucuc

SEQ ID NO: 2580223 - RNA, 15 nt, Human
cuucacuuuaauucu

SEQ ID NO: 2580224 - RNA, 14 nt, Human
cuucacuucuccca

SEQ ID NO: 2580225 - RNA, 13 nt, Human
cuucacuucuccc

SEQ ID NO: 2580226 - RNA, 15 nt, Human
cuucacuucugacca

SEQ ID NO: 2580227 - RNA, 16 nt, Human
cuucacuucugaccac

SEQ ID NO: 2580228 - RNA, 17 nt, Human
cuucacuucugaccaca

SEQ ID NO: 2580229 - RNA, 19 nt, Human
cuucacuucugaccacacu

SEQ ID NO: 2580230 - RNA, 21 nt, Human
cuucacuucugaccacacuuc

SEQ ID NO: 2580231 - RNA, 11 nt, Human
cuucagacaua

SEQ ID NO: 2580232 - RNA, 16 nt, Human
cuucagaaugugauuu

SEQ ID NO: 2580233 - RNA, 20 nt, Human
cuucagaaagugugcuuuau

SEQ ID NO: 2580234 - RNA, 19 nt, Human
cuucagacagagaggacug

SEQ ID NO: 2580235 - RNA, 19 nt, Human
cuucagacacaaaagucca

SEQ ID NO: 2580236 - RNA, 17 nt, Human
cuucagaagacacugca

SEQ ID NO: 2580237 - RNA, 18 nt, Human
cuuauugcccacgcugga

SEQ ID NO: 2580238 - RNA, 11 nt, Human
cuuauuagaac

SEQ ID NO: 2580239 - RNA, 17 nt, Human
cuuauuagaacaggcaa

SEQ ID NO: 2580240 - RNA, 14 nt, Human
cuucaccuuugucc

SEQ ID NO: 2580241 - RNA, 15 nt, Human
cuucaccucacugaa

SEQ ID NO: 2580242 - RNA, 20 nt, Human
cuucaccuuuguccccaccg

SEQ ID NO: 2580243 - RNA, 17 nt, Human
cuucaccuuugucccca

SEQ ID NO: 2580244 - RNA, 21 nt, Human
cuucaccugauucaacuaaaa

SEQ ID NO: 2580245 - RNA, 18 nt, Human
cuucaccugauucaacua

SEQ ID NO: 2580246 - RNA, 20 nt, Human
cuucaccugauucaacuaaa

SEQ ID NO: 2580247 - RNA, 18 nt, Human
cuucacuguccuccaagc

SEQ ID NO: 2580248 - RNA, 21 nt, Human
cuucacuguccuccaagccag

SEQ ID NO: 2580249 - RNA, 19 nt, Human
cuucacuguugaaaauuau

SEQ ID NO: 2580250 - RNA, 18 nt, Human
cuucacuguugaaaauua

SEQ ID NO: 2580251 - RNA, 16 nt, Human
cuucacuguugaaaau

SEQ ID NO: 2580252 - RNA, 15 nt, Human
cuucacuguugaaaa

SEQ ID NO: 2580253 - RNA, 17 nt, Human
cuucacuguccuccaag

SEQ ID NO: 2580254 - RNA, 18 nt, Human
cuuagcagggaaacagcu

SEQ ID NO: 2580255 - RNA, 17 nt, Human
cuuagcagcuuccagau

SEQ ID NO: 2580256 - RNA, 16 nt, Human
cuuagcagcuuccaga

SEQ ID NO: 2580257 - RNA, 15 nt, Human
cuuagcagcuuccag

SEQ ID NO: 2580258 - RNA, 22 nt, Human
cuuagcagcuaucucucaguga

SEQ ID NO: 2580259 - RNA, 23 nt, Human
cuuagcagcuaucucucagugaa

SEQ ID NO: 2580260 - RNA, 21 nt, Human
cuuagcagggaaacagcuaau

SEQ ID NO: 2580261 - RNA, 14 nt, Human
cuuagcaggagagg

SEQ ID NO: 2580262 - RNA, 13 nt, Human
cuuagcaggagag

SEQ ID NO: 2580263 - RNA, 18 nt, Human
cuuagcagcuuccagauu

SEQ ID NO: 2580264 - RNA, 22 nt, Human
cuuagcaggagaggagagccag

SEQ ID NO: 2580265 - RNA, 21 nt, Human
cuuagcaggagaggagagcca

SEQ ID NO: 2580266 - RNA, 16 nt, Human
cuuauggaauugauuu

SEQ ID NO: 2580267 - RNA, 17 nt, Human
cuuauggaauugauuug

SEQ ID NO: 2580268 - RNA, 19 nt, Human
cuuauggaauugauuugca

SEQ ID NO: 2580269 - RNA, 20 nt, Human
cuuauggaauugauuugcau

SEQ ID NO: 2580270 - RNA, 21 nt, Human
cuuauggaauugauuugcauu

SEQ ID NO: 2580271 - RNA, 23 nt, Human
cuuauggaauugauuugcauuga

SEQ ID NO: 2580272 - RNA, 21 nt, Human
cuuaugggcuggguucuaccc

SEQ ID NO: 2580273 - RNA, 14 nt, Human
cuuaugggcugggu

SEQ ID NO: 2580274 - RNA, 14 nt, Human
cuuauggaauugau

SEQ ID NO: 2580275 - RNA, 21 nt, Human
cuuauggaacacucugagacu

SEQ ID NO: 2580276 - RNA, 23 nt, Human
cuuaugggcuggguucuacccag

SEQ ID NO: 2580277 - RNA, 22 nt, Human
cuuaugggcuggguucuaccca

SEQ ID NO: 2580278 - RNA, 19 nt, Human
cuuauguagcaggaaauaa

SEQ ID NO: 2580279 - RNA, 18 nt, Human
cuuauuaaaguucuguaa

SEQ ID NO: 2580280 - RNA, 14 nt, Human
cuuauuaaaguucu

SEQ ID NO: 2580281 - RNA, 13 nt, Human
cuuauuaaaguuc

SEQ ID NO: 2580282 - RNA, 13 nt, Human
cuuauugcccacg

SEQ ID NO: 2580283 - RNA, 12 nt, Human
cuuauugcccac

SEQ ID NO: 2580284 - RNA, 18 nt, Human
cuuggccaguuaucccuu

SEQ ID NO: 2580285 - RNA, 22 nt, Human
cuuggccagaagggggccauga

SEQ ID NO: 2580286 - RNA, 17 nt, Human
cuuggcaugccuuccag

SEQ ID NO: 2580287 - RNA, 20 nt, Human
cuuggcaugccuuccagcac

SEQ ID NO: 2580288 - RNA, 17 nt, Human
cuuggccaagcagggag

SEQ ID NO: 2580289 - RNA, 15 nt, Human
cuuggccaagcaggg

SEQ ID NO: 2580290 - RNA, 17 nt, Human
cuuggccagaagggggc

SEQ ID NO: 2580291 - RNA, 14 nt, Human
cuugcucugcaccc

SEQ ID NO: 2580292 - RNA, 13 nt, Human
cuugcucugcacc

SEQ ID NO: 2580293 - RNA, 22 nt, Human
cuugcucucuggccuuuuccua

SEQ ID NO: 2580294 - RNA, 19 nt, Human
cuuggcaucacagggcaga

SEQ ID NO: 2580295 - RNA, 20 nt, Human
cuuggcaucacagggcagag

SEQ ID NO: 2580296 - RNA, 22 nt, Human
cuuggcaucacagggcagagcc

SEQ ID NO: 2580297 - RNA, 16 nt, Human
cuuggcaucagcuggc

SEQ ID NO: 2580298 - RNA, 14 nt, Human
cuugcucugcaggc

SEQ ID NO: 2580299 - RNA, 17 nt, Human
cuuggcaucagcuggcg

SEQ ID NO: 2580300 - RNA, 16 nt, Human
cuuggcaugccuucca

SEQ ID NO: 2580301 - RNA, 12 nt, Human
cuugcucugcug

SEQ ID NO: 2580302 - RNA, 15 nt, Human
cuugcucucuggccu

SEQ ID NO: 2580303 - RNA, 20 nt, Human
cuugcucucccucuucucaa

SEQ ID NO: 2580304 - RNA, 17 nt, Human
cuugcucucccucuucu

SEQ ID NO: 2580305 - RNA, 15 nt, Human
cuugcucucccucuu

SEQ ID NO: 2580306 - RNA, 20 nt, Human
cuugcucuccccugcccugc

SEQ ID NO: 2580307 - RNA, 14 nt, Human
cuugcucucccucu

SEQ ID NO: 2580308 - RNA, 20 nt, Human
cuugcucgcuguaaaaucuu

SEQ ID NO: 2580309 - RNA, 16 nt, Human
cuugccugcacaaacu

SEQ ID NO: 2580310 - RNA, 14 nt, Human
cuugccugauauaa

SEQ ID NO: 2580311 - RNA, 22 nt, Human
cuugccugaacauccuuccuuc

SEQ ID NO: 2580312 - RNA, 20 nt, Human
cuugccugaacauccuuccu

SEQ ID NO: 2580313 - RNA, 18 nt, Human
cuugccugaacauccuuc

SEQ ID NO: 2580314 - RNA, 17 nt, Human
cuugccugaacauccuu

SEQ ID NO: 2580315 - RNA, 19 nt, Human
cuugcucuccccugcccug

SEQ ID NO: 2580316 - RNA, 18 nt, Human
cuugccucuuccuugaag

SEQ ID NO: 2580317 - RNA, 16 nt, Human
cuugccucuuccuuga

SEQ ID NO: 2580318 - RNA, 13 nt, Human
cuugccucuuccu

SEQ ID NO: 2580319 - RNA, 12 nt, Human
cuugccucuucc

SEQ ID NO: 2580320 - RNA, 20 nt, Human
cuugccucugugcugugugu

SEQ ID NO: 2580321 - RNA, 19 nt, Human
cuugccucugugcugugug

SEQ ID NO: 2580322 - RNA, 16 nt, Human
cuugccucugugcugu

SEQ ID NO: 2580323 - RNA, 15 nt, Human
cuugccucugugcug

SEQ ID NO: 2580324 - RNA, 14 nt, Human
cuugccucugugcu

SEQ ID NO: 2580325 - RNA, 13 nt, Human
cuugccucugugc

SEQ ID NO: 2580326 - RNA, 23 nt, Human
cuugccucuguccccuucucuca

SEQ ID NO: 2580327 - RNA, 19 nt, Human
cuugccucuguccccuucu

SEQ ID NO: 2580328 - RNA, 15 nt, Human
cuugccucaaugcca

SEQ ID NO: 2580329 - RNA, 16 nt, Human
cuugccuagggccugg

SEQ ID NO: 2580330 - RNA, 18 nt, Human
cuugccuagggccugguc

SEQ ID NO: 2580331 - RNA, 19 nt, Human
cuugccuagggccuggucc

SEQ ID NO: 2580332 - RNA, 20 nt, Human
cuugccuagggccuggucca

SEQ ID NO: 2580333 - RNA, 20 nt, Human
cuugccgucuaccugagggg

SEQ ID NO: 2580334 - RNA, 12 nt, Human
cuugacagggca

SEQ ID NO: 2580335 - RNA, 23 nt, Human
cuugccgucuaccugaggggccu

SEQ ID NO: 2580336 - RNA, 14 nt, Human
cuugccuagggccu

SEQ ID NO: 2580337 - RNA, 18 nt, Human
cuugaauccuagggccug

SEQ ID NO: 2580338 - RNA, 14 nt, Human
cuugaauccuaggg

SEQ ID NO: 2580339 - RNA, 14 nt, Human
cuugacaacaucug

SEQ ID NO: 2580340 - RNA, 22 nt, Human
cuugacaaagucaagccacaug

SEQ ID NO: 2580341 - RNA, 23 nt, Human
cuugaaugaugccaugaggaaca

SEQ ID NO: 2580342 - RNA, 15 nt, Human
cuugacaccugcuga

SEQ ID NO: 2580343 - RNA, 13 nt, Human
cuugacaccugcu

SEQ ID NO: 2580344 - RNA, 17 nt, Human
cuugacagaacacuguc

SEQ ID NO: 2580345 - RNA, 16 nt, Human
cuugacagaacacugu

SEQ ID NO: 2580346 - RNA, 22 nt, Human
cuugacaccugcugagaaaaca

SEQ ID NO: 2580347 - RNA, 14 nt, Human
cuugacagaacacu

SEQ ID NO: 2580348 - RNA, 22 nt, Human
cuucuucagagacuccugcagg

SEQ ID NO: 2580349 - RNA, 18 nt, Human
cuucuucagagacuccug

SEQ ID NO: 2580350 - RNA, 22 nt, Human
cuucugacgugccuuuugcacc

SEQ ID NO: 2580351 - RNA, 13 nt, Human
cuucugacugcug

SEQ ID NO: 2580352 - RNA, 21 nt, Human
cuucugacugcugauucuccc

SEQ ID NO: 2580353 - RNA, 20 nt, Human
cuucugacgugccuuuugca

SEQ ID NO: 2580354 - RNA, 19 nt, Human
cuucugacgugccuuuugc

SEQ ID NO: 2580355 - RNA, 20 nt, Human
cuucuguuuuauaauuuugu

SEQ ID NO: 2580356 - RNA, 15 nt, Human
cuucuguuuuauaau

SEQ ID NO: 2580357 - RNA, 16 nt, Human
cuucugagcuauuuca

SEQ ID NO: 2580358 - RNA, 17 nt, Human
cuucugagcuauuucau

SEQ ID NO: 2580359 - RNA, 18 nt, Human
cuucugacuuaagugugc

SEQ ID NO: 2580360 - RNA, 21 nt, Human
cuucuucagagacuccugcag

SEQ ID NO: 2580361 - RNA, 20 nt, Human
cuucuucagagacuccugca

SEQ ID NO: 2580362 - RNA, 18 nt, Human
cuucugagcuauuucauc

SEQ ID NO: 2580363 - RNA, 20 nt, Human
cuucugagcuauuucaucua

SEQ ID NO: 2580364 - RNA, 19 nt, Human
cuucuuaaaguauucuucu

SEQ ID NO: 2580365 - RNA, 14 nt, Human
cuucuuaaaguauu

SEQ ID NO: 2580366 - RNA, 15 nt, Human
cuucuguuuucuguu

SEQ ID NO: 2580367 - RNA, 14 nt, Human
cuucuguuuucugu

SEQ ID NO: 2580368 - RNA, 17 nt, Human
cuucuguuuucuguuuc

SEQ ID NO: 2580369 - RNA, 13 nt, Human
cuucuuaaagagu

SEQ ID NO: 2580370 - RNA, 20 nt, Human
cuugaaugaugccaugagga

SEQ ID NO: 2580371 - RNA, 22 nt, Human
cuugaauauccccucccaguca

SEQ ID NO: 2580372 - RNA, 22 nt, Human
cuugaaguuguuacuaacuaaa

SEQ ID NO: 2580373 - RNA, 10 nt, Human
cuugaaguug

SEQ ID NO: 2580374 - RNA, 23 nt, Human
cuuuucaacuuggcuuccuuucu

SEQ ID NO: 2580375 - RNA, 22 nt, Human
cuuuucaaauagggucuaacuc

SEQ ID NO: 2580376 - RNA, 15 nt, Human
cuuuucaaaacauuu

SEQ ID NO: 2580377 - RNA, 13 nt, Human
cuuuuauugucag

SEQ ID NO: 2580378 - RNA, 21 nt, Human
cuuuuagggagagucauauuu

SEQ ID NO: 2580379 - RNA, 20 nt, Human
cuuuggucuacacugugcug

SEQ ID NO: 2580380 - RNA, 14 nt, Human
cuuugguagaaaag

SEQ ID NO: 2580381 - RNA, 17 nt, Human
cuuugguggagauaaag

SEQ ID NO: 2580382 - RNA, 20 nt, Human
cuuuuacugaagccuuucuu

SEQ ID NO: 2580383 - RNA, 16 nt, Human
cuuuggucuacacugu

SEQ ID NO: 2580384 - RNA, 22 nt, Human
cuuuggguuaagcauuaccacu

SEQ ID NO: 2580385 - RNA, 20 nt, Human
cuuuggguuaagcauuacca

SEQ ID NO: 2580386 - RNA, 17 nt, Human
cuuuggguuaagcauua

SEQ ID NO: 2580387 - RNA, 22 nt, Human
cuuugguacauggccaguguga

SEQ ID NO: 2580388 - RNA, 17 nt, Human
cuuugggguuuuuuaau

SEQ ID NO: 2580389 - RNA, 17 nt, Human
cuuuggggucagccagg

SEQ ID NO: 2580390 - RNA, 21 nt, Human
cuuuggggucagccagggcca

SEQ ID NO: 2580391 - RNA, 21 nt, Human
cuuuggguaccuauuuucauu

SEQ ID NO: 2580392 - RNA, 18 nt, Human
cuuuggguaccuauuuuc

SEQ ID NO: 2580393 - RNA, 22 nt, Human
cuuuggguaccuauuuucauug

SEQ ID NO: 2580394 - RNA, 21 nt, Human
cuuuggggcuuuuacaccagu

SEQ ID NO: 2580395 - RNA, 20 nt, Human
cuuuggggcuuuuacaccag

SEQ ID NO: 2580396 - RNA, 15 nt, Human
cuuuuauaaacuuua

SEQ ID NO: 2580397 - RNA, 20 nt, Human
cuuuuagggagagucauauu

SEQ ID NO: 2580398 - RNA, 16 nt, Human
cuuuuagggagaguca

SEQ ID NO: 2580399 - RNA, 17 nt, Human
cuuuuaggacccuuccc

SEQ ID NO: 2580400 - RNA, 18 nt, Human
cuuuuaggccaaaaaaau

SEQ ID NO: 2580401 - RNA, 17 nt, Human
cuuugguggcuuugcau

SEQ ID NO: 2580402 - RNA, 14 nt, Human
cuuugguggcuuug

SEQ ID NO: 2580403 - RNA, 18 nt, Human
cuuugguggcuuugcauu

SEQ ID NO: 2580404 - RNA, 15 nt, Human
cuuuuagaaauacug

SEQ ID NO: 2580405 - RNA, 19 nt, Human
cuuuuagaaauacugcaag

SEQ ID NO: 2580406 - RNA, 21 nt, Human
cuuuuagaaauacugcaagaa

SEQ ID NO: 2580407 - RNA, 23 nt, Human
cuuuuagaaauacugcaagaaaa

SEQ ID NO: 2580408 - RNA, 16 nt, Human
cuuuuaggccaaaaaa

SEQ ID NO: 2580409 - RNA, 22 nt, Human
cuuuuagcucaaacguggcuuu

SEQ ID NO: 2580410 - RNA, 13 nt, Human
cuuuuagccuagu

SEQ ID NO: 2580411 - RNA, 16 nt, Human
cuuuuauaaacuuuac

SEQ ID NO: 2580412 - RNA, 18 nt, Human
cuuuuauaaacuuuaccu

SEQ ID NO: 2580413 - RNA, 21 nt, Human
cuuuuauuguauaaacuauca

SEQ ID NO: 2580414 - RNA, 14 nt, Human
cuuuuauaaacuuu

SEQ ID NO: 2580415 - RNA, 19 nt, Human
cuuuuauuuagcaccaggg

SEQ ID NO: 2580416 - RNA, 17 nt, Human
cuuuuauuucuuaaaca

SEQ ID NO: 2580417 - RNA, 15 nt, Human
cuuucgcacagcagu

SEQ ID NO: 2580418 - RNA, 21 nt, Human
cuuucgacuugcauuuuugca

SEQ ID NO: 2580419 - RNA, 15 nt, Human
cuuucguacauuggc

SEQ ID NO: 2580420 - RNA, 22 nt, Human
cuuucggggagaggcugaggac

SEQ ID NO: 2580421 - RNA, 17 nt, Human
cuuuccuuuuuuaaaaa

SEQ ID NO: 2580422 - RNA, 18 nt, Human
cuuuccuuuuuuaaaaau

SEQ ID NO: 2580423 - RNA, 20 nt, Human
cuuucgacuugcauuuuugc

SEQ ID NO: 2580424 - RNA, 21 nt, Human
cuuuccuuuccccagcccagg

SEQ ID NO: 2580425 - RNA, 20 nt, Human
cuuuccuuuccccagcccag

SEQ ID NO: 2580426 - RNA, 17 nt, Human
cuuucuaguucagcugc

SEQ ID NO: 2580427 - RNA, 23 nt, Human
cuuucuaguggucuuuguaagag

SEQ ID NO: 2580428 - RNA, 22 nt, Human
cuuucuaguggucuuuguaaga

SEQ ID NO: 2580429 - RNA, 21 nt, Human
cuuucuaguggucuuuguaag

SEQ ID NO: 2580430 - RNA, 18 nt, Human
cuuucuaguucagcugcc

SEQ ID NO: 2580431 - RNA, 14 nt, Human
cuuucuaucauuuu

SEQ ID NO: 2580432 - RNA, 12 nt, Human
cuuucuaucauu

SEQ ID NO: 2580433 - RNA, 16 nt, Human
cuuucuauccucugua

SEQ ID NO: 2580434 - RNA, 18 nt, Human
cuuucuaaacaagauuuu

SEQ ID NO: 2580435 - RNA, 19 nt, Human
cuuucguuuguuuguuuca

SEQ ID NO: 2580436 - RNA, 14 nt, Human
cuuucuagcuguug

SEQ ID NO: 2580437 - RNA, 20 nt, Human
cuuucuaguggucuuuguaa

SEQ ID NO: 2580438 - RNA, 19 nt, Human
cuuucuaguggucuuugua

SEQ ID NO: 2580439 - RNA, 18 nt, Human
cuuucuaguggucuuugu

SEQ ID NO: 2580440 - RNA, 16 nt, Human
cuuucuaguggucuuu

SEQ ID NO: 2580441 - RNA, 21 nt, Human
cuuucuaguccuauucuauug

SEQ ID NO: 2580442 - RNA, 20 nt, Human
cuuucuaguccuauucuauu

SEQ ID NO: 2580443 - RNA, 23 nt, Human
cuuucuagcuguugagcuguuuu

SEQ ID NO: 2580444 - RNA, 19 nt, Human
cuuucuccccugcccccag

SEQ ID NO: 2580445 - RNA, 18 nt, Human
cuuucuccccugccccca

SEQ ID NO: 2580446 - RNA, 14 nt, Human
cuuucuccccugcc

SEQ ID NO: 2580447 - RNA, 21 nt, Human
cuuucucccaggccaggcucc

SEQ ID NO: 2580448 - RNA, 17 nt, Human
cuuucuauccucuguaa

SEQ ID NO: 2580449 - RNA, 13 nt, Human
cuuucucccaggc

SEQ ID NO: 2580450 - RNA, 15 nt, Human
cuuucuauuccaaag

SEQ ID NO: 2580451 - RNA, 19 nt, Human
cuuucucccaggccaggcu

SEQ ID NO: 2580452 - RNA, 20 nt, Human
cuuucucccaggccaggcuc

SEQ ID NO: 2580453 - RNA, 23 nt, Human
cuuucuccccugcccccaggacu

SEQ ID NO: 2580454 - RNA, 22 nt, Human
cuuucuccccugcccccaggac

SEQ ID NO: 2580455 - RNA, 24 nt, Human
cuuucuccccugcccccaggacug

SEQ ID NO: 2580456 - RNA, 15 nt, Human
cuuucuccuuagucu

SEQ ID NO: 2580457 - RNA, 20 nt, Human
cuuucuccuuagucuucuca

SEQ ID NO: 2580458 - RNA, 21 nt, Human
cuuucuccuuagucuucucau

SEQ ID NO: 2580459 - RNA, 23 nt, Human
cuuucuccuuagucuucucauag

SEQ ID NO: 2580460 - RNA, 18 nt, Human
cuuucucgauuuuaucuu

SEQ ID NO: 2580461 - RNA, 23 nt, Human
cuuucuccuuuguacuuugugcu

SEQ ID NO: 2580462 - RNA, 22 nt, Human
cuuugacgccaucccagcccca

SEQ ID NO: 2580463 - RNA, 21 nt, Human
cuuugacgccaucccagcccc

SEQ ID NO: 2580464 - RNA, 19 nt, Human
cuuugacgccaucccagcc

SEQ ID NO: 2580465 - RNA, 18 nt, Human
cuuugacgccaucccagc

SEQ ID NO: 2580466 - RNA, 13 nt, Human
cuuucucuacuuu

SEQ ID NO: 2580467 - RNA, 16 nt, Human
cuuugagguggaagag

SEQ ID NO: 2580468 - RNA, 17 nt, Human
cuuugagguggaagagg

SEQ ID NO: 2580469 - RNA, 13 nt, Human
cuuugaggaaacc

SEQ ID NO: 2580470 - RNA, 14 nt, Human
cuuugagguggaag

SEQ ID NO: 2580471 - RNA, 20 nt, Human
cuuugagauagaagaacugc

SEQ ID NO: 2580472 - RNA, 19 nt, Human
cuuucucgauuuuaucuuu

SEQ ID NO: 2580473 - RNA, 21 nt, Human
cuuugagcccacaaagccuua

SEQ ID NO: 2580474 - RNA, 16 nt, Human
cuuugagcuuaagaau

SEQ ID NO: 2580475 - RNA, 21 nt, Human
cuuugauguuaacacauuuug

SEQ ID NO: 2580476 - RNA, 20 nt, Human
cuuugauguuaacacauuuu

SEQ ID NO: 2580477 - RNA, 23 nt, Human
cuuugauguuaacacauuuugua

SEQ ID NO: 2580478 - RNA, 16 nt, Human
cuuugauuaauccaga

SEQ ID NO: 2580479 - RNA, 20 nt, Human
cuuugauuaaagacuccagu

SEQ ID NO: 2580480 - RNA, 17 nt, Human
cuuugauuaauccagaa

SEQ ID NO: 2580481 - RNA, 12 nt, Human
cuuugauucaua

SEQ ID NO: 2580482 - RNA, 19 nt, Human
cuuugauucauaguaacuu

SEQ ID NO: 2580483 - RNA, 13 nt, Human
cuuugauucuccu

SEQ ID NO: 2580484 - RNA, 21 nt, Human
cuuugauucauaguaacuucu

SEQ ID NO: 2580485 - RNA, 14 nt, Human
cuuugauucuccuu

SEQ ID NO: 2580486 - RNA, 19 nt, Human
cuuugauguuaacacauuu

SEQ ID NO: 2580487 - RNA, 16 nt, Human
cuuugauaauguuaaa

SEQ ID NO: 2580488 - RNA, 18 nt, Human
cuuugauguuaacacauu

SEQ ID NO: 2580489 - RNA, 15 nt, Human
cuuugauaauguuaa

SEQ ID NO: 2580490 - RNA, 14 nt, Human
cuuugauaauguua

SEQ ID NO: 2580491 - RNA, 13 nt, Human
cuuugauaauguu

SEQ ID NO: 2580492 - RNA, 18 nt, Human
cuuugauaaaauaaauga

SEQ ID NO: 2580493 - RNA, 17 nt, Human
cuuugauaaaauaaaug

SEQ ID NO: 2580494 - RNA, 14 nt, Human
cuuugauaaaauaa

SEQ ID NO: 2580495 - RNA, 21 nt, Human
cuuugagugcaguccugauca

SEQ ID NO: 2580496 - RNA, 16 nt, Human
cuuugaguuuccucag

SEQ ID NO: 2580497 - RNA, 17 nt, Human
cuuugaguuuccucagg

SEQ ID NO: 2580498 - RNA, 18 nt, Human
cuuugaguuuccucaggc

SEQ ID NO: 2580499 - RNA, 19 nt, Human
cuuugaguuuccucaggcu

SEQ ID NO: 2580500 - RNA, 22 nt, Human
cuuugaguuuccucaggcugcu

SEQ ID NO: 2580501 - RNA, 21 nt, Human
cuuugagugucuuaauuaaaa

SEQ ID NO: 2580502 - RNA, 22 nt, Human
cuuugagguggaagagggcugc

SEQ ID NO: 2580503 - RNA, 13 nt, Human
cuuugagugaucc

SEQ ID NO: 2580504 - RNA, 19 nt, Human
cuuucagauacaugguugu

SEQ ID NO: 2580505 - RNA, 20 nt, Human
cuuucagauaacuguuauuu

SEQ ID NO: 2580506 - RNA, 16 nt, Human
cuugugaggaaaguca

SEQ ID NO: 2580507 - RNA, 13 nt, Human
cuugugaggaaag

SEQ ID NO: 2580508 - RNA, 23 nt, Human
cuugugaggaaagucauuggcuu

SEQ ID NO: 2580509 - RNA, 19 nt, Human
cuugugaggaaagucauug

SEQ ID NO: 2580510 - RNA, 17 nt, Human
cuugugaggaaagucau

SEQ ID NO: 2580511 - RNA, 15 nt, Human
cuugugauuauuuau

SEQ ID NO: 2580512 - RNA, 17 nt, Human
cuugugauuauuuauua

SEQ ID NO: 2580513 - RNA, 23 nt, Human
cuugugcacccucuaucccaaua

SEQ ID NO: 2580514 - RNA, 20 nt, Human
cuugugcacccucuauccca

SEQ ID NO: 2580515 - RNA, 13 nt, Human
cuuguggacacag

SEQ ID NO: 2580516 - RNA, 15 nt, Human
cuuguggacacagcu

SEQ ID NO: 2580517 - RNA, 14 nt, Human
cuuguggacacagc

SEQ ID NO: 2580518 - RNA, 16 nt, Human
cuuuaaaguaugaauc

SEQ ID NO: 2580519 - RNA, 15 nt, Human
cuuuaaaucugugau

SEQ ID NO: 2580520 - RNA, 22 nt, Human
cuuuaaaguaugaaucuaugcc

SEQ ID NO: 2580521 - RNA, 22 nt, Human
cuuucaauaggaaaaacugauu

SEQ ID NO: 2580522 - RNA, 21 nt, Human
cuuucaauaggaaaaacugau

SEQ ID NO: 2580523 - RNA, 20 nt, Human
cuuucaauaggaaaaacuga

SEQ ID NO: 2580524 - RNA, 21 nt, Human
cuuuacacauucggcucccug

SEQ ID NO: 2580525 - RNA, 22 nt, Human
cuuuacacaucagucacaaguu

SEQ ID NO: 2580526 - RNA, 23 nt, Human
cuuuacacauucggcucccugga

SEQ ID NO: 2580527 - RNA, 16 nt, Human
cuuucacuauuuccuu

SEQ ID NO: 2580528 - RNA, 21 nt, Human
cuuucacuauuuccuuuauaa

SEQ ID NO: 2580529 - RNA, 15 nt, Human
cuuuacacucaggcu

SEQ ID NO: 2580530 - RNA, 22 nt, Human
cuuucacuauuuccuuuauaau

SEQ ID NO: 2580531 - RNA, 18 nt, Human
cuuuaauaucaucaguau

SEQ ID NO: 2580532 - RNA, 19 nt, Human
cuuuaauaucaucaguauu

SEQ ID NO: 2580533 - RNA, 21 nt, Human
cuuuaauaucaucaguauuga

SEQ ID NO: 2580534 - RNA, 14 nt, Human
cuuuaaucuucagu

SEQ ID NO: 2580535 - RNA, 17 nt, Human
cuuuaagugcacaacau

SEQ ID NO: 2580536 - RNA, 17 nt, Human
cuuuaaguuucaggaua

SEQ ID NO: 2580537 - RNA, 12 nt, Human
cuuuaauauaaa

SEQ ID NO: 2580538 - RNA, 22 nt, Human
cuuuaaucuucaguuuuaucuu

SEQ ID NO: 2580539 - RNA, 17 nt, Human
cuuuaaucuucaguuuu

SEQ ID NO: 2580540 - RNA, 21 nt, Human
cuuuaaucuucaguuuuaucu

SEQ ID NO: 2580541 - RNA, 21 nt, Human
cuuuaauuuuuuuaaccaaag

SEQ ID NO: 2580542 - RNA, 20 nt, Human
cuuuaauuuuuuuaaccaaa

SEQ ID NO: 2580543 - RNA, 23 nt, Human
cuuuaauuuuuuuaaccaaaggu

SEQ ID NO: 2580544 - RNA, 19 nt, Human
cuuuacaauguucauccca

SEQ ID NO: 2580545 - RNA, 17 nt, Human
gcacuccccugcugggu

SEQ ID NO: 2580546 - RNA, 23 nt, Human
gcacucacccaugugccaaggug

SEQ ID NO: 2580547 - RNA, 20 nt, Human
gcacucacccaugugccaag

SEQ ID NO: 2580548 - RNA, 19 nt, Human
gcacucacccaugugccaa

SEQ ID NO: 2580549 - RNA, 20 nt, Human
gcacucacagaccuggagcc

SEQ ID NO: 2580550 - RNA, 17 nt, Human
gcacucagaagacacug

SEQ ID NO: 2580551 - RNA, 16 nt, Human
gcacucagaagacacu

SEQ ID NO: 2580552 - RNA, 13 nt, Human
gcacucagaagac

SEQ ID NO: 2580553 - RNA, 22 nt, Human
gcacuccccugcuggguguggc

SEQ ID NO: 2580554 - RNA, 16 nt, Human
gcacuccccugcuggg

SEQ ID NO: 2580555 - RNA, 23 nt, Human
gcacucccuugguggcaagagcc

SEQ ID NO: 2580556 - RNA, 17 nt, Human
gcacuccggccugauga

SEQ ID NO: 2580557 - RNA, 14 nt, Human
gcacuccggaggua

SEQ ID NO: 2580558 - RNA, 14 nt, Human
gcacuugcaucugu

SEQ ID NO: 2580559 - RNA, 18 nt, Human
gcacuuggacucuugcuc

SEQ ID NO: 2580560 - RNA, 20 nt, Human
gcacuccucgguacucccau

SEQ ID NO: 2580561 - RNA, 19 nt, Human
gcacuccucgguacuccca

SEQ ID NO: 2580562 - RNA, 16 nt, Human
gcacucacagaccugg

SEQ ID NO: 2580563 - RNA, 19 nt, Human
gcacucacagaccuggagc

SEQ ID NO: 2580564 - RNA, 17 nt, Human
gcacucacagaccugga

SEQ ID NO: 2580565 - RNA, 17 nt, Human
gcacucacccaugugcc

SEQ ID NO: 2580566 - RNA, 22 nt, Human
gcacaucagcacgauuucuguu

SEQ ID NO: 2580567 - RNA, 23 nt, Human
gcacaucagcacgauuucuguuu

SEQ ID NO: 2580568 - RNA, 14 nt, Human
gcaccgggccacag

SEQ ID NO: 2580569 - RNA, 20 nt, Human
gcacauccuaugcaauauau

SEQ ID NO: 2580570 - RNA, 17 nt, Human
gcacauccuaugcaaua

SEQ ID NO: 2580571 - RNA, 15 nt, Human
gcaccuaccaucagg

SEQ ID NO: 2580572 - RNA, 22 nt, Human
gcaccuaccaccacgcccggcu

SEQ ID NO: 2580573 - RNA, 21 nt, Human
gcaccuaccaccacgcccggc

SEQ ID NO: 2580574 - RNA, 23 nt, Human
gcaccgggccacagagaaaguac

SEQ ID NO: 2580575 - RNA, 16 nt, Human
gcaccuaguccaguga

SEQ ID NO: 2580576 - RNA, 23 nt, Human
gcaccuaccaucagggacaggau

SEQ ID NO: 2580577 - RNA, 20 nt, Human
gcaccuaccaucagggacag

SEQ ID NO: 2580578 - RNA, 19 nt, Human
gcaccuaccaucagggaca

SEQ ID NO: 2580579 - RNA, 17 nt, Human
gcaccuaccaucaggga

SEQ ID NO: 2580580 - RNA, 14 nt, Human
gcaccuacuuacau

SEQ ID NO: 2580581 - RNA, 21 nt, Human
gcaccuacuacaucgcccucc

SEQ ID NO: 2580582 - RNA, 23 nt, Human
gcaccuacuacaucgcccuccac

SEQ ID NO: 2580583 - RNA, 17 nt, Human
gcaccuauagucccagc

SEQ ID NO: 2580584 - RNA, 18 nt, Human
gcaccuauagucccagcu

SEQ ID NO: 2580585 - RNA, 21 nt, Human
gcaccucacagaaaugagauc

SEQ ID NO: 2580586 - RNA, 21 nt, Human
gcaccuauagucccagcuacu

SEQ ID NO: 2580587 - RNA, 15 nt, Human
gauuuuuuuuucaua

SEQ ID NO: 2580588 - RNA, 19 nt, Human
gauuuuuugcauuccugac

SEQ ID NO: 2580589 - RNA, 14 nt, Human
gauuuuuuucugag

SEQ ID NO: 2580590 - RNA, 21 nt, Human
gcacagugcaucucagcccac

SEQ ID NO: 2580591 - RNA, 20 nt, Human
gcacagugcaucucagccca

SEQ ID NO: 2580592 - RNA, 19 nt, Human
gcacagugcaucucagccc

SEQ ID NO: 2580593 - RNA, 20 nt, Human
gcacaguguuaaaugaaauu

SEQ ID NO: 2580594 - RNA, 17 nt, Human
gcacaguguuaaaugaa

SEQ ID NO: 2580595 - RNA, 23 nt, Human
gcacagugucugggcugacuggg

SEQ ID NO: 2580596 - RNA, 21 nt, Human
gcacagugucugggcugacug

SEQ ID NO: 2580597 - RNA, 19 nt, Human
gcacagugucugggcugac

SEQ ID NO: 2580598 - RNA, 18 nt, Human
gcacagugucugggcuga

SEQ ID NO: 2580599 - RNA, 17 nt, Human
gcacagugucugggcug

SEQ ID NO: 2580600 - RNA, 15 nt, Human
gcacagugucugggc

SEQ ID NO: 2580601 - RNA, 22 nt, Human
gcacagugguggcagggccuag

SEQ ID NO: 2580602 - RNA, 18 nt, Human
gcacagugguggcagggc

SEQ ID NO: 2580603 - RNA, 17 nt, Human
gcacagugguggcaggg

SEQ ID NO: 2580604 - RNA, 16 nt, Human
gcacagugguggcagg

SEQ ID NO: 2580605 - RNA, 14 nt, Human
gcacagugccugca

SEQ ID NO: 2580606 - RNA, 20 nt, Human
gcacaguuuucugagaaaga

SEQ ID NO: 2580607 - RNA, 22 nt, Human
gcacaguuuucugagaaagacu

SEQ ID NO: 2580608 - RNA, 23 nt, Human
gcacaguuuucugagaaagacua

SEQ ID NO: 2580609 - RNA, 23 nt, Human
gcacaguuuucuggcuggagccu

SEQ ID NO: 2580610 - RNA, 15 nt, Human
gcacaguucaugguu

SEQ ID NO: 2580611 - RNA, 21 nt, Human
gcacauagcuaucaagugugc

SEQ ID NO: 2580612 - RNA, 17 nt, Human
gcacaauauugaacuuu

SEQ ID NO: 2580613 - RNA, 20 nt, Human
gcacaauaguaaccugggua

SEQ ID NO: 2580614 - RNA, 15 nt, Human
gcacaauaguaaccu

SEQ ID NO: 2580615 - RNA, 14 nt, Human
gcacacauuuuuua

SEQ ID NO: 2580616 - RNA, 20 nt, Human
gcacaauauugaacuuuuuu

SEQ ID NO: 2580617 - RNA, 19 nt, Human
gcacaauauugaacuuuuu

SEQ ID NO: 2580618 - RNA, 18 nt, Human
gcacacccacucagcucc

SEQ ID NO: 2580619 - RNA, 15 nt, Human
gcacacccagguuug

SEQ ID NO: 2580620 - RNA, 17 nt, Human
gcacacccacucagcuc

SEQ ID NO: 2580621 - RNA, 14 nt, Human
gcacaccgggcacu

SEQ ID NO: 2580622 - RNA, 16 nt, Human
gcacaauaaaaauguu

SEQ ID NO: 2580623 - RNA, 17 nt, Human
gcacaauaaaaauguuu

SEQ ID NO: 2580624 - RNA, 19 nt, Human
gcacaaggcugaccaagag

SEQ ID NO: 2580625 - RNA, 14 nt, Human
gcaauauguaaaua

SEQ ID NO: 2580626 - RNA, 21 nt, Human
gcaauauuaaugccuuuaaag

SEQ ID NO: 2580627 - RNA, 22 nt, Human
gcacaagcugcacccucaggca

SEQ ID NO: 2580628 - RNA, 20 nt, Human
gcaaguauuagaauaccaca

SEQ ID NO: 2580629 - RNA, 18 nt, Human
gcaagucagaauagaaau

SEQ ID NO: 2580630 - RNA, 23 nt, Human
gcaauauaucuaaauugaauaau

SEQ ID NO: 2580631 - RNA, 17 nt, Human
gcaauauaucuaaauug

SEQ ID NO: 2580632 - RNA, 17 nt, Human
gcaauauagaaacacga

SEQ ID NO: 2580633 - RNA, 20 nt, Human
gcaaguucuagagaagaggc

SEQ ID NO: 2580634 - RNA, 17 nt, Human
gcaauagugggcccucc

SEQ ID NO: 2580635 - RNA, 13 nt, Human
gcaauaguguguu

SEQ ID NO: 2580636 - RNA, 14 nt, Human
gcaauauagaaaca

SEQ ID NO: 2580637 - RNA, 17 nt, Human
gcaauaguguguucuga

SEQ ID NO: 2580638 - RNA, 20 nt, Human
gcaauaguguguucugauua

SEQ ID NO: 2580639 - RNA, 22 nt, Human
gcaauagucaaauugugugaaa

SEQ ID NO: 2580640 - RNA, 17 nt, Human
gcaaguucuagagaaga

SEQ ID NO: 2580641 - RNA, 19 nt, Human
gcaagugugugcaugugug

SEQ ID NO: 2580642 - RNA, 21 nt, Human
gcaagugugugcaugugugcg

SEQ ID NO: 2580643 - RNA, 22 nt, Human
gcaagugugugcaugugugcga

SEQ ID NO: 2580644 - RNA, 23 nt, Human
gcaaguguguaugugcgugugug

SEQ ID NO: 2580645 - RNA, 12 nt, Human
gcaagugugugc

SEQ ID NO: 2580646 - RNA, 13 nt, Human
gcaagugugugca

SEQ ID NO: 2580647 - RNA, 23 nt, Human
gcaagugugugcacaugugugcg

SEQ ID NO: 2580648 - RNA, 20 nt, Human
gcaagugauugggacagagg

SEQ ID NO: 2580649 - RNA, 19 nt, Human
gcaagugauugggacagag

SEQ ID NO: 2580650 - RNA, 21 nt, Human
gcaaguguaugcacgugugca

SEQ ID NO: 2580651 - RNA, 15 nt, Human
gcaagugucugugug

SEQ ID NO: 2580652 - RNA, 16 nt, Human
gcaagugucugugugc

SEQ ID NO: 2580653 - RNA, 17 nt, Human
gcaagugucugugugca

SEQ ID NO: 2580654 - RNA, 17 nt, Human
gcaagucauggcugugc

SEQ ID NO: 2580655 - RNA, 20 nt, Human
gcaagucccugacucucugu

SEQ ID NO: 2580656 - RNA, 22 nt, Human
gcaagucccugacucucuguga

SEQ ID NO: 2580657 - RNA, 23 nt, Human
gcaagucagaggauggccagugu

SEQ ID NO: 2580658 - RNA, 21 nt, Human
gcaagucagaggauggccagu

SEQ ID NO: 2580659 - RNA, 19 nt, Human
gcaagucagaggauggcca

SEQ ID NO: 2580660 - RNA, 15 nt, Human
gcaagucagaggaug

SEQ ID NO: 2580661 - RNA, 24 nt, Human
gcaagucagaggauggccaguguc

SEQ ID NO: 2580662 - RNA, 12 nt, Human
gcaagucaggac

SEQ ID NO: 2580663 - RNA, 13 nt, Human
gcaagucaggguu

SEQ ID NO: 2580664 - RNA, 16 nt, Human
gaugaucuuuaaaaua

SEQ ID NO: 2580665 - RNA, 21 nt, Human
gaugaucuaggaagacuuugg

SEQ ID NO: 2580666 - RNA, 15 nt, Human
gaugaucuaggaaga

SEQ ID NO: 2580667 - RNA, 18 nt, Human
gaugauacaagauuagaa

SEQ ID NO: 2580668 - RNA, 16 nt, Human
gaugagugagcaugcc

SEQ ID NO: 2580669 - RNA, 14 nt, Human
gaugaggggaggaa

SEQ ID NO: 2580670 - RNA, 14 nt, Human
gaugaggugcuggg

SEQ ID NO: 2580671 - RNA, 16 nt, Human
gaugaggugcugggag

SEQ ID NO: 2580672 - RNA, 17 nt, Human
gaugaggugcugggagg

SEQ ID NO: 2580673 - RNA, 20 nt, Human
gaugaguccccugugagauu

SEQ ID NO: 2580674 - RNA, 19 nt, Human
gaugaggugcugggaggga

SEQ ID NO: 2580675 - RNA, 17 nt, Human
gauguagaggagaaacu

SEQ ID NO: 2580676 - RNA, 18 nt, Human
gauguagaggagaaacug

SEQ ID NO: 2580677 - RNA, 18 nt, Human
gauguagccaugaccuua

SEQ ID NO: 2580678 - RNA, 15 nt, Human
gauguagauuuauuu

SEQ ID NO: 2580679 - RNA, 17 nt, Human
gauguagauuuauuuca

SEQ ID NO: 2580680 - RNA, 14 nt, Human
gauguagauuuauu

SEQ ID NO: 2580681 - RNA, 19 nt, Human
gauguaaacagugccugcu

SEQ ID NO: 2580682 - RNA, 20 nt, Human
gauguaaacagugccugcug

SEQ ID NO: 2580683 - RNA, 21 nt, Human
gauguaaacagugccugcuga

SEQ ID NO: 2580684 - RNA, 19 nt, Human
gauggagcccaggcgggag

SEQ ID NO: 2580685 - RNA, 17 nt, Human
gauggagcccaggcggg

SEQ ID NO: 2580686 - RNA, 14 nt, Human
gauggagcccaggc

SEQ ID NO: 2580687 - RNA, 20 nt, Human
gauggagccagcucugcauu

SEQ ID NO: 2580688 - RNA, 17 nt, Human
gaugguucguucuguuu

SEQ ID NO: 2580689 - RNA, 22 nt, Human
gauggagcccaggcgggagcgg

SEQ ID NO: 2580690 - RNA, 16 nt, Human
gauggagcgcaccugc

SEQ ID NO: 2580691 - RNA, 22 nt, Human
gaugguucccuugaugaagaag

SEQ ID NO: 2580692 - RNA, 16 nt, Human
gauguaaacagugccu

SEQ ID NO: 2580693 - RNA, 18 nt, Human
gauguaaaagacuuuuuu

SEQ ID NO: 2580694 - RNA, 19 nt, Human
gaugcugauguucagugua

SEQ ID NO: 2580695 - RNA, 18 nt, Human
gaugcugauguucagugu

SEQ ID NO: 2580696 - RNA, 17 nt, Human
gaugcugauguucagug

SEQ ID NO: 2580697 - RNA, 16 nt, Human
gaugcugauguucagu

SEQ ID NO: 2580698 - RNA, 15 nt, Human
gaugcugauguucag

SEQ ID NO: 2580699 - RNA, 21 nt, Human
gaugaucuacucagaaauuuu

SEQ ID NO: 2580700 - RNA, 13 nt, Human
gaugcugauguuc

SEQ ID NO: 2580701 - RNA, 15 nt, Human
gaugaucuacucaga

SEQ ID NO: 2580702 - RNA, 21 nt, Human
gaugauacaagauuagaagcu

SEQ ID NO: 2580703 - RNA, 13 nt, Human
gaugcugccccuc

SEQ ID NO: 2580704 - RNA, 12 nt, Human
gaugcugccuga

SEQ ID NO: 2580705 - RNA, 12 nt, Human
gaugcugccccu

SEQ ID NO: 2580706 - RNA, 23 nt, Human
gaugcugccagggcgccaucgcc

SEQ ID NO: 2580707 - RNA, 14 nt, Human
gaugcuggagaaga

SEQ ID NO: 2580708 - RNA, 15 nt, Human
gaugcugcuuucccc

SEQ ID NO: 2580709 - RNA, 12 nt, Human
gaugcugcuuuc

SEQ ID NO: 2580710 - RNA, 11 nt, Human
gaugcugcuuu

SEQ ID NO: 2580711 - RNA, 14 nt, Human
gaugcugccugagu

SEQ ID NO: 2580712 - RNA, 16 nt, Human
gaugcugccugaguca

SEQ ID NO: 2580713 - RNA, 23 nt, Human
gauggagacugguccugugugca

SEQ ID NO: 2580714 - RNA, 22 nt, Human
gauggagacugguccugugugc

SEQ ID NO: 2580715 - RNA, 14 nt, Human
gauggagagagggg

SEQ ID NO: 2580716 - RNA, 15 nt, Human
gauggagagagggga

SEQ ID NO: 2580717 - RNA, 22 nt, Human
gauggagcagagcaagucugca

SEQ ID NO: 2580718 - RNA, 16 nt, Human
gauggagagaggggaa

SEQ ID NO: 2580719 - RNA, 22 nt, Human
gauggagacuccaugagaagcc

SEQ ID NO: 2580720 - RNA, 21 nt, Human
gaugcuggagaagagaggaga

SEQ ID NO: 2580721 - RNA, 20 nt, Human
gaugcuggagaagagaggag

SEQ ID NO: 2580722 - RNA, 19 nt, Human
gaugcuggagaagagagga

SEQ ID NO: 2580723 - RNA, 16 nt, Human
gaugcuggagaagaga

SEQ ID NO: 2580724 - RNA, 15 nt, Human
gaugcuggagagguu

SEQ ID NO: 2580725 - RNA, 14 nt, Human
gaugcuggagaggu

SEQ ID NO: 2580726 - RNA, 16 nt, Human
gaugcuggagagguua

SEQ ID NO: 2580727 - RNA, 14 nt, Human
gaugcuggaugcuc

SEQ ID NO: 2580728 - RNA, 16 nt, Human
gaugcuggaugcuccu

SEQ ID NO: 2580729 - RNA, 12 nt, Human
gauggacagacu

SEQ ID NO: 2580730 - RNA, 16 nt, Human
gaucugcucagcccug

SEQ ID NO: 2580731 - RNA, 15 nt, Human
gaucugcucagcccu

SEQ ID NO: 2580732 - RNA, 14 nt, Human
gaucugcucagccc

SEQ ID NO: 2580733 - RNA, 13 nt, Human
gaucugcucagcc

SEQ ID NO: 2580734 - RNA, 20 nt, Human
gaucugcucagcccuggagg

SEQ ID NO: 2580735 - RNA, 19 nt, Human
gaucugcucagcccuggag

SEQ ID NO: 2580736 - RNA, 18 nt, Human
gaucugcucagcccugga

SEQ ID NO: 2580737 - RNA, 17 nt, Human
gaucugcucagcccugg

SEQ ID NO: 2580738 - RNA, 21 nt, Human
gaucugcucagcccuggaggu

SEQ ID NO: 2580739 - RNA, 21 nt, Human
gauguauguugaagccuuugu

SEQ ID NO: 2580740 - RNA, 19 nt, Human
gauguaugcagcuaucugg

SEQ ID NO: 2580741 - RNA, 15 nt, Human
gaugucacagggcca

SEQ ID NO: 2580742 - RNA, 13 nt, Human
gaugucacagggc

SEQ ID NO: 2580743 - RNA, 18 nt, Human
gaugucaauuucuguguu

SEQ ID NO: 2580744 - RNA, 15 nt, Human
gaugucaauuucugu

SEQ ID NO: 2580745 - RNA, 18 nt, Human
gauguauuuuuguacccu

SEQ ID NO: 2580746 - RNA, 20 nt, Human
gauguauguugaagccuuug

SEQ ID NO: 2580747 - RNA, 18 nt, Human
gauguauccaugggggca

SEQ ID NO: 2580748 - RNA, 17 nt, Human
gauguaggcauucugga

SEQ ID NO: 2580749 - RNA, 19 nt, Human
gauguaggguaaggugccu

SEQ ID NO: 2580750 - RNA, 20 nt, Human
gauguaggguaaggugccuu

SEQ ID NO: 2580751 - RNA, 21 nt, Human
gauguaggguaaggugccuuc

SEQ ID NO: 2580752 - RNA, 14 nt, Human
gauuauauuaugaa

SEQ ID NO: 2580753 - RNA, 20 nt, Human
gauuauagauuggagccacc

SEQ ID NO: 2580754 - RNA, 13 nt, Human
gauuauacagaau

SEQ ID NO: 2580755 - RNA, 14 nt, Human
gauuauggagcuuu

SEQ ID NO: 2580756 - RNA, 20 nt, Human
gauuauaggcaccuaccacc

SEQ ID NO: 2580757 - RNA, 21 nt, Human
gauuauaguugugggugggag

SEQ ID NO: 2580758 - RNA, 13 nt, Human
gauuauucagugu

SEQ ID NO: 2580759 - RNA, 14 nt, Human
gauuauucaguguc

SEQ ID NO: 2580760 - RNA, 19 nt, Human
gauuauucauuuaaaauga

SEQ ID NO: 2580761 - RNA, 16 nt, Human
gauuauucauuuaaaa

SEQ ID NO: 2580762 - RNA, 15 nt, Human
gauuauucauuuaaa

SEQ ID NO: 2580763 - RNA, 14 nt, Human
gauuauucauuuaa

SEQ ID NO: 2580764 - RNA, 13 nt, Human
gauuauucauuua

SEQ ID NO: 2580765 - RNA, 15 nt, Human
gauuauucaguguca

SEQ ID NO: 2580766 - RNA, 12 nt, Human
gauuauuggaaa

SEQ ID NO: 2580767 - RNA, 19 nt, Human
gauuauucugauuccacuu

SEQ ID NO: 2580768 - RNA, 17 nt, Human
gauuauucugauuccac

SEQ ID NO: 2580769 - RNA, 21 nt, Human
gauuauucauuuaaaaugauu

SEQ ID NO: 2580770 - RNA, 20 nt, Human
gauuauucauuuaaaaugau

SEQ ID NO: 2580771 - RNA, 22 nt, Human
gauuauucauuuaaaaugauua

SEQ ID NO: 2580772 - RNA, 23 nt, Human
gauuauucccuguacaauauuua

SEQ ID NO: 2580773 - RNA, 17 nt, Human
gauucuccugccucagc

SEQ ID NO: 2580774 - RNA, 15 nt, Human
gauucuccugccuca

SEQ ID NO: 2580775 - RNA, 14 nt, Human
gauucugagagcug

SEQ ID NO: 2580776 - RNA, 15 nt, Human
gauucugcaguaaau

SEQ ID NO: 2580777 - RNA, 16 nt, Human
gauucugcaguaaauc

SEQ ID NO: 2580778 - RNA, 18 nt, Human
gauucuccugccucagcc

SEQ ID NO: 2580779 - RNA, 15 nt, Human
gauuuaccacuugug

SEQ ID NO: 2580780 - RNA, 23 nt, Human
gauucuuauguagcaggaaauaa

SEQ ID NO: 2580781 - RNA, 14 nt, Human
gauucuuccaucug

SEQ ID NO: 2580782 - RNA, 16 nt, Human
gauuuacaguuucaaa

SEQ ID NO: 2580783 - RNA, 17 nt, Human
gauucuuccucccuccc

SEQ ID NO: 2580784 - RNA, 18 nt, Human
gauucuuccucccucccu

SEQ ID NO: 2580785 - RNA, 19 nt, Human
gauucuggauaaagccacu

SEQ ID NO: 2580786 - RNA, 17 nt, Human
gauucuggauaaagcca

SEQ ID NO: 2580787 - RNA, 13 nt, Human
gauucugcuuuua

SEQ ID NO: 2580788 - RNA, 18 nt, Human
gauucugcaguaaaucuu

SEQ ID NO: 2580789 - RNA, 19 nt, Human
gauucugcaguaaaucuuu

SEQ ID NO: 2580790 - RNA, 21 nt, Human
gauucugcaguaaaucuuuua

SEQ ID NO: 2580791 - RNA, 22 nt, Human
gauucugguuccagggucccuc

SEQ ID NO: 2580792 - RNA, 16 nt, Human
gauucuucaaaagcau

SEQ ID NO: 2580793 - RNA, 17 nt, Human
gauucugguuccagggu

SEQ ID NO: 2580794 - RNA, 22 nt, Human
gauucugggaggaagcagguug

SEQ ID NO: 2580795 - RNA, 22 nt, Human
gauucuggauaaagccacugaa

SEQ ID NO: 2580796 - RNA, 15 nt, Human
gauucugggaggaag

SEQ ID NO: 2580797 - RNA, 20 nt, Human
gauuuuuuacagcugccugc

SEQ ID NO: 2580798 - RNA, 15 nt, Human
gauuuaucaaaucag

SEQ ID NO: 2580799 - RNA, 14 nt, Human
gauuuaucaaauca

SEQ ID NO: 2580800 - RNA, 13 nt, Human
gauuuaucaaauc

SEQ ID NO: 2580801 - RNA, 12 nt, Human
gauuuaucaaau

SEQ ID NO: 2580802 - RNA, 21 nt, Human
gauuuauaguuuguacaugca

SEQ ID NO: 2580803 - RNA, 20 nt, Human
gauuuauaguuuguacaugc

SEQ ID NO: 2580804 - RNA, 17 nt, Human
gauuuauaguuuguaca

SEQ ID NO: 2580805 - RNA, 16 nt, Human
gauuuaccacuugugu

SEQ ID NO: 2580806 - RNA, 15 nt, Human
gauuuacgcucauug

SEQ ID NO: 2580807 - RNA, 20 nt, Human
gauuuaccuguuuucgcacc

SEQ ID NO: 2580808 - RNA, 22 nt, Human
gauuuacaguuucaaaaacugu

SEQ ID NO: 2580809 - RNA, 22 nt, Human
gauuuaguguuuuuaccucugu

SEQ ID NO: 2580810 - RNA, 13 nt, Human
gauuuauaaaugc

SEQ ID NO: 2580811 - RNA, 18 nt, Human
gauuuauaaaugcuauuu

SEQ ID NO: 2580812 - RNA, 15 nt, Human
gauuuagaacuguau

SEQ ID NO: 2580813 - RNA, 20 nt, Human
gauuuaggagaagccaggaa

SEQ ID NO: 2580814 - RNA, 22 nt, Human
gauuuagugaaagcuagagaua

SEQ ID NO: 2580815 - RNA, 21 nt, Human
gauuuaguguuuuuaccucug

SEQ ID NO: 2580816 - RNA, 16 nt, Human
gagcugcuggcuugca

SEQ ID NO: 2580817 - RNA, 21 nt, Human
gagcugcuggcuugcagugcg

SEQ ID NO: 2580818 - RNA, 21 nt, Human
gagcugccuuggcucagacau

SEQ ID NO: 2580819 - RNA, 22 nt, Human
gagcugccuuggcucagacaug

SEQ ID NO: 2580820 - RNA, 18 nt, Human
gagcugcuauagccuggg

SEQ ID NO: 2580821 - RNA, 20 nt, Human
gagcugcuauagccuggggu

SEQ ID NO: 2580822 - RNA, 13 nt, Human
gagcugcucacua

SEQ ID NO: 2580823 - RNA, 21 nt, Human
gagcugcuauagccuggggug

SEQ ID NO: 2580824 - RNA, 24 nt, Human
gagcugcucugaauuaguccuugc

SEQ ID NO: 2580825 - RNA, 14 nt, Human
gagcugcucugaau

SEQ ID NO: 2580826 - RNA, 16 nt, Human
gagcugcucuggaaaa

SEQ ID NO: 2580827 - RNA, 14 nt, Human
gagcugcugcccug

SEQ ID NO: 2580828 - RNA, 13 nt, Human
gagcugcugcccu

SEQ ID NO: 2580829 - RNA, 12 nt, Human
gagcugcuggcu

SEQ ID NO: 2580830 - RNA, 20 nt, Human
gagccuuccaggggugggac

SEQ ID NO: 2580831 - RNA, 22 nt, Human
gagcgccgugaguucucagggc

SEQ ID NO: 2580832 - RNA, 21 nt, Human
gagcgccgugaguucucaggg

SEQ ID NO: 2580833 - RNA, 23 nt, Human
gagcgccuccauccaaggccagg

SEQ ID NO: 2580834 - RNA, 19 nt, Human
gagcgccuccauccaaggc

SEQ ID NO: 2580835 - RNA, 15 nt, Human
gagcugccuuggcuc

SEQ ID NO: 2580836 - RNA, 18 nt, Human
gagcugccuuggcucaga

SEQ ID NO: 2580837 - RNA, 21 nt, Human
gagcgcccacuagacccacug

SEQ ID NO: 2580838 - RNA, 20 nt, Human
gagcgcaccugcccccuggu

SEQ ID NO: 2580839 - RNA, 17 nt, Human
gagcgcccgcgcccgcg

SEQ ID NO: 2580840 - RNA, 12 nt, Human
gagcgccccucc

SEQ ID NO: 2580841 - RNA, 16 nt, Human
gagcgcaucaggccug

SEQ ID NO: 2580842 - RNA, 23 nt, Human
gagccuuccaggggugggacacc

SEQ ID NO: 2580843 - RNA, 13 nt, Human
gagccuugaacuu

SEQ ID NO: 2580844 - RNA, 22 nt, Human
gagccuucugaggacauuccaa

SEQ ID NO: 2580845 - RNA, 18 nt, Human
gagcgcaccugcccccug

SEQ ID NO: 2580846 - RNA, 17 nt, Human
gaggggccuaggccuca

SEQ ID NO: 2580847 - RNA, 19 nt, Human
gaggggccuaggccucagc

SEQ ID NO: 2580848 - RNA, 22 nt, Human
gaggggccuaggccucagccag

SEQ ID NO: 2580849 - RNA, 23 nt, Human
gaggggccuaggccucagccaga

SEQ ID NO: 2580850 - RNA, 21 nt, Human
gaggggcccguugucucccug

SEQ ID NO: 2580851 - RNA, 17 nt, Human
gaggggcccgcuugccu

SEQ ID NO: 2580852 - RNA, 14 nt, Human
gaggggccccugcu

SEQ ID NO: 2580853 - RNA, 22 nt, Human
gaggggccccugcuucuccagc

SEQ ID NO: 2580854 - RNA, 13 nt, Human
gaggggcccgagc

SEQ ID NO: 2580855 - RNA, 14 nt, Human
gaggggccucaggu

SEQ ID NO: 2580856 - RNA, 18 nt, Human
gaggcugcagccaggcca

SEQ ID NO: 2580857 - RNA, 20 nt, Human
gaggcugaggcuggcacagg

SEQ ID NO: 2580858 - RNA, 16 nt, Human
gaggcugaggcuggca

SEQ ID NO: 2580859 - RNA, 19 nt, Human
gaggcugaggcuggcacag

SEQ ID NO: 2580860 - RNA, 15 nt, Human
gaggcugaggcuggc

SEQ ID NO: 2580861 - RNA, 12 nt, Human
gaggcugaggcg

SEQ ID NO: 2580862 - RNA, 13 nt, Human
gagggcugcccug

SEQ ID NO: 2580863 - RNA, 20 nt, Human
gaggcugcagaaggccaaga

SEQ ID NO: 2580864 - RNA, 21 nt, Human
gagggcuggaaucuggagagc

SEQ ID NO: 2580865 - RNA, 20 nt, Human
gagggcuggaaucuggagag

SEQ ID NO: 2580866 - RNA, 19 nt, Human
gagggcuggaaucuggaga

SEQ ID NO: 2580867 - RNA, 18 nt, Human
gagggcuggaaucuggag

SEQ ID NO: 2580868 - RNA, 13 nt, Human
gagggcuggaauc

SEQ ID NO: 2580869 - RNA, 15 nt, Human
gagggcuggaaucug

SEQ ID NO: 2580870 - RNA, 13 nt, Human
gaggggcaggcug

SEQ ID NO: 2580871 - RNA, 23 nt, Human
gaggggcaggcccugcacugucc

SEQ ID NO: 2580872 - RNA, 17 nt, Human
gaggggcaggcccugca

SEQ ID NO: 2580873 - RNA, 15 nt, Human
gaggggcaggcccug

SEQ ID NO: 2580874 - RNA, 14 nt, Human
gaggggcaggcccu

SEQ ID NO: 2580875 - RNA, 13 nt, Human
gaggggcaggccc

SEQ ID NO: 2580876 - RNA, 16 nt, Human
gaggggcagcccuugc

SEQ ID NO: 2580877 - RNA, 16 nt, Human
gaggggcaggcugaca

SEQ ID NO: 2580878 - RNA, 14 nt, Human
gaggggcaggcuga

SEQ ID NO: 2580879 - RNA, 17 nt, Human
gaggggcaucugccccu

SEQ ID NO: 2580880 - RNA, 22 nt, Human
gaggggcaucugccccuccccc

SEQ ID NO: 2580881 - RNA, 15 nt, Human
gaggggcagguaaac

SEQ ID NO: 2580882 - RNA, 19 nt, Human
gaggggcauggccagcagc

SEQ ID NO: 2580883 - RNA, 22 nt, Human
gaggcuagugugguguuuccug

SEQ ID NO: 2580884 - RNA, 19 nt, Human
gaggccagagacacaagcc

SEQ ID NO: 2580885 - RNA, 14 nt, Human
gaggccagagacac

SEQ ID NO: 2580886 - RNA, 13 nt, Human
gaggccagagaca

SEQ ID NO: 2580887 - RNA, 20 nt, Human
gaggccaccucuccaagggc

SEQ ID NO: 2580888 - RNA, 17 nt, Human
gaggccaccucuccaag

SEQ ID NO: 2580889 - RNA, 16 nt, Human
gaggccaccucuccaa

SEQ ID NO: 2580890 - RNA, 10 nt, Human
gaggccaccu

SEQ ID NO: 2580891 - RNA, 23 nt, Human
gaggccacaugagucccaguggg

SEQ ID NO: 2580892 - RNA, 15 nt, Human
gaggccaccucucca

SEQ ID NO: 2580893 - RNA, 14 nt, Human
gaggccaccucucc

SEQ ID NO: 2580894 - RNA, 12 nt, Human
gaggccaccucu

SEQ ID NO: 2580895 - RNA, 15 nt, Human
gaggccaagugcagg

SEQ ID NO: 2580896 - RNA, 18 nt, Human
gaggccacacucagcaca

SEQ ID NO: 2580897 - RNA, 21 nt, Human
gaggccacacucagcacaagg

SEQ ID NO: 2580898 - RNA, 22 nt, Human
gaggccacaugagucccagugg

SEQ ID NO: 2580899 - RNA, 17 nt, Human
gaggccacaugaguccc

SEQ ID NO: 2580900 - RNA, 16 nt, Human
gaggccacaugagucc

SEQ ID NO: 2580901 - RNA, 17 nt, Human
gaggccaagugcaggcu

SEQ ID NO: 2580902 - RNA, 19 nt, Human
gaggcuccacuuggucugu

SEQ ID NO: 2580903 - RNA, 18 nt, Human
gaggcuccacuuggucug

SEQ ID NO: 2580904 - RNA, 10 nt, Human
gaggcucagg

SEQ ID NO: 2580905 - RNA, 20 nt, Human
gaggcuauuauuuucacugu

SEQ ID NO: 2580906 - RNA, 21 nt, Human
gaggcuagaaccaagaagggc

SEQ ID NO: 2580907 - RNA, 18 nt, Human
gaggccaccucuccaagg

SEQ ID NO: 2580908 - RNA, 18 nt, Human
gaggcuacuguaaggcaa

SEQ ID NO: 2580909 - RNA, 12 nt, Human
gaggcucagguc

SEQ ID NO: 2580910 - RNA, 14 nt, Human
gaggcugaggcaga

SEQ ID NO: 2580911 - RNA, 23 nt, Human
gaggcuccacuuggucugugaga

SEQ ID NO: 2580912 - RNA, 19 nt, Human
gaggcugaggccuggacuu

SEQ ID NO: 2580913 - RNA, 18 nt, Human
gaggcugaggccuggacu

SEQ ID NO: 2580914 - RNA, 16 nt, Human
gaggcugaggccugga

SEQ ID NO: 2580915 - RNA, 14 nt, Human
gaggcugaggccug

SEQ ID NO: 2580916 - RNA, 16 nt, Human
gaggcugaggcagaag

SEQ ID NO: 2580917 - RNA, 18 nt, Human
gaggcugaggcagaagaa

SEQ ID NO: 2580918 - RNA, 16 nt, Human
gaggcugaggcaggag

SEQ ID NO: 2580919 - RNA, 17 nt, Human
gaggcugaggcaggagg

SEQ ID NO: 2580920 - RNA, 14 nt, Human
gaggcagggucuca

SEQ ID NO: 2580921 - RNA, 15 nt, Human
gaggcaggggcggag

SEQ ID NO: 2580922 - RNA, 23 nt, Human
gaggcagggccuugcccagagau

SEQ ID NO: 2580923 - RNA, 14 nt, Human
gaggcaggggcgga

SEQ ID NO: 2580924 - RNA, 22 nt, Human
gaggcagggccuugcccagaga

SEQ ID NO: 2580925 - RNA, 15 nt, Human
gaggacgcucucugg

SEQ ID NO: 2580926 - RNA, 22 nt, Human
gaggacgagcgauugaggugua

SEQ ID NO: 2580927 - RNA, 19 nt, Human
gaggaccuuaucugugcgu

SEQ ID NO: 2580928 - RNA, 15 nt, Human
gaggaccuuaucugu

SEQ ID NO: 2580929 - RNA, 13 nt, Human
gaggcaggucccc

SEQ ID NO: 2580930 - RNA, 16 nt, Human
gaggcagguccccaga

SEQ ID NO: 2580931 - RNA, 12 nt, Human
gaggcagguccc

SEQ ID NO: 2580932 - RNA, 15 nt, Human
gaggcagggucucac

SEQ ID NO: 2580933 - RNA, 17 nt, Human
gaggccaaggugggagg

SEQ ID NO: 2580934 - RNA, 22 nt, Human
gaggccaaggugggaggauugc

SEQ ID NO: 2580935 - RNA, 22 nt, Human
gaggcagugggucccacuuccc

SEQ ID NO: 2580936 - RNA, 19 nt, Human
gaggcagugggucccacuu

SEQ ID NO: 2580937 - RNA, 14 nt, Human
gaggcagugggucc

SEQ ID NO: 2580938 - RNA, 13 nt, Human
gaggcagggucag

SEQ ID NO: 2580939 - RNA, 13 nt, Human
gaggucuaaucua

SEQ ID NO: 2580940 - RNA, 23 nt, Human
gaggucgguagguucagccaagg

SEQ ID NO: 2580941 - RNA, 22 nt, Human
gaggucgguagguucagccaag

SEQ ID NO: 2580942 - RNA, 21 nt, Human
gaggucgguagguucagccaa

SEQ ID NO: 2580943 - RNA, 22 nt, Human
gaggucgaccccaaagccccuu

SEQ ID NO: 2580944 - RNA, 20 nt, Human
gaggucgggaguucgagacc

SEQ ID NO: 2580945 - RNA, 15 nt, Human
gaggucgaggcagga

SEQ ID NO: 2580946 - RNA, 15 nt, Human
gaggugaaagggagc

SEQ ID NO: 2580947 - RNA, 19 nt, Human
gaggucuuuugacaugugg

SEQ ID NO: 2580948 - RNA, 15 nt, Human
gaggucucuugaggg

SEQ ID NO: 2580949 - RNA, 22 nt, Human
gaggucuuuugacauguggaaa

SEQ ID NO: 2580950 - RNA, 20 nt, Human
gaggucucgcugaugcuggg

SEQ ID NO: 2580951 - RNA, 17 nt, Human
gaggucucgcugaugcu

SEQ ID NO: 2580952 - RNA, 23 nt, Human
gaggucucgcugaugcugggcug

SEQ ID NO: 2580953 - RNA, 22 nt, Human
gaggucucgcugaugcugggcu

SEQ ID NO: 2580954 - RNA, 16 nt, Human
gaggucucugccggcu

SEQ ID NO: 2580955 - RNA, 14 nt, Human
gaggucucuugagg

SEQ ID NO: 2580956 - RNA, 23 nt, Human
gaggugaccccagguuucuaugu

SEQ ID NO: 2580957 - RNA, 16 nt, Human
gaggugaaagggagcu

SEQ ID NO: 2580958 - RNA, 18 nt, Human
gagugacagaggcagccc

SEQ ID NO: 2580959 - RNA, 15 nt, Human
gagucccaaggaaag

SEQ ID NO: 2580960 - RNA, 16 nt, Human
gagucccaaggaaagc

SEQ ID NO: 2580961 - RNA, 16 nt, Human
gaguccauucucccag

SEQ ID NO: 2580962 - RNA, 15 nt, Human
gaguccauucuccca

SEQ ID NO: 2580963 - RNA, 18 nt, Human
gagucagguuugggguuc

SEQ ID NO: 2580964 - RNA, 18 nt, Human
gaguccauucucccaggu

SEQ ID NO: 2580965 - RNA, 17 nt, Human
gaguccauucucccagg

SEQ ID NO: 2580966 - RNA, 14 nt, Human
gagucccaaggaaa

SEQ ID NO: 2580967 - RNA, 12 nt, Human
gagucccaccuu

SEQ ID NO: 2580968 - RNA, 22 nt, Human
gagucagaaguuucugccgcag

SEQ ID NO: 2580969 - RNA, 22 nt, Human
gagucagacauuuuaagauggu

SEQ ID NO: 2580970 - RNA, 11 nt, Human
gagucagccuu

SEQ ID NO: 2580971 - RNA, 18 nt, Human
gagucagggagagcugaa

SEQ ID NO: 2580972 - RNA, 17 nt, Human
gagucagggaccccugc

SEQ ID NO: 2580973 - RNA, 18 nt, Human
gagucagggaccccugcc

SEQ ID NO: 2580974 - RNA, 22 nt, Human
gagucagggaccccugcccuug

SEQ ID NO: 2580975 - RNA, 20 nt, Human
gaggugcuuaagcagaagca

SEQ ID NO: 2580976 - RNA, 16 nt, Human
gagguggaagaaggga

SEQ ID NO: 2580977 - RNA, 15 nt, Human
gagguggaagaaggg

SEQ ID NO: 2580978 - RNA, 13 nt, Human
gagguggaagaag

SEQ ID NO: 2580979 - RNA, 22 nt, Human
gaggugcuuaagcagaagcauu

SEQ ID NO: 2580980 - RNA, 17 nt, Human
gagguggaagagggcug

SEQ ID NO: 2580981 - RNA, 20 nt, Human
gagguggaagagggcugcaa

SEQ ID NO: 2580982 - RNA, 16 nt, Human
gagucaccaagcccag

SEQ ID NO: 2580983 - RNA, 15 nt, Human
gagucaccaagccca

SEQ ID NO: 2580984 - RNA, 18 nt, Human
gagguggaagaagggaga

SEQ ID NO: 2580985 - RNA, 17 nt, Human
gagguggaagaagggag

SEQ ID NO: 2580986 - RNA, 19 nt, Human
gagguggaagaagggagaa

SEQ ID NO: 2580987 - RNA, 15 nt, Human
gagguggaagcccuc

SEQ ID NO: 2580988 - RNA, 17 nt, Human
gagucaccaagcccagu

SEQ ID NO: 2580989 - RNA, 20 nt, Human
gagguggaagcccuccuucc

SEQ ID NO: 2580990 - RNA, 14 nt, Human
gagucaccaggaau

SEQ ID NO: 2580991 - RNA, 20 nt, Human
gagucacccaugaagacagg

SEQ ID NO: 2580992 - RNA, 17 nt, Human
gaguugaucuggaaccc

SEQ ID NO: 2580993 - RNA, 19 nt, Human
gaguugaucuggaacccag

SEQ ID NO: 2580994 - RNA, 20 nt, Human
gaguugaucuggaacccaga

SEQ ID NO: 2580995 - RNA, 21 nt, Human
gaguugaucuggaacccagac

SEQ ID NO: 2580996 - RNA, 15 nt, Human
gaguugauucagcuc

SEQ ID NO: 2580997 - RNA, 16 nt, Human
gaguugauucagcucu

SEQ ID NO: 2580998 - RNA, 17 nt, Human
gaguugauucagcucug

SEQ ID NO: 2580999 - RNA, 19 nt, Human
gaguggcaggggacaggag

SEQ ID NO: 2581000 - RNA, 16 nt, Human
gaguggcaggggacag

SEQ ID NO: 2581001 - RNA, 14 nt, Human
gaguggcaggggac

SEQ ID NO: 2581002 - RNA, 23 nt, Human
gaguggcaggggacaggagucca

SEQ ID NO: 2581003 - RNA, 14 nt, Human
gaguugaucuggaa

SEQ ID NO: 2581004 - RNA, 16 nt, Human
gaguugaucuggaacc

SEQ ID NO: 2581005 - RNA, 17 nt, Human
gaguggaucuccaagga

SEQ ID NO: 2581006 - RNA, 16 nt, Human
gaguggaucuccaagg

SEQ ID NO: 2581007 - RNA, 22 nt, Human
gaguggaucuccaaggaccagg

SEQ ID NO: 2581008 - RNA, 19 nt, Human
gaguggaucuccaaggacc

SEQ ID NO: 2581009 - RNA, 18 nt, Human
gaguggaugauguuucgu

SEQ ID NO: 2581010 - RNA, 20 nt, Human
gagugacagaggcagcccca

SEQ ID NO: 2581011 - RNA, 18 nt, Human
gagugacggucccacacu

SEQ ID NO: 2581012 - RNA, 15 nt, Human
gagugacggucccac

SEQ ID NO: 2581013 - RNA, 19 nt, Human
gagugacaguggauugcau

SEQ ID NO: 2581014 - RNA, 20 nt, Human
gaguccauucucccagguac

SEQ ID NO: 2581015 - RNA, 18 nt, Human
gagucccaaggaaagccc

SEQ ID NO: 2581016 - RNA, 15 nt, Human
gagugacucgagggu

SEQ ID NO: 2581017 - RNA, 18 nt, Human
gagugacucgaggguugg

SEQ ID NO: 2581018 - RNA, 20 nt, Human
gagugacggucccacacugg

SEQ ID NO: 2581019 - RNA, 19 nt, Human
gagugauagucuuuugcuu

SEQ ID NO: 2581020 - RNA, 19 nt, Human
gagugaguguggcuccccu

SEQ ID NO: 2581021 - RNA, 23 nt, Human
gagugcagccguuugagaagaaa

SEQ ID NO: 2581022 - RNA, 16 nt, Human
gagugcagccguuuga

SEQ ID NO: 2581023 - RNA, 18 nt, Human
gaguggaguggaagaaga

SEQ ID NO: 2581024 - RNA, 18 nt, Human
gaguggaggaggccuggg

SEQ ID NO: 2581025 - RNA, 17 nt, Human
gaguggaggaggccugg

SEQ ID NO: 2581026 - RNA, 19 nt, Human
gaguggagguuaaggcuga

SEQ ID NO: 2581027 - RNA, 19 nt, Human
gagugcaaugacacagucu

SEQ ID NO: 2581028 - RNA, 22 nt, Human
gagugauacaacuucaagugca

SEQ ID NO: 2581029 - RNA, 16 nt, Human
gagugcaacaguagca

SEQ ID NO: 2581030 - RNA, 21 nt, Human
gagugcaagccccugcuccag

SEQ ID NO: 2581031 - RNA, 16 nt, Human
gaguuuaaauuguaau

SEQ ID NO: 2581032 - RNA, 13 nt, Human
gaguuuaaagcaa

SEQ ID NO: 2581033 - RNA, 18 nt, Human
gaguugcugcaaaccuga

SEQ ID NO: 2581034 - RNA, 14 nt, Human
gaguugaugucucc

SEQ ID NO: 2581035 - RNA, 18 nt, Human
gaguugauucagcucugc

SEQ ID NO: 2581036 - RNA, 22 nt, Human
gaguuguuacauuuuuaagugc

SEQ ID NO: 2581037 - RNA, 15 nt, Human
gaguuguugcccugg

SEQ ID NO: 2581038 - RNA, 16 nt, Human
gaguuguuuucagacu

SEQ ID NO: 2581039 - RNA, 22 nt, Human
gaguuguuuucagacucagacu

SEQ ID NO: 2581040 - RNA, 19 nt, Human
gaagcagaauaaagcaauu

SEQ ID NO: 2581041 - RNA, 18 nt, Human
gaagcagaauaaagcaau

SEQ ID NO: 2581042 - RNA, 17 nt, Human
gaagcagaauaaagcaa

SEQ ID NO: 2581043 - RNA, 16 nt, Human
gaagcagaauaaagca

SEQ ID NO: 2581044 - RNA, 15 nt, Human
gaagcagaauaaagc

SEQ ID NO: 2581045 - RNA, 14 nt, Human
gaagcagaauaaag

SEQ ID NO: 2581046 - RNA, 13 nt, Human
gaagcagaauaaa

SEQ ID NO: 2581047 - RNA, 12 nt, Human
gaagcagaauaa

SEQ ID NO: 2581048 - RNA, 23 nt, Human
gaagcacuuugggauucuuucca

SEQ ID NO: 2581049 - RNA, 22 nt, Human
gaagcagaauaaagcaauuuuc

SEQ ID NO: 2581050 - RNA, 23 nt, Human
gaagcagaauaaagcaauuuucc

SEQ ID NO: 2581051 - RNA, 21 nt, Human
gaagcagaauaaagcaauuuu

SEQ ID NO: 2581052 - RNA, 20 nt, Human
gaagcagaauaaagcaauuu

SEQ ID NO: 2581053 - RNA, 15 nt, Human
gaagcagaggaagga

SEQ ID NO: 2581054 - RNA, 21 nt, Human
gaagcagaugcaaagaggcaa

SEQ ID NO: 2581055 - RNA, 19 nt, Human
gaagcagaugcaaagaggc

SEQ ID NO: 2581056 - RNA, 20 nt, Human
gaagcagaugcaaagaggca

SEQ ID NO: 2581057 - RNA, 22 nt, Human
gaagacaaugacuuacuguaca

SEQ ID NO: 2581058 - RNA, 23 nt, Human
gaagacaaugugaaaagaaaaau

SEQ ID NO: 2581059 - RNA, 16 nt, Human
gaagacaaugacuuac

SEQ ID NO: 2581060 - RNA, 17 nt, Human
gaagaauuuucagaccc

SEQ ID NO: 2581061 - RNA, 20 nt, Human
gaagaauuuucagaccccag

SEQ ID NO: 2581062 - RNA, 21 nt, Human
gaagaauuuucagaccccagc

SEQ ID NO: 2581063 - RNA, 12 nt, Human
gaagacacagac

SEQ ID NO: 2581064 - RNA, 21 nt, Human
gaagacacagacugcgauuug

SEQ ID NO: 2581065 - RNA, 17 nt, Human
gaagacaccagagcaga

SEQ ID NO: 2581066 - RNA, 16 nt, Human
gaagacaccagagcag

SEQ ID NO: 2581067 - RNA, 15 nt, Human
gaagacaccagagca

SEQ ID NO: 2581068 - RNA, 14 nt, Human
gaagacaccagagc

SEQ ID NO: 2581069 - RNA, 23 nt, Human
gaagauuuugaaauuuuuauuaa

SEQ ID NO: 2581070 - RNA, 14 nt, Human
gaagcaaaauuuuu

SEQ ID NO: 2581071 - RNA, 21 nt, Human
gaagacaccagagcagaugca

SEQ ID NO: 2581072 - RNA, 18 nt, Human
gaagacaccagagcagau

SEQ ID NO: 2581073 - RNA, 22 nt, Human
gaagacaccagagcagaugcag

SEQ ID NO: 2581074 - RNA, 13 nt, Human
gaagcaaacacau

SEQ ID NO: 2581075 - RNA, 15 nt, Human
gaagcaaacacauua

SEQ ID NO: 2581076 - RNA, 20 nt, Human
gaagcacaugccucucucag

SEQ ID NO: 2581077 - RNA, 17 nt, Human
gaagcacaugccucucu

SEQ ID NO: 2581078 - RNA, 15 nt, Human
gaagcacaugccucu

SEQ ID NO: 2581079 - RNA, 18 nt, Human
gaagcaauaaagaagagu

SEQ ID NO: 2581080 - RNA, 19 nt, Human
gaagcaauaaagaagagug

SEQ ID NO: 2581081 - RNA, 16 nt, Human
gaagcaacagaaaaaa

SEQ ID NO: 2581082 - RNA, 20 nt, Human
gaagcaaugcuucaucccuu

SEQ ID NO: 2581083 - RNA, 16 nt, Human
gaagcaacgaagggaa

SEQ ID NO: 2581084 - RNA, 23 nt, Human
gaagcaacccaaauguucaucaa

SEQ ID NO: 2581085 - RNA, 17 nt, Human
gaagcaaacuaagcccc

SEQ ID NO: 2581086 - RNA, 16 nt, Human
gaagcaaagcaccagc

SEQ ID NO: 2581087 - RNA, 17 nt, Human
gaagcaaacacauuaag

SEQ ID NO: 2581088 - RNA, 16 nt, Human
gaacucuggcuuccag

SEQ ID NO: 2581089 - RNA, 13 nt, Human
gaacugaaaucau

SEQ ID NO: 2581090 - RNA, 14 nt, Human
gaacugaaaucaua

SEQ ID NO: 2581091 - RNA, 22 nt, Human
gaacuccuugauuuuagccuuc

SEQ ID NO: 2581092 - RNA, 20 nt, Human
gaacuccugggcucaagcag

SEQ ID NO: 2581093 - RNA, 20 nt, Human
gaacucugacaacagacuuc

SEQ ID NO: 2581094 - RNA, 17 nt, Human
gaacucucuccacccua

SEQ ID NO: 2581095 - RNA, 20 nt, Human
gaaccgcagaagccucccca

SEQ ID NO: 2581096 - RNA, 21 nt, Human
gaaccgcagaagccuccccag

SEQ ID NO: 2581097 - RNA, 15 nt, Human
gaacuccuggccuca

SEQ ID NO: 2581098 - RNA, 15 nt, Human
gaacuccuugauuuu

SEQ ID NO: 2581099 - RNA, 14 nt, Human
gaacuccugggcuc

SEQ ID NO: 2581100 - RNA, 18 nt, Human
gaaccgaggggcucagga

SEQ ID NO: 2581101 - RNA, 21 nt, Human
gaaccgaggggcucaggaaaa

SEQ ID NO: 2581102 - RNA, 23 nt, Human
gaaccgagcaaagaucaaaauaa

SEQ ID NO: 2581103 - RNA, 21 nt, Human
gaaccgagcaaagaucaaaau

SEQ ID NO: 2581104 - RNA, 19 nt, Human
gaaccgagcaaagaucaaa

SEQ ID NO: 2581105 - RNA, 23 nt, Human
gaacccuuuuggcccccgagcug

SEQ ID NO: 2581106 - RNA, 17 nt, Human
gaacccuuggcuugccc

SEQ ID NO: 2581107 - RNA, 18 nt, Human
gaacccuuggcuugccca

SEQ ID NO: 2581108 - RNA, 20 nt, Human
gaacccuuggcuugcccacg

SEQ ID NO: 2581109 - RNA, 21 nt, Human
gaacccuuggcuugcccacgu

SEQ ID NO: 2581110 - RNA, 23 nt, Human
gaacccugugcugguguccugac

SEQ ID NO: 2581111 - RNA, 17 nt, Human
gaacccuuuuggccccc

SEQ ID NO: 2581112 - RNA, 18 nt, Human
gaacccuuuuggcccccg

SEQ ID NO: 2581113 - RNA, 19 nt, Human
gaacccuuuuggcccccga

SEQ ID NO: 2581114 - RNA, 17 nt, Human
gaaccgagcaaagauca

SEQ ID NO: 2581115 - RNA, 17 nt, Human
gaacccugugcuggugu

SEQ ID NO: 2581116 - RNA, 14 nt, Human
gaacccugugcugg

SEQ ID NO: 2581117 - RNA, 19 nt, Human
gaacccugcguggggacag

SEQ ID NO: 2581118 - RNA, 12 nt, Human
gaacccuuggcu

SEQ ID NO: 2581119 - RNA, 16 nt, Human
gaacccuuggcuugcc

SEQ ID NO: 2581120 - RNA, 18 nt, Human
gaacccugcguggggaca

SEQ ID NO: 2581121 - RNA, 13 nt, Human
gaacccugugcug

SEQ ID NO: 2581122 - RNA, 12 nt, Human
gaagaauuccag

SEQ ID NO: 2581123 - RNA, 14 nt, Human
gaagaaugaacaaa

SEQ ID NO: 2581124 - RNA, 23 nt, Human
gaagaauugaacccaggaggugg

SEQ ID NO: 2581125 - RNA, 18 nt, Human
gaagaauugaacccagga

SEQ ID NO: 2581126 - RNA, 19 nt, Human
gaagaauugaacccaggag

SEQ ID NO: 2581127 - RNA, 20 nt, Human
gaagaauugaacccaggagg

SEQ ID NO: 2581128 - RNA, 13 nt, Human
gaagaauuuuaaa

SEQ ID NO: 2581129 - RNA, 12 nt, Human
gaagaauuuuaa

SEQ ID NO: 2581130 - RNA, 14 nt, Human
gaagaauuuguuau

SEQ ID NO: 2581131 - RNA, 13 nt, Human
gaagaauuuguua

SEQ ID NO: 2581132 - RNA, 15 nt, Human
gaagaauuuuaaaaa

SEQ ID NO: 2581133 - RNA, 14 nt, Human
gaagaauuuuaaaa

SEQ ID NO: 2581134 - RNA, 23 nt, Human
gaagaauuuuaaaaaugaauccu

SEQ ID NO: 2581135 - RNA, 15 nt, Human
gaagaauuuucagac

SEQ ID NO: 2581136 - RNA, 14 nt, Human
gaagaauauucagg

SEQ ID NO: 2581137 - RNA, 19 nt, Human
gaagaauacaaacauauuu

SEQ ID NO: 2581138 - RNA, 17 nt, Human
gaagaauauucaggacu

SEQ ID NO: 2581139 - RNA, 20 nt, Human
gaagaaucuguuucccagca

SEQ ID NO: 2581140 - RNA, 19 nt, Human
gaagaauauucaggacuua

SEQ ID NO: 2581141 - RNA, 12 nt, Human
gaacuggcugca

SEQ ID NO: 2581142 - RNA, 11 nt, Human
gaacuggcugc

SEQ ID NO: 2581143 - RNA, 17 nt, Human
gaacugaaguuucacau

SEQ ID NO: 2581144 - RNA, 12 nt, Human
gaacugaacuca

SEQ ID NO: 2581145 - RNA, 17 nt, Human
gaacugagcuccucugg

SEQ ID NO: 2581146 - RNA, 19 nt, Human
gaacugagcuccucugggc

SEQ ID NO: 2581147 - RNA, 17 nt, Human
gaacugccucuuuccug

SEQ ID NO: 2581148 - RNA, 22 nt, Human
gaacugcuagucaagugcgucc

SEQ ID NO: 2581149 - RNA, 21 nt, Human
gaacugccuuuggcagaguuc

SEQ ID NO: 2581150 - RNA, 12 nt, Human
gaacucugaaau

SEQ ID NO: 2581151 - RNA, 20 nt, Human
gaacugaaccggcuuuacca

SEQ ID NO: 2581152 - RNA, 17 nt, Human
gaacugcugggcuuggc

SEQ ID NO: 2581153 - RNA, 20 nt, Human
gaacugcugggcuuggcagc

SEQ ID NO: 2581154 - RNA, 20 nt, Human
gaacuggacccuguugcuaa

SEQ ID NO: 2581155 - RNA, 18 nt, Human
gaacuggacccuguugcu

SEQ ID NO: 2581156 - RNA, 16 nt, Human
gaacugcuuucuuucg

SEQ ID NO: 2581157 - RNA, 23 nt, Human
gaacuggacccuguugcuaagcc

SEQ ID NO: 2581158 - RNA, 22 nt, Human
gaacuggacccuguugcuaagc

SEQ ID NO: 2581159 - RNA, 14 nt, Human
gaacuggacucagg

SEQ ID NO: 2581160 - RNA, 15 nt, Human
gaacuggacucagga

SEQ ID NO: 2581161 - RNA, 21 nt, Human
gaacuggacucaggaugccca

SEQ ID NO: 2581162 - RNA, 23 nt, Human
gaacuggacucaggaugcccagg

SEQ ID NO: 2581163 - RNA, 20 nt, Human
gaauauugcugauggugcaa

SEQ ID NO: 2581164 - RNA, 19 nt, Human
gaauauugcugauggugca

SEQ ID NO: 2581165 - RNA, 13 nt, Human
gaauauuguccau

SEQ ID NO: 2581166 - RNA, 11 nt, Human
gaauauucagg

SEQ ID NO: 2581167 - RNA, 12 nt, Human
gaauauuuauua

SEQ ID NO: 2581168 - RNA, 19 nt, Human
gaauauuuauauuucacua

SEQ ID NO: 2581169 - RNA, 10 nt, Human
gaauauuuau

SEQ ID NO: 2581170 - RNA, 18 nt, Human
gaauauuuauauuucacu

SEQ ID NO: 2581171 - RNA, 18 nt, Human
gaauauuuauuaccucug

SEQ ID NO: 2581172 - RNA, 17 nt, Human
gaauauuuauuaccucu

SEQ ID NO: 2581173 - RNA, 15 nt, Human
gaauauuuauuaccu

SEQ ID NO: 2581174 - RNA, 13 nt, Human
gaauauuuauuac

SEQ ID NO: 2581175 - RNA, 21 nt, Human
gaauauuuauuaccucugaua

SEQ ID NO: 2581176 - RNA, 19 nt, Human
gaauauuuauuaccucuga

SEQ ID NO: 2581177 - RNA, 10 nt, Human
gaauauuuga

SEQ ID NO: 2581178 - RNA, 19 nt, Human
gaauauuuccauauggauu

SEQ ID NO: 2581179 - RNA, 20 nt, Human
gaauauuuauauuucacuau

SEQ ID NO: 2581180 - RNA, 12 nt, Human
gaauauuugaau

SEQ ID NO: 2581181 - RNA, 11 nt, Human
gaauauuugaa

SEQ ID NO: 2581182 - RNA, 15 nt, Human
gaauauugcugaugg

SEQ ID NO: 2581183 - RNA, 14 nt, Human
gaauauugcugaug

SEQ ID NO: 2581184 - RNA, 20 nt, Human
gaauauuagugaccucagcu

SEQ ID NO: 2581185 - RNA, 21 nt, Human
gaauauuagcuuuacuguuug

SEQ ID NO: 2581186 - RNA, 12 nt, Human
gaauauuagcuu

SEQ ID NO: 2581187 - RNA, 21 nt, Human
gaauaugggagaaauagugug

SEQ ID NO: 2581188 - RNA, 13 nt, Human
gaauauaauuauc

SEQ ID NO: 2581189 - RNA, 12 nt, Human
gaauauaauuau

SEQ ID NO: 2581190 - RNA, 20 nt, Human
gaauauaauauauuugugua

SEQ ID NO: 2581191 - RNA, 19 nt, Human
gaauauaauauauuugugu

SEQ ID NO: 2581192 - RNA, 16 nt, Human
gaauauaauacuguau

SEQ ID NO: 2581193 - RNA, 23 nt, Human
gaauagucuagauggcuccucuc

SEQ ID NO: 2581194 - RNA, 14 nt, Human
gaauauaaacacua

SEQ ID NO: 2581195 - RNA, 21 nt, Human
gaauauaaacacuauauggca

SEQ ID NO: 2581196 - RNA, 21 nt, Human
gaaguuguuacuaacuaaacu

SEQ ID NO: 2581197 - RNA, 20 nt, Human
gaaguugugccuuuuauagc

SEQ ID NO: 2581198 - RNA, 21 nt, Human
gaaguugauauagaacagugc

SEQ ID NO: 2581199 - RNA, 18 nt, Human
gaaguugauauagaacag

SEQ ID NO: 2581200 - RNA, 17 nt, Human
gaaguugcagugagcug

SEQ ID NO: 2581201 - RNA, 22 nt, Human
gaaguuggagugaguguggcuc

SEQ ID NO: 2581202 - RNA, 17 nt, Human
gaauaguauccuccagg

SEQ ID NO: 2581203 - RNA, 16 nt, Human
gaauaguauccuccag

SEQ ID NO: 2581204 - RNA, 14 nt, Human
gaaguuguuuguca

SEQ ID NO: 2581205 - RNA, 22 nt, Human
gaaguuguuacuaacuaaacuc

SEQ ID NO: 2581206 - RNA, 21 nt, Human
gaauaguauccuccagguuuu

SEQ ID NO: 2581207 - RNA, 20 nt, Human
gaauaguauccuccagguuu

SEQ ID NO: 2581208 - RNA, 19 nt, Human
gaauaguauccuccagguu

SEQ ID NO: 2581209 - RNA, 18 nt, Human
gaauaguauccuccaggu

SEQ ID NO: 2581210 - RNA, 13 nt, Human
gaauauaaacacu

SEQ ID NO: 2581211 - RNA, 16 nt, Human
gaauaguugagcccca

SEQ ID NO: 2581212 - RNA, 15 nt, Human
gaaguugaaugggca

SEQ ID NO: 2581213 - RNA, 22 nt, Human
gaaguucaccauuaaaagggau

SEQ ID NO: 2581214 - RNA, 20 nt, Human
gaaguucaccauuaaaaggg

SEQ ID NO: 2581215 - RNA, 19 nt, Human
gaaguucaccauuaaaagg

SEQ ID NO: 2581216 - RNA, 15 nt, Human
gaaguucaccauuaa

SEQ ID NO: 2581217 - RNA, 21 nt, Human
gaaguuauuuucuacaguggu

SEQ ID NO: 2581218 - RNA, 21 nt, Human
gaaguuagaauuccuucaggg

SEQ ID NO: 2581219 - RNA, 20 nt, Human
gaaguuagaauuccuucagg

SEQ ID NO: 2581220 - RNA, 14 nt, Human
gaaguuagaauucc

SEQ ID NO: 2581221 - RNA, 13 nt, Human
gaaguuagaauuc

SEQ ID NO: 2581222 - RNA, 16 nt, Human
gaaguuacugaaugca

SEQ ID NO: 2581223 - RNA, 15 nt, Human
gaaguuacugaaugc

SEQ ID NO: 2581224 - RNA, 15 nt, Human
gaaguuaacagagac

SEQ ID NO: 2581225 - RNA, 18 nt, Human
gaaguuacuguuauagag

SEQ ID NO: 2581226 - RNA, 14 nt, Human
gaaguuacugaaug

SEQ ID NO: 2581227 - RNA, 22 nt, Human
gaaguguuucacgagagcccgg

SEQ ID NO: 2581228 - RNA, 21 nt, Human
gaaguguuucacgagagcccg

SEQ ID NO: 2581229 - RNA, 22 nt, Human
gaaguguugcauggauguuuua

SEQ ID NO: 2581230 - RNA, 21 nt, Human
gaaguguugcauggauguuuu

SEQ ID NO: 2581231 - RNA, 18 nt, Human
gaaguguugcauggaugu

SEQ ID NO: 2581232 - RNA, 15 nt, Human
gaaguguugcaugga

SEQ ID NO: 2581233 - RNA, 13 nt, Human
gaaguguugcaug

SEQ ID NO: 2581234 - RNA, 17 nt, Human
gaaguguuaauacuagu

SEQ ID NO: 2581235 - RNA, 15 nt, Human
gaaguguguuuccuu

SEQ ID NO: 2581236 - RNA, 21 nt, Human
gaagugugggucugugugugu

SEQ ID NO: 2581237 - RNA, 24 nt, Human
gaagugugggucugugugugugua

SEQ ID NO: 2581238 - RNA, 17 nt, Human
gaaggggaggagggcgg

SEQ ID NO: 2581239 - RNA, 15 nt, Human
gaaggggaggagggc

SEQ ID NO: 2581240 - RNA, 22 nt, Human
gaaggggagauaaggguaucug

SEQ ID NO: 2581241 - RNA, 21 nt, Human
gaaggggacccccgcccccug

SEQ ID NO: 2581242 - RNA, 20 nt, Human
gaaggggacccccgcccccu

SEQ ID NO: 2581243 - RNA, 18 nt, Human
gaaggggacccccgcccc

SEQ ID NO: 2581244 - RNA, 12 nt, Human
gaagcuagcucc

SEQ ID NO: 2581245 - RNA, 19 nt, Human
gaagcuagcuccccuccuc

SEQ ID NO: 2581246 - RNA, 17 nt, Human
gaagcuagcuccccucc

SEQ ID NO: 2581247 - RNA, 22 nt, Human
gaagcuagcuccccuccucucc

SEQ ID NO: 2581248 - RNA, 16 nt, Human
gaagcuagcuccccuc

SEQ ID NO: 2581249 - RNA, 15 nt, Human
gaagcuagcuccccu

SEQ ID NO: 2581250 - RNA, 14 nt, Human
gaagcuagcucccc

SEQ ID NO: 2581251 - RNA, 20 nt, Human
gaagcuaucguaaaauuaag

SEQ ID NO: 2581252 - RNA, 19 nt, Human
gaagcuccgcuuucuaccc

SEQ ID NO: 2581253 - RNA, 20 nt, Human
gaagcucaccuguugcuuac

SEQ ID NO: 2581254 - RNA, 19 nt, Human
gaagcuauaaauuccucuu

SEQ ID NO: 2581255 - RNA, 22 nt, Human
gaagcucaccuguugcuuacaa

SEQ ID NO: 2581256 - RNA, 14 nt, Human
gaagcucagacugg

SEQ ID NO: 2581257 - RNA, 12 nt, Human
gaagcucagccc

SEQ ID NO: 2581258 - RNA, 13 nt, Human
gaagcucagccca

SEQ ID NO: 2581259 - RNA, 23 nt, Human
gaagcucuggcugaacccugugc

SEQ ID NO: 2581260 - RNA, 20 nt, Human
gaagcucuggcugaacccug

SEQ ID NO: 2581261 - RNA, 19 nt, Human
gaagcucuggcugaacccu

SEQ ID NO: 2581262 - RNA, 12 nt, Human
gaagcucuggcu

SEQ ID NO: 2581263 - RNA, 16 nt, Human
gaagcucugaagucac

SEQ ID NO: 2581264 - RNA, 20 nt, Human
gaagcucugaagucacauca

SEQ ID NO: 2581265 - RNA, 23 nt, Human
gaagcugaagugcauccaaaggu

SEQ ID NO: 2581266 - RNA, 22 nt, Human
gaagcugaagugcauccaaagg

SEQ ID NO: 2581267 - RNA, 18 nt, Human
gaagcugacgaacuucca

SEQ ID NO: 2581268 - RNA, 19 nt, Human
gaagcugacgaacuuccau

SEQ ID NO: 2581269 - RNA, 22 nt, Human
gaagcugaaaaccuaaguccuu

SEQ ID NO: 2581270 - RNA, 18 nt, Human
gaagcucuugaagacacu

SEQ ID NO: 2581271 - RNA, 17 nt, Human
gaaggccccgcccaggc

SEQ ID NO: 2581272 - RNA, 21 nt, Human
gaagcugaugcuuugcuucaa

SEQ ID NO: 2581273 - RNA, 17 nt, Human
gaagcugaugcuuugcu

SEQ ID NO: 2581274 - RNA, 19 nt, Human
gaagcugagcaccagggga

SEQ ID NO: 2581275 - RNA, 14 nt, Human
gaagcugagcacca

SEQ ID NO: 2581276 - RNA, 17 nt, Human
gaagcugagcaccaggg

SEQ ID NO: 2581277 - RNA, 18 nt, Human
gaagcugaggcgggagaa

SEQ ID NO: 2581278 - RNA, 22 nt, Human
gaagcuccgcuuucuacccagc

SEQ ID NO: 2581279 - RNA, 17 nt, Human
gaagcuccucuccccag

SEQ ID NO: 2581280 - RNA, 19 nt, Human
gaagcuccucuccccagcc

SEQ ID NO: 2581281 - RNA, 14 nt, Human
gaagcucagcccac

SEQ ID NO: 2581282 - RNA, 15 nt, Human
gaagcucagcccacc

SEQ ID NO: 2581283 - RNA, 17 nt, Human
gaagcucagcccacccc

SEQ ID NO: 2581284 - RNA, 18 nt, Human
gaagcucagcccaccccc

SEQ ID NO: 2581285 - RNA, 20 nt, Human
gaagcuccucuccccagccc

SEQ ID NO: 2581286 - RNA, 21 nt, Human
gaagcuccucuccccagccca

SEQ ID NO: 2581287 - RNA, 22 nt, Human
gaagcuccucuccccagcccag

SEQ ID NO: 2581288 - RNA, 23 nt, Human
gaagcuccucuccccagcccaga

SEQ ID NO: 2581289 - RNA, 13 nt, Human
gaagcucugaagu

SEQ ID NO: 2581290 - RNA, 15 nt, Human
gaagcucugaaguca

SEQ ID NO: 2581291 - RNA, 19 nt, Human
gaagcucagcccacccccc

SEQ ID NO: 2581292 - RNA, 22 nt, Human
gaaggcuggguucugauccuag

SEQ ID NO: 2581293 - RNA, 20 nt, Human
gaaggcuggguucugauccu

SEQ ID NO: 2581294 - RNA, 15 nt, Human
gaagggccagagcca

SEQ ID NO: 2581295 - RNA, 16 nt, Human
gaagggccagagccag

SEQ ID NO: 2581296 - RNA, 17 nt, Human
gaagggccagagccagg

SEQ ID NO: 2581297 - RNA, 18 nt, Human
gaagggccagagccaggg

SEQ ID NO: 2581298 - RNA, 16 nt, Human
gaaggcuucucucugu

SEQ ID NO: 2581299 - RNA, 14 nt, Human
gaagggccagagcc

SEQ ID NO: 2581300 - RNA, 21 nt, Human
gaaggcucuucuccccagagu

SEQ ID NO: 2581301 - RNA, 12 nt, Human
gaaggcuguccu

SEQ ID NO: 2581302 - RNA, 17 nt, Human
gaaggcuguccuuaccc

SEQ ID NO: 2581303 - RNA, 11 nt, Human
gaagggccagu

SEQ ID NO: 2581304 - RNA, 13 nt, Human
gaagggccagagc

SEQ ID NO: 2581305 - RNA, 14 nt, Human
gaagggccaguccu

SEQ ID NO: 2581306 - RNA, 16 nt, Human
gaagggccaguccugc

SEQ ID NO: 2581307 - RNA, 18 nt, Human
gaagggccaguccugccu

SEQ ID NO: 2581308 - RNA, 19 nt, Human
gaagggccaguccugccug

SEQ ID NO: 2581309 - RNA, 20 nt, Human
gaagggccaguccugccugg

SEQ ID NO: 2581310 - RNA, 18 nt, Human
gaagggccagucugggcu

SEQ ID NO: 2581311 - RNA, 14 nt, Human
gaagggccagucug

SEQ ID NO: 2581312 - RNA, 22 nt, Human
gaagggccaguccugccuggcc

SEQ ID NO: 2581313 - RNA, 20 nt, Human
gaagggcuagaaccuggagg

SEQ ID NO: 2581314 - RNA, 22 nt, Human
gaagggcuagaaccuggagagc

SEQ ID NO: 2581315 - RNA, 20 nt, Human
gaagggcuagaaccuggaga

SEQ ID NO: 2581316 - RNA, 19 nt, Human
gaagggcuagaaccuggag

SEQ ID NO: 2581317 - RNA, 20 nt, Human
gaagggccagucugggcugc

SEQ ID NO: 2581318 - RNA, 19 nt, Human
gaagggccagucugggcug

SEQ ID NO: 2581319 - RNA, 21 nt, Human
gaagggcccuucacugccuuu

SEQ ID NO: 2581320 - RNA, 21 nt, Human
gaagggcuuggacucaagcaa

SEQ ID NO: 2581321 - RNA, 16 nt, Human
gaaggggacccccgcc

SEQ ID NO: 2581322 - RNA, 19 nt, Human
gaaggccccgcccaggcuu

SEQ ID NO: 2581323 - RNA, 18 nt, Human
gaaggccccgcccaggcu

SEQ ID NO: 2581324 - RNA, 21 nt, Human
gaaggcucgagcaugccugga

SEQ ID NO: 2581325 - RNA, 17 nt, Human
gaaggccgagaagcaag

SEQ ID NO: 2581326 - RNA, 18 nt, Human
gaaggccgagaagcaaga

SEQ ID NO: 2581327 - RNA, 20 nt, Human
gaaggccucccuagccagca

SEQ ID NO: 2581328 - RNA, 22 nt, Human
gaaggccgagaagcaagaaaga

SEQ ID NO: 2581329 - RNA, 19 nt, Human
gaaggcuggguucugaucc

SEQ ID NO: 2581330 - RNA, 15 nt, Human
gaaggcuggguucug

SEQ ID NO: 2581331 - RNA, 13 nt, Human
gaaggcuggcugg

SEQ ID NO: 2581332 - RNA, 16 nt, Human
gaaggcuggcugggca

SEQ ID NO: 2581333 - RNA, 23 nt, Human
gaaggcucuucuccccagaguuc

SEQ ID NO: 2581334 - RNA, 18 nt, Human
gaaggcucuucuccccag

SEQ ID NO: 2581335 - RNA, 19 nt, Human
gaaggcucgagcaugccug

SEQ ID NO: 2581336 - RNA, 20 nt, Human
gacagaaccccuacaugaaa

SEQ ID NO: 2581337 - RNA, 15 nt, Human
gacagaagcagcucu

SEQ ID NO: 2581338 - RNA, 17 nt, Human
gacagcccgggcucugc

SEQ ID NO: 2581339 - RNA, 21 nt, Human
gacagaaagcagaacagugau

SEQ ID NO: 2581340 - RNA, 15 nt, Human
gacagaacacugucu

SEQ ID NO: 2581341 - RNA, 14 nt, Human
gacagaacacuguc

SEQ ID NO: 2581342 - RNA, 13 nt, Human
gacagaacacugu

SEQ ID NO: 2581343 - RNA, 20 nt, Human
gacacaggaugaaggcaaug

SEQ ID NO: 2581344 - RNA, 17 nt, Human
gacacaggaugaaggca

SEQ ID NO: 2581345 - RNA, 22 nt, Human
gacacagcuuuaucaccagaga

SEQ ID NO: 2581346 - RNA, 23 nt, Human
gacacagcuuuaucaccagagag

SEQ ID NO: 2581347 - RNA, 12 nt, Human
gacacaggcccg

SEQ ID NO: 2581348 - RNA, 23 nt, Human
gacacagcucuucuccaggcugu

SEQ ID NO: 2581349 - RNA, 22 nt, Human
gacacagcucuucuccaggcug

SEQ ID NO: 2581350 - RNA, 17 nt, Human
gacacagcucuucucca

SEQ ID NO: 2581351 - RNA, 11 nt, Human
gacacagaaaa

SEQ ID NO: 2581352 - RNA, 16 nt, Human
gacacagaaaauguug

SEQ ID NO: 2581353 - RNA, 18 nt, Human
gacacagaaaauguugag

SEQ ID NO: 2581354 - RNA, 13 nt, Human
gacacagcucuuc

SEQ ID NO: 2581355 - RNA, 16 nt, Human
gacacagcucuucucc

SEQ ID NO: 2581356 - RNA, 14 nt, Human
gacacagcucuucu

SEQ ID NO: 2581357 - RNA, 16 nt, Human
gacacacugaagaagc

SEQ ID NO: 2581358 - RNA, 15 nt, Human
gacacacugaagaag

SEQ ID NO: 2581359 - RNA, 17 nt, Human
gacauuugcucauggaa

SEQ ID NO: 2581360 - RNA, 16 nt, Human
gacauuugcucaugga

SEQ ID NO: 2581361 - RNA, 15 nt, Human
gacauuugccuugcu

SEQ ID NO: 2581362 - RNA, 21 nt, Human
gacauuucucuuacugcaaau

SEQ ID NO: 2581363 - RNA, 20 nt, Human
gacauuucucuuacugcaaa

SEQ ID NO: 2581364 - RNA, 19 nt, Human
gacauuucucuuacugcaa

SEQ ID NO: 2581365 - RNA, 16 nt, Human
gacauuucuuugugcu

SEQ ID NO: 2581366 - RNA, 13 nt, Human
gacauuucucuaa

SEQ ID NO: 2581367 - RNA, 16 nt, Human
gacauuucucuaagag

SEQ ID NO: 2581368 - RNA, 18 nt, Human
gacauuuauacucuuuuu

SEQ ID NO: 2581369 - RNA, 21 nt, Human
gacauuguuuugccaacauug

SEQ ID NO: 2581370 - RNA, 11 nt, Human
gacauuuccca

SEQ ID NO: 2581371 - RNA, 19 nt, Human
gacauuguuggccaaagcc

SEQ ID NO: 2581372 - RNA, 20 nt, Human
gacauuguuuugccaacauu

SEQ ID NO: 2581373 - RNA, 14 nt, Human
gacauuguuuugcc

SEQ ID NO: 2581374 - RNA, 13 nt, Human
gacauuguuuugc

SEQ ID NO: 2581375 - RNA, 22 nt, Human
gacauuguuggcagcauaaagg

SEQ ID NO: 2581376 - RNA, 22 nt, Human
gacauuguuuugccaacauugc

SEQ ID NO: 2581377 - RNA, 23 nt, Human
gacauuccugggcacaguuuggu

SEQ ID NO: 2581378 - RNA, 17 nt, Human
gacauuccugggcacag

SEQ ID NO: 2581379 - RNA, 16 nt, Human
gacauuccugggcaca

SEQ ID NO: 2581380 - RNA, 22 nt, Human
gacauuccuaaacuaucuuuuu

SEQ ID NO: 2581381 - RNA, 20 nt, Human
gacauuccuaaacuaucuuu

SEQ ID NO: 2581382 - RNA, 18 nt, Human
gacauucaugccuggcuu

SEQ ID NO: 2581383 - RNA, 16 nt, Human
gacauucaugccuggc

SEQ ID NO: 2581384 - RNA, 23 nt, Human
gacauucugucgccuuagcaugu

SEQ ID NO: 2581385 - RNA, 17 nt, Human
gacauucugccaggccc

SEQ ID NO: 2581386 - RNA, 11 nt, Human
gacauucuguc

SEQ ID NO: 2581387 - RNA, 22 nt, Human
gacauucugccaggcccccaag

SEQ ID NO: 2581388 - RNA, 14 nt, Human
gacauucugccagg

SEQ ID NO: 2581389 - RNA, 15 nt, Human
gacauugcggacagc

SEQ ID NO: 2581390 - RNA, 14 nt, Human
gacauugcggacag

SEQ ID NO: 2581391 - RNA, 12 nt, Human
gacauugucaau

SEQ ID NO: 2581392 - RNA, 19 nt, Human
gacauuguagagcuucugg

SEQ ID NO: 2581393 - RNA, 17 nt, Human
gacauugucagcaaauu

SEQ ID NO: 2581394 - RNA, 13 nt, Human
gacauugucaaua

SEQ ID NO: 2581395 - RNA, 14 nt, Human
gacauugucaauaa

SEQ ID NO: 2581396 - RNA, 18 nt, Human
gacauuguggcacauucu

SEQ ID NO: 2581397 - RNA, 15 nt, Human
gacauugucaauaaa

SEQ ID NO: 2581398 - RNA, 17 nt, Human
gacauuguuggcagcau

SEQ ID NO: 2581399 - RNA, 19 nt, Human
gacagcccgggcucugccu

SEQ ID NO: 2581400 - RNA, 18 nt, Human
gacagcccgggcucugcc

SEQ ID NO: 2581401 - RNA, 16 nt, Human
gacagaagcagcucuu

SEQ ID NO: 2581402 - RNA, 20 nt, Human
gacagcccgggcucugccuc

SEQ ID NO: 2581403 - RNA, 13 nt, Human
gacagaagaaggc

SEQ ID NO: 2581404 - RNA, 21 nt, Human
gacagugagacucugucucag

SEQ ID NO: 2581405 - RNA, 15 nt, Human
gacagugaucuccau

SEQ ID NO: 2581406 - RNA, 21 nt, Human
gacagugaucuccauauguua

SEQ ID NO: 2581407 - RNA, 13 nt, Human
gacagugccuggg

SEQ ID NO: 2581408 - RNA, 18 nt, Human
gacauucaccugccccaa

SEQ ID NO: 2581409 - RNA, 16 nt, Human
gacagugcuucagccu

SEQ ID NO: 2581410 - RNA, 16 nt, Human
gacagugaucuccaua

SEQ ID NO: 2581411 - RNA, 17 nt, Human
gacagugccugggaaug

SEQ ID NO: 2581412 - RNA, 21 nt, Human
gacagugccugggaauguauu

SEQ ID NO: 2581413 - RNA, 22 nt, Human
gacagugccugggaauguauua

SEQ ID NO: 2581414 - RNA, 16 nt, Human
gacauuccaagacagu

SEQ ID NO: 2581415 - RNA, 21 nt, Human
gacauucaccugccccaacuc

SEQ ID NO: 2581416 - RNA, 13 nt, Human
gacauucaugccu

SEQ ID NO: 2581417 - RNA, 19 nt, Human
gaccaucccugaaggcccc

SEQ ID NO: 2581418 - RNA, 18 nt, Human
gaccaucccugaaggccc

SEQ ID NO: 2581419 - RNA, 13 nt, Human
gaccaucccugaa

SEQ ID NO: 2581420 - RNA, 12 nt, Human
gaccaucccuga

SEQ ID NO: 2581421 - RNA, 14 nt, Human
gaccagggagccuu

SEQ ID NO: 2581422 - RNA, 15 nt, Human
gaccagggagccuuu

SEQ ID NO: 2581423 - RNA, 22 nt, Human
gaccagggagccuuugguucug

SEQ ID NO: 2581424 - RNA, 14 nt, Human
gaccagggcagggc

SEQ ID NO: 2581425 - RNA, 20 nt, Human
gaccagggauuuccaugaug

SEQ ID NO: 2581426 - RNA, 15 nt, Human
gaccagggcagggcc

SEQ ID NO: 2581427 - RNA, 16 nt, Human
gaccagggcagggcca

SEQ ID NO: 2581428 - RNA, 20 nt, Human
gaccauaauguuacauuauu

SEQ ID NO: 2581429 - RNA, 13 nt, Human
gaccauacuaauu

SEQ ID NO: 2581430 - RNA, 15 nt, Human
gaccauaauguuaca

SEQ ID NO: 2581431 - RNA, 19 nt, Human
gaccauccacucuacccuc

SEQ ID NO: 2581432 - RNA, 13 nt, Human
gaccagcucagga

SEQ ID NO: 2581433 - RNA, 14 nt, Human
gaccagcucaggac

SEQ ID NO: 2581434 - RNA, 22 nt, Human
gaccagcucaggacagaugcca

SEQ ID NO: 2581435 - RNA, 18 nt, Human
gaccagggauuuccauga

SEQ ID NO: 2581436 - RNA, 13 nt, Human
gaccagcuggggc

SEQ ID NO: 2581437 - RNA, 12 nt, Human
gaccagcugggg

SEQ ID NO: 2581438 - RNA, 11 nt, Human
gaccagcuggg

SEQ ID NO: 2581439 - RNA, 23 nt, Human
gaccagcuggggcguggggaggg

SEQ ID NO: 2581440 - RNA, 23 nt, Human
gaccagccuguuggacccgcucu

SEQ ID NO: 2581441 - RNA, 12 nt, Human
gaccagcucagg

SEQ ID NO: 2581442 - RNA, 12 nt, Human
gaccagccuggg

SEQ ID NO: 2581443 - RNA, 17 nt, Human
gaccagccugggcagca

SEQ ID NO: 2581444 - RNA, 22 nt, Human
gaccagccuggccaacauggua

SEQ ID NO: 2581445 - RNA, 15 nt, Human
gacgcucucuggccu

SEQ ID NO: 2581446 - RNA, 19 nt, Human
gacgcuacccgggaagggg

SEQ ID NO: 2581447 - RNA, 18 nt, Human
gacgcuacccgggaaggg

SEQ ID NO: 2581448 - RNA, 16 nt, Human
gacgcuacccgggaag

SEQ ID NO: 2581449 - RNA, 18 nt, Human
gacgccaucccagcccca

SEQ ID NO: 2581450 - RNA, 17 nt, Human
gacgccaucccagcccc

SEQ ID NO: 2581451 - RNA, 21 nt, Human
gacgccugggggugccaggac

SEQ ID NO: 2581452 - RNA, 14 nt, Human
gacgcgucuccugu

SEQ ID NO: 2581453 - RNA, 12 nt, Human
gacgccuggggg

SEQ ID NO: 2581454 - RNA, 19 nt, Human
gacgccugggggugccagg

SEQ ID NO: 2581455 - RNA, 16 nt, Human
gacgcucucuggccuu

SEQ ID NO: 2581456 - RNA, 17 nt, Human
gacgcucucuggccuuc

SEQ ID NO: 2581457 - RNA, 15 nt, Human
gacgcgucuccuguu

SEQ ID NO: 2581458 - RNA, 16 nt, Human
gacgccaucccagccc

SEQ ID NO: 2581459 - RNA, 14 nt, Human
gaccugaggcccuu

SEQ ID NO: 2581460 - RNA, 13 nt, Human
gaccugaggcccu

SEQ ID NO: 2581461 - RNA, 11 nt, Human
gaccugaggcc

SEQ ID NO: 2581462 - RNA, 14 nt, Human
gaccucuguugucc

SEQ ID NO: 2581463 - RNA, 12 nt, Human
gaccucuguugu

SEQ ID NO: 2581464 - RNA, 12 nt, Human
gaccugaagaau

SEQ ID NO: 2581465 - RNA, 16 nt, Human
gaccugaagagugguc

SEQ ID NO: 2581466 - RNA, 13 nt, Human
gaccugaaguuca

SEQ ID NO: 2581467 - RNA, 22 nt, Human
gaccugaaguucaccauuaaaa

SEQ ID NO: 2581468 - RNA, 15 nt, Human
gaccugacuauugaa

SEQ ID NO: 2581469 - RNA, 16 nt, Human
gaccugagcuccccac

SEQ ID NO: 2581470 - RNA, 18 nt, Human
gaccugagcuccccacca

SEQ ID NO: 2581471 - RNA, 22 nt, Human
gaccugagcuccccaccacccc

SEQ ID NO: 2581472 - RNA, 13 nt, Human
gaccugaggaagc

SEQ ID NO: 2581473 - RNA, 14 nt, Human
gaccugaggaagcg

SEQ ID NO: 2581474 - RNA, 19 nt, Human
gaccucuccaucuucagcu

SEQ ID NO: 2581475 - RNA, 16 nt, Human
gaccucuguuguccuc

SEQ ID NO: 2581476 - RNA, 15 nt, Human
gaccucugcucugag

SEQ ID NO: 2581477 - RNA, 16 nt, Human
gaccucugcucugagg

SEQ ID NO: 2581478 - RNA, 14 nt, Human
gaccucugcagcaa

SEQ ID NO: 2581479 - RNA, 22 nt, Human
gaccucguccucccccugccag

SEQ ID NO: 2581480 - RNA, 12 nt, Human
gaccucucccag

SEQ ID NO: 2581481 - RNA, 22 nt, Human
gaccucuccccuggaacugucu

SEQ ID NO: 2581482 - RNA, 14 nt, Human
gaccucucccaggg

SEQ ID NO: 2581483 - RNA, 20 nt, Human
gaccaucccugaaggccccg

SEQ ID NO: 2581484 - RNA, 13 nt, Human
gaccauccuauuu

SEQ ID NO: 2581485 - RNA, 21 nt, Human
gaccauccacucuacccuccc

SEQ ID NO: 2581486 - RNA, 23 nt, Human
gaccauccacucuacccucccac

SEQ ID NO: 2581487 - RNA, 17 nt, Human
gaccucguccucccccu

SEQ ID NO: 2581488 - RNA, 18 nt, Human
gaccucguccucccccug

SEQ ID NO: 2581489 - RNA, 19 nt, Human
gaccucguccucccccugc

SEQ ID NO: 2581490 - RNA, 21 nt, Human
gaccucguccucccccugcca

SEQ ID NO: 2581491 - RNA, 15 nt, Human
gaccucguccucccc

SEQ ID NO: 2581492 - RNA, 16 nt, Human
gaccucguccuccccc

SEQ ID NO: 2581493 - RNA, 13 nt, Human
gacuuuagggacu

SEQ ID NO: 2581494 - RNA, 22 nt, Human
gacuuuaucuaauaccucugug

SEQ ID NO: 2581495 - RNA, 21 nt, Human
gacuuuaucuaauaccucugu

SEQ ID NO: 2581496 - RNA, 17 nt, Human
gacuuuagucugcaaaa

SEQ ID NO: 2581497 - RNA, 19 nt, Human
gacuuuauuuucugguaga

SEQ ID NO: 2581498 - RNA, 12 nt, Human
gacuuucaggua

SEQ ID NO: 2581499 - RNA, 14 nt, Human
gacuuucagguacu

SEQ ID NO: 2581500 - RNA, 17 nt, Human
gacucuucugagcaccu

SEQ ID NO: 2581501 - RNA, 12 nt, Human
gacucuugcucu

SEQ ID NO: 2581502 - RNA, 14 nt, Human
gacucuuguuuuca

SEQ ID NO: 2581503 - RNA, 16 nt, Human
gacucuugcucuuucu

SEQ ID NO: 2581504 - RNA, 15 nt, Human
gacucuugcucuuuc

SEQ ID NO: 2581505 - RNA, 9 nt, Human
gacucuugu

SEQ ID NO: 2581506 - RNA, 21 nt, Human
gacucuuaagaagacugcauu

SEQ ID NO: 2581507 - RNA, 15 nt, Human
gacucuuacuuuuua

SEQ ID NO: 2581508 - RNA, 17 nt, Human
gacucuguggggccuug

SEQ ID NO: 2581509 - RNA, 18 nt, Human
gacucuguggggccuugg

SEQ ID NO: 2581510 - RNA, 15 nt, Human
gacucuuaagaagac

SEQ ID NO: 2581511 - RNA, 14 nt, Human
gacucuuaagaaga

SEQ ID NO: 2581512 - RNA, 21 nt, Human
gacucugcccccugcuggcuc

SEQ ID NO: 2581513 - RNA, 19 nt, Human
gacucugcccccugcuggc

SEQ ID NO: 2581514 - RNA, 22 nt, Human
gacucugcccccugcuggcucu

SEQ ID NO: 2581515 - RNA, 19 nt, Human
gacucugucucaaaaaaac

SEQ ID NO: 2581516 - RNA, 13 nt, Human
gacucagaagccu

SEQ ID NO: 2581517 - RNA, 15 nt, Human
gacucagaagccucu

SEQ ID NO: 2581518 - RNA, 16 nt, Human
gacucagaagccucug

SEQ ID NO: 2581519 - RNA, 17 nt, Human
gacucagaagccucugg

SEQ ID NO: 2581520 - RNA, 20 nt, Human
gacucugcacaugucuugua

SEQ ID NO: 2581521 - RNA, 18 nt, Human
gacucugcccccugcugg

SEQ ID NO: 2581522 - RNA, 17 nt, Human
gacucugcccccugcug

SEQ ID NO: 2581523 - RNA, 16 nt, Human
gacucugcccccugcu

SEQ ID NO: 2581524 - RNA, 15 nt, Human
gacucugcccccugc

SEQ ID NO: 2581525 - RNA, 14 nt, Human
gacucugcccccug

SEQ ID NO: 2581526 - RNA, 13 nt, Human
gacucugcccccu

SEQ ID NO: 2581527 - RNA, 12 nt, Human
gacucugccccc

SEQ ID NO: 2581528 - RNA, 10 nt, Human
gacucugccc

SEQ ID NO: 2581529 - RNA, 16 nt, Human
gacucugccuccucuu

SEQ ID NO: 2581530 - RNA, 12 nt, Human
gacucugccucc

SEQ ID NO: 2581531 - RNA, 12 nt, Human
gacucacccaag

SEQ ID NO: 2581532 - RNA, 12 nt, Human
gacucaccucug

SEQ ID NO: 2581533 - RNA, 13 nt, Human
gacucaccucugc

SEQ ID NO: 2581534 - RNA, 14 nt, Human
gacucaccucugcc

SEQ ID NO: 2581535 - RNA, 15 nt, Human
gacucaccucugccu

SEQ ID NO: 2581536 - RNA, 17 nt, Human
gacucaccucugccuca

SEQ ID NO: 2581537 - RNA, 17 nt, Human
gacucaccuguuacuug

SEQ ID NO: 2581538 - RNA, 18 nt, Human
gacucaccucugccucaa

SEQ ID NO: 2581539 - RNA, 23 nt, Human
gacucacuuaucccaagagaaug

SEQ ID NO: 2581540 - RNA, 15 nt, Human
gacucaccuccccca

SEQ ID NO: 2581541 - RNA, 22 nt, Human
gacucaccucccccaucucuuc

SEQ ID NO: 2581542 - RNA, 23 nt, Human
gacuguacuccucccaggcgccc

SEQ ID NO: 2581543 - RNA, 18 nt, Human
gacuguacuccucccagg

SEQ ID NO: 2581544 - RNA, 14 nt, Human
gacugaauuucuuu

SEQ ID NO: 2581545 - RNA, 16 nt, Human
gacugaagccugcagg

SEQ ID NO: 2581546 - RNA, 18 nt, Human
gacugaagaugcagcuca

SEQ ID NO: 2581547 - RNA, 19 nt, Human
gacugugacaggcagcaga

SEQ ID NO: 2581548 - RNA, 18 nt, Human
gacugugacaggcagcag

SEQ ID NO: 2581549 - RNA, 17 nt, Human
gacugugacaggcagca

SEQ ID NO: 2581550 - RNA, 16 nt, Human
gacuguauuugugacu

SEQ ID NO: 2581551 - RNA, 13 nt, Human
gacugucuuucag

SEQ ID NO: 2581552 - RNA, 14 nt, Human
gacuguauuuguga

SEQ ID NO: 2581553 - RNA, 15 nt, Human
gacuguauuugugac

SEQ ID NO: 2581554 - RNA, 19 nt, Human
gacuguauauaaaggaaaa

SEQ ID NO: 2581555 - RNA, 14 nt, Human
gacuguauauaaag

SEQ ID NO: 2581556 - RNA, 23 nt, Human
gacuguagggagggcggcagggg

SEQ ID NO: 2581557 - RNA, 22 nt, Human
gacuguagggagggcggcaggg

SEQ ID NO: 2581558 - RNA, 13 nt, Human
gacuguagggagg

SEQ ID NO: 2581559 - RNA, 18 nt, Human
gacugaauuguccccagu

SEQ ID NO: 2581560 - RNA, 11 nt, Human
gacuguagaaa

SEQ ID NO: 2581561 - RNA, 22 nt, Human
gacugugugcucaggagcccug

SEQ ID NO: 2581562 - RNA, 19 nt, Human
gacugugaugccacacaga

SEQ ID NO: 2581563 - RNA, 20 nt, Human
gacugugacaggcagcagag

SEQ ID NO: 2581564 - RNA, 13 nt, Human
gacugugaugcca

SEQ ID NO: 2581565 - RNA, 12 nt, Human
gacuguggcugc

SEQ ID NO: 2581566 - RNA, 14 nt, Human
gacuguggcugcua

SEQ ID NO: 2581567 - RNA, 15 nt, Human
gacuguggcugcuag

SEQ ID NO: 2581568 - RNA, 19 nt, Human
gacuguucaagagcacacu

SEQ ID NO: 2581569 - RNA, 18 nt, Human
gacuguucaagagcacac

SEQ ID NO: 2581570 - RNA, 14 nt, Human
gacuguucaagagc

SEQ ID NO: 2581571 - RNA, 22 nt, Human
gacuguuagaaaauggacacug

SEQ ID NO: 2581572 - RNA, 14 nt, Human
gacuguuccugucu

SEQ ID NO: 2581573 - RNA, 21 nt, Human
gacuguugggguggguauaaa

SEQ ID NO: 2581574 - RNA, 21 nt, Human
gacuguguguugccacaggac

SEQ ID NO: 2581575 - RNA, 22 nt, Human
gacuguguguugccacaggaca

SEQ ID NO: 2581576 - RNA, 18 nt, Human
gacuuguuuuugcacaug

SEQ ID NO: 2581577 - RNA, 23 nt, Human
gacuguucaagagcacacuuggc

SEQ ID NO: 2581578 - RNA, 13 nt, Human
ggcaggcucacug

SEQ ID NO: 2581579 - RNA, 19 nt, Human
ggcaggcuagaaccuggca

SEQ ID NO: 2581580 - RNA, 18 nt, Human
ggcaggcuagaaccuggc

SEQ ID NO: 2581581 - RNA, 22 nt, Human
ggcaggcuaaggcguggagcug

SEQ ID NO: 2581582 - RNA, 21 nt, Human
ggcaggcuaaggcguggagcu

SEQ ID NO: 2581583 - RNA, 17 nt, Human
ggcaggcuaaggcgugg

SEQ ID NO: 2581584 - RNA, 22 nt, Human
ggcaggcccugcacuguccugc

SEQ ID NO: 2581585 - RNA, 22 nt, Human
ggcaggcucacugccaggccag

SEQ ID NO: 2581586 - RNA, 19 nt, Human
ggcaggcucacugccaggc

SEQ ID NO: 2581587 - RNA, 16 nt, Human
ggcaggcucacugcca

SEQ ID NO: 2581588 - RNA, 15 nt, Human
ggcaggcucacugcc

SEQ ID NO: 2581589 - RNA, 18 nt, Human
ggcaggcugacaucugug

SEQ ID NO: 2581590 - RNA, 16 nt, Human
ggcaggcugacaucug

SEQ ID NO: 2581591 - RNA, 10 nt, Human
ggcaggcagu

SEQ ID NO: 2581592 - RNA, 21 nt, Human
ggcaggcccugcacuguccug

SEQ ID NO: 2581593 - RNA, 19 nt, Human
ggcaggcccugcacugucc

SEQ ID NO: 2581594 - RNA, 16 nt, Human
ggcaggcccugcacug

SEQ ID NO: 2581595 - RNA, 15 nt, Human
ggcaggcccugcacu

SEQ ID NO: 2581596 - RNA, 14 nt, Human
ggcaggcccugcac

SEQ ID NO: 2581597 - RNA, 13 nt, Human
ggcaggcccugca

SEQ ID NO: 2581598 - RNA, 17 nt, Human
ggcaggcuggccagucc

SEQ ID NO: 2581599 - RNA, 13 nt, Human
ggcaggcuggcca

SEQ ID NO: 2581600 - RNA, 12 nt, Human
ggcaggcuggcc

SEQ ID NO: 2581601 - RNA, 11 nt, Human
ggcaggcuggc

SEQ ID NO: 2581602 - RNA, 20 nt, Human
ggcaggcuggccaguccagg

SEQ ID NO: 2581603 - RNA, 16 nt, Human
ggcaggcuggcuggcc

SEQ ID NO: 2581604 - RNA, 17 nt, Human
ggcagaaaauugcacaa

SEQ ID NO: 2581605 - RNA, 11 nt, Human
ggcagaaaauu

SEQ ID NO: 2581606 - RNA, 17 nt, Human
ggcagaaagcaaaauua

SEQ ID NO: 2581607 - RNA, 22 nt, Human
ggcagaaagcaaaugugaccug

SEQ ID NO: 2581608 - RNA, 22 nt, Human
ggcacuuugaaggggccucacc

SEQ ID NO: 2581609 - RNA, 14 nt, Human
ggcacuuuuuaauu

SEQ ID NO: 2581610 - RNA, 19 nt, Human
ggcagaagacaccagagca

SEQ ID NO: 2581611 - RNA, 18 nt, Human
ggcagaagacaccagagc

SEQ ID NO: 2581612 - RNA, 17 nt, Human
ggcagaagacaccagag

SEQ ID NO: 2581613 - RNA, 16 nt, Human
ggcagaagacaccaga

SEQ ID NO: 2581614 - RNA, 21 nt, Human
ggcagaagacaccagagcaga

SEQ ID NO: 2581615 - RNA, 20 nt, Human
ggcagaagacaccagagcag

SEQ ID NO: 2581616 - RNA, 17 nt, Human
ggcagaaggcaaaccca

SEQ ID NO: 2581617 - RNA, 19 nt, Human
ggcagaauaaucuuugggu

SEQ ID NO: 2581618 - RNA, 15 nt, Human
ggcagaagggagaag

SEQ ID NO: 2581619 - RNA, 22 nt, Human
ggcagaagacaccagagcagau

SEQ ID NO: 2581620 - RNA, 16 nt, Human
ggcagaaggccaagag

SEQ ID NO: 2581621 - RNA, 21 nt, Human
ggcagagaaagaagagacagg

SEQ ID NO: 2581622 - RNA, 18 nt, Human
ggcagagaaagaagagac

SEQ ID NO: 2581623 - RNA, 17 nt, Human
ggcagagaaagaagaga

SEQ ID NO: 2581624 - RNA, 14 nt, Human
ggcagagaaagaag

SEQ ID NO: 2581625 - RNA, 14 nt, Human
ggcagacuggguuu

SEQ ID NO: 2581626 - RNA, 19 nt, Human
ggcagagagcggucucagg

SEQ ID NO: 2581627 - RNA, 10 nt, Human
ggcagagagc

SEQ ID NO: 2581628 - RNA, 9 nt, Human
ggcagagag

SEQ ID NO: 2581629 - RNA, 14 nt, Human
ggcagagaaucaua

SEQ ID NO: 2581630 - RNA, 12 nt, Human
ggcagaaggaag

SEQ ID NO: 2581631 - RNA, 14 nt, Human
ggcagaacugagcu

SEQ ID NO: 2581632 - RNA, 15 nt, Human
ggcagaacugagcuc

SEQ ID NO: 2581633 - RNA, 21 nt, Human
ggcagaacugagcuccucugg

SEQ ID NO: 2581634 - RNA, 17 nt, Human
ggcagaagaauugaacc

SEQ ID NO: 2581635 - RNA, 15 nt, Human
ggcagaagacaccag

SEQ ID NO: 2581636 - RNA, 12 nt, Human
ggcagaagacac

SEQ ID NO: 2581637 - RNA, 22 nt, Human
ggcagaagaauugaacccagga

SEQ ID NO: 2581638 - RNA, 23 nt, Human
ggcagaagaauugaacccaggag

SEQ ID NO: 2581639 - RNA, 21 nt, Human
ggcagaacacuaaccugaccg

SEQ ID NO: 2581640 - RNA, 20 nt, Human
ggcagaacacuaaccugacc

SEQ ID NO: 2581641 - RNA, 15 nt, Human
ggcagaacacuaacc

SEQ ID NO: 2581642 - RNA, 14 nt, Human
ggcagaacacuaac

SEQ ID NO: 2581643 - RNA, 22 nt, Human
ggcagaaagguucugcccggga

SEQ ID NO: 2581644 - RNA, 20 nt, Human
ggcagaaagguucugcccgg

SEQ ID NO: 2581645 - RNA, 14 nt, Human
ggcagaaaguggcc

SEQ ID NO: 2581646 - RNA, 16 nt, Human
ggcagaaaguggccau

SEQ ID NO: 2581647 - RNA, 14 nt, Human
ggcagaacagccgc

SEQ ID NO: 2581648 - RNA, 18 nt, Human
ggcagaacagccgcuccu

SEQ ID NO: 2581649 - RNA, 20 nt, Human
ggcagaacagccgcuccugu

SEQ ID NO: 2581650 - RNA, 13 nt, Human
ggcagaacugagc

SEQ ID NO: 2581651 - RNA, 17 nt, Human
ggcagccaggccacaag

SEQ ID NO: 2581652 - RNA, 15 nt, Human
ggcagccaggccaca

SEQ ID NO: 2581653 - RNA, 10 nt, Human
ggcagagcag

SEQ ID NO: 2581654 - RNA, 14 nt, Human
ggcagccaggccac

SEQ ID NO: 2581655 - RNA, 23 nt, Human
ggcagagauuggaaugggcagcu

SEQ ID NO: 2581656 - RNA, 12 nt, Human
ggcagccaggcu

SEQ ID NO: 2581657 - RNA, 19 nt, Human
ggcagccaggcugccaagg

SEQ ID NO: 2581658 - RNA, 13 nt, Human
ggcagccaggcug

SEQ ID NO: 2581659 - RNA, 15 nt, Human
ggcagccaggcugcc

SEQ ID NO: 2581660 - RNA, 18 nt, Human
ggcagccgugccuucagc

SEQ ID NO: 2581661 - RNA, 21 nt, Human
ggcagccgugccuucagcucu

SEQ ID NO: 2581662 - RNA, 19 nt, Human
ggcagccgugccuucagcu

SEQ ID NO: 2581663 - RNA, 22 nt, Human
ggcagccgugccuucagcucua

SEQ ID NO: 2581664 - RNA, 14 nt, Human
ggcagccucccauc

SEQ ID NO: 2581665 - RNA, 21 nt, Human
ggcagccucccauccagggcc

SEQ ID NO: 2581666 - RNA, 22 nt, Human
ggcagccucccauccagggccc

SEQ ID NO: 2581667 - RNA, 19 nt, Human
ggcaggacaacgaggaagc

SEQ ID NO: 2581668 - RNA, 18 nt, Human
ggcaggacaacgaggaag

SEQ ID NO: 2581669 - RNA, 15 nt, Human
ggcaggaccaggacu

SEQ ID NO: 2581670 - RNA, 14 nt, Human
ggcaggaccaggac

SEQ ID NO: 2581671 - RNA, 15 nt, Human
ggcaggaccucagag

SEQ ID NO: 2581672 - RNA, 21 nt, Human
ggcaggaccucagaguccagg

SEQ ID NO: 2581673 - RNA, 20 nt, Human
ggcaggacaacgaggaagcc

SEQ ID NO: 2581674 - RNA, 21 nt, Human
ggcaggacaacgaggaagccc

SEQ ID NO: 2581675 - RNA, 23 nt, Human
ggcaggacaugcugaagccaaag

SEQ ID NO: 2581676 - RNA, 14 nt, Human
ggcaggcagcgcca

SEQ ID NO: 2581677 - RNA, 13 nt, Human
ggcaggcagcgcc

SEQ ID NO: 2581678 - RNA, 15 nt, Human
ggcaggcagcgccaa

SEQ ID NO: 2581679 - RNA, 21 nt, Human
ggcaggaccuucgggcugugc

SEQ ID NO: 2581680 - RNA, 23 nt, Human
ggcaggaccuucgggcugugccc

SEQ ID NO: 2581681 - RNA, 18 nt, Human
ggcaggcacagcacaggg

SEQ ID NO: 2581682 - RNA, 23 nt, Human
ggcaggacucagcuccccagagu

SEQ ID NO: 2581683 - RNA, 21 nt, Human
ggcaggacucagcuccccaga

SEQ ID NO: 2581684 - RNA, 16 nt, Human
ggcaggacucagcucc

SEQ ID NO: 2581685 - RNA, 21 nt, Human
ggcaaccccaguucugcuccu

SEQ ID NO: 2581686 - RNA, 20 nt, Human
ggcaaccccaguucugcucc

SEQ ID NO: 2581687 - RNA, 16 nt, Human
ggcaaccacuaagaau

SEQ ID NO: 2581688 - RNA, 19 nt, Human
ggcaaccacuaagaauuca

SEQ ID NO: 2581689 - RNA, 18 nt, Human
ggcaaccccaguucugcu

SEQ ID NO: 2581690 - RNA, 17 nt, Human
ggcaaccccaguucugc

SEQ ID NO: 2581691 - RNA, 16 nt, Human
ggcaaccccaguucug

SEQ ID NO: 2581692 - RNA, 21 nt, Human
ggcaaccacaggcagcauuua

SEQ ID NO: 2581693 - RNA, 14 nt, Human
ggcaacagaucugg

SEQ ID NO: 2581694 - RNA, 15 nt, Human
ggcaacagaucugga

SEQ ID NO: 2581695 - RNA, 19 nt, Human
ggcaacagagcaagauccu

SEQ ID NO: 2581696 - RNA, 14 nt, Human
ggcaacaucuuuau

SEQ ID NO: 2581697 - RNA, 19 nt, Human
ggcaacagaucuggaaccu

SEQ ID NO: 2581698 - RNA, 19 nt, Human
ggcaacauugcuggcugga

SEQ ID NO: 2581699 - RNA, 20 nt, Human
ggcaaccacaggcagcauuu

SEQ ID NO: 2581700 - RNA, 22 nt, Human
ggaugugaauugccugcagaga

SEQ ID NO: 2581701 - RNA, 18 nt, Human
ggaugugauuguggaaug

SEQ ID NO: 2581702 - RNA, 23 nt, Human
ggauguggcugcagcagcggugg

SEQ ID NO: 2581703 - RNA, 17 nt, Human
ggauguggcugcagcag

SEQ ID NO: 2581704 - RNA, 22 nt, Human
ggaugugggguccccaucaucc

SEQ ID NO: 2581705 - RNA, 15 nt, Human
ggaugugggagggag

SEQ ID NO: 2581706 - RNA, 23 nt, Human
ggaugugggagggagcagacagg

SEQ ID NO: 2581707 - RNA, 16 nt, Human
ggaugugguggcagug

SEQ ID NO: 2581708 - RNA, 20 nt, Human
ggauguucagcacugucccu

SEQ ID NO: 2581709 - RNA, 13 nt, Human
ggaugugugcaug

SEQ ID NO: 2581710 - RNA, 23 nt, Human
ggauguucagcacugucccuugc

SEQ ID NO: 2581711 - RNA, 15 nt, Human
ggauguucuggcccu

SEQ ID NO: 2581712 - RNA, 23 nt, Human
ggaugguucccuugaugaagaag

SEQ ID NO: 2581713 - RNA, 22 nt, Human
ggaugguucccuugaugaagaa

SEQ ID NO: 2581714 - RNA, 15 nt, Human
ggaugguguucaaaa

SEQ ID NO: 2581715 - RNA, 23 nt, Human
ggaugagagcccagagguaacag

SEQ ID NO: 2581716 - RNA, 20 nt, Human
ggaugagagcccagagguaa

SEQ ID NO: 2581717 - RNA, 16 nt, Human
ggauguaaacagugcc

SEQ ID NO: 2581718 - RNA, 17 nt, Human
ggauguaaacagugccu

SEQ ID NO: 2581719 - RNA, 18 nt, Human
ggauguaaacagugccug

SEQ ID NO: 2581720 - RNA, 19 nt, Human
ggauguaaacagugccugc

SEQ ID NO: 2581721 - RNA, 17 nt, Human
ggaugucuuccuuggag

SEQ ID NO: 2581722 - RNA, 14 nt, Human
ggaugucuuccuug

SEQ ID NO: 2581723 - RNA, 13 nt, Human
ggaugucuuccuu

SEQ ID NO: 2581724 - RNA, 20 nt, Human
ggauguaaacagugccugcu

SEQ ID NO: 2581725 - RNA, 22 nt, Human
ggaugagaaagguugaagcacc

SEQ ID NO: 2581726 - RNA, 12 nt, Human
ggaugagaaagg

SEQ ID NO: 2581727 - RNA, 19 nt, Human
ggaugagagcccagaggua

SEQ ID NO: 2581728 - RNA, 18 nt, Human
ggaugagagcccagaggu

SEQ ID NO: 2581729 - RNA, 16 nt, Human
ggaugagagcccagag

SEQ ID NO: 2581730 - RNA, 15 nt, Human
ggaugagagcccaga

SEQ ID NO: 2581731 - RNA, 23 nt, Human
ggaugagaauuugagugcucuga

SEQ ID NO: 2581732 - RNA, 14 nt, Human
ggaugagagcccag

SEQ ID NO: 2581733 - RNA, 19 nt, Human
ggaugacuagaggcaggga

SEQ ID NO: 2581734 - RNA, 22 nt, Human
ggaugacgguauuaugcuucuu

SEQ ID NO: 2581735 - RNA, 14 nt, Human
ggaugaccagaaca

SEQ ID NO: 2581736 - RNA, 16 nt, Human
ggaugacaugugacuc

SEQ ID NO: 2581737 - RNA, 21 nt, Human
ggaugagaauuugagugcucu

SEQ ID NO: 2581738 - RNA, 23 nt, Human
ggaugacgguauuaugcuucuug

SEQ ID NO: 2581739 - RNA, 18 nt, Human
ggaugacuagaggcaggg

SEQ ID NO: 2581740 - RNA, 23 nt, Human
ggaugaauguaugugcacuguca

SEQ ID NO: 2581741 - RNA, 22 nt, Human
ggaugaaugaggucccaggcag

SEQ ID NO: 2581742 - RNA, 14 nt, Human
ggaugaaugagguc

SEQ ID NO: 2581743 - RNA, 18 nt, Human
ggaugaaugaggucccag

SEQ ID NO: 2581744 - RNA, 21 nt, Human
ggaugaauuccaaauucugcu

SEQ ID NO: 2581745 - RNA, 16 nt, Human
ggaugacaugucccua

SEQ ID NO: 2581746 - RNA, 20 nt, Human
ggaugacaugucccuacacc

SEQ ID NO: 2581747 - RNA, 15 nt, Human
ggaugacaugucccu

SEQ ID NO: 2581748 - RNA, 21 nt, Human
ggaugacaugcacucagcucu

SEQ ID NO: 2581749 - RNA, 22 nt, Human
ggauuuuaacaaaagcaagacu

SEQ ID NO: 2581750 - RNA, 19 nt, Human
ggauuuggguuggaaguga

SEQ ID NO: 2581751 - RNA, 22 nt, Human
ggauuuucuauuguuacucugg

SEQ ID NO: 2581752 - RNA, 16 nt, Human
ggauuuucaucagggg

SEQ ID NO: 2581753 - RNA, 16 nt, Human
ggauuuugucaagcag

SEQ ID NO: 2581754 - RNA, 12 nt, Human
ggauuuugagua

SEQ ID NO: 2581755 - RNA, 16 nt, Human
ggcaaaauccuugcuu

SEQ ID NO: 2581756 - RNA, 13 nt, Human
ggcaaaauugcaa

SEQ ID NO: 2581757 - RNA, 21 nt, Human
ggauuuugauccaagcugguc

SEQ ID NO: 2581758 - RNA, 18 nt, Human
ggauuaaccucugcacua

SEQ ID NO: 2581759 - RNA, 17 nt, Human
ggauuaaccucugcacu

SEQ ID NO: 2581760 - RNA, 16 nt, Human
ggauuaaccucugcac

SEQ ID NO: 2581761 - RNA, 15 nt, Human
ggauuaaccucugca

SEQ ID NO: 2581762 - RNA, 22 nt, Human
ggauuugccccuucccaucucu

SEQ ID NO: 2581763 - RNA, 14 nt, Human
ggauuugccccuuc

SEQ ID NO: 2581764 - RNA, 18 nt, Human
ggauuugaugcuguuuga

SEQ ID NO: 2581765 - RNA, 14 nt, Human
ggauuaauaugaaa

SEQ ID NO: 2581766 - RNA, 15 nt, Human
ggauuaauaugaaaa

SEQ ID NO: 2581767 - RNA, 16 nt, Human
ggauuaauaugaaaac

SEQ ID NO: 2581768 - RNA, 21 nt, Human
ggauuugaggagcagcuucag

SEQ ID NO: 2581769 - RNA, 23 nt, Human
ggauuaaacuuaaucuaaaugga

SEQ ID NO: 2581770 - RNA, 18 nt, Human
ggauguuuuucaugaaaa

SEQ ID NO: 2581771 - RNA, 23 nt, Human
ggauguuuuaauuccaugaaucg

SEQ ID NO: 2581772 - RNA, 23 nt, Human
ggauguuucugucacaucagcuc

SEQ ID NO: 2581773 - RNA, 21 nt, Human
ggcaaagggagcagaacugaa

SEQ ID NO: 2581774 - RNA, 20 nt, Human
ggcaaagggagcagaacuga

SEQ ID NO: 2581775 - RNA, 19 nt, Human
ggcaaaggaagguggaugg

SEQ ID NO: 2581776 - RNA, 17 nt, Human
ggcaaaggaagguggau

SEQ ID NO: 2581777 - RNA, 16 nt, Human
ggcaaaggaaggugga

SEQ ID NO: 2581778 - RNA, 18 nt, Human
ggcaaagcuuuuagaaau

SEQ ID NO: 2581779 - RNA, 22 nt, Human
ggcaaagcacgaaauguuauuu

SEQ ID NO: 2581780 - RNA, 13 nt, Human
ggcaaacccauca

SEQ ID NO: 2581781 - RNA, 17 nt, Human
ggcaaacuucagacuga

SEQ ID NO: 2581782 - RNA, 16 nt, Human
ggcaaagacagaagcc

SEQ ID NO: 2581783 - RNA, 23 nt, Human
ggcaaacaggcaguuggccagag

SEQ ID NO: 2581784 - RNA, 23 nt, Human
ggcaaaaugagagggcaguguuu

SEQ ID NO: 2581785 - RNA, 13 nt, Human
ggcaaacaggcag

SEQ ID NO: 2581786 - RNA, 16 nt, Human
ggcaaauuaacuugag

SEQ ID NO: 2581787 - RNA, 13 nt, Human
ggcaaaugcccaa

SEQ ID NO: 2581788 - RNA, 16 nt, Human
ggcaaaugcccaaggg

SEQ ID NO: 2581789 - RNA, 20 nt, Human
ggcaaauuaacuugaguuuu

SEQ ID NO: 2581790 - RNA, 20 nt, Human
ggcaacacagcgagacuccg

SEQ ID NO: 2581791 - RNA, 12 nt, Human
ggcaacagagca

SEQ ID NO: 2581792 - RNA, 21 nt, Human
ggcaacacagcgagacuccgu

SEQ ID NO: 2581793 - RNA, 13 nt, Human
ggcaaaugacuuu

SEQ ID NO: 2581794 - RNA, 16 nt, Human
ggcaaauaucuugaaa

SEQ ID NO: 2581795 - RNA, 16 nt, Human
ggcaaaucaguuacua

SEQ ID NO: 2581796 - RNA, 12 nt, Human
ggcaaauaaaag

SEQ ID NO: 2581797 - RNA, 20 nt, Human
ggcaaagguggcucuccagu

SEQ ID NO: 2581798 - RNA, 23 nt, Human
ggccuccggcgucagccuccagc

SEQ ID NO: 2581799 - RNA, 22 nt, Human
ggccuccggcgucagccuccag

SEQ ID NO: 2581800 - RNA, 21 nt, Human
ggccuccggcgucagccucca

SEQ ID NO: 2581801 - RNA, 20 nt, Human
ggccuccggcgucagccucc

SEQ ID NO: 2581802 - RNA, 19 nt, Human
ggccuccccugccaccagg

SEQ ID NO: 2581803 - RNA, 17 nt, Human
ggccuccccugccacca

SEQ ID NO: 2581804 - RNA, 15 nt, Human
ggccuccccugccac

SEQ ID NO: 2581805 - RNA, 23 nt, Human
ggccucccacccgaugcugcuuu

SEQ ID NO: 2581806 - RNA, 21 nt, Human
ggccucccacccgaugcugcu

SEQ ID NO: 2581807 - RNA, 20 nt, Human
ggccucccacccgaugcugc

SEQ ID NO: 2581808 - RNA, 14 nt, Human
ggccucccacccga

SEQ ID NO: 2581809 - RNA, 13 nt, Human
ggccucccacccg

SEQ ID NO: 2581810 - RNA, 15 nt, Human
ggccuccccugcuga

SEQ ID NO: 2581811 - RNA, 19 nt, Human
ggccuccggcgucagccuc

SEQ ID NO: 2581812 - RNA, 16 nt, Human
ggccuccggccucccc

SEQ ID NO: 2581813 - RNA, 14 nt, Human
ggccuccggccucc

SEQ ID NO: 2581814 - RNA, 14 nt, Human
ggccuccccugcug

SEQ ID NO: 2581815 - RNA, 22 nt, Human
ggccuccccugccaccaggcca

SEQ ID NO: 2581816 - RNA, 15 nt, Human
ggccucccucucucu

SEQ ID NO: 2581817 - RNA, 23 nt, Human
ggccucccucucucuucugcucc

SEQ ID NO: 2581818 - RNA, 15 nt, Human
ggcccuccgacagcc

SEQ ID NO: 2581819 - RNA, 23 nt, Human
ggcccuuccucuccacugccuuc

SEQ ID NO: 2581820 - RNA, 22 nt, Human
ggcccuuccucuccacugccuu

SEQ ID NO: 2581821 - RNA, 19 nt, Human
ggcccuuccucuccacugc

SEQ ID NO: 2581822 - RNA, 13 nt, Human
ggcccucccuugg

SEQ ID NO: 2581823 - RNA, 14 nt, Human
ggcccucccaguac

SEQ ID NO: 2581824 - RNA, 23 nt, Human
ggcccucccuguuccccagagaa

SEQ ID NO: 2581825 - RNA, 23 nt, Human
ggcccucccuuggaaaccugccc

SEQ ID NO: 2581826 - RNA, 15 nt, Human
ggcccucccuuggaa

SEQ ID NO: 2581827 - RNA, 18 nt, Human
ggcccuuccucuccacug

SEQ ID NO: 2581828 - RNA, 14 nt, Human
ggccucccaacuca

SEQ ID NO: 2581829 - RNA, 13 nt, Human
ggccucccaacuc

SEQ ID NO: 2581830 - RNA, 16 nt, Human
ggccucccaaagugcu

SEQ ID NO: 2581831 - RNA, 13 nt, Human
ggccucccaaagu

SEQ ID NO: 2581832 - RNA, 19 nt, Human
ggcccagcccccacagugc

SEQ ID NO: 2581833 - RNA, 17 nt, Human
ggcccagcccccacagu

SEQ ID NO: 2581834 - RNA, 16 nt, Human
ggcccagcccccacag

SEQ ID NO: 2581835 - RNA, 13 nt, Human
ggcccagccccca

SEQ ID NO: 2581836 - RNA, 13 nt, Human
ggcccaggccauc

SEQ ID NO: 2581837 - RNA, 15 nt, Human
ggcccaggcaggcca

SEQ ID NO: 2581838 - RNA, 14 nt, Human
ggcccagggcccag

SEQ ID NO: 2581839 - RNA, 17 nt, Human
ggcccagggacaccagc

SEQ ID NO: 2581840 - RNA, 10 nt, Human
ggcccaggga

SEQ ID NO: 2581841 - RNA, 20 nt, Human
ggcccagggacaccagccag

SEQ ID NO: 2581842 - RNA, 19 nt, Human
ggcccagggacaccagcca

SEQ ID NO: 2581843 - RNA, 23 nt, Human
ggcccagggacaccagccaggcu

SEQ ID NO: 2581844 - RNA, 20 nt, Human
ggcccagggagaggccauga

SEQ ID NO: 2581845 - RNA, 19 nt, Human
ggcccagcccggcucccac

SEQ ID NO: 2581846 - RNA, 16 nt, Human
ggcccagcccggcucc

SEQ ID NO: 2581847 - RNA, 15 nt, Human
ggcccagcccggcuc

SEQ ID NO: 2581848 - RNA, 14 nt, Human
ggcccagcccggcu

SEQ ID NO: 2581849 - RNA, 12 nt, Human
ggcccagcccgg

SEQ ID NO: 2581850 - RNA, 11 nt, Human
ggcccagcccg

SEQ ID NO: 2581851 - RNA, 21 nt, Human
ggcccagcccccacagugcug

SEQ ID NO: 2581852 - RNA, 15 nt, Human
ggcccagcccugcug

SEQ ID NO: 2581853 - RNA, 14 nt, Human
ggcccagcccugcu

SEQ ID NO: 2581854 - RNA, 13 nt, Human
ggcccagcccugc

SEQ ID NO: 2581855 - RNA, 12 nt, Human
ggcccagcccug

SEQ ID NO: 2581856 - RNA, 22 nt, Human
ggcccagcccugcuggccgccu

SEQ ID NO: 2581857 - RNA, 16 nt, Human
ggcccagcccugcugg

SEQ ID NO: 2581858 - RNA, 22 nt, Human
ggcccagccggccucucuggcc

SEQ ID NO: 2581859 - RNA, 21 nt, Human
ggcccagccggccucucuggc

SEQ ID NO: 2581860 - RNA, 20 nt, Human
ggcccagccggccucucugg

SEQ ID NO: 2581861 - RNA, 19 nt, Human
ggcccagccggccucucug

SEQ ID NO: 2581862 - RNA, 17 nt, Human
ggcccagccggccucuc

SEQ ID NO: 2581863 - RNA, 16 nt, Human
ggcccagccggccucu

SEQ ID NO: 2581864 - RNA, 12 nt, Human
ggcccagccggc

SEQ ID NO: 2581865 - RNA, 16 nt, Human
ggcccagcggccccuc

SEQ ID NO: 2581866 - RNA, 16 nt, Human
ggcccagcgaccucgg

SEQ ID NO: 2581867 - RNA, 20 nt, Human
ggcccucagcauauuuguau

SEQ ID NO: 2581868 - RNA, 20 nt, Human
ggcccucauuaaugacacuu

SEQ ID NO: 2581869 - RNA, 12 nt, Human
ggcccucagcau

SEQ ID NO: 2581870 - RNA, 22 nt, Human
ggcccucaccccugcccuggga

SEQ ID NO: 2581871 - RNA, 19 nt, Human
ggcccgcuugccucggcuc

SEQ ID NO: 2581872 - RNA, 17 nt, Human
ggcccgcuugccucggc

SEQ ID NO: 2581873 - RNA, 14 nt, Human
ggcccgcuugccuc

SEQ ID NO: 2581874 - RNA, 13 nt, Human
ggcccgcuugccu

SEQ ID NO: 2581875 - RNA, 12 nt, Human
ggcccucccagu

SEQ ID NO: 2581876 - RNA, 19 nt, Human
ggcccucccuguuccccag

SEQ ID NO: 2581877 - RNA, 20 nt, Human
ggcccucccuguuccccaga

SEQ ID NO: 2581878 - RNA, 21 nt, Human
ggcccucccuguuccccagag

SEQ ID NO: 2581879 - RNA, 22 nt, Human
ggcccucccuguuccccagaga

SEQ ID NO: 2581880 - RNA, 23 nt, Human
ggccccagucagccucucuccca

SEQ ID NO: 2581881 - RNA, 21 nt, Human
ggccccagucagccucucucc

SEQ ID NO: 2581882 - RNA, 17 nt, Human
ggccccagucagccucu

SEQ ID NO: 2581883 - RNA, 16 nt, Human
ggccccagucagccuc

SEQ ID NO: 2581884 - RNA, 17 nt, Human
ggcccgacagccuggca

SEQ ID NO: 2581885 - RNA, 16 nt, Human
ggcccgacagccuggc

SEQ ID NO: 2581886 - RNA, 15 nt, Human
ggcccgacagccugg

SEQ ID NO: 2581887 - RNA, 19 nt, Human
ggcccgccuggcagaacug

SEQ ID NO: 2581888 - RNA, 23 nt, Human
ggcccgccuggcagaacugagcu

SEQ ID NO: 2581889 - RNA, 16 nt, Human
ggcccgcacagagcug

SEQ ID NO: 2581890 - RNA, 15 nt, Human
ggcccgccuggcaga

SEQ ID NO: 2581891 - RNA, 16 nt, Human
ggccccaggaccuggc

SEQ ID NO: 2581892 - RNA, 21 nt, Human
ggccccaggaccuggcugcca

SEQ ID NO: 2581893 - RNA, 13 nt, Human
ggccccaggaagc

SEQ ID NO: 2581894 - RNA, 14 nt, Human
ggccccaggaagcc

SEQ ID NO: 2581895 - RNA, 15 nt, Human
ggccccaggaagccg

SEQ ID NO: 2581896 - RNA, 22 nt, Human
ggccccaggcauugccaagggc

SEQ ID NO: 2581897 - RNA, 17 nt, Human
ggccccagggcuacccu

SEQ ID NO: 2581898 - RNA, 15 nt, Human
ggccccagucagccu

SEQ ID NO: 2581899 - RNA, 13 nt, Human
ggccccagucagc

SEQ ID NO: 2581900 - RNA, 18 nt, Human
ggccccagggcuacccuc

SEQ ID NO: 2581901 - RNA, 23 nt, Human
ggccccagccuggcccagcuccc

SEQ ID NO: 2581902 - RNA, 22 nt, Human
ggccccagccuggcccagcucc

SEQ ID NO: 2581903 - RNA, 21 nt, Human
ggccccagccuggcccagcuc

SEQ ID NO: 2581904 - RNA, 20 nt, Human
ggccccagccuggcccagcu

SEQ ID NO: 2581905 - RNA, 18 nt, Human
ggccccaggaaaggccca

SEQ ID NO: 2581906 - RNA, 15 nt, Human
ggccccaccaccuag

SEQ ID NO: 2581907 - RNA, 19 nt, Human
ggccccagccuggcccagc

SEQ ID NO: 2581908 - RNA, 18 nt, Human
ggccccagccuggcccag

SEQ ID NO: 2581909 - RNA, 14 nt, Human
ggccccaccaccua

SEQ ID NO: 2581910 - RNA, 18 nt, Human
ggcccauccccccucacc

SEQ ID NO: 2581911 - RNA, 16 nt, Human
ggcccauccccccuca

SEQ ID NO: 2581912 - RNA, 19 nt, Human
ggcccauccccccucacca

SEQ ID NO: 2581913 - RNA, 13 nt, Human
ggcccaucccccc

SEQ ID NO: 2581914 - RNA, 22 nt, Human
ggcccaucaguguacccccgcc

SEQ ID NO: 2581915 - RNA, 16 nt, Human
ggcccaucaguguacc

SEQ ID NO: 2581916 - RNA, 24 nt, Human
ggcccauaucugugaaaugcuggc

SEQ ID NO: 2581917 - RNA, 20 nt, Human
ggccccaaaaccacagcccu

SEQ ID NO: 2581918 - RNA, 21 nt, Human
ggccccaaaaccacagcccug

SEQ ID NO: 2581919 - RNA, 16 nt, Human
ggccccaaaaccacag

SEQ ID NO: 2581920 - RNA, 21 nt, Human
ggccaguccaggcugccgugg

SEQ ID NO: 2581921 - RNA, 21 nt, Human
ggccaguaucuauauaugugu

SEQ ID NO: 2581922 - RNA, 16 nt, Human
ggccaguccaggcugc

SEQ ID NO: 2581923 - RNA, 15 nt, Human
ggccaguccaggcug

SEQ ID NO: 2581924 - RNA, 18 nt, Human
ggccaguaccuuuccauu

SEQ ID NO: 2581925 - RNA, 16 nt, Human
ggccaguaccuuucca

SEQ ID NO: 2581926 - RNA, 14 nt, Human
ggccaguccaggcu

SEQ ID NO: 2581927 - RNA, 19 nt, Human
ggccagguggccacuccag

SEQ ID NO: 2581928 - RNA, 20 nt, Human
ggccaguaagggaaauagaa

SEQ ID NO: 2581929 - RNA, 23 nt, Human
ggccaggugggcgggcagcacag

SEQ ID NO: 2581930 - RNA, 17 nt, Human
ggccagguuucugccca

SEQ ID NO: 2581931 - RNA, 17 nt, Human
ggccaggggucucccug

SEQ ID NO: 2581932 - RNA, 20 nt, Human
ggccagccuccgagagggag

SEQ ID NO: 2581933 - RNA, 19 nt, Human
ggccagccuccgagaggga

SEQ ID NO: 2581934 - RNA, 16 nt, Human
ggccagccuccgagag

SEQ ID NO: 2581935 - RNA, 19 nt, Human
ggccagcccggcugguuuu

SEQ ID NO: 2581936 - RNA, 21 nt, Human
ggccaggucccagcuugagcu

SEQ ID NO: 2581937 - RNA, 16 nt, Human
ggccagggugagagcu

SEQ ID NO: 2581938 - RNA, 23 nt, Human
ggccagggucacugaaggccugg

SEQ ID NO: 2581939 - RNA, 14 nt, Human
ggccaggugcagug

SEQ ID NO: 2581940 - RNA, 14 nt, Human
ggccaggugcacag

SEQ ID NO: 2581941 - RNA, 12 nt, Human
ggcauucucuga

SEQ ID NO: 2581942 - RNA, 12 nt, Human
ggcauuccuucu

SEQ ID NO: 2581943 - RNA, 15 nt, Human
ggcauuccugcuuau

SEQ ID NO: 2581944 - RNA, 23 nt, Human
ggcauugauggggaaggaggcug

SEQ ID NO: 2581945 - RNA, 13 nt, Human
ggcauuccugcuu

SEQ ID NO: 2581946 - RNA, 12 nt, Human
ggccaaaggaag

SEQ ID NO: 2581947 - RNA, 15 nt, Human
ggccaaagccaaagc

SEQ ID NO: 2581948 - RNA, 21 nt, Human
ggccaaaggaagcacaugccu

SEQ ID NO: 2581949 - RNA, 21 nt, Human
ggccaaaggagggucaggaag

SEQ ID NO: 2581950 - RNA, 22 nt, Human
ggccaaaggagggucaggaagg

SEQ ID NO: 2581951 - RNA, 12 nt, Human
ggcauuguggga

SEQ ID NO: 2581952 - RNA, 21 nt, Human
ggcauuggcagcaggugcugc

SEQ ID NO: 2581953 - RNA, 19 nt, Human
ggcauuggcagcaggugcu

SEQ ID NO: 2581954 - RNA, 19 nt, Human
ggcauugucccugugccua

SEQ ID NO: 2581955 - RNA, 16 nt, Human
ggcauugauggggaag

SEQ ID NO: 2581956 - RNA, 12 nt, Human
ggcauugcuuuc

SEQ ID NO: 2581957 - RNA, 18 nt, Human
ggcauuggcagcaggugc

SEQ ID NO: 2581958 - RNA, 13 nt, Human
ggcauugcuuucc

SEQ ID NO: 2581959 - RNA, 20 nt, Human
ggccagaugcaccagcccuu

SEQ ID NO: 2581960 - RNA, 19 nt, Human
ggccagaugcaccagcccu

SEQ ID NO: 2581961 - RNA, 13 nt, Human
ggccagauccagc

SEQ ID NO: 2581962 - RNA, 16 nt, Human
ggccagauccagccug

SEQ ID NO: 2581963 - RNA, 17 nt, Human
ggccagaugcaccagcc

SEQ ID NO: 2581964 - RNA, 12 nt, Human
ggccagauccag

SEQ ID NO: 2581965 - RNA, 20 nt, Human
ggccagaguggccuggccag

SEQ ID NO: 2581966 - RNA, 18 nt, Human
ggccagaguggccuggcc

SEQ ID NO: 2581967 - RNA, 19 nt, Human
ggccagaguggccuggcca

SEQ ID NO: 2581968 - RNA, 18 nt, Human
ggccagcaccaucucuuu

SEQ ID NO: 2581969 - RNA, 19 nt, Human
ggccagaguauuggucucc

SEQ ID NO: 2581970 - RNA, 19 nt, Human
ggccagccccggcccuggg

SEQ ID NO: 2581971 - RNA, 17 nt, Human
ggccagccccggcccug

SEQ ID NO: 2581972 - RNA, 12 nt, Human
ggccagccccuc

SEQ ID NO: 2581973 - RNA, 20 nt, Human
ggccagccccggcccugggc

SEQ ID NO: 2581974 - RNA, 14 nt, Human
ggccagccccuccc

SEQ ID NO: 2581975 - RNA, 15 nt, Human
ggccagccccuccca

SEQ ID NO: 2581976 - RNA, 16 nt, Human
ggccagccccucccac

SEQ ID NO: 2581977 - RNA, 18 nt, Human
ggccagcccggcugguuu

SEQ ID NO: 2581978 - RNA, 16 nt, Human
ggccagcccggcuggu

SEQ ID NO: 2581979 - RNA, 15 nt, Human
ggccagcccggcugg

SEQ ID NO: 2581980 - RNA, 14 nt, Human
ggccagcccggcug

SEQ ID NO: 2581981 - RNA, 23 nt, Human
ggccagccccucccaccacagca

SEQ ID NO: 2581982 - RNA, 18 nt, Human
ggccagccccucccacca

SEQ ID NO: 2581983 - RNA, 21 nt, Human
ggccagccccucccaccacag

SEQ ID NO: 2581984 - RNA, 19 nt, Human
ggccaacaucgugaaaccc

SEQ ID NO: 2581985 - RNA, 13 nt, Human
ggccaaggagcug

SEQ ID NO: 2581986 - RNA, 14 nt, Human
ggccaaggagcugc

SEQ ID NO: 2581987 - RNA, 15 nt, Human
ggccaaggagcugcu

SEQ ID NO: 2581988 - RNA, 21 nt, Human
ggccaaggaugccccgucccc

SEQ ID NO: 2581989 - RNA, 13 nt, Human
ggccaagguggga

SEQ ID NO: 2581990 - RNA, 14 nt, Human
ggccaacaaagaac

SEQ ID NO: 2581991 - RNA, 21 nt, Human
ggccaaauuauuuguguaaua

SEQ ID NO: 2581992 - RNA, 13 nt, Human
ggccaaaguguua

SEQ ID NO: 2581993 - RNA, 16 nt, Human
ggccaacaaagcuguu

SEQ ID NO: 2581994 - RNA, 15 nt, Human
ggccaacaaagcugu

SEQ ID NO: 2581995 - RNA, 12 nt, Human
ggccaacaaagc

SEQ ID NO: 2581996 - RNA, 15 nt, Human
ggccaacaccaggga

SEQ ID NO: 2581997 - RNA, 18 nt, Human
ggccaacaccagggaugg

SEQ ID NO: 2581998 - RNA, 13 nt, Human
ggccaacauggua

SEQ ID NO: 2581999 - RNA, 20 nt, Human
ggccaacccuucuccucuug

SEQ ID NO: 2582000 - RNA, 16 nt, Human
ggccaacccuucuccu

SEQ ID NO: 2582001 - RNA, 23 nt, Human
ggccagagggagugacagaggca

SEQ ID NO: 2582002 - RNA, 16 nt, Human
ggccaagugcaggcug

SEQ ID NO: 2582003 - RNA, 18 nt, Human
ggccaagugcaggcuggc

SEQ ID NO: 2582004 - RNA, 14 nt, Human
ggccagaguggccu

SEQ ID NO: 2582005 - RNA, 15 nt, Human
ggccagaguggccug

SEQ ID NO: 2582006 - RNA, 16 nt, Human
ggccagaguggccugg

SEQ ID NO: 2582007 - RNA, 19 nt, Human
ggccaaggccuucuccucc

SEQ ID NO: 2582008 - RNA, 18 nt, Human
ggccaaggccuucuccuc

SEQ ID NO: 2582009 - RNA, 16 nt, Human
ggccaaggccuucucc

SEQ ID NO: 2582010 - RNA, 16 nt, Human
ggccaaggagcugcua

SEQ ID NO: 2582011 - RNA, 16 nt, Human
ggccaaggagggugag

SEQ ID NO: 2582012 - RNA, 22 nt, Human
ggccagagggagugacagaggc

SEQ ID NO: 2582013 - RNA, 19 nt, Human
gcuuguacauaaugcgugc

SEQ ID NO: 2582014 - RNA, 22 nt, Human
gcuugguggaugaaaugucagu

SEQ ID NO: 2582015 - RNA, 22 nt, Human
gcuuggguguaacaggucuccu

SEQ ID NO: 2582016 - RNA, 23 nt, Human
gcuuggguguaacaggucuccuc

SEQ ID NO: 2582017 - RNA, 21 nt, Human
ggaccccagcugggaggcaag

SEQ ID NO: 2582018 - RNA, 20 nt, Human
ggaccccagcugggaggcaa

SEQ ID NO: 2582019 - RNA, 18 nt, Human
ggaccccagcugggaggc

SEQ ID NO: 2582020 - RNA, 14 nt, Human
ggaccccagcuggg

SEQ ID NO: 2582021 - RNA, 13 nt, Human
ggaccccagcugg

SEQ ID NO: 2582022 - RNA, 11 nt, Human
ggaccccagcu

SEQ ID NO: 2582023 - RNA, 12 nt, Human
ggaccccagcug

SEQ ID NO: 2582024 - RNA, 18 nt, Human
ggaccccgagccuggcuc

SEQ ID NO: 2582025 - RNA, 13 nt, Human
ggacccccagcuu

SEQ ID NO: 2582026 - RNA, 18 nt, Human
ggaccccagcugugagcc

SEQ ID NO: 2582027 - RNA, 20 nt, Human
ggaccccaucugugaauaag

SEQ ID NO: 2582028 - RNA, 21 nt, Human
ggaccccagcugugagccuug

SEQ ID NO: 2582029 - RNA, 14 nt, Human
ggaccccaucugug

SEQ ID NO: 2582030 - RNA, 17 nt, Human
ggaccccaucugugaau

SEQ ID NO: 2582031 - RNA, 18 nt, Human
ggaccccaucugugaaua

SEQ ID NO: 2582032 - RNA, 18 nt, Human
ggaccccuggugguucac

SEQ ID NO: 2582033 - RNA, 14 nt, Human
ggacccgcucugga

SEQ ID NO: 2582034 - RNA, 13 nt, Human
ggaccccugcccu

SEQ ID NO: 2582035 - RNA, 21 nt, Human
ggaccccgagccuggcuccaa

SEQ ID NO: 2582036 - RNA, 16 nt, Human
ggaccccuccucccuu

SEQ ID NO: 2582037 - RNA, 13 nt, Human
ggaccccucaccu

SEQ ID NO: 2582038 - RNA, 18 nt, Human
ggacccugaggcccagag

SEQ ID NO: 2582039 - RNA, 15 nt, Human
ggacccugaggccca

SEQ ID NO: 2582040 - RNA, 14 nt, Human
ggacccugaggccc

SEQ ID NO: 2582041 - RNA, 21 nt, Human
ggacccggaggggccuggcag

SEQ ID NO: 2582042 - RNA, 20 nt, Human
ggacccggaggggccuggca

SEQ ID NO: 2582043 - RNA, 19 nt, Human
ggacccugaggcccagagg

SEQ ID NO: 2582044 - RNA, 17 nt, Human
ggacccgcucuggacca

SEQ ID NO: 2582045 - RNA, 15 nt, Human
ggacccgcucuggac

SEQ ID NO: 2582046 - RNA, 19 nt, Human
ggacccgcucuggaccaac

SEQ ID NO: 2582047 - RNA, 23 nt, Human
ggaccgggccgcuagaugggcau

SEQ ID NO: 2582048 - RNA, 23 nt, Human
ggaccgccagauggggccucugu

SEQ ID NO: 2582049 - RNA, 22 nt, Human
ggaccuaaauggccucaugugg

SEQ ID NO: 2582050 - RNA, 17 nt, Human
ggaccuaaauggccuca

SEQ ID NO: 2582051 - RNA, 17 nt, Human
ggaccgguacagaaagg

SEQ ID NO: 2582052 - RNA, 21 nt, Human
ggagagcuagaaccuggaggg

SEQ ID NO: 2582053 - RNA, 20 nt, Human
ggagagcuagaaccuggagg

SEQ ID NO: 2582054 - RNA, 22 nt, Human
ggagagcuagaaccuggagagc

SEQ ID NO: 2582055 - RNA, 20 nt, Human
ggagagcuagaaccuggaga

SEQ ID NO: 2582056 - RNA, 22 nt, Human
ggagagcuagaaccuggagggc

SEQ ID NO: 2582057 - RNA, 15 nt, Human
ggagagcuagcagca

SEQ ID NO: 2582058 - RNA, 19 nt, Human
ggagagcuagaaccuggag

SEQ ID NO: 2582059 - RNA, 18 nt, Human
ggagagcuagaaccugga

SEQ ID NO: 2582060 - RNA, 16 nt, Human
ggagagcuagaaccug

SEQ ID NO: 2582061 - RNA, 22 nt, Human
ggagagcuagaacccggcaggc

SEQ ID NO: 2582062 - RNA, 18 nt, Human
ggagagcgccugccccuc

SEQ ID NO: 2582063 - RNA, 20 nt, Human
ggagagcgccugccccuccc

SEQ ID NO: 2582064 - RNA, 20 nt, Human
ggagagcuagaacccggcag

SEQ ID NO: 2582065 - RNA, 22 nt, Human
ggagagcgccugccccucccag

SEQ ID NO: 2582066 - RNA, 22 nt, Human
ggagacuuagggcaccaggggu

SEQ ID NO: 2582067 - RNA, 12 nt, Human
ggagagagaaag

SEQ ID NO: 2582068 - RNA, 11 nt, Human
ggagagagaaa

SEQ ID NO: 2582069 - RNA, 10 nt, Human
ggagagagaa

SEQ ID NO: 2582070 - RNA, 18 nt, Human
ggagagaggcagagagcg

SEQ ID NO: 2582071 - RNA, 16 nt, Human
ggagagaggcagagag

SEQ ID NO: 2582072 - RNA, 13 nt, Human
ggagagaggcaga

SEQ ID NO: 2582073 - RNA, 10 nt, Human
ggagagaggc

SEQ ID NO: 2582074 - RNA, 22 nt, Human
ggagagagcagcuucugccacu

SEQ ID NO: 2582075 - RNA, 19 nt, Human
ggagagagagagagagagg

SEQ ID NO: 2582076 - RNA, 19 nt, Human
ggagagagacguguacaua

SEQ ID NO: 2582077 - RNA, 21 nt, Human
ggagagagaaagccaggcagg

SEQ ID NO: 2582078 - RNA, 20 nt, Human
ggagagagaaagccaggcag

SEQ ID NO: 2582079 - RNA, 18 nt, Human
ggagagagaaagccaggc

SEQ ID NO: 2582080 - RNA, 17 nt, Human
ggagagagaaagccagg

SEQ ID NO: 2582081 - RNA, 14 nt, Human
ggagagagaaagcc

SEQ ID NO: 2582082 - RNA, 14 nt, Human
ggagagagacucca

SEQ ID NO: 2582083 - RNA, 13 nt, Human
ggagagccagaga

SEQ ID NO: 2582084 - RNA, 21 nt, Human
ggagagccagaaccuggaggg

SEQ ID NO: 2582085 - RNA, 20 nt, Human
ggagagccagaaccuggagg

SEQ ID NO: 2582086 - RNA, 19 nt, Human
ggagagccagaaccuggag

SEQ ID NO: 2582087 - RNA, 22 nt, Human
ggagagccaccaagagggacgc

SEQ ID NO: 2582088 - RNA, 16 nt, Human
ggagagccagaaccug

SEQ ID NO: 2582089 - RNA, 21 nt, Human
ggagagccagagaagugacag

SEQ ID NO: 2582090 - RNA, 16 nt, Human
ggagagccagagaagu

SEQ ID NO: 2582091 - RNA, 15 nt, Human
ggagagccagagaag

SEQ ID NO: 2582092 - RNA, 14 nt, Human
ggagagccagagaa

SEQ ID NO: 2582093 - RNA, 11 nt, Human
ggagagccagc

SEQ ID NO: 2582094 - RNA, 12 nt, Human
ggagagccagcc

SEQ ID NO: 2582095 - RNA, 14 nt, Human
ggagagccagcccu

SEQ ID NO: 2582096 - RNA, 15 nt, Human
ggagagccagcccuc

SEQ ID NO: 2582097 - RNA, 16 nt, Human
ggagagcaggcuggca

SEQ ID NO: 2582098 - RNA, 14 nt, Human
ggagagcaggcugg

SEQ ID NO: 2582099 - RNA, 23 nt, Human
ggagagcaggcuggcagcucucc

SEQ ID NO: 2582100 - RNA, 13 nt, Human
ggagagcaggcug

SEQ ID NO: 2582101 - RNA, 12 nt, Human
ggagagcaggcu

SEQ ID NO: 2582102 - RNA, 11 nt, Human
ggagagcagcg

SEQ ID NO: 2582103 - RNA, 21 nt, Human
ggagagaggggaauaauagaa

SEQ ID NO: 2582104 - RNA, 20 nt, Human
ggagagaguugaaccuaaac

SEQ ID NO: 2582105 - RNA, 17 nt, Human
ggagagaguugaaccua

SEQ ID NO: 2582106 - RNA, 12 nt, Human
ggagagagggga

SEQ ID NO: 2582107 - RNA, 14 nt, Human
ggagagaggggaau

SEQ ID NO: 2582108 - RNA, 16 nt, Human
ggagagccuuccaggg

SEQ ID NO: 2582109 - RNA, 13 nt, Human
ggagagccuucca

SEQ ID NO: 2582110 - RNA, 23 nt, Human
ggagagccagcccucccuguccu

SEQ ID NO: 2582111 - RNA, 18 nt, Human
ggagagccagcccucccu

SEQ ID NO: 2582112 - RNA, 21 nt, Human
ggagagccagcccucccuguc

SEQ ID NO: 2582113 - RNA, 11 nt, Human
ggagagcccag

SEQ ID NO: 2582114 - RNA, 12 nt, Human
ggagagcccagc

SEQ ID NO: 2582115 - RNA, 18 nt, Human
ggagagccuuccaggggu

SEQ ID NO: 2582116 - RNA, 17 nt, Human
ggagagccuuccagggg

SEQ ID NO: 2582117 - RNA, 22 nt, Human
ggagagccuuccagggguggga

SEQ ID NO: 2582118 - RNA, 12 nt, Human
ggagagccugcu

SEQ ID NO: 2582119 - RNA, 11 nt, Human
ggagagccugc

SEQ ID NO: 2582120 - RNA, 14 nt, Human
ggagagccugcugg

SEQ ID NO: 2582121 - RNA, 13 nt, Human
ggagagccugcug

SEQ ID NO: 2582122 - RNA, 16 nt, Human
ggagagccugcuggca

SEQ ID NO: 2582123 - RNA, 16 nt, Human
ggagagcgccugcccc

SEQ ID NO: 2582124 - RNA, 20 nt, Human
ggacuuguauauuuguacaa

SEQ ID NO: 2582125 - RNA, 19 nt, Human
ggacuuguauauuuguaca

SEQ ID NO: 2582126 - RNA, 15 nt, Human
ggacuuguauauuug

SEQ ID NO: 2582127 - RNA, 9 nt, Human
ggacuuugu

SEQ ID NO: 2582128 - RNA, 16 nt, Human
ggacuugugucucugu

SEQ ID NO: 2582129 - RNA, 18 nt, Human
ggacuuuuauuuccagug

SEQ ID NO: 2582130 - RNA, 19 nt, Human
ggagaaaauggacguguua

SEQ ID NO: 2582131 - RNA, 13 nt, Human
ggacuuuucugca

SEQ ID NO: 2582132 - RNA, 12 nt, Human
ggagaaaaacaa

SEQ ID NO: 2582133 - RNA, 13 nt, Human
ggagaaaacacuu

SEQ ID NO: 2582134 - RNA, 17 nt, Human
ggacuuggaagcuccgc

SEQ ID NO: 2582135 - RNA, 16 nt, Human
ggacuuggagguagcu

SEQ ID NO: 2582136 - RNA, 14 nt, Human
ggacuuguauauuu

SEQ ID NO: 2582137 - RNA, 18 nt, Human
ggacuuccuugcucuccc

SEQ ID NO: 2582138 - RNA, 23 nt, Human
ggacuuccuguccagcuccaacc

SEQ ID NO: 2582139 - RNA, 15 nt, Human
ggacuuccuugcucu

SEQ ID NO: 2582140 - RNA, 15 nt, Human
ggacuuggaagcucc

SEQ ID NO: 2582141 - RNA, 20 nt, Human
ggagacugguccugugugca

SEQ ID NO: 2582142 - RNA, 18 nt, Human
ggagacuggggggcuuga

SEQ ID NO: 2582143 - RNA, 15 nt, Human
ggagacuggggggcu

SEQ ID NO: 2582144 - RNA, 23 nt, Human
ggagacugcuucccauccuaccc

SEQ ID NO: 2582145 - RNA, 23 nt, Human
ggagacugggcugagggagccug

SEQ ID NO: 2582146 - RNA, 16 nt, Human
ggagacugucucaaga

SEQ ID NO: 2582147 - RNA, 19 nt, Human
ggagacugcuucccauccu

SEQ ID NO: 2582148 - RNA, 18 nt, Human
ggagacugcuucccaucc

SEQ ID NO: 2582149 - RNA, 13 nt, Human
ggagacugggcug

SEQ ID NO: 2582150 - RNA, 17 nt, Human
ggagacugggcugaggg

SEQ ID NO: 2582151 - RNA, 20 nt, Human
ggagacugggcugagggagc

SEQ ID NO: 2582152 - RNA, 15 nt, Human
ggagacugcuuccca

SEQ ID NO: 2582153 - RNA, 14 nt, Human
ggagacugcuuccc

SEQ ID NO: 2582154 - RNA, 22 nt, Human
ggagacugcugagucaacccaa

SEQ ID NO: 2582155 - RNA, 18 nt, Human
ggagaaaugaaaaaauau

SEQ ID NO: 2582156 - RNA, 20 nt, Human
ggagaaaauucaauuguaaa

SEQ ID NO: 2582157 - RNA, 11 nt, Human
ggagaaacaca

SEQ ID NO: 2582158 - RNA, 13 nt, Human
ggagaaacagaga

SEQ ID NO: 2582159 - RNA, 14 nt, Human
ggagaaauugacag

SEQ ID NO: 2582160 - RNA, 15 nt, Human
ggagaaauugacaga

SEQ ID NO: 2582161 - RNA, 14 nt, Human
ggagaaacagagac

SEQ ID NO: 2582162 - RNA, 20 nt, Human
ggagaaaugcauccauuccu

SEQ ID NO: 2582163 - RNA, 17 nt, Human
ggagaaauguuguucau

SEQ ID NO: 2582164 - RNA, 23 nt, Human
ggagaaaugcauccauuccucag

SEQ ID NO: 2582165 - RNA, 22 nt, Human
ggagaaccaaaaagaggcuaug

SEQ ID NO: 2582166 - RNA, 22 nt, Human
ggagaacuagaaccuggagggc

SEQ ID NO: 2582167 - RNA, 18 nt, Human
ggagaacuagaaccugga

SEQ ID NO: 2582168 - RNA, 18 nt, Human
ggagaaccuugugccugg

SEQ ID NO: 2582169 - RNA, 17 nt, Human
ggagaaccuugugccug

SEQ ID NO: 2582170 - RNA, 20 nt, Human
ggagaaccaaaucuggaagc

SEQ ID NO: 2582171 - RNA, 15 nt, Human
ggagaaccucaggcu

SEQ ID NO: 2582172 - RNA, 18 nt, Human
ggacuuccuguccagcuc

SEQ ID NO: 2582173 - RNA, 19 nt, Human
ggacuuccuguccagcucc

SEQ ID NO: 2582174 - RNA, 20 nt, Human
ggacuuccuguccagcucca

SEQ ID NO: 2582175 - RNA, 21 nt, Human
ggacuuccuguccagcuccaa

SEQ ID NO: 2582176 - RNA, 11 nt, Human
ggacuuccugu

SEQ ID NO: 2582177 - RNA, 21 nt, Human
ggacuucacgaaguguugcau

SEQ ID NO: 2582178 - RNA, 20 nt, Human
ggacuuagaaagcaggggcu

SEQ ID NO: 2582179 - RNA, 20 nt, Human
ggacuuaacggcuccaggau

SEQ ID NO: 2582180 - RNA, 19 nt, Human
ggacuuaacggcuccagga

SEQ ID NO: 2582181 - RNA, 17 nt, Human
ggacuuaacggcuccag

SEQ ID NO: 2582182 - RNA, 15 nt, Human
ggacuuaacggcucc

SEQ ID NO: 2582183 - RNA, 18 nt, Human
ggacuuagaaagcagggg

SEQ ID NO: 2582184 - RNA, 17 nt, Human
ggacuuagaaagcaggg

SEQ ID NO: 2582185 - RNA, 15 nt, Human
ggacuuagaaagcag

SEQ ID NO: 2582186 - RNA, 17 nt, Human
ggacuuagcugggagaa

SEQ ID NO: 2582187 - RNA, 22 nt, Human
ggacugugugcucaggagcccu

SEQ ID NO: 2582188 - RNA, 14 nt, Human
ggacucagcccuga

SEQ ID NO: 2582189 - RNA, 15 nt, Human
ggacucagcccugag

SEQ ID NO: 2582190 - RNA, 16 nt, Human
ggacucagcccugagg

SEQ ID NO: 2582191 - RNA, 17 nt, Human
ggacucagcccugaggu

SEQ ID NO: 2582192 - RNA, 23 nt, Human
ggacugugugcucaggagcccug

SEQ ID NO: 2582193 - RNA, 20 nt, Human
ggacuguuuuuuccugagcu

SEQ ID NO: 2582194 - RNA, 21 nt, Human
ggacuguuuuuuccugagcuu

SEQ ID NO: 2582195 - RNA, 23 nt, Human
ggacuguuuuuuccugagcuugg

SEQ ID NO: 2582196 - RNA, 23 nt, Human
ggacuguugacauccaagcuucc

SEQ ID NO: 2582197 - RNA, 20 nt, Human
ggacuacaggugugagucac

SEQ ID NO: 2582198 - RNA, 17 nt, Human
ggaccuauguccuaagg

SEQ ID NO: 2582199 - RNA, 19 nt, Human
ggaccucagaguccaggcc

SEQ ID NO: 2582200 - RNA, 20 nt, Human
ggaccuaggauaucuucucc

SEQ ID NO: 2582201 - RNA, 12 nt, Human
ggaccucaggcc

SEQ ID NO: 2582202 - RNA, 21 nt, Human
ggacuacguuaagggaaggaa

SEQ ID NO: 2582203 - RNA, 16 nt, Human
ggaccucagcugcuuc

SEQ ID NO: 2582204 - RNA, 21 nt, Human
ggaccuauguccuaaggacac

SEQ ID NO: 2582205 - RNA, 21 nt, Human
ggaccucagaguccaggcccc

SEQ ID NO: 2582206 - RNA, 17 nt, Human
ggacuagaaccuggagg

SEQ ID NO: 2582207 - RNA, 14 nt, Human
ggacuagaaccugg

SEQ ID NO: 2582208 - RNA, 18 nt, Human
ggacuagagggaccucuc

SEQ ID NO: 2582209 - RNA, 19 nt, Human
ggacuagagggaccucucc

SEQ ID NO: 2582210 - RNA, 21 nt, Human
ggacuagagggaccucuccca

SEQ ID NO: 2582211 - RNA, 17 nt, Human
ggacucagaagccucug

SEQ ID NO: 2582212 - RNA, 18 nt, Human
ggacucaauuucucccca

SEQ ID NO: 2582213 - RNA, 18 nt, Human
ggacucagaagccucugg

SEQ ID NO: 2582214 - RNA, 13 nt, Human
ggacucagcccug

SEQ ID NO: 2582215 - RNA, 20 nt, Human
ggacuauauuugggccugcu

SEQ ID NO: 2582216 - RNA, 19 nt, Human
ggacucaauuucuccccag

SEQ ID NO: 2582217 - RNA, 15 nt, Human
ggacucacuugccca

SEQ ID NO: 2582218 - RNA, 22 nt, Human
ggacucaaugcacugacauugu

SEQ ID NO: 2582219 - RNA, 16 nt, Human
ggacuaggguccuggg

SEQ ID NO: 2582220 - RNA, 15 nt, Human
ggacuauagcccagg

SEQ ID NO: 2582221 - RNA, 22 nt, Human
ggacuagccccuguggagacug

SEQ ID NO: 2582222 - RNA, 14 nt, Human
ggacuagccccugu

SEQ ID NO: 2582223 - RNA, 15 nt, Human
ggaggcugagauggg

SEQ ID NO: 2582224 - RNA, 19 nt, Human
ggaggcugagaugggagaa

SEQ ID NO: 2582225 - RNA, 14 nt, Human
ggaggcugagacag

SEQ ID NO: 2582226 - RNA, 15 nt, Human
ggaggcucuggagcc

SEQ ID NO: 2582227 - RNA, 15 nt, Human
ggaggccccaaagga

SEQ ID NO: 2582228 - RNA, 19 nt, Human
ggaggcccaguucacccug

SEQ ID NO: 2582229 - RNA, 21 nt, Human
ggaggcucuggagcccacugu

SEQ ID NO: 2582230 - RNA, 15 nt, Human
ggaggucgaggcagg

SEQ ID NO: 2582231 - RNA, 16 nt, Human
ggaggucgaggcagga

SEQ ID NO: 2582232 - RNA, 18 nt, Human
ggaggcugagacaggaga

SEQ ID NO: 2582233 - RNA, 15 nt, Human
ggaggcugagacagg

SEQ ID NO: 2582234 - RNA, 12 nt, Human
ggaggcugaggc

SEQ ID NO: 2582235 - RNA, 14 nt, Human
ggaggcugaggcag

SEQ ID NO: 2582236 - RNA, 19 nt, Human
ggaggcugagacaggagaa

SEQ ID NO: 2582237 - RNA, 15 nt, Human
ggaggcugaggcaga

SEQ ID NO: 2582238 - RNA, 16 nt, Human
ggaggcugaggcagaa

SEQ ID NO: 2582239 - RNA, 18 nt, Human
ggaggcugaggcagaaga

SEQ ID NO: 2582240 - RNA, 17 nt, Human
ggaggcugaggcaggag

SEQ ID NO: 2582241 - RNA, 14 nt, Human
ggaggucgaggcag

SEQ ID NO: 2582242 - RNA, 17 nt, Human
ggagguugcagggagcc

SEQ ID NO: 2582243 - RNA, 20 nt, Human
ggagguugcagugagcugag

SEQ ID NO: 2582244 - RNA, 16 nt, Human
ggagguugaagccaag

SEQ ID NO: 2582245 - RNA, 14 nt, Human
ggagguugaagcca

SEQ ID NO: 2582246 - RNA, 12 nt, Human
ggagguugauaa

SEQ ID NO: 2582247 - RNA, 19 nt, Human
ggagguugaucagaucuga

SEQ ID NO: 2582248 - RNA, 12 nt, Human
ggagguugcagg

SEQ ID NO: 2582249 - RNA, 14 nt, Human
ggagguugcaggga

SEQ ID NO: 2582250 - RNA, 18 nt, Human
ggaggucgaggcaggagg

SEQ ID NO: 2582251 - RNA, 19 nt, Human
ggaggugucaggcugcugg

SEQ ID NO: 2582252 - RNA, 13 nt, Human
ggaggcugaggcg

SEQ ID NO: 2582253 - RNA, 16 nt, Human
ggaggugucaggcugc

SEQ ID NO: 2582254 - RNA, 19 nt, Human
ggaggcugaggcaggagga

SEQ ID NO: 2582255 - RNA, 16 nt, Human
ggagguucucucggag

SEQ ID NO: 2582256 - RNA, 21 nt, Human
ggagguguuuaaagagagguu

SEQ ID NO: 2582257 - RNA, 17 nt, Human
ggagguuaaggcugagg

SEQ ID NO: 2582258 - RNA, 19 nt, Human
ggagguuaaggcugaggaa

SEQ ID NO: 2582259 - RNA, 21 nt, Human
ggagguuaaggcugaggaaag

SEQ ID NO: 2582260 - RNA, 18 nt, Human
ggagguguggagccgagg

SEQ ID NO: 2582261 - RNA, 12 nt, Human
ggaggaagagaa

SEQ ID NO: 2582262 - RNA, 23 nt, Human
ggaggaaauuugaauggguccau

SEQ ID NO: 2582263 - RNA, 18 nt, Human
ggaggaacacugcacucu

SEQ ID NO: 2582264 - RNA, 22 nt, Human
ggaggaaaaccaagccguggcu

SEQ ID NO: 2582265 - RNA, 21 nt, Human
ggaggaaaaccaagccguggc

SEQ ID NO: 2582266 - RNA, 21 nt, Human
ggagcuuuuuuccuuaaucca

SEQ ID NO: 2582267 - RNA, 20 nt, Human
ggaggaaaaccaagccgugg

SEQ ID NO: 2582268 - RNA, 21 nt, Human
ggaggcaugugaugagaggaa

SEQ ID NO: 2582269 - RNA, 23 nt, Human
ggaggaagcagaauaaagcaauu

SEQ ID NO: 2582270 - RNA, 16 nt, Human
ggaggcauggcccugg

SEQ ID NO: 2582271 - RNA, 15 nt, Human
ggaggcauggcccug

SEQ ID NO: 2582272 - RNA, 14 nt, Human
ggaggcaucugcac

SEQ ID NO: 2582273 - RNA, 15 nt, Human
ggaggaagcagaaua

SEQ ID NO: 2582274 - RNA, 14 nt, Human
ggaggaagcagaau

SEQ ID NO: 2582275 - RNA, 13 nt, Human
ggaggaagcagaa

SEQ ID NO: 2582276 - RNA, 12 nt, Human
ggaggaagcaga

SEQ ID NO: 2582277 - RNA, 11 nt, Human
ggaggaagcag

SEQ ID NO: 2582278 - RNA, 21 nt, Human
ggaggaagaagcuuaggcagg

SEQ ID NO: 2582279 - RNA, 12 nt, Human
ggaggaaagcaa

SEQ ID NO: 2582280 - RNA, 22 nt, Human
ggaggaagcagaauaaagcaau

SEQ ID NO: 2582281 - RNA, 20 nt, Human
ggaggaagcagaauaaagca

SEQ ID NO: 2582282 - RNA, 19 nt, Human
ggaggaagcagaauaaagc

SEQ ID NO: 2582283 - RNA, 17 nt, Human
ggaggaagcagaauaaa

SEQ ID NO: 2582284 - RNA, 11 nt, Human
ggaggaagccc

SEQ ID NO: 2582285 - RNA, 19 nt, Human
ggaggaagcagguugaggg

SEQ ID NO: 2582286 - RNA, 13 nt, Human
ggaggccagccuu

SEQ ID NO: 2582287 - RNA, 14 nt, Human
ggaggccaggccgg

SEQ ID NO: 2582288 - RNA, 23 nt, Human
ggaggccaggccggcgagcccug

SEQ ID NO: 2582289 - RNA, 17 nt, Human
ggaggcauggcccuggg

SEQ ID NO: 2582290 - RNA, 18 nt, Human
ggaggccaaggugggagg

SEQ ID NO: 2582291 - RNA, 20 nt, Human
ggaggcucuggagcccacug

SEQ ID NO: 2582292 - RNA, 17 nt, Human
ggaggcucuggagccca

SEQ ID NO: 2582293 - RNA, 13 nt, Human
ggaggcccaguuc

SEQ ID NO: 2582294 - RNA, 17 nt, Human
ggaggccauugugugag

SEQ ID NO: 2582295 - RNA, 18 nt, Human
ggagccaguaaacagagg

SEQ ID NO: 2582296 - RNA, 18 nt, Human
ggagcccacuguacuugc

SEQ ID NO: 2582297 - RNA, 18 nt, Human
ggagccccagcuacccuu

SEQ ID NO: 2582298 - RNA, 17 nt, Human
ggagccccagcuacccu

SEQ ID NO: 2582299 - RNA, 20 nt, Human
ggagccccagcccccuuugg

SEQ ID NO: 2582300 - RNA, 16 nt, Human
ggagccccagcccccu

SEQ ID NO: 2582301 - RNA, 15 nt, Human
ggagccccagccccc

SEQ ID NO: 2582302 - RNA, 12 nt, Human
ggagcccacugu

SEQ ID NO: 2582303 - RNA, 13 nt, Human
ggagccccagccc

SEQ ID NO: 2582304 - RNA, 20 nt, Human
ggagcuccacucugcuucuc

SEQ ID NO: 2582305 - RNA, 23 nt, Human
ggagccccaggccucuguguccu

SEQ ID NO: 2582306 - RNA, 17 nt, Human
ggagccccauuccuggg

SEQ ID NO: 2582307 - RNA, 16 nt, Human
ggagccccauuccugg

SEQ ID NO: 2582308 - RNA, 14 nt, Human
ggagccccagugcc

SEQ ID NO: 2582309 - RNA, 14 nt, Human
ggagccccaggguc

SEQ ID NO: 2582310 - RNA, 20 nt, Human
ggagccccagggucuucccu

SEQ ID NO: 2582311 - RNA, 22 nt, Human
ggagccccaggccucugugucc

SEQ ID NO: 2582312 - RNA, 20 nt, Human
ggagccccaggccucugugu

SEQ ID NO: 2582313 - RNA, 14 nt, Human
ggagccccaggccu

SEQ ID NO: 2582314 - RNA, 13 nt, Human
ggagccccaggcc

SEQ ID NO: 2582315 - RNA, 12 nt, Human
ggagccccaggg

SEQ ID NO: 2582316 - RNA, 13 nt, Human
ggagccccagggu

SEQ ID NO: 2582317 - RNA, 22 nt, Human
ggagcugccuguucagcuccag

SEQ ID NO: 2582318 - RNA, 15 nt, Human
ggagcugaaaaauca

SEQ ID NO: 2582319 - RNA, 21 nt, Human
ggagcuccucuccuggaggau

SEQ ID NO: 2582320 - RNA, 17 nt, Human
ggagcugccuuggcuca

SEQ ID NO: 2582321 - RNA, 18 nt, Human
ggagcucuucaggccucc

SEQ ID NO: 2582322 - RNA, 20 nt, Human
ggagcucuucaggccucccu

SEQ ID NO: 2582323 - RNA, 16 nt, Human
ggagcugaguggggga

SEQ ID NO: 2582324 - RNA, 18 nt, Human
ggagcuccucuccuggag

SEQ ID NO: 2582325 - RNA, 17 nt, Human
ggagcuccucuccugga

SEQ ID NO: 2582326 - RNA, 13 nt, Human
ggagcuccucucc

SEQ ID NO: 2582327 - RNA, 20 nt, Human
ggagcuccucuccuggagga

SEQ ID NO: 2582328 - RNA, 19 nt, Human
ggagcuccucuccuggagg

SEQ ID NO: 2582329 - RNA, 17 nt, Human
ggagcucuucaggccuc

SEQ ID NO: 2582330 - RNA, 18 nt, Human
ggagcugccuuggcucag

SEQ ID NO: 2582331 - RNA, 21 nt, Human
ggagcugccuuggcucagaca

SEQ ID NO: 2582332 - RNA, 24 nt, Human
ggagcugcucacuaccuccucagg

SEQ ID NO: 2582333 - RNA, 19 nt, Human
ggagcugcuauagccuggg

SEQ ID NO: 2582334 - RNA, 18 nt, Human
ggagcugcuauagccugg

SEQ ID NO: 2582335 - RNA, 13 nt, Human
ggagcugcuggcu

SEQ ID NO: 2582336 - RNA, 15 nt, Human
ggagcugcuggcuug

SEQ ID NO: 2582337 - RNA, 23 nt, Human
ggagcugcuggcuugcagugcgc

SEQ ID NO: 2582338 - RNA, 12 nt, Human
ggagcuggcccc

SEQ ID NO: 2582339 - RNA, 20 nt, Human
ggagcuuucaaagaaggaau

SEQ ID NO: 2582340 - RNA, 15 nt, Human
ggagcuugggaaugg

SEQ ID NO: 2582341 - RNA, 21 nt, Human
ggagcuucucugaugugauau

SEQ ID NO: 2582342 - RNA, 16 nt, Human
ggagcuggccccgccg

SEQ ID NO: 2582343 - RNA, 15 nt, Human
ggagcuggccccgcc

SEQ ID NO: 2582344 - RNA, 23 nt, Human
ggagcagaaucaguauugggagc

SEQ ID NO: 2582345 - RNA, 16 nt, Human
ggagcagaacugaacc

SEQ ID NO: 2582346 - RNA, 13 nt, Human
ggagcagaaucag

SEQ ID NO: 2582347 - RNA, 12 nt, Human
ggagcagaacug

SEQ ID NO: 2582348 - RNA, 17 nt, Human
ggagcagagcucugccg

SEQ ID NO: 2582349 - RNA, 20 nt, Human
ggagcagacaggaggaauca

SEQ ID NO: 2582350 - RNA, 15 nt, Human
ggagcagaccacccc

SEQ ID NO: 2582351 - RNA, 19 nt, Human
ggagcagagcaagucugca

SEQ ID NO: 2582352 - RNA, 23 nt, Human
ggagcaggagauugagaaggaga

SEQ ID NO: 2582353 - RNA, 22 nt, Human
ggagcaggagauugagaaggag

SEQ ID NO: 2582354 - RNA, 21 nt, Human
ggagcaggagauugagaagga

SEQ ID NO: 2582355 - RNA, 16 nt, Human
ggagcaggagauugag

SEQ ID NO: 2582356 - RNA, 13 nt, Human
ggagcagccucag

SEQ ID NO: 2582357 - RNA, 15 nt, Human
ggagcaggagauuga

SEQ ID NO: 2582358 - RNA, 21 nt, Human
ggagcagccacauuccugaug

SEQ ID NO: 2582359 - RNA, 12 nt, Human
ggagcagagggg

SEQ ID NO: 2582360 - RNA, 13 nt, Human
ggagcagccacau

SEQ ID NO: 2582361 - RNA, 15 nt, Human
ggagcccacuguacu

SEQ ID NO: 2582362 - RNA, 23 nt, Human
ggagccaugcgcccccuccgccc

SEQ ID NO: 2582363 - RNA, 22 nt, Human
ggagccaugcgcccccuccgcc

SEQ ID NO: 2582364 - RNA, 13 nt, Human
ggagccagggcug

SEQ ID NO: 2582365 - RNA, 12 nt, Human
ggagcagugucu

SEQ ID NO: 2582366 - RNA, 18 nt, Human
ggagcaguaucaugaagc

SEQ ID NO: 2582367 - RNA, 18 nt, Human
ggagcagugcaggcacag

SEQ ID NO: 2582368 - RNA, 14 nt, Human
ggagcagugcaggc

SEQ ID NO: 2582369 - RNA, 15 nt, Human
ggagcaggggcgugg

SEQ ID NO: 2582370 - RNA, 21 nt, Human
ggagcaggcggugggcaccca

SEQ ID NO: 2582371 - RNA, 18 nt, Human
ggcucccuucccaccucu

SEQ ID NO: 2582372 - RNA, 17 nt, Human
ggcucccuucccaccuc

SEQ ID NO: 2582373 - RNA, 16 nt, Human
ggcucccuucccaccu

SEQ ID NO: 2582374 - RNA, 22 nt, Human
ggcucccuucccaccucucuca

SEQ ID NO: 2582375 - RNA, 20 nt, Human
ggcucccuucccaccucucu

SEQ ID NO: 2582376 - RNA, 20 nt, Human
ggcuccuaucuguguuuuga

SEQ ID NO: 2582377 - RNA, 24 nt, Human
ggcuccgucaguaucaggccugcc

SEQ ID NO: 2582378 - RNA, 15 nt, Human
ggcuccgaacacccu

SEQ ID NO: 2582379 - RNA, 18 nt, Human
ggcuccgucaguaucagg

SEQ ID NO: 2582380 - RNA, 22 nt, Human
ggcuccgucaguaucaggccug

SEQ ID NO: 2582381 - RNA, 17 nt, Human
ggcuccucccggugccc

SEQ ID NO: 2582382 - RNA, 12 nt, Human
ggcuccucucag

SEQ ID NO: 2582383 - RNA, 12 nt, Human
ggcuccugaggg

SEQ ID NO: 2582384 - RNA, 13 nt, Human
ggcuccugccacc

SEQ ID NO: 2582385 - RNA, 12 nt, Human
ggcuccugccag

SEQ ID NO: 2582386 - RNA, 12 nt, Human
ggcuccugccac

SEQ ID NO: 2582387 - RNA, 9 nt, Human
ggcuccugc

SEQ ID NO: 2582388 - RNA, 22 nt, Human
ggcugcaugcgggcuuccuccu

SEQ ID NO: 2582389 - RNA, 15 nt, Human
ggcugcagugagcca

SEQ ID NO: 2582390 - RNA, 23 nt, Human
ggcugcaucugggauucccacca

SEQ ID NO: 2582391 - RNA, 13 nt, Human
ggcugccaccaag

SEQ ID NO: 2582392 - RNA, 20 nt, Human
ggcugcaugcgggcuuccuc

SEQ ID NO: 2582393 - RNA, 22 nt, Human
ggcugaacccugugcugguguc

SEQ ID NO: 2582394 - RNA, 21 nt, Human
ggcugaacccugugcuggugu

SEQ ID NO: 2582395 - RNA, 23 nt, Human
ggcugaacccugugcuggugucc

SEQ ID NO: 2582396 - RNA, 15 nt, Human
ggcugaacggggaga

SEQ ID NO: 2582397 - RNA, 17 nt, Human
ggcugaacggggagaaa

SEQ ID NO: 2582398 - RNA, 22 nt, Human
ggcugcagugacgugcaccugu

SEQ ID NO: 2582399 - RNA, 22 nt, Human
ggcugaaauucuccuggagguc

SEQ ID NO: 2582400 - RNA, 21 nt, Human
ggcugaaauucuccuggaggu

SEQ ID NO: 2582401 - RNA, 19 nt, Human
ggcugaaauucuccuggag

SEQ ID NO: 2582402 - RNA, 18 nt, Human
ggcugaaauucuccugga

SEQ ID NO: 2582403 - RNA, 17 nt, Human
ggcugaaauucuccugg

SEQ ID NO: 2582404 - RNA, 16 nt, Human
ggcugaaauucuccug

SEQ ID NO: 2582405 - RNA, 14 nt, Human
ggcugaaauucucc

SEQ ID NO: 2582406 - RNA, 11 nt, Human
ggcugaaagcc

SEQ ID NO: 2582407 - RNA, 20 nt, Human
ggcugaacccugugcuggug

SEQ ID NO: 2582408 - RNA, 19 nt, Human
ggcugaacccugugcuggu

SEQ ID NO: 2582409 - RNA, 17 nt, Human
ggcugaacccugugcug

SEQ ID NO: 2582410 - RNA, 16 nt, Human
ggcugaacccugugcu

SEQ ID NO: 2582411 - RNA, 15 nt, Human
ggcugaacccugugc

SEQ ID NO: 2582412 - RNA, 14 nt, Human
ggcugaacccugug

SEQ ID NO: 2582413 - RNA, 21 nt, Human
ggcugaacacuccaauuaagg

SEQ ID NO: 2582414 - RNA, 17 nt, Human
ggcugcagggaguccga

SEQ ID NO: 2582415 - RNA, 17 nt, Human
ggcucgaaucucugugc

SEQ ID NO: 2582416 - RNA, 15 nt, Human
ggcucgaaucucugu

SEQ ID NO: 2582417 - RNA, 21 nt, Human
ggcuccuuucuccagccagca

SEQ ID NO: 2582418 - RNA, 20 nt, Human
ggcuccuuucuccagccagc

SEQ ID NO: 2582419 - RNA, 13 nt, Human
ggcucgaaucucu

SEQ ID NO: 2582420 - RNA, 19 nt, Human
ggcuccuuucuccagccag

SEQ ID NO: 2582421 - RNA, 17 nt, Human
ggcuccuuucuccagcc

SEQ ID NO: 2582422 - RNA, 13 nt, Human
ggcuccuuucucc

SEQ ID NO: 2582423 - RNA, 12 nt, Human
ggcuccuuucuc

SEQ ID NO: 2582424 - RNA, 17 nt, Human
ggcuccugccuucuguc

SEQ ID NO: 2582425 - RNA, 18 nt, Human
ggcucgagcaugccugga

SEQ ID NO: 2582426 - RNA, 19 nt, Human
ggcucgaaucucugugccu

SEQ ID NO: 2582427 - RNA, 18 nt, Human
ggcucgaaucucugugcc

SEQ ID NO: 2582428 - RNA, 20 nt, Human
ggcucgaaucucugugccuu

SEQ ID NO: 2582429 - RNA, 21 nt, Human
ggcucgagcaguccugccuca

SEQ ID NO: 2582430 - RNA, 24 nt, Human
ggcucuuccaggcugggagagccu

SEQ ID NO: 2582431 - RNA, 23 nt, Human
ggcucuuccaggcugggagagcc

SEQ ID NO: 2582432 - RNA, 19 nt, Human
ggcucgauuuuguaucugc

SEQ ID NO: 2582433 - RNA, 20 nt, Human
ggcuccuuuuucucccucug

SEQ ID NO: 2582434 - RNA, 12 nt, Human
ggcucuucucau

SEQ ID NO: 2582435 - RNA, 20 nt, Human
ggcucuuccaggcugggaga

SEQ ID NO: 2582436 - RNA, 20 nt, Human
ggcucuucucauuucacccc

SEQ ID NO: 2582437 - RNA, 13 nt, Human
ggcucuucucauu

SEQ ID NO: 2582438 - RNA, 22 nt, Human
ggcucuucucauuucaccccuc

SEQ ID NO: 2582439 - RNA, 16 nt, Human
ggcucuucuccccaga

SEQ ID NO: 2582440 - RNA, 20 nt, Human
ggcugaaagaggccaaugcc

SEQ ID NO: 2582441 - RNA, 22 nt, Human
ggcuggccuggccccucagggu

SEQ ID NO: 2582442 - RNA, 17 nt, Human
ggcuggccuggccccuc

SEQ ID NO: 2582443 - RNA, 22 nt, Human
ggcuggcccagcccugcuggcc

SEQ ID NO: 2582444 - RNA, 20 nt, Human
ggcuggcccagcccugcugg

SEQ ID NO: 2582445 - RNA, 19 nt, Human
ggcuggcccagcccugcug

SEQ ID NO: 2582446 - RNA, 13 nt, Human
ggcuggcccugcc

SEQ ID NO: 2582447 - RNA, 14 nt, Human
ggcuggcccugccc

SEQ ID NO: 2582448 - RNA, 15 nt, Human
ggcuggcccugcccu

SEQ ID NO: 2582449 - RNA, 20 nt, Human
ggcuggcgugcaguggugcg

SEQ ID NO: 2582450 - RNA, 16 nt, Human
ggcuggcgugcagugg

SEQ ID NO: 2582451 - RNA, 13 nt, Human
ggcuggccuuccu

SEQ ID NO: 2582452 - RNA, 21 nt, Human
ggcuggcccagcccugcuggc

SEQ ID NO: 2582453 - RNA, 16 nt, Human
ggcuggcccugcccug

SEQ ID NO: 2582454 - RNA, 14 nt, Human
ggcuggcgugcagu

SEQ ID NO: 2582455 - RNA, 18 nt, Human
ggcuggcccagcccugcu

SEQ ID NO: 2582456 - RNA, 17 nt, Human
ggcuggcccagcccugc

SEQ ID NO: 2582457 - RNA, 16 nt, Human
ggcuggcccagcccug

SEQ ID NO: 2582458 - RNA, 15 nt, Human
ggcuggcccagcccu

SEQ ID NO: 2582459 - RNA, 14 nt, Human
ggcuggcccagccc

SEQ ID NO: 2582460 - RNA, 13 nt, Human
ggcuggcccagcc

SEQ ID NO: 2582461 - RNA, 20 nt, Human
ggcuggcagcucuccaguca

SEQ ID NO: 2582462 - RNA, 12 nt, Human
ggcuggcccagc

SEQ ID NO: 2582463 - RNA, 18 nt, Human
ggcuggcagcucuccagu

SEQ ID NO: 2582464 - RNA, 14 nt, Human
ggcuggcacaggac

SEQ ID NO: 2582465 - RNA, 15 nt, Human
ggcuggcacaggaca

SEQ ID NO: 2582466 - RNA, 16 nt, Human
ggcuggcagcucucca

SEQ ID NO: 2582467 - RNA, 15 nt, Human
ggcuggcagcucucc

SEQ ID NO: 2582468 - RNA, 14 nt, Human
ggcuggcagcucuc

SEQ ID NO: 2582469 - RNA, 19 nt, Human
ggcuggcaccgccuucucu

SEQ ID NO: 2582470 - RNA, 13 nt, Human
ggcuggcacagga

SEQ ID NO: 2582471 - RNA, 21 nt, Human
ggcuggauuuugaauuuucuu

SEQ ID NO: 2582472 - RNA, 18 nt, Human
ggcuggaugugguggcau

SEQ ID NO: 2582473 - RNA, 19 nt, Human
ggcuggaugugguggcaua

SEQ ID NO: 2582474 - RNA, 15 nt, Human
ggcuggaugaaauuu

SEQ ID NO: 2582475 - RNA, 15 nt, Human
ggcuggauguggugg

SEQ ID NO: 2582476 - RNA, 18 nt, Human
ggcugccaugugaagagg

SEQ ID NO: 2582477 - RNA, 19 nt, Human
ggcugcccacacaccccaa

SEQ ID NO: 2582478 - RNA, 17 nt, Human
ggcugcccacacacccc

SEQ ID NO: 2582479 - RNA, 17 nt, Human
ggcuggaucugugaggg

SEQ ID NO: 2582480 - RNA, 21 nt, Human
ggcugcccccggcccccuggu

SEQ ID NO: 2582481 - RNA, 20 nt, Human
ggcugcccccggcccccugg

SEQ ID NO: 2582482 - RNA, 19 nt, Human
ggcugcccccggcccccug

SEQ ID NO: 2582483 - RNA, 19 nt, Human
ggcugccccaaccugcuga

SEQ ID NO: 2582484 - RNA, 18 nt, Human
ggcugcccacuaugguca

SEQ ID NO: 2582485 - RNA, 20 nt, Human
ggcugcccacacaccccaau

SEQ ID NO: 2582486 - RNA, 16 nt, Human
ggcuggcuucaggagg

SEQ ID NO: 2582487 - RNA, 13 nt, Human
ggcuggcuucagg

SEQ ID NO: 2582488 - RNA, 13 nt, Human
ggcuggcuggggc

SEQ ID NO: 2582489 - RNA, 12 nt, Human
ggcuggcugggg

SEQ ID NO: 2582490 - RNA, 13 nt, Human
ggcuggcugggca

SEQ ID NO: 2582491 - RNA, 14 nt, Human
ggcuggcugcagug

SEQ ID NO: 2582492 - RNA, 15 nt, Human
ggcuggcugcaguga

SEQ ID NO: 2582493 - RNA, 24 nt, Human
ggcuggcuccagaugcagggcagu

SEQ ID NO: 2582494 - RNA, 16 nt, Human
ggcuggcucccucuug

SEQ ID NO: 2582495 - RNA, 22 nt, Human
ggcuggcuccagaugcagggca

SEQ ID NO: 2582496 - RNA, 17 nt, Human
ggcuggcgcagccaagg

SEQ ID NO: 2582497 - RNA, 16 nt, Human
ggcuggcgcagccaag

SEQ ID NO: 2582498 - RNA, 14 nt, Human
ggcuggcgcagcca

SEQ ID NO: 2582499 - RNA, 14 nt, Human
ggcuggccuuccug

SEQ ID NO: 2582500 - RNA, 21 nt, Human
ggcuggcgcagccaaggccga

SEQ ID NO: 2582501 - RNA, 19 nt, Human
ggcuggcgcagccaaggcc

SEQ ID NO: 2582502 - RNA, 20 nt, Human
ggcuggcggcuacucagcag

SEQ ID NO: 2582503 - RNA, 17 nt, Human
ggcuggcuaacuggaag

SEQ ID NO: 2582504 - RNA, 23 nt, Human
ggcugggaacugcagaccugucc

SEQ ID NO: 2582505 - RNA, 21 nt, Human
ggcugggaacugcagaccugu

SEQ ID NO: 2582506 - RNA, 19 nt, Human
ggcugggaacucaccuggg

SEQ ID NO: 2582507 - RNA, 18 nt, Human
ggcugggacguggcucag

SEQ ID NO: 2582508 - RNA, 19 nt, Human
ggcugggacguggcucagc

SEQ ID NO: 2582509 - RNA, 23 nt, Human
ggcugggacguggcucagccagc

SEQ ID NO: 2582510 - RNA, 13 nt, Human
aaaaaaaaagaaa

SEQ ID NO: 2582511 - RNA, 10 nt, Human
aaaaaaaaga

SEQ ID NO: 2582512 - RNA, 13 nt, Human
aaaaaaaaaguuc

SEQ ID NO: 2582513 - RNA, 12 nt, Human
aaaaaaaaaguu

SEQ ID NO: 2582514 - RNA, 20 nt, Human
aaaaagucagacugcuggga

SEQ ID NO: 2582515 - RNA, 13 nt, Human
aaaaagugacaca

SEQ ID NO: 2582516 - RNA, 22 nt, Human
aaaaagucuacgcucuccuuuc

SEQ ID NO: 2582517 - RNA, 15 nt, Human
aaaaaguauuauuuu

SEQ ID NO: 2582518 - RNA, 19 nt, Human
aaaaaguauuauuuuccaa

SEQ ID NO: 2582519 - RNA, 13 nt, Human
aaaaaguauuauu

SEQ ID NO: 2582520 - RNA, 14 nt, Human
aaaaaguauuauuu

SEQ ID NO: 2582521 - RNA, 19 nt, Human
aaaaaguaggaaaugaaug

SEQ ID NO: 2582522 - RNA, 21 nt, Human
aaaaaguaaguaccacucagg

SEQ ID NO: 2582523 - RNA, 21 nt, Human
aaaaagggauccguacauuca

SEQ ID NO: 2582524 - RNA, 22 nt, Human
aaaaagggcagggcaucuccug

SEQ ID NO: 2582525 - RNA, 20 nt, Human
aaaaagcuccaaaugcagcu

SEQ ID NO: 2582526 - RNA, 19 nt, Human
aaaaagcucauauuuugua

SEQ ID NO: 2582527 - RNA, 20 nt, Human
aaaaagcuccuguccuccca

SEQ ID NO: 2582528 - RNA, 18 nt, Human
aaaaagcucauauuuugu

SEQ ID NO: 2582529 - RNA, 19 nt, Human
aaaaaggaaaaaauuaaua

SEQ ID NO: 2582530 - RNA, 19 nt, Human
aaaaagcuuccaugauucu

SEQ ID NO: 2582531 - RNA, 13 nt, Human
aaaaagcuucccc

SEQ ID NO: 2582532 - RNA, 13 nt, Human
aaaaaauacuugu

SEQ ID NO: 2582533 - RNA, 20 nt, Human
aaaaaauacugccagaugcu

SEQ ID NO: 2582534 - RNA, 16 nt, Human
aaaaaauacugccaga

SEQ ID NO: 2582535 - RNA, 11 nt, Human
aaaaaauacuu

SEQ ID NO: 2582536 - RNA, 16 nt, Human
aaaaaauaaaacauuu

SEQ ID NO: 2582537 - RNA, 12 nt, Human
aaaaaaguuuua

SEQ ID NO: 2582538 - RNA, 20 nt, Human
aaaaaaguuuacaaguguau

SEQ ID NO: 2582539 - RNA, 14 nt, Human
aaaaaauacugcca

SEQ ID NO: 2582540 - RNA, 11 nt, Human
aaaaaauacug

SEQ ID NO: 2582541 - RNA, 20 nt, Human
aaaaaauaaucuauuucuau

SEQ ID NO: 2582542 - RNA, 16 nt, Human
aaaaaaggcauuguuu

SEQ ID NO: 2582543 - RNA, 19 nt, Human
aaaaaaggacaauuucaaa

SEQ ID NO: 2582544 - RNA, 13 nt, Human
aaaaaagauauau

SEQ ID NO: 2582545 - RNA, 21 nt, Human
aaaaaagaggaaagaaugaaa

SEQ ID NO: 2582546 - RNA, 18 nt, Human
aaaaaaguuauauagguu

SEQ ID NO: 2582547 - RNA, 15 nt, Human
aaaaaaguuauauag

SEQ ID NO: 2582548 - RNA, 13 nt, Human
aaaaaaguuauau

SEQ ID NO: 2582549 - RNA, 12 nt, Human
aaaaaaguuaua

SEQ ID NO: 2582550 - RNA, 12 nt, Human
aaaaaaaaguua

SEQ ID NO: 2582551 - RNA, 11 nt, Human
aaaaaaaaguu

SEQ ID NO: 2582552 - RNA, 13 nt, Human
aaaaaaaauacuu

SEQ ID NO: 2582553 - RNA, 11 nt, Human
aaaaaaaagaa

SEQ ID NO: 2582554 - RNA, 13 nt, Human
aaaaaaacacaaa

SEQ ID NO: 2582555 - RNA, 15 nt, Human
ggcugucaauuacag

SEQ ID NO: 2582556 - RNA, 23 nt, Human
ggcuguaucccaugagccucagc

SEQ ID NO: 2582557 - RNA, 22 nt, Human
ggcuguaucccaugagccucag

SEQ ID NO: 2582558 - RNA, 20 nt, Human
ggcuguaucccaugagccuc

SEQ ID NO: 2582559 - RNA, 15 nt, Human
ggcuucaguggcagc

SEQ ID NO: 2582560 - RNA, 19 nt, Human
ggcuguccagugcccauuc

SEQ ID NO: 2582561 - RNA, 17 nt, Human
ggcuucagcauauuuau

SEQ ID NO: 2582562 - RNA, 16 nt, Human
ggcuguccagugccca

SEQ ID NO: 2582563 - RNA, 20 nt, Human
ggcuucagcauauuuauagc

SEQ ID NO: 2582564 - RNA, 14 nt, Human
ggcugucaucugug

SEQ ID NO: 2582565 - RNA, 17 nt, Human
ggcugucaucugugcac

SEQ ID NO: 2582566 - RNA, 15 nt, Human
ggcuguccagugccc

SEQ ID NO: 2582567 - RNA, 11 nt, Human
ggcuguccagu

SEQ ID NO: 2582568 - RNA, 15 nt, Human
ggcugucagcaggaa

SEQ ID NO: 2582569 - RNA, 16 nt, Human
ggcugucagcaggaag

SEQ ID NO: 2582570 - RNA, 17 nt, Human
ggcugucagcaggaagc

SEQ ID NO: 2582571 - RNA, 18 nt, Human
ggcugucagcaggaagca

SEQ ID NO: 2582572 - RNA, 18 nt, Human
ggcugucaguaugacauu

SEQ ID NO: 2582573 - RNA, 17 nt, Human
ggcuggugggaggggcg

SEQ ID NO: 2582574 - RNA, 13 nt, Human
ggcuggugggagg

SEQ ID NO: 2582575 - RNA, 21 nt, Human
ggcugguggcucccggagggc

SEQ ID NO: 2582576 - RNA, 16 nt, Human
ggcugguggcccagga

SEQ ID NO: 2582577 - RNA, 16 nt, Human
ggcuggugucaccuga

SEQ ID NO: 2582578 - RNA, 19 nt, Human
ggcuguaucccaugagccu

SEQ ID NO: 2582579 - RNA, 23 nt, Human
aaaaagugacacagcagcuucac

SEQ ID NO: 2582580 - RNA, 20 nt, Human
aaaaagugacacagcagcuu

SEQ ID NO: 2582581 - RNA, 19 nt, Human
aaaaagugacacagcagcu

SEQ ID NO: 2582582 - RNA, 17 nt, Human
aaaaagugacacagcag

SEQ ID NO: 2582583 - RNA, 16 nt, Human
aaaaagugacacagca

SEQ ID NO: 2582584 - RNA, 15 nt, Human
aaaaagugacacagc

SEQ ID NO: 2582585 - RNA, 14 nt, Human
aaaaagugacacag

SEQ ID NO: 2582586 - RNA, 12 nt, Human
aaaaaguguuua

SEQ ID NO: 2582587 - RNA, 13 nt, Human
aaaaaguguuuau

SEQ ID NO: 2582588 - RNA, 19 nt, Human
ggcuggugcuguggccagg

SEQ ID NO: 2582589 - RNA, 13 nt, Human
ggcugguggccca

SEQ ID NO: 2582590 - RNA, 14 nt, Human
ggcugguggcccag

SEQ ID NO: 2582591 - RNA, 18 nt, Human
ggcuggugccagccuucc

SEQ ID NO: 2582592 - RNA, 15 nt, Human
ggcuggugccagccu

SEQ ID NO: 2582593 - RNA, 10 nt, Human
ggcuggugcc

SEQ ID NO: 2582594 - RNA, 17 nt, Human
aaaaaguuauauagguu

SEQ ID NO: 2582595 - RNA, 12 nt, Human
aaaaaguuauau

SEQ ID NO: 2582596 - RNA, 23 nt, Human
aaaaaguguuuauuuuucauauu

SEQ ID NO: 2582597 - RNA, 12 nt, Human
ggcuuccuuucu

SEQ ID NO: 2582598 - RNA, 20 nt, Human
ggcuuccugcguccuccuca

SEQ ID NO: 2582599 - RNA, 19 nt, Human
ggcuuccugcguccuccuc

SEQ ID NO: 2582600 - RNA, 22 nt, Human
ggcuucccaguggcugcugccc

SEQ ID NO: 2582601 - RNA, 21 nt, Human
ggcuucccaguggcugcugcc

SEQ ID NO: 2582602 - RNA, 20 nt, Human
ggcuucccaguggcugcugc

SEQ ID NO: 2582603 - RNA, 19 nt, Human
ggcuucccaguggcugcug

SEQ ID NO: 2582604 - RNA, 21 nt, Human
ggcuuccucuagaagccaagg

SEQ ID NO: 2582605 - RNA, 17 nt, Human
ggcuucccaguggcugc

SEQ ID NO: 2582606 - RNA, 21 nt, Human
ggcuuccagguaucuccagga

SEQ ID NO: 2582607 - RNA, 17 nt, Human
ggcuuccauuugugugu

SEQ ID NO: 2582608 - RNA, 18 nt, Human
ggcuuccauuugugugug

SEQ ID NO: 2582609 - RNA, 22 nt, Human
ggcuuccauuugugugugugca

SEQ ID NO: 2582610 - RNA, 15 nt, Human
ggcuucaugccagcu

SEQ ID NO: 2582611 - RNA, 18 nt, Human
ggcuucaggggagucccg

SEQ ID NO: 2582612 - RNA, 16 nt, Human
ggcuucaguggcagcu

SEQ ID NO: 2582613 - RNA, 19 nt, Human
ggcuuccaagguggucugc

SEQ ID NO: 2582614 - RNA, 14 nt, Human
ggcuuccaaggugg

SEQ ID NO: 2582615 - RNA, 17 nt, Human
ggcuucauucaagucua

SEQ ID NO: 2582616 - RNA, 14 nt, Human
ggcuucauucaagu

SEQ ID NO: 2582617 - RNA, 16 nt, Human
ggcuucaugccagcua

SEQ ID NO: 2582618 - RNA, 18 nt, Human
ggcuucauuagagcaggc

SEQ ID NO: 2582619 - RNA, 12 nt, Human
ggcuuccaggua

SEQ ID NO: 2582620 - RNA, 22 nt, Human
ggcuuccagagaguccucugga

SEQ ID NO: 2582621 - RNA, 20 nt, Human
ggcuuccagagaguccucug

SEQ ID NO: 2582622 - RNA, 14 nt, Human
ggcuuccagagagu

SEQ ID NO: 2582623 - RNA, 13 nt, Human
ggcuuccagagag

SEQ ID NO: 2582624 - RNA, 22 nt, Human
ggcuuccaagguggucugcucg

SEQ ID NO: 2582625 - RNA, 21 nt, Human
ggcuuccagaaaaccccagca

SEQ ID NO: 2582626 - RNA, 13 nt, Human
ggcuucucucuca

SEQ ID NO: 2582627 - RNA, 12 nt, Human
ggcuucucucuc

SEQ ID NO: 2582628 - RNA, 11 nt, Human
ggcuucucucu

SEQ ID NO: 2582629 - RNA, 16 nt, Human
ggcuucuccugaccca

SEQ ID NO: 2582630 - RNA, 15 nt, Human
ggcuucuccugaccc

SEQ ID NO: 2582631 - RNA, 13 nt, Human
ggcuucuccugac

SEQ ID NO: 2582632 - RNA, 12 nt, Human
ggcuucuccuga

SEQ ID NO: 2582633 - RNA, 23 nt, Human
ggcuucuccgccagccuccucug

SEQ ID NO: 2582634 - RNA, 21 nt, Human
ggcuucuccgccagccuccuc

SEQ ID NO: 2582635 - RNA, 18 nt, Human
ggcuucuccgccagccuc

SEQ ID NO: 2582636 - RNA, 17 nt, Human
ggcuucuccgccagccu

SEQ ID NO: 2582637 - RNA, 16 nt, Human
ggcuucuccgccagcc

SEQ ID NO: 2582638 - RNA, 21 nt, Human
ggcuucucauacguccaccau

SEQ ID NO: 2582639 - RNA, 20 nt, Human
ggcuucucauacguccacca

SEQ ID NO: 2582640 - RNA, 17 nt, Human
ggcuuuuuuuuucucuu

SEQ ID NO: 2582641 - RNA, 23 nt, Human
gggaaaaagaggaucuggagaac

SEQ ID NO: 2582642 - RNA, 16 nt, Human
ggcuucucucucacca

SEQ ID NO: 2582643 - RNA, 15 nt, Human
ggcuucucucucacc

SEQ ID NO: 2582644 - RNA, 13 nt, Human
gggaaaaucagcc

SEQ ID NO: 2582645 - RNA, 21 nt, Human
gggaaagacauccauaaagaa

SEQ ID NO: 2582646 - RNA, 14 nt, Human
gggaaacuuggcuc

SEQ ID NO: 2582647 - RNA, 17 nt, Human
gggaaaauuauuugcau

SEQ ID NO: 2582648 - RNA, 18 nt, Human
gggaaaauuauuugcaua

SEQ ID NO: 2582649 - RNA, 23 nt, Human
gggaaaaucagccugcuccagcu

SEQ ID NO: 2582650 - RNA, 16 nt, Human
ggcuuuuuuuuucucu

SEQ ID NO: 2582651 - RNA, 13 nt, Human
gggaaaagcagcu

SEQ ID NO: 2582652 - RNA, 17 nt, Human
gggcagcugggcccaac

SEQ ID NO: 2582653 - RNA, 16 nt, Human
gggcagcugggcccaa

SEQ ID NO: 2582654 - RNA, 14 nt, Human
gggcagcugggccc

SEQ ID NO: 2582655 - RNA, 13 nt, Human
gggcagcugggcc

SEQ ID NO: 2582656 - RNA, 14 nt, Human
gggcagcagggcua

SEQ ID NO: 2582657 - RNA, 20 nt, Human
gggcagcauagcaagacaca

SEQ ID NO: 2582658 - RNA, 13 nt, Human
gggcagccaggcu

SEQ ID NO: 2582659 - RNA, 17 nt, Human
gggcagccaaacccaug

SEQ ID NO: 2582660 - RNA, 14 nt, Human
gggcagccaggcug

SEQ ID NO: 2582661 - RNA, 16 nt, Human
gggcagccaggcugcc

SEQ ID NO: 2582662 - RNA, 14 nt, Human
gggcagcacagcaa

SEQ ID NO: 2582663 - RNA, 13 nt, Human
gggcagcacagca

SEQ ID NO: 2582664 - RNA, 20 nt, Human
gggcagcagaaggggguggu

SEQ ID NO: 2582665 - RNA, 12 nt, Human
gggcagcacagc

SEQ ID NO: 2582666 - RNA, 16 nt, Human
gggcagcacagagagg

SEQ ID NO: 2582667 - RNA, 22 nt, Human
gggcaggacucagcuccccaga

SEQ ID NO: 2582668 - RNA, 18 nt, Human
gggcaggagggcccuacc

SEQ ID NO: 2582669 - RNA, 23 nt, Human
gggcaggacucagcuccccagag

SEQ ID NO: 2582670 - RNA, 19 nt, Human
gggcagcuugccccggccc

SEQ ID NO: 2582671 - RNA, 19 nt, Human
gggcaggaaggagagccug

SEQ ID NO: 2582672 - RNA, 21 nt, Human
gggcaggaaggagagccugcu

SEQ ID NO: 2582673 - RNA, 16 nt, Human
gggcaggaaggagagc

SEQ ID NO: 2582674 - RNA, 18 nt, Human
gggcaggaaggagagccu

SEQ ID NO: 2582675 - RNA, 19 nt, Human
gggcagcugggcccaaccc

SEQ ID NO: 2582676 - RNA, 18 nt, Human
gggcagcugggcccaacc

SEQ ID NO: 2582677 - RNA, 19 nt, Human
gggcagcuguuagagucca

SEQ ID NO: 2582678 - RNA, 16 nt, Human
aaaagggacugagaaa

SEQ ID NO: 2582679 - RNA, 20 nt, Human
aaaaggcuagguacacagcu

SEQ ID NO: 2582680 - RNA, 20 nt, Human
aaaagggaaguugugccuuu

SEQ ID NO: 2582681 - RNA, 19 nt, Human
aaaagggaaguugugccuu

SEQ ID NO: 2582682 - RNA, 14 nt, Human
aaaagggaagucua

SEQ ID NO: 2582683 - RNA, 18 nt, Human
aaaagggaacugaacauu

SEQ ID NO: 2582684 - RNA, 14 nt, Human
gggaggggcaggcu

SEQ ID NO: 2582685 - RNA, 13 nt, Human
gggaggggcaggc

SEQ ID NO: 2582686 - RNA, 12 nt, Human
gggaggggcagg

SEQ ID NO: 2582687 - RNA, 15 nt, Human
gggagggcccacuuc

SEQ ID NO: 2582688 - RNA, 18 nt, Human
gggaggggcgcuggccca

SEQ ID NO: 2582689 - RNA, 16 nt, Human
gggaggggcgcuggcc

SEQ ID NO: 2582690 - RNA, 18 nt, Human
gggaggggcgcccaccuc

SEQ ID NO: 2582691 - RNA, 10 nt, Human
gggaggggcg

SEQ ID NO: 2582692 - RNA, 17 nt, Human
gggaggggcaggcugac

SEQ ID NO: 2582693 - RNA, 16 nt, Human
gggaggggcaggcuga

SEQ ID NO: 2582694 - RNA, 13 nt, Human
gggaggggcccgc

SEQ ID NO: 2582695 - RNA, 14 nt, Human
gggaggggccuagg

SEQ ID NO: 2582696 - RNA, 20 nt, Human
gggaggggcgcuggcccagc

SEQ ID NO: 2582697 - RNA, 19 nt, Human
gggaggggcgcuggcccag

SEQ ID NO: 2582698 - RNA, 21 nt, Human
gggaggggcgcuggcccagcc

SEQ ID NO: 2582699 - RNA, 21 nt, Human
gggauuccugacccaggccgc

SEQ ID NO: 2582700 - RNA, 19 nt, Human
gggauuccugacccaggcc

SEQ ID NO: 2582701 - RNA, 17 nt, Human
gggauuccugacccagg

SEQ ID NO: 2582702 - RNA, 16 nt, Human
gggauuccugacccag

SEQ ID NO: 2582703 - RNA, 14 nt, Human
gggauucaggcugc

SEQ ID NO: 2582704 - RNA, 14 nt, Human
gggauuccugaccc

SEQ ID NO: 2582705 - RNA, 13 nt, Human
gggauuccugacc

SEQ ID NO: 2582706 - RNA, 15 nt, Human
gggauucccaccaag

SEQ ID NO: 2582707 - RNA, 15 nt, Human
gggauucaggcugcu

SEQ ID NO: 2582708 - RNA, 16 nt, Human
gggauucaggcugcuu

SEQ ID NO: 2582709 - RNA, 15 nt, Human
gggcaaacaggcagu

SEQ ID NO: 2582710 - RNA, 12 nt, Human
gggcagagccca

SEQ ID NO: 2582711 - RNA, 14 nt, Human
gggcagagcccaag

SEQ ID NO: 2582712 - RNA, 13 nt, Human
gggcagagccggg

SEQ ID NO: 2582713 - RNA, 14 nt, Human
gggcagagccggga

SEQ ID NO: 2582714 - RNA, 19 nt, Human
gggcagagcuggcucugag

SEQ ID NO: 2582715 - RNA, 16 nt, Human
gggcagauuuucagca

SEQ ID NO: 2582716 - RNA, 17 nt, Human
gggcagagcuggcucug

SEQ ID NO: 2582717 - RNA, 16 nt, Human
gggcagagcuggcucu

SEQ ID NO: 2582718 - RNA, 11 nt, Human
gggcagagcug

SEQ ID NO: 2582719 - RNA, 17 nt, Human
gggcagagccgggaagc

SEQ ID NO: 2582720 - RNA, 21 nt, Human
gggcaaaaaacucgaggacug

SEQ ID NO: 2582721 - RNA, 15 nt, Human
gggauuucucccagc

SEQ ID NO: 2582722 - RNA, 23 nt, Human
gggcagagcagagaccaucccug

SEQ ID NO: 2582723 - RNA, 18 nt, Human
gggcaaaauucccaggga

SEQ ID NO: 2582724 - RNA, 16 nt, Human
gggcaaaacugaauua

SEQ ID NO: 2582725 - RNA, 14 nt, Human
gggcaaacaggcag

SEQ ID NO: 2582726 - RNA, 15 nt, Human
gggauuuccaugaug

SEQ ID NO: 2582727 - RNA, 21 nt, Human
gggauucuacuuuaagcacua

SEQ ID NO: 2582728 - RNA, 19 nt, Human
gggauucugguuccagggu

SEQ ID NO: 2582729 - RNA, 17 nt, Human
gggauuucucccagcuc

SEQ ID NO: 2582730 - RNA, 20 nt, Human
gggauuuccagccagggcug

SEQ ID NO: 2582731 - RNA, 16 nt, Human
aaaauauacuguaaag

SEQ ID NO: 2582732 - RNA, 17 nt, Human
aaaauauacuguaaaga

SEQ ID NO: 2582733 - RNA, 18 nt, Human
aaaauauacuguaaagaa

SEQ ID NO: 2582734 - RNA, 20 nt, Human
aaaauauacuguaaagaaag

SEQ ID NO: 2582735 - RNA, 22 nt, Human
aaaauauacuguaaagaaagag

SEQ ID NO: 2582736 - RNA, 23 nt, Human
aaaauauacuguaaagaaagaga

SEQ ID NO: 2582737 - RNA, 20 nt, Human
aaaauauagcuguacaaaua

SEQ ID NO: 2582738 - RNA, 16 nt, Human
aaaauauagcuguaca

SEQ ID NO: 2582739 - RNA, 12 nt, Human
aaaauauacugu

SEQ ID NO: 2582740 - RNA, 13 nt, Human
aaaauauacugua

SEQ ID NO: 2582741 - RNA, 14 nt, Human
aaaauauacuguaa

SEQ ID NO: 2582742 - RNA, 15 nt, Human
aaaauauacuguaaa

SEQ ID NO: 2582743 - RNA, 11 nt, Human
aaaauauacug

SEQ ID NO: 2582744 - RNA, 24 nt, Human
aaaauauaauuuuuuagagagcug

SEQ ID NO: 2582745 - RNA, 21 nt, Human
aaaauauagcuguacaaauau

SEQ ID NO: 2582746 - RNA, 18 nt, Human
aaaauauauaucaaauau

SEQ ID NO: 2582747 - RNA, 14 nt, Human
aaaauauauuuaau

SEQ ID NO: 2582748 - RNA, 21 nt, Human
aaaauauggaacuucuaauau

SEQ ID NO: 2582749 - RNA, 20 nt, Human
aaaauauggguugcauuugg

SEQ ID NO: 2582750 - RNA, 20 nt, Human
aaaauauggaacuucuaaua

SEQ ID NO: 2582751 - RNA, 20 nt, Human
aaaauaguugagccagcaga

SEQ ID NO: 2582752 - RNA, 18 nt, Human
aaaauaguugagccagca

SEQ ID NO: 2582753 - RNA, 23 nt, Human
aaaauaguuaagacaugauuucc

SEQ ID NO: 2582754 - RNA, 21 nt, Human
aaaauaguugagccagcagac

SEQ ID NO: 2582755 - RNA, 18 nt, Human
aaaauaguggugugauuu

SEQ ID NO: 2582756 - RNA, 17 nt, Human
aaaauauaaaacugcgu

SEQ ID NO: 2582757 - RNA, 14 nt, Human
aaaauauaaaacug

SEQ ID NO: 2582758 - RNA, 10 nt, Human
aaaauauaaa

SEQ ID NO: 2582759 - RNA, 22 nt, Human
aaaauauaaaacugcguuaaag

SEQ ID NO: 2582760 - RNA, 13 nt, Human
aaaauauaaaaua

SEQ ID NO: 2582761 - RNA, 10 nt, Human
aaaauauaac

SEQ ID NO: 2582762 - RNA, 12 nt, Human
aaaauagccugc

SEQ ID NO: 2582763 - RNA, 23 nt, Human
aaaauagcaaccuuuuuaucucc

SEQ ID NO: 2582764 - RNA, 17 nt, Human
aaaauagcaauccuaaa

SEQ ID NO: 2582765 - RNA, 10 nt, Human
aaaauagcca

SEQ ID NO: 2582766 - RNA, 19 nt, Human
aaaauagcuuguauagugu

SEQ ID NO: 2582767 - RNA, 13 nt, Human
aaaauagcuugua

SEQ ID NO: 2582768 - RNA, 21 nt, Human
aaaauagcuuguauaguguaa

SEQ ID NO: 2582769 - RNA, 12 nt, Human
aaaauagcuugu

SEQ ID NO: 2582770 - RNA, 19 nt, Human
aaaauaguaaaugcuuugu

SEQ ID NO: 2582771 - RNA, 18 nt, Human
aaaauaguaaaugcuuug

SEQ ID NO: 2582772 - RNA, 18 nt, Human
aaaauagguauacagugg

SEQ ID NO: 2582773 - RNA, 17 nt, Human
aaaaguacauuuaauac

SEQ ID NO: 2582774 - RNA, 13 nt, Human
aaaaguacauuua

SEQ ID NO: 2582775 - RNA, 21 nt, Human
aaaaguacauuuaauacagca

SEQ ID NO: 2582776 - RNA, 15 nt, Human
aaaaguacaauuuac

SEQ ID NO: 2582777 - RNA, 23 nt, Human
aaaaguaaguaccacucaggcca

SEQ ID NO: 2582778 - RNA, 17 nt, Human
aaaagguuuuauuuugu

SEQ ID NO: 2582779 - RNA, 16 nt, Human
aaaagguuuuauuuug

SEQ ID NO: 2582780 - RNA, 15 nt, Human
aaaagguuuuauuuu

SEQ ID NO: 2582781 - RNA, 11 nt, Human
aaaaguaaaca

SEQ ID NO: 2582782 - RNA, 19 nt, Human
aaaagguuuuauuuuguaa

SEQ ID NO: 2582783 - RNA, 23 nt, Human
aaaagguuuuauuuuguaauuau

SEQ ID NO: 2582784 - RNA, 22 nt, Human
aaaaguaaguaccacucaggcc

SEQ ID NO: 2582785 - RNA, 12 nt, Human
aaaaguaacuug

SEQ ID NO: 2582786 - RNA, 12 nt, Human
aaaauaaauuau

SEQ ID NO: 2582787 - RNA, 14 nt, Human
aaaauaacacacau

SEQ ID NO: 2582788 - RNA, 20 nt, Human
aaaauaauuuuuauauuuga

SEQ ID NO: 2582789 - RNA, 12 nt, Human
aaaauaaauaaa

SEQ ID NO: 2582790 - RNA, 11 nt, Human
aaaauaaauau

SEQ ID NO: 2582791 - RNA, 14 nt, Human
aaaauaaauauaua

SEQ ID NO: 2582792 - RNA, 12 nt, Human
aaaauaaauaua

SEQ ID NO: 2582793 - RNA, 15 nt, Human
aaaauaaauauauau

SEQ ID NO: 2582794 - RNA, 14 nt, Human
aaaauaccaaggaa

SEQ ID NO: 2582795 - RNA, 15 nt, Human
aaaauaccagccagu

SEQ ID NO: 2582796 - RNA, 22 nt, Human
aaaauagauaagaguagaaacu

SEQ ID NO: 2582797 - RNA, 22 nt, Human
aaaauacuauuuuuacugccac

SEQ ID NO: 2582798 - RNA, 21 nt, Human
aaaauagcaacacucuauauu

SEQ ID NO: 2582799 - RNA, 22 nt, Human
aaaauagcaacacucuauauuu

SEQ ID NO: 2582800 - RNA, 15 nt, Human
aaaauacuauucuga

SEQ ID NO: 2582801 - RNA, 23 nt, Human
aaaauaauuuuuauauuugaaau

SEQ ID NO: 2582802 - RNA, 21 nt, Human
aaaauaauuuuuauauuugaa

SEQ ID NO: 2582803 - RNA, 14 nt, Human
aaaauaccagccag

SEQ ID NO: 2582804 - RNA, 14 nt, Human
aaaauacaaaauua

SEQ ID NO: 2582805 - RNA, 22 nt, Human
aaaacugauuuuuuuuuccuuc

SEQ ID NO: 2582806 - RNA, 18 nt, Human
aaaacugauuuuuuuuuc

SEQ ID NO: 2582807 - RNA, 19 nt, Human
aaaacugcucauaugaugu

SEQ ID NO: 2582808 - RNA, 19 nt, Human
aaaacugcguuaaaggcuc

SEQ ID NO: 2582809 - RNA, 21 nt, Human
aaaacguggcugcuucaagga

SEQ ID NO: 2582810 - RNA, 19 nt, Human
aaaaccaagccguggcuuc

SEQ ID NO: 2582811 - RNA, 15 nt, Human
aaaacguuuuauugu

SEQ ID NO: 2582812 - RNA, 16 nt, Human
aaaacguuuuauugug

SEQ ID NO: 2582813 - RNA, 17 nt, Human
aaaacguuuuauugugu

SEQ ID NO: 2582814 - RNA, 19 nt, Human
aaaacguuuuauuguguuu

SEQ ID NO: 2582815 - RNA, 19 nt, Human
aaaacuaaaucucuaauau

SEQ ID NO: 2582816 - RNA, 18 nt, Human
aaaacuaaaucucuaaua

SEQ ID NO: 2582817 - RNA, 22 nt, Human
aaaacuaaauagcauguauugu

SEQ ID NO: 2582818 - RNA, 19 nt, Human
aaaacuaaauagcauguau

SEQ ID NO: 2582819 - RNA, 18 nt, Human
aaaacuaaauagcaugua

SEQ ID NO: 2582820 - RNA, 21 nt, Human
aaaacuacaaaucaaguauuu

SEQ ID NO: 2582821 - RNA, 18 nt, Human
aaaacguggcugcuucaa

SEQ ID NO: 2582822 - RNA, 17 nt, Human
aaaacguggcugcuuca

SEQ ID NO: 2582823 - RNA, 16 nt, Human
aaaacguggcugcuuc

SEQ ID NO: 2582824 - RNA, 14 nt, Human
aaaacguggcugcu

SEQ ID NO: 2582825 - RNA, 19 nt, Human
aaaacauuuuaaauggaca

SEQ ID NO: 2582826 - RNA, 22 nt, Human
aaaaccaaagagggcuuccucu

SEQ ID NO: 2582827 - RNA, 13 nt, Human
aaaaccaaagagg

SEQ ID NO: 2582828 - RNA, 14 nt, Human
aaaaccaagaagau

SEQ ID NO: 2582829 - RNA, 15 nt, Human
aaaaccaauguucuc

SEQ ID NO: 2582830 - RNA, 22 nt, Human
aaaaauguuggauuuauaaaug

SEQ ID NO: 2582831 - RNA, 13 nt, Human
aaaaauuagcuga

SEQ ID NO: 2582832 - RNA, 17 nt, Human
aaaacauuuuaaaugga

SEQ ID NO: 2582833 - RNA, 16 nt, Human
aaaacauuuuaaaugg

SEQ ID NO: 2582834 - RNA, 21 nt, Human
aaaacauuuuuuaauagaaua

SEQ ID NO: 2582835 - RNA, 19 nt, Human
aaaacauuuucacacaaua

SEQ ID NO: 2582836 - RNA, 19 nt, Human
aaaaaucucaaauuucuaa

SEQ ID NO: 2582837 - RNA, 20 nt, Human
aaaaaucucaaauuucuaaa

SEQ ID NO: 2582838 - RNA, 22 nt, Human
gggaacagacuggaagcacagc

SEQ ID NO: 2582839 - RNA, 17 nt, Human
aaaaaucucaaauuucu

SEQ ID NO: 2582840 - RNA, 14 nt, Human
gggaacagacagga

SEQ ID NO: 2582841 - RNA, 15 nt, Human
gggaacagacaggag

SEQ ID NO: 2582842 - RNA, 16 nt, Human
gggaacagacaggaga

SEQ ID NO: 2582843 - RNA, 22 nt, Human
gggaaagccagugacuccagga

SEQ ID NO: 2582844 - RNA, 19 nt, Human
gggaaagccagugacucca

SEQ ID NO: 2582845 - RNA, 15 nt, Human
gggaaagccaccucu

SEQ ID NO: 2582846 - RNA, 15 nt, Human
gggaaaggauauuuu

SEQ ID NO: 2582847 - RNA, 22 nt, Human
gggaaaggcucugaaagccagc

SEQ ID NO: 2582848 - RNA, 13 nt, Human
gggaaaggggugc

SEQ ID NO: 2582849 - RNA, 17 nt, Human
gggaaauacuacuccug

SEQ ID NO: 2582850 - RNA, 14 nt, Human
gggaaauaagagag

SEQ ID NO: 2582851 - RNA, 14 nt, Human
gggaaauggugccu

SEQ ID NO: 2582852 - RNA, 19 nt, Human
gggaacaaggguggcaucc

SEQ ID NO: 2582853 - RNA, 19 nt, Human
gggaacagacaacagaagu

SEQ ID NO: 2582854 - RNA, 14 nt, Human
gggaacagacugga

SEQ ID NO: 2582855 - RNA, 20 nt, Human
aaaaauguuggauuuauaaa

SEQ ID NO: 2582856 - RNA, 16 nt, Human
aaaaauguuggauuua

SEQ ID NO: 2582857 - RNA, 12 nt, Human
aaaaauuaaaau

SEQ ID NO: 2582858 - RNA, 20 nt, Human
aaaaauguuaaaauguauuc

SEQ ID NO: 2582859 - RNA, 12 nt, Human
aaaaauguguaa

SEQ ID NO: 2582860 - RNA, 18 nt, Human
aaaaaugugcaaaacagc

SEQ ID NO: 2582861 - RNA, 13 nt, Human
aaaaaugccuuug

SEQ ID NO: 2582862 - RNA, 12 nt, Human
aaaaaugccuuu

SEQ ID NO: 2582863 - RNA, 22 nt, Human
aaaaaugucuuggguaggcggg

SEQ ID NO: 2582864 - RNA, 21 nt, Human
aaaaaugcacguagcugaggc

SEQ ID NO: 2582865 - RNA, 22 nt, Human
aaaaaugcaaauccuaugugau

SEQ ID NO: 2582866 - RNA, 23 nt, Human
aaaaaugcaaauccuaugugauu

SEQ ID NO: 2582867 - RNA, 18 nt, Human
aaaaaugcccuuaaauca

SEQ ID NO: 2582868 - RNA, 12 nt, Human
aaaaaugaaagc

SEQ ID NO: 2582869 - RNA, 14 nt, Human
aaaaaugaaauuau

SEQ ID NO: 2582870 - RNA, 17 nt, Human
aaaaaugacagauguug

SEQ ID NO: 2582871 - RNA, 20 nt, Human
aaaaaugacuaaaaauauua

SEQ ID NO: 2582872 - RNA, 20 nt, Human
aaaaaugcaaauccuaugug

SEQ ID NO: 2582873 - RNA, 18 nt, Human
aaaaaugcaaauccuaug

SEQ ID NO: 2582874 - RNA, 15 nt, Human
aaaaaugauguucau

SEQ ID NO: 2582875 - RNA, 22 nt, Human
aaaaaucugaccaaaacaaaca

SEQ ID NO: 2582876 - RNA, 18 nt, Human
gggaacagacaggagaaa

SEQ ID NO: 2582877 - RNA, 18 nt, Human
aaaaaucugcagaaggaa

SEQ ID NO: 2582878 - RNA, 20 nt, Human
aaaaaucugcagaaggaaaa

SEQ ID NO: 2582879 - RNA, 18 nt, Human
aaaagccuguuuaagaga

SEQ ID NO: 2582880 - RNA, 16 nt, Human
aaaagccuguuuaaga

SEQ ID NO: 2582881 - RNA, 19 nt, Human
aaaagccugcaauuucaua

SEQ ID NO: 2582882 - RNA, 20 nt, Human
aaaacuuuacuaagaugaca

SEQ ID NO: 2582883 - RNA, 21 nt, Human
aaaacuuuaugcuaagugaaa

SEQ ID NO: 2582884 - RNA, 22 nt, Human
aaaacuugauguguuaucucuu

SEQ ID NO: 2582885 - RNA, 14 nt, Human
aaaagccucugugu

SEQ ID NO: 2582886 - RNA, 16 nt, Human
aaaacuuuccucgccu

SEQ ID NO: 2582887 - RNA, 14 nt, Human
aaaacuuuccucgc

SEQ ID NO: 2582888 - RNA, 19 nt, Human
aaaacuuuacuaagaugac

SEQ ID NO: 2582889 - RNA, 17 nt, Human
aaaacuuguaaaugcug

SEQ ID NO: 2582890 - RNA, 14 nt, Human
aaaagcugggcagg

SEQ ID NO: 2582891 - RNA, 14 nt, Human
aaaagcuuccauga

SEQ ID NO: 2582892 - RNA, 23 nt, Human
gggacugccagucccccugcccc

SEQ ID NO: 2582893 - RNA, 12 nt, Human
aaaagcuccugu

SEQ ID NO: 2582894 - RNA, 18 nt, Human
aaaagcucauauuuugua

SEQ ID NO: 2582895 - RNA, 20 nt, Human
aaaagcucuuacacuacauu

SEQ ID NO: 2582896 - RNA, 13 nt, Human
aaaagcuccuguc

SEQ ID NO: 2582897 - RNA, 10 nt, Human
aaaagcugau

SEQ ID NO: 2582898 - RNA, 13 nt, Human
aaaagcugcucag

SEQ ID NO: 2582899 - RNA, 22 nt, Human
aaaagcuccauuuuuagugaaa

SEQ ID NO: 2582900 - RNA, 21 nt, Human
aaaagcuauuagccaggauca

SEQ ID NO: 2582901 - RNA, 20 nt, Human
aaaagcuauuagccaggauc

SEQ ID NO: 2582902 - RNA, 14 nt, Human
aaaagcucauauuu

SEQ ID NO: 2582903 - RNA, 17 nt, Human
aaaagcuauuagccagg

SEQ ID NO: 2582904 - RNA, 15 nt, Human
aaaagcuauuagcca

SEQ ID NO: 2582905 - RNA, 20 nt, Human
aaaagcuauggugagaugca

SEQ ID NO: 2582906 - RNA, 13 nt, Human
gggagggcuccag

SEQ ID NO: 2582907 - RNA, 11 nt, Human
gggagggcucc

SEQ ID NO: 2582908 - RNA, 22 nt, Human
gggagggcggcaggggccugga

SEQ ID NO: 2582909 - RNA, 21 nt, Human
gggagggcggcaggggccugg

SEQ ID NO: 2582910 - RNA, 13 nt, Human
gggagggccuggg

SEQ ID NO: 2582911 - RNA, 11 nt, Human
gggagggcagc

SEQ ID NO: 2582912 - RNA, 13 nt, Human
gggagggcagcag

SEQ ID NO: 2582913 - RNA, 13 nt, Human
gggaggccaagga

SEQ ID NO: 2582914 - RNA, 17 nt, Human
gggaggcauggcccugg

SEQ ID NO: 2582915 - RNA, 14 nt, Human
gggagagccagcuc

SEQ ID NO: 2582916 - RNA, 15 nt, Human
gggagagccagcucc

SEQ ID NO: 2582917 - RNA, 12 nt, Human
gggagagcccag

SEQ ID NO: 2582918 - RNA, 16 nt, Human
gggaggcauggcccug

SEQ ID NO: 2582919 - RNA, 13 nt, Human
gggaggcagccgg

SEQ ID NO: 2582920 - RNA, 20 nt, Human
gggaggcagagguugcagug

SEQ ID NO: 2582921 - RNA, 14 nt, Human
gggagacugggcug

SEQ ID NO: 2582922 - RNA, 16 nt, Human
gggagacugggcugag

SEQ ID NO: 2582923 - RNA, 19 nt, Human
gggagacugggcugaggga

SEQ ID NO: 2582924 - RNA, 20 nt, Human
gggagacugggcugagggag

SEQ ID NO: 2582925 - RNA, 22 nt, Human
gggagagaccucaucaggauga

SEQ ID NO: 2582926 - RNA, 12 nt, Human
gggagagaccuc

SEQ ID NO: 2582927 - RNA, 13 nt, Human
gggagagacccuu

SEQ ID NO: 2582928 - RNA, 22 nt, Human
gggagagagagagagagaggac

SEQ ID NO: 2582929 - RNA, 14 nt, Human
gggagagagagaga

SEQ ID NO: 2582930 - RNA, 18 nt, Human
gggagagagacguguaca

SEQ ID NO: 2582931 - RNA, 12 nt, Human
gggagagagaga

SEQ ID NO: 2582932 - RNA, 11 nt, Human
gggaggcagag

SEQ ID NO: 2582933 - RNA, 14 nt, Human
gggagagcaggcug

SEQ ID NO: 2582934 - RNA, 13 nt, Human
gggagagcaggcu

SEQ ID NO: 2582935 - RNA, 12 nt, Human
gggagagcaggc

SEQ ID NO: 2582936 - RNA, 23 nt, Human
gggagagagagagagagaggaca

SEQ ID NO: 2582937 - RNA, 16 nt, Human
gggagagcaggcuggc

SEQ ID NO: 2582938 - RNA, 15 nt, Human
gggagagcaggcugg

SEQ ID NO: 2582939 - RNA, 23 nt, Human
gggagagcaggcuggcagcucuc

SEQ ID NO: 2582940 - RNA, 12 nt, Human
gggagagccagc

SEQ ID NO: 2582941 - RNA, 16 nt, Human
gggacugcuaaauaaa

SEQ ID NO: 2582942 - RNA, 20 nt, Human
gggacugggagccgcagcag

SEQ ID NO: 2582943 - RNA, 19 nt, Human
gggacuggaaccagggaga

SEQ ID NO: 2582944 - RNA, 15 nt, Human
gggacugcuaaauaa

SEQ ID NO: 2582945 - RNA, 13 nt, Human
gggacugggaggg

SEQ ID NO: 2582946 - RNA, 14 nt, Human
gggacugggagggc

SEQ ID NO: 2582947 - RNA, 15 nt, Human
gggacugggagggcc

SEQ ID NO: 2582948 - RNA, 17 nt, Human
gggacugggagggccca

SEQ ID NO: 2582949 - RNA, 21 nt, Human
gggacuggguuuggaccccag

SEQ ID NO: 2582950 - RNA, 20 nt, Human
gggacuggguuuggacccca

SEQ ID NO: 2582951 - RNA, 12 nt, Human
gggacuggguuu

SEQ ID NO: 2582952 - RNA, 20 nt, Human
gggacuggggaugugggagg

SEQ ID NO: 2582953 - RNA, 21 nt, Human
gggacugucuuucagauacau

SEQ ID NO: 2582954 - RNA, 20 nt, Human
gggacuuccuugcucucccu

SEQ ID NO: 2582955 - RNA, 19 nt, Human
gggacuuccuugcucuccc

SEQ ID NO: 2582956 - RNA, 15 nt, Human
gggacuuccuugcuc

SEQ ID NO: 2582957 - RNA, 12 nt, Human
gggacugugugu

SEQ ID NO: 2582958 - RNA, 13 nt, Human
gggacuugaaguu

SEQ ID NO: 2582959 - RNA, 14 nt, Human
gggacuucuuuuca

SEQ ID NO: 2582960 - RNA, 16 nt, Human
aaacuggauuaaacuu

SEQ ID NO: 2582961 - RNA, 13 nt, Human
aaacugcccccuc

SEQ ID NO: 2582962 - RNA, 17 nt, Human
aaacugcccccucugcc

SEQ ID NO: 2582963 - RNA, 19 nt, Human
aaacugcccccucugcccu

SEQ ID NO: 2582964 - RNA, 20 nt, Human
aaacugcccccucugcccug

SEQ ID NO: 2582965 - RNA, 17 nt, Human
aaacuggggccuccaga

SEQ ID NO: 2582966 - RNA, 18 nt, Human
aaacuggggccuccagaa

SEQ ID NO: 2582967 - RNA, 14 nt, Human
aaacuggcuuuggc

SEQ ID NO: 2582968 - RNA, 13 nt, Human
aaacuggcuuugg

SEQ ID NO: 2582969 - RNA, 20 nt, Human
aaacuggcaaacuucagacu

SEQ ID NO: 2582970 - RNA, 15 nt, Human
aaacuggguuccugc

SEQ ID NO: 2582971 - RNA, 20 nt, Human
aaacuggggccuccagaacu

SEQ ID NO: 2582972 - RNA, 16 nt, Human
aaacuggguuccugca

SEQ ID NO: 2582973 - RNA, 16 nt, Human
aaacugguauuuuauc

SEQ ID NO: 2582974 - RNA, 16 nt, Human
aaacuggggccucccu

SEQ ID NO: 2582975 - RNA, 22 nt, Human
aaacugguauuuuaucuuugau

SEQ ID NO: 2582976 - RNA, 22 nt, Human
aaacugguuuguugcagccaaa

SEQ ID NO: 2582977 - RNA, 22 nt, Human
aaacuagcauaucugccuuuau

SEQ ID NO: 2582978 - RNA, 21 nt, Human
aaacuagcauaucugccuuua

SEQ ID NO: 2582979 - RNA, 20 nt, Human
aaacuagcauaucugccuuu

SEQ ID NO: 2582980 - RNA, 19 nt, Human
aaacuagcauaucugccuu

SEQ ID NO: 2582981 - RNA, 15 nt, Human
aaacuagcucgugau

SEQ ID NO: 2582982 - RNA, 14 nt, Human
aaacuagcauaucu

SEQ ID NO: 2582983 - RNA, 18 nt, Human
aaacuccacaucugccuu

SEQ ID NO: 2582984 - RNA, 17 nt, Human
aaacuccacaucugccu

SEQ ID NO: 2582985 - RNA, 19 nt, Human
aaacuccacaucugccuua

SEQ ID NO: 2582986 - RNA, 23 nt, Human
aaacuagcucgugauuggcauau

SEQ ID NO: 2582987 - RNA, 22 nt, Human
aaacucauuuccuauguaacug

SEQ ID NO: 2582988 - RNA, 16 nt, Human
aaacuccacaucugcc

SEQ ID NO: 2582989 - RNA, 23 nt, Human
aaacucccacuugucaugugaca

SEQ ID NO: 2582990 - RNA, 19 nt, Human
aaacuccgucuuagaagug

SEQ ID NO: 2582991 - RNA, 12 nt, Human
aaacugcccccu

SEQ ID NO: 2582992 - RNA, 11 nt, Human
aaacugccccc

SEQ ID NO: 2582993 - RNA, 22 nt, Human
aaacuccugccccuguucucuu

SEQ ID NO: 2582994 - RNA, 14 nt, Human
aaacuccugccccu

SEQ ID NO: 2582995 - RNA, 11 nt, Human
aaacuccugac

SEQ ID NO: 2582996 - RNA, 16 nt, Human
aaacguggcugcuuca

SEQ ID NO: 2582997 - RNA, 12 nt, Human
aaacgugaaaau

SEQ ID NO: 2582998 - RNA, 17 nt, Human
aaacguggcugcuucaa

SEQ ID NO: 2582999 - RNA, 20 nt, Human
aaacguggcugcuucaagga

SEQ ID NO: 2583000 - RNA, 15 nt, Human
aaacuaaauuguaaa

SEQ ID NO: 2583001 - RNA, 13 nt, Human
aaacuaaauugua

SEQ ID NO: 2583002 - RNA, 18 nt, Human
aaacgucuuauuguggua

SEQ ID NO: 2583003 - RNA, 11 nt, Human
aaacuaaucca

SEQ ID NO: 2583004 - RNA, 16 nt, Human
aaacuaauauuuuaug

SEQ ID NO: 2583005 - RNA, 20 nt, Human
aaacuaacagauaagcaaga

SEQ ID NO: 2583006 - RNA, 20 nt, Human
aaacuaaauuguaaacuccu

SEQ ID NO: 2583007 - RNA, 15 nt, Human
aaacuaacagauaag

SEQ ID NO: 2583008 - RNA, 18 nt, Human
aaacuaaggcccucuuga

SEQ ID NO: 2583009 - RNA, 20 nt, Human
aaacuaccuaacauuauuua

SEQ ID NO: 2583010 - RNA, 22 nt, Human
aaacuacacaucccuaaugugu

SEQ ID NO: 2583011 - RNA, 16 nt, Human
aaaccacagcaguuga

SEQ ID NO: 2583012 - RNA, 15 nt, Human
aaaccacagcaguug

SEQ ID NO: 2583013 - RNA, 21 nt, Human
aaaccacauuggagauguuua

SEQ ID NO: 2583014 - RNA, 14 nt, Human
aaaccaccagaagc

SEQ ID NO: 2583015 - RNA, 14 nt, Human
aaaccacagcugcu

SEQ ID NO: 2583016 - RNA, 18 nt, Human
aaaccacagcccugucag

SEQ ID NO: 2583017 - RNA, 15 nt, Human
aaaccaagcaaagga

SEQ ID NO: 2583018 - RNA, 15 nt, Human
aaaccacagcccugu

SEQ ID NO: 2583019 - RNA, 16 nt, Human
aaaccacagcccuguc

SEQ ID NO: 2583020 - RNA, 17 nt, Human
aaaccacagcccuguca

SEQ ID NO: 2583021 - RNA, 13 nt, Human
aaacggcccucuu

SEQ ID NO: 2583022 - RNA, 23 nt, Human
aaacggauuauuuuuucagaccg

SEQ ID NO: 2583023 - RNA, 22 nt, Human
aaacggauuauuuuuucagacc

SEQ ID NO: 2583024 - RNA, 21 nt, Human
aaacggauuauuuuuucagac

SEQ ID NO: 2583025 - RNA, 23 nt, Human
aaacggccucacuaggcuucugg

SEQ ID NO: 2583026 - RNA, 20 nt, Human
aaacggauuauuuuuucaga

SEQ ID NO: 2583027 - RNA, 18 nt, Human
aaacggauuauuuuuuca

SEQ ID NO: 2583028 - RNA, 16 nt, Human
aaacggauuauuuuuu

SEQ ID NO: 2583029 - RNA, 14 nt, Human
aaacggauuauuuu

SEQ ID NO: 2583030 - RNA, 12 nt, Human
aaacggauuauu

SEQ ID NO: 2583031 - RNA, 23 nt, Human
aaacggauuagggcauuugagaa

SEQ ID NO: 2583032 - RNA, 14 nt, Human
aaacgcugccugcc

SEQ ID NO: 2583033 - RNA, 16 nt, Human
aaacgcugccugccca

SEQ ID NO: 2583034 - RNA, 12 nt, Human
aaacgcugccug

SEQ ID NO: 2583035 - RNA, 20 nt, Human
ggguaucaggugcugccauc

SEQ ID NO: 2583036 - RNA, 16 nt, Human
ggguaggcgggaagga

SEQ ID NO: 2583037 - RNA, 23 nt, Human
ggggucuguguguuuaugugugu

SEQ ID NO: 2583038 - RNA, 15 nt, Human
ggggucuguaaaauc

SEQ ID NO: 2583039 - RNA, 23 nt, Human
ggguagcuguaaggcaugaagga

SEQ ID NO: 2583040 - RNA, 12 nt, Human
ggguaggcggga

SEQ ID NO: 2583041 - RNA, 18 nt, Human
ggguaggaggaugggcuc

SEQ ID NO: 2583042 - RNA, 21 nt, Human
gggucaggccacggcagccua

SEQ ID NO: 2583043 - RNA, 17 nt, Human
gggucaggccacggcag

SEQ ID NO: 2583044 - RNA, 14 nt, Human
gggucaggagaggg

SEQ ID NO: 2583045 - RNA, 15 nt, Human
gggucaggccacggc

SEQ ID NO: 2583046 - RNA, 17 nt, Human
gggucagccagggccag

SEQ ID NO: 2583047 - RNA, 13 nt, Human
gggucagccaggg

SEQ ID NO: 2583048 - RNA, 12 nt, Human
gggucagccagg

SEQ ID NO: 2583049 - RNA, 13 nt, Human
gggucaggaagga

SEQ ID NO: 2583050 - RNA, 19 nt, Human
gggucagccagggccaggg

SEQ ID NO: 2583051 - RNA, 23 nt, Human
ggguauaaaacuuuccucgccug

SEQ ID NO: 2583052 - RNA, 13 nt, Human
ggguauauucauu

SEQ ID NO: 2583053 - RNA, 19 nt, Human
gggucagacgccugaggaa

SEQ ID NO: 2583054 - RNA, 17 nt, Human
ggggcgaggcagaggac

SEQ ID NO: 2583055 - RNA, 21 nt, Human
ggggccuugcgguauccgccc

SEQ ID NO: 2583056 - RNA, 12 nt, Human
ggggcccugguc

SEQ ID NO: 2583057 - RNA, 22 nt, Human
ggggccuggcgggaugggccac

SEQ ID NO: 2583058 - RNA, 23 nt, Human
ggggucugggaggaauggacaga

SEQ ID NO: 2583059 - RNA, 20 nt, Human
ggggucuggaguugaucugg

SEQ ID NO: 2583060 - RNA, 21 nt, Human
ggggucuggaguugaucugga

SEQ ID NO: 2583061 - RNA, 22 nt, Human
ggggucucccucuccugccuac

SEQ ID NO: 2583062 - RNA, 15 nt, Human
ggggucuccaggagg

SEQ ID NO: 2583063 - RNA, 19 nt, Human
ggggucucccucuccugcc

SEQ ID NO: 2583064 - RNA, 20 nt, Human
ggggucucccucuccugccu

SEQ ID NO: 2583065 - RNA, 19 nt, Human
ggggcgcccaccuccccac

SEQ ID NO: 2583066 - RNA, 22 nt, Human
gggguccuucaaguuagcucag

SEQ ID NO: 2583067 - RNA, 22 nt, Human
ggggcgccgcaaaccacacugg

SEQ ID NO: 2583068 - RNA, 14 nt, Human
ggggcgcccaccuc

SEQ ID NO: 2583069 - RNA, 13 nt, Human
ggggcgaggcaga

SEQ ID NO: 2583070 - RNA, 21 nt, Human
ggggcgaucgcggcggagcug

SEQ ID NO: 2583071 - RNA, 23 nt, Human
aaacauguuucuuuguaaugaaa

SEQ ID NO: 2583072 - RNA, 22 nt, Human
aaacauguuucuuuguaaugaa

SEQ ID NO: 2583073 - RNA, 19 nt, Human
aaacauguuucuuuguaau

SEQ ID NO: 2583074 - RNA, 12 nt, Human
aaacauguuucc

SEQ ID NO: 2583075 - RNA, 23 nt, Human
gggucucacuauguugcccaggc

SEQ ID NO: 2583076 - RNA, 12 nt, Human
gggucucacucu

SEQ ID NO: 2583077 - RNA, 14 nt, Human
gggucuagggagag

SEQ ID NO: 2583078 - RNA, 19 nt, Human
gggucaggaaggaugagca

SEQ ID NO: 2583079 - RNA, 20 nt, Human
gggucgucaccaccucuccu

SEQ ID NO: 2583080 - RNA, 22 nt, Human
gggucucacuauguugcccagg

SEQ ID NO: 2583081 - RNA, 15 nt, Human
aaaccaaaaacugaa

SEQ ID NO: 2583082 - RNA, 14 nt, Human
aaaccaaagaagaa

SEQ ID NO: 2583083 - RNA, 20 nt, Human
aaaccaaagagggcuuccuc

SEQ ID NO: 2583084 - RNA, 19 nt, Human
aaaccaaagagggcuuccu

SEQ ID NO: 2583085 - RNA, 17 nt, Human
aaaccaaagagggcuuc

SEQ ID NO: 2583086 - RNA, 15 nt, Human
aaaccaaagaagaaa

SEQ ID NO: 2583087 - RNA, 21 nt, Human
aaaccaaagagggcuuccucu

SEQ ID NO: 2583088 - RNA, 14 nt, Human
aaaccaagccgugg

SEQ ID NO: 2583089 - RNA, 18 nt, Human
aaaccaaaucacugaacu

SEQ ID NO: 2583090 - RNA, 12 nt, Human
aaaccaagaaga

SEQ ID NO: 2583091 - RNA, 17 nt, Human
aaacauugguucuugua

SEQ ID NO: 2583092 - RNA, 20 nt, Human
aaacauugaaguaaugaauu

SEQ ID NO: 2583093 - RNA, 18 nt, Human
aaacauugguucuuguau

SEQ ID NO: 2583094 - RNA, 20 nt, Human
aaacauugguucuuguauua

SEQ ID NO: 2583095 - RNA, 21 nt, Human
aaacauugguucuuguauuaa

SEQ ID NO: 2583096 - RNA, 23 nt, Human
aaacauuuaacuuguuuccaaug

SEQ ID NO: 2583097 - RNA, 17 nt, Human
aaacaaggaugaauuaa

SEQ ID NO: 2583098 - RNA, 19 nt, Human
aaacaacuucaauauccaa

SEQ ID NO: 2583099 - RNA, 17 nt, Human
aaacaacucuuugagaa

SEQ ID NO: 2583100 - RNA, 15 nt, Human
aaacaaaauuucuau

SEQ ID NO: 2583101 - RNA, 14 nt, Human
aaacaaaauuucua

SEQ ID NO: 2583102 - RNA, 13 nt, Human
aaacaaagaaauu

SEQ ID NO: 2583103 - RNA, 11 nt, Human
aaacaaagaag

SEQ ID NO: 2583104 - RNA, 20 nt, Human
aaacaaaauuuguuugaaau

SEQ ID NO: 2583105 - RNA, 12 nt, Human
aaacaaagccag

SEQ ID NO: 2583106 - RNA, 22 nt, Human
aaacaacaauuucuacuuugaa

SEQ ID NO: 2583107 - RNA, 16 nt, Human
aaaauuuuuaaucuuu

SEQ ID NO: 2583108 - RNA, 15 nt, Human
aaaauuuuuaaucuu

SEQ ID NO: 2583109 - RNA, 20 nt, Human
aaaauuguuaauuuuuccua

SEQ ID NO: 2583110 - RNA, 21 nt, Human
aaaauuguuuugagcuuucca

SEQ ID NO: 2583111 - RNA, 16 nt, Human
aaaauuguauagagau

SEQ ID NO: 2583112 - RNA, 15 nt, Human
aaaauuguauagaga

SEQ ID NO: 2583113 - RNA, 13 nt, Human
aaaauuguauaga

SEQ ID NO: 2583114 - RNA, 15 nt, Human
aaaauuguaaaauug

SEQ ID NO: 2583115 - RNA, 17 nt, Human
aaaauguauaugcacuu

SEQ ID NO: 2583116 - RNA, 16 nt, Human
aaaauugguuggagaa

SEQ ID NO: 2583117 - RNA, 17 nt, Human
aaaauugguuggagaau

SEQ ID NO: 2583118 - RNA, 21 nt, Human
aaaauuguauguuaaguuacu

SEQ ID NO: 2583119 - RNA, 21 nt, Human
aaaauuguauagagauaugca

SEQ ID NO: 2583120 - RNA, 13 nt, Human
aaaauugugauca

SEQ ID NO: 2583121 - RNA, 16 nt, Human
aaaauugugauguguc

SEQ ID NO: 2583122 - RNA, 19 nt, Human
aaaauuuuuucucuaggaa

SEQ ID NO: 2583123 - RNA, 19 nt, Human
aaaauuuuuaaucuuuaau

SEQ ID NO: 2583124 - RNA, 12 nt, Human
aaacaaaauaga

SEQ ID NO: 2583125 - RNA, 22 nt, Human
aaaauuuaaaggguguacuuau

SEQ ID NO: 2583126 - RNA, 18 nt, Human
aaaauguacugagauuuu

SEQ ID NO: 2583127 - RNA, 10 nt, Human
aaaauguacu

SEQ ID NO: 2583128 - RNA, 21 nt, Human
aaaauguaggguuauaauaau

SEQ ID NO: 2583129 - RNA, 21 nt, Human
aaaauguaggcuuaguuugug

SEQ ID NO: 2583130 - RNA, 14 nt, Human
aaaauguauaugca

SEQ ID NO: 2583131 - RNA, 21 nt, Human
aaaauggacguguuaugacuc

SEQ ID NO: 2583132 - RNA, 22 nt, Human
aaaauggaggccauugugugag

SEQ ID NO: 2583133 - RNA, 21 nt, Human
aaaauguaagcuguuuauuuu

SEQ ID NO: 2583134 - RNA, 15 nt, Human
aaaauauuauguguu

SEQ ID NO: 2583135 - RNA, 14 nt, Human
aaaauauuaugugu

SEQ ID NO: 2583136 - RNA, 14 nt, Human
aaaauauguucuuu

SEQ ID NO: 2583137 - RNA, 23 nt, Human
gggcuggaacagauucacacugu

SEQ ID NO: 2583138 - RNA, 11 nt, Human
gggcuggaaca

SEQ ID NO: 2583139 - RNA, 20 nt, Human
gggcugcuuccuccuggaaa

SEQ ID NO: 2583140 - RNA, 19 nt, Human
gggcugcuuccuccuggaa

SEQ ID NO: 2583141 - RNA, 18 nt, Human
gggcugcuuccuccugga

SEQ ID NO: 2583142 - RNA, 21 nt, Human
aaaauauuauguguuuccaua

SEQ ID NO: 2583143 - RNA, 16 nt, Human
aaaauauuauaacuua

SEQ ID NO: 2583144 - RNA, 19 nt, Human
aaaauauuauaacuuaaaa

SEQ ID NO: 2583145 - RNA, 19 nt, Human
gggcuggacugaggccuga

SEQ ID NO: 2583146 - RNA, 15 nt, Human
gggcuggacugaggc

SEQ ID NO: 2583147 - RNA, 21 nt, Human
gggcuggaaucuggagagcua

SEQ ID NO: 2583148 - RNA, 18 nt, Human
gggcuggaaucuggagag

SEQ ID NO: 2583149 - RNA, 14 nt, Human
gggcuggacugagg

SEQ ID NO: 2583150 - RNA, 14 nt, Human
gggcuggcccagcc

SEQ ID NO: 2583151 - RNA, 13 nt, Human
gggcuggcccagc

SEQ ID NO: 2583152 - RNA, 12 nt, Human
gggcuggcccag

SEQ ID NO: 2583153 - RNA, 23 nt, Human
ggggcccugccuccuuugugagg

SEQ ID NO: 2583154 - RNA, 19 nt, Human
ggggcccugccuccuuugu

SEQ ID NO: 2583155 - RNA, 16 nt, Human
ggggcccugccuccuu

SEQ ID NO: 2583156 - RNA, 17 nt, Human
ggggccaguuggucccc

SEQ ID NO: 2583157 - RNA, 16 nt, Human
ggggccaggcuggguc

SEQ ID NO: 2583158 - RNA, 14 nt, Human
ggggccaggcuggg

SEQ ID NO: 2583159 - RNA, 13 nt, Human
ggggccaggcugg

SEQ ID NO: 2583160 - RNA, 17 nt, Human
ggggaccucaggccugg

SEQ ID NO: 2583161 - RNA, 16 nt, Human
ggggaccucaggccug

SEQ ID NO: 2583162 - RNA, 15 nt, Human
ggggaccucaggccu

SEQ ID NO: 2583163 - RNA, 13 nt, Human
ggggaccucaggc

SEQ ID NO: 2583164 - RNA, 17 nt, Human
ggggaaaggcaaggucc

SEQ ID NO: 2583165 - RNA, 22 nt, Human
ggggaaaggcaagguccggccc

SEQ ID NO: 2583166 - RNA, 18 nt, Human
ggggaacucagauccagg

SEQ ID NO: 2583167 - RNA, 21 nt, Human
ggggaacucagauccagggac

SEQ ID NO: 2583168 - RNA, 13 nt, Human
ggggaacuccugg

SEQ ID NO: 2583169 - RNA, 13 nt, Human
ggggaaagcacag

SEQ ID NO: 2583170 - RNA, 24 nt, Human
ggggaaaaucagccugcuccagcu

SEQ ID NO: 2583171 - RNA, 21 nt, Human
aaacauauauaacaaugcugu

SEQ ID NO: 2583172 - RNA, 16 nt, Human
aaacaugcuacacacu

SEQ ID NO: 2583173 - RNA, 22 nt, Human
aaacaugcuacacacugcaugu

SEQ ID NO: 2583174 - RNA, 19 nt, Human
aaacauauauaacaaugcu

SEQ ID NO: 2583175 - RNA, 16 nt, Human
aaacauauauaacaau

SEQ ID NO: 2583176 - RNA, 13 nt, Human
aaacauauauaac

SEQ ID NO: 2583177 - RNA, 13 nt, Human
aaacauaauucuu

SEQ ID NO: 2583178 - RNA, 20 nt, Human
aaacauaaucuucugccuuc

SEQ ID NO: 2583179 - RNA, 21 nt, Human
aaacauaauucuuguauauua

SEQ ID NO: 2583180 - RNA, 14 nt, Human
aaacacaacuauau

SEQ ID NO: 2583181 - RNA, 15 nt, Human
aaacaauaaagagau

SEQ ID NO: 2583182 - RNA, 14 nt, Human
aaacaauaaagaga

SEQ ID NO: 2583183 - RNA, 15 nt, Human
aaacaagugcuggca

SEQ ID NO: 2583184 - RNA, 19 nt, Human
aaacacaaaugcagggauu

SEQ ID NO: 2583185 - RNA, 14 nt, Human
aaacacaaaugcag

SEQ ID NO: 2583186 - RNA, 13 nt, Human
aaacacaaaugca

SEQ ID NO: 2583187 - RNA, 14 nt, Human
aaacacaauauuuu

SEQ ID NO: 2583188 - RNA, 16 nt, Human
aaacacaccaggcugu

SEQ ID NO: 2583189 - RNA, 17 nt, Human
aaacacaccaggcugug

SEQ ID NO: 2583190 - RNA, 18 nt, Human
aaacacaccaggcugugg

SEQ ID NO: 2583191 - RNA, 23 nt, Human
aaacacaccaggcugugggccuc

SEQ ID NO: 2583192 - RNA, 15 nt, Human
aaacacacugaggca

SEQ ID NO: 2583193 - RNA, 16 nt, Human
aaacacacugaggcag

SEQ ID NO: 2583194 - RNA, 19 nt, Human
aaacacacugaggcaggga

SEQ ID NO: 2583195 - RNA, 17 nt, Human
aaacacacugaggcagg

SEQ ID NO: 2583196 - RNA, 13 nt, Human
aaacauaaauaaa

SEQ ID NO: 2583197 - RNA, 17 nt, Human
aaacauaaauaaaauga

SEQ ID NO: 2583198 - RNA, 14 nt, Human
aaacauaaauaaaa

SEQ ID NO: 2583199 - RNA, 17 nt, Human
aaagcuaaaaugauuuu

SEQ ID NO: 2583200 - RNA, 18 nt, Human
aaagcuaaaguaucugua

SEQ ID NO: 2583201 - RNA, 18 nt, Human
aaagcuaggccuggccag

SEQ ID NO: 2583202 - RNA, 17 nt, Human
aaagcuaggccuggcca

SEQ ID NO: 2583203 - RNA, 22 nt, Human
aaagcagugcaugcugucccuu

SEQ ID NO: 2583204 - RNA, 21 nt, Human
aaagcagugcaugcugucccu

SEQ ID NO: 2583205 - RNA, 23 nt, Human
aaagcaguuaacuuuaagacuga

SEQ ID NO: 2583206 - RNA, 16 nt, Human
aaagcagugcaugcug

SEQ ID NO: 2583207 - RNA, 22 nt, Human
aaagcaccaaaauaagaaaaga

SEQ ID NO: 2583208 - RNA, 19 nt, Human
aaagcggacaucagcuggu

SEQ ID NO: 2583209 - RNA, 17 nt, Human
aaagcagugcaugcugu

SEQ ID NO: 2583210 - RNA, 18 nt, Human
aaagcaccaaaauaagaa

SEQ ID NO: 2583211 - RNA, 19 nt, Human
aaagcaccaaaauaagaaa

SEQ ID NO: 2583212 - RNA, 20 nt, Human
aaagcaccaaaauaagaaaa

SEQ ID NO: 2583213 - RNA, 21 nt, Human
aaagcaccaaaauaagaaaag

SEQ ID NO: 2583214 - RNA, 15 nt, Human
aaagcacaguuugaa

SEQ ID NO: 2583215 - RNA, 21 nt, Human
aaagcacaguguuaaaugaaa

SEQ ID NO: 2583216 - RNA, 20 nt, Human
aaagcacaguguuaaaugaa

SEQ ID NO: 2583217 - RNA, 14 nt, Human
aaagcacaguguua

SEQ ID NO: 2583218 - RNA, 22 nt, Human
aaagcacaggugggcuucccag

SEQ ID NO: 2583219 - RNA, 16 nt, Human
aaagcacaagaagcgu

SEQ ID NO: 2583220 - RNA, 13 nt, Human
aaagcacaagaag

SEQ ID NO: 2583221 - RNA, 16 nt, Human
aaagcaccaaaauaag

SEQ ID NO: 2583222 - RNA, 17 nt, Human
aaagcaccaaaauaaga

SEQ ID NO: 2583223 - RNA, 17 nt, Human
aaagcacaguuugaaca

SEQ ID NO: 2583224 - RNA, 16 nt, Human
aaagcacaguuugaac

SEQ ID NO: 2583225 - RNA, 16 nt, Human
aaagcacauugaaaga

SEQ ID NO: 2583226 - RNA, 22 nt, Human
ggugcccaagccagaggcuggg

SEQ ID NO: 2583227 - RNA, 21 nt, Human
ggugcccaagccagaggcugg

SEQ ID NO: 2583228 - RNA, 23 nt, Human
ggugcccaagccagaggcugggu

SEQ ID NO: 2583229 - RNA, 22 nt, Human
ggugcccaagcucagaaggcuc

SEQ ID NO: 2583230 - RNA, 18 nt, Human
ggugcccaagccagaggc

SEQ ID NO: 2583231 - RNA, 17 nt, Human
ggugcccaagccagagg

SEQ ID NO: 2583232 - RNA, 14 nt, Human
ggugcccaagccag

SEQ ID NO: 2583233 - RNA, 13 nt, Human
ggugcccacaggc

SEQ ID NO: 2583234 - RNA, 14 nt, Human
ggugcccacaggcc

SEQ ID NO: 2583235 - RNA, 23 nt, Human
ggugcccagaauaaguuauugca

SEQ ID NO: 2583236 - RNA, 20 nt, Human
ggugcccagaaugaggcugc

SEQ ID NO: 2583237 - RNA, 23 nt, Human
aaagcaauuuuccuugaagccga

SEQ ID NO: 2583238 - RNA, 22 nt, Human
aaagcaauuuuccuugaagccg

SEQ ID NO: 2583239 - RNA, 21 nt, Human
aaagcaauuuuccuugaagcc

SEQ ID NO: 2583240 - RNA, 20 nt, Human
aaagcacacucauccccuca

SEQ ID NO: 2583241 - RNA, 13 nt, Human
aaaggaauuuaaa

SEQ ID NO: 2583242 - RNA, 19 nt, Human
aaaggacagaguaugaaca

SEQ ID NO: 2583243 - RNA, 22 nt, Human
aaaggacaccuuuuaacucacc

SEQ ID NO: 2583244 - RNA, 16 nt, Human
aaaggacaauuucaaa

SEQ ID NO: 2583245 - RNA, 15 nt, Human
aaaggacaauuucaa

SEQ ID NO: 2583246 - RNA, 23 nt, Human
aaaggaauuggcauguguauguu

SEQ ID NO: 2583247 - RNA, 11 nt, Human
aaaggaaagag

SEQ ID NO: 2583248 - RNA, 18 nt, Human
aaaggaaaauaguaaugu

SEQ ID NO: 2583249 - RNA, 21 nt, Human
aaaggaauccacucccaggca

SEQ ID NO: 2583250 - RNA, 17 nt, Human
aaaggaaucauuucuau

SEQ ID NO: 2583251 - RNA, 20 nt, Human
aaaggaagguucugguguga

SEQ ID NO: 2583252 - RNA, 23 nt, Human
aaaggaagguucuggugugaacu

SEQ ID NO: 2583253 - RNA, 14 nt, Human
aaaggaagucuagg

SEQ ID NO: 2583254 - RNA, 23 nt, Human
aaagcuauuagccaggaucaugg

SEQ ID NO: 2583255 - RNA, 22 nt, Human
aaagcuauuagccaggaucaug

SEQ ID NO: 2583256 - RNA, 20 nt, Human
aaagcuauuagccaggauca

SEQ ID NO: 2583257 - RNA, 19 nt, Human
aaagcuauuagccaggauc

SEQ ID NO: 2583258 - RNA, 18 nt, Human
aaagcuauuagccaggau

SEQ ID NO: 2583259 - RNA, 17 nt, Human
aaagcuauuagccagga

SEQ ID NO: 2583260 - RNA, 15 nt, Human
aaagcuauuagccag

SEQ ID NO: 2583261 - RNA, 22 nt, Human
aaagcuauggugagaugcagcu

SEQ ID NO: 2583262 - RNA, 15 nt, Human
aaagcuauggugaga

SEQ ID NO: 2583263 - RNA, 23 nt, Human
aaagcuaaaaugauuuuaucugu

SEQ ID NO: 2583264 - RNA, 17 nt, Human
aaagcuuccaugauucu

SEQ ID NO: 2583265 - RNA, 18 nt, Human
aaagcuuccaugauucua

SEQ ID NO: 2583266 - RNA, 20 nt, Human
aaagcuuccaugauucuauu

SEQ ID NO: 2583267 - RNA, 11 nt, Human
aaagcuucccc

SEQ ID NO: 2583268 - RNA, 19 nt, Human
aaagcuuuuuauuccuccu

SEQ ID NO: 2583269 - RNA, 19 nt, Human
aaaggaaaaagcacaagaa

SEQ ID NO: 2583270 - RNA, 16 nt, Human
aaaggaaaaagcacaa

SEQ ID NO: 2583271 - RNA, 19 nt, Human
aaagcuucuaucccaggag

SEQ ID NO: 2583272 - RNA, 21 nt, Human
aaagcuucuaucccaggaggu

SEQ ID NO: 2583273 - RNA, 19 nt, Human
aaagcuugcaacaaaauuc

SEQ ID NO: 2583274 - RNA, 20 nt, Human
aaagcuugaagaucguuagu

SEQ ID NO: 2583275 - RNA, 20 nt, Human
ggucuuuguaagaguguaga

SEQ ID NO: 2583276 - RNA, 15 nt, Human
ggucuuuguaagagu

SEQ ID NO: 2583277 - RNA, 14 nt, Human
ggucuuuguaagag

SEQ ID NO: 2583278 - RNA, 13 nt, Human
ggucuuuguaaga

SEQ ID NO: 2583279 - RNA, 12 nt, Human
ggucuuuguaag

SEQ ID NO: 2583280 - RNA, 19 nt, Human
ggucuuuucaucugggaaa

SEQ ID NO: 2583281 - RNA, 19 nt, Human
ggucuuuguaagaguguag

SEQ ID NO: 2583282 - RNA, 16 nt, Human
ggucuuuucaucuggg

SEQ ID NO: 2583283 - RNA, 20 nt, Human
ggucuuuucaucugggaaag

SEQ ID NO: 2583284 - RNA, 21 nt, Human
ggucuuuugacauguggaaag

SEQ ID NO: 2583285 - RNA, 21 nt, Human
ggugauccacucgccuucauc

SEQ ID NO: 2583286 - RNA, 17 nt, Human
ggucuuuuuaugcauuu

SEQ ID NO: 2583287 - RNA, 17 nt, Human
ggucuuuugacaugugg

SEQ ID NO: 2583288 - RNA, 18 nt, Human
ggucuguuggcaggcugg

SEQ ID NO: 2583289 - RNA, 16 nt, Human
ggucuguuggcaggcu

SEQ ID NO: 2583290 - RNA, 18 nt, Human
ggucuguucuugaagcag

SEQ ID NO: 2583291 - RNA, 13 nt, Human
ggucuugaucucc

SEQ ID NO: 2583292 - RNA, 20 nt, Human
ggucuugggaaauaugaaug

SEQ ID NO: 2583293 - RNA, 13 nt, Human
ggucuugggaaau

SEQ ID NO: 2583294 - RNA, 23 nt, Human
ggucuuggagcugagccucucac

SEQ ID NO: 2583295 - RNA, 18 nt, Human
ggucuuggagcugagccu

SEQ ID NO: 2583296 - RNA, 20 nt, Human
ggucuugguuccagccugcc

SEQ ID NO: 2583297 - RNA, 21 nt, Human
ggucuugguuccagccugcca

SEQ ID NO: 2583298 - RNA, 18 nt, Human
ggucuuuccuaaggcugc

SEQ ID NO: 2583299 - RNA, 19 nt, Human
ggucuuuccuaaggcugca

SEQ ID NO: 2583300 - RNA, 19 nt, Human
ggucuuuccuaucauggag

SEQ ID NO: 2583301 - RNA, 21 nt, Human
ggucuuucauggggugaugcu

SEQ ID NO: 2583302 - RNA, 16 nt, Human
ggucuuucauggggug

SEQ ID NO: 2583303 - RNA, 22 nt, Human
ggugcacaagcuccaagcuccc

SEQ ID NO: 2583304 - RNA, 16 nt, Human
ggugcacaagcuccaa

SEQ ID NO: 2583305 - RNA, 15 nt, Human
ggugaugcugggcug

SEQ ID NO: 2583306 - RNA, 13 nt, Human
ggugaugccaggu

SEQ ID NO: 2583307 - RNA, 16 nt, Human
ggugaugcugggcugg

SEQ ID NO: 2583308 - RNA, 22 nt, Human
ggugauuacauaaucuguacaa

SEQ ID NO: 2583309 - RNA, 15 nt, Human
ggugccaguuauggc

SEQ ID NO: 2583310 - RNA, 16 nt, Human
ggugcagagcugaaga

SEQ ID NO: 2583311 - RNA, 15 nt, Human
ggugcacagugauuu

SEQ ID NO: 2583312 - RNA, 16 nt, Human
ggugcacagugauuuu

SEQ ID NO: 2583313 - RNA, 15 nt, Human
ggugauuucagagag

SEQ ID NO: 2583314 - RNA, 20 nt, Human
ggugcacagacgucccucca

SEQ ID NO: 2583315 - RNA, 17 nt, Human
ggucuguucuuuccaaa

SEQ ID NO: 2583316 - RNA, 19 nt, Human
ggucuguucuuuccaaagu

SEQ ID NO: 2583317 - RNA, 22 nt, Human
ggucuugaacuccuggccucaa

SEQ ID NO: 2583318 - RNA, 21 nt, Human
ggucuugaacuccuggccuca

SEQ ID NO: 2583319 - RNA, 14 nt, Human
ggucugugagaugc

SEQ ID NO: 2583320 - RNA, 24 nt, Human
ggucugugagaugcuagaacuccc

SEQ ID NO: 2583321 - RNA, 12 nt, Human
ggucuguucuuu

SEQ ID NO: 2583322 - RNA, 13 nt, Human
ggucuguucuuga

SEQ ID NO: 2583323 - RNA, 15 nt, Human
ggucugucccaccag

SEQ ID NO: 2583324 - RNA, 15 nt, Human
ggucuggcugagcug

SEQ ID NO: 2583325 - RNA, 14 nt, Human
ggucuggccucagg

SEQ ID NO: 2583326 - RNA, 13 nt, Human
ggucuggcugcuu

SEQ ID NO: 2583327 - RNA, 21 nt, Human
ggucugggaggaauggacaga

SEQ ID NO: 2583328 - RNA, 16 nt, Human
ggucugggacuuccuu

SEQ ID NO: 2583329 - RNA, 17 nt, Human
ggucugggacuuccuug

SEQ ID NO: 2583330 - RNA, 14 nt, Human
ggucuguaaaaucu

SEQ ID NO: 2583331 - RNA, 12 nt, Human
ggucuguaaaau

SEQ ID NO: 2583332 - RNA, 18 nt, Human
ggucuguacguuaccucu

SEQ ID NO: 2583333 - RNA, 14 nt, Human
ggucuguagggauu

SEQ ID NO: 2583334 - RNA, 14 nt, Human
ggucugucccacca

SEQ ID NO: 2583335 - RNA, 21 nt, Human
aaagauuuucagaaaauauua

SEQ ID NO: 2583336 - RNA, 15 nt, Human
ggucuggcagccucc

SEQ ID NO: 2583337 - RNA, 22 nt, Human
ggucuggcagccucccauccag

SEQ ID NO: 2583338 - RNA, 23 nt, Human
ggucuggagaagcucccaggaac

SEQ ID NO: 2583339 - RNA, 22 nt, Human
ggucuggagaagcagugagccg

SEQ ID NO: 2583340 - RNA, 22 nt, Human
ggucugcucuuucucugccagu

SEQ ID NO: 2583341 - RNA, 22 nt, Human
aaagacuauucaaacagucuca

SEQ ID NO: 2583342 - RNA, 23 nt, Human
aaagaaugggcaguuacaugcau

SEQ ID NO: 2583343 - RNA, 18 nt, Human
aaagaaugggcaguuaca

SEQ ID NO: 2583344 - RNA, 12 nt, Human
aaagaaugggca

SEQ ID NO: 2583345 - RNA, 17 nt, Human
aaagaauggaaggugga

SEQ ID NO: 2583346 - RNA, 13 nt, Human
aaagacuccaaag

SEQ ID NO: 2583347 - RNA, 23 nt, Human
aaagacuauucaaacagucucag

SEQ ID NO: 2583348 - RNA, 15 nt, Human
aaagacucaguguuc

SEQ ID NO: 2583349 - RNA, 15 nt, Human
aaagacuguacaaag

SEQ ID NO: 2583350 - RNA, 21 nt, Human
aaagagaccuaccucagguug

SEQ ID NO: 2583351 - RNA, 20 nt, Human
aaagagaccuaccucagguu

SEQ ID NO: 2583352 - RNA, 18 nt, Human
aaagagaccuaccucagg

SEQ ID NO: 2583353 - RNA, 17 nt, Human
aaagagaccuaccucag

SEQ ID NO: 2583354 - RNA, 18 nt, Human
aaagagagaaaaacaaau

SEQ ID NO: 2583355 - RNA, 15 nt, Human
aaagagacuggagca

SEQ ID NO: 2583356 - RNA, 12 nt, Human
aaagagagaaaa

SEQ ID NO: 2583357 - RNA, 21 nt, Human
aaagagaauugggggcuuagg

SEQ ID NO: 2583358 - RNA, 18 nt, Human
aaagagaacuuccagauc

SEQ ID NO: 2583359 - RNA, 15 nt, Human
aaagagaaguauuau

SEQ ID NO: 2583360 - RNA, 14 nt, Human
aaagagaaggagcc

SEQ ID NO: 2583361 - RNA, 19 nt, Human
aaagacuuuuccaacccuc

SEQ ID NO: 2583362 - RNA, 18 nt, Human
aaagacuuaguauauuuu

SEQ ID NO: 2583363 - RNA, 20 nt, Human
aaagacuuaguauauuuucu

SEQ ID NO: 2583364 - RNA, 14 nt, Human
aaagagaaaagaaa

SEQ ID NO: 2583365 - RNA, 12 nt, Human
aaagagaaaaga

SEQ ID NO: 2583366 - RNA, 13 nt, Human
aaagagaaaagaa

SEQ ID NO: 2583367 - RNA, 18 nt, Human
aaagagaaaaaaaguuug

SEQ ID NO: 2583368 - RNA, 18 nt, Human
aaagaggcuaugugagca

SEQ ID NO: 2583369 - RNA, 13 nt, Human
aaagaggcuaugu

SEQ ID NO: 2583370 - RNA, 15 nt, Human
aaagaugagugagca

SEQ ID NO: 2583371 - RNA, 18 nt, Human
aaagaggcgucuguauau

SEQ ID NO: 2583372 - RNA, 20 nt, Human
aaagaggcgucuguauauuu

SEQ ID NO: 2583373 - RNA, 16 nt, Human
aaagaggcugaaagag

SEQ ID NO: 2583374 - RNA, 13 nt, Human
aaagagagaaugu

SEQ ID NO: 2583375 - RNA, 18 nt, Human
aaagagagaaaacuuauu

SEQ ID NO: 2583376 - RNA, 13 nt, Human
aaagagagaaaac

SEQ ID NO: 2583377 - RNA, 13 nt, Human
aaagagagaaaau

SEQ ID NO: 2583378 - RNA, 14 nt, Human
aaagagagaaaaua

SEQ ID NO: 2583379 - RNA, 15 nt, Human
aaagagagaaaauaa

SEQ ID NO: 2583380 - RNA, 16 nt, Human
aaagagagaaaauaaa

SEQ ID NO: 2583381 - RNA, 17 nt, Human
aaagagagaaaauaaaa

SEQ ID NO: 2583382 - RNA, 18 nt, Human
aaagagagaaaauaaaaa

SEQ ID NO: 2583383 - RNA, 19 nt, Human
aaagagagaaaauaaaaag

SEQ ID NO: 2583384 - RNA, 20 nt, Human
aaagaggcagcuugaaacug

SEQ ID NO: 2583385 - RNA, 21 nt, Human
aaagagagaaaauaaaaaguu

SEQ ID NO: 2583386 - RNA, 22 nt, Human
aaagagagaaaauaaaaaguua

SEQ ID NO: 2583387 - RNA, 22 nt, Human
aaagagagaaaacuuauuugag

SEQ ID NO: 2583388 - RNA, 18 nt, Human
aaagagagaauguagaua

SEQ ID NO: 2583389 - RNA, 19 nt, Human
aaagauucauuuuuaauca

SEQ ID NO: 2583390 - RNA, 15 nt, Human
aaagauucauuuuua

SEQ ID NO: 2583391 - RNA, 13 nt, Human
aaagauucauuuu

SEQ ID NO: 2583392 - RNA, 20 nt, Human
aaagauucauuuuuaaucau

SEQ ID NO: 2583393 - RNA, 15 nt, Human
aaagauuuucagaaa

SEQ ID NO: 2583394 - RNA, 14 nt, Human
aaagauuuucagaa

SEQ ID NO: 2583395 - RNA, 20 nt, Human
aaagauguuugucagauaug

SEQ ID NO: 2583396 - RNA, 19 nt, Human
aaagauucagguauguugc

SEQ ID NO: 2583397 - RNA, 19 nt, Human
aaagauuacuuagaggaaa

SEQ ID NO: 2583398 - RNA, 21 nt, Human
aaagauguuugucagauauga

SEQ ID NO: 2583399 - RNA, 22 nt, Human
aaagauuacuuuuucuuuaugu

SEQ ID NO: 2583400 - RNA, 21 nt, Human
aaagaugauuuaaaagggaag

SEQ ID NO: 2583401 - RNA, 20 nt, Human
aaagaggcugaaagaggcca

SEQ ID NO: 2583402 - RNA, 14 nt, Human
aaagaugcaaugua

SEQ ID NO: 2583403 - RNA, 20 nt, Human
aaagaugcaaggaccaggac

SEQ ID NO: 2583404 - RNA, 22 nt, Human
aaagaugcaucuaccgcucuug

SEQ ID NO: 2583405 - RNA, 22 nt, Human
aaagaugccggguuuuauauuu

SEQ ID NO: 2583406 - RNA, 23 nt, Human
aaagauggggucuguaaaaucuu

SEQ ID NO: 2583407 - RNA, 17 nt, Human
aaagaugcucuucugug

SEQ ID NO: 2583408 - RNA, 15 nt, Human
aaacuguagaaauga

SEQ ID NO: 2583409 - RNA, 16 nt, Human
aaacuguagaaaugau

SEQ ID NO: 2583410 - RNA, 18 nt, Human
aaacuguagaaaugauga

SEQ ID NO: 2583411 - RNA, 15 nt, Human
aaacuguagucucag

SEQ ID NO: 2583412 - RNA, 16 nt, Human
aaacuguagucucagg

SEQ ID NO: 2583413 - RNA, 22 nt, Human
aaacuguauugaugacaguagu

SEQ ID NO: 2583414 - RNA, 14 nt, Human
aaacuguauugaug

SEQ ID NO: 2583415 - RNA, 23 nt, Human
gguaguacuccugcaaaauuuua

SEQ ID NO: 2583416 - RNA, 22 nt, Human
gguaguacuccugcaaaauuuu

SEQ ID NO: 2583417 - RNA, 16 nt, Human
gguaguuaguagcaug

SEQ ID NO: 2583418 - RNA, 19 nt, Human
gguaguuaguagcauguug

SEQ ID NO: 2583419 - RNA, 22 nt, Human
gguauaaaacuuuccucgccug

SEQ ID NO: 2583420 - RNA, 21 nt, Human
gguauaaaacuuuccucgccu

SEQ ID NO: 2583421 - RNA, 13 nt, Human
gguauaaaagaug

SEQ ID NO: 2583422 - RNA, 12 nt, Human
gguauaaaagau

SEQ ID NO: 2583423 - RNA, 18 nt, Human
gguaguugcaauugaauu

SEQ ID NO: 2583424 - RNA, 18 nt, Human
gguauaaguggugugugu

SEQ ID NO: 2583425 - RNA, 16 nt, Human
gguauaaaagaugggg

SEQ ID NO: 2583426 - RNA, 17 nt, Human
gguauaaugguugacug

SEQ ID NO: 2583427 - RNA, 14 nt, Human
gguaugugugugua

SEQ ID NO: 2583428 - RNA, 21 nt, Human
gguauggaaggguuuguggcu

SEQ ID NO: 2583429 - RNA, 16 nt, Human
ggucaugcccuccucu

SEQ ID NO: 2583430 - RNA, 17 nt, Human
ggucaugcccuccucuc

SEQ ID NO: 2583431 - RNA, 15 nt, Human
ggucaugcccuccuc

SEQ ID NO: 2583432 - RNA, 15 nt, Human
ggucaugguggugca

SEQ ID NO: 2583433 - RNA, 20 nt, Human
ggucaugcccuccucuccca

SEQ ID NO: 2583434 - RNA, 15 nt, Human
ggucauuuaugaaaa

SEQ ID NO: 2583435 - RNA, 17 nt, Human
gguccaaauaaaaacua

SEQ ID NO: 2583436 - RNA, 11 nt, Human
gguccaaauaa

SEQ ID NO: 2583437 - RNA, 15 nt, Human
gguccaaauaaaaac

SEQ ID NO: 2583438 - RNA, 19 nt, Human
gguccacccaggagccccg

SEQ ID NO: 2583439 - RNA, 23 nt, Human
gguauuggcuagagguucaaaga

SEQ ID NO: 2583440 - RNA, 20 nt, Human
gguauuacacuguauuugua

SEQ ID NO: 2583441 - RNA, 18 nt, Human
gguauuaugcuucuugga

SEQ ID NO: 2583442 - RNA, 14 nt, Human
gguauuagaaagug

SEQ ID NO: 2583443 - RNA, 14 nt, Human
gguauuccugccuc

SEQ ID NO: 2583444 - RNA, 18 nt, Human
gguauuccuuuuguguac

SEQ ID NO: 2583445 - RNA, 17 nt, Human
gguauuguauuuauuca

SEQ ID NO: 2583446 - RNA, 12 nt, Human
gguauuguauuu

SEQ ID NO: 2583447 - RNA, 19 nt, Human
gguauuccuuuuguguaca

SEQ ID NO: 2583448 - RNA, 13 nt, Human
aaacuuuaauaua

SEQ ID NO: 2583449 - RNA, 14 nt, Human
aaacuuuaccuuuu

SEQ ID NO: 2583450 - RNA, 20 nt, Human
aaacuuuacccaaaaacuaa

SEQ ID NO: 2583451 - RNA, 16 nt, Human
aaagaaugauuaugaa

SEQ ID NO: 2583452 - RNA, 24 nt, Human
aaacuuuuuugaaauaauaaaucu

SEQ ID NO: 2583453 - RNA, 18 nt, Human
aaacuuguuacuaaagaa

SEQ ID NO: 2583454 - RNA, 12 nt, Human
ggucccacccca

SEQ ID NO: 2583455 - RNA, 21 nt, Human
ggucccaagcugggccccagc

SEQ ID NO: 2583456 - RNA, 20 nt, Human
ggucccaagcugggccccag

SEQ ID NO: 2583457 - RNA, 19 nt, Human
ggucccaagcugggcccca

SEQ ID NO: 2583458 - RNA, 16 nt, Human
ggucccaagcugggcc

SEQ ID NO: 2583459 - RNA, 13 nt, Human
ggucccacacugg

SEQ ID NO: 2583460 - RNA, 23 nt, Human
ggucccaagcugggccccagccc

SEQ ID NO: 2583461 - RNA, 22 nt, Human
gguccacccaggagccccgagg

SEQ ID NO: 2583462 - RNA, 20 nt, Human
gguccacccaggagccccga

SEQ ID NO: 2583463 - RNA, 15 nt, Human
ggucccaagcugggc

SEQ ID NO: 2583464 - RNA, 23 nt, Human
ggucccaacaggaggacaauuca

SEQ ID NO: 2583465 - RNA, 22 nt, Human
ggucccaacaggaggacaauuc

SEQ ID NO: 2583466 - RNA, 16 nt, Human
gguccaugggcagagc

SEQ ID NO: 2583467 - RNA, 18 nt, Human
gguccaugggcagagccc

SEQ ID NO: 2583468 - RNA, 12 nt, Human
ggucccaacagg

SEQ ID NO: 2583469 - RNA, 14 nt, Human
gguccaccccaugu

SEQ ID NO: 2583470 - RNA, 17 nt, Human
gguccaugggcagagcc

SEQ ID NO: 2583471 - RNA, 20 nt, Human
gcuucacggaagagccuugc

SEQ ID NO: 2583472 - RNA, 16 nt, Human
gcuucacuguauaaau

SEQ ID NO: 2583473 - RNA, 15 nt, Human
gcuucacuguauaaa

SEQ ID NO: 2583474 - RNA, 14 nt, Human
gcuucacuguauaa

SEQ ID NO: 2583475 - RNA, 22 nt, Human
gcuucagccacaguuuccucau

SEQ ID NO: 2583476 - RNA, 14 nt, Human
gcuucagccaggag

SEQ ID NO: 2583477 - RNA, 17 nt, Human
gcuucagcauauuuaua

SEQ ID NO: 2583478 - RNA, 16 nt, Human
gcuucagccacaguuu

SEQ ID NO: 2583479 - RNA, 19 nt, Human
gcuucagcauauuuauagc

SEQ ID NO: 2583480 - RNA, 17 nt, Human
gcuucacuguauaaaua

SEQ ID NO: 2583481 - RNA, 15 nt, Human
gcuucaauuaauaaa

SEQ ID NO: 2583482 - RNA, 22 nt, Human
gcuucaauacccaaauccucuc

SEQ ID NO: 2583483 - RNA, 14 nt, Human
gcuuaacuucacau

SEQ ID NO: 2583484 - RNA, 22 nt, Human
gcuucacccugaaugguuccau

SEQ ID NO: 2583485 - RNA, 20 nt, Human
gcuucaccccaaucccagcu

SEQ ID NO: 2583486 - RNA, 15 nt, Human
gcuucaccagagcau

SEQ ID NO: 2583487 - RNA, 14 nt, Human
gcuucaccagagca

SEQ ID NO: 2583488 - RNA, 19 nt, Human
gcuucaccccaaucccagc

SEQ ID NO: 2583489 - RNA, 22 nt, Human
gcuucaaggauccugagccaga

SEQ ID NO: 2583490 - RNA, 23 nt, Human
gcuuaaaggugucuuccucccaa

SEQ ID NO: 2583491 - RNA, 22 nt, Human
gcuuaaaggugucuuccuccca

SEQ ID NO: 2583492 - RNA, 20 nt, Human
gcuuaaaggugucuuccucc

SEQ ID NO: 2583493 - RNA, 17 nt, Human
gcuuaaaggugucuucc

SEQ ID NO: 2583494 - RNA, 16 nt, Human
gcuuaaaggugucuuc

SEQ ID NO: 2583495 - RNA, 12 nt, Human
gcuuaaagaugu

SEQ ID NO: 2583496 - RNA, 15 nt, Human
gcugugagccccugg

SEQ ID NO: 2583497 - RNA, 12 nt, Human
gcugugagcccc

SEQ ID NO: 2583498 - RNA, 23 nt, Human
gcugugagacagugggaaauauu

SEQ ID NO: 2583499 - RNA, 20 nt, Human
gcugugagacagugggaaau

SEQ ID NO: 2583500 - RNA, 18 nt, Human
gcugugagacagugggaa

SEQ ID NO: 2583501 - RNA, 15 nt, Human
gcugugagacagugg

SEQ ID NO: 2583502 - RNA, 17 nt, Human
gcugugacuucuccagg

SEQ ID NO: 2583503 - RNA, 16 nt, Human
gcugugacuucuccag

SEQ ID NO: 2583504 - RNA, 13 nt, Human
gcugugaaaaaaa

SEQ ID NO: 2583505 - RNA, 18 nt, Human
gcugugaacauggacucu

SEQ ID NO: 2583506 - RNA, 22 nt, Human
gcugugacaauggcaacaauuu

SEQ ID NO: 2583507 - RNA, 20 nt, Human
gcugugaauuuguguaagga

SEQ ID NO: 2583508 - RNA, 13 nt, Human
gcugugagccuug

SEQ ID NO: 2583509 - RNA, 13 nt, Human
gcugugcugcccu

SEQ ID NO: 2583510 - RNA, 12 nt, Human
gcugugcugccc

SEQ ID NO: 2583511 - RNA, 21 nt, Human
gcugugcucuggacaggcaug

SEQ ID NO: 2583512 - RNA, 22 nt, Human
gcugugcugcccugcccaccug

SEQ ID NO: 2583513 - RNA, 19 nt, Human
gcugugcugcccugcccac

SEQ ID NO: 2583514 - RNA, 15 nt, Human
gcuguggaagcaaca

SEQ ID NO: 2583515 - RNA, 20 nt, Human
gcugugagccccugguccug

SEQ ID NO: 2583516 - RNA, 16 nt, Human
gcugugagccccuggu

SEQ ID NO: 2583517 - RNA, 18 nt, Human
gcuguugucccucugcua

SEQ ID NO: 2583518 - RNA, 17 nt, Human
gcuguugucccucugcu

SEQ ID NO: 2583519 - RNA, 14 nt, Human
gcuguuguacauuu

SEQ ID NO: 2583520 - RNA, 13 nt, Human
gcuguuguacauu

SEQ ID NO: 2583521 - RNA, 12 nt, Human
gcuguuguacau

SEQ ID NO: 2583522 - RNA, 16 nt, Human
gcuguuguacauuuau

SEQ ID NO: 2583523 - RNA, 15 nt, Human
gcuguuguacauuua

SEQ ID NO: 2583524 - RNA, 16 nt, Human
gcuguugucccucugc

SEQ ID NO: 2583525 - RNA, 22 nt, Human
gcuguuggcugggggccucagu

SEQ ID NO: 2583526 - RNA, 21 nt, Human
gcuguuggcugggggccucag

SEQ ID NO: 2583527 - RNA, 15 nt, Human
gcuggguucugaucc

SEQ ID NO: 2583528 - RNA, 15 nt, Human
gcuggguucuaccca

SEQ ID NO: 2583529 - RNA, 21 nt, Human
gcuggguuggaggguguccca

SEQ ID NO: 2583530 - RNA, 14 nt, Human
gcuggguuggaggg

SEQ ID NO: 2583531 - RNA, 22 nt, Human
gcuggguuggcgcacccucccc

SEQ ID NO: 2583532 - RNA, 21 nt, Human
gcuggguuggcgcacccuccc

SEQ ID NO: 2583533 - RNA, 17 nt, Human
gcuggguuggcgcaccc

SEQ ID NO: 2583534 - RNA, 14 nt, Human
gcuggguucugcac

SEQ ID NO: 2583535 - RNA, 22 nt, Human
gcugguuuuguaagaugcuggg

SEQ ID NO: 2583536 - RNA, 21 nt, Human
gcugguuuuguaagaugcugg

SEQ ID NO: 2583537 - RNA, 15 nt, Human
gcugguuuuucaguu

SEQ ID NO: 2583538 - RNA, 14 nt, Human
gcugguuuuucagu

SEQ ID NO: 2583539 - RNA, 16 nt, Human
gcuguaagaagagacu

SEQ ID NO: 2583540 - RNA, 20 nt, Human
gcuguaaaaugcaugauuuu

SEQ ID NO: 2583541 - RNA, 14 nt, Human
gcuguaaauaaaug

SEQ ID NO: 2583542 - RNA, 16 nt, Human
gcuguaaaaugcauga

SEQ ID NO: 2583543 - RNA, 14 nt, Human
gcuguaaaaucuug

SEQ ID NO: 2583544 - RNA, 15 nt, Human
gcuguaaauaaaugc

SEQ ID NO: 2583545 - RNA, 21 nt, Human
gcuguaaugaaacaccuucuc

SEQ ID NO: 2583546 - RNA, 16 nt, Human
gcuguacaaauauaag

SEQ ID NO: 2583547 - RNA, 16 nt, Human
gcuguacacugcacga

SEQ ID NO: 2583548 - RNA, 12 nt, Human
gcuguacacugc

SEQ ID NO: 2583549 - RNA, 22 nt, Human
gcuguaaucuaugaauucuaag

SEQ ID NO: 2583550 - RNA, 18 nt, Human
gcuguaaggcaugaagga

SEQ ID NO: 2583551 - RNA, 19 nt, Human
gcuguaaggcaugaaggau

SEQ ID NO: 2583552 - RNA, 17 nt, Human
gcuguaaggcaugaagg

SEQ ID NO: 2583553 - RNA, 24 nt, Human
gcuguaagaagagacugggaagau

SEQ ID NO: 2583554 - RNA, 23 nt, Human
gcuguaucccaugagccucagca

SEQ ID NO: 2583555 - RNA, 20 nt, Human
gcuguaucccaugagccuca

SEQ ID NO: 2583556 - RNA, 21 nt, Human
gcuguacaaauauaagaauaa

SEQ ID NO: 2583557 - RNA, 17 nt, Human
gcuguauuaagccacuu

SEQ ID NO: 2583558 - RNA, 16 nt, Human
gcuguaucuuguuuuu

SEQ ID NO: 2583559 - RNA, 18 nt, Human
gcuguaucuuguuuuucc

SEQ ID NO: 2583560 - RNA, 14 nt, Human
gcuguaucuuguuu

SEQ ID NO: 2583561 - RNA, 22 nt, Human
gcuuccuacccacaccucugcc

SEQ ID NO: 2583562 - RNA, 16 nt, Human
gcuuccggcuccugug

SEQ ID NO: 2583563 - RNA, 18 nt, Human
gcuuccggcuccugugcu

SEQ ID NO: 2583564 - RNA, 18 nt, Human
gcuuccuagaaguuacug

SEQ ID NO: 2583565 - RNA, 23 nt, Human
gcuuccuacccacaccucugcca

SEQ ID NO: 2583566 - RNA, 21 nt, Human
gcuuccuagaaguuacugaau

SEQ ID NO: 2583567 - RNA, 13 nt, Human
gcuuccuucauuu

SEQ ID NO: 2583568 - RNA, 14 nt, Human
gcuuccuucauuuc

SEQ ID NO: 2583569 - RNA, 17 nt, Human
gcuuccuucauuuccuc

SEQ ID NO: 2583570 - RNA, 22 nt, Human
gcuuccuucugugaaaguacau

SEQ ID NO: 2583571 - RNA, 14 nt, Human
gcuucccugacuca

SEQ ID NO: 2583572 - RNA, 18 nt, Human
gcuucccugacucauucu

SEQ ID NO: 2583573 - RNA, 14 nt, Human
gcuuccgcauccua

SEQ ID NO: 2583574 - RNA, 17 nt, Human
gcuucccucugccuguc

SEQ ID NO: 2583575 - RNA, 19 nt, Human
gcuucccucugccuguccc

SEQ ID NO: 2583576 - RNA, 20 nt, Human
gcuucccucugccugucccu

SEQ ID NO: 2583577 - RNA, 23 nt, Human
gcuucccucugccugucccucuc

SEQ ID NO: 2583578 - RNA, 18 nt, Human
gcuucccgcucagcccuc

SEQ ID NO: 2583579 - RNA, 17 nt, Human
gcuucccgcucagcccu

SEQ ID NO: 2583580 - RNA, 16 nt, Human
gcuucccgcucagccc

SEQ ID NO: 2583581 - RNA, 15 nt, Human
gcuucccgcucagcc

SEQ ID NO: 2583582 - RNA, 14 nt, Human
gcuucccuaaucua

SEQ ID NO: 2583583 - RNA, 12 nt, Human
gcuucccucugc

SEQ ID NO: 2583584 - RNA, 13 nt, Human
gcuucccucugcc

SEQ ID NO: 2583585 - RNA, 15 nt, Human
gcuucccucugccug

SEQ ID NO: 2583586 - RNA, 23 nt, Human
gcuucccgcucagcccucccugc

SEQ ID NO: 2583587 - RNA, 13 nt, Human
gcuucccuaaucu

SEQ ID NO: 2583588 - RNA, 18 nt, Human
gcuuccccucucuccucc

SEQ ID NO: 2583589 - RNA, 13 nt, Human
gcuucccauccua

SEQ ID NO: 2583590 - RNA, 12 nt, Human
gcuucccauccu

SEQ ID NO: 2583591 - RNA, 22 nt, Human
gcuucccaguggcugcugccca

SEQ ID NO: 2583592 - RNA, 21 nt, Human
gcuucccaguggcugcugccc

SEQ ID NO: 2583593 - RNA, 20 nt, Human
gcuucccaguggcugcugcc

SEQ ID NO: 2583594 - RNA, 19 nt, Human
gcuucccaguggcugcugc

SEQ ID NO: 2583595 - RNA, 18 nt, Human
gcuucccaguggcugcug

SEQ ID NO: 2583596 - RNA, 14 nt, Human
gcuuccccucucuc

SEQ ID NO: 2583597 - RNA, 16 nt, Human
gcuuccccucucuccu

SEQ ID NO: 2583598 - RNA, 16 nt, Human
gcuucccccauagcca

SEQ ID NO: 2583599 - RNA, 18 nt, Human
gcuucccccauagccacc

SEQ ID NO: 2583600 - RNA, 22 nt, Human
gcuucccauccuacccucgggc

SEQ ID NO: 2583601 - RNA, 17 nt, Human
gcuucccauccuacccu

SEQ ID NO: 2583602 - RNA, 19 nt, Human
gcuucccauuguggcuccu

SEQ ID NO: 2583603 - RNA, 14 nt, Human
gcuucccccauagc

SEQ ID NO: 2583604 - RNA, 15 nt, Human
gcuucccccauagcc

SEQ ID NO: 2583605 - RNA, 20 nt, Human
gcuuccauuugugugugugc

SEQ ID NO: 2583606 - RNA, 20 nt, Human
gcuuggggcucacacaccug

SEQ ID NO: 2583607 - RNA, 16 nt, Human
gcuuggggcucacaca

SEQ ID NO: 2583608 - RNA, 19 nt, Human
gcuugggcuucauccuccu

SEQ ID NO: 2583609 - RNA, 20 nt, Human
gcuugggcccagcugggcuc

SEQ ID NO: 2583610 - RNA, 19 nt, Human
gcuugggcccagcugggcu

SEQ ID NO: 2583611 - RNA, 18 nt, Human
gcuugggcccagcugggc

SEQ ID NO: 2583612 - RNA, 17 nt, Human
gcuugggcccagcuggg

SEQ ID NO: 2583613 - RNA, 15 nt, Human
gcuugggcccagcug

SEQ ID NO: 2583614 - RNA, 14 nt, Human
gcuugggcccagcu

SEQ ID NO: 2583615 - RNA, 19 nt, Human
gcuugggaccgccagaugg

SEQ ID NO: 2583616 - RNA, 14 nt, Human
gcuugggacaaauc

SEQ ID NO: 2583617 - RNA, 14 nt, Human
gcuuguacauaaug

SEQ ID NO: 2583618 - RNA, 16 nt, Human
gcuuguacauaaugcg

SEQ ID NO: 2583619 - RNA, 14 nt, Human
gcuuggguggagaa

SEQ ID NO: 2583620 - RNA, 13 nt, Human
gcuuggguggaga

SEQ ID NO: 2583621 - RNA, 16 nt, Human
gcuuggggcuuccuaa

SEQ ID NO: 2583622 - RNA, 24 nt, Human
gcuugggggaugacuagaggcagg

SEQ ID NO: 2583623 - RNA, 19 nt, Human
gcuuggguggagaagccau

SEQ ID NO: 2583624 - RNA, 18 nt, Human
gcuuggguggagaagcca

SEQ ID NO: 2583625 - RNA, 17 nt, Human
gcuuggguggagaagcc

SEQ ID NO: 2583626 - RNA, 16 nt, Human
gcuuggguggagaagc

SEQ ID NO: 2583627 - RNA, 21 nt, Human
gcuuggguggagaagccauug

SEQ ID NO: 2583628 - RNA, 20 nt, Human
gcuuggguggagaagccauu

SEQ ID NO: 2583629 - RNA, 19 nt, Human
gcuuggguguaacaggucu

SEQ ID NO: 2583630 - RNA, 21 nt, Human
gcuuggguguaacaggucucc

SEQ ID NO: 2583631 - RNA, 21 nt, Human
gcuucuugccucugugcugug

SEQ ID NO: 2583632 - RNA, 20 nt, Human
gcuucuugccucugugcugu

SEQ ID NO: 2583633 - RNA, 18 nt, Human
gcuucgggcccuucccac

SEQ ID NO: 2583634 - RNA, 20 nt, Human
gcuucgggcccuucccacag

SEQ ID NO: 2583635 - RNA, 19 nt, Human
gcuucuugccucugugcug

SEQ ID NO: 2583636 - RNA, 19 nt, Human
gcuucgaggcccagcgacc

SEQ ID NO: 2583637 - RNA, 21 nt, Human
gcuucgaggcccagcgaccuc

SEQ ID NO: 2583638 - RNA, 12 nt, Human
gcuuccuuucuu

SEQ ID NO: 2583639 - RNA, 23 nt, Human
gcuuccuuuguuuuuuuuuccug

SEQ ID NO: 2583640 - RNA, 22 nt, Human
gcuuccuuggcaucacagggca

SEQ ID NO: 2583641 - RNA, 22 nt, Human
gcuuccuuuguuuuuuuuuccu

SEQ ID NO: 2583642 - RNA, 16 nt, Human
gcuuggccugcuguga

SEQ ID NO: 2583643 - RNA, 15 nt, Human
gcuuggccugcugug

SEQ ID NO: 2583644 - RNA, 14 nt, Human
gcuuggcugcuugg

SEQ ID NO: 2583645 - RNA, 19 nt, Human
gcuugaaacccguggcgcu

SEQ ID NO: 2583646 - RNA, 14 nt, Human
gcuuggccugcugu

SEQ ID NO: 2583647 - RNA, 17 nt, Human
gcuugaaaaaugugcaa

SEQ ID NO: 2583648 - RNA, 23 nt, Human
gcuucuuuuaguuguaucucuuu

SEQ ID NO: 2583649 - RNA, 18 nt, Human
gcuucuuucuuugggaau

SEQ ID NO: 2583650 - RNA, 12 nt, Human
gcuucuuucuuu

SEQ ID NO: 2583651 - RNA, 23 nt, Human
gcuucuuucuuugggaauauuug

SEQ ID NO: 2583652 - RNA, 16 nt, Human
gcuucuuucauuuucu

SEQ ID NO: 2583653 - RNA, 17 nt, Human
gcugcugcccccacccc

SEQ ID NO: 2583654 - RNA, 15 nt, Human
gcugcugcccaggcc

SEQ ID NO: 2583655 - RNA, 13 nt, Human
gcugcugcccagg

SEQ ID NO: 2583656 - RNA, 12 nt, Human
gcugcugcccag

SEQ ID NO: 2583657 - RNA, 21 nt, Human
gcugcugcguggcauagccca

SEQ ID NO: 2583658 - RNA, 12 nt, Human
gcugcugcugcu

SEQ ID NO: 2583659 - RNA, 15 nt, Human
gcugcugcugcgccc

SEQ ID NO: 2583660 - RNA, 20 nt, Human
gcugcugcuaaucuucaggg

SEQ ID NO: 2583661 - RNA, 17 nt, Human
gcugcugcgcccugggc

SEQ ID NO: 2583662 - RNA, 12 nt, Human
gcugcugcgccc

SEQ ID NO: 2583663 - RNA, 13 nt, Human
gcugcugcccugc

SEQ ID NO: 2583664 - RNA, 23 nt, Human
gcugcugccuuuagucgcugagg

SEQ ID NO: 2583665 - RNA, 23 nt, Human
gcugcucuauuguagcauuucuu

SEQ ID NO: 2583666 - RNA, 22 nt, Human
gcugcucugaauuaguccuugc

SEQ ID NO: 2583667 - RNA, 17 nt, Human
gcugcuccuuccuucac

SEQ ID NO: 2583668 - RNA, 13 nt, Human
gcugcuccucaug

SEQ ID NO: 2583669 - RNA, 11 nt, Human
gcugcuccucc

SEQ ID NO: 2583670 - RNA, 12 nt, Human
gcugcuccucca

SEQ ID NO: 2583671 - RNA, 14 nt, Human
gcugcuccuccagg

SEQ ID NO: 2583672 - RNA, 15 nt, Human
gcugcuccuccaggg

SEQ ID NO: 2583673 - RNA, 18 nt, Human
gcugcuccuccagggcca

SEQ ID NO: 2583674 - RNA, 23 nt, Human
gcugcuccuccagggccacgugc

SEQ ID NO: 2583675 - RNA, 18 nt, Human
gcugccugggaucccuca

SEQ ID NO: 2583676 - RNA, 16 nt, Human
gcugccugggaucccu

SEQ ID NO: 2583677 - RNA, 19 nt, Human
gcugccugggaucccucau

SEQ ID NO: 2583678 - RNA, 23 nt, Human
gcugcuccuagagggaggggccu

SEQ ID NO: 2583679 - RNA, 21 nt, Human
gcugcuccuagagggaggggc

SEQ ID NO: 2583680 - RNA, 22 nt, Human
gcugccuggcccccagcugugg

SEQ ID NO: 2583681 - RNA, 19 nt, Human
gcugcuccuagagggaggg

SEQ ID NO: 2583682 - RNA, 21 nt, Human
gcugccuggcccccagcugug

SEQ ID NO: 2583683 - RNA, 14 nt, Human
gcugccugcccaca

SEQ ID NO: 2583684 - RNA, 15 nt, Human
gcugccugcccacac

SEQ ID NO: 2583685 - RNA, 18 nt, Human
gcugccugcccacacagg

SEQ ID NO: 2583686 - RNA, 13 nt, Human
gcugccugggauc

SEQ ID NO: 2583687 - RNA, 21 nt, Human
gcugccugcuuuucacugcug

SEQ ID NO: 2583688 - RNA, 19 nt, Human
gcugccuggcccccagcug

SEQ ID NO: 2583689 - RNA, 17 nt, Human
gcugccugcccacacag

SEQ ID NO: 2583690 - RNA, 13 nt, Human
gcugccugcccgu

SEQ ID NO: 2583691 - RNA, 22 nt, Human
gcugccugcccguaaacacgcc

SEQ ID NO: 2583692 - RNA, 22 nt, Human
gcugccugccgguaaacacgcc

SEQ ID NO: 2583693 - RNA, 22 nt, Human
gcugccugcgcccaccccgcuc

SEQ ID NO: 2583694 - RNA, 21 nt, Human
gcugccugcgcccaccccgcu

SEQ ID NO: 2583695 - RNA, 16 nt, Human
gcugccugccugucug

SEQ ID NO: 2583696 - RNA, 15 nt, Human
gcugccugccugucu

SEQ ID NO: 2583697 - RNA, 14 nt, Human
gcugccugccuguc

SEQ ID NO: 2583698 - RNA, 13 nt, Human
gcugccugccugu

SEQ ID NO: 2583699 - RNA, 11 nt, Human
gcugccugccu

SEQ ID NO: 2583700 - RNA, 18 nt, Human
gcugccuaaguggcugcu

SEQ ID NO: 2583701 - RNA, 17 nt, Human
gcugccgccccacccag

SEQ ID NO: 2583702 - RNA, 22 nt, Human
gcugccguggggccgccgccuc

SEQ ID NO: 2583703 - RNA, 13 nt, Human
gcugccguggggc

SEQ ID NO: 2583704 - RNA, 17 nt, Human
gcugccuaaguggcugc

SEQ ID NO: 2583705 - RNA, 16 nt, Human
gcugccuaaguggcug

SEQ ID NO: 2583706 - RNA, 15 nt, Human
gcugccgcaccccag

SEQ ID NO: 2583707 - RNA, 18 nt, Human
gcugccgcaccccagagu

SEQ ID NO: 2583708 - RNA, 22 nt, Human
gcugccgcaccccagagugugg

SEQ ID NO: 2583709 - RNA, 13 nt, Human
gcugccgccuccc

SEQ ID NO: 2583710 - RNA, 15 nt, Human
gcugccgccucccag

SEQ ID NO: 2583711 - RNA, 16 nt, Human
gcugccgccucccagc

SEQ ID NO: 2583712 - RNA, 18 nt, Human
gcugccgccucccagccu

SEQ ID NO: 2583713 - RNA, 19 nt, Human
gcugccgccucccagccug

SEQ ID NO: 2583714 - RNA, 20 nt, Human
gcugccgccucccagccugg

SEQ ID NO: 2583715 - RNA, 12 nt, Human
gcugccccagcc

SEQ ID NO: 2583716 - RNA, 19 nt, Human
gcugccccacagguguguu

SEQ ID NO: 2583717 - RNA, 20 nt, Human
gcugccccaaccugcugaag

SEQ ID NO: 2583718 - RNA, 18 nt, Human
gcugccccaaccugcuga

SEQ ID NO: 2583719 - RNA, 17 nt, Human
gcugccccaaccugcug

SEQ ID NO: 2583720 - RNA, 16 nt, Human
gcugccccaaccugcu

SEQ ID NO: 2583721 - RNA, 14 nt, Human
gcugccccaaccug

SEQ ID NO: 2583722 - RNA, 18 nt, Human
gcugcccaggggagcccu

SEQ ID NO: 2583723 - RNA, 16 nt, Human
gcugccccagccagau

SEQ ID NO: 2583724 - RNA, 14 nt, Human
gcugccccagccag

SEQ ID NO: 2583725 - RNA, 18 nt, Human
gcugccccaucagugcuc

SEQ ID NO: 2583726 - RNA, 23 nt, Human
gcugccccauuuauccaccucca

SEQ ID NO: 2583727 - RNA, 14 nt, Human
gcugccgcacccca

SEQ ID NO: 2583728 - RNA, 19 nt, Human
gcugcccaggggagcccuc

SEQ ID NO: 2583729 - RNA, 14 nt, Human
gcugcccaggccca

SEQ ID NO: 2583730 - RNA, 12 nt, Human
gcugcccaggcc

SEQ ID NO: 2583731 - RNA, 17 nt, Human
gcugcccagaguugcug

SEQ ID NO: 2583732 - RNA, 14 nt, Human
gcugcccagaguug

SEQ ID NO: 2583733 - RNA, 13 nt, Human
gcugccaugugaa

SEQ ID NO: 2583734 - RNA, 21 nt, Human
gcugccaugugaagagggaga

SEQ ID NO: 2583735 - RNA, 17 nt, Human
gcugccaugugaagagg

SEQ ID NO: 2583736 - RNA, 17 nt, Human
gcugcccacacacccca

SEQ ID NO: 2583737 - RNA, 23 nt, Human
gcugccauccagguucagcuugu

SEQ ID NO: 2583738 - RNA, 23 nt, Human
gcugccauggcgugucccucucg

SEQ ID NO: 2583739 - RNA, 22 nt, Human
gcugccauggcgugucccucuc

SEQ ID NO: 2583740 - RNA, 17 nt, Human
gcugccagcucuguauc

SEQ ID NO: 2583741 - RNA, 18 nt, Human
gcugccagcucuguauca

SEQ ID NO: 2583742 - RNA, 21 nt, Human
gcugccauccagguucagcuu

SEQ ID NO: 2583743 - RNA, 21 nt, Human
gcugccagccgagauagccaa

SEQ ID NO: 2583744 - RNA, 19 nt, Human
gcugccagccgagauagcc

SEQ ID NO: 2583745 - RNA, 19 nt, Human
gcugcacucugugcccaug

SEQ ID NO: 2583746 - RNA, 18 nt, Human
gcugcacucugugcccau

SEQ ID NO: 2583747 - RNA, 14 nt, Human
gcugccacuuuuua

SEQ ID NO: 2583748 - RNA, 12 nt, Human
gcugccagagaa

SEQ ID NO: 2583749 - RNA, 17 nt, Human
gcugcacucugugccca

SEQ ID NO: 2583750 - RNA, 16 nt, Human
gcugcacucugugccc

SEQ ID NO: 2583751 - RNA, 15 nt, Human
gcugcacucugugcc

SEQ ID NO: 2583752 - RNA, 14 nt, Human
gcugcacucugugc

SEQ ID NO: 2583753 - RNA, 21 nt, Human
gcugcaccugccagccuggcu

SEQ ID NO: 2583754 - RNA, 22 nt, Human
gcugcaccugccagccuggcuu

SEQ ID NO: 2583755 - RNA, 19 nt, Human
gcugcaccggcuggccugg

SEQ ID NO: 2583756 - RNA, 18 nt, Human
gcugcaccggcuggccug

SEQ ID NO: 2583757 - RNA, 22 nt, Human
gcugcaccggcuggccuggccc

SEQ ID NO: 2583758 - RNA, 17 nt, Human
gcugcaccugccagccu

SEQ ID NO: 2583759 - RNA, 18 nt, Human
gcugcaccugccagccug

SEQ ID NO: 2583760 - RNA, 19 nt, Human
gcugcaccugccagccugg

SEQ ID NO: 2583761 - RNA, 20 nt, Human
gcugcaccugccagccuggc

SEQ ID NO: 2583762 - RNA, 17 nt, Human
gcugcaccggcuggccu

SEQ ID NO: 2583763 - RNA, 16 nt, Human
gcugcaccggcuggcc

SEQ ID NO: 2583764 - RNA, 14 nt, Human
gcugcaccggcugg

SEQ ID NO: 2583765 - RNA, 15 nt, Human
gcugaggcuggcaca

SEQ ID NO: 2583766 - RNA, 16 nt, Human
gcugaggcuggcacag

SEQ ID NO: 2583767 - RNA, 18 nt, Human
gcugaggcuggcacagga

SEQ ID NO: 2583768 - RNA, 15 nt, Human
gcugagggaccagcc

SEQ ID NO: 2583769 - RNA, 23 nt, Human
gcugagggauggacugaugcuuu

SEQ ID NO: 2583770 - RNA, 22 nt, Human
gcugagggauggacugaugcuu

SEQ ID NO: 2583771 - RNA, 21 nt, Human
gcugagggauggacugaugcu

SEQ ID NO: 2583772 - RNA, 14 nt, Human
gcugagggagccug

SEQ ID NO: 2583773 - RNA, 16 nt, Human
gcugaggaggccucca

SEQ ID NO: 2583774 - RNA, 13 nt, Human
gcugaggcuggca

SEQ ID NO: 2583775 - RNA, 16 nt, Human
gcugagggaccagcca

SEQ ID NO: 2583776 - RNA, 12 nt, Human
gcugaggaaagg

SEQ ID NO: 2583777 - RNA, 15 nt, Human
gcugaggaaaggcca

SEQ ID NO: 2583778 - RNA, 16 nt, Human
gcugaggaaaggccag

SEQ ID NO: 2583779 - RNA, 14 nt, Human
gcugaggaggccuc

SEQ ID NO: 2583780 - RNA, 17 nt, Human
gcugaggaaaggccagc

SEQ ID NO: 2583781 - RNA, 21 nt, Human
gcugaggaaaggccagcuggc

SEQ ID NO: 2583782 - RNA, 22 nt, Human
gcugaggaaaggccagcuggca

SEQ ID NO: 2583783 - RNA, 23 nt, Human
gcugaggaaaggccagcuggcag

SEQ ID NO: 2583784 - RNA, 23 nt, Human
gcugaggggggccgugcccaggg

SEQ ID NO: 2583785 - RNA, 22 nt, Human
gcugaggggaggaucacuggag

SEQ ID NO: 2583786 - RNA, 21 nt, Human
gcugaggggggccgugcccag

SEQ ID NO: 2583787 - RNA, 12 nt, Human
gcuggagugcag

SEQ ID NO: 2583788 - RNA, 12 nt, Human
gcuggagugagg

SEQ ID NO: 2583789 - RNA, 17 nt, Human
gcuggagcucugcccau

SEQ ID NO: 2583790 - RNA, 23 nt, Human
gcuggaggacuagaaccuggagg

SEQ ID NO: 2583791 - RNA, 21 nt, Human
gcuggaggacuagaaccugga

SEQ ID NO: 2583792 - RNA, 12 nt, Human
gcuggagcuggc

SEQ ID NO: 2583793 - RNA, 22 nt, Human
gcuggagcuggcgucugucuuc

SEQ ID NO: 2583794 - RNA, 19 nt, Human
gcuggacugaggccugagc

SEQ ID NO: 2583795 - RNA, 18 nt, Human
gcuggacugaggccugag

SEQ ID NO: 2583796 - RNA, 17 nt, Human
gcuggacugaggccuga

SEQ ID NO: 2583797 - RNA, 16 nt, Human
gcuggacugaggccug

SEQ ID NO: 2583798 - RNA, 14 nt, Human
gcuggagcucugcc

SEQ ID NO: 2583799 - RNA, 21 nt, Human
gcuggacucucagucucugag

SEQ ID NO: 2583800 - RNA, 22 nt, Human
gcuggacucucagucucugagc

SEQ ID NO: 2583801 - RNA, 14 nt, Human
gcuggacugaggcc

SEQ ID NO: 2583802 - RNA, 13 nt, Human
gcuggacugaggc

SEQ ID NO: 2583803 - RNA, 21 nt, Human
gcuggacggggacuggggaug

SEQ ID NO: 2583804 - RNA, 19 nt, Human
gcuggacggggacugggga

SEQ ID NO: 2583805 - RNA, 14 nt, Human
gcuggacuacccac

SEQ ID NO: 2583806 - RNA, 16 nt, Human
gcuggacggcauuccu

SEQ ID NO: 2583807 - RNA, 20 nt, Human
gcugggcucccuucccaccu

SEQ ID NO: 2583808 - RNA, 17 nt, Human
gcugggcucccuuccca

SEQ ID NO: 2583809 - RNA, 16 nt, Human
gcugggcucccuuccc

SEQ ID NO: 2583810 - RNA, 12 nt, Human
gcugggcucccu

SEQ ID NO: 2583811 - RNA, 17 nt, Human
gcugggcagaggaaagc

SEQ ID NO: 2583812 - RNA, 16 nt, Human
gcugggcagaggaaag

SEQ ID NO: 2583813 - RNA, 19 nt, Human
gcugggcagaggaaagcaa

SEQ ID NO: 2583814 - RNA, 13 nt, Human
gcugggcagcuac

SEQ ID NO: 2583815 - RNA, 12 nt, Human
gcugggcagcua

SEQ ID NO: 2583816 - RNA, 13 nt, Human
gcugggcagcugu

SEQ ID NO: 2583817 - RNA, 12 nt, Human
gcugggcagcug

SEQ ID NO: 2583818 - RNA, 22 nt, Human
gcuggguggcccauccccccuc

SEQ ID NO: 2583819 - RNA, 21 nt, Human
gcuggguggcccauccccccu

SEQ ID NO: 2583820 - RNA, 20 nt, Human
gcuggguggcccaucccccc

SEQ ID NO: 2583821 - RNA, 16 nt, Human
gcuggguggcccaucc

SEQ ID NO: 2583822 - RNA, 16 nt, Human
gcuggguucauuugug

SEQ ID NO: 2583823 - RNA, 17 nt, Human
gcugggugguacccucu

SEQ ID NO: 2583824 - RNA, 15 nt, Human
gcuggguguggcgca

SEQ ID NO: 2583825 - RNA, 19 nt, Human
gcugggucgcccuggacug

SEQ ID NO: 2583826 - RNA, 14 nt, Human
gcuggguggcccau

SEQ ID NO: 2583827 - RNA, 13 nt, Human
gcuggguggccca

SEQ ID NO: 2583828 - RNA, 17 nt, Human
gcuggguggcacugcca

SEQ ID NO: 2583829 - RNA, 15 nt, Human
gcuggguggcacugc

SEQ ID NO: 2583830 - RNA, 14 nt, Human
gcuggguggcacug

SEQ ID NO: 2583831 - RNA, 18 nt, Human
gcugggucgcccuggacu

SEQ ID NO: 2583832 - RNA, 17 nt, Human
gcugggucgcccuggac

SEQ ID NO: 2583833 - RNA, 16 nt, Human
gcugggucgcccugga

SEQ ID NO: 2583834 - RNA, 14 nt, Human
gcugggcagcuguu

SEQ ID NO: 2583835 - RNA, 19 nt, Human
gcuggccuggccccucagg

SEQ ID NO: 2583836 - RNA, 18 nt, Human
gcuggccuggccccucag

SEQ ID NO: 2583837 - RNA, 22 nt, Human
gcugggauuacaggcuccugcc

SEQ ID NO: 2583838 - RNA, 23 nt, Human
gcugggauuacaggcuccugcca

SEQ ID NO: 2583839 - RNA, 16 nt, Human
gcugggauuacaggug

SEQ ID NO: 2583840 - RNA, 17 nt, Human
gcuggccuggccccuca

SEQ ID NO: 2583841 - RNA, 16 nt, Human
gcuggccuggccccuc

SEQ ID NO: 2583842 - RNA, 15 nt, Human
gcuggagugcaguga

SEQ ID NO: 2583843 - RNA, 14 nt, Human
gcuggagugcagug

SEQ ID NO: 2583844 - RNA, 15 nt, Human
gcugggcagaggaaa

SEQ ID NO: 2583845 - RNA, 14 nt, Human
gcugggcagaggaa

SEQ ID NO: 2583846 - RNA, 13 nt, Human
gcugggcagagga

SEQ ID NO: 2583847 - RNA, 19 nt, Human
gcugggcagaaggccaaga

SEQ ID NO: 2583848 - RNA, 13 nt, Human
gcugggcagaagg

SEQ ID NO: 2583849 - RNA, 18 nt, Human
gcugggauuacaggugug

SEQ ID NO: 2583850 - RNA, 17 nt, Human
gcugggauuacaggugu

SEQ ID NO: 2583851 - RNA, 17 nt, Human
gcugggauuacagggau

SEQ ID NO: 2583852 - RNA, 19 nt, Human
gcugggauuacagguguga

SEQ ID NO: 2583853 - RNA, 22 nt, Human
gcugggcacacgccucccacug

SEQ ID NO: 2583854 - RNA, 20 nt, Human
gcugggcacacgccucccac

SEQ ID NO: 2583855 - RNA, 21 nt, Human
gcugggauuacaggcuccugc

SEQ ID NO: 2583856 - RNA, 22 nt, Human
gcucagguggggucacucuggc

SEQ ID NO: 2583857 - RNA, 21 nt, Human
gcucagguggggucacucugg

SEQ ID NO: 2583858 - RNA, 19 nt, Human
gcucaggucccuggggcua

SEQ ID NO: 2583859 - RNA, 18 nt, Human
gcucaggagcccugggag

SEQ ID NO: 2583860 - RNA, 15 nt, Human
gcucaggagcccugg

SEQ ID NO: 2583861 - RNA, 12 nt, Human
gcucagggccug

SEQ ID NO: 2583862 - RNA, 17 nt, Human
gcucaggacucagaagc

SEQ ID NO: 2583863 - RNA, 18 nt, Human
gcucaggacucagaagcc

SEQ ID NO: 2583864 - RNA, 21 nt, Human
gcucaggagcccugggaggcu

SEQ ID NO: 2583865 - RNA, 16 nt, Human
gcucagggccuggcuc

SEQ ID NO: 2583866 - RNA, 13 nt, Human
gcucagggccugg

SEQ ID NO: 2583867 - RNA, 23 nt, Human
gcucagggccaugcugaggccug

SEQ ID NO: 2583868 - RNA, 19 nt, Human
gcucaggacucagaagccu

SEQ ID NO: 2583869 - RNA, 17 nt, Human
gcucagggccuggcuca

SEQ ID NO: 2583870 - RNA, 15 nt, Human
gcucaggucccuggg

SEQ ID NO: 2583871 - RNA, 20 nt, Human
gcucaggggcguguggcuca

SEQ ID NO: 2583872 - RNA, 18 nt, Human
gcucaggggcguguggcu

SEQ ID NO: 2583873 - RNA, 20 nt, Human
gcucagagagggugggagug

SEQ ID NO: 2583874 - RNA, 18 nt, Human
gcucagagagggugggag

SEQ ID NO: 2583875 - RNA, 22 nt, Human
gcucagagagggugggaguggg

SEQ ID NO: 2583876 - RNA, 14 nt, Human
gcucaggagcccug

SEQ ID NO: 2583877 - RNA, 15 nt, Human
gcucagagagggugg

SEQ ID NO: 2583878 - RNA, 16 nt, Human
gcucacuaugaaucua

SEQ ID NO: 2583879 - RNA, 14 nt, Human
gcucacuaugaauc

SEQ ID NO: 2583880 - RNA, 21 nt, Human
gcucacuaccuccucagggau

SEQ ID NO: 2583881 - RNA, 18 nt, Human
gcucacuaccuccucagg

SEQ ID NO: 2583882 - RNA, 13 nt, Human
gcucacgugugug

SEQ ID NO: 2583883 - RNA, 15 nt, Human
gcucacgugugugac

SEQ ID NO: 2583884 - RNA, 16 nt, Human
gcucacuaccuccuca

SEQ ID NO: 2583885 - RNA, 17 nt, Human
gcucacgugugugacuc

SEQ ID NO: 2583886 - RNA, 22 nt, Human
gcucacgugagagugucuucac

SEQ ID NO: 2583887 - RNA, 14 nt, Human
gcucacgucacacu

SEQ ID NO: 2583888 - RNA, 15 nt, Human
gcucacgucacacuu

SEQ ID NO: 2583889 - RNA, 23 nt, Human
gcucaccuguugcuuacaauuuu

SEQ ID NO: 2583890 - RNA, 21 nt, Human
gcucacgccuguaaucccagc

SEQ ID NO: 2583891 - RNA, 23 nt, Human
gcucacgccuguaaucccagcac

SEQ ID NO: 2583892 - RNA, 22 nt, Human
gcucacgccuguaaucccagca

SEQ ID NO: 2583893 - RNA, 21 nt, Human
gcucacgccuaugaucccagc

SEQ ID NO: 2583894 - RNA, 22 nt, Human
gcucacgccuaugaucccagca

SEQ ID NO: 2583895 - RNA, 22 nt, Human
gcucaccuguugcuuacaauuu

SEQ ID NO: 2583896 - RNA, 21 nt, Human
gcucaccuguugcuuacaauu

SEQ ID NO: 2583897 - RNA, 22 nt, Human
gccuguucaguuacagaaagug

SEQ ID NO: 2583898 - RNA, 21 nt, Human
gccuguucaguuacagaaagu

SEQ ID NO: 2583899 - RNA, 20 nt, Human
gccuguucaguuacagaaag

SEQ ID NO: 2583900 - RNA, 19 nt, Human
gccuguucaguuacagaaa

SEQ ID NO: 2583901 - RNA, 16 nt, Human
gccuguucaguuacag

SEQ ID NO: 2583902 - RNA, 15 nt, Human
gccuguucaguuaca

SEQ ID NO: 2583903 - RNA, 13 nt, Human
gccuguucaguua

SEQ ID NO: 2583904 - RNA, 12 nt, Human
gccuguucaguu

SEQ ID NO: 2583905 - RNA, 24 nt, Human
gccuguucaguuacagaaaguggu

SEQ ID NO: 2583906 - RNA, 19 nt, Human
gccuguucagcuccagcuc

SEQ ID NO: 2583907 - RNA, 22 nt, Human
gccuguuagacucuuacuuuuu

SEQ ID NO: 2583908 - RNA, 22 nt, Human
gccugugugacaucaguggcau

SEQ ID NO: 2583909 - RNA, 20 nt, Human
gccuguucagcuccagcuca

SEQ ID NO: 2583910 - RNA, 11 nt, Human
gccuguucagu

SEQ ID NO: 2583911 - RNA, 19 nt, Human
gccuguuauaacucugcac

SEQ ID NO: 2583912 - RNA, 18 nt, Human
gcuaggaacacuccuuca

SEQ ID NO: 2583913 - RNA, 21 nt, Human
gcuaggaacacuccuucacag

SEQ ID NO: 2583914 - RNA, 19 nt, Human
gcuaggaacacuccuucac

SEQ ID NO: 2583915 - RNA, 20 nt, Human
gcuauugucaccagggcugg

SEQ ID NO: 2583916 - RNA, 21 nt, Human
gcuauugucaccagggcugga

SEQ ID NO: 2583917 - RNA, 14 nt, Human
gcuauuuaaaacuu

SEQ ID NO: 2583918 - RNA, 22 nt, Human
gcuauuuaaaaaaaaaagagga

SEQ ID NO: 2583919 - RNA, 22 nt, Human
gcuauuguuucuuuaagaaagu

SEQ ID NO: 2583920 - RNA, 16 nt, Human
gcuauuguaaauaugu

SEQ ID NO: 2583921 - RNA, 13 nt, Human
gcuauuguaaaua

SEQ ID NO: 2583922 - RNA, 13 nt, Human
gcuauuuaaaacu

SEQ ID NO: 2583923 - RNA, 14 nt, Human
gcuauuucaucuau

SEQ ID NO: 2583924 - RNA, 15 nt, Human
gcuauuucaucuauu

SEQ ID NO: 2583925 - RNA, 17 nt, Human
gcuauuuccauuccaga

SEQ ID NO: 2583926 - RNA, 11 nt, Human
gcucaccuggg

SEQ ID NO: 2583927 - RNA, 12 nt, Human
gcucaccugggg

SEQ ID NO: 2583928 - RNA, 13 nt, Human
gcucaccuggggu

SEQ ID NO: 2583929 - RNA, 20 nt, Human
gcucaccuguugcuuacaau

SEQ ID NO: 2583930 - RNA, 19 nt, Human
gcucaccuguugcuuacaa

SEQ ID NO: 2583931 - RNA, 15 nt, Human
gcucaccuguugcuu

SEQ ID NO: 2583932 - RNA, 22 nt, Human
gcucaccuggggugugggaggc

SEQ ID NO: 2583933 - RNA, 16 nt, Human
gcuauugucaccaggg

SEQ ID NO: 2583934 - RNA, 11 nt, Human
gcuaugugacu

SEQ ID NO: 2583935 - RNA, 22 nt, Human
gcuauggugagaugcagcugga

SEQ ID NO: 2583936 - RNA, 22 nt, Human
gcuauguauggaauacaguguu

SEQ ID NO: 2583937 - RNA, 21 nt, Human
gcuauggggauagaugugugg

SEQ ID NO: 2583938 - RNA, 16 nt, Human
gcuauggugagaugca

SEQ ID NO: 2583939 - RNA, 15 nt, Human
gcuauggugagaugc

SEQ ID NO: 2583940 - RNA, 14 nt, Human
gcuauggugagaug

SEQ ID NO: 2583941 - RNA, 18 nt, Human
gcuauggggagaaaagac

SEQ ID NO: 2583942 - RNA, 19 nt, Human
gcuauggggauagaugugu

SEQ ID NO: 2583943 - RNA, 19 nt, Human
gcuaugggagccccagggu

SEQ ID NO: 2583944 - RNA, 21 nt, Human
gcuaugggagccccagggucu

SEQ ID NO: 2583945 - RNA, 15 nt, Human
gcuaggccuggccag

SEQ ID NO: 2583946 - RNA, 14 nt, Human
gcuaggccuggcca

SEQ ID NO: 2583947 - RNA, 21 nt, Human
gcuaguaauuggaaaggcagc

SEQ ID NO: 2583948 - RNA, 16 nt, Human
gcuaguaucaaaagaa

SEQ ID NO: 2583949 - RNA, 18 nt, Human
gcuaggcauacaaguagg

SEQ ID NO: 2583950 - RNA, 18 nt, Human
gcuagucaagcuccuccu

SEQ ID NO: 2583951 - RNA, 19 nt, Human
gcuagucaagcuccuccuc

SEQ ID NO: 2583952 - RNA, 16 nt, Human
gcuagucaagcuccuc

SEQ ID NO: 2583953 - RNA, 21 nt, Human
gcuagucaagcuccuccuccc

SEQ ID NO: 2583954 - RNA, 18 nt, Human
gcuaugggagccccaggg

SEQ ID NO: 2583955 - RNA, 17 nt, Human
gcucuacaucuucugcc

SEQ ID NO: 2583956 - RNA, 18 nt, Human
gcucucagcucagcgcca

SEQ ID NO: 2583957 - RNA, 16 nt, Human
gcucuacaucuucugc

SEQ ID NO: 2583958 - RNA, 16 nt, Human
gcucucaggccagcug

SEQ ID NO: 2583959 - RNA, 15 nt, Human
gcucucaggccagcu

SEQ ID NO: 2583960 - RNA, 14 nt, Human
gcucucaggccagc

SEQ ID NO: 2583961 - RNA, 13 nt, Human
gcucucaggccag

SEQ ID NO: 2583962 - RNA, 22 nt, Human
gcucuacagcuaaucagcauuc

SEQ ID NO: 2583963 - RNA, 20 nt, Human
gcucuacagcuaaucagcau

SEQ ID NO: 2583964 - RNA, 21 nt, Human
gcucccaggcauuccccagga

SEQ ID NO: 2583965 - RNA, 20 nt, Human
gcucccaggcauuccccagg

SEQ ID NO: 2583966 - RNA, 22 nt, Human
gcuccccgccuguucccccgcc

SEQ ID NO: 2583967 - RNA, 12 nt, Human
gcuccccuccaa

SEQ ID NO: 2583968 - RNA, 20 nt, Human
gcuccccgccuguucccccg

SEQ ID NO: 2583969 - RNA, 17 nt, Human
gcuccccgccuguuccc

SEQ ID NO: 2583970 - RNA, 14 nt, Human
gcucccccuguccc

SEQ ID NO: 2583971 - RNA, 13 nt, Human
gcucccccugucc

SEQ ID NO: 2583972 - RNA, 12 nt, Human
gcucccccuguc

SEQ ID NO: 2583973 - RNA, 19 nt, Human
gcuccccagcccuggcucu

SEQ ID NO: 2583974 - RNA, 18 nt, Human
gcucccccuguccccuca

SEQ ID NO: 2583975 - RNA, 16 nt, Human
gcuccccgccuguucc

SEQ ID NO: 2583976 - RNA, 14 nt, Human
gcuccccagcccca

SEQ ID NO: 2583977 - RNA, 20 nt, Human
gcuccccagcccuggcucug

SEQ ID NO: 2583978 - RNA, 18 nt, Human
gcuccccagcccuggcuc

SEQ ID NO: 2583979 - RNA, 16 nt, Human
gcuccccagcccuggc

SEQ ID NO: 2583980 - RNA, 15 nt, Human
gcuccccagcccugg

SEQ ID NO: 2583981 - RNA, 14 nt, Human
gcuccccagcccug

SEQ ID NO: 2583982 - RNA, 15 nt, Human
gcuccccagcccagg

SEQ ID NO: 2583983 - RNA, 16 nt, Human
gcuccccagcccaggg

SEQ ID NO: 2583984 - RNA, 18 nt, Human
gcucccauuucuacucuc

SEQ ID NO: 2583985 - RNA, 17 nt, Human
gcucccauuucuacucu

SEQ ID NO: 2583986 - RNA, 19 nt, Human
gcuccccacugccuacugc

SEQ ID NO: 2583987 - RNA, 20 nt, Human
gcuccccacugccuacugca

SEQ ID NO: 2583988 - RNA, 13 nt, Human
gcuccccagccca

SEQ ID NO: 2583989 - RNA, 14 nt, Human
gcuccccagcccag

SEQ ID NO: 2583990 - RNA, 22 nt, Human
gcucccaggcauuccccaggag

SEQ ID NO: 2583991 - RNA, 15 nt, Human
gcucccauuucuacu

SEQ ID NO: 2583992 - RNA, 15 nt, Human
gcucgggcccaggcc

SEQ ID NO: 2583993 - RNA, 14 nt, Human
gcucgggcccaggc

SEQ ID NO: 2583994 - RNA, 13 nt, Human
gcucgggcccagg

SEQ ID NO: 2583995 - RNA, 12 nt, Human
gcucgggcccag

SEQ ID NO: 2583996 - RNA, 16 nt, Human
gcucggaggcugcccc

SEQ ID NO: 2583997 - RNA, 15 nt, Human
gcucggaggcugccc

SEQ ID NO: 2583998 - RNA, 14 nt, Human
gcucggaggcugcc

SEQ ID NO: 2583999 - RNA, 21 nt, Human
gcucggaggccccaaaggaaa

SEQ ID NO: 2584000 - RNA, 19 nt, Human
gcucggaggccccaaagga

SEQ ID NO: 2584001 - RNA, 18 nt, Human
gcucggaggccccaaagg

SEQ ID NO: 2584002 - RNA, 14 nt, Human
gcucggaggcccca

SEQ ID NO: 2584003 - RNA, 14 nt, Human
gcuccugcugcacc

SEQ ID NO: 2584004 - RNA, 18 nt, Human
gcucggaggcugcccccg

SEQ ID NO: 2584005 - RNA, 17 nt, Human
gcucggaggcugccccc

SEQ ID NO: 2584006 - RNA, 23 nt, Human
gcucggaggcugcccccggcccc

SEQ ID NO: 2584007 - RNA, 15 nt, Human
gcuccugcugcacca

SEQ ID NO: 2584008 - RNA, 12 nt, Human
gcuccugcugca

SEQ ID NO: 2584009 - RNA, 11 nt, Human
gcuccugcugc

SEQ ID NO: 2584010 - RNA, 22 nt, Human
gcucgcugcugcgcccugggcu

SEQ ID NO: 2584011 - RNA, 13 nt, Human
gcucgcuguugcu

SEQ ID NO: 2584012 - RNA, 16 nt, Human
gcucgcuguugcugaa

SEQ ID NO: 2584013 - RNA, 14 nt, Human
gcucgcuguugcug

SEQ ID NO: 2584014 - RNA, 21 nt, Human
gcucgcuguugcugaauaggc

SEQ ID NO: 2584015 - RNA, 15 nt, Human
gcucggaggaagccc

SEQ ID NO: 2584016 - RNA, 20 nt, Human
gcuccugcuccacagccauc

SEQ ID NO: 2584017 - RNA, 17 nt, Human
gcuccugcuccacagcc

SEQ ID NO: 2584018 - RNA, 14 nt, Human
gcuccugcuccaca

SEQ ID NO: 2584019 - RNA, 18 nt, Human
gcuccugccuucuguccu

SEQ ID NO: 2584020 - RNA, 17 nt, Human
gcuccugccuucugucc

SEQ ID NO: 2584021 - RNA, 19 nt, Human
gcuccugccuucuguccug

SEQ ID NO: 2584022 - RNA, 19 nt, Human
gcuccugccgcagagcugg

SEQ ID NO: 2584023 - RNA, 18 nt, Human
gcuccugccgcagagcug

SEQ ID NO: 2584024 - RNA, 22 nt, Human
gcuccugccgcagagcuggccg

SEQ ID NO: 2584025 - RNA, 15 nt, Human
gcuccugccuucugu

SEQ ID NO: 2584026 - RNA, 17 nt, Human
gcuccugccgcagagcu

SEQ ID NO: 2584027 - RNA, 15 nt, Human
gcuccugccgcagag

SEQ ID NO: 2584028 - RNA, 12 nt, Human
gcuccugcccac

SEQ ID NO: 2584029 - RNA, 19 nt, Human
gcuccugccaguguggaac

SEQ ID NO: 2584030 - RNA, 21 nt, Human
gcuccugccaccacgcccggc

SEQ ID NO: 2584031 - RNA, 22 nt, Human
gcuccugccaccacgcccggcu

SEQ ID NO: 2584032 - RNA, 15 nt, Human
gcuccccucggagaa

SEQ ID NO: 2584033 - RNA, 18 nt, Human
gcuccccucggagaagag

SEQ ID NO: 2584034 - RNA, 18 nt, Human
gcuccccuccucuccccu

SEQ ID NO: 2584035 - RNA, 13 nt, Human
gcuccccuccucu

SEQ ID NO: 2584036 - RNA, 15 nt, Human
gcuccccucccuccu

SEQ ID NO: 2584037 - RNA, 17 nt, Human
gcuccucuccuggagga

SEQ ID NO: 2584038 - RNA, 16 nt, Human
gcuccucuccuggagg

SEQ ID NO: 2584039 - RNA, 15 nt, Human
gcuccucuccuggag

SEQ ID NO: 2584040 - RNA, 14 nt, Human
gcuccucuccugga

SEQ ID NO: 2584041 - RNA, 12 nt, Human
gcuccucugcuu

SEQ ID NO: 2584042 - RNA, 18 nt, Human
gcuccucuccuggaggau

SEQ ID NO: 2584043 - RNA, 11 nt, Human
gcuccucuggg

SEQ ID NO: 2584044 - RNA, 19 nt, Human
gcuccucugggcaggaccu

SEQ ID NO: 2584045 - RNA, 12 nt, Human
gcuccucugggc

SEQ ID NO: 2584046 - RNA, 13 nt, Human
gcuccucugggca

SEQ ID NO: 2584047 - RNA, 14 nt, Human
gcuccucugggcag

SEQ ID NO: 2584048 - RNA, 16 nt, Human
gcuccucugggcagga

SEQ ID NO: 2584049 - RNA, 15 nt, Human
gcucugcauuugucu

SEQ ID NO: 2584050 - RNA, 22 nt, Human
gcucugcaugcggcccagcccg

SEQ ID NO: 2584051 - RNA, 21 nt, Human
gcucugcaugcggcccagccc

SEQ ID NO: 2584052 - RNA, 20 nt, Human
gcucugcaugcggcccagcc

SEQ ID NO: 2584053 - RNA, 19 nt, Human
gcucugcaugcggcccagc

SEQ ID NO: 2584054 - RNA, 18 nt, Human
gcucugcaugcggcccag

SEQ ID NO: 2584055 - RNA, 17 nt, Human
gcucugcaugcggccca

SEQ ID NO: 2584056 - RNA, 16 nt, Human
gcucugcaugcggccc

SEQ ID NO: 2584057 - RNA, 15 nt, Human
gcucugcaugcggcc

SEQ ID NO: 2584058 - RNA, 11 nt, Human
gcucugcaugc

SEQ ID NO: 2584059 - RNA, 18 nt, Human
gcucugcaggcaccuuag

SEQ ID NO: 2584060 - RNA, 16 nt, Human
gcucugcaggcaccuu

SEQ ID NO: 2584061 - RNA, 15 nt, Human
gcucugcaggcaccu

SEQ ID NO: 2584062 - RNA, 14 nt, Human
gcucugcaggcacc

SEQ ID NO: 2584063 - RNA, 19 nt, Human
gcucugcagcccagggacc

SEQ ID NO: 2584064 - RNA, 16 nt, Human
gcucuggaggggaggg

SEQ ID NO: 2584065 - RNA, 15 nt, Human
gcucuggaggggagg

SEQ ID NO: 2584066 - RNA, 23 nt, Human
gcucugccaacuucuucagagcu

SEQ ID NO: 2584067 - RNA, 13 nt, Human
gcucuggagggga

SEQ ID NO: 2584068 - RNA, 23 nt, Human
gcucuggagcccacuguacuugc

SEQ ID NO: 2584069 - RNA, 21 nt, Human
gcucugagcaaauguggcucc

SEQ ID NO: 2584070 - RNA, 20 nt, Human
gcucugagcaaauguggcuc

SEQ ID NO: 2584071 - RNA, 18 nt, Human
gcucugcaauuccccucu

SEQ ID NO: 2584072 - RNA, 23 nt, Human
gcucugcaauuccccucugcugc

SEQ ID NO: 2584073 - RNA, 11 nt, Human
gcucugcacag

SEQ ID NO: 2584074 - RNA, 12 nt, Human
gcucugcacaga

SEQ ID NO: 2584075 - RNA, 13 nt, Human
gcucugcacagau

SEQ ID NO: 2584076 - RNA, 14 nt, Human
gcucugcacagaug

SEQ ID NO: 2584077 - RNA, 18 nt, Human
gcucugcacagauggauu

SEQ ID NO: 2584078 - RNA, 18 nt, Human
gcucugcagcccagggac

SEQ ID NO: 2584079 - RNA, 15 nt, Human
gcucugcagcccagg

SEQ ID NO: 2584080 - RNA, 13 nt, Human
gcucugcagccca

SEQ ID NO: 2584081 - RNA, 15 nt, Human
gcucugcacagaugg

SEQ ID NO: 2584082 - RNA, 21 nt, Human
gcucugaccgaaacagcgcug

SEQ ID NO: 2584083 - RNA, 17 nt, Human
gcucugacccagugaga

SEQ ID NO: 2584084 - RNA, 15 nt, Human
gcucugacccaguga

SEQ ID NO: 2584085 - RNA, 20 nt, Human
gcucugacagaaagcagaua

SEQ ID NO: 2584086 - RNA, 15 nt, Human
gcugaaauuuuauau

SEQ ID NO: 2584087 - RNA, 17 nt, Human
gcugaaauuuuauaugc

SEQ ID NO: 2584088 - RNA, 18 nt, Human
gcugaaauucuccuggag

SEQ ID NO: 2584089 - RNA, 17 nt, Human
gcugaaauucuccugga

SEQ ID NO: 2584090 - RNA, 16 nt, Human
gcugaaaugcugcauu

SEQ ID NO: 2584091 - RNA, 17 nt, Human
gcugaagcugccugcuu

SEQ ID NO: 2584092 - RNA, 16 nt, Human
gcugaagcugccugcu

SEQ ID NO: 2584093 - RNA, 19 nt, Human
gcugaaggaaaccagugca

SEQ ID NO: 2584094 - RNA, 14 nt, Human
gcugaaggacugug

SEQ ID NO: 2584095 - RNA, 13 nt, Human
gcugaaggacugu

SEQ ID NO: 2584096 - RNA, 12 nt, Human
gcugaaggacug

SEQ ID NO: 2584097 - RNA, 20 nt, Human
gcugaacacuccaauuaagg

SEQ ID NO: 2584098 - RNA, 21 nt, Human
gcugaacacuccaauuaagga

SEQ ID NO: 2584099 - RNA, 18 nt, Human
gcugaagauggcauccug

SEQ ID NO: 2584100 - RNA, 15 nt, Human
gcugaagcugccugc

SEQ ID NO: 2584101 - RNA, 13 nt, Human
gcugaagcugccu

SEQ ID NO: 2584102 - RNA, 20 nt, Human
gcugaaggcucgagcaugcc

SEQ ID NO: 2584103 - RNA, 12 nt, Human
gcugaaggcucg

SEQ ID NO: 2584104 - RNA, 17 nt, Human
gcugaaugguuuucaaa

SEQ ID NO: 2584105 - RNA, 22 nt, Human
gcugaauacagaggcaacugca

SEQ ID NO: 2584106 - RNA, 15 nt, Human
gcugaauccagauca

SEQ ID NO: 2584107 - RNA, 17 nt, Human
gcugaauguugggacug

SEQ ID NO: 2584108 - RNA, 22 nt, Human
gcugaaggacugugacaggcag

SEQ ID NO: 2584109 - RNA, 21 nt, Human
gcugaaggacugugacaggca

SEQ ID NO: 2584110 - RNA, 19 nt, Human
gcugaauaggcgaucacaa

SEQ ID NO: 2584111 - RNA, 23 nt, Human
gcugaauguugggacugcuaaau

SEQ ID NO: 2584112 - RNA, 20 nt, Human
gcugaauguugggacugcua

SEQ ID NO: 2584113 - RNA, 23 nt, Human
gcugaaggacugugacaggcagc

SEQ ID NO: 2584114 - RNA, 14 nt, Human
gcugaauuaucuau

SEQ ID NO: 2584115 - RNA, 15 nt, Human
gcugacagacacagg

SEQ ID NO: 2584116 - RNA, 14 nt, Human
gcugacagacacag

SEQ ID NO: 2584117 - RNA, 14 nt, Human
gcugagcucucugu

SEQ ID NO: 2584118 - RNA, 14 nt, Human
gcugagcgccagga

SEQ ID NO: 2584119 - RNA, 23 nt, Human
gcugagcgaggagaugcuccuug

SEQ ID NO: 2584120 - RNA, 16 nt, Human
gcugacagacacaggc

SEQ ID NO: 2584121 - RNA, 18 nt, Human
gcucuuagcagcuuccag

SEQ ID NO: 2584122 - RNA, 17 nt, Human
gcucuuagcagcuucca

SEQ ID NO: 2584123 - RNA, 19 nt, Human
gcucuuagcagcuuccaga

SEQ ID NO: 2584124 - RNA, 19 nt, Human
gcucuuaauuguucauuuu

SEQ ID NO: 2584125 - RNA, 16 nt, Human
gcucuuagcagcuucc

SEQ ID NO: 2584126 - RNA, 12 nt, Human
gcucuuccaggc

SEQ ID NO: 2584127 - RNA, 12 nt, Human
gcucuucaggcc

SEQ ID NO: 2584128 - RNA, 15 nt, Human
gcucuucaggccucc

SEQ ID NO: 2584129 - RNA, 18 nt, Human
gcucuucaggccucccuc

SEQ ID NO: 2584130 - RNA, 16 nt, Human
gcucuuccaggcuggg

SEQ ID NO: 2584131 - RNA, 15 nt, Human
gcucuuccaggcugg

SEQ ID NO: 2584132 - RNA, 14 nt, Human
gcucuucauguuuc

SEQ ID NO: 2584133 - RNA, 12 nt, Human
gcugaaauacug

SEQ ID NO: 2584134 - RNA, 19 nt, Human
gcucuucauaauucuaaga

SEQ ID NO: 2584135 - RNA, 17 nt, Human
gcucuucauaauucuaa

SEQ ID NO: 2584136 - RNA, 19 nt, Human
gcucuucagugggagaaaa

SEQ ID NO: 2584137 - RNA, 16 nt, Human
gcugaaauucuccugg

SEQ ID NO: 2584138 - RNA, 15 nt, Human
gcugaaauucuccug

SEQ ID NO: 2584139 - RNA, 14 nt, Human
gcugaaauucuccu

SEQ ID NO: 2584140 - RNA, 15 nt, Human
gcugaaaugcugcau

SEQ ID NO: 2584141 - RNA, 20 nt, Human
gcugaaauacugaggggucu

SEQ ID NO: 2584142 - RNA, 15 nt, Human
gcucugggagaggau

SEQ ID NO: 2584143 - RNA, 22 nt, Human
gcucuggcugaacccugugcug

SEQ ID NO: 2584144 - RNA, 19 nt, Human
gcucugucgcccaggcugg

SEQ ID NO: 2584145 - RNA, 16 nt, Human
gcucuguccugggagu

SEQ ID NO: 2584146 - RNA, 17 nt, Human
gcucuguguugccaugu

SEQ ID NO: 2584147 - RNA, 14 nt, Human
gcucuguccuggga

SEQ ID NO: 2584148 - RNA, 15 nt, Human
gcucuguccugggag

SEQ ID NO: 2584149 - RNA, 21 nt, Human
gcucuggcugaacccugugcu

SEQ ID NO: 2584150 - RNA, 20 nt, Human
gcucuggcugaacccugugc

SEQ ID NO: 2584151 - RNA, 19 nt, Human
gcucuggcugaacccugug

SEQ ID NO: 2584152 - RNA, 16 nt, Human
gcucuggcugaacccu

SEQ ID NO: 2584153 - RNA, 15 nt, Human
gcucuggcugaaccc

SEQ ID NO: 2584154 - RNA, 22 nt, Human
gcucugccaacuucuucagagc

SEQ ID NO: 2584155 - RNA, 11 nt, Human
gcucuggcuga

SEQ ID NO: 2584156 - RNA, 21 nt, Human
gccaugguacccccuucuggg

SEQ ID NO: 2584157 - RNA, 20 nt, Human
gccaugguacccccuucugg

SEQ ID NO: 2584158 - RNA, 22 nt, Human
gccauauugcacaugucuuaau

SEQ ID NO: 2584159 - RNA, 21 nt, Human
gccauauugcacaugucuuaa

SEQ ID NO: 2584160 - RNA, 18 nt, Human
gccauguagaagcugcau

SEQ ID NO: 2584161 - RNA, 16 nt, Human
gccauguagaagcugc

SEQ ID NO: 2584162 - RNA, 15 nt, Human
gccauguagaagcug

SEQ ID NO: 2584163 - RNA, 20 nt, Human
gccauauucuguuggccagu

SEQ ID NO: 2584164 - RNA, 19 nt, Human
gccauauucuguuggccag

SEQ ID NO: 2584165 - RNA, 22 nt, Human
gccaugucugggaacagggacg

SEQ ID NO: 2584166 - RNA, 14 nt, Human
gccauguuggccag

SEQ ID NO: 2584167 - RNA, 15 nt, Human
gccaugugaagaggg

SEQ ID NO: 2584168 - RNA, 17 nt, Human
gccaugugaagagggag

SEQ ID NO: 2584169 - RNA, 18 nt, Human
gccauguuggccaggcug

SEQ ID NO: 2584170 - RNA, 17 nt, Human
gccauguuggccaggcu

SEQ ID NO: 2584171 - RNA, 16 nt, Human
gccauguuggccaggc

SEQ ID NO: 2584172 - RNA, 15 nt, Human
gccauguuggccagg

SEQ ID NO: 2584173 - RNA, 17 nt, Human
gcccacgcuggagugca

SEQ ID NO: 2584174 - RNA, 16 nt, Human
gcccacgcuggagugc

SEQ ID NO: 2584175 - RNA, 17 nt, Human
gccauucugacucauau

SEQ ID NO: 2584176 - RNA, 15 nt, Human
gcccacgcuggagug

SEQ ID NO: 2584177 - RNA, 14 nt, Human
gcccacgcccccac

SEQ ID NO: 2584178 - RNA, 13 nt, Human
gcccacgccccca

SEQ ID NO: 2584179 - RNA, 17 nt, Human
gccauucuccacagcaa

SEQ ID NO: 2584180 - RNA, 18 nt, Human
gcccaccuuggcucaagu

SEQ ID NO: 2584181 - RNA, 24 nt, Human
gccauguuggccaggcuggucuca

SEQ ID NO: 2584182 - RNA, 22 nt, Human
gccauguuggccaggcuggucu

SEQ ID NO: 2584183 - RNA, 20 nt, Human
gccauguuggccaggcuggu

SEQ ID NO: 2584184 - RNA, 19 nt, Human
gccauguuggccaggcugg

SEQ ID NO: 2584185 - RNA, 17 nt, Human
gccauuccccgucucug

SEQ ID NO: 2584186 - RNA, 18 nt, Human
gccauuccccgucucugg

SEQ ID NO: 2584187 - RNA, 18 nt, Human
gccauucucaagcccugc

SEQ ID NO: 2584188 - RNA, 16 nt, Human
gccauucucaagcccu

SEQ ID NO: 2584189 - RNA, 22 nt, Human
gccauuccugguacccagccau

SEQ ID NO: 2584190 - RNA, 20 nt, Human
gccauuccugguacccagcc

SEQ ID NO: 2584191 - RNA, 18 nt, Human
gccauucacugcccccag

SEQ ID NO: 2584192 - RNA, 14 nt, Human
gccauuccaacagc

SEQ ID NO: 2584193 - RNA, 21 nt, Human
gccauucacuucauaauccag

SEQ ID NO: 2584194 - RNA, 22 nt, Human
gccauucacuucauaauccagu

SEQ ID NO: 2584195 - RNA, 19 nt, Human
gccauguuccaauaaacag

SEQ ID NO: 2584196 - RNA, 20 nt, Human
gccauguuccaauaaacagg

SEQ ID NO: 2584197 - RNA, 14 nt, Human
gccaggccuggguc

SEQ ID NO: 2584198 - RNA, 21 nt, Human
gccaggccucuuggcagucac

SEQ ID NO: 2584199 - RNA, 17 nt, Human
gccaggccucuuggcag

SEQ ID NO: 2584200 - RNA, 13 nt, Human
gccaggccgggcc

SEQ ID NO: 2584201 - RNA, 20 nt, Human
gccaggcccucugcccacuc

SEQ ID NO: 2584202 - RNA, 19 nt, Human
gccaggcccucugcccacu

SEQ ID NO: 2584203 - RNA, 20 nt, Human
gccaggccaccuccagaaac

SEQ ID NO: 2584204 - RNA, 19 nt, Human
gccaggccggcgagcccug

SEQ ID NO: 2584205 - RNA, 20 nt, Human
gccaggccggcgagcccugu

SEQ ID NO: 2584206 - RNA, 23 nt, Human
gccaggccggcgagcccugugga

SEQ ID NO: 2584207 - RNA, 21 nt, Human
gccaggcccucugcccacucc

SEQ ID NO: 2584208 - RNA, 17 nt, Human
gccaggcccucugccca

SEQ ID NO: 2584209 - RNA, 16 nt, Human
gccaggcccucugccc

SEQ ID NO: 2584210 - RNA, 19 nt, Human
gccaggccacuggccccug

SEQ ID NO: 2584211 - RNA, 15 nt, Human
gccaggcccucugcc

SEQ ID NO: 2584212 - RNA, 13 nt, Human
gccaggccagagg

SEQ ID NO: 2584213 - RNA, 24 nt, Human
gccaggaucaugguguaauaagac

SEQ ID NO: 2584214 - RNA, 22 nt, Human
gccaggaucaugguguaauaag

SEQ ID NO: 2584215 - RNA, 20 nt, Human
gccaggauggaacacggcca

SEQ ID NO: 2584216 - RNA, 19 nt, Human
gccaggccaccaggauggc

SEQ ID NO: 2584217 - RNA, 16 nt, Human
gccaggccaccaggau

SEQ ID NO: 2584218 - RNA, 15 nt, Human
gccaggccaccagga

SEQ ID NO: 2584219 - RNA, 12 nt, Human
gccaggccagag

SEQ ID NO: 2584220 - RNA, 23 nt, Human
gccaggccacaagacccuugugg

SEQ ID NO: 2584221 - RNA, 19 nt, Human
gccaggaucaugguguaau

SEQ ID NO: 2584222 - RNA, 17 nt, Human
gccaggaucauggugua

SEQ ID NO: 2584223 - RNA, 19 nt, Human
gccaggaguuugagaccag

SEQ ID NO: 2584224 - RNA, 12 nt, Human
gccagccagcag

SEQ ID NO: 2584225 - RNA, 13 nt, Human
gccagccagcagc

SEQ ID NO: 2584226 - RNA, 14 nt, Human
gccagccagcagcc

SEQ ID NO: 2584227 - RNA, 20 nt, Human
gccaggagcucuucaggccu

SEQ ID NO: 2584228 - RNA, 16 nt, Human
gccaggaggccaggcu

SEQ ID NO: 2584229 - RNA, 23 nt, Human
gccaggagcugggcagaaggcca

SEQ ID NO: 2584230 - RNA, 22 nt, Human
gccaggagcugggcagaaggcc

SEQ ID NO: 2584231 - RNA, 13 nt, Human
gccaggagcuggg

SEQ ID NO: 2584232 - RNA, 22 nt, Human
gccaggagcucuucaggccucc

SEQ ID NO: 2584233 - RNA, 23 nt, Human
gccagcaggcucucaggccagcu

SEQ ID NO: 2584234 - RNA, 21 nt, Human
gccagcaggcucucaggccag

SEQ ID NO: 2584235 - RNA, 20 nt, Human
gccagcaggcucucaggcca

SEQ ID NO: 2584236 - RNA, 19 nt, Human
gccagcaggcucucaggcc

SEQ ID NO: 2584237 - RNA, 18 nt, Human
gccagcaggcucucaggc

SEQ ID NO: 2584238 - RNA, 17 nt, Human
gccagcaggcucucagg

SEQ ID NO: 2584239 - RNA, 16 nt, Human
gccagcaggcucucag

SEQ ID NO: 2584240 - RNA, 13 nt, Human
gccagcaggcucu

SEQ ID NO: 2584241 - RNA, 16 nt, Human
gccagcagccagcucu

SEQ ID NO: 2584242 - RNA, 17 nt, Human
gccagcagccagcucuc

SEQ ID NO: 2584243 - RNA, 18 nt, Human
gccagcagccagcucuca

SEQ ID NO: 2584244 - RNA, 19 nt, Human
gccagcagccagcucucag

SEQ ID NO: 2584245 - RNA, 20 nt, Human
gccagcagccagcucucagc

SEQ ID NO: 2584246 - RNA, 21 nt, Human
gccagcagccagcucucagcc

SEQ ID NO: 2584247 - RNA, 22 nt, Human
gccagcagccagcucucagcca

SEQ ID NO: 2584248 - RNA, 23 nt, Human
gccagcagccagcucucagccaa

SEQ ID NO: 2584249 - RNA, 16 nt, Human
gccagcacuuguauau

SEQ ID NO: 2584250 - RNA, 15 nt, Human
gccagcacuuguaua

SEQ ID NO: 2584251 - RNA, 14 nt, Human
gccagcaccuggca

SEQ ID NO: 2584252 - RNA, 14 nt, Human
gccagcacuugucc

SEQ ID NO: 2584253 - RNA, 19 nt, Human
gccagcacuuguccagcug

SEQ ID NO: 2584254 - RNA, 14 nt, Human
gccagcagacauug

SEQ ID NO: 2584255 - RNA, 13 nt, Human
gccagcagacauu

SEQ ID NO: 2584256 - RNA, 20 nt, Human
gccagcacuuguccagcuga

SEQ ID NO: 2584257 - RNA, 16 nt, Human
gccagcagacauuguc

SEQ ID NO: 2584258 - RNA, 15 nt, Human
gccagcagacauugu

SEQ ID NO: 2584259 - RNA, 17 nt, Human
gccagcagacauuguca

SEQ ID NO: 2584260 - RNA, 12 nt, Human
gccagcagccag

SEQ ID NO: 2584261 - RNA, 13 nt, Human
gccagcagccagc

SEQ ID NO: 2584262 - RNA, 15 nt, Human
gccagcagccagcuc

SEQ ID NO: 2584263 - RNA, 15 nt, Human
gccagcacacagggc

SEQ ID NO: 2584264 - RNA, 16 nt, Human
gccagcacacagggca

SEQ ID NO: 2584265 - RNA, 17 nt, Human
gccagcacacagggcag

SEQ ID NO: 2584266 - RNA, 18 nt, Human
gccagcacacagggcagu

SEQ ID NO: 2584267 - RNA, 22 nt, Human
gccagcacagaaacagaggaga

SEQ ID NO: 2584268 - RNA, 20 nt, Human
gccagcacagaaacagagga

SEQ ID NO: 2584269 - RNA, 22 nt, Human
gccagcacacagggcagugagg

SEQ ID NO: 2584270 - RNA, 22 nt, Human
gccagcaaugauguccagaaga

SEQ ID NO: 2584271 - RNA, 21 nt, Human
gccagcaaugauguccagaag

SEQ ID NO: 2584272 - RNA, 23 nt, Human
gccagcaaugacaucucaggggc

SEQ ID NO: 2584273 - RNA, 20 nt, Human
gccagcaaugacaucucagg

SEQ ID NO: 2584274 - RNA, 12 nt, Human
gccagcacacag

SEQ ID NO: 2584275 - RNA, 13 nt, Human
gccagcacacagg

SEQ ID NO: 2584276 - RNA, 13 nt, Human
gccagcaacugaa

SEQ ID NO: 2584277 - RNA, 22 nt, Human
gccagcaaagccccaugcugga

SEQ ID NO: 2584278 - RNA, 16 nt, Human
gccagcaacugaauaa

SEQ ID NO: 2584279 - RNA, 14 nt, Human
gccagcaacugaau

SEQ ID NO: 2584280 - RNA, 13 nt, Human
gccagcaaugaca

SEQ ID NO: 2584281 - RNA, 23 nt, Human
gccagcaaagccccaugcuggag

SEQ ID NO: 2584282 - RNA, 16 nt, Human
gccagcaaagccccau

SEQ ID NO: 2584283 - RNA, 14 nt, Human
gccagcaaagcccc

SEQ ID NO: 2584284 - RNA, 22 nt, Human
gccagacggcacccacccagca

SEQ ID NO: 2584285 - RNA, 19 nt, Human
gccagacacucugcucugc

SEQ ID NO: 2584286 - RNA, 17 nt, Human
gccagacccccuggaga

SEQ ID NO: 2584287 - RNA, 16 nt, Human
gccagacacaggcccu

SEQ ID NO: 2584288 - RNA, 17 nt, Human
gccagacacaggcccuc

SEQ ID NO: 2584289 - RNA, 15 nt, Human
gccagaauuucaaac

SEQ ID NO: 2584290 - RNA, 21 nt, Human
gccagaaguuugucaagucaa

SEQ ID NO: 2584291 - RNA, 22 nt, Human
gccagacaucaacagauaaaua

SEQ ID NO: 2584292 - RNA, 15 nt, Human
gccagacacucugcu

SEQ ID NO: 2584293 - RNA, 13 nt, Human
gccagacacucug

SEQ ID NO: 2584294 - RNA, 18 nt, Human
gccagacaugccacaagg

SEQ ID NO: 2584295 - RNA, 14 nt, Human
gccagacauguggu

SEQ ID NO: 2584296 - RNA, 18 nt, Human
gccagaagauccccucag

SEQ ID NO: 2584297 - RNA, 17 nt, Human
gccagaagauccccuca

SEQ ID NO: 2584298 - RNA, 22 nt, Human
gccagaacguggcucugcuggc

SEQ ID NO: 2584299 - RNA, 20 nt, Human
gccagaacguggcucugcug

SEQ ID NO: 2584300 - RNA, 18 nt, Human
gccagaacguggcucugc

SEQ ID NO: 2584301 - RNA, 17 nt, Human
gccagaaccuggagggc

SEQ ID NO: 2584302 - RNA, 12 nt, Human
gccagaagcuga

SEQ ID NO: 2584303 - RNA, 19 nt, Human
gccagaagauccccucagg

SEQ ID NO: 2584304 - RNA, 18 nt, Human
gccagaagggggccauga

SEQ ID NO: 2584305 - RNA, 21 nt, Human
gccagaagcugagcaccaggg

SEQ ID NO: 2584306 - RNA, 22 nt, Human
gccacauuuggaauacuuuuug

SEQ ID NO: 2584307 - RNA, 16 nt, Human
gccacauugggcagcg

SEQ ID NO: 2584308 - RNA, 19 nt, Human
gccacauuuggaauacuuu

SEQ ID NO: 2584309 - RNA, 20 nt, Human
gccacauggggcugggcagc

SEQ ID NO: 2584310 - RNA, 15 nt, Human
gccacaugggaggcu

SEQ ID NO: 2584311 - RNA, 14 nt, Human
gccacauuuggaau

SEQ ID NO: 2584312 - RNA, 17 nt, Human
gccacauggggcugggc

SEQ ID NO: 2584313 - RNA, 20 nt, Human
gccacauuccugaugcuucu

SEQ ID NO: 2584314 - RNA, 16 nt, Human
gccacauuccugaugc

SEQ ID NO: 2584315 - RNA, 22 nt, Human
gccacauggcuuccuccugcgc

SEQ ID NO: 2584316 - RNA, 21 nt, Human
gccacauggcuuccuccugcg

SEQ ID NO: 2584317 - RNA, 20 nt, Human
gccacaugagucccaguggg

SEQ ID NO: 2584318 - RNA, 17 nt, Human
gccaccaggcuggcgca

SEQ ID NO: 2584319 - RNA, 16 nt, Human
gccaccaggcuggcgc

SEQ ID NO: 2584320 - RNA, 14 nt, Human
gccaccaggcuggc

SEQ ID NO: 2584321 - RNA, 13 nt, Human
gccaccaggcugg

SEQ ID NO: 2584322 - RNA, 12 nt, Human
gccaccaggcug

SEQ ID NO: 2584323 - RNA, 17 nt, Human
gccaccaggauggcccu

SEQ ID NO: 2584324 - RNA, 20 nt, Human
gccaccaggccaccucccca

SEQ ID NO: 2584325 - RNA, 18 nt, Human
gccaccaggccaccuccc

SEQ ID NO: 2584326 - RNA, 15 nt, Human
gccaccaggccaccu

SEQ ID NO: 2584327 - RNA, 12 nt, Human
gccaccaggaug

SEQ ID NO: 2584328 - RNA, 12 nt, Human
gccaccaggcca

SEQ ID NO: 2584329 - RNA, 23 nt, Human
gccaccagagaccguccucaccc

SEQ ID NO: 2584330 - RNA, 22 nt, Human
gccaccagagaccguccucacc

SEQ ID NO: 2584331 - RNA, 21 nt, Human
gccaccagagaccguccucac

SEQ ID NO: 2584332 - RNA, 19 nt, Human
gccaccagagaccguccuc

SEQ ID NO: 2584333 - RNA, 10 nt, Human
gccaccagcg

SEQ ID NO: 2584334 - RNA, 12 nt, Human
gccaccagagac

SEQ ID NO: 2584335 - RNA, 16 nt, Human
gccaccacguccagcu

SEQ ID NO: 2584336 - RNA, 14 nt, Human
gccaccacguccag

SEQ ID NO: 2584337 - RNA, 15 nt, Human
gccaccacguccagc

SEQ ID NO: 2584338 - RNA, 15 nt, Human
gccaccauccugcug

SEQ ID NO: 2584339 - RNA, 14 nt, Human
gccaccauccugcu

SEQ ID NO: 2584340 - RNA, 17 nt, Human
gccaccauccugcagcc

SEQ ID NO: 2584341 - RNA, 12 nt, Human
gccaccauccug

SEQ ID NO: 2584342 - RNA, 16 nt, Human
gccaccaugcccagcu

SEQ ID NO: 2584343 - RNA, 22 nt, Human
gccaccaugcccagcucagagg

SEQ ID NO: 2584344 - RNA, 14 nt, Human
gccaccauggccag

SEQ ID NO: 2584345 - RNA, 16 nt, Human
gccaccauggccagcc

SEQ ID NO: 2584346 - RNA, 17 nt, Human
gccaccauggccagcca

SEQ ID NO: 2584347 - RNA, 18 nt, Human
gccaccauggccagccaa

SEQ ID NO: 2584348 - RNA, 19 nt, Human
gccaccaggcuggcgcagc

SEQ ID NO: 2584349 - RNA, 18 nt, Human
gccaccaggcuggcgcag

SEQ ID NO: 2584350 - RNA, 20 nt, Human
gccaccaggcuggcgcagcc

SEQ ID NO: 2584351 - RNA, 22 nt, Human
gccaccauauucagugcugugg

SEQ ID NO: 2584352 - RNA, 18 nt, Human
gccaccauccuauugcaa

SEQ ID NO: 2584353 - RNA, 16 nt, Human
gccaccagucacuguc

SEQ ID NO: 2584354 - RNA, 23 nt, Human
gccaccauauucagugcuguggc

SEQ ID NO: 2584355 - RNA, 21 nt, Human
gccaccaacauacucccaucu

SEQ ID NO: 2584356 - RNA, 20 nt, Human
gccaccaacauacucccauc

SEQ ID NO: 2584357 - RNA, 19 nt, Human
gccaccaacauacucccau

SEQ ID NO: 2584358 - RNA, 16 nt, Human
gccaccaaaggccagg

SEQ ID NO: 2584359 - RNA, 17 nt, Human
gccaccaaaggccaggg

SEQ ID NO: 2584360 - RNA, 13 nt, Human
gccaccacgcccg

SEQ ID NO: 2584361 - RNA, 22 nt, Human
gccaccaagagggacgccuggg

SEQ ID NO: 2584362 - RNA, 13 nt, Human
gccaccacccccc

SEQ ID NO: 2584363 - RNA, 14 nt, Human
gccaccacgcccgg

SEQ ID NO: 2584364 - RNA, 22 nt, Human
gccaccaccccccacucugugc

SEQ ID NO: 2584365 - RNA, 16 nt, Human
gccaccaccccccacu

SEQ ID NO: 2584366 - RNA, 22 nt, Human
gccaccaacauacucccaucug

SEQ ID NO: 2584367 - RNA, 14 nt, Human
gccaccaagaggga

SEQ ID NO: 2584368 - RNA, 19 nt, Human
gccaccaagagggacgccu

SEQ ID NO: 2584369 - RNA, 22 nt, Human
gccaccaacucuugcaggucuc

SEQ ID NO: 2584370 - RNA, 12 nt, Human
gccaccaacucu

SEQ ID NO: 2584371 - RNA, 17 nt, Human
gccacugccucuuccuc

SEQ ID NO: 2584372 - RNA, 16 nt, Human
gccacugccucuuccu

SEQ ID NO: 2584373 - RNA, 13 nt, Human
gccacugccucuu

SEQ ID NO: 2584374 - RNA, 12 nt, Human
gccacugccucu

SEQ ID NO: 2584375 - RNA, 13 nt, Human
gccacugcugcuu

SEQ ID NO: 2584376 - RNA, 22 nt, Human
gccacugccuucgcuucuugcc

SEQ ID NO: 2584377 - RNA, 16 nt, Human
gccacuggccaucucc

SEQ ID NO: 2584378 - RNA, 12 nt, Human
gccacuggccau

SEQ ID NO: 2584379 - RNA, 23 nt, Human
gccacugccuucgcuucuugccu

SEQ ID NO: 2584380 - RNA, 18 nt, Human
gccacugccuucgcuucu

SEQ ID NO: 2584381 - RNA, 19 nt, Human
gccacugcccgagcuggug

SEQ ID NO: 2584382 - RNA, 21 nt, Human
gccacugcccgagcuggugca

SEQ ID NO: 2584383 - RNA, 17 nt, Human
gccacuggccaucucca

SEQ ID NO: 2584384 - RNA, 18 nt, Human
gccacugugaagagaacc

SEQ ID NO: 2584385 - RNA, 19 nt, Human
gccacugugaagagaacca

SEQ ID NO: 2584386 - RNA, 23 nt, Human
gccacuucuggguggggcagugg

SEQ ID NO: 2584387 - RNA, 21 nt, Human
gccacuugaugacccccaacc

SEQ ID NO: 2584388 - RNA, 20 nt, Human
gccacuucuggguggggcag

SEQ ID NO: 2584389 - RNA, 14 nt, Human
gccacuucugggug

SEQ ID NO: 2584390 - RNA, 15 nt, Human
gccacuucccaggua

SEQ ID NO: 2584391 - RNA, 22 nt, Human
gccacuuaccuucaauaaagua

SEQ ID NO: 2584392 - RNA, 23 nt, Human
gccacuuaccuucaauaaaguau

SEQ ID NO: 2584393 - RNA, 18 nt, Human
gccacuuaaaauguucac

SEQ ID NO: 2584394 - RNA, 14 nt, Human
gccacuuaccuuca

SEQ ID NO: 2584395 - RNA, 19 nt, Human
gccacuuaccuucaauaaa

SEQ ID NO: 2584396 - RNA, 21 nt, Human
gccacuuaccuucaauaaagu

SEQ ID NO: 2584397 - RNA, 13 nt, Human
gccacuucccagg

SEQ ID NO: 2584398 - RNA, 19 nt, Human
gccacuuugcaaaggagcu

SEQ ID NO: 2584399 - RNA, 21 nt, Human
gccacuuugguacauggccag

SEQ ID NO: 2584400 - RNA, 22 nt, Human
gccacuuugguacauggccagu

SEQ ID NO: 2584401 - RNA, 23 nt, Human
gccacuuugguacauggccagug

SEQ ID NO: 2584402 - RNA, 23 nt, Human
gccacuuuugacuagggauucag

SEQ ID NO: 2584403 - RNA, 12 nt, Human
gccagaaauaaa

SEQ ID NO: 2584404 - RNA, 16 nt, Human
gccagaacaguuugua

SEQ ID NO: 2584405 - RNA, 18 nt, Human
gccagaacaguuuguaca

SEQ ID NO: 2584406 - RNA, 20 nt, Human
gccagaaaaacguguugccu

SEQ ID NO: 2584407 - RNA, 10 nt, Human
gccagaaaaa

SEQ ID NO: 2584408 - RNA, 21 nt, Human
gccacccugggcucugugggc

SEQ ID NO: 2584409 - RNA, 19 nt, Human
gccacccugggcucugugg

SEQ ID NO: 2584410 - RNA, 18 nt, Human
gccacccugggcucugug

SEQ ID NO: 2584411 - RNA, 17 nt, Human
gccacccugggcucugu

SEQ ID NO: 2584412 - RNA, 16 nt, Human
gccaccgccuccuaca

SEQ ID NO: 2584413 - RNA, 23 nt, Human
gccacugcaccgggccacagaga

SEQ ID NO: 2584414 - RNA, 19 nt, Human
gccacccuggggagaaagu

SEQ ID NO: 2584415 - RNA, 13 nt, Human
gccacccugggga

SEQ ID NO: 2584416 - RNA, 18 nt, Human
gccacugcacuccagccu

SEQ ID NO: 2584417 - RNA, 21 nt, Human
gccacugcacuauagccuagg

SEQ ID NO: 2584418 - RNA, 19 nt, Human
gccacugcacuccagccug

SEQ ID NO: 2584419 - RNA, 20 nt, Human
gccacugcacuccagccugg

SEQ ID NO: 2584420 - RNA, 21 nt, Human
gccacugcacuccagccuggg

SEQ ID NO: 2584421 - RNA, 22 nt, Human
gccacugcacuccagccugggc

SEQ ID NO: 2584422 - RNA, 16 nt, Human
gccacugcccgagcug

SEQ ID NO: 2584423 - RNA, 17 nt, Human
gccacugcccgagcugg

SEQ ID NO: 2584424 - RNA, 18 nt, Human
gccacugcccgagcuggu

SEQ ID NO: 2584425 - RNA, 15 nt, Human
gccacugcacuccgg

SEQ ID NO: 2584426 - RNA, 22 nt, Human
gccaccgccgacuuuguacccc

SEQ ID NO: 2584427 - RNA, 19 nt, Human
gccacugcauaccaaccug

SEQ ID NO: 2584428 - RNA, 18 nt, Human
gccaccccacccucccug

SEQ ID NO: 2584429 - RNA, 15 nt, Human
gccaccccacccucc

SEQ ID NO: 2584430 - RNA, 16 nt, Human
gccacccaccucccug

SEQ ID NO: 2584431 - RNA, 17 nt, Human
gccacccaccucccugc

SEQ ID NO: 2584432 - RNA, 18 nt, Human
gccacccaccucccugcc

SEQ ID NO: 2584433 - RNA, 21 nt, Human
gccacccaccucccugccucc

SEQ ID NO: 2584434 - RNA, 16 nt, Human
gccaccauuccuggaa

SEQ ID NO: 2584435 - RNA, 14 nt, Human
gccaccauuccugg

SEQ ID NO: 2584436 - RNA, 22 nt, Human
gccaccauuccuggaaaccaca

SEQ ID NO: 2584437 - RNA, 22 nt, Human
gccaccccacccucccuggagu

SEQ ID NO: 2584438 - RNA, 21 nt, Human
gccaccccacccucccuggag

SEQ ID NO: 2584439 - RNA, 20 nt, Human
gccaccccacccucccugga

SEQ ID NO: 2584440 - RNA, 18 nt, Human
gccaccccgggcucucug

SEQ ID NO: 2584441 - RNA, 19 nt, Human
gccaccccgggcucucugc

SEQ ID NO: 2584442 - RNA, 19 nt, Human
gccacccuaccuguucagu

SEQ ID NO: 2584443 - RNA, 13 nt, Human
gccacccuaccug

SEQ ID NO: 2584444 - RNA, 23 nt, Human
gccacccguucugcuggccugga

SEQ ID NO: 2584445 - RNA, 18 nt, Human
gccacccuaccuguucag

SEQ ID NO: 2584446 - RNA, 13 nt, Human
gccacccucaugc

SEQ ID NO: 2584447 - RNA, 15 nt, Human
gccaccccuccuucc

SEQ ID NO: 2584448 - RNA, 21 nt, Human
gccaccccgggcucucugcug

SEQ ID NO: 2584449 - RNA, 22 nt, Human
gccacccguucugcuggccugg

SEQ ID NO: 2584450 - RNA, 21 nt, Human
gccacccguucugcuggccug

SEQ ID NO: 2584451 - RNA, 18 nt, Human
gccacccguucugcuggc

SEQ ID NO: 2584452 - RNA, 16 nt, Human
gccaccccuccuuccu

SEQ ID NO: 2584453 - RNA, 15 nt, Human
gccacccucaugcug

SEQ ID NO: 2584454 - RNA, 16 nt, Human
gccacccucaugcugu

SEQ ID NO: 2584455 - RNA, 14 nt, Human
gccacccugggcuc

SEQ ID NO: 2584456 - RNA, 13 nt, Human
gccacccugggcu

SEQ ID NO: 2584457 - RNA, 12 nt, Human
gccacccugggc

SEQ ID NO: 2584458 - RNA, 18 nt, Human
gcacuuggagacuuguau

SEQ ID NO: 2584459 - RNA, 13 nt, Human
gcacuuggagcca

SEQ ID NO: 2584460 - RNA, 16 nt, Human
gcacuuggagccaagg

SEQ ID NO: 2584461 - RNA, 15 nt, Human
gcacuuggcugcaua

SEQ ID NO: 2584462 - RNA, 14 nt, Human
gcacuuggccucug

SEQ ID NO: 2584463 - RNA, 16 nt, Human
gcacuuggagaggcug

SEQ ID NO: 2584464 - RNA, 22 nt, Human
gcacuuggagccaaggguucag

SEQ ID NO: 2584465 - RNA, 16 nt, Human
gcccugccugagggcc

SEQ ID NO: 2584466 - RNA, 15 nt, Human
gcccugccugagggc

SEQ ID NO: 2584467 - RNA, 23 nt, Human
gcccugcugagucccaggcugag

SEQ ID NO: 2584468 - RNA, 21 nt, Human
gcccugcugagucccaggcug

SEQ ID NO: 2584469 - RNA, 22 nt, Human
gcccugcugagucccaggcuga

SEQ ID NO: 2584470 - RNA, 13 nt, Human
gcccuguuaaaag

SEQ ID NO: 2584471 - RNA, 21 nt, Human
gcccugcugccgccucccagc

SEQ ID NO: 2584472 - RNA, 22 nt, Human
gcccugcugccgccucccagcc

SEQ ID NO: 2584473 - RNA, 23 nt, Human
gcccugcugccgccucccagccu

SEQ ID NO: 2584474 - RNA, 14 nt, Human
gcccuguuaaaaga

SEQ ID NO: 2584475 - RNA, 17 nt, Human
gcccuguuaaaagauga

SEQ ID NO: 2584476 - RNA, 17 nt, Human
gcccuguucagcuacuc

SEQ ID NO: 2584477 - RNA, 22 nt, Human
gcccugcugcugacccagccug

SEQ ID NO: 2584478 - RNA, 21 nt, Human
gcccugugggcccccaaaugg

SEQ ID NO: 2584479 - RNA, 22 nt, Human
gcccuguucucuaccaagcuau

SEQ ID NO: 2584480 - RNA, 20 nt, Human
gcccuguucagcuacuccca

SEQ ID NO: 2584481 - RNA, 16 nt, Human
gcccuguugacacagg

SEQ ID NO: 2584482 - RNA, 21 nt, Human
gcccuguugacacaggucuuu

SEQ ID NO: 2584483 - RNA, 19 nt, Human
gcccuguugacacaggucu

SEQ ID NO: 2584484 - RNA, 22 nt, Human
gcccugccuccuuugugaggaa

SEQ ID NO: 2584485 - RNA, 16 nt, Human
gcccugccuccuuugu

SEQ ID NO: 2584486 - RNA, 14 nt, Human
gcccugccugaggg

SEQ ID NO: 2584487 - RNA, 13 nt, Human
gcccugccugagg

SEQ ID NO: 2584488 - RNA, 12 nt, Human
gcccugccugag

SEQ ID NO: 2584489 - RNA, 11 nt, Human
gcccugccuga

SEQ ID NO: 2584490 - RNA, 16 nt, Human
gcccugcugaguccca

SEQ ID NO: 2584491 - RNA, 15 nt, Human
gcccugccucuguuu

SEQ ID NO: 2584492 - RNA, 13 nt, Human
gcccugccucugu

SEQ ID NO: 2584493 - RNA, 14 nt, Human
gcccugccuccuuu

SEQ ID NO: 2584494 - RNA, 15 nt, Human
gccgcugagcgagga

SEQ ID NO: 2584495 - RNA, 17 nt, Human
gccgcugagcgaggaga

SEQ ID NO: 2584496 - RNA, 16 nt, Human
gccgcugaguggcagg

SEQ ID NO: 2584497 - RNA, 12 nt, Human
gccgcugccacc

SEQ ID NO: 2584498 - RNA, 14 nt, Human
gccgcugccaccca

SEQ ID NO: 2584499 - RNA, 12 nt, Human
gccgcugccacg

SEQ ID NO: 2584500 - RNA, 19 nt, Human
gccgcugcccggcgcccuc

SEQ ID NO: 2584501 - RNA, 17 nt, Human
gccgcugccacccaccu

SEQ ID NO: 2584502 - RNA, 17 nt, Human
gccgcugugagccccug

SEQ ID NO: 2584503 - RNA, 12 nt, Human
gccgcugugagc

SEQ ID NO: 2584504 - RNA, 23 nt, Human
gccgcugugagccccugguccug

SEQ ID NO: 2584505 - RNA, 15 nt, Human
gccgcuguucaccca

SEQ ID NO: 2584506 - RNA, 15 nt, Human
gccggcauggcuggg

SEQ ID NO: 2584507 - RNA, 12 nt, Human
gccggccagccc

SEQ ID NO: 2584508 - RNA, 14 nt, Human
gccggccagccccu

SEQ ID NO: 2584509 - RNA, 16 nt, Human
gccgcuuuucuccucu

SEQ ID NO: 2584510 - RNA, 16 nt, Human
gccgcuguucacccac

SEQ ID NO: 2584511 - RNA, 17 nt, Human
gccgcuguucacccaca

SEQ ID NO: 2584512 - RNA, 17 nt, Human
gccgccucgcccaccgc

SEQ ID NO: 2584513 - RNA, 16 nt, Human
gccgccucgcccaccg

SEQ ID NO: 2584514 - RNA, 15 nt, Human
gccgccucgcccacc

SEQ ID NO: 2584515 - RNA, 13 nt, Human
gccgccucgccca

SEQ ID NO: 2584516 - RNA, 19 nt, Human
gccgccucccagccugggg

SEQ ID NO: 2584517 - RNA, 23 nt, Human
gccgccugcccgucucucuccca

SEQ ID NO: 2584518 - RNA, 15 nt, Human
gccgccugguacuca

SEQ ID NO: 2584519 - RNA, 13 nt, Human
gccgccugguacu

SEQ ID NO: 2584520 - RNA, 22 nt, Human
gccgcucggaggccccaaagga

SEQ ID NO: 2584521 - RNA, 21 nt, Human
gccgcucggaggccccaaagg

SEQ ID NO: 2584522 - RNA, 20 nt, Human
gccgcucggaggccccaaag

SEQ ID NO: 2584523 - RNA, 18 nt, Human
gccgcucggaggccccaa

SEQ ID NO: 2584524 - RNA, 17 nt, Human
gccgcucggaggcccca

SEQ ID NO: 2584525 - RNA, 16 nt, Human
gccgcucggaggcccc

SEQ ID NO: 2584526 - RNA, 15 nt, Human
gccgcucggaggccc

SEQ ID NO: 2584527 - RNA, 23 nt, Human
gccgcuccugucugccagccagc

SEQ ID NO: 2584528 - RNA, 18 nt, Human
gccgccugguacucaagc

SEQ ID NO: 2584529 - RNA, 20 nt, Human
gcccuuaccugccaggaagc

SEQ ID NO: 2584530 - RNA, 16 nt, Human
gcccuuaccugccagg

SEQ ID NO: 2584531 - RNA, 15 nt, Human
gccgccaugcuccug

SEQ ID NO: 2584532 - RNA, 20 nt, Human
gcccuuacacuuacuguugu

SEQ ID NO: 2584533 - RNA, 16 nt, Human
gcccuuacacuuacug

SEQ ID NO: 2584534 - RNA, 17 nt, Human
gcccuguuguguauaga

SEQ ID NO: 2584535 - RNA, 20 nt, Human
gcccuguugacacaggucuu

SEQ ID NO: 2584536 - RNA, 16 nt, Human
gccgcauucccugagu

SEQ ID NO: 2584537 - RNA, 18 nt, Human
gccgcauucccugaguca

SEQ ID NO: 2584538 - RNA, 15 nt, Human
gccgcauucccugag

SEQ ID NO: 2584539 - RNA, 16 nt, Human
gccgccaugcuccugg

SEQ ID NO: 2584540 - RNA, 16 nt, Human
gccgccauugccacca

SEQ ID NO: 2584541 - RNA, 17 nt, Human
gccgccauugccaccag

SEQ ID NO: 2584542 - RNA, 18 nt, Human
gccgccauugccaccagg

SEQ ID NO: 2584543 - RNA, 14 nt, Human
gccgccucccagcc

SEQ ID NO: 2584544 - RNA, 15 nt, Human
gccgccucccagccu

SEQ ID NO: 2584545 - RNA, 16 nt, Human
gccgccucccagccug

SEQ ID NO: 2584546 - RNA, 17 nt, Human
gccgccucccagccugg

SEQ ID NO: 2584547 - RNA, 12 nt, Human
gccgccucccag

SEQ ID NO: 2584548 - RNA, 13 nt, Human
gccgccucccagc

SEQ ID NO: 2584549 - RNA, 21 nt, Human
gccgccauugccaccaggaga

SEQ ID NO: 2584550 - RNA, 16 nt, Human
gccgccucacccccuc

SEQ ID NO: 2584551 - RNA, 21 nt, Human
gcccaugucgcgcucagcaug

SEQ ID NO: 2584552 - RNA, 20 nt, Human
gcccaugucgcgcucagcau

SEQ ID NO: 2584553 - RNA, 19 nt, Human
gcccaugucgcgcucagca

SEQ ID NO: 2584554 - RNA, 21 nt, Human
gcccaugggcacugcugggug

SEQ ID NO: 2584555 - RNA, 20 nt, Human
gcccaugggcacugcugggu

SEQ ID NO: 2584556 - RNA, 19 nt, Human
gcccaugggcacugcuggg

SEQ ID NO: 2584557 - RNA, 18 nt, Human
gcccaugggcacugcugg

SEQ ID NO: 2584558 - RNA, 23 nt, Human
gcccaugggcacugcuggguggc

SEQ ID NO: 2584559 - RNA, 22 nt, Human
gcccaugggcacugcugggugg

SEQ ID NO: 2584560 - RNA, 21 nt, Human
gcccaugguugagaaaugaau

SEQ ID NO: 2584561 - RNA, 20 nt, Human
gcccaugggagcugguuaga

SEQ ID NO: 2584562 - RNA, 17 nt, Human
gcccaugggcacugcug

SEQ ID NO: 2584563 - RNA, 16 nt, Human
gcccaugggcacugcu

SEQ ID NO: 2584564 - RNA, 15 nt, Human
gcccaugggcacugc

SEQ ID NO: 2584565 - RNA, 22 nt, Human
gcccauggcccucccaguaccu

SEQ ID NO: 2584566 - RNA, 18 nt, Human
gcccacugcccacccccu

SEQ ID NO: 2584567 - RNA, 16 nt, Human
gcccacugcccacccc

SEQ ID NO: 2584568 - RNA, 15 nt, Human
gcccacucccugcaa

SEQ ID NO: 2584569 - RNA, 14 nt, Human
gcccacucccugca

SEQ ID NO: 2584570 - RNA, 19 nt, Human
gcccacucccugcaaccug

SEQ ID NO: 2584571 - RNA, 17 nt, Human
gcccacucugcucgccu

SEQ ID NO: 2584572 - RNA, 14 nt, Human
gcccacguccuguc

SEQ ID NO: 2584573 - RNA, 13 nt, Human
gcccacguccugu

SEQ ID NO: 2584574 - RNA, 17 nt, Human
gcccacguagggcggca

SEQ ID NO: 2584575 - RNA, 16 nt, Human
gcccacguagggcggc

SEQ ID NO: 2584576 - RNA, 15 nt, Human
gcccacguagggcgg

SEQ ID NO: 2584577 - RNA, 17 nt, Human
gcccacuagacccacug

SEQ ID NO: 2584578 - RNA, 16 nt, Human
gcccacguccugucag

SEQ ID NO: 2584579 - RNA, 15 nt, Human
gcccacguccuguca

SEQ ID NO: 2584580 - RNA, 23 nt, Human
gcccacguccugucagugccgcc

SEQ ID NO: 2584581 - RNA, 13 nt, Human
gcccacucccugc

SEQ ID NO: 2584582 - RNA, 23 nt, Human
gcccacuagacccacuggacuca

SEQ ID NO: 2584583 - RNA, 18 nt, Human
gcccacuauggucaucuu

SEQ ID NO: 2584584 - RNA, 17 nt, Human
gcccauguguucccucu

SEQ ID NO: 2584585 - RNA, 20 nt, Human
gcccaugugugagugugugc

SEQ ID NO: 2584586 - RNA, 13 nt, Human
gcccaugugugag

SEQ ID NO: 2584587 - RNA, 14 nt, Human
gcccaugugugagu

SEQ ID NO: 2584588 - RNA, 15 nt, Human
gcccaugugugagug

SEQ ID NO: 2584589 - RNA, 18 nt, Human
gccccaaaacucuccucu

SEQ ID NO: 2584590 - RNA, 15 nt, Human
gccccaaaaccacag

SEQ ID NO: 2584591 - RNA, 16 nt, Human
gccccaaaaccacagc

SEQ ID NO: 2584592 - RNA, 19 nt, Human
gccccaaaaccacagcccu

SEQ ID NO: 2584593 - RNA, 20 nt, Human
gccccaaaaccacagcccug

SEQ ID NO: 2584594 - RNA, 21 nt, Human
gccccaaaaccacagcccugu

SEQ ID NO: 2584595 - RNA, 22 nt, Human
gccccaaaaccacagcccuguc

SEQ ID NO: 2584596 - RNA, 20 nt, Human
gcccccaguccccaccccug

SEQ ID NO: 2584597 - RNA, 18 nt, Human
gcccccaguccccacccc

SEQ ID NO: 2584598 - RNA, 17 nt, Human
gcccccaguccccaccc

SEQ ID NO: 2584599 - RNA, 15 nt, Human
gcccccaguccccac

SEQ ID NO: 2584600 - RNA, 16 nt, Human
gcccccaggugccagu

SEQ ID NO: 2584601 - RNA, 19 nt, Human
gccccaaaacucuccucug

SEQ ID NO: 2584602 - RNA, 18 nt, Human
gcccccaggacugggcca

SEQ ID NO: 2584603 - RNA, 17 nt, Human
gcccccaggacugggcc

SEQ ID NO: 2584604 - RNA, 23 nt, Human
gccccaaaaccacagcccuguca

SEQ ID NO: 2584605 - RNA, 22 nt, Human
gcccccagggcacuucacagag

SEQ ID NO: 2584606 - RNA, 20 nt, Human
gcccccagggcacuucacag

SEQ ID NO: 2584607 - RNA, 16 nt, Human
gcccccaggcugcugg

SEQ ID NO: 2584608 - RNA, 17 nt, Human
gcccccaggcugcugga

SEQ ID NO: 2584609 - RNA, 19 nt, Human
gcccccuccucucccaucc

SEQ ID NO: 2584610 - RNA, 21 nt, Human
gcccccuccucucccaucccc

SEQ ID NO: 2584611 - RNA, 17 nt, Human
gcccccuccucucccau

SEQ ID NO: 2584612 - RNA, 16 nt, Human
gcccccuccucuccca

SEQ ID NO: 2584613 - RNA, 15 nt, Human
gcccccuccucuccc

SEQ ID NO: 2584614 - RNA, 21 nt, Human
gcccccuccucuagcuguggg

SEQ ID NO: 2584615 - RNA, 20 nt, Human
gcccccuccucuagcugugg

SEQ ID NO: 2584616 - RNA, 19 nt, Human
gcccccuccucuagcugug

SEQ ID NO: 2584617 - RNA, 16 nt, Human
gcccccuccucuagcu

SEQ ID NO: 2584618 - RNA, 22 nt, Human
gcccccuccgcccugccacuca

SEQ ID NO: 2584619 - RNA, 20 nt, Human
gcccccuccgcccugccacu

SEQ ID NO: 2584620 - RNA, 18 nt, Human
gcccccuccgcccugcca

SEQ ID NO: 2584621 - RNA, 22 nt, Human
gcccccaguccccaccccugcc

SEQ ID NO: 2584622 - RNA, 21 nt, Human
gcccccaguccccaccccugc

SEQ ID NO: 2584623 - RNA, 13 nt, Human
gcccccaucucau

SEQ ID NO: 2584624 - RNA, 16 nt, Human
gcccccuccgcccugc

SEQ ID NO: 2584625 - RNA, 16 nt, Human
gcccccucgugccagu

SEQ ID NO: 2584626 - RNA, 14 nt, Human
gcccccucgugcca

SEQ ID NO: 2584627 - RNA, 12 nt, Human
gcccccucgugc

SEQ ID NO: 2584628 - RNA, 14 nt, Human
gcccccucugcccu

SEQ ID NO: 2584629 - RNA, 12 nt, Human
gccccugccccg

SEQ ID NO: 2584630 - RNA, 17 nt, Human
gcccccucgugccaguc

SEQ ID NO: 2584631 - RNA, 14 nt, Human
gccccugccccguc

SEQ ID NO: 2584632 - RNA, 15 nt, Human
gccccugccccguca

SEQ ID NO: 2584633 - RNA, 16 nt, Human
gccccugccccgucac

SEQ ID NO: 2584634 - RNA, 20 nt, Human
gccccugccccgucaccauc

SEQ ID NO: 2584635 - RNA, 22 nt, Human
gccccugccccgucaccaucuc

SEQ ID NO: 2584636 - RNA, 14 nt, Human
gccccugcccggcu

SEQ ID NO: 2584637 - RNA, 13 nt, Human
gccccugcccggc

SEQ ID NO: 2584638 - RNA, 22 nt, Human
gccccuggaugcagccucacag

SEQ ID NO: 2584639 - RNA, 18 nt, Human
gccccuggaugcagccuc

SEQ ID NO: 2584640 - RNA, 16 nt, Human
gccccuggaugcagcc

SEQ ID NO: 2584641 - RNA, 22 nt, Human
gcccguugucucccuggcccuc

SEQ ID NO: 2584642 - RNA, 21 nt, Human
gcccguugucucccuggcccu

SEQ ID NO: 2584643 - RNA, 20 nt, Human
gcccguugucucccuggccc

SEQ ID NO: 2584644 - RNA, 19 nt, Human
gcccguugucucccuggcc

SEQ ID NO: 2584645 - RNA, 18 nt, Human
gcccguugucucccuggc

SEQ ID NO: 2584646 - RNA, 17 nt, Human
gcccguugucucccugg

SEQ ID NO: 2584647 - RNA, 16 nt, Human
gcccguugucucccug

SEQ ID NO: 2584648 - RNA, 17 nt, Human
gcccguugaggaugagg

SEQ ID NO: 2584649 - RNA, 22 nt, Human
gcccuaaaguguauuuuuuuac

SEQ ID NO: 2584650 - RNA, 20 nt, Human
gcccgugacauccccacccu

SEQ ID NO: 2584651 - RNA, 13 nt, Human
gcccguguggccc

SEQ ID NO: 2584652 - RNA, 19 nt, Human
gcccgugacagacuccuga

SEQ ID NO: 2584653 - RNA, 15 nt, Human
gcccguguggccccu

SEQ ID NO: 2584654 - RNA, 16 nt, Human
gcccguguggccccuu

SEQ ID NO: 2584655 - RNA, 17 nt, Human
gcccguguggccccuuc

SEQ ID NO: 2584656 - RNA, 18 nt, Human
gcccguguggccccuuca

SEQ ID NO: 2584657 - RNA, 19 nt, Human
gcccuagagcacacuguag

SEQ ID NO: 2584658 - RNA, 13 nt, Human
gcccuagagcaca

SEQ ID NO: 2584659 - RNA, 17 nt, Human
gcccuagagcacacugu

SEQ ID NO: 2584660 - RNA, 21 nt, Human
gcccuacuucuuugcuuugcc

SEQ ID NO: 2584661 - RNA, 23 nt, Human
gcccuaccagcgcccgcugggcu

SEQ ID NO: 2584662 - RNA, 22 nt, Human
gcccuaccagcgcccgcugggc

SEQ ID NO: 2584663 - RNA, 21 nt, Human
gcccuaccagcgcccgcuggg

SEQ ID NO: 2584664 - RNA, 20 nt, Human
gcccuaccagcgcccgcugg

SEQ ID NO: 2584665 - RNA, 14 nt, Human
gcccuacuauucag

SEQ ID NO: 2584666 - RNA, 21 nt, Human
gcccuacagaggucucugccg

SEQ ID NO: 2584667 - RNA, 20 nt, Human
gcccuacagaggucucugcc

SEQ ID NO: 2584668 - RNA, 13 nt, Human
gcccuaccagcgc

SEQ ID NO: 2584669 - RNA, 15 nt, Human
gcccuacaccuugag

SEQ ID NO: 2584670 - RNA, 16 nt, Human
gcccuacagaggucuc

SEQ ID NO: 2584671 - RNA, 19 nt, Human
gcccuaaaauuccacugcg

SEQ ID NO: 2584672 - RNA, 23 nt, Human
gcccguugucucccuggcccuca

SEQ ID NO: 2584673 - RNA, 15 nt, Human
gcccuaaaagcacac

SEQ ID NO: 2584674 - RNA, 23 nt, Human
gcccuaaugcgcaggcuggcccu

SEQ ID NO: 2584675 - RNA, 16 nt, Human
gccuacccacccccag

SEQ ID NO: 2584676 - RNA, 17 nt, Human
gccuacccacccccagg

SEQ ID NO: 2584677 - RNA, 18 nt, Human
gccggccucucuggccuc

SEQ ID NO: 2584678 - RNA, 16 nt, Human
gccggccucucuggcc

SEQ ID NO: 2584679 - RNA, 15 nt, Human
gccggccucucuggc

SEQ ID NO: 2584680 - RNA, 14 nt, Human
gccggccucucugg

SEQ ID NO: 2584681 - RNA, 19 nt, Human
gccuacaugcuuugugaac

SEQ ID NO: 2584682 - RNA, 18 nt, Human
gccggccaggugggcggg

SEQ ID NO: 2584683 - RNA, 13 nt, Human
gccggccaggugg

SEQ ID NO: 2584684 - RNA, 12 nt, Human
gccggcccuggg

SEQ ID NO: 2584685 - RNA, 20 nt, Human
gccggcccuggggcuaggcu

SEQ ID NO: 2584686 - RNA, 13 nt, Human
gccggccucucug

SEQ ID NO: 2584687 - RNA, 12 nt, Human
gccggccucucu

SEQ ID NO: 2584688 - RNA, 13 nt, Human
gccggcccugggg

SEQ ID NO: 2584689 - RNA, 14 nt, Human
gccggcccuggggc

SEQ ID NO: 2584690 - RNA, 14 nt, Human
gccuaccugcucuc

SEQ ID NO: 2584691 - RNA, 13 nt, Human
gccuaccugcucu

SEQ ID NO: 2584692 - RNA, 19 nt, Human
gccggccucucuggccucc

SEQ ID NO: 2584693 - RNA, 17 nt, Human
gccuacuccaaaauguu

SEQ ID NO: 2584694 - RNA, 12 nt, Human
gccuacucacga

SEQ ID NO: 2584695 - RNA, 17 nt, Human
gccuaccccgcagacac

SEQ ID NO: 2584696 - RNA, 14 nt, Human
gccuaccccgcaga

SEQ ID NO: 2584697 - RNA, 21 nt, Human
gccuaccccgcagacaccuug

SEQ ID NO: 2584698 - RNA, 22 nt, Human
gccuaccggcaauuuccggcca

SEQ ID NO: 2584699 - RNA, 19 nt, Human
gccucuuggaccucugcuc

SEQ ID NO: 2584700 - RNA, 18 nt, Human
gccucuuggaccucugcu

SEQ ID NO: 2584701 - RNA, 17 nt, Human
gccucuuggaccucugc

SEQ ID NO: 2584702 - RNA, 18 nt, Human
gccucuuggaaaaaguga

SEQ ID NO: 2584703 - RNA, 20 nt, Human
gccugcccaggccccugcca

SEQ ID NO: 2584704 - RNA, 19 nt, Human
gccugcccaggccccugcc

SEQ ID NO: 2584705 - RNA, 20 nt, Human
gccucuuggaccucugcucu

SEQ ID NO: 2584706 - RNA, 16 nt, Human
gccugccgguaaacac

SEQ ID NO: 2584707 - RNA, 16 nt, Human
gccugccuccagggcu

SEQ ID NO: 2584708 - RNA, 11 nt, Human
gccugccucca

SEQ ID NO: 2584709 - RNA, 21 nt, Human
gccugccgguaaacacgccug

SEQ ID NO: 2584710 - RNA, 18 nt, Human
gccugcccaggccccugc

SEQ ID NO: 2584711 - RNA, 17 nt, Human
gccugcccaggccccug

SEQ ID NO: 2584712 - RNA, 18 nt, Human
gccucuugagcaguggcu

SEQ ID NO: 2584713 - RNA, 20 nt, Human
gccucuugagcaguggcugg

SEQ ID NO: 2584714 - RNA, 19 nt, Human
gccucuugagcaguggcug

SEQ ID NO: 2584715 - RNA, 21 nt, Human
gccucuugagcaguggcuggu

SEQ ID NO: 2584716 - RNA, 20 nt, Human
gccucuugcggucccuucuu

SEQ ID NO: 2584717 - RNA, 17 nt, Human
gccucugugcugugugu

SEQ ID NO: 2584718 - RNA, 14 nt, Human
gccucugugcugug

SEQ ID NO: 2584719 - RNA, 12 nt, Human
gccucugugcug

SEQ ID NO: 2584720 - RNA, 11 nt, Human
gccucugugcu

SEQ ID NO: 2584721 - RNA, 19 nt, Human
gccucugugucacuggcug

SEQ ID NO: 2584722 - RNA, 16 nt, Human
gccucugugucacugg

SEQ ID NO: 2584723 - RNA, 15 nt, Human
gccucugugucacug

SEQ ID NO: 2584724 - RNA, 12 nt, Human
gccucuguguca

SEQ ID NO: 2584725 - RNA, 18 nt, Human
gccucugugcugugugug

SEQ ID NO: 2584726 - RNA, 21 nt, Human
gccucuguggagccccagcau

SEQ ID NO: 2584727 - RNA, 12 nt, Human
gccucuuccucc

SEQ ID NO: 2584728 - RNA, 22 nt, Human
gccucuuccucccucauuccac

SEQ ID NO: 2584729 - RNA, 15 nt, Human
gccucuguguccuuc

SEQ ID NO: 2584730 - RNA, 14 nt, Human
gccucuguguccuu

SEQ ID NO: 2584731 - RNA, 22 nt, Human
gccucugugucacuggcugccu

SEQ ID NO: 2584732 - RNA, 20 nt, Human
gccucugugucacuggcugc

SEQ ID NO: 2584733 - RNA, 21 nt, Human
gccucuguguccuucccugca

SEQ ID NO: 2584734 - RNA, 18 nt, Human
gccucuguguccuucccu

SEQ ID NO: 2584735 - RNA, 18 nt, Human
gccucuuaaagcugccug

SEQ ID NO: 2584736 - RNA, 16 nt, Human
gccucuucuucuucag

SEQ ID NO: 2584737 - RNA, 20 nt, Human
gccucuucuucuucagaaga

SEQ ID NO: 2584738 - RNA, 21 nt, Human
gccucuucuucuucagaagac

SEQ ID NO: 2584739 - RNA, 18 nt, Human
gccucuucugggagggca

SEQ ID NO: 2584740 - RNA, 15 nt, Human
gccucuucuucuuca

SEQ ID NO: 2584741 - RNA, 14 nt, Human
gccucuucugggag

SEQ ID NO: 2584742 - RNA, 15 nt, Human
gccucuucugggagg

SEQ ID NO: 2584743 - RNA, 17 nt, Human
gccucuguuugacaaac

SEQ ID NO: 2584744 - RNA, 19 nt, Human
gccucuuaaagcugccugu

SEQ ID NO: 2584745 - RNA, 17 nt, Human
gccucuucuagagccgu

SEQ ID NO: 2584746 - RNA, 12 nt, Human
gccucuucucua

SEQ ID NO: 2584747 - RNA, 23 nt, Human
gccucuucucuacucuagggaaa

SEQ ID NO: 2584748 - RNA, 16 nt, Human
gccuccucccuuagcu

SEQ ID NO: 2584749 - RNA, 23 nt, Human
gccuccucaucugggggagugga

SEQ ID NO: 2584750 - RNA, 14 nt, Human
gccuccucaucugg

SEQ ID NO: 2584751 - RNA, 22 nt, Human
gccuccucaucccguguucucc

SEQ ID NO: 2584752 - RNA, 17 nt, Human
gccuccucaucccgugu

SEQ ID NO: 2584753 - RNA, 16 nt, Human
gccuccuccuucccaa

SEQ ID NO: 2584754 - RNA, 13 nt, Human
gccuccuccugac

SEQ ID NO: 2584755 - RNA, 17 nt, Human
gccuccucccuuagcuc

SEQ ID NO: 2584756 - RNA, 18 nt, Human
gccuccugcccuuaccug

SEQ ID NO: 2584757 - RNA, 14 nt, Human
gccuccugccugcc

SEQ ID NO: 2584758 - RNA, 15 nt, Human
gccuccuccugacca

SEQ ID NO: 2584759 - RNA, 13 nt, Human
gccuccuccagcc

SEQ ID NO: 2584760 - RNA, 15 nt, Human
gccuccucaucccgu

SEQ ID NO: 2584761 - RNA, 12 nt, Human
gccuccucaucc

SEQ ID NO: 2584762 - RNA, 12 nt, Human
gccucugggacu

SEQ ID NO: 2584763 - RNA, 13 nt, Human
gccucuggcuaga

SEQ ID NO: 2584764 - RNA, 18 nt, Human
gccucuggcuagaggcca

SEQ ID NO: 2584765 - RNA, 19 nt, Human
gccucuggcuagaggccag

SEQ ID NO: 2584766 - RNA, 21 nt, Human
gccucuggcuagaggccagcc

SEQ ID NO: 2584767 - RNA, 22 nt, Human
gccucuggcuagaggccagccc

SEQ ID NO: 2584768 - RNA, 23 nt, Human
gccucuggcuagaggccagcccc

SEQ ID NO: 2584769 - RNA, 12 nt, Human
gccucugugccu

SEQ ID NO: 2584770 - RNA, 13 nt, Human
gccuccugugugu

SEQ ID NO: 2584771 - RNA, 17 nt, Human
gccucuggauuguggga

SEQ ID NO: 2584772 - RNA, 12 nt, Human
gccucuggcuag

SEQ ID NO: 2584773 - RNA, 15 nt, Human
gccucugcugccaug

SEQ ID NO: 2584774 - RNA, 12 nt, Human
gccucugcuggc

SEQ ID NO: 2584775 - RNA, 18 nt, Human
gccuccuguguagcuggg

SEQ ID NO: 2584776 - RNA, 13 nt, Human
gccuccuguguaa

SEQ ID NO: 2584777 - RNA, 23 nt, Human
gccuccugccugccccucucccg

SEQ ID NO: 2584778 - RNA, 17 nt, Human
gccuccugccugccccu

SEQ ID NO: 2584779 - RNA, 21 nt, Human
gccugcgccaccgcccagaga

SEQ ID NO: 2584780 - RNA, 16 nt, Human
gccugccuugaagcca

SEQ ID NO: 2584781 - RNA, 23 nt, Human
gccugccuugaagccacugaagc

SEQ ID NO: 2584782 - RNA, 17 nt, Human
gccugccuggcaggcug

SEQ ID NO: 2584783 - RNA, 16 nt, Human
gccugccuggcaggcu

SEQ ID NO: 2584784 - RNA, 15 nt, Human
gccugccuggcaggc

SEQ ID NO: 2584785 - RNA, 13 nt, Human
gccugccuggcag

SEQ ID NO: 2584786 - RNA, 14 nt, Human
gccugccuggagcg

SEQ ID NO: 2584787 - RNA, 13 nt, Human
gccugccuggagc

SEQ ID NO: 2584788 - RNA, 12 nt, Human
gccugccuggag

SEQ ID NO: 2584789 - RNA, 22 nt, Human
gccugccugucugucucuccau

SEQ ID NO: 2584790 - RNA, 16 nt, Human
gccugccugucugucu

SEQ ID NO: 2584791 - RNA, 14 nt, Human
gccugccugucugu

SEQ ID NO: 2584792 - RNA, 13 nt, Human
gccugccugucug

SEQ ID NO: 2584793 - RNA, 17 nt, Human
gccugccuguucccauu

SEQ ID NO: 2584794 - RNA, 18 nt, Human
gccugccuccagggcugg

SEQ ID NO: 2584795 - RNA, 17 nt, Human
gccugccuccagggcug

SEQ ID NO: 2584796 - RNA, 22 nt, Human
gccugccuccagggcuggacug

SEQ ID NO: 2584797 - RNA, 16 nt, Human
gccugccucuucucua

SEQ ID NO: 2584798 - RNA, 22 nt, Human
gccuggccccucagggucccug

SEQ ID NO: 2584799 - RNA, 20 nt, Human
gccuggccccucaggguccc

SEQ ID NO: 2584800 - RNA, 18 nt, Human
gccuggccggcaacccca

SEQ ID NO: 2584801 - RNA, 15 nt, Human
gccuggccggcaacc

SEQ ID NO: 2584802 - RNA, 13 nt, Human
gccuggcuucugg

SEQ ID NO: 2584803 - RNA, 10 nt, Human
gccuggccug

SEQ ID NO: 2584804 - RNA, 23 nt, Human
gccuggcuucuggagcccuuggg

SEQ ID NO: 2584805 - RNA, 18 nt, Human
gccuggcuucuggagccc

SEQ ID NO: 2584806 - RNA, 22 nt, Human
gccuggcuucuggagcccuugg

SEQ ID NO: 2584807 - RNA, 14 nt, Human
gccuggcuucugga

SEQ ID NO: 2584808 - RNA, 15 nt, Human
gccuggcuucuggag

SEQ ID NO: 2584809 - RNA, 16 nt, Human
gccuggcuucuggagc

SEQ ID NO: 2584810 - RNA, 17 nt, Human
gccuggcuucuggagcc

SEQ ID NO: 2584811 - RNA, 21 nt, Human
gccugggaggucaaggcugca

SEQ ID NO: 2584812 - RNA, 23 nt, Human
gccugggaauguauuauucugca

SEQ ID NO: 2584813 - RNA, 15 nt, Human
gccugggaauguauu

SEQ ID NO: 2584814 - RNA, 14 nt, Human
gccugggaucccuc

SEQ ID NO: 2584815 - RNA, 22 nt, Human
gccugggaggucaaggcugcag

SEQ ID NO: 2584816 - RNA, 18 nt, Human
gccugggaucccucaucc

SEQ ID NO: 2584817 - RNA, 21 nt, Human
gccugggaucccucauccuca

SEQ ID NO: 2584818 - RNA, 20 nt, Human
gccuguguccaugcgcucag

SEQ ID NO: 2584819 - RNA, 19 nt, Human
gccuguguccaugcgcuca

SEQ ID NO: 2584820 - RNA, 21 nt, Human
gccugugucccaugacccacc

SEQ ID NO: 2584821 - RNA, 20 nt, Human
gccugugucccaugacccac

SEQ ID NO: 2584822 - RNA, 19 nt, Human
gccugugucccaugaccca

SEQ ID NO: 2584823 - RNA, 15 nt, Human
gccugugucccauga

SEQ ID NO: 2584824 - RNA, 23 nt, Human
gccuguguccaugcgcucagggc

SEQ ID NO: 2584825 - RNA, 21 nt, Human
gccuguguccaugcgcucagg

SEQ ID NO: 2584826 - RNA, 23 nt, Human
gccugugucccaugacccacccc

SEQ ID NO: 2584827 - RNA, 22 nt, Human
gccugugucccaugacccaccc

SEQ ID NO: 2584828 - RNA, 21 nt, Human
gccugugugacaucaguggca

SEQ ID NO: 2584829 - RNA, 17 nt, Human
gccuggccccucagggu

SEQ ID NO: 2584830 - RNA, 16 nt, Human
gccuggccccucaggg

SEQ ID NO: 2584831 - RNA, 15 nt, Human
gccuggccccucagg

SEQ ID NO: 2584832 - RNA, 17 nt, Human
caaucagccuaguugau

SEQ ID NO: 2584833 - RNA, 15 nt, Human
caaucagcuccuucc

SEQ ID NO: 2584834 - RNA, 16 nt, Human
caaucagcuccuuccu

SEQ ID NO: 2584835 - RNA, 18 nt, Human
caaucagcuccuuccugg

SEQ ID NO: 2584836 - RNA, 13 nt, Human
caaugccaucauc

SEQ ID NO: 2584837 - RNA, 18 nt, Human
caaugccauccucaaaca

SEQ ID NO: 2584838 - RNA, 16 nt, Human
caaugccauccucaaa

SEQ ID NO: 2584839 - RNA, 14 nt, Human
caaugccaucaucu

SEQ ID NO: 2584840 - RNA, 20 nt, Human
caaugcccguaaugcuuaga

SEQ ID NO: 2584841 - RNA, 20 nt, Human
caaugccauccucaaacacu

SEQ ID NO: 2584842 - RNA, 15 nt, Human
caaucaacucuaaua

SEQ ID NO: 2584843 - RNA, 14 nt, Human
caaucaaaucugcu

SEQ ID NO: 2584844 - RNA, 17 nt, Human
caaucaaagcacuugga

SEQ ID NO: 2584845 - RNA, 12 nt, Human
caauauuuuucu

SEQ ID NO: 2584846 - RNA, 18 nt, Human
caaucaaaggaaaauagu

SEQ ID NO: 2584847 - RNA, 15 nt, Human
caauggcagccuugg

SEQ ID NO: 2584848 - RNA, 14 nt, Human
caauggcagccuug

SEQ ID NO: 2584849 - RNA, 20 nt, Human
caaugcugauguccucacca

SEQ ID NO: 2584850 - RNA, 13 nt, Human
caaugcugauguc

SEQ ID NO: 2584851 - RNA, 14 nt, Human
caaugcugauuugg

SEQ ID NO: 2584852 - RNA, 16 nt, Human
caaugcugauuuggug

SEQ ID NO: 2584853 - RNA, 21 nt, Human
caaugcugauuuggugaccaa

SEQ ID NO: 2584854 - RNA, 13 nt, Human
caauggcagccuu

SEQ ID NO: 2584855 - RNA, 13 nt, Human
caauugucuuuuu

SEQ ID NO: 2584856 - RNA, 14 nt, Human
caauuguaaauuga

SEQ ID NO: 2584857 - RNA, 14 nt, Human
caauugucauuuau

SEQ ID NO: 2584858 - RNA, 19 nt, Human
caauuguaaaacugaggca

SEQ ID NO: 2584859 - RNA, 16 nt, Human
caauugguuaaucuuu

SEQ ID NO: 2584860 - RNA, 22 nt, Human
caauugggauggcgcuaggcau

SEQ ID NO: 2584861 - RNA, 12 nt, Human
caauuggaggaa

SEQ ID NO: 2584862 - RNA, 12 nt, Human
caaugcuggcug

SEQ ID NO: 2584863 - RNA, 16 nt, Human
caauauuguacaguuu

SEQ ID NO: 2584864 - RNA, 15 nt, Human
caauauuguacaguu

SEQ ID NO: 2584865 - RNA, 17 nt, Human
caauauuuccucaugug

SEQ ID NO: 2584866 - RNA, 19 nt, Human
caauauuuccucaugugau

SEQ ID NO: 2584867 - RNA, 14 nt, Human
caauauuuccucau

SEQ ID NO: 2584868 - RNA, 13 nt, Human
caauauuuauuau

SEQ ID NO: 2584869 - RNA, 14 nt, Human
caauauuuauuauu

SEQ ID NO: 2584870 - RNA, 14 nt, Human
caauauuuaaacau

SEQ ID NO: 2584871 - RNA, 13 nt, Human
caauauuuaaaca

SEQ ID NO: 2584872 - RNA, 12 nt, Human
caauauuuauua

SEQ ID NO: 2584873 - RNA, 16 nt, Human
caauauugucauuccu

SEQ ID NO: 2584874 - RNA, 14 nt, Human
caauauuguuucua

SEQ ID NO: 2584875 - RNA, 18 nt, Human
caauauuguacaguuuuu

SEQ ID NO: 2584876 - RNA, 17 nt, Human
caauauuguacaguuuu

SEQ ID NO: 2584877 - RNA, 14 nt, Human
caauauuuuuagau

SEQ ID NO: 2584878 - RNA, 19 nt, Human
caauauuuucuuuaaugcu

SEQ ID NO: 2584879 - RNA, 20 nt, Human
caauauuuucuuuaaugcuu

SEQ ID NO: 2584880 - RNA, 16 nt, Human
caauauuuucuuuaau

SEQ ID NO: 2584881 - RNA, 22 nt, Human
caauauuuuccaugaaaaugca

SEQ ID NO: 2584882 - RNA, 20 nt, Human
caauauuuuccaugaaaaug

SEQ ID NO: 2584883 - RNA, 19 nt, Human
caauauuuuccaugaaaau

SEQ ID NO: 2584884 - RNA, 16 nt, Human
caauauuuuccaugaa

SEQ ID NO: 2584885 - RNA, 13 nt, Human
caauauuuguaga

SEQ ID NO: 2584886 - RNA, 14 nt, Human
caauauuuguagaa

SEQ ID NO: 2584887 - RNA, 15 nt, Human
caauauuuguagaag

SEQ ID NO: 2584888 - RNA, 15 nt, Human
caauauuuuccauga

SEQ ID NO: 2584889 - RNA, 13 nt, Human
caauauuuuccau

SEQ ID NO: 2584890 - RNA, 11 nt, Human
caauauuuucc

SEQ ID NO: 2584891 - RNA, 12 nt, Human
cacaaggacuuc

SEQ ID NO: 2584892 - RNA, 14 nt, Human
cacaaggacuuccu

SEQ ID NO: 2584893 - RNA, 16 nt, Human
cacaaggacuuccugu

SEQ ID NO: 2584894 - RNA, 22 nt, Human
cacaaggacuuccuguccagcu

SEQ ID NO: 2584895 - RNA, 17 nt, Human
cacaaggauagaugcug

SEQ ID NO: 2584896 - RNA, 18 nt, Human
cacaaggauagaugcugg

SEQ ID NO: 2584897 - RNA, 21 nt, Human
cacaaggauagaugcuggccc

SEQ ID NO: 2584898 - RNA, 22 nt, Human
cacaaggauagaugcuggccca

SEQ ID NO: 2584899 - RNA, 14 nt, Human
caauuucagacucc

SEQ ID NO: 2584900 - RNA, 12 nt, Human
cacaagcuggaa

SEQ ID NO: 2584901 - RNA, 11 nt, Human
caauuucaagu

SEQ ID NO: 2584902 - RNA, 16 nt, Human
cacaagcuggaagcac

SEQ ID NO: 2584903 - RNA, 14 nt, Human
cacaagcuggaagc

SEQ ID NO: 2584904 - RNA, 13 nt, Human
cacaagcuggaag

SEQ ID NO: 2584905 - RNA, 15 nt, Human
cacaagcuggaagca

SEQ ID NO: 2584906 - RNA, 20 nt, Human
caauuuauuauggcacauca

SEQ ID NO: 2584907 - RNA, 16 nt, Human
caauugucauuuauaa

SEQ ID NO: 2584908 - RNA, 15 nt, Human
caauugucauuuaua

SEQ ID NO: 2584909 - RNA, 18 nt, Human
caauugugagccaccacg

SEQ ID NO: 2584910 - RNA, 21 nt, Human
caauugugagccaccacgucc

SEQ ID NO: 2584911 - RNA, 13 nt, Human
caauuuauuaugg

SEQ ID NO: 2584912 - RNA, 17 nt, Human
caauugucauuuauaaa

SEQ ID NO: 2584913 - RNA, 14 nt, Human
caauuuauucaaga

SEQ ID NO: 2584914 - RNA, 17 nt, Human
caauuuauucaagaaaa

SEQ ID NO: 2584915 - RNA, 20 nt, Human
caauuucaaaaaaauaaaau

SEQ ID NO: 2584916 - RNA, 21 nt, Human
caauuucaaaaaaauaaaaua

SEQ ID NO: 2584917 - RNA, 18 nt, Human
caaguuccaaguugcuaa

SEQ ID NO: 2584918 - RNA, 21 nt, Human
caaguuccucuagugcccucc

SEQ ID NO: 2584919 - RNA, 17 nt, Human
caaguucaaucuguuuu

SEQ ID NO: 2584920 - RNA, 12 nt, Human
caaguucaaucu

SEQ ID NO: 2584921 - RNA, 19 nt, Human
caaguauuugggaagugaa

SEQ ID NO: 2584922 - RNA, 22 nt, Human
caaguauuugggaagugaagac

SEQ ID NO: 2584923 - RNA, 20 nt, Human
caaguuauuguacagcuguu

SEQ ID NO: 2584924 - RNA, 12 nt, Human
caaguuauugua

SEQ ID NO: 2584925 - RNA, 19 nt, Human
caaguuauugacaaacucu

SEQ ID NO: 2584926 - RNA, 17 nt, Human
caagcucccaggcauuc

SEQ ID NO: 2584927 - RNA, 15 nt, Human
caagcucccaggcau

SEQ ID NO: 2584928 - RNA, 14 nt, Human
caagcucccaggca

SEQ ID NO: 2584929 - RNA, 12 nt, Human
caagcucccagg

SEQ ID NO: 2584930 - RNA, 23 nt, Human
caagcuccuccucccugcaucug

SEQ ID NO: 2584931 - RNA, 14 nt, Human
caagcuccuccucc

SEQ ID NO: 2584932 - RNA, 15 nt, Human
caagcuccuccuccc

SEQ ID NO: 2584933 - RNA, 16 nt, Human
caagcuccuccucccu

SEQ ID NO: 2584934 - RNA, 17 nt, Human
caagcuccuccucccug

SEQ ID NO: 2584935 - RNA, 16 nt, Human
caagcucugcuccucu

SEQ ID NO: 2584936 - RNA, 14 nt, Human
caagcucccaggcc

SEQ ID NO: 2584937 - RNA, 20 nt, Human
caagcuccgccucccggguu

SEQ ID NO: 2584938 - RNA, 15 nt, Human
caagcucugcuccuc

SEQ ID NO: 2584939 - RNA, 18 nt, Human
caagcuccaagcucccag

SEQ ID NO: 2584940 - RNA, 17 nt, Human
caagcuccaagcuccca

SEQ ID NO: 2584941 - RNA, 21 nt, Human
caagcuccaagcucccaggca

SEQ ID NO: 2584942 - RNA, 19 nt, Human
caagcuccaagcucccagg

SEQ ID NO: 2584943 - RNA, 17 nt, Human
caagcuccaucuccacu

SEQ ID NO: 2584944 - RNA, 22 nt, Human
caagcucccaagggauggugcc

SEQ ID NO: 2584945 - RNA, 18 nt, Human
caagcucccaagggaugg

SEQ ID NO: 2584946 - RNA, 13 nt, Human
caagcucccaagg

SEQ ID NO: 2584947 - RNA, 21 nt, Human
caagcuccaucuccacuccag

SEQ ID NO: 2584948 - RNA, 17 nt, Human
caaguauuauaccuuuu

SEQ ID NO: 2584949 - RNA, 22 nt, Human
caaguauuauaccuuuuuuaga

SEQ ID NO: 2584950 - RNA, 13 nt, Human
caaguauuauacc

SEQ ID NO: 2584951 - RNA, 18 nt, Human
caaguaagaagacaugaa

SEQ ID NO: 2584952 - RNA, 14 nt, Human
caaguaagaagaca

SEQ ID NO: 2584953 - RNA, 16 nt, Human
caaguaagaagacaug

SEQ ID NO: 2584954 - RNA, 13 nt, Human
caaguaaacauuc

SEQ ID NO: 2584955 - RNA, 13 nt, Human
caaguaagaagac

SEQ ID NO: 2584956 - RNA, 22 nt, Human
caaguaagaagacaugaaccaa

SEQ ID NO: 2584957 - RNA, 19 nt, Human
caagguuuuauaaggcuga

SEQ ID NO: 2584958 - RNA, 24 nt, Human
caagguuuaggcugguggcccagg

SEQ ID NO: 2584959 - RNA, 22 nt, Human
caagguuuaggcugguggccca

SEQ ID NO: 2584960 - RNA, 23 nt, Human
caagguuuaggcugguggcccag

SEQ ID NO: 2584961 - RNA, 21 nt, Human
caagguuuaggcugguggccc

SEQ ID NO: 2584962 - RNA, 20 nt, Human
caagguuuaggcugguggcc

SEQ ID NO: 2584963 - RNA, 16 nt, Human
caaggccccagagacu

SEQ ID NO: 2584964 - RNA, 17 nt, Human
caaggccccagagacuc

SEQ ID NO: 2584965 - RNA, 22 nt, Human
caaggcccccgggccgacggag

SEQ ID NO: 2584966 - RNA, 21 nt, Human
caaggccccagagacucagag

SEQ ID NO: 2584967 - RNA, 14 nt, Human
caaggccccagaga

SEQ ID NO: 2584968 - RNA, 15 nt, Human
caaggccccagagac

SEQ ID NO: 2584969 - RNA, 12 nt, Human
caaggccccaga

SEQ ID NO: 2584970 - RNA, 14 nt, Human
caaggccaucuggg

SEQ ID NO: 2584971 - RNA, 17 nt, Human
caaggccaucugggcuc

SEQ ID NO: 2584972 - RNA, 23 nt, Human
caaggccauccuucccugucugc

SEQ ID NO: 2584973 - RNA, 17 nt, Human
caaggccauccuucccu

SEQ ID NO: 2584974 - RNA, 20 nt, Human
caaggauugcuacuguccua

SEQ ID NO: 2584975 - RNA, 22 nt, Human
caagcuccuccucccugcaucu

SEQ ID NO: 2584976 - RNA, 19 nt, Human
caaggauugcuacuguccu

SEQ ID NO: 2584977 - RNA, 14 nt, Human
caaggcaaggcugu

SEQ ID NO: 2584978 - RNA, 15 nt, Human
caaggcaaggcaggu

SEQ ID NO: 2584979 - RNA, 14 nt, Human
caaggcaaggcagg

SEQ ID NO: 2584980 - RNA, 17 nt, Human
caaggccagaguggccu

SEQ ID NO: 2584981 - RNA, 18 nt, Human
caaggcaaggcaggugcc

SEQ ID NO: 2584982 - RNA, 16 nt, Human
caaggcaaggcaggug

SEQ ID NO: 2584983 - RNA, 18 nt, Human
caaggccagaguggccug

SEQ ID NO: 2584984 - RNA, 19 nt, Human
caaggccagaguggccugg

SEQ ID NO: 2584985 - RNA, 20 nt, Human
caaggccagaguggccuggc

SEQ ID NO: 2584986 - RNA, 21 nt, Human
caaggccagaguggccuggcc

SEQ ID NO: 2584987 - RNA, 22 nt, Human
caaggccagaguggccuggcca

SEQ ID NO: 2584988 - RNA, 15 nt, Human
caaggccauccuucc

SEQ ID NO: 2584989 - RNA, 16 nt, Human
caaccccuucgcuccu

SEQ ID NO: 2584990 - RNA, 14 nt, Human
caaccccuucgcuc

SEQ ID NO: 2584991 - RNA, 17 nt, Human
caaccccuucgcuccug

SEQ ID NO: 2584992 - RNA, 21 nt, Human
caaccccuguggagcccgcac

SEQ ID NO: 2584993 - RNA, 17 nt, Human
caacuaggcuucagcau

SEQ ID NO: 2584994 - RNA, 16 nt, Human
caaccccuguggagcc

SEQ ID NO: 2584995 - RNA, 20 nt, Human
caacccccagcacccgggcu

SEQ ID NO: 2584996 - RNA, 22 nt, Human
caaccccuguggagcccgcacc

SEQ ID NO: 2584997 - RNA, 19 nt, Human
caacuaucucauuuccaag

SEQ ID NO: 2584998 - RNA, 19 nt, Human
caacuauauuguuugcuaa

SEQ ID NO: 2584999 - RNA, 13 nt, Human
caacuauggccug

SEQ ID NO: 2585000 - RNA, 19 nt, Human
caacuauaagcccacuguu

SEQ ID NO: 2585001 - RNA, 18 nt, Human
caacuauauuaucaugca

SEQ ID NO: 2585002 - RNA, 19 nt, Human
caacuauauuaucaugcaa

SEQ ID NO: 2585003 - RNA, 23 nt, Human
caaccccagccgcucggaggccc

SEQ ID NO: 2585004 - RNA, 15 nt, Human
caaccccagccgcuc

SEQ ID NO: 2585005 - RNA, 14 nt, Human
caaccccagccgcu

SEQ ID NO: 2585006 - RNA, 14 nt, Human
caacccccagccug

SEQ ID NO: 2585007 - RNA, 17 nt, Human
caacccccaccccacac

SEQ ID NO: 2585008 - RNA, 18 nt, Human
caacccccaccccacacu

SEQ ID NO: 2585009 - RNA, 15 nt, Human
caacccccagcaccc

SEQ ID NO: 2585010 - RNA, 13 nt, Human
caacccccagcac

SEQ ID NO: 2585011 - RNA, 23 nt, Human
caacccccaccccacacuuguuc

SEQ ID NO: 2585012 - RNA, 22 nt, Human
caaccccaguucugcuccucuc

SEQ ID NO: 2585013 - RNA, 20 nt, Human
caaccccaguucugcuccuc

SEQ ID NO: 2585014 - RNA, 19 nt, Human
caaccccaguucugcuccu

SEQ ID NO: 2585015 - RNA, 17 nt, Human
caaccccaguucugcuc

SEQ ID NO: 2585016 - RNA, 14 nt, Human
caaccccaguucug

SEQ ID NO: 2585017 - RNA, 13 nt, Human
caaccccaguucu

SEQ ID NO: 2585018 - RNA, 13 nt, Human
caaccccaggcug

SEQ ID NO: 2585019 - RNA, 11 nt, Human
caacccccacc

SEQ ID NO: 2585020 - RNA, 12 nt, Human
caacccccaccc

SEQ ID NO: 2585021 - RNA, 13 nt, Human
caacccccacccc

SEQ ID NO: 2585022 - RNA, 14 nt, Human
caacccccacccca

SEQ ID NO: 2585023 - RNA, 15 nt, Human
caacuauuuuuccaa

SEQ ID NO: 2585024 - RNA, 12 nt, Human
caacuccagaaa

SEQ ID NO: 2585025 - RNA, 16 nt, Human
caacuauggaucagaa

SEQ ID NO: 2585026 - RNA, 17 nt, Human
caacuauggaucagaau

SEQ ID NO: 2585027 - RNA, 14 nt, Human
caacuauggccugu

SEQ ID NO: 2585028 - RNA, 15 nt, Human
caagaagcccaggaa

SEQ ID NO: 2585029 - RNA, 19 nt, Human
caacuccuagggccacuga

SEQ ID NO: 2585030 - RNA, 21 nt, Human
caacucccugccccccagccc

SEQ ID NO: 2585031 - RNA, 19 nt, Human
caacucccugccccccagc

SEQ ID NO: 2585032 - RNA, 20 nt, Human
caacucccugccccccagcc

SEQ ID NO: 2585033 - RNA, 17 nt, Human
caacuccaguagcuugg

SEQ ID NO: 2585034 - RNA, 14 nt, Human
caagacaugucugu

SEQ ID NO: 2585035 - RNA, 15 nt, Human
caagacaugucuguu

SEQ ID NO: 2585036 - RNA, 17 nt, Human
caagacaugucuguucu

SEQ ID NO: 2585037 - RNA, 15 nt, Human
caagacauuaaaucu

SEQ ID NO: 2585038 - RNA, 11 nt, Human
caagacauugu

SEQ ID NO: 2585039 - RNA, 13 nt, Human
caagacauuguca

SEQ ID NO: 2585040 - RNA, 14 nt, Human
caagacauugucaa

SEQ ID NO: 2585041 - RNA, 17 nt, Human
caagacauugucaauaa

SEQ ID NO: 2585042 - RNA, 18 nt, Human
caagacauugucaauaaa

SEQ ID NO: 2585043 - RNA, 23 nt, Human
caagaaucagucuauccacagag

SEQ ID NO: 2585044 - RNA, 18 nt, Human
caagaaucagugcaaaga

SEQ ID NO: 2585045 - RNA, 19 nt, Human
caagaaucagugcaaagau

SEQ ID NO: 2585046 - RNA, 17 nt, Human
caagaaggaugauucaa

SEQ ID NO: 2585047 - RNA, 18 nt, Human
caagaagcccaggaaagg

SEQ ID NO: 2585048 - RNA, 21 nt, Human
caagaagcgugagacgccacc

SEQ ID NO: 2585049 - RNA, 15 nt, Human
caagaagccuuuccu

SEQ ID NO: 2585050 - RNA, 22 nt, Human
caagaagcuuuaauauuuaaau

SEQ ID NO: 2585051 - RNA, 20 nt, Human
caagaauaaucacgcuuucc

SEQ ID NO: 2585052 - RNA, 21 nt, Human
caagaauaaucacgcuuuccu

SEQ ID NO: 2585053 - RNA, 22 nt, Human
caagaauaaucacgcuuuccug

SEQ ID NO: 2585054 - RNA, 23 nt, Human
caagaauaaucacgcuuuccuga

SEQ ID NO: 2585055 - RNA, 18 nt, Human
caagaauagaugcugacu

SEQ ID NO: 2585056 - RNA, 13 nt, Human
caagcaccuccug

SEQ ID NO: 2585057 - RNA, 21 nt, Human
caagcacagugguggcagggc

SEQ ID NO: 2585058 - RNA, 20 nt, Human
caagcacagugguggcaggg

SEQ ID NO: 2585059 - RNA, 19 nt, Human
caagcacagugguggcagg

SEQ ID NO: 2585060 - RNA, 16 nt, Human
caagcacagugguggc

SEQ ID NO: 2585061 - RNA, 17 nt, Human
caagcacaucugcauuu

SEQ ID NO: 2585062 - RNA, 20 nt, Human
caagcacaucugcauuuuca

SEQ ID NO: 2585063 - RNA, 12 nt, Human
caagcacagcag

SEQ ID NO: 2585064 - RNA, 13 nt, Human
caagcacagcagc

SEQ ID NO: 2585065 - RNA, 14 nt, Human
caagcacagcagcc

SEQ ID NO: 2585066 - RNA, 17 nt, Human
caagcacagcagccugg

SEQ ID NO: 2585067 - RNA, 15 nt, Human
caagcacaguggugg

SEQ ID NO: 2585068 - RNA, 13 nt, Human
caagcacaguggu

SEQ ID NO: 2585069 - RNA, 17 nt, Human
caagcacagugccugca

SEQ ID NO: 2585070 - RNA, 18 nt, Human
caagcaccuagccucgcu

SEQ ID NO: 2585071 - RNA, 14 nt, Human
caagcaccuccugc

SEQ ID NO: 2585072 - RNA, 14 nt, Human
caagaccacguuuc

SEQ ID NO: 2585073 - RNA, 16 nt, Human
caagaccacguuucua

SEQ ID NO: 2585074 - RNA, 16 nt, Human
caagauauuuauauau

SEQ ID NO: 2585075 - RNA, 18 nt, Human
caagaucauguaccccaa

SEQ ID NO: 2585076 - RNA, 19 nt, Human
caagauccugucuuuaagg

SEQ ID NO: 2585077 - RNA, 21 nt, Human
caagauauuuuaaaaucuguc

SEQ ID NO: 2585078 - RNA, 23 nt, Human
caagauauuuuaaaaucugucac

SEQ ID NO: 2585079 - RNA, 19 nt, Human
caagaccaccacuucgaaa

SEQ ID NO: 2585080 - RNA, 18 nt, Human
caagaugaaggagaggca

SEQ ID NO: 2585081 - RNA, 15 nt, Human
caagaucuuucagga

SEQ ID NO: 2585082 - RNA, 19 nt, Human
caagaugagagaacuggag

SEQ ID NO: 2585083 - RNA, 15 nt, Human
caagaucugugcagc

SEQ ID NO: 2585084 - RNA, 16 nt, Human
caagaucgcgccacug

SEQ ID NO: 2585085 - RNA, 22 nt, Human
caagauccugucuuuaaggaaa

SEQ ID NO: 2585086 - RNA, 20 nt, Human
caagaucugugcagccccgc

SEQ ID NO: 2585087 - RNA, 12 nt, Human
caagaucuuuca

SEQ ID NO: 2585088 - RNA, 13 nt, Human
caagaucuuucag

SEQ ID NO: 2585089 - RNA, 14 nt, Human
caagaucuuucagg

SEQ ID NO: 2585090 - RNA, 19 nt, Human
caagauuuuccuuuuuuau

SEQ ID NO: 2585091 - RNA, 17 nt, Human
caagauuuuccuuuuuu

SEQ ID NO: 2585092 - RNA, 16 nt, Human
caagauuuuccuuuuu

SEQ ID NO: 2585093 - RNA, 15 nt, Human
caagauuuuccuuuu

SEQ ID NO: 2585094 - RNA, 12 nt, Human
caagauuuuccu

SEQ ID NO: 2585095 - RNA, 18 nt, Human
caagauuuuccacaagau

SEQ ID NO: 2585096 - RNA, 22 nt, Human
caagauuuuccuuuuuuauaca

SEQ ID NO: 2585097 - RNA, 21 nt, Human
caagauuuuccuuuuuuauac

SEQ ID NO: 2585098 - RNA, 22 nt, Human
caagauuuugaaugcuuccuga

SEQ ID NO: 2585099 - RNA, 16 nt, Human
caagcaaaaggagaga

SEQ ID NO: 2585100 - RNA, 14 nt, Human
caagcaaguauuag

SEQ ID NO: 2585101 - RNA, 23 nt, Human
caagcaagcucccaagggauggu

SEQ ID NO: 2585102 - RNA, 12 nt, Human
caagcaagcucc

SEQ ID NO: 2585103 - RNA, 13 nt, Human
caagcaagaaaca

SEQ ID NO: 2585104 - RNA, 17 nt, Human
caagcaaccugggucca

SEQ ID NO: 2585105 - RNA, 16 nt, Human
caagcaaccugggucc

SEQ ID NO: 2585106 - RNA, 19 nt, Human
caagcaaaggugaagagac

SEQ ID NO: 2585107 - RNA, 18 nt, Human
caagcaagaaacacuggg

SEQ ID NO: 2585108 - RNA, 22 nt, Human
caagcaaccuggguccaaauaa

SEQ ID NO: 2585109 - RNA, 19 nt, Human
caagcaaccuggguccaaa

SEQ ID NO: 2585110 - RNA, 19 nt, Human
caagcaaaugugaaucauu

SEQ ID NO: 2585111 - RNA, 17 nt, Human
caagcaaaugugaauca

SEQ ID NO: 2585112 - RNA, 15 nt, Human
caagcaaaugugaau

SEQ ID NO: 2585113 - RNA, 23 nt, Human
caagcaaaaucauggaaugguua

SEQ ID NO: 2585114 - RNA, 22 nt, Human
caagcaaaaucauggaaugguu

SEQ ID NO: 2585115 - RNA, 14 nt, Human
caagcaaaaucaug

SEQ ID NO: 2585116 - RNA, 17 nt, Human
caagauuuucuacuuuu

SEQ ID NO: 2585117 - RNA, 13 nt, Human
cacaucagcuugc

SEQ ID NO: 2585118 - RNA, 23 nt, Human
cacaucagcuugcccuguuaaaa

SEQ ID NO: 2585119 - RNA, 17 nt, Human
cacaucagucacaaguu

SEQ ID NO: 2585120 - RNA, 22 nt, Human
cacaucuugcucugcugacaga

SEQ ID NO: 2585121 - RNA, 21 nt, Human
cacaucuugcucugcugacag

SEQ ID NO: 2585122 - RNA, 20 nt, Human
cacaucuugcucugcugaca

SEQ ID NO: 2585123 - RNA, 15 nt, Human
cacaucuugcucugc

SEQ ID NO: 2585124 - RNA, 20 nt, Human
cacaucuugaucugcucagc

SEQ ID NO: 2585125 - RNA, 22 nt, Human
cacaucuucccuagaggguucc

SEQ ID NO: 2585126 - RNA, 23 nt, Human
cacauccauuucaucuauuucug

SEQ ID NO: 2585127 - RNA, 21 nt, Human
cacauccauuucaucuauuuc

SEQ ID NO: 2585128 - RNA, 21 nt, Human
cacauccacacacgcaggaac

SEQ ID NO: 2585129 - RNA, 14 nt, Human
cacaucuugcucug

SEQ ID NO: 2585130 - RNA, 13 nt, Human
cacaucuugcucu

SEQ ID NO: 2585131 - RNA, 23 nt, Human
cacccagugagcacucccaaguc

SEQ ID NO: 2585132 - RNA, 20 nt, Human
cacccagugagcacucccaa

SEQ ID NO: 2585133 - RNA, 17 nt, Human
cacccagugagcacucc

SEQ ID NO: 2585134 - RNA, 17 nt, Human
cacccagucuguucccc

SEQ ID NO: 2585135 - RNA, 13 nt, Human
cacccaucuguuu

SEQ ID NO: 2585136 - RNA, 18 nt, Human
cacccaucuguuuuuugu

SEQ ID NO: 2585137 - RNA, 23 nt, Human
cacccauccuaccaaugcaugca

SEQ ID NO: 2585138 - RNA, 22 nt, Human
cacccauccuaccaaugcaugc

SEQ ID NO: 2585139 - RNA, 23 nt, Human
cacccauccuaucagccugucuc

SEQ ID NO: 2585140 - RNA, 15 nt, Human
cacccaugaagacag

SEQ ID NO: 2585141 - RNA, 14 nt, Human
cacccaugaagaca

SEQ ID NO: 2585142 - RNA, 21 nt, Human
cacccagaugggggaaagcac

SEQ ID NO: 2585143 - RNA, 21 nt, Human
cacccacucuccucugccuca

SEQ ID NO: 2585144 - RNA, 14 nt, Human
cacccagacagcuc

SEQ ID NO: 2585145 - RNA, 16 nt, Human
cacccagacagcuccc

SEQ ID NO: 2585146 - RNA, 22 nt, Human
cacccagacagcucccucugcc

SEQ ID NO: 2585147 - RNA, 23 nt, Human
caccaggcacgaacccaccugcu

SEQ ID NO: 2585148 - RNA, 24 nt, Human
caccaggcacgaacccaccugcug

SEQ ID NO: 2585149 - RNA, 15 nt, Human
cacccacucagcucc

SEQ ID NO: 2585150 - RNA, 19 nt, Human
caccaggcacgaacccacc

SEQ ID NO: 2585151 - RNA, 20 nt, Human
caccaggcacgaacccaccu

SEQ ID NO: 2585152 - RNA, 21 nt, Human
caccaggcacgaacccaccug

SEQ ID NO: 2585153 - RNA, 22 nt, Human
caccaggcacgaacccaccugc

SEQ ID NO: 2585154 - RNA, 23 nt, Human
caccaggcaccucacagaaauga

SEQ ID NO: 2585155 - RNA, 22 nt, Human
caccaggcaccucacagaaaug

SEQ ID NO: 2585156 - RNA, 20 nt, Human
caccaggcaccucacagaaa

SEQ ID NO: 2585157 - RNA, 21 nt, Human
caccaggauggcccuucccac

SEQ ID NO: 2585158 - RNA, 13 nt, Human
caccaggauggcc

SEQ ID NO: 2585159 - RNA, 15 nt, Human
caccaggauggcccu

SEQ ID NO: 2585160 - RNA, 23 nt, Human
caccaggaauguuaaagucagug

SEQ ID NO: 2585161 - RNA, 20 nt, Human
cacccaggcuggaguacagu

SEQ ID NO: 2585162 - RNA, 20 nt, Human
cacccaggcuggagugcaau

SEQ ID NO: 2585163 - RNA, 12 nt, Human
cacccagcccac

SEQ ID NO: 2585164 - RNA, 18 nt, Human
cacccagcaacuccaacu

SEQ ID NO: 2585165 - RNA, 11 nt, Human
cacccagccca

SEQ ID NO: 2585166 - RNA, 10 nt, Human
cacccagccc

SEQ ID NO: 2585167 - RNA, 16 nt, Human
cacauuuaagagacag

SEQ ID NO: 2585168 - RNA, 15 nt, Human
caccagccccugccc

SEQ ID NO: 2585169 - RNA, 14 nt, Human
caccagccccugcc

SEQ ID NO: 2585170 - RNA, 13 nt, Human
caccagccccugc

SEQ ID NO: 2585171 - RNA, 22 nt, Human
caccagccccagugcccacagg

SEQ ID NO: 2585172 - RNA, 21 nt, Human
caccagccccagugcccacag

SEQ ID NO: 2585173 - RNA, 18 nt, Human
caccagccccagugccca

SEQ ID NO: 2585174 - RNA, 18 nt, Human
caccagcccggccugcuc

SEQ ID NO: 2585175 - RNA, 17 nt, Human
caccagcccggccugcu

SEQ ID NO: 2585176 - RNA, 16 nt, Human
caccagcccggccugc

SEQ ID NO: 2585177 - RNA, 15 nt, Human
caccagcccggccug

SEQ ID NO: 2585178 - RNA, 21 nt, Human
caccagccccugccccagccc

SEQ ID NO: 2585179 - RNA, 19 nt, Human
caccagccccugccccagc

SEQ ID NO: 2585180 - RNA, 17 nt, Human
caccagccccugcccca

SEQ ID NO: 2585181 - RNA, 16 nt, Human
caccagccccugcccc

SEQ ID NO: 2585182 - RNA, 19 nt, Human
caccagcccuuagcaggga

SEQ ID NO: 2585183 - RNA, 19 nt, Human
caccagcccggccugcucc

SEQ ID NO: 2585184 - RNA, 17 nt, Human
caccaggaaccucuuca

SEQ ID NO: 2585185 - RNA, 11 nt, Human
caccaggaagg

SEQ ID NO: 2585186 - RNA, 12 nt, Human
caccaggaaugu

SEQ ID NO: 2585187 - RNA, 17 nt, Human
caccaggaauguuaaag

SEQ ID NO: 2585188 - RNA, 21 nt, Human
caccaggaauguuaaagucag

SEQ ID NO: 2585189 - RNA, 16 nt, Human
caccaggagaaccacu

SEQ ID NO: 2585190 - RNA, 17 nt, Human
caccaggagaaccacua

SEQ ID NO: 2585191 - RNA, 19 nt, Human
caccaggagaaccacuaca

SEQ ID NO: 2585192 - RNA, 17 nt, Human
caccaggagucccuggu

SEQ ID NO: 2585193 - RNA, 17 nt, Human
caccagccccagugccc

SEQ ID NO: 2585194 - RNA, 18 nt, Human
cacauuuauucugcucac

SEQ ID NO: 2585195 - RNA, 19 nt, Human
cacauuuaagagacaguca

SEQ ID NO: 2585196 - RNA, 23 nt, Human
cacauuguuuuaaaaagaaacaa

SEQ ID NO: 2585197 - RNA, 18 nt, Human
cacauuguuuuaaaaaga

SEQ ID NO: 2585198 - RNA, 16 nt, Human
cacauuguuuuaaaaa

SEQ ID NO: 2585199 - RNA, 15 nt, Human
cacauuguuuuaaaa

SEQ ID NO: 2585200 - RNA, 17 nt, Human
cacauuuauucugcuca

SEQ ID NO: 2585201 - RNA, 12 nt, Human
cacauuguuuua

SEQ ID NO: 2585202 - RNA, 15 nt, Human
cacaucuuuccuguc

SEQ ID NO: 2585203 - RNA, 14 nt, Human
cacaucuuuccugu

SEQ ID NO: 2585204 - RNA, 18 nt, Human
cacaugaaaccuuauuuu

SEQ ID NO: 2585205 - RNA, 12 nt, Human
cacaucuuucac

SEQ ID NO: 2585206 - RNA, 18 nt, Human
cacaucuuucacacuucc

SEQ ID NO: 2585207 - RNA, 19 nt, Human
cacaucuuucacacuucca

SEQ ID NO: 2585208 - RNA, 21 nt, Human
cacaucuuucacacuuccacc

SEQ ID NO: 2585209 - RNA, 22 nt, Human
cacaucuuuaucuguucuugcu

SEQ ID NO: 2585210 - RNA, 15 nt, Human
cacaucuuuaucugu

SEQ ID NO: 2585211 - RNA, 13 nt, Human
cacaucuuggcac

SEQ ID NO: 2585212 - RNA, 23 nt, Human
cacaucuugcucugcugacagac

SEQ ID NO: 2585213 - RNA, 21 nt, Human
caccugccccucaacucuccu

SEQ ID NO: 2585214 - RNA, 18 nt, Human
caccugccccucaacucu

SEQ ID NO: 2585215 - RNA, 12 nt, Human
caccugcccugc

SEQ ID NO: 2585216 - RNA, 13 nt, Human
caccugcccugcc

SEQ ID NO: 2585217 - RNA, 22 nt, Human
caccugccagccuggcuucugg

SEQ ID NO: 2585218 - RNA, 12 nt, Human
caccugccaggg

SEQ ID NO: 2585219 - RNA, 11 nt, Human
caccugccagg

SEQ ID NO: 2585220 - RNA, 20 nt, Human
caccuaucucgugggagagc

SEQ ID NO: 2585221 - RNA, 18 nt, Human
caccuaucucgugggaga

SEQ ID NO: 2585222 - RNA, 16 nt, Human
caccuauagucccagc

SEQ ID NO: 2585223 - RNA, 13 nt, Human
caccugccagccu

SEQ ID NO: 2585224 - RNA, 14 nt, Human
caccugccagccug

SEQ ID NO: 2585225 - RNA, 15 nt, Human
caccugccagccugg

SEQ ID NO: 2585226 - RNA, 16 nt, Human
caccugccagccuggc

SEQ ID NO: 2585227 - RNA, 17 nt, Human
caccugccagccuggcu

SEQ ID NO: 2585228 - RNA, 20 nt, Human
caccugccagccuggcuucu

SEQ ID NO: 2585229 - RNA, 20 nt, Human
cacccuggggccuggaccug

SEQ ID NO: 2585230 - RNA, 19 nt, Human
cacccuggggccuggaccu

SEQ ID NO: 2585231 - RNA, 15 nt, Human
cacccuggggccugg

SEQ ID NO: 2585232 - RNA, 14 nt, Human
cacccuggggccug

SEQ ID NO: 2585233 - RNA, 22 nt, Human
cacccuggggccuggaccugcc

SEQ ID NO: 2585234 - RNA, 21 nt, Human
cacccuggggccuggaccugc

SEQ ID NO: 2585235 - RNA, 15 nt, Human
cacccuggugggcca

SEQ ID NO: 2585236 - RNA, 21 nt, Human
cacccuguacuguucuguguc

SEQ ID NO: 2585237 - RNA, 17 nt, Human
cacccuguacuguucug

SEQ ID NO: 2585238 - RNA, 16 nt, Human
cacccuguacuguucu

SEQ ID NO: 2585239 - RNA, 16 nt, Human
cacccuggugggccaa

SEQ ID NO: 2585240 - RNA, 21 nt, Human
cacccugggcccugggcugga

SEQ ID NO: 2585241 - RNA, 17 nt, Human
cacccugggcccugggc

SEQ ID NO: 2585242 - RNA, 14 nt, Human
cacccugggcccug

SEQ ID NO: 2585243 - RNA, 12 nt, Human
cacccugggccc

SEQ ID NO: 2585244 - RNA, 13 nt, Human
cacccuggggccu

SEQ ID NO: 2585245 - RNA, 22 nt, Human
cacccugggcccugggcuggaa

SEQ ID NO: 2585246 - RNA, 17 nt, Human
cacccuggggagaaagu

SEQ ID NO: 2585247 - RNA, 23 nt, Human
cacccuguacuguucugugucuu

SEQ ID NO: 2585248 - RNA, 20 nt, Human
cacccuguccaaacugccua

SEQ ID NO: 2585249 - RNA, 17 nt, Human
caccuaguggcugucca

SEQ ID NO: 2585250 - RNA, 16 nt, Human
caccuaguggcugucc

SEQ ID NO: 2585251 - RNA, 15 nt, Human
caccuaguggcuguc

SEQ ID NO: 2585252 - RNA, 14 nt, Human
caccuaguggcugu

SEQ ID NO: 2585253 - RNA, 15 nt, Human
caccuaguccaguga

SEQ ID NO: 2585254 - RNA, 23 nt, Human
cacccuguccaaacugccuaagc

SEQ ID NO: 2585255 - RNA, 22 nt, Human
caccuaguggcuguccagugcc

SEQ ID NO: 2585256 - RNA, 21 nt, Human
caccuaguggcuguccagugc

SEQ ID NO: 2585257 - RNA, 19 nt, Human
caccuaguggcuguccagu

SEQ ID NO: 2585258 - RNA, 18 nt, Human
caccuaguggcuguccag

SEQ ID NO: 2585259 - RNA, 23 nt, Human
caccuaguggcuguccagugccc

SEQ ID NO: 2585260 - RNA, 14 nt, Human
caccuauaaaacag

SEQ ID NO: 2585261 - RNA, 16 nt, Human
caccuauaaaacaggu

SEQ ID NO: 2585262 - RNA, 19 nt, Human
caccuauaaaacaggucaa

SEQ ID NO: 2585263 - RNA, 22 nt, Human
cacccuccugucuucccagggu

SEQ ID NO: 2585264 - RNA, 16 nt, Human
cacccucgaagcgcgc

SEQ ID NO: 2585265 - RNA, 24 nt, Human
cacccucgaagcgcgccacucgcu

SEQ ID NO: 2585266 - RNA, 19 nt, Human
cacccucgaagcgcgccac

SEQ ID NO: 2585267 - RNA, 23 nt, Human
cacccucgaagcgcgccacucgc

SEQ ID NO: 2585268 - RNA, 21 nt, Human
cacccuccugucuucccaggg

SEQ ID NO: 2585269 - RNA, 20 nt, Human
cacccuccugucuucccagg

SEQ ID NO: 2585270 - RNA, 19 nt, Human
cacccuccugucuucccag

SEQ ID NO: 2585271 - RNA, 12 nt, Human
cacccuccuuuc

SEQ ID NO: 2585272 - RNA, 19 nt, Human
cacccugccuuaucuugca

SEQ ID NO: 2585273 - RNA, 18 nt, Human
cacccugccuuaucuugc

SEQ ID NO: 2585274 - RNA, 12 nt, Human
cacccugcuaca

SEQ ID NO: 2585275 - RNA, 12 nt, Human
cacccugcucuc

SEQ ID NO: 2585276 - RNA, 21 nt, Human
cacccuggccgaguccaagcu

SEQ ID NO: 2585277 - RNA, 22 nt, Human
cacccuggccgaguccaagcug

SEQ ID NO: 2585278 - RNA, 11 nt, Human
cacccuggaau

SEQ ID NO: 2585279 - RNA, 21 nt, Human
cacccuggauugaucggagcc

SEQ ID NO: 2585280 - RNA, 21 nt, Human
cacccuggaggauuucaucuc

SEQ ID NO: 2585281 - RNA, 18 nt, Human
cacccugagccccuuccu

SEQ ID NO: 2585282 - RNA, 17 nt, Human
cacccugagccccuucc

SEQ ID NO: 2585283 - RNA, 12 nt, Human
cacccugagccc

SEQ ID NO: 2585284 - RNA, 23 nt, Human
cacccugaaugguuccaugccug

SEQ ID NO: 2585285 - RNA, 13 nt, Human
cacccugccuuau

SEQ ID NO: 2585286 - RNA, 12 nt, Human
cacccugccuua

SEQ ID NO: 2585287 - RNA, 22 nt, Human
cacccugauuuaggagaagcca

SEQ ID NO: 2585288 - RNA, 19 nt, Human
caccugcggugcuaucucc

SEQ ID NO: 2585289 - RNA, 17 nt, Human
caccugcggugcuaucu

SEQ ID NO: 2585290 - RNA, 14 nt, Human
caccugcccugccc

SEQ ID NO: 2585291 - RNA, 16 nt, Human
caccugcggugcuauc

SEQ ID NO: 2585292 - RNA, 20 nt, Human
caccugcggugcuaucuccc

SEQ ID NO: 2585293 - RNA, 19 nt, Human
cacugaaguuaacagagac

SEQ ID NO: 2585294 - RNA, 23 nt, Human
cacugaagaagcaccaaucauga

SEQ ID NO: 2585295 - RNA, 11 nt, Human
cacugaagaag

SEQ ID NO: 2585296 - RNA, 19 nt, Human
cacugaaguagugugcagu

SEQ ID NO: 2585297 - RNA, 18 nt, Human
cacugaaggccuggccca

SEQ ID NO: 2585298 - RNA, 17 nt, Human
cacugaagcugggauuc

SEQ ID NO: 2585299 - RNA, 12 nt, Human
cacucccaagcc

SEQ ID NO: 2585300 - RNA, 13 nt, Human
cacugaagcuggg

SEQ ID NO: 2585301 - RNA, 16 nt, Human
cacuccagugagacag

SEQ ID NO: 2585302 - RNA, 21 nt, Human
cacuccagugagacagcucug

SEQ ID NO: 2585303 - RNA, 22 nt, Human
cacuccaugcuuagucacugcc

SEQ ID NO: 2585304 - RNA, 21 nt, Human
cacuccaugcuuagucacugc

SEQ ID NO: 2585305 - RNA, 17 nt, Human
cacuccagugccagcaa

SEQ ID NO: 2585306 - RNA, 16 nt, Human
cacuccagugccagca

SEQ ID NO: 2585307 - RNA, 23 nt, Human
cacuccaugcuuagucacugccu

SEQ ID NO: 2585308 - RNA, 13 nt, Human
cacucccaagucu

SEQ ID NO: 2585309 - RNA, 17 nt, Human
cacuccagaccccuggc

SEQ ID NO: 2585310 - RNA, 14 nt, Human
cacuccaccaccca

SEQ ID NO: 2585311 - RNA, 15 nt, Human
cacuccaccacccaa

SEQ ID NO: 2585312 - RNA, 13 nt, Human
cacuccagugcca

SEQ ID NO: 2585313 - RNA, 18 nt, Human
cacuccaccacccaaaag

SEQ ID NO: 2585314 - RNA, 16 nt, Human
cacggagccacuccuc

SEQ ID NO: 2585315 - RNA, 17 nt, Human
cacggagccacuccucu

SEQ ID NO: 2585316 - RNA, 18 nt, Human
cacggagccacuccucug

SEQ ID NO: 2585317 - RNA, 19 nt, Human
cacggagccacuccucuga

SEQ ID NO: 2585318 - RNA, 21 nt, Human
cacuacauuauaaaugucucu

SEQ ID NO: 2585319 - RNA, 21 nt, Human
cacggagccacuccucugacu

SEQ ID NO: 2585320 - RNA, 23 nt, Human
cacggagccacuccucugacuca

SEQ ID NO: 2585321 - RNA, 13 nt, Human
cacuacauucugu

SEQ ID NO: 2585322 - RNA, 14 nt, Human
cacuacauucuguu

SEQ ID NO: 2585323 - RNA, 16 nt, Human
cacggaagagccuugc

SEQ ID NO: 2585324 - RNA, 22 nt, Human
cacggaagagccuugcggaagg

SEQ ID NO: 2585325 - RNA, 17 nt, Human
cacggacguuuccauca

SEQ ID NO: 2585326 - RNA, 15 nt, Human
cacggagccacuccu

SEQ ID NO: 2585327 - RNA, 18 nt, Human
cacggacguuuccaucag

SEQ ID NO: 2585328 - RNA, 15 nt, Human
cacggaaguuuucaa

SEQ ID NO: 2585329 - RNA, 17 nt, Human
cacgcuuucuagcuguu

SEQ ID NO: 2585330 - RNA, 14 nt, Human
cacggaaguuuuca

SEQ ID NO: 2585331 - RNA, 16 nt, Human
cacuagccagacacuc

SEQ ID NO: 2585332 - RNA, 20 nt, Human
cacuagccagacacucugcu

SEQ ID NO: 2585333 - RNA, 16 nt, Human
cacuagcccaaugaaa

SEQ ID NO: 2585334 - RNA, 21 nt, Human
cacuccaauuaaggauuuuau

SEQ ID NO: 2585335 - RNA, 22 nt, Human
cacuccaauuaaggauuuuaug

SEQ ID NO: 2585336 - RNA, 16 nt, Human
cacuccagaccccugg

SEQ ID NO: 2585337 - RNA, 14 nt, Human
cacuccagaccccu

SEQ ID NO: 2585338 - RNA, 19 nt, Human
cacuagcccaaugaaauga

SEQ ID NO: 2585339 - RNA, 10 nt, Human
cacuccacca

SEQ ID NO: 2585340 - RNA, 11 nt, Human
cacuccaccac

SEQ ID NO: 2585341 - RNA, 19 nt, Human
cacuccaccacccaaaagu

SEQ ID NO: 2585342 - RNA, 16 nt, Human
cacuagacccacugga

SEQ ID NO: 2585343 - RNA, 15 nt, Human
cacuagaacucucca

SEQ ID NO: 2585344 - RNA, 17 nt, Human
cacuagaacucuccauc

SEQ ID NO: 2585345 - RNA, 12 nt, Human
cacuacugcagu

SEQ ID NO: 2585346 - RNA, 15 nt, Human
cacuacauucuguua

SEQ ID NO: 2585347 - RNA, 15 nt, Human
cacuacauucauuua

SEQ ID NO: 2585348 - RNA, 21 nt, Human
cacuacugcuaccacaacuau

SEQ ID NO: 2585349 - RNA, 15 nt, Human
cacgcuggagugcag

SEQ ID NO: 2585350 - RNA, 20 nt, Human
cacgcuggagugcagugagc

SEQ ID NO: 2585351 - RNA, 18 nt, Human
cacgcuggagugcaguga

SEQ ID NO: 2585352 - RNA, 17 nt, Human
cacgcuggagugcagug

SEQ ID NO: 2585353 - RNA, 16 nt, Human
cacgcuggagugcagu

SEQ ID NO: 2585354 - RNA, 13 nt, Human
cacgcugucucca

SEQ ID NO: 2585355 - RNA, 14 nt, Human
cacgcugucuccag

SEQ ID NO: 2585356 - RNA, 15 nt, Human
cacgcugucuccaga

SEQ ID NO: 2585357 - RNA, 16 nt, Human
cacgcugucuccagac

SEQ ID NO: 2585358 - RNA, 17 nt, Human
cacgcugucuccagacc

SEQ ID NO: 2585359 - RNA, 21 nt, Human
cacgcuggagugcagugagcc

SEQ ID NO: 2585360 - RNA, 18 nt, Human
cacgcugucuccagaccc

SEQ ID NO: 2585361 - RNA, 19 nt, Human
cacgcugucuccagacccc

SEQ ID NO: 2585362 - RNA, 20 nt, Human
cacgcugucuccagaccccc

SEQ ID NO: 2585363 - RNA, 23 nt, Human
cacgcugucuccagacccccacc

SEQ ID NO: 2585364 - RNA, 16 nt, Human
cacgcugugggcaggu

SEQ ID NO: 2585365 - RNA, 18 nt, Human
cacgcugugggcaggugg

SEQ ID NO: 2585366 - RNA, 22 nt, Human
cacgcugugggcaggugggagc

SEQ ID NO: 2585367 - RNA, 14 nt, Human
cacgcuuuccugaa

SEQ ID NO: 2585368 - RNA, 14 nt, Human
cacgcuuucuagcu

SEQ ID NO: 2585369 - RNA, 19 nt, Human
cacgcuugcguaugucugu

SEQ ID NO: 2585370 - RNA, 20 nt, Human
cacgcuucuucuuuugagca

SEQ ID NO: 2585371 - RNA, 23 nt, Human
auugauaagagggcacacacugu

SEQ ID NO: 2585372 - RNA, 22 nt, Human
auugauaagagggcacacacug

SEQ ID NO: 2585373 - RNA, 17 nt, Human
auugaggggauuaauau

SEQ ID NO: 2585374 - RNA, 22 nt, Human
auugaggggauuaauaugaaaa

SEQ ID NO: 2585375 - RNA, 16 nt, Human
auugauaagagggcac

SEQ ID NO: 2585376 - RNA, 22 nt, Human
auuuaacuugaggguaauaaac

SEQ ID NO: 2585377 - RNA, 21 nt, Human
auuuaacuugaggguaauaaa

SEQ ID NO: 2585378 - RNA, 20 nt, Human
auuuaacuugaggguaauaa

SEQ ID NO: 2585379 - RNA, 18 nt, Human
auuuaacuugaggguaau

SEQ ID NO: 2585380 - RNA, 17 nt, Human
auuuaacuuguuuccaa

SEQ ID NO: 2585381 - RNA, 23 nt, Human
auuuaacuugaggguaauaaacu

SEQ ID NO: 2585382 - RNA, 20 nt, Human
auuuaacuuguuuccaaugu

SEQ ID NO: 2585383 - RNA, 16 nt, Human
auuuaagagacaguca

SEQ ID NO: 2585384 - RNA, 16 nt, Human
auuuaagacacugaaa

SEQ ID NO: 2585385 - RNA, 15 nt, Human
auuuaagacacugaa

SEQ ID NO: 2585386 - RNA, 19 nt, Human
auuuaacuugagcuuuaaa

SEQ ID NO: 2585387 - RNA, 21 nt, Human
auuuaauaguguuaaucaauu

SEQ ID NO: 2585388 - RNA, 20 nt, Human
auuuaauaguguuaaucaau

SEQ ID NO: 2585389 - RNA, 19 nt, Human
auuuaauaguguuaaucaa

SEQ ID NO: 2585390 - RNA, 18 nt, Human
auuuaauaguguuaauca

SEQ ID NO: 2585391 - RNA, 17 nt, Human
auuuaauaguguuaauc

SEQ ID NO: 2585392 - RNA, 15 nt, Human
auuuaauaguguuaa

SEQ ID NO: 2585393 - RNA, 14 nt, Human
auuuaauaguguua

SEQ ID NO: 2585394 - RNA, 22 nt, Human
auuuaauuagugcuaaguguga

SEQ ID NO: 2585395 - RNA, 21 nt, Human
auuuaauuagugcuaagugug

SEQ ID NO: 2585396 - RNA, 23 nt, Human
auuuaauaguguuaaucaauuua

SEQ ID NO: 2585397 - RNA, 22 nt, Human
auuuaauaguguuaaucaauuu

SEQ ID NO: 2585398 - RNA, 20 nt, Human
auuuaauuagugcuaagugu

SEQ ID NO: 2585399 - RNA, 23 nt, Human
auuuaauuagugcuaagugugaa

SEQ ID NO: 2585400 - RNA, 15 nt, Human
auuuaauucauguuu

SEQ ID NO: 2585401 - RNA, 17 nt, Human
auuuaauucauguuucu

SEQ ID NO: 2585402 - RNA, 16 nt, Human
auuuaauucucuugaa

SEQ ID NO: 2585403 - RNA, 13 nt, Human
auuuaauucucuu

SEQ ID NO: 2585404 - RNA, 18 nt, Human
auuuaauuagugcuaagu

SEQ ID NO: 2585405 - RNA, 15 nt, Human
auuuauauauguauu

SEQ ID NO: 2585406 - RNA, 14 nt, Human
auuuauauauguau

SEQ ID NO: 2585407 - RNA, 14 nt, Human
auuuauauauugaa

SEQ ID NO: 2585408 - RNA, 14 nt, Human
auuuauauauuuau

SEQ ID NO: 2585409 - RNA, 15 nt, Human
auuuauauagauuau

SEQ ID NO: 2585410 - RNA, 19 nt, Human
auuuauauacaaccugcuu

SEQ ID NO: 2585411 - RNA, 22 nt, Human
auuuauaguuuguacaugcauu

SEQ ID NO: 2585412 - RNA, 15 nt, Human
auuuaauucucuuga

SEQ ID NO: 2585413 - RNA, 16 nt, Human
auuuauaguuuguaca

SEQ ID NO: 2585414 - RNA, 15 nt, Human
auuuauauaaauuuu

SEQ ID NO: 2585415 - RNA, 15 nt, Human
auuuaauacagcagu

SEQ ID NO: 2585416 - RNA, 13 nt, Human
auuuaauacagca

SEQ ID NO: 2585417 - RNA, 22 nt, Human
auuuaauaaaauaauucuaaag

SEQ ID NO: 2585418 - RNA, 21 nt, Human
auuuaauaaaauaauucuaaa

SEQ ID NO: 2585419 - RNA, 19 nt, Human
auuuaauaaaauaauucua

SEQ ID NO: 2585420 - RNA, 16 nt, Human
auuuaauaaaaaaaca

SEQ ID NO: 2585421 - RNA, 22 nt, Human
auuuaagugcguguguagaguu

SEQ ID NO: 2585422 - RNA, 21 nt, Human
auuuaagugcguguguagagu

SEQ ID NO: 2585423 - RNA, 20 nt, Human
auuuaagugcguguguagag

SEQ ID NO: 2585424 - RNA, 19 nt, Human
auuuaaguucauauuccau

SEQ ID NO: 2585425 - RNA, 12 nt, Human
auuuaagcauug

SEQ ID NO: 2585426 - RNA, 13 nt, Human
auuuaagcauugu

SEQ ID NO: 2585427 - RNA, 14 nt, Human
auuuaagcauuguu

SEQ ID NO: 2585428 - RNA, 15 nt, Human
auuuaagcauuguuu

SEQ ID NO: 2585429 - RNA, 15 nt, Human
auuuaagauaauuau

SEQ ID NO: 2585430 - RNA, 11 nt, Human
auuuaagcauu

SEQ ID NO: 2585431 - RNA, 15 nt, Human
auuuaagauaguuuu

SEQ ID NO: 2585432 - RNA, 19 nt, Human
auuuaagccucauauuuaa

SEQ ID NO: 2585433 - RNA, 17 nt, Human
auuuaagccucauauuu

SEQ ID NO: 2585434 - RNA, 18 nt, Human
auuuaagcuuaugucaga

SEQ ID NO: 2585435 - RNA, 21 nt, Human
auuuaagccucauauuuaaag

SEQ ID NO: 2585436 - RNA, 14 nt, Human
auuuaagugcgugu

SEQ ID NO: 2585437 - RNA, 19 nt, Human
auuuaagugcguguguaga

SEQ ID NO: 2585438 - RNA, 21 nt, Human
auuuauccugaaauuucagau

SEQ ID NO: 2585439 - RNA, 19 nt, Human
auuuauccugaaauuucag

SEQ ID NO: 2585440 - RNA, 20 nt, Human
auuuauccugaaauuucaga

SEQ ID NO: 2585441 - RNA, 18 nt, Human
auuuauccugaaauuuca

SEQ ID NO: 2585442 - RNA, 15 nt, Human
auuuauauauuggua

SEQ ID NO: 2585443 - RNA, 18 nt, Human
auuuaucagugacagagu

SEQ ID NO: 2585444 - RNA, 15 nt, Human
auuuauauauuuaua

SEQ ID NO: 2585445 - RNA, 16 nt, Human
auuuauauauuuauaa

SEQ ID NO: 2585446 - RNA, 17 nt, Human
auuuauauauuuauaac

SEQ ID NO: 2585447 - RNA, 18 nt, Human
auuuauauauuuauaacu

SEQ ID NO: 2585448 - RNA, 23 nt, Human
auuuaucagugacagaguucacu

SEQ ID NO: 2585449 - RNA, 20 nt, Human
auuucacaacagaucaauuu

SEQ ID NO: 2585450 - RNA, 15 nt, Human
auuucacaacagauc

SEQ ID NO: 2585451 - RNA, 13 nt, Human
auuucacaacaga

SEQ ID NO: 2585452 - RNA, 23 nt, Human
auuucacaguguguuugugauug

SEQ ID NO: 2585453 - RNA, 13 nt, Human
auuucacauuaau

SEQ ID NO: 2585454 - RNA, 14 nt, Human
auuuaucucuauuu

SEQ ID NO: 2585455 - RNA, 21 nt, Human
auuucaauuuccaagagcuga

SEQ ID NO: 2585456 - RNA, 14 nt, Human
auuucacucuccuu

SEQ ID NO: 2585457 - RNA, 16 nt, Human
auuucagcagcugcag

SEQ ID NO: 2585458 - RNA, 20 nt, Human
auuucacgucgucuucugua

SEQ ID NO: 2585459 - RNA, 14 nt, Human
auuucacuauuuuu

SEQ ID NO: 2585460 - RNA, 15 nt, Human
auuucaggagcagcc

SEQ ID NO: 2585461 - RNA, 22 nt, Human
auuucacuauuuuuauuuauau

SEQ ID NO: 2585462 - RNA, 15 nt, Human
auuucaggagggauu

SEQ ID NO: 2585463 - RNA, 19 nt, Human
auuucaggauacucuguca

SEQ ID NO: 2585464 - RNA, 22 nt, Human
auuucaggauacucugucagau

SEQ ID NO: 2585465 - RNA, 15 nt, Human
auuucaccuguaaac

SEQ ID NO: 2585466 - RNA, 16 nt, Human
auuucaccuguaaacc

SEQ ID NO: 2585467 - RNA, 18 nt, Human
auuucaccuguaaaccug

SEQ ID NO: 2585468 - RNA, 19 nt, Human
auuucaccuguaaaccuga

SEQ ID NO: 2585469 - RNA, 12 nt, Human
auuucacucucc

SEQ ID NO: 2585470 - RNA, 20 nt, Human
auuucaccccucccuuucuc

SEQ ID NO: 2585471 - RNA, 15 nt, Human
auuucaccccucccu

SEQ ID NO: 2585472 - RNA, 14 nt, Human
auuucaccuguaaa

SEQ ID NO: 2585473 - RNA, 21 nt, Human
auuucaccccucccuuucucc

SEQ ID NO: 2585474 - RNA, 22 nt, Human
auuucacauuaauauuugcuga

SEQ ID NO: 2585475 - RNA, 21 nt, Human
auuucacauuaauauuugcug

SEQ ID NO: 2585476 - RNA, 15 nt, Human
auuugcacaaguuuu

SEQ ID NO: 2585477 - RNA, 18 nt, Human
auuucucuuacugcaaau

SEQ ID NO: 2585478 - RNA, 19 nt, Human
auuucucugauuugcaaaa

SEQ ID NO: 2585479 - RNA, 21 nt, Human
auuucuccuuugauaaaauaa

SEQ ID NO: 2585480 - RNA, 20 nt, Human
auuucuccuuugauaaaaua

SEQ ID NO: 2585481 - RNA, 14 nt, Human
auuucagugccaau

SEQ ID NO: 2585482 - RNA, 19 nt, Human
auuucaggggucgucacca

SEQ ID NO: 2585483 - RNA, 22 nt, Human
auuucaggggucgucaccaccu

SEQ ID NO: 2585484 - RNA, 20 nt, Human
auuucagguuuuguaaagau

SEQ ID NO: 2585485 - RNA, 21 nt, Human
auuucagguuuuguaaagaug

SEQ ID NO: 2585486 - RNA, 20 nt, Human
auuucuguuuagauaauaca

SEQ ID NO: 2585487 - RNA, 19 nt, Human
auuucuguuuagauaauac

SEQ ID NO: 2585488 - RNA, 23 nt, Human
auuucugaguuucauucuccugc

SEQ ID NO: 2585489 - RNA, 11 nt, Human
auuucugagaa

SEQ ID NO: 2585490 - RNA, 17 nt, Human
auuucugagaagguccu

SEQ ID NO: 2585491 - RNA, 18 nt, Human
auuucugaaguggacucu

SEQ ID NO: 2585492 - RNA, 20 nt, Human
auuucugaaaugaccucaag

SEQ ID NO: 2585493 - RNA, 20 nt, Human
auuucucuuacugcaaaugu

SEQ ID NO: 2585494 - RNA, 21 nt, Human
auuucuguuuagauaauacac

SEQ ID NO: 2585495 - RNA, 13 nt, Human
auuucugcauaug

SEQ ID NO: 2585496 - RNA, 16 nt, Human
auuucugcagguucuu

SEQ ID NO: 2585497 - RNA, 23 nt, Human
auuucugagaagguccuuaauga

SEQ ID NO: 2585498 - RNA, 21 nt, Human
auuucuuaaacaaauguauga

SEQ ID NO: 2585499 - RNA, 13 nt, Human
auuucuuaaacaa

SEQ ID NO: 2585500 - RNA, 20 nt, Human
caaaagguuaauaaaguaau

SEQ ID NO: 2585501 - RNA, 19 nt, Human
caaaagguucacuaaagca

SEQ ID NO: 2585502 - RNA, 13 nt, Human
caaaaggugccug

SEQ ID NO: 2585503 - RNA, 15 nt, Human
caaaaggugccugug

SEQ ID NO: 2585504 - RNA, 18 nt, Human
caaaaggugccugugagg

SEQ ID NO: 2585505 - RNA, 22 nt, Human
caaaaggugccugugaggcagg

SEQ ID NO: 2585506 - RNA, 21 nt, Human
caaacaucacucugcugcuua

SEQ ID NO: 2585507 - RNA, 18 nt, Human
caaacaucacucugcugc

SEQ ID NO: 2585508 - RNA, 18 nt, Human
caaacauccuaucaacaa

SEQ ID NO: 2585509 - RNA, 17 nt, Human
caaacaucacucugcug

SEQ ID NO: 2585510 - RNA, 23 nt, Human
caaaaggugccugugaggcaggg

SEQ ID NO: 2585511 - RNA, 12 nt, Human
caaacaugaagu

SEQ ID NO: 2585512 - RNA, 14 nt, Human
caaacaugaagugu

SEQ ID NO: 2585513 - RNA, 21 nt, Human
caaacaugaaguguguuuccu

SEQ ID NO: 2585514 - RNA, 19 nt, Human
caaaagcaucuaugugaga

SEQ ID NO: 2585515 - RNA, 13 nt, Human
caaaagcauguga

SEQ ID NO: 2585516 - RNA, 21 nt, Human
caaaagguauuuuaaucacca

SEQ ID NO: 2585517 - RNA, 15 nt, Human
caaaagcccauucau

SEQ ID NO: 2585518 - RNA, 19 nt, Human
caaaagcccauucauucca

SEQ ID NO: 2585519 - RNA, 20 nt, Human
caaaaggguuuaaacugauu

SEQ ID NO: 2585520 - RNA, 22 nt, Human
caaaaggguuuaaacugauuca

SEQ ID NO: 2585521 - RNA, 20 nt, Human
caaaagggugucugagcccu

SEQ ID NO: 2585522 - RNA, 19 nt, Human
auuuuuuuuucauacacuu

SEQ ID NO: 2585523 - RNA, 20 nt, Human
auuuuuuuuucauacacuua

SEQ ID NO: 2585524 - RNA, 21 nt, Human
auuuuuuuuucauacacuuau

SEQ ID NO: 2585525 - RNA, 20 nt, Human
caaaagauugcugaaauuuu

SEQ ID NO: 2585526 - RNA, 22 nt, Human
caaaagauugcugaaauuuuau

SEQ ID NO: 2585527 - RNA, 14 nt, Human
caaaagcaagacug

SEQ ID NO: 2585528 - RNA, 15 nt, Human
caaaagcaaaugaga

SEQ ID NO: 2585529 - RNA, 23 nt, Human
caaaagcaagacuguugcucaaa

SEQ ID NO: 2585530 - RNA, 16 nt, Human
caaaagcaagacuguu

SEQ ID NO: 2585531 - RNA, 14 nt, Human
caaaagcacccuug

SEQ ID NO: 2585532 - RNA, 14 nt, Human
auuuuuuuuucaua

SEQ ID NO: 2585533 - RNA, 16 nt, Human
auuuuuuuuucauaca

SEQ ID NO: 2585534 - RNA, 15 nt, Human
auuuuuuuuguuuca

SEQ ID NO: 2585535 - RNA, 15 nt, Human
auuuuuuuucuguua

SEQ ID NO: 2585536 - RNA, 17 nt, Human
auuuuuuuucuguuaua

SEQ ID NO: 2585537 - RNA, 14 nt, Human
auuuuuuuucaugu

SEQ ID NO: 2585538 - RNA, 15 nt, Human
auuuuuuuucauguu

SEQ ID NO: 2585539 - RNA, 16 nt, Human
auuuuuuuucauguuu

SEQ ID NO: 2585540 - RNA, 20 nt, Human
auuuuuuuucauguuuuaac

SEQ ID NO: 2585541 - RNA, 18 nt, Human
auuuuuuuucuguuauau

SEQ ID NO: 2585542 - RNA, 19 nt, Human
auuuuuuuucuguuauaua

SEQ ID NO: 2585543 - RNA, 20 nt, Human
auuuuuuuucuguuauauaa

SEQ ID NO: 2585544 - RNA, 18 nt, Human
auuuuuuuuaaguauuua

SEQ ID NO: 2585545 - RNA, 12 nt, Human
auuuuuauucau

SEQ ID NO: 2585546 - RNA, 15 nt, Human
auuuuuauuauuugu

SEQ ID NO: 2585547 - RNA, 16 nt, Human
auuuuuauuaaauuau

SEQ ID NO: 2585548 - RNA, 16 nt, Human
auuuuuauuuuucuaa

SEQ ID NO: 2585549 - RNA, 15 nt, Human
auuuuuauucauaag

SEQ ID NO: 2585550 - RNA, 22 nt, Human
auuuuuuucacuggaguuacau

SEQ ID NO: 2585551 - RNA, 14 nt, Human
auuuuuauucauaa

SEQ ID NO: 2585552 - RNA, 13 nt, Human
auuuuuauucaua

SEQ ID NO: 2585553 - RNA, 14 nt, Human
auuuuuauuuauau

SEQ ID NO: 2585554 - RNA, 14 nt, Human
auuuuuauuucaaa

SEQ ID NO: 2585555 - RNA, 15 nt, Human
auuuuuuucugaauu

SEQ ID NO: 2585556 - RNA, 15 nt, Human
auuuuuuucugauug

SEQ ID NO: 2585557 - RNA, 14 nt, Human
auuuuuuucugauu

SEQ ID NO: 2585558 - RNA, 20 nt, Human
auuuuuuucuaccuugaggu

SEQ ID NO: 2585559 - RNA, 13 nt, Human
auuuuuuucuacc

SEQ ID NO: 2585560 - RNA, 17 nt, Human
auuuuuaaaauauuuau

SEQ ID NO: 2585561 - RNA, 16 nt, Human
auuuuuaaaauauuua

SEQ ID NO: 2585562 - RNA, 22 nt, Human
auuuuuaaaaugcaacaugugu

SEQ ID NO: 2585563 - RNA, 16 nt, Human
auuuuuaaaacccauu

SEQ ID NO: 2585564 - RNA, 17 nt, Human
auuuuuaaaacccauuu

SEQ ID NO: 2585565 - RNA, 16 nt, Human
auuuuuauauuugaaa

SEQ ID NO: 2585566 - RNA, 22 nt, Human
auuuuguuuuugucuuaaaaag

SEQ ID NO: 2585567 - RNA, 19 nt, Human
auuuuuauauuugaaauau

SEQ ID NO: 2585568 - RNA, 19 nt, Human
auuuuuaaaauuuuaauau

SEQ ID NO: 2585569 - RNA, 15 nt, Human
auuuuuauggaauuu

SEQ ID NO: 2585570 - RNA, 12 nt, Human
auuuuuauggaa

SEQ ID NO: 2585571 - RNA, 14 nt, Human
auuuuuauggaauu

SEQ ID NO: 2585572 - RNA, 19 nt, Human
auuuuuaucuuucgugaua

SEQ ID NO: 2585573 - RNA, 15 nt, Human
auuuuuaucuuucgu

SEQ ID NO: 2585574 - RNA, 12 nt, Human
auuuuuaucuuu

SEQ ID NO: 2585575 - RNA, 15 nt, Human
caaaccauaaacuuc

SEQ ID NO: 2585576 - RNA, 17 nt, Human
caaaccaguaucgcuca

SEQ ID NO: 2585577 - RNA, 17 nt, Human
caaaccaucauugaaau

SEQ ID NO: 2585578 - RNA, 16 nt, Human
caaaccaucauugaaa

SEQ ID NO: 2585579 - RNA, 14 nt, Human
caaaccaucauuga

SEQ ID NO: 2585580 - RNA, 21 nt, Human
caaacaugacccuaaaucuug

SEQ ID NO: 2585581 - RNA, 22 nt, Human
caaacaugaaguguguuuccuu

SEQ ID NO: 2585582 - RNA, 23 nt, Human
caaacaugggguuggcugggccc

SEQ ID NO: 2585583 - RNA, 20 nt, Human
caaacaugggguuggcuggg

SEQ ID NO: 2585584 - RNA, 13 nt, Human
caaaccagaagca

SEQ ID NO: 2585585 - RNA, 18 nt, Human
caaacaugugguuaaugc

SEQ ID NO: 2585586 - RNA, 20 nt, Human
auuuugaaaucaugaagaua

SEQ ID NO: 2585587 - RNA, 19 nt, Human
auuuugaaaaauuccuauu

SEQ ID NO: 2585588 - RNA, 18 nt, Human
auuuugaaaaauuccuau

SEQ ID NO: 2585589 - RNA, 22 nt, Human
auuuugaaaaauuccuauugug

SEQ ID NO: 2585590 - RNA, 20 nt, Human
auuuguguuuuaauuuaaac

SEQ ID NO: 2585591 - RNA, 13 nt, Human
auuuguguuuuaa

SEQ ID NO: 2585592 - RNA, 14 nt, Human
auuuguuauaauga

SEQ ID NO: 2585593 - RNA, 21 nt, Human
auuuguguuuuaauuuaaaca

SEQ ID NO: 2585594 - RNA, 15 nt, Human
auuuguuaaauauuu

SEQ ID NO: 2585595 - RNA, 16 nt, Human
auuuguuaaauauuua

SEQ ID NO: 2585596 - RNA, 17 nt, Human
auuuguuaaauauuuac

SEQ ID NO: 2585597 - RNA, 18 nt, Human
auuuguuaaauauuuaca

SEQ ID NO: 2585598 - RNA, 21 nt, Human
auuugcacuggaguucuaugc

SEQ ID NO: 2585599 - RNA, 19 nt, Human
auuugcagagacaggaccu

SEQ ID NO: 2585600 - RNA, 22 nt, Human
auuugcagagacaggaccugac

SEQ ID NO: 2585601 - RNA, 16 nt, Human
auuugcacccuccgcc

SEQ ID NO: 2585602 - RNA, 15 nt, Human
auuugcagagacagg

SEQ ID NO: 2585603 - RNA, 15 nt, Human
auuugugugugugca

SEQ ID NO: 2585604 - RNA, 20 nt, Human
auuugugugugugcaagugu

SEQ ID NO: 2585605 - RNA, 12 nt, Human
auuugugugugu

SEQ ID NO: 2585606 - RNA, 14 nt, Human
auuugugugugugc

SEQ ID NO: 2585607 - RNA, 15 nt, Human
auuuuagucacuuuu

SEQ ID NO: 2585608 - RNA, 14 nt, Human
auuuuagucacuuu

SEQ ID NO: 2585609 - RNA, 23 nt, Human
auuuuagucacacguggucuuuc

SEQ ID NO: 2585610 - RNA, 23 nt, Human
auuuuagugacagcucugccugu

SEQ ID NO: 2585611 - RNA, 21 nt, Human
auuuuaguuucuguucugugg

SEQ ID NO: 2585612 - RNA, 19 nt, Human
auuuuaguuucuguucugu

SEQ ID NO: 2585613 - RNA, 18 nt, Human
auuuuaguuucuguucug

SEQ ID NO: 2585614 - RNA, 16 nt, Human
auuuuaguuucuguuc

SEQ ID NO: 2585615 - RNA, 15 nt, Human
auuuuaguuucuguu

SEQ ID NO: 2585616 - RNA, 14 nt, Human
auuuuaguuucugu

SEQ ID NO: 2585617 - RNA, 18 nt, Human
auuuuaguuacagcugug

SEQ ID NO: 2585618 - RNA, 14 nt, Human
auuuguugaaauua

SEQ ID NO: 2585619 - RNA, 22 nt, Human
auuuguucauagacccucucaa

SEQ ID NO: 2585620 - RNA, 23 nt, Human
auuuuagguguugauuuucuguu

SEQ ID NO: 2585621 - RNA, 21 nt, Human
auuuuagguguugauuuucug

SEQ ID NO: 2585622 - RNA, 16 nt, Human
auuuguugaaauuaug

SEQ ID NO: 2585623 - RNA, 21 nt, Human
auuuguucauagacccucuca

SEQ ID NO: 2585624 - RNA, 17 nt, Human
auuuguuauuuucagua

SEQ ID NO: 2585625 - RNA, 16 nt, Human
auuuguuauuuugcaa

SEQ ID NO: 2585626 - RNA, 19 nt, Human
auuuguucuauagcuuuuc

SEQ ID NO: 2585627 - RNA, 17 nt, Human
auuuguuauuuugcaac

SEQ ID NO: 2585628 - RNA, 19 nt, Human
auuuguuauuuguacaguu

SEQ ID NO: 2585629 - RNA, 18 nt, Human
auuuguuauuuguacagu

SEQ ID NO: 2585630 - RNA, 17 nt, Human
auuuguuauuuguacag

SEQ ID NO: 2585631 - RNA, 12 nt, Human
auuuguuaaugg

SEQ ID NO: 2585632 - RNA, 17 nt, Human
auuuucucccaggaagc

SEQ ID NO: 2585633 - RNA, 15 nt, Human
auuuucucccaggaa

SEQ ID NO: 2585634 - RNA, 23 nt, Human
auuuucucccaggaagcuuugau

SEQ ID NO: 2585635 - RNA, 16 nt, Human
auuuucuauuguuacu

SEQ ID NO: 2585636 - RNA, 16 nt, Human
auuuucugcaagccug

SEQ ID NO: 2585637 - RNA, 12 nt, Human
auuuucugcaag

SEQ ID NO: 2585638 - RNA, 18 nt, Human
auuuucucuguguuuguu

SEQ ID NO: 2585639 - RNA, 22 nt, Human
auuuucucuguguuuguuccua

SEQ ID NO: 2585640 - RNA, 18 nt, Human
auuuucuggaauacauga

SEQ ID NO: 2585641 - RNA, 19 nt, Human
auuuucuggaauacaugaa

SEQ ID NO: 2585642 - RNA, 22 nt, Human
auuuucuggaauacaugaaaua

SEQ ID NO: 2585643 - RNA, 13 nt, Human
auuuugaaaaacu

SEQ ID NO: 2585644 - RNA, 15 nt, Human
auuuugaaaaacugc

SEQ ID NO: 2585645 - RNA, 18 nt, Human
auuuucugguagauagaa

SEQ ID NO: 2585646 - RNA, 17 nt, Human
auuuucugguagauaga

SEQ ID NO: 2585647 - RNA, 20 nt, Human
auuuucugguagauagaaau

SEQ ID NO: 2585648 - RNA, 20 nt, Human
auuuucuuuuuaauaaaaag

SEQ ID NO: 2585649 - RNA, 17 nt, Human
auuuugaaaaauuccua

SEQ ID NO: 2585650 - RNA, 17 nt, Human
auuuucuauaauuuaaa

SEQ ID NO: 2585651 - RNA, 18 nt, Human
auuuucuauaauuuaaau

SEQ ID NO: 2585652 - RNA, 19 nt, Human
auuuucuauaauuuaaaua

SEQ ID NO: 2585653 - RNA, 23 nt, Human
auuuuaguuucuguucuguggaa

SEQ ID NO: 2585654 - RNA, 20 nt, Human
auuuucuauuguuacucugg

SEQ ID NO: 2585655 - RNA, 22 nt, Human
auugaggacacugauauggguc

SEQ ID NO: 2585656 - RNA, 21 nt, Human
auugaggccugcccucaggga

SEQ ID NO: 2585657 - RNA, 12 nt, Human
auugaggccugc

SEQ ID NO: 2585658 - RNA, 17 nt, Human
auucuuuaucuugacau

SEQ ID NO: 2585659 - RNA, 21 nt, Human
auucuuuauacaacagugcua

SEQ ID NO: 2585660 - RNA, 19 nt, Human
auucuuuauacaacagugc

SEQ ID NO: 2585661 - RNA, 18 nt, Human
auucuuuauacaacagug

SEQ ID NO: 2585662 - RNA, 13 nt, Human
auucuuuauacaa

SEQ ID NO: 2585663 - RNA, 17 nt, Human
auucuuuaaauuucauc

SEQ ID NO: 2585664 - RNA, 15 nt, Human
auucucuuauccaac

SEQ ID NO: 2585665 - RNA, 23 nt, Human
auucuuuauacaacagugcuaaa

SEQ ID NO: 2585666 - RNA, 19 nt, Human
auucuuucaagugaaucua

SEQ ID NO: 2585667 - RNA, 16 nt, Human
auucuuuccauuauga

SEQ ID NO: 2585668 - RNA, 17 nt, Human
auucuuuccauuaugau

SEQ ID NO: 2585669 - RNA, 21 nt, Human
auucuuuccauuaugauucuu

SEQ ID NO: 2585670 - RNA, 22 nt, Human
auucuuuccauuaugauucuuu

SEQ ID NO: 2585671 - RNA, 13 nt, Human
auucguucugugg

SEQ ID NO: 2585672 - RNA, 19 nt, Human
auucucuaguuugauuaaa

SEQ ID NO: 2585673 - RNA, 20 nt, Human
auucucuaguuugauuaaau

SEQ ID NO: 2585674 - RNA, 21 nt, Human
auucgguauccccccaucuug

SEQ ID NO: 2585675 - RNA, 21 nt, Human
auucggugugcaccaggguug

SEQ ID NO: 2585676 - RNA, 23 nt, Human
auucgguguggugcagugugaaa

SEQ ID NO: 2585677 - RNA, 21 nt, Human
auucgugcagcauaugaggau

SEQ ID NO: 2585678 - RNA, 23 nt, Human
auucguggugaucaauuaaaugu

SEQ ID NO: 2585679 - RNA, 23 nt, Human
auucucuaguuugauuaaauucu

SEQ ID NO: 2585680 - RNA, 14 nt, Human
auucucuccaaaaa

SEQ ID NO: 2585681 - RNA, 15 nt, Human
auucucuccaaaaau

SEQ ID NO: 2585682 - RNA, 19 nt, Human
auucucuccaaaaaugcac

SEQ ID NO: 2585683 - RNA, 12 nt, Human
auucucuuaucc

SEQ ID NO: 2585684 - RNA, 14 nt, Human
auucucuuauccaa

SEQ ID NO: 2585685 - RNA, 19 nt, Human
auucauucuuagcucuuaa

SEQ ID NO: 2585686 - RNA, 14 nt, Human
auucauucuuagcu

SEQ ID NO: 2585687 - RNA, 10 nt, Human
auucauuuaa

SEQ ID NO: 2585688 - RNA, 16 nt, Human
auucauuguauaaaaa

SEQ ID NO: 2585689 - RNA, 20 nt, Human
auucauugaagucagaugug

SEQ ID NO: 2585690 - RNA, 15 nt, Human
auucauugaagucag

SEQ ID NO: 2585691 - RNA, 19 nt, Human
auucauuguauaaaaauag

SEQ ID NO: 2585692 - RNA, 16 nt, Human
auucauuuaaaaugau

SEQ ID NO: 2585693 - RNA, 15 nt, Human
auucauuuaaaauga

SEQ ID NO: 2585694 - RNA, 14 nt, Human
auucauuuaaaaug

SEQ ID NO: 2585695 - RNA, 13 nt, Human
auucauuuaaaau

SEQ ID NO: 2585696 - RNA, 17 nt, Human
auucauuuaaaaugauu

SEQ ID NO: 2585697 - RNA, 18 nt, Human
auuccuuugaagaggaaa

SEQ ID NO: 2585698 - RNA, 16 nt, Human
auuccuuugaagagga

SEQ ID NO: 2585699 - RNA, 17 nt, Human
auuccuuucucauccca

SEQ ID NO: 2585700 - RNA, 15 nt, Human
auuccuuucucaucc

SEQ ID NO: 2585701 - RNA, 16 nt, Human
auuccuuucuaucauu

SEQ ID NO: 2585702 - RNA, 17 nt, Human
auuccuuucuaucauuu

SEQ ID NO: 2585703 - RNA, 11 nt, Human
auucauuucaa

SEQ ID NO: 2585704 - RNA, 21 nt, Human
auucgaccugauuuacaguuu

SEQ ID NO: 2585705 - RNA, 20 nt, Human
auucgaccugauuuacaguu

SEQ ID NO: 2585706 - RNA, 18 nt, Human
auucgaccugauuuacag

SEQ ID NO: 2585707 - RNA, 15 nt, Human
auucgaaccaggaaa

SEQ ID NO: 2585708 - RNA, 16 nt, Human
auucgaccugauuuac

SEQ ID NO: 2585709 - RNA, 18 nt, Human
auuccuuuguguuucuau

SEQ ID NO: 2585710 - RNA, 20 nt, Human
auuccuuugaagaggaaaau

SEQ ID NO: 2585711 - RNA, 18 nt, Human
auuccuuuuguguacagu

SEQ ID NO: 2585712 - RNA, 16 nt, Human
auucgagacagaaccu

SEQ ID NO: 2585713 - RNA, 17 nt, Human
auucgagacagaaccuu

SEQ ID NO: 2585714 - RNA, 19 nt, Human
auucgcccaaagccagaca

SEQ ID NO: 2585715 - RNA, 21 nt, Human
auucgcccaaagccagacagc

SEQ ID NO: 2585716 - RNA, 20 nt, Human
auucgcccaaagccagacag

SEQ ID NO: 2585717 - RNA, 16 nt, Human
auuagauguucucuau

SEQ ID NO: 2585718 - RNA, 14 nt, Human
auuagauguucucu

SEQ ID NO: 2585719 - RNA, 13 nt, Human
auuagauguucuc

SEQ ID NO: 2585720 - RNA, 22 nt, Human
auuagagggagguguuuaaaga

SEQ ID NO: 2585721 - RNA, 13 nt, Human
auuagagggaggu

SEQ ID NO: 2585722 - RNA, 21 nt, Human
auuagagggaggagaaugagc

SEQ ID NO: 2585723 - RNA, 19 nt, Human
auuagagggaggagaauga

SEQ ID NO: 2585724 - RNA, 17 nt, Human
auuagagugucuuucca

SEQ ID NO: 2585725 - RNA, 23 nt, Human
auuagagugucuuuccacggagc

SEQ ID NO: 2585726 - RNA, 16 nt, Human
auuagagugucuuucc

SEQ ID NO: 2585727 - RNA, 15 nt, Human
auuagagucagccuu

SEQ ID NO: 2585728 - RNA, 22 nt, Human
auuagaugugauuuaauagugu

SEQ ID NO: 2585729 - RNA, 21 nt, Human
auuagaugugauuuaauagug

SEQ ID NO: 2585730 - RNA, 15 nt, Human
auuagaugugauuua

SEQ ID NO: 2585731 - RNA, 14 nt, Human
auuagaugugauuu

SEQ ID NO: 2585732 - RNA, 13 nt, Human
auuagaugugauu

SEQ ID NO: 2585733 - RNA, 16 nt, Human
auuauguauguuuaca

SEQ ID NO: 2585734 - RNA, 15 nt, Human
auuauguauguuuac

SEQ ID NO: 2585735 - RNA, 19 nt, Human
auuauguccacuguguaua

SEQ ID NO: 2585736 - RNA, 17 nt, Human
auuauguccacugugua

SEQ ID NO: 2585737 - RNA, 17 nt, Human
auuauguauguuuacau

SEQ ID NO: 2585738 - RNA, 21 nt, Human
auuaugugccagauuuaugca

SEQ ID NO: 2585739 - RNA, 13 nt, Human
auuaugugccaga

SEQ ID NO: 2585740 - RNA, 20 nt, Human
auucaaguauuagggguaau

SEQ ID NO: 2585741 - RNA, 12 nt, Human
auucaaguauua

SEQ ID NO: 2585742 - RNA, 21 nt, Human
auucaaggcauuucuaucaca

SEQ ID NO: 2585743 - RNA, 15 nt, Human
auucaagguggccaa

SEQ ID NO: 2585744 - RNA, 21 nt, Human
auucaaguguaaaauauuuug

SEQ ID NO: 2585745 - RNA, 20 nt, Human
auucaaguguaaaauauuuu

SEQ ID NO: 2585746 - RNA, 15 nt, Human
auucaaguuauugua

SEQ ID NO: 2585747 - RNA, 14 nt, Human
auucaaguuauugu

SEQ ID NO: 2585748 - RNA, 21 nt, Human
auucaagucuaugaugcuguu

SEQ ID NO: 2585749 - RNA, 16 nt, Human
auucaaguguacagug

SEQ ID NO: 2585750 - RNA, 16 nt, Human
auucaaguuauuguac

SEQ ID NO: 2585751 - RNA, 17 nt, Human
auucaauaaaguauuua

SEQ ID NO: 2585752 - RNA, 14 nt, Human
auucaauaaaguau

SEQ ID NO: 2585753 - RNA, 13 nt, Human
auucaauaaagua

SEQ ID NO: 2585754 - RNA, 12 nt, Human
auucaauaaagu

SEQ ID NO: 2585755 - RNA, 19 nt, Human
auucauaguaacuucuuau

SEQ ID NO: 2585756 - RNA, 14 nt, Human
auucauuacagcuu

SEQ ID NO: 2585757 - RNA, 12 nt, Human
auucauguaaac

SEQ ID NO: 2585758 - RNA, 12 nt, Human
auucauguuucu

SEQ ID NO: 2585759 - RNA, 13 nt, Human
auucauguuucuu

SEQ ID NO: 2585760 - RNA, 15 nt, Human
auucauguuucuuaa

SEQ ID NO: 2585761 - RNA, 12 nt, Human
auucauuccauu

SEQ ID NO: 2585762 - RNA, 17 nt, Human
auucauuccauucugga

SEQ ID NO: 2585763 - RNA, 20 nt, Human
auucauuauuuuuccacuuu

SEQ ID NO: 2585764 - RNA, 19 nt, Human
auucauuauuuuuccacuu

SEQ ID NO: 2585765 - RNA, 19 nt, Human
auucauuccauucuggaag

SEQ ID NO: 2585766 - RNA, 18 nt, Human
auucauuccauucuggaa

SEQ ID NO: 2585767 - RNA, 14 nt, Human
auucauauuuacuu

SEQ ID NO: 2585768 - RNA, 17 nt, Human
auucauggccuggggga

SEQ ID NO: 2585769 - RNA, 17 nt, Human
auucauauugaauauaa

SEQ ID NO: 2585770 - RNA, 14 nt, Human
auucauauugaaua

SEQ ID NO: 2585771 - RNA, 13 nt, Human
auucauauugaau

SEQ ID NO: 2585772 - RNA, 14 nt, Human
auuaacaaauuaug

SEQ ID NO: 2585773 - RNA, 21 nt, Human
auuaacaugaauauuuagugu

SEQ ID NO: 2585774 - RNA, 23 nt, Human
auuaacaguuuuccaugaaaacg

SEQ ID NO: 2585775 - RNA, 18 nt, Human
auuaacauaggugaaagu

SEQ ID NO: 2585776 - RNA, 12 nt, Human
auuaacaguuuu

SEQ ID NO: 2585777 - RNA, 14 nt, Human
auuaacaguuuucc

SEQ ID NO: 2585778 - RNA, 16 nt, Human
auuaacaguuuuccau

SEQ ID NO: 2585779 - RNA, 18 nt, Human
auuaacaguuuuccauga

SEQ ID NO: 2585780 - RNA, 19 nt, Human
auuaacaguuuuccaugaa

SEQ ID NO: 2585781 - RNA, 21 nt, Human
auuaacaguuuuccaugaaaa

SEQ ID NO: 2585782 - RNA, 22 nt, Human
auuaacaguuuuccaugaaaac

SEQ ID NO: 2585783 - RNA, 18 nt, Human
auuaacaacaauaacacu

SEQ ID NO: 2585784 - RNA, 20 nt, Human
auuaacaaauuauguuacau

SEQ ID NO: 2585785 - RNA, 11 nt, Human
auuaacacugc

SEQ ID NO: 2585786 - RNA, 20 nt, Human
auuaauuguuuugcacuuuu

SEQ ID NO: 2585787 - RNA, 19 nt, Human
auuaauuguuuugcacuuu

SEQ ID NO: 2585788 - RNA, 18 nt, Human
auuaauuguuuugcacuu

SEQ ID NO: 2585789 - RNA, 21 nt, Human
auuaauuggcagcagauuuua

SEQ ID NO: 2585790 - RNA, 20 nt, Human
auuaauuggcagcagauuuu

SEQ ID NO: 2585791 - RNA, 12 nt, Human
auuaaugcacuu

SEQ ID NO: 2585792 - RNA, 16 nt, Human
auuaaugcacuuucua

SEQ ID NO: 2585793 - RNA, 15 nt, Human
auuaaugcacuuucu

SEQ ID NO: 2585794 - RNA, 14 nt, Human
auuaaugcacuuuc

SEQ ID NO: 2585795 - RNA, 13 nt, Human
auuaaugcacuuu

SEQ ID NO: 2585796 - RNA, 17 nt, Human
auuaaugccuuuaaagu

SEQ ID NO: 2585797 - RNA, 16 nt, Human
auuaaugccuuuaaag

SEQ ID NO: 2585798 - RNA, 15 nt, Human
auuaaugccuuuaaa

SEQ ID NO: 2585799 - RNA, 20 nt, Human
auuaaugccauuaucccuga

SEQ ID NO: 2585800 - RNA, 15 nt, Human
auuaauggaaauguu

SEQ ID NO: 2585801 - RNA, 21 nt, Human
auuaaugccuuuaaaguauga

SEQ ID NO: 2585802 - RNA, 18 nt, Human
auuaaugccuuuaaagua

SEQ ID NO: 2585803 - RNA, 14 nt, Human
auuacacaaaacaa

SEQ ID NO: 2585804 - RNA, 13 nt, Human
auuacacaaaaca

SEQ ID NO: 2585805 - RNA, 19 nt, Human
auuacacuguauuuguauc

SEQ ID NO: 2585806 - RNA, 18 nt, Human
auuacacuguauuuguau

SEQ ID NO: 2585807 - RNA, 14 nt, Human
auuacacccaaaga

SEQ ID NO: 2585808 - RNA, 18 nt, Human
auuacacaaaacaaaugc

SEQ ID NO: 2585809 - RNA, 17 nt, Human
auuacacaaaacaaaug

SEQ ID NO: 2585810 - RNA, 21 nt, Human
auuacaccagccucgucuuca

SEQ ID NO: 2585811 - RNA, 17 nt, Human
auuaauuuuuuuauugu

SEQ ID NO: 2585812 - RNA, 19 nt, Human
auuaauuggcagcagauuu

SEQ ID NO: 2585813 - RNA, 16 nt, Human
auuaauuuuuuuauug

SEQ ID NO: 2585814 - RNA, 19 nt, Human
auuaauuuuuuuauuguuu

SEQ ID NO: 2585815 - RNA, 18 nt, Human
auuaauuuuuuuauuguu

SEQ ID NO: 2585816 - RNA, 22 nt, Human
auuacaagcgugagccacugca

SEQ ID NO: 2585817 - RNA, 15 nt, Human
auuacaggcuccugc

SEQ ID NO: 2585818 - RNA, 16 nt, Human
auuacaggcuccugcc

SEQ ID NO: 2585819 - RNA, 15 nt, Human
auuacagagaggaga

SEQ ID NO: 2585820 - RNA, 17 nt, Human
auuacagagaggagaaa

SEQ ID NO: 2585821 - RNA, 20 nt, Human
auuacacuguauuuguaucu

SEQ ID NO: 2585822 - RNA, 12 nt, Human
auuacagagagg

SEQ ID NO: 2585823 - RNA, 17 nt, Human
auuacaggcuccugcca

SEQ ID NO: 2585824 - RNA, 19 nt, Human
auuacaggcuccugccacc

SEQ ID NO: 2585825 - RNA, 13 nt, Human
auuacagguguga

SEQ ID NO: 2585826 - RNA, 15 nt, Human
auuacaggcuugagc

SEQ ID NO: 2585827 - RNA, 23 nt, Human
cagagcuucccugacucauucug

SEQ ID NO: 2585828 - RNA, 19 nt, Human
cagagcugacacaggauga

SEQ ID NO: 2585829 - RNA, 19 nt, Human
cagagcuuggacuggaugc

SEQ ID NO: 2585830 - RNA, 16 nt, Human
cagagcuuggacugga

SEQ ID NO: 2585831 - RNA, 15 nt, Human
cagagcuuggacugg

SEQ ID NO: 2585832 - RNA, 20 nt, Human
cagagcuucuuccaggugcc

SEQ ID NO: 2585833 - RNA, 23 nt, Human
cagagcuucuuccaggugcccag

SEQ ID NO: 2585834 - RNA, 19 nt, Human
cagaggaaagcaaaggaga

SEQ ID NO: 2585835 - RNA, 17 nt, Human
cagaggaaagcaaagga

SEQ ID NO: 2585836 - RNA, 13 nt, Human
cagaggggguggc

SEQ ID NO: 2585837 - RNA, 18 nt, Human
cagaggggcuuucuggag

SEQ ID NO: 2585838 - RNA, 23 nt, Human
cagagaggguggugaccucugcc

SEQ ID NO: 2585839 - RNA, 23 nt, Human
cagagagggugggagugggccca

SEQ ID NO: 2585840 - RNA, 17 nt, Human
cagagagggugacaaga

SEQ ID NO: 2585841 - RNA, 21 nt, Human
cagagagggcaggcaugaagu

SEQ ID NO: 2585842 - RNA, 18 nt, Human
cagagagggugacaagau

SEQ ID NO: 2585843 - RNA, 19 nt, Human
cagagaggucaagcccagg

SEQ ID NO: 2585844 - RNA, 20 nt, Human
cagagagguuaaggugggua

SEQ ID NO: 2585845 - RNA, 20 nt, Human
cagagagucccacugccuca

SEQ ID NO: 2585846 - RNA, 18 nt, Human
cagagagucccacugccu

SEQ ID NO: 2585847 - RNA, 14 nt, Human
cagagagucccacu

SEQ ID NO: 2585848 - RNA, 12 nt, Human
cagagaguccca

SEQ ID NO: 2585849 - RNA, 21 nt, Human
cagagaggucaagcccaggag

SEQ ID NO: 2585850 - RNA, 13 nt, Human
cagagcugccacc

SEQ ID NO: 2585851 - RNA, 15 nt, Human
cagagcugacacagg

SEQ ID NO: 2585852 - RNA, 14 nt, Human
cagagcugacacag

SEQ ID NO: 2585853 - RNA, 17 nt, Human
cagagcucuccagcucc

SEQ ID NO: 2585854 - RNA, 20 nt, Human
cagagcucuccagcuccaag

SEQ ID NO: 2585855 - RNA, 15 nt, Human
cagagcucuccagcu

SEQ ID NO: 2585856 - RNA, 14 nt, Human
cagagcucuccagc

SEQ ID NO: 2585857 - RNA, 17 nt, Human
cagagcuacuugggcca

SEQ ID NO: 2585858 - RNA, 22 nt, Human
cagagagucccacugccucagg

SEQ ID NO: 2585859 - RNA, 12 nt, Human
cagagcucacaa

SEQ ID NO: 2585860 - RNA, 23 nt, Human
cagagacuccugcaggcagccag

SEQ ID NO: 2585861 - RNA, 14 nt, Human
cagagacugcugug

SEQ ID NO: 2585862 - RNA, 20 nt, Human
cagagacuugggacauugcc

SEQ ID NO: 2585863 - RNA, 18 nt, Human
cagagacuugggacauug

SEQ ID NO: 2585864 - RNA, 15 nt, Human
cagagacuugggaca

SEQ ID NO: 2585865 - RNA, 14 nt, Human
cagagagaagccug

SEQ ID NO: 2585866 - RNA, 12 nt, Human
cagagagaagcc

SEQ ID NO: 2585867 - RNA, 22 nt, Human
cagagagagaagugccccugcu

SEQ ID NO: 2585868 - RNA, 23 nt, Human
cagagagagaagugccccugcug

SEQ ID NO: 2585869 - RNA, 19 nt, Human
cagagagagaagugccccu

SEQ ID NO: 2585870 - RNA, 20 nt, Human
cagagagagaagugccccug

SEQ ID NO: 2585871 - RNA, 21 nt, Human
cagagagagaagugccccugc

SEQ ID NO: 2585872 - RNA, 12 nt, Human
cagagagggugg

SEQ ID NO: 2585873 - RNA, 15 nt, Human
cagagagggcaggca

SEQ ID NO: 2585874 - RNA, 14 nt, Human
cagagagggcaggc

SEQ ID NO: 2585875 - RNA, 13 nt, Human
cagagagggcagg

SEQ ID NO: 2585876 - RNA, 12 nt, Human
cagagagggcag

SEQ ID NO: 2585877 - RNA, 18 nt, Human
cagagagggcaggcauga

SEQ ID NO: 2585878 - RNA, 16 nt, Human
cagagagggcaggcau

SEQ ID NO: 2585879 - RNA, 15 nt, Human
cagagagggggccac

SEQ ID NO: 2585880 - RNA, 22 nt, Human
cagagaggguggugaccucugc

SEQ ID NO: 2585881 - RNA, 20 nt, Human
cagagaggguggugaccucu

SEQ ID NO: 2585882 - RNA, 17 nt, Human
cagagaggguggugacc

SEQ ID NO: 2585883 - RNA, 22 nt, Human
cagagagggggccaccucccca

SEQ ID NO: 2585884 - RNA, 20 nt, Human
cagagagggggccaccuccc

SEQ ID NO: 2585885 - RNA, 14 nt, Human
cagauccccaagcc

SEQ ID NO: 2585886 - RNA, 15 nt, Human
cagaucccagcucac

SEQ ID NO: 2585887 - RNA, 12 nt, Human
cagaucccagcu

SEQ ID NO: 2585888 - RNA, 14 nt, Human
cagaucccagcuca

SEQ ID NO: 2585889 - RNA, 15 nt, Human
cagauccagggacug

SEQ ID NO: 2585890 - RNA, 22 nt, Human
cagaucccagaaggaccuccug

SEQ ID NO: 2585891 - RNA, 12 nt, Human
cagauccaggac

SEQ ID NO: 2585892 - RNA, 13 nt, Human
cagauccaggacu

SEQ ID NO: 2585893 - RNA, 13 nt, Human
cagauccagggac

SEQ ID NO: 2585894 - RNA, 14 nt, Human
cagauccagggaca

SEQ ID NO: 2585895 - RNA, 15 nt, Human
cagauccagggacag

SEQ ID NO: 2585896 - RNA, 23 nt, Human
cagauccagggacagaggcccca

SEQ ID NO: 2585897 - RNA, 19 nt, Human
cagauauauuuuucacagu

SEQ ID NO: 2585898 - RNA, 18 nt, Human
cagauaugauauguaaac

SEQ ID NO: 2585899 - RNA, 18 nt, Human
cagauccagccugggguc

SEQ ID NO: 2585900 - RNA, 13 nt, Human
cagauauauuuuu

SEQ ID NO: 2585901 - RNA, 14 nt, Human
cagauauauuuuuc

SEQ ID NO: 2585902 - RNA, 15 nt, Human
cagauauauuuuuca

SEQ ID NO: 2585903 - RNA, 15 nt, Human
cagauaugauaugua

SEQ ID NO: 2585904 - RNA, 16 nt, Human
cagauauauuuuucac

SEQ ID NO: 2585905 - RNA, 18 nt, Human
cagauauauuuuucacag

SEQ ID NO: 2585906 - RNA, 16 nt, Human
cagaggggguggccuc

SEQ ID NO: 2585907 - RNA, 14 nt, Human
cagaggggguggcc

SEQ ID NO: 2585908 - RNA, 19 nt, Human
cagauacuuggggggcuga

SEQ ID NO: 2585909 - RNA, 19 nt, Human
cagauagauauaugcucug

SEQ ID NO: 2585910 - RNA, 19 nt, Human
cagaggggcuuucuggaga

SEQ ID NO: 2585911 - RNA, 23 nt, Human
cagauauaaauggcugguuuuua

SEQ ID NO: 2585912 - RNA, 20 nt, Human
cagauauaaauggcugguuu

SEQ ID NO: 2585913 - RNA, 18 nt, Human
cagauauaaauggcuggu

SEQ ID NO: 2585914 - RNA, 20 nt, Human
cagauauauaucauauuggu

SEQ ID NO: 2585915 - RNA, 22 nt, Human
cagauauaaauggcugguuuuu

SEQ ID NO: 2585916 - RNA, 19 nt, Human
cagauauauuaagugacug

SEQ ID NO: 2585917 - RNA, 22 nt, Human
cagauauaaaagacugaccaau

SEQ ID NO: 2585918 - RNA, 18 nt, Human
cagauugcaacaggcugg

SEQ ID NO: 2585919 - RNA, 14 nt, Human
cagauuguuaucua

SEQ ID NO: 2585920 - RNA, 22 nt, Human
cagauuggcucacacugagaau

SEQ ID NO: 2585921 - RNA, 21 nt, Human
cagauuggcucacacugagaa

SEQ ID NO: 2585922 - RNA, 20 nt, Human
cagauuggcucacacugaga

SEQ ID NO: 2585923 - RNA, 20 nt, Human
cagauugcaacaggcugggc

SEQ ID NO: 2585924 - RNA, 19 nt, Human
cagauugcaacaggcuggg

SEQ ID NO: 2585925 - RNA, 13 nt, Human
cagauuuaugcau

SEQ ID NO: 2585926 - RNA, 18 nt, Human
cagauuuacacugggaga

SEQ ID NO: 2585927 - RNA, 17 nt, Human
cagauuuacacugggag

SEQ ID NO: 2585928 - RNA, 14 nt, Human
cagauuuacacugg

SEQ ID NO: 2585929 - RNA, 13 nt, Human
cagauuuacacug

SEQ ID NO: 2585930 - RNA, 20 nt, Human
cagauuucacucuccuuggu

SEQ ID NO: 2585931 - RNA, 22 nt, Human
cagauuuagugaaagcuagaga

SEQ ID NO: 2585932 - RNA, 17 nt, Human
cagauuuagugaaagcu

SEQ ID NO: 2585933 - RNA, 20 nt, Human
cagauuuagugaaagcuaga

SEQ ID NO: 2585934 - RNA, 17 nt, Human
cagcaccaucucuccuc

SEQ ID NO: 2585935 - RNA, 22 nt, Human
cagcaccacccuagucccuucc

SEQ ID NO: 2585936 - RNA, 21 nt, Human
cagcaccacccuagucccuuc

SEQ ID NO: 2585937 - RNA, 16 nt, Human
cagauuuccagucucc

SEQ ID NO: 2585938 - RNA, 19 nt, Human
cagauuucacucuccuugg

SEQ ID NO: 2585939 - RNA, 24 nt, Human
cagauuuccagucuccaccaggaa

SEQ ID NO: 2585940 - RNA, 19 nt, Human
cagcaccaucucuccuccu

SEQ ID NO: 2585941 - RNA, 20 nt, Human
cagcaccauccgccagggcc

SEQ ID NO: 2585942 - RNA, 21 nt, Human
cagcaccauccgccagggccc

SEQ ID NO: 2585943 - RNA, 18 nt, Human
cagcacccagcaacucca

SEQ ID NO: 2585944 - RNA, 15 nt, Human
cagcaccccuuccau

SEQ ID NO: 2585945 - RNA, 14 nt, Human
cagcaccccuucca

SEQ ID NO: 2585946 - RNA, 13 nt, Human
cagcaccccuucc

SEQ ID NO: 2585947 - RNA, 16 nt, Human
cagcaccccugucucu

SEQ ID NO: 2585948 - RNA, 22 nt, Human
cagccaggcugccaaggccaga

SEQ ID NO: 2585949 - RNA, 13 nt, Human
cagccaggcugcc

SEQ ID NO: 2585950 - RNA, 16 nt, Human
cagccaggcugccaag

SEQ ID NO: 2585951 - RNA, 18 nt, Human
cagccaggcgggcucaag

SEQ ID NO: 2585952 - RNA, 16 nt, Human
cagccaggcgggcuca

SEQ ID NO: 2585953 - RNA, 15 nt, Human
cagccaggcgggcuc

SEQ ID NO: 2585954 - RNA, 14 nt, Human
cagccaggcgggcu

SEQ ID NO: 2585955 - RNA, 20 nt, Human
cagccaggcgggcucaagga

SEQ ID NO: 2585956 - RNA, 19 nt, Human
cagccaggcgggcucaagg

SEQ ID NO: 2585957 - RNA, 14 nt, Human
cagccaggcucugu

SEQ ID NO: 2585958 - RNA, 18 nt, Human
cagccaggcucugugcug

SEQ ID NO: 2585959 - RNA, 17 nt, Human
cagccaggcucugugcu

SEQ ID NO: 2585960 - RNA, 16 nt, Human
cagccaggcucugugc

SEQ ID NO: 2585961 - RNA, 15 nt, Human
cagccaggcucugug

SEQ ID NO: 2585962 - RNA, 23 nt, Human
cagccaggcucugugcugacccu

SEQ ID NO: 2585963 - RNA, 22 nt, Human
cagccaggcucugugcugaccc

SEQ ID NO: 2585964 - RNA, 12 nt, Human
cagccaggcugc

SEQ ID NO: 2585965 - RNA, 14 nt, Human
cagcacgauuucug

SEQ ID NO: 2585966 - RNA, 15 nt, Human
cagcacgauuucugu

SEQ ID NO: 2585967 - RNA, 12 nt, Human
cagcaccuggca

SEQ ID NO: 2585968 - RNA, 13 nt, Human
cagcaccugucuc

SEQ ID NO: 2585969 - RNA, 17 nt, Human
cagcacguguggccugu

SEQ ID NO: 2585970 - RNA, 18 nt, Human
cagcacgggggccaagga

SEQ ID NO: 2585971 - RNA, 14 nt, Human
cagccagacuggca

SEQ ID NO: 2585972 - RNA, 22 nt, Human
cagccagaccuauuccuccugg

SEQ ID NO: 2585973 - RNA, 20 nt, Human
cagccagaccuauuccuccu

SEQ ID NO: 2585974 - RNA, 14 nt, Human
cagcacuacucugu

SEQ ID NO: 2585975 - RNA, 11 nt, Human
cagcacuacuc

SEQ ID NO: 2585976 - RNA, 20 nt, Human
cagcacuaaagcaguggaca

SEQ ID NO: 2585977 - RNA, 10 nt, Human
cagcacuaac

SEQ ID NO: 2585978 - RNA, 14 nt, Human
cagcacuaaagcag

SEQ ID NO: 2585979 - RNA, 17 nt, Human
cagcacuaaagcagugg

SEQ ID NO: 2585980 - RNA, 19 nt, Human
cagcacuaaagcaguggac

SEQ ID NO: 2585981 - RNA, 15 nt, Human
cagccagacuggcac

SEQ ID NO: 2585982 - RNA, 18 nt, Human
cagccagacuggcacagu

SEQ ID NO: 2585983 - RNA, 20 nt, Human
cagccagacuggcacaguuu

SEQ ID NO: 2585984 - RNA, 11 nt, Human
cagccagccca

SEQ ID NO: 2585985 - RNA, 12 nt, Human
cagccagcccag

SEQ ID NO: 2585986 - RNA, 20 nt, Human
cagccagcccagcccagcug

SEQ ID NO: 2585987 - RNA, 17 nt, Human
cagccagcccagcccag

SEQ ID NO: 2585988 - RNA, 19 nt, Human
cagccagcccagcccagcu

SEQ ID NO: 2585989 - RNA, 13 nt, Human
cagccagcccagc

SEQ ID NO: 2585990 - RNA, 14 nt, Human
cagccagcccagcc

SEQ ID NO: 2585991 - RNA, 15 nt, Human
cagccagcccagccc

SEQ ID NO: 2585992 - RNA, 16 nt, Human
cagccagcccagccca

SEQ ID NO: 2585993 - RNA, 18 nt, Human
cagccaggccacuggccc

SEQ ID NO: 2585994 - RNA, 13 nt, Human
cagccaggcgggc

SEQ ID NO: 2585995 - RNA, 12 nt, Human
cagccaggcggg

SEQ ID NO: 2585996 - RNA, 15 nt, Human
cagccaggccccagg

SEQ ID NO: 2585997 - RNA, 23 nt, Human
cagacuguguauucauugaaguc

SEQ ID NO: 2585998 - RNA, 14 nt, Human
cagacuguguauuc

SEQ ID NO: 2585999 - RNA, 12 nt, Human
cagacuguguau

SEQ ID NO: 2586000 - RNA, 22 nt, Human
cagacuguguaaaaagagagcu

SEQ ID NO: 2586001 - RNA, 23 nt, Human
cagacugguugaguucagguagc

SEQ ID NO: 2586002 - RNA, 21 nt, Human
cagacuguguaaaaagagagc

SEQ ID NO: 2586003 - RNA, 20 nt, Human
cagacuggugagcagacugg

SEQ ID NO: 2586004 - RNA, 18 nt, Human
cagacuuaccaggaagca

SEQ ID NO: 2586005 - RNA, 24 nt, Human
cagacuguuagaaaauggacacug

SEQ ID NO: 2586006 - RNA, 23 nt, Human
cagacuguuagaaaauggacacu

SEQ ID NO: 2586007 - RNA, 14 nt, Human
cagacuuaccagga

SEQ ID NO: 2586008 - RNA, 21 nt, Human
cagacaggcaagcaccuccug

SEQ ID NO: 2586009 - RNA, 20 nt, Human
cagacaggcaagcaccuccu

SEQ ID NO: 2586010 - RNA, 18 nt, Human
cagacaggcaagcaccuc

SEQ ID NO: 2586011 - RNA, 13 nt, Human
cagacaggcaagc

SEQ ID NO: 2586012 - RNA, 24 nt, Human
cagacaggaccagggauuuccaug

SEQ ID NO: 2586013 - RNA, 17 nt, Human
cagacaggaccagggau

SEQ ID NO: 2586014 - RNA, 13 nt, Human
cagacaggagaaa

SEQ ID NO: 2586015 - RNA, 12 nt, Human
cagacaggagga

SEQ ID NO: 2586016 - RNA, 21 nt, Human
cagacaggagaaaugcaucca

SEQ ID NO: 2586017 - RNA, 23 nt, Human
cagacaggaaagggaaggcccca

SEQ ID NO: 2586018 - RNA, 11 nt, Human
cagacaggcaa

SEQ ID NO: 2586019 - RNA, 18 nt, Human
cagacagcugccugggau

SEQ ID NO: 2586020 - RNA, 17 nt, Human
cagacagcugccuggga

SEQ ID NO: 2586021 - RNA, 16 nt, Human
cagacagcugccuggg

SEQ ID NO: 2586022 - RNA, 15 nt, Human
cagacagcugccugg

SEQ ID NO: 2586023 - RNA, 16 nt, Human
cagacaggaccaggga

SEQ ID NO: 2586024 - RNA, 15 nt, Human
cagacaggaccaggg

SEQ ID NO: 2586025 - RNA, 13 nt, Human
cagacaggaccag

SEQ ID NO: 2586026 - RNA, 21 nt, Human
cagacagcuccacccuggccg

SEQ ID NO: 2586027 - RNA, 11 nt, Human
cagacagcucc

SEQ ID NO: 2586028 - RNA, 12 nt, Human
cagacagcuccc

SEQ ID NO: 2586029 - RNA, 17 nt, Human
cagacagcucccucugc

SEQ ID NO: 2586030 - RNA, 19 nt, Human
cagacagcucccucugccu

SEQ ID NO: 2586031 - RNA, 15 nt, Human
cagacaggaaaggga

SEQ ID NO: 2586032 - RNA, 20 nt, Human
cagacaggaaagggaaggcc

SEQ ID NO: 2586033 - RNA, 14 nt, Human
cagacagcugccug

SEQ ID NO: 2586034 - RNA, 13 nt, Human
cagacagcugccu

SEQ ID NO: 2586035 - RNA, 16 nt, Human
cagacagccuguaucu

SEQ ID NO: 2586036 - RNA, 14 nt, Human
cagacagccuguau

SEQ ID NO: 2586037 - RNA, 13 nt, Human
cagacagccugua

SEQ ID NO: 2586038 - RNA, 12 nt, Human
cagacagccugu

SEQ ID NO: 2586039 - RNA, 14 nt, Human
cagacagcccucca

SEQ ID NO: 2586040 - RNA, 17 nt, Human
cagacagcagcucaggc

SEQ ID NO: 2586041 - RNA, 18 nt, Human
cagacagcagcucaggca

SEQ ID NO: 2586042 - RNA, 19 nt, Human
cagacagcagcucaggcac

SEQ ID NO: 2586043 - RNA, 12 nt, Human
cagacagaggau

SEQ ID NO: 2586044 - RNA, 14 nt, Human
cagacagaggauga

SEQ ID NO: 2586045 - RNA, 19 nt, Human
cagacagacaucucugcac

SEQ ID NO: 2586046 - RNA, 16 nt, Human
cagacagacacacaca

SEQ ID NO: 2586047 - RNA, 19 nt, Human
cagacagaggaugagcucu

SEQ ID NO: 2586048 - RNA, 21 nt, Human
cagacagauggaaaagggaga

SEQ ID NO: 2586049 - RNA, 21 nt, Human
cagacagcaacggggaggcca

SEQ ID NO: 2586050 - RNA, 13 nt, Human
cagacagcagcuc

SEQ ID NO: 2586051 - RNA, 15 nt, Human
cagacagcagcucag

SEQ ID NO: 2586052 - RNA, 16 nt, Human
cagacagcagcucagg

SEQ ID NO: 2586053 - RNA, 15 nt, Human
cagacagacacacac

SEQ ID NO: 2586054 - RNA, 14 nt, Human
cagacagacacaca

SEQ ID NO: 2586055 - RNA, 17 nt, Human
cagacuggcacaguuuu

SEQ ID NO: 2586056 - RNA, 18 nt, Human
cagacuggcacaguuuuc

SEQ ID NO: 2586057 - RNA, 21 nt, Human
cagacuggaagcacagcuuca

SEQ ID NO: 2586058 - RNA, 20 nt, Human
cagacuggaagcacagcuuc

SEQ ID NO: 2586059 - RNA, 22 nt, Human
cagacuggcacaguuuucugag

SEQ ID NO: 2586060 - RNA, 23 nt, Human
cagacuggcacaguuuucugaga

SEQ ID NO: 2586061 - RNA, 18 nt, Human
cagacugcauguaguugg

SEQ ID NO: 2586062 - RNA, 11 nt, Human
cagacuggagg

SEQ ID NO: 2586063 - RNA, 16 nt, Human
cagacuggcuggcugc

SEQ ID NO: 2586064 - RNA, 15 nt, Human
cagacuggguuucua

SEQ ID NO: 2586065 - RNA, 12 nt, Human
cagacuggaggg

SEQ ID NO: 2586066 - RNA, 20 nt, Human
cagacuggguuucuagccca

SEQ ID NO: 2586067 - RNA, 18 nt, Human
cagacuggguuucuagcc

SEQ ID NO: 2586068 - RNA, 15 nt, Human
cagacuggugagcag

SEQ ID NO: 2586069 - RNA, 17 nt, Human
cagacuggugagcagac

SEQ ID NO: 2586070 - RNA, 18 nt, Human
cagacuggaagcacagcu

SEQ ID NO: 2586071 - RNA, 17 nt, Human
cagacuggaagcacagc

SEQ ID NO: 2586072 - RNA, 16 nt, Human
cagacuggaagcacag

SEQ ID NO: 2586073 - RNA, 14 nt, Human
cagacuggaagcac

SEQ ID NO: 2586074 - RNA, 13 nt, Human
cagacuggaagca

SEQ ID NO: 2586075 - RNA, 14 nt, Human
cagacugcuuccaa

SEQ ID NO: 2586076 - RNA, 20 nt, Human
cagacugcuuccaauuuucu

SEQ ID NO: 2586077 - RNA, 20 nt, Human
cagacugcugggacuggcca

SEQ ID NO: 2586078 - RNA, 23 nt, Human
cagacugcugggacuggccaggu

SEQ ID NO: 2586079 - RNA, 15 nt, Human
cagacugcugggacu

SEQ ID NO: 2586080 - RNA, 16 nt, Human
cagacugcugggacug

SEQ ID NO: 2586081 - RNA, 13 nt, Human
cagacugcuggga

SEQ ID NO: 2586082 - RNA, 18 nt, Human
cagacugcgauuuguccc

SEQ ID NO: 2586083 - RNA, 21 nt, Human
cagacucuacagaggccaugg

SEQ ID NO: 2586084 - RNA, 20 nt, Human
cagacucuacagaggccaug

SEQ ID NO: 2586085 - RNA, 19 nt, Human
cagacucuacagaggccau

SEQ ID NO: 2586086 - RNA, 18 nt, Human
cagacucuacagaggcca

SEQ ID NO: 2586087 - RNA, 21 nt, Human
cagacuccugaggacagcugu

SEQ ID NO: 2586088 - RNA, 23 nt, Human
cagacucuacagaggccaugggc

SEQ ID NO: 2586089 - RNA, 17 nt, Human
cagacucucugugaacc

SEQ ID NO: 2586090 - RNA, 12 nt, Human
cagacucucugu

SEQ ID NO: 2586091 - RNA, 14 nt, Human
cagacucuggucuu

SEQ ID NO: 2586092 - RNA, 23 nt, Human
cagacucuuuuuguaccugguga

SEQ ID NO: 2586093 - RNA, 20 nt, Human
cagacugacaaauguguauc

SEQ ID NO: 2586094 - RNA, 20 nt, Human
cagacugaacuuaccgugag

SEQ ID NO: 2586095 - RNA, 18 nt, Human
cagacaggcaaauaaaag

SEQ ID NO: 2586096 - RNA, 15 nt, Human
cagacaggccccgug

SEQ ID NO: 2586097 - RNA, 14 nt, Human
cagacaggcucuua

SEQ ID NO: 2586098 - RNA, 20 nt, Human
cagacaggccccgugaggca

SEQ ID NO: 2586099 - RNA, 20 nt, Human
cagacaggcucuuagcagcu

SEQ ID NO: 2586100 - RNA, 18 nt, Human
cagacaggcucuuagcag

SEQ ID NO: 2586101 - RNA, 22 nt, Human
cagacaggcucuuagcagcuuc

SEQ ID NO: 2586102 - RNA, 23 nt, Human
cagacaggcaagcaccuccugcc

SEQ ID NO: 2586103 - RNA, 22 nt, Human
cagacaggcaagcaccuccugc

SEQ ID NO: 2586104 - RNA, 17 nt, Human
cagacucuacagaggcc

SEQ ID NO: 2586105 - RNA, 20 nt, Human
cagacuccugaggacagcug

SEQ ID NO: 2586106 - RNA, 16 nt, Human
cagacuccugaggaca

SEQ ID NO: 2586107 - RNA, 21 nt, Human
cagacuccugugcaacuuucc

SEQ ID NO: 2586108 - RNA, 22 nt, Human
cagacucgauucauauugaaua

SEQ ID NO: 2586109 - RNA, 19 nt, Human
cagacaguguuuucuggga

SEQ ID NO: 2586110 - RNA, 18 nt, Human
cagacaggguucauugaa

SEQ ID NO: 2586111 - RNA, 19 nt, Human
cagacucccauuccugaag

SEQ ID NO: 2586112 - RNA, 20 nt, Human
cagacucccauuccugaaga

SEQ ID NO: 2586113 - RNA, 14 nt, Human
cagacuccugagga

SEQ ID NO: 2586114 - RNA, 13 nt, Human
cagacuccugagg

SEQ ID NO: 2586115 - RNA, 20 nt, Human
caggaaagagaacuuccaga

SEQ ID NO: 2586116 - RNA, 16 nt, Human
caggaaagagaacuuc

SEQ ID NO: 2586117 - RNA, 17 nt, Human
caggaaaggcuccagga

SEQ ID NO: 2586118 - RNA, 16 nt, Human
caggaaaggcuccagg

SEQ ID NO: 2586119 - RNA, 20 nt, Human
caggaaaggcuccaggagca

SEQ ID NO: 2586120 - RNA, 19 nt, Human
caggaaaggcuccaggagc

SEQ ID NO: 2586121 - RNA, 19 nt, Human
caggaaacuccacaucugc

SEQ ID NO: 2586122 - RNA, 16 nt, Human
cagcuucaccagagca

SEQ ID NO: 2586123 - RNA, 23 nt, Human
caggaaacuccacaucugccuua

SEQ ID NO: 2586124 - RNA, 22 nt, Human
caggaaacuccacaucugccuu

SEQ ID NO: 2586125 - RNA, 21 nt, Human
caggaaacuccacaucugccu

SEQ ID NO: 2586126 - RNA, 20 nt, Human
caggaaacuccacaucugcc

SEQ ID NO: 2586127 - RNA, 20 nt, Human
cagcuuauugucuagugaaa

SEQ ID NO: 2586128 - RNA, 14 nt, Human
cagcuucaccagag

SEQ ID NO: 2586129 - RNA, 13 nt, Human
cagcuucaccaga

SEQ ID NO: 2586130 - RNA, 18 nt, Human
cagcugucccugucacca

SEQ ID NO: 2586131 - RNA, 20 nt, Human
cagcuguaugauucccagcc

SEQ ID NO: 2586132 - RNA, 17 nt, Human
cagcugccucacuuccu

SEQ ID NO: 2586133 - RNA, 14 nt, Human
cagcuuauugucua

SEQ ID NO: 2586134 - RNA, 12 nt, Human
cagcugucccug

SEQ ID NO: 2586135 - RNA, 13 nt, Human
cagcugucccugu

SEQ ID NO: 2586136 - RNA, 14 nt, Human
cagcugucccuguc

SEQ ID NO: 2586137 - RNA, 15 nt, Human
cagcugucccuguca

SEQ ID NO: 2586138 - RNA, 16 nt, Human
cagcugucccugucac

SEQ ID NO: 2586139 - RNA, 17 nt, Human
cagcugucccugucacc

SEQ ID NO: 2586140 - RNA, 22 nt, Human
cagcugagcacauucuggcuca

SEQ ID NO: 2586141 - RNA, 17 nt, Human
cagcugagagaaaauaa

SEQ ID NO: 2586142 - RNA, 21 nt, Human
cagcugagagacuuuuaauca

SEQ ID NO: 2586143 - RNA, 21 nt, Human
cagcugacuuuucuguccgag

SEQ ID NO: 2586144 - RNA, 14 nt, Human
cagcugagcgccag

SEQ ID NO: 2586145 - RNA, 16 nt, Human
cagcugagcgccagga

SEQ ID NO: 2586146 - RNA, 18 nt, Human
cagcugagcgccaggaug

SEQ ID NO: 2586147 - RNA, 19 nt, Human
cagcugccgaccagagccc

SEQ ID NO: 2586148 - RNA, 14 nt, Human
cagcugccucacuu

SEQ ID NO: 2586149 - RNA, 17 nt, Human
cagccugcuccagcugu

SEQ ID NO: 2586150 - RNA, 19 nt, Human
cagccugcuccagcuguuc

SEQ ID NO: 2586151 - RNA, 14 nt, Human
cagcgccuuuccca

SEQ ID NO: 2586152 - RNA, 22 nt, Human
cagcgccuuucccaacucuagc

SEQ ID NO: 2586153 - RNA, 15 nt, Human
cagccugcuccagcu

SEQ ID NO: 2586154 - RNA, 16 nt, Human
cagccugcuccagcug

SEQ ID NO: 2586155 - RNA, 20 nt, Human
cagcuaacacacagcuccca

SEQ ID NO: 2586156 - RNA, 18 nt, Human
cagcuaacacacagcucc

SEQ ID NO: 2586157 - RNA, 17 nt, Human
cagcuaacacacagcuc

SEQ ID NO: 2586158 - RNA, 16 nt, Human
cagcuaacacacagcu

SEQ ID NO: 2586159 - RNA, 13 nt, Human
cagcgccuuuccc

SEQ ID NO: 2586160 - RNA, 15 nt, Human
cagcuaacauggaag

SEQ ID NO: 2586161 - RNA, 19 nt, Human
cagcuaaagcaauaugcau

SEQ ID NO: 2586162 - RNA, 18 nt, Human
cagcuaaagcccaaccuc

SEQ ID NO: 2586163 - RNA, 15 nt, Human
cagcuaacacacagc

SEQ ID NO: 2586164 - RNA, 17 nt, Human
cagcuaacaauugugaa

SEQ ID NO: 2586165 - RNA, 22 nt, Human
cagcuaaagcccaaccuccuga

SEQ ID NO: 2586166 - RNA, 14 nt, Human
cagcggccccugca

SEQ ID NO: 2586167 - RNA, 19 nt, Human
cagcggccccucccacaca

SEQ ID NO: 2586168 - RNA, 18 nt, Human
cagcggccccucccacac

SEQ ID NO: 2586169 - RNA, 17 nt, Human
cagcggccccucccaca

SEQ ID NO: 2586170 - RNA, 19 nt, Human
cagcguuucuaugacacau

SEQ ID NO: 2586171 - RNA, 22 nt, Human
cagcguuugaggggcuggccuu

SEQ ID NO: 2586172 - RNA, 20 nt, Human
cagcguuugaggggcuggcc

SEQ ID NO: 2586173 - RNA, 16 nt, Human
cagcggccccugcauc

SEQ ID NO: 2586174 - RNA, 15 nt, Human
cagcggccccugcau

SEQ ID NO: 2586175 - RNA, 12 nt, Human
cagcuaaagcaa

SEQ ID NO: 2586176 - RNA, 16 nt, Human
cagcggccccucccac

SEQ ID NO: 2586177 - RNA, 15 nt, Human
cagcggccccuccca

SEQ ID NO: 2586178 - RNA, 13 nt, Human
cagcggccccucc

SEQ ID NO: 2586179 - RNA, 22 nt, Human
cagcggagguguggagccgagg

SEQ ID NO: 2586180 - RNA, 20 nt, Human
cagcgcuggccgggaccccg

SEQ ID NO: 2586181 - RNA, 19 nt, Human
cagcgcuggguccacccca

SEQ ID NO: 2586182 - RNA, 20 nt, Human
caggccggcgagcccugugg

SEQ ID NO: 2586183 - RNA, 14 nt, Human
caggccuccuacag

SEQ ID NO: 2586184 - RNA, 17 nt, Human
caggccucuguguccuu

SEQ ID NO: 2586185 - RNA, 15 nt, Human
caggccucugugucc

SEQ ID NO: 2586186 - RNA, 14 nt, Human
caggccucuguguc

SEQ ID NO: 2586187 - RNA, 13 nt, Human
caggccucugugu

SEQ ID NO: 2586188 - RNA, 12 nt, Human
caggccucugug

SEQ ID NO: 2586189 - RNA, 18 nt, Human
caggccucuuggcaguca

SEQ ID NO: 2586190 - RNA, 15 nt, Human
caggccucuuggcag

SEQ ID NO: 2586191 - RNA, 12 nt, Human
caggccucuugg

SEQ ID NO: 2586192 - RNA, 22 nt, Human
caggccucuguguccuucccug

SEQ ID NO: 2586193 - RNA, 20 nt, Human
caggccugaaagaggcugag

SEQ ID NO: 2586194 - RNA, 15 nt, Human
caggccugaaagagg

SEQ ID NO: 2586195 - RNA, 19 nt, Human
caggccugggucugugucu

SEQ ID NO: 2586196 - RNA, 20 nt, Human
caggccugggucugugucuc

SEQ ID NO: 2586197 - RNA, 19 nt, Human
caggccucuuggcagucac

SEQ ID NO: 2586198 - RNA, 14 nt, Human
caggccugggucug

SEQ ID NO: 2586199 - RNA, 16 nt, Human
caggccugggucugug

SEQ ID NO: 2586200 - RNA, 18 nt, Human
caggccugggucuguguc

SEQ ID NO: 2586201 - RNA, 12 nt, Human
caggccuccuac

SEQ ID NO: 2586202 - RNA, 19 nt, Human
caggccguggcugcccaca

SEQ ID NO: 2586203 - RNA, 17 nt, Human
caggccguggcugccca

SEQ ID NO: 2586204 - RNA, 19 nt, Human
caggccgggguggagcaug

SEQ ID NO: 2586205 - RNA, 19 nt, Human
caggccggugugggcugug

SEQ ID NO: 2586206 - RNA, 18 nt, Human
caggccguccucccgggc

SEQ ID NO: 2586207 - RNA, 20 nt, Human
caggccgggguggagcaugg

SEQ ID NO: 2586208 - RNA, 22 nt, Human
caggccggugugggcugugucg

SEQ ID NO: 2586209 - RNA, 22 nt, Human
caggccguccucccgggcccuc

SEQ ID NO: 2586210 - RNA, 15 nt, Human
caggccguggcugcc

SEQ ID NO: 2586211 - RNA, 11 nt, Human
caggcuacugu

SEQ ID NO: 2586212 - RNA, 19 nt, Human
caggcguucagcucacugu

SEQ ID NO: 2586213 - RNA, 22 nt, Human
caggcguagaucaccagaauaa

SEQ ID NO: 2586214 - RNA, 22 nt, Human
caggcguucagcucacuguucu

SEQ ID NO: 2586215 - RNA, 23 nt, Human
caggcuaaacauccaauauuuuc

SEQ ID NO: 2586216 - RNA, 13 nt, Human
caggcuacacuga

SEQ ID NO: 2586217 - RNA, 19 nt, Human
caggcuaaggcguggagcu

SEQ ID NO: 2586218 - RNA, 20 nt, Human
caggcuacacugacacuggu

SEQ ID NO: 2586219 - RNA, 14 nt, Human
caggcuacucuccu

SEQ ID NO: 2586220 - RNA, 21 nt, Human
caggcugggagagccuuccag

SEQ ID NO: 2586221 - RNA, 21 nt, Human
caggcgugagccaccgugccu

SEQ ID NO: 2586222 - RNA, 13 nt, Human
caggcguucagcu

SEQ ID NO: 2586223 - RNA, 19 nt, Human
caggcgauccaccugucuc

SEQ ID NO: 2586224 - RNA, 11 nt, Human
caggccuugcg

SEQ ID NO: 2586225 - RNA, 15 nt, Human
caggcgaggccugga

SEQ ID NO: 2586226 - RNA, 16 nt, Human
caggcgauccaccugu

SEQ ID NO: 2586227 - RNA, 12 nt, Human
caggccugugug

SEQ ID NO: 2586228 - RNA, 16 nt, Human
caggccuuaucuccaa

SEQ ID NO: 2586229 - RNA, 17 nt, Human
caggccuuaucuccaag

SEQ ID NO: 2586230 - RNA, 22 nt, Human
caggccuuaucuccaagaccag

SEQ ID NO: 2586231 - RNA, 16 nt, Human
caggggaaaagaggag

SEQ ID NO: 2586232 - RNA, 14 nt, Human
caggggaaaagagg

SEQ ID NO: 2586233 - RNA, 17 nt, Human
caggggaaaaucagccu

SEQ ID NO: 2586234 - RNA, 19 nt, Human
cagggcuauagcucaggac

SEQ ID NO: 2586235 - RNA, 19 nt, Human
cagggagcauggcugugag

SEQ ID NO: 2586236 - RNA, 18 nt, Human
cagggcuagugacuugug

SEQ ID NO: 2586237 - RNA, 15 nt, Human
cagggcuagugacuu

SEQ ID NO: 2586238 - RNA, 14 nt, Human
cagggcuagugacu

SEQ ID NO: 2586239 - RNA, 19 nt, Human
cagggcuacccugagcuga

SEQ ID NO: 2586240 - RNA, 22 nt, Human
cagggcuacccugagcugaggc

SEQ ID NO: 2586241 - RNA, 23 nt, Human
cagggcuacccugagcugaggca

SEQ ID NO: 2586242 - RNA, 24 nt, Human
cagggcuacccugagcugaggcag

SEQ ID NO: 2586243 - RNA, 13 nt, Human
cagggcuccugcc

SEQ ID NO: 2586244 - RNA, 19 nt, Human
cagggcucacgugggaacc

SEQ ID NO: 2586245 - RNA, 14 nt, Human
cagggcuccugcac

SEQ ID NO: 2586246 - RNA, 12 nt, Human
cagggcuccugc

SEQ ID NO: 2586247 - RNA, 11 nt, Human
cagggcuccug

SEQ ID NO: 2586248 - RNA, 12 nt, Human
cagggcucagcc

SEQ ID NO: 2586249 - RNA, 13 nt, Human
cagggcucagccu

SEQ ID NO: 2586250 - RNA, 14 nt, Human
cagggcucagccug

SEQ ID NO: 2586251 - RNA, 20 nt, Human
cagggcucucuuuccuucuu

SEQ ID NO: 2586252 - RNA, 22 nt, Human
cagggcuccugccuucuguccu

SEQ ID NO: 2586253 - RNA, 20 nt, Human
cagggcuccugccuucuguc

SEQ ID NO: 2586254 - RNA, 12 nt, Human
cagggcuccugg

SEQ ID NO: 2586255 - RNA, 23 nt, Human
cagggcuccugccuucuguccug

SEQ ID NO: 2586256 - RNA, 13 nt, Human
cagggcuccuggg

SEQ ID NO: 2586257 - RNA, 15 nt, Human
cagggcucugcccca

SEQ ID NO: 2586258 - RNA, 15 nt, Human
cagggcucugaccag

SEQ ID NO: 2586259 - RNA, 12 nt, Human
cagggcucugac

SEQ ID NO: 2586260 - RNA, 24 nt, Human
cagggcucucuuuccuucuugccu

SEQ ID NO: 2586261 - RNA, 22 nt, Human
cagggcucucuuuccuucuugc

SEQ ID NO: 2586262 - RNA, 21 nt, Human
cagggcucucuuuccuucuug

SEQ ID NO: 2586263 - RNA, 19 nt, Human
cagggcucugccccagagg

SEQ ID NO: 2586264 - RNA, 13 nt, Human
cagggcucugccc

SEQ ID NO: 2586265 - RNA, 16 nt, Human
cagggcuacccugagc

SEQ ID NO: 2586266 - RNA, 18 nt, Human
cagggcuacccugagcug

SEQ ID NO: 2586267 - RNA, 14 nt, Human
cagggcuacccuga

SEQ ID NO: 2586268 - RNA, 17 nt, Human
cagggcuacccuccccc

SEQ ID NO: 2586269 - RNA, 17 nt, Human
cagggcuaagagcuagc

SEQ ID NO: 2586270 - RNA, 15 nt, Human
cagggcuacccuccc

SEQ ID NO: 2586271 - RNA, 15 nt, Human
cagggagcauggcug

SEQ ID NO: 2586272 - RNA, 19 nt, Human
cagggagcauuuuccucca

SEQ ID NO: 2586273 - RNA, 23 nt, Human
cagggagaggagugacugagcuu

SEQ ID NO: 2586274 - RNA, 16 nt, Human
cagggagaggccauga

SEQ ID NO: 2586275 - RNA, 17 nt, Human
cagggagaggccaugau

SEQ ID NO: 2586276 - RNA, 21 nt, Human
cagggagcaggcggugggcac

SEQ ID NO: 2586277 - RNA, 23 nt, Human
caggcugggagagccuuccaggg

SEQ ID NO: 2586278 - RNA, 22 nt, Human
caggcugggagagccuuccagg

SEQ ID NO: 2586279 - RNA, 16 nt, Human
caggcuacucuccucg

SEQ ID NO: 2586280 - RNA, 15 nt, Human
caggcuacucuccuc

SEQ ID NO: 2586281 - RNA, 13 nt, Human
cagggagaagcuc

SEQ ID NO: 2586282 - RNA, 18 nt, Human
caggcuacucuccucggc

SEQ ID NO: 2586283 - RNA, 12 nt, Human
cagggagacaga

SEQ ID NO: 2586284 - RNA, 19 nt, Human
cagggagacccguccauuu

SEQ ID NO: 2586285 - RNA, 22 nt, Human
cagggagaccgagcgcuuucug

SEQ ID NO: 2586286 - RNA, 19 nt, Human
cagggagaccgagcgcuuu

SEQ ID NO: 2586287 - RNA, 21 nt, Human
caggcacccccuggagagaag

SEQ ID NO: 2586288 - RNA, 18 nt, Human
caggcacccccuggagag

SEQ ID NO: 2586289 - RNA, 21 nt, Human
caggaggcuuggaaagcauca

SEQ ID NO: 2586290 - RNA, 23 nt, Human
caggcacccuucuuuccucuucc

SEQ ID NO: 2586291 - RNA, 21 nt, Human
caggcacccuucuuuccucuu

SEQ ID NO: 2586292 - RNA, 16 nt, Human
caggcacccuucuuuc

SEQ ID NO: 2586293 - RNA, 13 nt, Human
caggcacccuucu

SEQ ID NO: 2586294 - RNA, 13 nt, Human
caggcaccgagaa

SEQ ID NO: 2586295 - RNA, 16 nt, Human
caggcaccgagaaugu

SEQ ID NO: 2586296 - RNA, 17 nt, Human
caggcaccgagaauguu

SEQ ID NO: 2586297 - RNA, 20 nt, Human
caggcaccucacagaaauga

SEQ ID NO: 2586298 - RNA, 16 nt, Human
caggcaccucacagaa

SEQ ID NO: 2586299 - RNA, 15 nt, Human
caggcaccucacaga

SEQ ID NO: 2586300 - RNA, 19 nt, Human
caggcaccuuaguggcuuu

SEQ ID NO: 2586301 - RNA, 16 nt, Human
caggcacgaacccacc

SEQ ID NO: 2586302 - RNA, 17 nt, Human
caggcacgaacccaccu

SEQ ID NO: 2586303 - RNA, 19 nt, Human
caggcacgaacccaccugc

SEQ ID NO: 2586304 - RNA, 22 nt, Human
caggcacgaacccaccugcuga

SEQ ID NO: 2586305 - RNA, 22 nt, Human
caggcacuagccuuuggcucug

SEQ ID NO: 2586306 - RNA, 16 nt, Human
caggcacuagccuuug

SEQ ID NO: 2586307 - RNA, 20 nt, Human
caggcacgaacccaccugcu

SEQ ID NO: 2586308 - RNA, 21 nt, Human
caggcacgaacccaccugcug

SEQ ID NO: 2586309 - RNA, 12 nt, Human
caggccaggccc

SEQ ID NO: 2586310 - RNA, 11 nt, Human
caggccaggcc

SEQ ID NO: 2586311 - RNA, 20 nt, Human
caggcacucaaugcagccag

SEQ ID NO: 2586312 - RNA, 23 nt, Human
caggcacuagccuuuggcucugg

SEQ ID NO: 2586313 - RNA, 18 nt, Human
caggccaggccaccagga

SEQ ID NO: 2586314 - RNA, 16 nt, Human
caggccaggccaccag

SEQ ID NO: 2586315 - RNA, 14 nt, Human
caggccaggccacc

SEQ ID NO: 2586316 - RNA, 14 nt, Human
caggccaggccagc

SEQ ID NO: 2586317 - RNA, 19 nt, Human
caggaggccagccuugacc

SEQ ID NO: 2586318 - RNA, 18 nt, Human
caggaggccagccuugac

SEQ ID NO: 2586319 - RNA, 22 nt, Human
caggaggccagccuugaccauu

SEQ ID NO: 2586320 - RNA, 19 nt, Human
caggaggccccuggcccag

SEQ ID NO: 2586321 - RNA, 18 nt, Human
caggaggccccuggccca

SEQ ID NO: 2586322 - RNA, 17 nt, Human
caggaggccccuggccc

SEQ ID NO: 2586323 - RNA, 16 nt, Human
caggaggccccuggcc

SEQ ID NO: 2586324 - RNA, 18 nt, Human
caggaggccaggccggcg

SEQ ID NO: 2586325 - RNA, 14 nt, Human
caggaggccccugg

SEQ ID NO: 2586326 - RNA, 19 nt, Human
caggaggaucacuugaguc

SEQ ID NO: 2586327 - RNA, 21 nt, Human
caggaggacugccccgugcag

SEQ ID NO: 2586328 - RNA, 23 nt, Human
caggaggacugccccgugcagac

SEQ ID NO: 2586329 - RNA, 23 nt, Human
caggaggagacuagauuuaugaa

SEQ ID NO: 2586330 - RNA, 19 nt, Human
caggaggaggugccaacag

SEQ ID NO: 2586331 - RNA, 15 nt, Human
caggaggaggugcca

SEQ ID NO: 2586332 - RNA, 22 nt, Human
caggaggauugcuugagcccag

SEQ ID NO: 2586333 - RNA, 16 nt, Human
caggaggacaauucau

SEQ ID NO: 2586334 - RNA, 15 nt, Human
caggaggacaauuca

SEQ ID NO: 2586335 - RNA, 13 nt, Human
caggaggacaauu

SEQ ID NO: 2586336 - RNA, 23 nt, Human
caggaggaaucaugucaggccug

SEQ ID NO: 2586337 - RNA, 22 nt, Human
caggaggacaauucaugaacuu

SEQ ID NO: 2586338 - RNA, 19 nt, Human
caggaggacaauucaugaa

SEQ ID NO: 2586339 - RNA, 19 nt, Human
caggaggacugccccgugc

SEQ ID NO: 2586340 - RNA, 17 nt, Human
caggcaaugcuggcugu

SEQ ID NO: 2586341 - RNA, 16 nt, Human
caggcaaugcuggcug

SEQ ID NO: 2586342 - RNA, 15 nt, Human
caggcaaugcuggcu

SEQ ID NO: 2586343 - RNA, 14 nt, Human
caggcaaugcuggc

SEQ ID NO: 2586344 - RNA, 19 nt, Human
caggaggccggggccgggu

SEQ ID NO: 2586345 - RNA, 20 nt, Human
caggaggccccuggcccagc

SEQ ID NO: 2586346 - RNA, 12 nt, Human
caggaggcugag

SEQ ID NO: 2586347 - RNA, 13 nt, Human
caggaggcugagg

SEQ ID NO: 2586348 - RNA, 15 nt, Human
caggaggcugaggca

SEQ ID NO: 2586349 - RNA, 16 nt, Human
caggaggcugaggcag

SEQ ID NO: 2586350 - RNA, 17 nt, Human
caggaggcugaggcaga

SEQ ID NO: 2586351 - RNA, 18 nt, Human
caggaggcugaggcagaa

SEQ ID NO: 2586352 - RNA, 20 nt, Human
caggaggcugaggcagaaga

SEQ ID NO: 2586353 - RNA, 21 nt, Human
caggaggcugaggcagaagaa

SEQ ID NO: 2586354 - RNA, 17 nt, Human
caggaggcugaggcagg

SEQ ID NO: 2586355 - RNA, 18 nt, Human
caggaggcugaggcagga

SEQ ID NO: 2586356 - RNA, 19 nt, Human
caggaggcugaggcaggag

SEQ ID NO: 2586357 - RNA, 20 nt, Human
caggaggcugaggcaggagg

SEQ ID NO: 2586358 - RNA, 21 nt, Human
caggaggcugaggcaggagga

SEQ ID NO: 2586359 - RNA, 15 nt, Human
caggaggcugagggg

SEQ ID NO: 2586360 - RNA, 16 nt, Human
caggaccacaaaaaug

SEQ ID NO: 2586361 - RNA, 16 nt, Human
caggacaugcugaagc

SEQ ID NO: 2586362 - RNA, 13 nt, Human
caggacaugcuga

SEQ ID NO: 2586363 - RNA, 23 nt, Human
caggacaugcgguagccagcaca

SEQ ID NO: 2586364 - RNA, 12 nt, Human
caggacauuucu

SEQ ID NO: 2586365 - RNA, 14 nt, Human
caggacauuucucu

SEQ ID NO: 2586366 - RNA, 18 nt, Human
caggacauuucucuaaga

SEQ ID NO: 2586367 - RNA, 17 nt, Human
caggacaugcugaagcc

SEQ ID NO: 2586368 - RNA, 12 nt, Human
caggaccacaaa

SEQ ID NO: 2586369 - RNA, 21 nt, Human
caggaccagggauuuccauga

SEQ ID NO: 2586370 - RNA, 12 nt, Human
caggaccagcuc

SEQ ID NO: 2586371 - RNA, 13 nt, Human
caggaccagcuca

SEQ ID NO: 2586372 - RNA, 21 nt, Human
caggaccagucaaccugggca

SEQ ID NO: 2586373 - RNA, 22 nt, Human
caggaccaugggaccaggucuu

SEQ ID NO: 2586374 - RNA, 16 nt, Human
caggaccaugggacca

SEQ ID NO: 2586375 - RNA, 13 nt, Human
caggacccagagg

SEQ ID NO: 2586376 - RNA, 14 nt, Human
caggacccagagga

SEQ ID NO: 2586377 - RNA, 15 nt, Human
caggacccagaggaa

SEQ ID NO: 2586378 - RNA, 16 nt, Human
caggacccagaggaag

SEQ ID NO: 2586379 - RNA, 20 nt, Human
caggacccaccaugucugcc

SEQ ID NO: 2586380 - RNA, 21 nt, Human
caggacccaucacgccugugc

SEQ ID NO: 2586381 - RNA, 16 nt, Human
caggaccucaggugag

SEQ ID NO: 2586382 - RNA, 23 nt, Human
caggaccucaggugagaagcaga

SEQ ID NO: 2586383 - RNA, 15 nt, Human
cauauguaccaugua

SEQ ID NO: 2586384 - RNA, 22 nt, Human
cauagguucacaccauuuuguu

SEQ ID NO: 2586385 - RNA, 17 nt, Human
cauauguauuccugauc

SEQ ID NO: 2586386 - RNA, 21 nt, Human
cauauguaccauguacaugaa

SEQ ID NO: 2586387 - RNA, 14 nt, Human
cauauguaaaauaa

SEQ ID NO: 2586388 - RNA, 18 nt, Human
cauauguugaauacuuuu

SEQ ID NO: 2586389 - RNA, 22 nt, Human
cauauuaccacagacauacuaa

SEQ ID NO: 2586390 - RNA, 16 nt, Human
cauauguugaauacuu

SEQ ID NO: 2586391 - RNA, 17 nt, Human
cauauguugaauacuuu

SEQ ID NO: 2586392 - RNA, 17 nt, Human
cauaugugaauauggac

SEQ ID NO: 2586393 - RNA, 15 nt, Human
cauauguuacacuaa

SEQ ID NO: 2586394 - RNA, 20 nt, Human
cauauuaggaaaauaugggu

SEQ ID NO: 2586395 - RNA, 14 nt, Human
cauauuaggaaaau

SEQ ID NO: 2586396 - RNA, 21 nt, Human
cauauuauuuuauguugcaua

SEQ ID NO: 2586397 - RNA, 13 nt, Human
cauauuaugucuu

SEQ ID NO: 2586398 - RNA, 16 nt, Human
cauagguuuaauaauu

SEQ ID NO: 2586399 - RNA, 19 nt, Human
cauaggucacuggcucucc

SEQ ID NO: 2586400 - RNA, 18 nt, Human
cauaggucacuggcucuc

SEQ ID NO: 2586401 - RNA, 17 nt, Human
cauaggucacuggcucu

SEQ ID NO: 2586402 - RNA, 16 nt, Human
cauaggucacuggcuc

SEQ ID NO: 2586403 - RNA, 21 nt, Human
cauaggucacuggcucuccaa

SEQ ID NO: 2586404 - RNA, 16 nt, Human
cauaggugaucucauu

SEQ ID NO: 2586405 - RNA, 13 nt, Human
cauauguaaaaua

SEQ ID NO: 2586406 - RNA, 19 nt, Human
cauagcagcuuauucacaa

SEQ ID NO: 2586407 - RNA, 23 nt, Human
cauagcagagaaugaaagggccc

SEQ ID NO: 2586408 - RNA, 17 nt, Human
cauagcagauuuuaauu

SEQ ID NO: 2586409 - RNA, 16 nt, Human
cauagcagauuuuaau

SEQ ID NO: 2586410 - RNA, 15 nt, Human
cauaggucacuggcu

SEQ ID NO: 2586411 - RNA, 14 nt, Human
cauaggucacuggc

SEQ ID NO: 2586412 - RNA, 16 nt, Human
cauagguauuucaaaa

SEQ ID NO: 2586413 - RNA, 18 nt, Human
cauagcagauuuuaauuu

SEQ ID NO: 2586414 - RNA, 14 nt, Human
cauaauuaaagugu

SEQ ID NO: 2586415 - RNA, 18 nt, Human
cauaauguuacauuauua

SEQ ID NO: 2586416 - RNA, 18 nt, Human
cauaauuaaaguguccau

SEQ ID NO: 2586417 - RNA, 17 nt, Human
cauaauuaaagugucca

SEQ ID NO: 2586418 - RNA, 16 nt, Human
cauaauuaaagugucc

SEQ ID NO: 2586419 - RNA, 15 nt, Human
cauaauuaaaguguc

SEQ ID NO: 2586420 - RNA, 14 nt, Human
cauaauuaugacag

SEQ ID NO: 2586421 - RNA, 18 nt, Human
cauaauuauuauuuggcc

SEQ ID NO: 2586422 - RNA, 19 nt, Human
cauaauuaugacaguuaua

SEQ ID NO: 2586423 - RNA, 15 nt, Human
cauaauuaugacagu

SEQ ID NO: 2586424 - RNA, 17 nt, Human
cauaauuaugacaguua

SEQ ID NO: 2586425 - RNA, 19 nt, Human
cauacagggaugguguuca

SEQ ID NO: 2586426 - RNA, 16 nt, Human
cauacaguuugcacuu

SEQ ID NO: 2586427 - RNA, 21 nt, Human
cauacaggauuugaacucaga

SEQ ID NO: 2586428 - RNA, 12 nt, Human
cauacagcucua

SEQ ID NO: 2586429 - RNA, 18 nt, Human
cauacagcauuacaaauu

SEQ ID NO: 2586430 - RNA, 16 nt, Human
cauacagggauggugu

SEQ ID NO: 2586431 - RNA, 23 nt, Human
cauacaggaagguagaaauaucu

SEQ ID NO: 2586432 - RNA, 23 nt, Human
cauaaugcgugcauaccacuuuu

SEQ ID NO: 2586433 - RNA, 16 nt, Human
cauaaugcuacugucu

SEQ ID NO: 2586434 - RNA, 19 nt, Human
caguuuuccaugaaaacgu

SEQ ID NO: 2586435 - RNA, 13 nt, Human
caguuuuccuucu

SEQ ID NO: 2586436 - RNA, 16 nt, Human
cauaaugugaaguguu

SEQ ID NO: 2586437 - RNA, 15 nt, Human
cauaaugugaagugu

SEQ ID NO: 2586438 - RNA, 13 nt, Human
cauaaugugaagu

SEQ ID NO: 2586439 - RNA, 12 nt, Human
cauaaugugaag

SEQ ID NO: 2586440 - RNA, 19 nt, Human
cauaaugugaaguguuaau

SEQ ID NO: 2586441 - RNA, 17 nt, Human
cauaaugugaaguguua

SEQ ID NO: 2586442 - RNA, 17 nt, Human
cauaauguuacauuauu

SEQ ID NO: 2586443 - RNA, 15 nt, Human
cauaaugcuacuguc

SEQ ID NO: 2586444 - RNA, 14 nt, Human
cauaaugcuacugu

SEQ ID NO: 2586445 - RNA, 22 nt, Human
cauaaugggguccuggccaucc

SEQ ID NO: 2586446 - RNA, 11 nt, Human
cauaaugugaa

SEQ ID NO: 2586447 - RNA, 14 nt, Human
cauaauguauuguu

SEQ ID NO: 2586448 - RNA, 14 nt, Human
cauaaugggguccu

SEQ ID NO: 2586449 - RNA, 15 nt, Human
cauaauguauaaaga

SEQ ID NO: 2586450 - RNA, 18 nt, Human
caguuuuauccacagaaa

SEQ ID NO: 2586451 - RNA, 23 nt, Human
caguuuucaagucaaauuaauaa

SEQ ID NO: 2586452 - RNA, 15 nt, Human
caguuuuaucauuuu

SEQ ID NO: 2586453 - RNA, 15 nt, Human
caguuuuacucugcu

SEQ ID NO: 2586454 - RNA, 12 nt, Human
caguuuucauaa

SEQ ID NO: 2586455 - RNA, 22 nt, Human
caguuuucaagucaaauuaaua

SEQ ID NO: 2586456 - RNA, 12 nt, Human
caguuuuccaug

SEQ ID NO: 2586457 - RNA, 13 nt, Human
caguuuuccauga

SEQ ID NO: 2586458 - RNA, 14 nt, Human
caguuuuccaugaa

SEQ ID NO: 2586459 - RNA, 15 nt, Human
caguuuuccaugaaa

SEQ ID NO: 2586460 - RNA, 16 nt, Human
caguuuuccaugaaaa

SEQ ID NO: 2586461 - RNA, 17 nt, Human
caguuuuccaugaaaac

SEQ ID NO: 2586462 - RNA, 18 nt, Human
caguuuuccaugaaaacg

SEQ ID NO: 2586463 - RNA, 13 nt, Human
caguuuuccauug

SEQ ID NO: 2586464 - RNA, 11 nt, Human
caguuuuccuu

SEQ ID NO: 2586465 - RNA, 22 nt, Human
caguuguuagugugucuuagug

SEQ ID NO: 2586466 - RNA, 18 nt, Human
caguuguuagugugucuu

SEQ ID NO: 2586467 - RNA, 18 nt, Human
caguuuaucauucaagug

SEQ ID NO: 2586468 - RNA, 16 nt, Human
caguuuaucauucaag

SEQ ID NO: 2586469 - RNA, 15 nt, Human
caguuuaucauucaa

SEQ ID NO: 2586470 - RNA, 14 nt, Human
caguuuaucauuca

SEQ ID NO: 2586471 - RNA, 23 nt, Human
caguuguucaauaauaaauauuu

SEQ ID NO: 2586472 - RNA, 19 nt, Human
caguuuaucauucaagugu

SEQ ID NO: 2586473 - RNA, 19 nt, Human
caguuucuguccugcuggu

SEQ ID NO: 2586474 - RNA, 15 nt, Human
caguuucuguccugc

SEQ ID NO: 2586475 - RNA, 14 nt, Human
caguuucugccucu

SEQ ID NO: 2586476 - RNA, 18 nt, Human
caguuucuuagcuuuuua

SEQ ID NO: 2586477 - RNA, 15 nt, Human
caguuucuuagcuuu

SEQ ID NO: 2586478 - RNA, 13 nt, Human
caguuugaacaaa

SEQ ID NO: 2586479 - RNA, 18 nt, Human
caguuucaauucagugcu

SEQ ID NO: 2586480 - RNA, 23 nt, Human
caguuucacuuucacauagaugu

SEQ ID NO: 2586481 - RNA, 17 nt, Human
caguuuccucaucuguc

SEQ ID NO: 2586482 - RNA, 15 nt, Human
caguuucagguguuu

SEQ ID NO: 2586483 - RNA, 22 nt, Human
caguuucagguguuuaguugca

SEQ ID NO: 2586484 - RNA, 21 nt, Human
caguuuguuaguaugaggcau

SEQ ID NO: 2586485 - RNA, 13 nt, Human
caguuuguuuaca

SEQ ID NO: 2586486 - RNA, 16 nt, Human
caguuuuaacuagaau

SEQ ID NO: 2586487 - RNA, 16 nt, Human
caguuuguuuacacac

SEQ ID NO: 2586488 - RNA, 14 nt, Human
caguuuguuuacac

SEQ ID NO: 2586489 - RNA, 18 nt, Human
caguuuguuuacacacgu

SEQ ID NO: 2586490 - RNA, 23 nt, Human
caguuuguuaguaugaggcauuu

SEQ ID NO: 2586491 - RNA, 16 nt, Human
caguuugagacaggag

SEQ ID NO: 2586492 - RNA, 18 nt, Human
caguuugagacaggagac

SEQ ID NO: 2586493 - RNA, 15 nt, Human
caguuugagacagga

SEQ ID NO: 2586494 - RNA, 16 nt, Human
caucacuuuucaguga

SEQ ID NO: 2586495 - RNA, 15 nt, Human
caucacuuuucagug

SEQ ID NO: 2586496 - RNA, 19 nt, Human
caucacuuguacaaaauaa

SEQ ID NO: 2586497 - RNA, 14 nt, Human
caucagaaaggaau

SEQ ID NO: 2586498 - RNA, 19 nt, Human
caucagaaacacccucaca

SEQ ID NO: 2586499 - RNA, 11 nt, Human
caucagaaagg

SEQ ID NO: 2586500 - RNA, 17 nt, Human
caucacuuuucagugau

SEQ ID NO: 2586501 - RNA, 17 nt, Human
caucagaaacacccuca

SEQ ID NO: 2586502 - RNA, 18 nt, Human
cauccucuucugcuuagg

SEQ ID NO: 2586503 - RNA, 15 nt, Human
cauccucuucugcuu

SEQ ID NO: 2586504 - RNA, 16 nt, Human
cauccugacucugccc

SEQ ID NO: 2586505 - RNA, 19 nt, Human
caucccacgcacuccauga

SEQ ID NO: 2586506 - RNA, 11 nt, Human
caucccagagg

SEQ ID NO: 2586507 - RNA, 14 nt, Human
cauccucuucugcu

SEQ ID NO: 2586508 - RNA, 22 nt, Human
cauccucuguacagagcccacg

SEQ ID NO: 2586509 - RNA, 12 nt, Human
caucccagcccc

SEQ ID NO: 2586510 - RNA, 20 nt, Human
caucccaaacccuucagugc

SEQ ID NO: 2586511 - RNA, 13 nt, Human
caucccaacuguc

SEQ ID NO: 2586512 - RNA, 15 nt, Human
caucccacaaguggu

SEQ ID NO: 2586513 - RNA, 23 nt, Human
caucccaaaaucauaagauauuu

SEQ ID NO: 2586514 - RNA, 20 nt, Human
cauccauuucaucuauuucu

SEQ ID NO: 2586515 - RNA, 23 nt, Human
cauccauuucaucuauuucugag

SEQ ID NO: 2586516 - RNA, 11 nt, Human
caucccagccc

SEQ ID NO: 2586517 - RNA, 14 nt, Human
caucccacacccug

SEQ ID NO: 2586518 - RNA, 13 nt, Human
caucccacugcuc

SEQ ID NO: 2586519 - RNA, 21 nt, Human
caucagcacgauuucuguuua

SEQ ID NO: 2586520 - RNA, 18 nt, Human
caucagcauaccuuuauu

SEQ ID NO: 2586521 - RNA, 17 nt, Human
caucagcauaccuuuau

SEQ ID NO: 2586522 - RNA, 13 nt, Human
caucagcauaccu

SEQ ID NO: 2586523 - RNA, 13 nt, Human
caucagaagauaa

SEQ ID NO: 2586524 - RNA, 20 nt, Human
caucagcauaccuuuauugu

SEQ ID NO: 2586525 - RNA, 11 nt, Human
caucagaagga

SEQ ID NO: 2586526 - RNA, 19 nt, Human
caucagcacgauuucuguu

SEQ ID NO: 2586527 - RNA, 19 nt, Human
caucccaaacccuucagug

SEQ ID NO: 2586528 - RNA, 22 nt, Human
cauccauuuauuuggcaucugu

SEQ ID NO: 2586529 - RNA, 19 nt, Human
cauccauuucaucuauuuc

SEQ ID NO: 2586530 - RNA, 16 nt, Human
cauccauuccucaggg

SEQ ID NO: 2586531 - RNA, 17 nt, Human
cauccauuccucaggga

SEQ ID NO: 2586532 - RNA, 18 nt, Human
cauccauuccucagggac

SEQ ID NO: 2586533 - RNA, 19 nt, Human
cauccauuccucagggaca

SEQ ID NO: 2586534 - RNA, 13 nt, Human
caucagcugcuga

SEQ ID NO: 2586535 - RNA, 15 nt, Human
cauccauuccucagg

SEQ ID NO: 2586536 - RNA, 14 nt, Human
caucagcuccagcu

SEQ ID NO: 2586537 - RNA, 18 nt, Human
cauccugaggcuccacuu

SEQ ID NO: 2586538 - RNA, 19 nt, Human
cauccugaggcuccacuug

SEQ ID NO: 2586539 - RNA, 12 nt, Human
cauccugcagcc

SEQ ID NO: 2586540 - RNA, 20 nt, Human
cauccugacucugcccccug

SEQ ID NO: 2586541 - RNA, 19 nt, Human
cauccugacucugcccccu

SEQ ID NO: 2586542 - RNA, 17 nt, Human
cauccugacucugcccc

SEQ ID NO: 2586543 - RNA, 22 nt, Human
cauccugacucugcccccugcu

SEQ ID NO: 2586544 - RNA, 12 nt, Human
cauccugcaggc

SEQ ID NO: 2586545 - RNA, 15 nt, Human
caucuaaacugcccc

SEQ ID NO: 2586546 - RNA, 21 nt, Human
caucuaaacugcccccucugc

SEQ ID NO: 2586547 - RNA, 18 nt, Human
caucuaaauaccugcccu

SEQ ID NO: 2586548 - RNA, 15 nt, Human
caucuaaccucaucu

SEQ ID NO: 2586549 - RNA, 15 nt, Human
caucuaaauaccugc

SEQ ID NO: 2586550 - RNA, 20 nt, Human
cauccugccuuagagccagg

SEQ ID NO: 2586551 - RNA, 20 nt, Human
cauccugcagccuccuccug

SEQ ID NO: 2586552 - RNA, 23 nt, Human
caucuaaaaauagacuuaaaucu

SEQ ID NO: 2586553 - RNA, 22 nt, Human
caucguuuucuucacuguccuc

SEQ ID NO: 2586554 - RNA, 22 nt, Human
caucuggauaggagccugcugg

SEQ ID NO: 2586555 - RNA, 21 nt, Human
caucuggauaggagccugcug

SEQ ID NO: 2586556 - RNA, 20 nt, Human
caucuggauaggagccugcu

SEQ ID NO: 2586557 - RNA, 18 nt, Human
caucuggauaggagccug

SEQ ID NO: 2586558 - RNA, 20 nt, Human
caucuggcaacaucuuuauc

SEQ ID NO: 2586559 - RNA, 18 nt, Human
caucuaaccucaucuucu

SEQ ID NO: 2586560 - RNA, 19 nt, Human
caucuaaccucaucuucuu

SEQ ID NO: 2586561 - RNA, 16 nt, Human
caucuggauaggagcc

SEQ ID NO: 2586562 - RNA, 23 nt, Human
caucuggccguugauguuggcug

SEQ ID NO: 2586563 - RNA, 23 nt, Human
caucuggauaggagccugcuggu

SEQ ID NO: 2586564 - RNA, 21 nt, Human
caucuguauacccucuguuuc

SEQ ID NO: 2586565 - RNA, 20 nt, Human
caucuguauacccucuguuu

SEQ ID NO: 2586566 - RNA, 19 nt, Human
caucuguauacccucuguu

SEQ ID NO: 2586567 - RNA, 18 nt, Human
caucuguauacccucugu

SEQ ID NO: 2586568 - RNA, 19 nt, Human
caucuguaacucuaaaaga

SEQ ID NO: 2586569 - RNA, 22 nt, Human
caucuguauaaguaagaaaaua

SEQ ID NO: 2586570 - RNA, 21 nt, Human
caucuguauaaguaagaaaau

SEQ ID NO: 2586571 - RNA, 20 nt, Human
caucuguauaaguaagaaaa

SEQ ID NO: 2586572 - RNA, 17 nt, Human
caucuguaccucugccu

SEQ ID NO: 2586573 - RNA, 16 nt, Human
caucuguaacucuaaa

SEQ ID NO: 2586574 - RNA, 15 nt, Human
cagucgugccugugu

SEQ ID NO: 2586575 - RNA, 17 nt, Human
cagucgugccugugucc

SEQ ID NO: 2586576 - RNA, 14 nt, Human
cagucgugccugug

SEQ ID NO: 2586577 - RNA, 17 nt, Human
cagucuaauuuuuauuc

SEQ ID NO: 2586578 - RNA, 13 nt, Human
cagucuaauuuuu

SEQ ID NO: 2586579 - RNA, 18 nt, Human
cagucuaauuuuuauuca

SEQ ID NO: 2586580 - RNA, 21 nt, Human
cagucuacccaccucagccuc

SEQ ID NO: 2586581 - RNA, 19 nt, Human
cagucuacccagagaagcc

SEQ ID NO: 2586582 - RNA, 15 nt, Human
cagucuacccagaga

SEQ ID NO: 2586583 - RNA, 14 nt, Human
cagucuacccagag

SEQ ID NO: 2586584 - RNA, 23 nt, Human
cagucuacccaccucagccuccu

SEQ ID NO: 2586585 - RNA, 21 nt, Human
cagucucucucucucucuccc

SEQ ID NO: 2586586 - RNA, 22 nt, Human
cagucugauucccaagcucugc

SEQ ID NO: 2586587 - RNA, 21 nt, Human
cagucugauucccaagcucug

SEQ ID NO: 2586588 - RNA, 22 nt, Human
cagucucccuuucccuucuugg

SEQ ID NO: 2586589 - RNA, 22 nt, Human
cagucucccuucucccaugagg

SEQ ID NO: 2586590 - RNA, 18 nt, Human
cagucucccuucucccau

SEQ ID NO: 2586591 - RNA, 18 nt, Human
cagucucccuuucccuuc

SEQ ID NO: 2586592 - RNA, 15 nt, Human
cagucucggguggcu

SEQ ID NO: 2586593 - RNA, 22 nt, Human
cagucucggguggcuagucaga

SEQ ID NO: 2586594 - RNA, 22 nt, Human
cagucuauccacagagaguccc

SEQ ID NO: 2586595 - RNA, 17 nt, Human
cagucuauccacagaga

SEQ ID NO: 2586596 - RNA, 16 nt, Human
cagucuauccacagag

SEQ ID NO: 2586597 - RNA, 15 nt, Human
cagucuauccacaga

SEQ ID NO: 2586598 - RNA, 13 nt, Human
cagucuauccaca

SEQ ID NO: 2586599 - RNA, 22 nt, Human
cagucuacccagagaagccccu

SEQ ID NO: 2586600 - RNA, 23 nt, Human
cagucuauccacagagaguccca

SEQ ID NO: 2586601 - RNA, 21 nt, Human
caguuauaaguagcaggccaa

SEQ ID NO: 2586602 - RNA, 13 nt, Human
caguuauggcuau

SEQ ID NO: 2586603 - RNA, 19 nt, Human
caguuauggcuauaggugc

SEQ ID NO: 2586604 - RNA, 20 nt, Human
caguuauggcuauaggugcu

SEQ ID NO: 2586605 - RNA, 17 nt, Human
caguuauuauauuuaca

SEQ ID NO: 2586606 - RNA, 21 nt, Human
caguuauuauauuuacaaaug

SEQ ID NO: 2586607 - RNA, 19 nt, Human
caguggugcgaucuggguu

SEQ ID NO: 2586608 - RNA, 17 nt, Human
caguggugaagaaaacu

SEQ ID NO: 2586609 - RNA, 14 nt, Human
caguggugaagaaa

SEQ ID NO: 2586610 - RNA, 23 nt, Human
caguggugaagaaaacuccuuua

SEQ ID NO: 2586611 - RNA, 20 nt, Human
cagugguaagcucuggcuuu

SEQ ID NO: 2586612 - RNA, 17 nt, Human
cagugguaagcucuggc

SEQ ID NO: 2586613 - RNA, 20 nt, Human
cagugguccacaucccggga

SEQ ID NO: 2586614 - RNA, 19 nt, Human
cagugguccauggaaugcu

SEQ ID NO: 2586615 - RNA, 18 nt, Human
caguggucaaaccgcacu

SEQ ID NO: 2586616 - RNA, 13 nt, Human
caguggucucaca

SEQ ID NO: 2586617 - RNA, 21 nt, Human
cagugguaugaucacggcuca

SEQ ID NO: 2586618 - RNA, 15 nt, Human
caguuagcaaacuuu

SEQ ID NO: 2586619 - RNA, 16 nt, Human
caguuagcaaacuuug

SEQ ID NO: 2586620 - RNA, 19 nt, Human
caguuaggguugaguuacu

SEQ ID NO: 2586621 - RNA, 19 nt, Human
caguuacucagcccugggc

SEQ ID NO: 2586622 - RNA, 15 nt, Human
caguuacucugaagg

SEQ ID NO: 2586623 - RNA, 16 nt, Human
caguuacucugaaggg

SEQ ID NO: 2586624 - RNA, 20 nt, Human
caguuacucagaauucucua

SEQ ID NO: 2586625 - RNA, 13 nt, Human
caguuacucagcc

SEQ ID NO: 2586626 - RNA, 14 nt, Human
caguuacucagccc

SEQ ID NO: 2586627 - RNA, 15 nt, Human
caguuacucagcccu

SEQ ID NO: 2586628 - RNA, 16 nt, Human
caguuacucagcccug

SEQ ID NO: 2586629 - RNA, 17 nt, Human
caguuacucagcccugg

SEQ ID NO: 2586630 - RNA, 18 nt, Human
caguuacucagcccuggg

SEQ ID NO: 2586631 - RNA, 13 nt, Human
caguuacucugaa

SEQ ID NO: 2586632 - RNA, 18 nt, Human
cagugggagcugccuguu

SEQ ID NO: 2586633 - RNA, 17 nt, Human
cagugggagcugccugu

SEQ ID NO: 2586634 - RNA, 21 nt, Human
cagugcccaccaacaucccau

SEQ ID NO: 2586635 - RNA, 16 nt, Human
cagugggagcugccug

SEQ ID NO: 2586636 - RNA, 22 nt, Human
cagugggucccacuuccccucc

SEQ ID NO: 2586637 - RNA, 20 nt, Human
cagugggucccacuuccccu

SEQ ID NO: 2586638 - RNA, 18 nt, Human
cagugggucccacuuccc

SEQ ID NO: 2586639 - RNA, 17 nt, Human
cagugggucccacuucc

SEQ ID NO: 2586640 - RNA, 15 nt, Human
cagugggucccacuu

SEQ ID NO: 2586641 - RNA, 14 nt, Human
cagugggucccacu

SEQ ID NO: 2586642 - RNA, 20 nt, Human
cagugguaugaucacggcuc

SEQ ID NO: 2586643 - RNA, 15 nt, Human
cagugguaagcucug

SEQ ID NO: 2586644 - RNA, 23 nt, Human
cagugggucccacuuccccuccu

SEQ ID NO: 2586645 - RNA, 13 nt, Human
cagugggugcccc

SEQ ID NO: 2586646 - RNA, 22 nt, Human
cagugauuaccagggacugagg

SEQ ID NO: 2586647 - RNA, 23 nt, Human
cagucugauucccaagcucugcu

SEQ ID NO: 2586648 - RNA, 19 nt, Human
cagugauuuuuuucuugua

SEQ ID NO: 2586649 - RNA, 15 nt, Human
cagugcaaaugucag

SEQ ID NO: 2586650 - RNA, 22 nt, Human
cagugauuuuuuucuuguaauu

SEQ ID NO: 2586651 - RNA, 12 nt, Human
cagucugcugcc

SEQ ID NO: 2586652 - RNA, 22 nt, Human
cagugcccacaggaucagucug

SEQ ID NO: 2586653 - RNA, 18 nt, Human
cagugcccacaggaucag

SEQ ID NO: 2586654 - RNA, 18 nt, Human
cagugcaagagacucugg

SEQ ID NO: 2586655 - RNA, 11 nt, Human
cagugcaagag

SEQ ID NO: 2586656 - RNA, 19 nt, Human
cagugcaagagacucuggc

SEQ ID NO: 2586657 - RNA, 16 nt, Human
cagugcccaccaacau

SEQ ID NO: 2586658 - RNA, 21 nt, Human
cagugcccacaggaucagucu

SEQ ID NO: 2586659 - RNA, 17 nt, Human
cagugcaacagcacugg

SEQ ID NO: 2586660 - RNA, 20 nt, Human
cagugcaaaugucagauaca

SEQ ID NO: 2586661 - RNA, 15 nt, Human
cagugcaacacugaa

SEQ ID NO: 2586662 - RNA, 16 nt, Human
caguucccagaaucaa

SEQ ID NO: 2586663 - RNA, 15 nt, Human
caguucccagaauca

SEQ ID NO: 2586664 - RNA, 18 nt, Human
caguucauugcacuuuga

SEQ ID NO: 2586665 - RNA, 18 nt, Human
caguucauguuugcuuca

SEQ ID NO: 2586666 - RNA, 23 nt, Human
caguucaguggcagggcucagga

SEQ ID NO: 2586667 - RNA, 14 nt, Human
caguucccagaauc

SEQ ID NO: 2586668 - RNA, 13 nt, Human
caguucccagaau

SEQ ID NO: 2586669 - RNA, 21 nt, Human
caguucccagaaggcauauca

SEQ ID NO: 2586670 - RNA, 15 nt, Human
caguucauugcacuu

SEQ ID NO: 2586671 - RNA, 22 nt, Human
caguuauuauauuuacaaaugg

SEQ ID NO: 2586672 - RNA, 22 nt, Human
caguuaugauuuuuuuuucaua

SEQ ID NO: 2586673 - RNA, 18 nt, Human
caguuaugugaaugaucu

SEQ ID NO: 2586674 - RNA, 20 nt, Human
caguuaugugaaugaucucu

SEQ ID NO: 2586675 - RNA, 23 nt, Human
caguucaaucucccgcugcugcu

SEQ ID NO: 2586676 - RNA, 22 nt, Human
caguucaaucucccgcugcugc

SEQ ID NO: 2586677 - RNA, 19 nt, Human
caguucaaucucccgcugc

SEQ ID NO: 2586678 - RNA, 13 nt, Human
caguucacccuga

SEQ ID NO: 2586679 - RNA, 14 nt, Human
caguucaagaaagc

SEQ ID NO: 2586680 - RNA, 16 nt, Human
caguucaccugcacuu

SEQ ID NO: 2586681 - RNA, 23 nt, Human
caguucagaaucacuucugagaa

SEQ ID NO: 2586682 - RNA, 14 nt, Human
caguucagcuuggg

SEQ ID NO: 2586683 - RNA, 13 nt, Human
caguucagcacca

SEQ ID NO: 2586684 - RNA, 16 nt, Human
caguucagcaccaccc

SEQ ID NO: 2586685 - RNA, 15 nt, Human
caguucagcuugggg

SEQ ID NO: 2586686 - RNA, 17 nt, Human
caguucagcaccacccu

SEQ ID NO: 2586687 - RNA, 17 nt, Human
caguucaggagucccaa

SEQ ID NO: 2586688 - RNA, 20 nt, Human
caguucaggagucccaagga

SEQ ID NO: 2586689 - RNA, 23 nt, Human
caguucaggagucccaaggaaag

SEQ ID NO: 2586690 - RNA, 16 nt, Human
caguucaguaccugga

SEQ ID NO: 2586691 - RNA, 15 nt, Human
caguucaguaccugg

SEQ ID NO: 2586692 - RNA, 23 nt, Human
caguucaguaauaaacuguguuu

SEQ ID NO: 2586693 - RNA, 20 nt, Human
caguucaguggcagggcuca

SEQ ID NO: 2586694 - RNA, 19 nt, Human
caguucaguggcagggcuc

SEQ ID NO: 2586695 - RNA, 18 nt, Human
caguucaguggcagggcu

SEQ ID NO: 2586696 - RNA, 22 nt, Human
caguucaguaccuggaggagga

SEQ ID NO: 2586697 - RNA, 21 nt, Human
caguucaguaccuggaggagg

SEQ ID NO: 2586698 - RNA, 20 nt, Human
caguucaguaccuggaggag

SEQ ID NO: 2586699 - RNA, 19 nt, Human
caguucaguaccuggagga

SEQ ID NO: 2586700 - RNA, 18 nt, Human
caguucaguaccuggagg

SEQ ID NO: 2586701 - RNA, 23 nt, Human
caguucauauguaccauguacau

SEQ ID NO: 2586702 - RNA, 22 nt, Human
caguucaguggcagggcucagg

SEQ ID NO: 2586703 - RNA, 21 nt, Human
caguucaguggcagggcucag

SEQ ID NO: 2586704 - RNA, 16 nt, Human
caguucauguuugcuu

SEQ ID NO: 2586705 - RNA, 17 nt, Human
cauuggaagaccccacc

SEQ ID NO: 2586706 - RNA, 20 nt, Human
cauuggaagaccccacccaa

SEQ ID NO: 2586707 - RNA, 18 nt, Human
cauuggaagaccccaccc

SEQ ID NO: 2586708 - RNA, 17 nt, Human
cauuggacccuuccaug

SEQ ID NO: 2586709 - RNA, 15 nt, Human
cauuggauucugaga

SEQ ID NO: 2586710 - RNA, 20 nt, Human
cauuggauucugagagcugu

SEQ ID NO: 2586711 - RNA, 16 nt, Human
cauuggagauguuuag

SEQ ID NO: 2586712 - RNA, 16 nt, Human
cauuggacccuuccau

SEQ ID NO: 2586713 - RNA, 18 nt, Human
cauuggacccacaugagg

SEQ ID NO: 2586714 - RNA, 15 nt, Human
cauuuagucauguga

SEQ ID NO: 2586715 - RNA, 15 nt, Human
cauuuagguuucuga

SEQ ID NO: 2586716 - RNA, 14 nt, Human
cauugguucuugua

SEQ ID NO: 2586717 - RNA, 18 nt, Human
cauuuaggugaggaagca

SEQ ID NO: 2586718 - RNA, 17 nt, Human
cauuuaguuugauuauu

SEQ ID NO: 2586719 - RNA, 20 nt, Human
cauuuaguucuuuguuauuu

SEQ ID NO: 2586720 - RNA, 17 nt, Human
cauuuagucaugugacc

SEQ ID NO: 2586721 - RNA, 14 nt, Human
cauuuaguucuuug

SEQ ID NO: 2586722 - RNA, 20 nt, Human
cauuuaguccaaugucuuuu

SEQ ID NO: 2586723 - RNA, 14 nt, Human
cauugguggacuac

SEQ ID NO: 2586724 - RNA, 16 nt, Human
cauuuaggugaggaag

SEQ ID NO: 2586725 - RNA, 20 nt, Human
cauuggguccugggucuuuc

SEQ ID NO: 2586726 - RNA, 21 nt, Human
cauuggguccugggucuuuca

SEQ ID NO: 2586727 - RNA, 23 nt, Human
cauuggguuguagccaaagguuc

SEQ ID NO: 2586728 - RNA, 19 nt, Human
cauuggguggguaaauuca

SEQ ID NO: 2586729 - RNA, 18 nt, Human
cauuggguggguaaauuc

SEQ ID NO: 2586730 - RNA, 20 nt, Human
cauuuaugagcucuucaugu

SEQ ID NO: 2586731 - RNA, 23 nt, Human
cauuuaugagcucuucauguuuc

SEQ ID NO: 2586732 - RNA, 20 nt, Human
cauuuggcaaugccaucauc

SEQ ID NO: 2586733 - RNA, 15 nt, Human
cauuuaugauuuaau

SEQ ID NO: 2586734 - RNA, 19 nt, Human
cauuuggcagagcuucuuc

SEQ ID NO: 2586735 - RNA, 16 nt, Human
cauuuaugaagcaagc

SEQ ID NO: 2586736 - RNA, 17 nt, Human
cauuuaugagcucuuca

SEQ ID NO: 2586737 - RNA, 17 nt, Human
cauuuaucuuucuacag

SEQ ID NO: 2586738 - RNA, 20 nt, Human
cauuuauccaccuccaucuu

SEQ ID NO: 2586739 - RNA, 18 nt, Human
cauuuaucaaucaguaua

SEQ ID NO: 2586740 - RNA, 20 nt, Human
cauuuaucaaucaguauaau

SEQ ID NO: 2586741 - RNA, 20 nt, Human
cauuuggucaagauuuugaa

SEQ ID NO: 2586742 - RNA, 21 nt, Human
cauuuggugguuucagaaaug

SEQ ID NO: 2586743 - RNA, 20 nt, Human
cauuugggagacaugugaca

SEQ ID NO: 2586744 - RNA, 18 nt, Human
cauuugggagacauguga

SEQ ID NO: 2586745 - RNA, 18 nt, Human
cauuuggcauuuauuugu

SEQ ID NO: 2586746 - RNA, 21 nt, Human
cauuuggcagggguggcugcc

SEQ ID NO: 2586747 - RNA, 17 nt, Human
cauuugggguagcuaga

SEQ ID NO: 2586748 - RNA, 22 nt, Human
cauuugggguagcuagaggaac

SEQ ID NO: 2586749 - RNA, 16 nt, Human
cauuuguauaaaauaa

SEQ ID NO: 2586750 - RNA, 14 nt, Human
cauuuguauaaaau

SEQ ID NO: 2586751 - RNA, 16 nt, Human
cauuuguuggaaugaa

SEQ ID NO: 2586752 - RNA, 23 nt, Human
cauuuuuuuuaagaaaaaggaug

SEQ ID NO: 2586753 - RNA, 21 nt, Human
cauuuuuuuucagcagacuau

SEQ ID NO: 2586754 - RNA, 18 nt, Human
ccaaaaguggccucuuug

SEQ ID NO: 2586755 - RNA, 21 nt, Human
ccaaaaguggccucuuugucu

SEQ ID NO: 2586756 - RNA, 15 nt, Human
ccaaaaguggccucu

SEQ ID NO: 2586757 - RNA, 22 nt, Human
ccaaaagucaaaaggugccugu

SEQ ID NO: 2586758 - RNA, 15 nt, Human
ccaaaagcuuuuuau

SEQ ID NO: 2586759 - RNA, 23 nt, Human
ccaaaagauugcugaaauuuuau

SEQ ID NO: 2586760 - RNA, 21 nt, Human
ccaaaagucaaaaggugccug

SEQ ID NO: 2586761 - RNA, 13 nt, Human
ccaaaaaaauacu

SEQ ID NO: 2586762 - RNA, 14 nt, Human
ccaaaaggcagaag

SEQ ID NO: 2586763 - RNA, 14 nt, Human
ccaaaagcacuuac

SEQ ID NO: 2586764 - RNA, 14 nt, Human
ccaaaagcugcuca

SEQ ID NO: 2586765 - RNA, 22 nt, Human
ccaaaguacacuguuucaaacu

SEQ ID NO: 2586766 - RNA, 13 nt, Human
ccaaaguauuuuu

SEQ ID NO: 2586767 - RNA, 16 nt, Human
ccaaagucuuaaaaua

SEQ ID NO: 2586768 - RNA, 14 nt, Human
ccaaagugcuggga

SEQ ID NO: 2586769 - RNA, 13 nt, Human
ccaaggaccaggu

SEQ ID NO: 2586770 - RNA, 14 nt, Human
ccaaggaccagguu

SEQ ID NO: 2586771 - RNA, 14 nt, Human
ccaaggaccccuca

SEQ ID NO: 2586772 - RNA, 15 nt, Human
ccaaggaccccucac

SEQ ID NO: 2586773 - RNA, 16 nt, Human
ccaaggaccccucacc

SEQ ID NO: 2586774 - RNA, 23 nt, Human
ccaaggaaaccacagcugcugga

SEQ ID NO: 2586775 - RNA, 22 nt, Human
ccaaggaaaccacagcugcugg

SEQ ID NO: 2586776 - RNA, 21 nt, Human
ccaaggaaaccacagcugcug

SEQ ID NO: 2586777 - RNA, 20 nt, Human
ccaaggaaaccacagcugcu

SEQ ID NO: 2586778 - RNA, 19 nt, Human
ccaaggaaaccacagcugc

SEQ ID NO: 2586779 - RNA, 18 nt, Human
ccaaggaaaccacagcug

SEQ ID NO: 2586780 - RNA, 15 nt, Human
ccaaggacugaggga

SEQ ID NO: 2586781 - RNA, 22 nt, Human
ccaaggaccccucaccuugcaa

SEQ ID NO: 2586782 - RNA, 23 nt, Human
ccaaggacugagggacucugaag

SEQ ID NO: 2586783 - RNA, 18 nt, Human
ccaaggaccccucaccuu

SEQ ID NO: 2586784 - RNA, 11 nt, Human
ccaaggacugc

SEQ ID NO: 2586785 - RNA, 13 nt, Human
ccaaggacugccg

SEQ ID NO: 2586786 - RNA, 15 nt, Human
ccaaggacugccgac

SEQ ID NO: 2586787 - RNA, 14 nt, Human
ccaaggagaaacag

SEQ ID NO: 2586788 - RNA, 15 nt, Human
ccaaggagaaacaga

SEQ ID NO: 2586789 - RNA, 18 nt, Human
ccaaggagaaacagagac

SEQ ID NO: 2586790 - RNA, 21 nt, Human
ccaaggagaaacagagacagg

SEQ ID NO: 2586791 - RNA, 14 nt, Human
ccaaggagacacaa

SEQ ID NO: 2586792 - RNA, 19 nt, Human
ccaaggagaaacagagaca

SEQ ID NO: 2586793 - RNA, 12 nt, Human
ccaaggagcugc

SEQ ID NO: 2586794 - RNA, 13 nt, Human
ccaaggagcugcu

SEQ ID NO: 2586795 - RNA, 14 nt, Human
ccaaggagcugcua

SEQ ID NO: 2586796 - RNA, 15 nt, Human
ccaaggagcugcuau

SEQ ID NO: 2586797 - RNA, 16 nt, Human
ccaaggagcugcuaua

SEQ ID NO: 2586798 - RNA, 22 nt, Human
ccaaggagcugcuauagccugg

SEQ ID NO: 2586799 - RNA, 13 nt, Human
ccaaggaggaaaa

SEQ ID NO: 2586800 - RNA, 21 nt, Human
ccaaggaggaaaaacagacaa

SEQ ID NO: 2586801 - RNA, 23 nt, Human
ccaaggagaugaagcaaacacau

SEQ ID NO: 2586802 - RNA, 14 nt, Human
ccaaggagaugaag

SEQ ID NO: 2586803 - RNA, 19 nt, Human
ccaauggaaccuccuuucu

SEQ ID NO: 2586804 - RNA, 18 nt, Human
ccaauggaaccuccuuuc

SEQ ID NO: 2586805 - RNA, 17 nt, Human
ccaauggaaccuccuuu

SEQ ID NO: 2586806 - RNA, 17 nt, Human
ccaaugcugauguccuc

SEQ ID NO: 2586807 - RNA, 18 nt, Human
ccaaugcuuuuaucaaac

SEQ ID NO: 2586808 - RNA, 14 nt, Human
ccaaugcugauguc

SEQ ID NO: 2586809 - RNA, 18 nt, Human
ccaaugccccacuggcag

SEQ ID NO: 2586810 - RNA, 12 nt, Human
ccaaggaggauu

SEQ ID NO: 2586811 - RNA, 20 nt, Human
ccaaggagggugagugcaag

SEQ ID NO: 2586812 - RNA, 14 nt, Human
ccaaugggagcuca

SEQ ID NO: 2586813 - RNA, 22 nt, Human
ccaauuauaugagacguuuuug

SEQ ID NO: 2586814 - RNA, 23 nt, Human
ccaauggacuaacuugucuuugg

SEQ ID NO: 2586815 - RNA, 14 nt, Human
ccaauuauguuaaa

SEQ ID NO: 2586816 - RNA, 21 nt, Human
ccaauggagacugucucaaga

SEQ ID NO: 2586817 - RNA, 17 nt, Human
ccaauuauguuaaacua

SEQ ID NO: 2586818 - RNA, 15 nt, Human
ccaauuauguuaaac

SEQ ID NO: 2586819 - RNA, 21 nt, Human
ccaauucaacccuuugcccca

SEQ ID NO: 2586820 - RNA, 19 nt, Human
ccaauucgaacuuuuucca

SEQ ID NO: 2586821 - RNA, 14 nt, Human
ccaauucagacagg

SEQ ID NO: 2586822 - RNA, 16 nt, Human
ccaauucagacaggca

SEQ ID NO: 2586823 - RNA, 14 nt, Human
ccaauuccuuguag

SEQ ID NO: 2586824 - RNA, 12 nt, Human
ccaauuccuugu

SEQ ID NO: 2586825 - RNA, 20 nt, Human
ccaauuccuugcacauagua

SEQ ID NO: 2586826 - RNA, 11 nt, Human
ccaauucuuac

SEQ ID NO: 2586827 - RNA, 13 nt, Human
ccaacucacccca

SEQ ID NO: 2586828 - RNA, 16 nt, Human
ccaacuauggccugug

SEQ ID NO: 2586829 - RNA, 15 nt, Human
ccaacuauggccugu

SEQ ID NO: 2586830 - RNA, 14 nt, Human
ccaacuauggccug

SEQ ID NO: 2586831 - RNA, 16 nt, Human
ccaaaucauaguggcu

SEQ ID NO: 2586832 - RNA, 23 nt, Human
ccaaaucagcugcuacuacuccu

SEQ ID NO: 2586833 - RNA, 15 nt, Human
ccaaaucagcugcua

SEQ ID NO: 2586834 - RNA, 23 nt, Human
ccaaagugccacucauuccugua

SEQ ID NO: 2586835 - RNA, 15 nt, Human
ccaaaucaaaauaug

SEQ ID NO: 2586836 - RNA, 15 nt, Human
ccaagcucugcuccu

SEQ ID NO: 2586837 - RNA, 14 nt, Human
ccaagcucugcucc

SEQ ID NO: 2586838 - RNA, 12 nt, Human
ccaacuccagga

SEQ ID NO: 2586839 - RNA, 16 nt, Human
ccaagcucugcuccuc

SEQ ID NO: 2586840 - RNA, 14 nt, Human
ccaacucaccugag

SEQ ID NO: 2586841 - RNA, 20 nt, Human
ccaaaucacugaacuuugcu

SEQ ID NO: 2586842 - RNA, 21 nt, Human
ccaacucaccccagccccaaa

SEQ ID NO: 2586843 - RNA, 21 nt, Human
ccaacuccagaaagugacaag

SEQ ID NO: 2586844 - RNA, 21 nt, Human
cauucuccaccugccagggac

SEQ ID NO: 2586845 - RNA, 19 nt, Human
cauucuccaccugccaggg

SEQ ID NO: 2586846 - RNA, 18 nt, Human
cauucuccaccugccagg

SEQ ID NO: 2586847 - RNA, 17 nt, Human
cauucuccaccugccag

SEQ ID NO: 2586848 - RNA, 19 nt, Human
cauuauuaguacugcucuu

SEQ ID NO: 2586849 - RNA, 13 nt, Human
cauuauuaucaac

SEQ ID NO: 2586850 - RNA, 16 nt, Human
cauuaucgggagcagu

SEQ ID NO: 2586851 - RNA, 14 nt, Human
cauuaucccugaau

SEQ ID NO: 2586852 - RNA, 17 nt, Human
cauuaucgggagcagug

SEQ ID NO: 2586853 - RNA, 18 nt, Human
cauuaucgggagcagugu

SEQ ID NO: 2586854 - RNA, 20 nt, Human
cauuaucgggagcagugucu

SEQ ID NO: 2586855 - RNA, 21 nt, Human
cauuaucgggagcagugucuu

SEQ ID NO: 2586856 - RNA, 23 nt, Human
cauuaucgggagcagugucuucc

SEQ ID NO: 2586857 - RNA, 14 nt, Human
cauucucugucuca

SEQ ID NO: 2586858 - RNA, 19 nt, Human
cauucucugucucauccau

SEQ ID NO: 2586859 - RNA, 23 nt, Human
cauucucugucucauccaucauc

SEQ ID NO: 2586860 - RNA, 16 nt, Human
cauucugaaggagccc

SEQ ID NO: 2586861 - RNA, 12 nt, Human
cauucucucucc

SEQ ID NO: 2586862 - RNA, 16 nt, Human
cauucucucuccugua

SEQ ID NO: 2586863 - RNA, 15 nt, Human
cauucucucuccugu

SEQ ID NO: 2586864 - RNA, 16 nt, Human
cauucucucuccuguc

SEQ ID NO: 2586865 - RNA, 18 nt, Human
cauucucucuccugucca

SEQ ID NO: 2586866 - RNA, 20 nt, Human
cauucucucuccuguccaac

SEQ ID NO: 2586867 - RNA, 12 nt, Human
cauucucugaag

SEQ ID NO: 2586868 - RNA, 13 nt, Human
cauucucugaaga

SEQ ID NO: 2586869 - RNA, 20 nt, Human
cauucuccuuguguuacuaa

SEQ ID NO: 2586870 - RNA, 18 nt, Human
cauguauuggccuggagg

SEQ ID NO: 2586871 - RNA, 17 nt, Human
cauguauuggccuggag

SEQ ID NO: 2586872 - RNA, 16 nt, Human
cauguauuggccugga

SEQ ID NO: 2586873 - RNA, 15 nt, Human
cauguauuggccugg

SEQ ID NO: 2586874 - RNA, 14 nt, Human
cauguauuggccug

SEQ ID NO: 2586875 - RNA, 15 nt, Human
cauguauuauuucau

SEQ ID NO: 2586876 - RNA, 21 nt, Human
cauguauugcacauuguaaaa

SEQ ID NO: 2586877 - RNA, 18 nt, Human
cauguauugcacauugua

SEQ ID NO: 2586878 - RNA, 17 nt, Human
cauguauugcacauugu

SEQ ID NO: 2586879 - RNA, 13 nt, Human
cauguaugucuug

SEQ ID NO: 2586880 - RNA, 23 nt, Human
cauguaucuaugcauuuucugga

SEQ ID NO: 2586881 - RNA, 22 nt, Human
cauguaugucuuggacacugua

SEQ ID NO: 2586882 - RNA, 21 nt, Human
cauguaugucuuggacacugu

SEQ ID NO: 2586883 - RNA, 18 nt, Human
cauguaugucuuggacac

SEQ ID NO: 2586884 - RNA, 17 nt, Human
cauguaugucuuggaca

SEQ ID NO: 2586885 - RNA, 21 nt, Human
cauguauguuuugguaucugu

SEQ ID NO: 2586886 - RNA, 12 nt, Human
cauguauguuuu

SEQ ID NO: 2586887 - RNA, 22 nt, Human
cauguauguuuugguaucuguu

SEQ ID NO: 2586888 - RNA, 13 nt, Human
cauguucuuaauu

SEQ ID NO: 2586889 - RNA, 16 nt, Human
cauguucuuaauucuu

SEQ ID NO: 2586890 - RNA, 17 nt, Human
cauguuaccuccuauaa

SEQ ID NO: 2586891 - RNA, 21 nt, Human
cauguuacauaagauaaaugu

SEQ ID NO: 2586892 - RNA, 16 nt, Human
cauguccaagaagccc

SEQ ID NO: 2586893 - RNA, 15 nt, Human
cauguccaagaagcc

SEQ ID NO: 2586894 - RNA, 16 nt, Human
cauguuacauaagaua

SEQ ID NO: 2586895 - RNA, 17 nt, Human
cauguuacauaagauaa

SEQ ID NO: 2586896 - RNA, 13 nt, Human
cauuaucccugaa

SEQ ID NO: 2586897 - RNA, 22 nt, Human
cauuaucauguguaaucaauaa

SEQ ID NO: 2586898 - RNA, 18 nt, Human
cauuaucauguguaauca

SEQ ID NO: 2586899 - RNA, 16 nt, Human
cauuaucauguguaau

SEQ ID NO: 2586900 - RNA, 15 nt, Human
cauuaucauguguaa

SEQ ID NO: 2586901 - RNA, 14 nt, Human
cauuaucaugugua

SEQ ID NO: 2586902 - RNA, 13 nt, Human
cauuaucaugugu

SEQ ID NO: 2586903 - RNA, 12 nt, Human
cauuaucaugug

SEQ ID NO: 2586904 - RNA, 20 nt, Human
cauguuggccaggcugcucu

SEQ ID NO: 2586905 - RNA, 19 nt, Human
cauuaucacuuuaaagccc

SEQ ID NO: 2586906 - RNA, 19 nt, Human
cauuauauuuauuacugua

SEQ ID NO: 2586907 - RNA, 19 nt, Human
cauguuggccaggcugguc

SEQ ID NO: 2586908 - RNA, 17 nt, Human
cauguuggccaggcugg

SEQ ID NO: 2586909 - RNA, 18 nt, Human
cauguuggccaggcuggu

SEQ ID NO: 2586910 - RNA, 18 nt, Human
cauguucuuaauucuuag

SEQ ID NO: 2586911 - RNA, 13 nt, Human
cauguuaauuuca

SEQ ID NO: 2586912 - RNA, 14 nt, Human
cauguucugcuuuc

SEQ ID NO: 2586913 - RNA, 16 nt, Human
caugaauccaguccag

SEQ ID NO: 2586914 - RNA, 23 nt, Human
caugaaguuuccuuggcuggugc

SEQ ID NO: 2586915 - RNA, 22 nt, Human
caugaaguuuccuuggcuggug

SEQ ID NO: 2586916 - RNA, 20 nt, Human
caucugucaccaauugguua

SEQ ID NO: 2586917 - RNA, 21 nt, Human
caugaauauuuaguguucaua

SEQ ID NO: 2586918 - RNA, 15 nt, Human
caugaaucugcaaug

SEQ ID NO: 2586919 - RNA, 20 nt, Human
caugaaucgcuucucuuuug

SEQ ID NO: 2586920 - RNA, 18 nt, Human
caugaaucgcuucucuuu

SEQ ID NO: 2586921 - RNA, 17 nt, Human
caugaaucgcuucucuu

SEQ ID NO: 2586922 - RNA, 16 nt, Human
caugaaucgcuucucu

SEQ ID NO: 2586923 - RNA, 15 nt, Human
caugaaucgcuucuc

SEQ ID NO: 2586924 - RNA, 21 nt, Human
caugaaucccacccacaugug

SEQ ID NO: 2586925 - RNA, 22 nt, Human
caugaaugguauggaacucucu

SEQ ID NO: 2586926 - RNA, 16 nt, Human
caugaaugcacacuag

SEQ ID NO: 2586927 - RNA, 16 nt, Human
caugaauuugugaagg

SEQ ID NO: 2586928 - RNA, 13 nt, Human
caugacaaagacu

SEQ ID NO: 2586929 - RNA, 21 nt, Human
caugaauuuuuuucaucuucu

SEQ ID NO: 2586930 - RNA, 19 nt, Human
caugacaacuuugccagcu

SEQ ID NO: 2586931 - RNA, 21 nt, Human
caugacaacuuugccagcuuu

SEQ ID NO: 2586932 - RNA, 14 nt, Human
caugacaagcccca

SEQ ID NO: 2586933 - RNA, 15 nt, Human
caugacaagccccag

SEQ ID NO: 2586934 - RNA, 16 nt, Human
caugaugcugggauuu

SEQ ID NO: 2586935 - RNA, 18 nt, Human
caugauggagcgcaccug

SEQ ID NO: 2586936 - RNA, 19 nt, Human
caugauggagcgcaccugc

SEQ ID NO: 2586937 - RNA, 15 nt, Human
caugauggcaacaga

SEQ ID NO: 2586938 - RNA, 19 nt, Human
caugauggcaacagaucug

SEQ ID NO: 2586939 - RNA, 15 nt, Human
caugaugcugggauu

SEQ ID NO: 2586940 - RNA, 12 nt, Human
caugauggaguc

SEQ ID NO: 2586941 - RNA, 19 nt, Human
caugauggagucagguuug

SEQ ID NO: 2586942 - RNA, 23 nt, Human
caugauggagucagguuuggggu

SEQ ID NO: 2586943 - RNA, 18 nt, Human
caugacaagccccaggca

SEQ ID NO: 2586944 - RNA, 16 nt, Human
caugacaagccccagg

SEQ ID NO: 2586945 - RNA, 17 nt, Human
caugacaagccccaggc

SEQ ID NO: 2586946 - RNA, 12 nt, Human
caugcaagguca

SEQ ID NO: 2586947 - RNA, 15 nt, Human
caugcaaggucauuu

SEQ ID NO: 2586948 - RNA, 15 nt, Human
caugcaaaggcuggg

SEQ ID NO: 2586949 - RNA, 14 nt, Human
caugcaaaggcugg

SEQ ID NO: 2586950 - RNA, 16 nt, Human
caugcaaaggcuggga

SEQ ID NO: 2586951 - RNA, 14 nt, Human
caugcaaaugcugu

SEQ ID NO: 2586952 - RNA, 16 nt, Human
caugcaaaugcuguau

SEQ ID NO: 2586953 - RNA, 22 nt, Human
caugcaaaugcuguauucuucu

SEQ ID NO: 2586954 - RNA, 14 nt, Human
caugcaaggggaaa

SEQ ID NO: 2586955 - RNA, 22 nt, Human
cauggcccucccaguaccuccu

SEQ ID NO: 2586956 - RNA, 14 nt, Human
cauggcccucccag

SEQ ID NO: 2586957 - RNA, 23 nt, Human
cauggcccucccaguaccuccug

SEQ ID NO: 2586958 - RNA, 12 nt, Human
cauggcccuggg

SEQ ID NO: 2586959 - RNA, 14 nt, Human
cauggcccuggggu

SEQ ID NO: 2586960 - RNA, 18 nt, Human
cauggccccucugaccug

SEQ ID NO: 2586961 - RNA, 17 nt, Human
cauggccccucugaccu

SEQ ID NO: 2586962 - RNA, 16 nt, Human
cauggccccugugagu

SEQ ID NO: 2586963 - RNA, 15 nt, Human
cauggccccugugag

SEQ ID NO: 2586964 - RNA, 15 nt, Human
cauggcccucauuaa

SEQ ID NO: 2586965 - RNA, 22 nt, Human
cauggcccucauuaaugacacu

SEQ ID NO: 2586966 - RNA, 16 nt, Human
cauggccccucugacc

SEQ ID NO: 2586967 - RNA, 13 nt, Human
cauggccccucug

SEQ ID NO: 2586968 - RNA, 12 nt, Human
cauggccccucu

SEQ ID NO: 2586969 - RNA, 19 nt, Human
caugcaaggggaaaaucuc

SEQ ID NO: 2586970 - RNA, 20 nt, Human
caugcaaggggaaaaucuca

SEQ ID NO: 2586971 - RNA, 15 nt, Human
cauggccagguggcc

SEQ ID NO: 2586972 - RNA, 17 nt, Human
caugcuccuggcccacu

SEQ ID NO: 2586973 - RNA, 14 nt, Human
caugcuccuggccc

SEQ ID NO: 2586974 - RNA, 16 nt, Human
caugcuccuggcccac

SEQ ID NO: 2586975 - RNA, 19 nt, Human
cauggccuaugcacauaug

SEQ ID NO: 2586976 - RNA, 17 nt, Human
cauggccuaugcacaua

SEQ ID NO: 2586977 - RNA, 15 nt, Human
cauggcuuccuccuc

SEQ ID NO: 2586978 - RNA, 18 nt, Human
cauggcuuccuccucccu

SEQ ID NO: 2586979 - RNA, 16 nt, Human
cauggcuuccuccucc

SEQ ID NO: 2586980 - RNA, 21 nt, Human
cauggccuauuauauuaaaau

SEQ ID NO: 2586981 - RNA, 20 nt, Human
cauggccuauuauauuaaaa

SEQ ID NO: 2586982 - RNA, 17 nt, Human
cauggcuuccuccugcg

SEQ ID NO: 2586983 - RNA, 15 nt, Human
cauggcuuccuccug

SEQ ID NO: 2586984 - RNA, 21 nt, Human
cauggccucuucagaucucua

SEQ ID NO: 2586985 - RNA, 16 nt, Human
cauggccuaugcacau

SEQ ID NO: 2586986 - RNA, 14 nt, Human
cauggccgugaacu

SEQ ID NO: 2586987 - RNA, 18 nt, Human
caugggaaaggggaaguu

SEQ ID NO: 2586988 - RNA, 18 nt, Human
caugggaaagccaccucu

SEQ ID NO: 2586989 - RNA, 18 nt, Human
cauggcuugccacagcuc

SEQ ID NO: 2586990 - RNA, 15 nt, Human
cauggcuugccacag

SEQ ID NO: 2586991 - RNA, 19 nt, Human
cauggcuugccacagcucu

SEQ ID NO: 2586992 - RNA, 20 nt, Human
caugggaagacgaggcccuc

SEQ ID NO: 2586993 - RNA, 19 nt, Human
caugggaagacgaggcccu

SEQ ID NO: 2586994 - RNA, 20 nt, Human
caugggaaaugucaacaagu

SEQ ID NO: 2586995 - RNA, 21 nt, Human
ccugaggcugggcucccuucc

SEQ ID NO: 2586996 - RNA, 19 nt, Human
ccugaggcugggcucccuu

SEQ ID NO: 2586997 - RNA, 17 nt, Human
ccugaggcugggcuccc

SEQ ID NO: 2586998 - RNA, 16 nt, Human
ccugaggcugggcucc

SEQ ID NO: 2586999 - RNA, 15 nt, Human
ccugacuccucuaag

SEQ ID NO: 2587000 - RNA, 13 nt, Human
ccugacuccucua

SEQ ID NO: 2587001 - RNA, 22 nt, Human
ccugaccugugagcccagcugg

SEQ ID NO: 2587002 - RNA, 21 nt, Human
ccugaccuugaggagucuugu

SEQ ID NO: 2587003 - RNA, 21 nt, Human
ccucuuugcuuugcuuucugc

SEQ ID NO: 2587004 - RNA, 23 nt, Human
ccugaccuugaggagucuugugu

SEQ ID NO: 2587005 - RNA, 22 nt, Human
ccugaccuugaggagucuugug

SEQ ID NO: 2587006 - RNA, 13 nt, Human
ccugacucauucu

SEQ ID NO: 2587007 - RNA, 10 nt, Human
ccugacucaa

SEQ ID NO: 2587008 - RNA, 18 nt, Human
ccugaccugugagcccag

SEQ ID NO: 2587009 - RNA, 19 nt, Human
ccugaccugugagcccagc

SEQ ID NO: 2587010 - RNA, 20 nt, Human
ccugaccugugagcccagcu

SEQ ID NO: 2587011 - RNA, 21 nt, Human
ccugaccugugagcccagcug

SEQ ID NO: 2587012 - RNA, 20 nt, Human
ccucuuuggcuccccuguac

SEQ ID NO: 2587013 - RNA, 19 nt, Human
ccucuuuggcuccccugua

SEQ ID NO: 2587014 - RNA, 14 nt, Human
ccugaccugugagc

SEQ ID NO: 2587015 - RNA, 16 nt, Human
ccugaccugucucacc

SEQ ID NO: 2587016 - RNA, 14 nt, Human
ccugaggcuguggu

SEQ ID NO: 2587017 - RNA, 23 nt, Human
ccugagggccccucugcccagcu

SEQ ID NO: 2587018 - RNA, 20 nt, Human
ccugacuccucuaagccacu

SEQ ID NO: 2587019 - RNA, 18 nt, Human
ccugaggggcaucugccc

SEQ ID NO: 2587020 - RNA, 12 nt, Human
ccugaggggccu

SEQ ID NO: 2587021 - RNA, 19 nt, Human
ccugaggggcaucugcccc

SEQ ID NO: 2587022 - RNA, 20 nt, Human
ccugaggggcaucugccccu

SEQ ID NO: 2587023 - RNA, 22 nt, Human
ccugaggggcaucugccccucc

SEQ ID NO: 2587024 - RNA, 23 nt, Human
ccugaggggcaucugccccuccc

SEQ ID NO: 2587025 - RNA, 16 nt, Human
ccugaggggccucuua

SEQ ID NO: 2587026 - RNA, 23 nt, Human
ccugagucugcuauauuuucaug

SEQ ID NO: 2587027 - RNA, 18 nt, Human
ccugagucuccugugccc

SEQ ID NO: 2587028 - RNA, 16 nt, Human
ccugagucuccugugc

SEQ ID NO: 2587029 - RNA, 20 nt, Human
ccugaguggaucuccaagga

SEQ ID NO: 2587030 - RNA, 19 nt, Human
ccugaguggaucuccaagg

SEQ ID NO: 2587031 - RNA, 14 nt, Human
ccugaguggugcca

SEQ ID NO: 2587032 - RNA, 18 nt, Human
ccugaguggaucuccaag

SEQ ID NO: 2587033 - RNA, 14 nt, Human
ccugaguggaucuc

SEQ ID NO: 2587034 - RNA, 13 nt, Human
ccugaguggaucu

SEQ ID NO: 2587035 - RNA, 15 nt, Human
ccugagugccuggcc

SEQ ID NO: 2587036 - RNA, 14 nt, Human
ccugagugccuggc

SEQ ID NO: 2587037 - RNA, 12 nt, Human
ccugcagagcug

SEQ ID NO: 2587038 - RNA, 13 nt, Human
ccugcagagcugc

SEQ ID NO: 2587039 - RNA, 14 nt, Human
ccugcagagcugcg

SEQ ID NO: 2587040 - RNA, 17 nt, Human
ccugcagagcugcgggc

SEQ ID NO: 2587041 - RNA, 14 nt, Human
ccugaguuccuagc

SEQ ID NO: 2587042 - RNA, 16 nt, Human
ccugaguggugccaaa

SEQ ID NO: 2587043 - RNA, 23 nt, Human
ccugaguggaucuccaaggacca

SEQ ID NO: 2587044 - RNA, 11 nt, Human
ccugcagagag

SEQ ID NO: 2587045 - RNA, 16 nt, Human
ccugcagacucacugu

SEQ ID NO: 2587046 - RNA, 18 nt, Human
ccugaguuccuagccacc

SEQ ID NO: 2587047 - RNA, 17 nt, Human
ccugcaggcagccaggc

SEQ ID NO: 2587048 - RNA, 16 nt, Human
ccugcaggcagccagg

SEQ ID NO: 2587049 - RNA, 12 nt, Human
ccugcagagggc

SEQ ID NO: 2587050 - RNA, 15 nt, Human
ccugcaggcagccag

SEQ ID NO: 2587051 - RNA, 21 nt, Human
ccugcaggcagccaggccaca

SEQ ID NO: 2587052 - RNA, 20 nt, Human
ccugcaggcagccaggccac

SEQ ID NO: 2587053 - RNA, 19 nt, Human
ccugcaggcagccaggcca

SEQ ID NO: 2587054 - RNA, 18 nt, Human
ccugcaggcagccaggcc

SEQ ID NO: 2587055 - RNA, 23 nt, Human
ccugcaggcagccaggccacaag

SEQ ID NO: 2587056 - RNA, 14 nt, Human
ccugcagagggcac

SEQ ID NO: 2587057 - RNA, 15 nt, Human
ccugcagagagaagc

SEQ ID NO: 2587058 - RNA, 13 nt, Human
ccugcagagagaa

SEQ ID NO: 2587059 - RNA, 16 nt, Human
ccugcagagagaagcc

SEQ ID NO: 2587060 - RNA, 21 nt, Human
ccucugcuacguuccuauugu

SEQ ID NO: 2587061 - RNA, 11 nt, Human
ccucugcuacg

SEQ ID NO: 2587062 - RNA, 20 nt, Human
ccucugcggaccccagcugu

SEQ ID NO: 2587063 - RNA, 18 nt, Human
ccucugcggaccccagcu

SEQ ID NO: 2587064 - RNA, 17 nt, Human
ccucugcggaccccagc

SEQ ID NO: 2587065 - RNA, 16 nt, Human
ccucugcggaccccag

SEQ ID NO: 2587066 - RNA, 19 nt, Human
ccucugccugucuccccca

SEQ ID NO: 2587067 - RNA, 13 nt, Human
ccucugcggaccc

SEQ ID NO: 2587068 - RNA, 18 nt, Human
ccucugccugucccucuc

SEQ ID NO: 2587069 - RNA, 22 nt, Human
ccucugccugucccucucaggc

SEQ ID NO: 2587070 - RNA, 15 nt, Human
ccucugccugucucc

SEQ ID NO: 2587071 - RNA, 14 nt, Human
ccucugccucaaug

SEQ ID NO: 2587072 - RNA, 19 nt, Human
ccucugccugaaccuucca

SEQ ID NO: 2587073 - RNA, 21 nt, Human
ccucugccugaaccuuccauc

SEQ ID NO: 2587074 - RNA, 19 nt, Human
ccucugccugucccucuca

SEQ ID NO: 2587075 - RNA, 21 nt, Human
ccucugccugaagucacacag

SEQ ID NO: 2587076 - RNA, 17 nt, Human
ccucuucucuuccugua

SEQ ID NO: 2587077 - RNA, 16 nt, Human
ccucuucucuuccugu

SEQ ID NO: 2587078 - RNA, 14 nt, Human
ccucuucucuuccu

SEQ ID NO: 2587079 - RNA, 12 nt, Human
ccucuucucuuc

SEQ ID NO: 2587080 - RNA, 13 nt, Human
ccucuucugggag

SEQ ID NO: 2587081 - RNA, 17 nt, Human
ccucuucugggagggca

SEQ ID NO: 2587082 - RNA, 18 nt, Human
ccucuucugggagggcag

SEQ ID NO: 2587083 - RNA, 21 nt, Human
ccucuucugggagggcagcag

SEQ ID NO: 2587084 - RNA, 20 nt, Human
ccucuucugcuuaggagaga

SEQ ID NO: 2587085 - RNA, 14 nt, Human
ccucuucugcaucu

SEQ ID NO: 2587086 - RNA, 15 nt, Human
ccucuucuggcucaa

SEQ ID NO: 2587087 - RNA, 18 nt, Human
ccucuucugacgugccuu

SEQ ID NO: 2587088 - RNA, 17 nt, Human
ccucuucugacgugccu

SEQ ID NO: 2587089 - RNA, 20 nt, Human
ccucuucugacgugccuuuu

SEQ ID NO: 2587090 - RNA, 18 nt, Human
ccucuuuggcuccccugu

SEQ ID NO: 2587091 - RNA, 14 nt, Human
ccucuuuggcuccc

SEQ ID NO: 2587092 - RNA, 13 nt, Human
ccucuuugcuuug

SEQ ID NO: 2587093 - RNA, 14 nt, Human
ccucuuugcuuugc

SEQ ID NO: 2587094 - RNA, 15 nt, Human
ccucuuugcuuugcu

SEQ ID NO: 2587095 - RNA, 17 nt, Human
ccucuuugcuuugcuuu

SEQ ID NO: 2587096 - RNA, 19 nt, Human
ccucuuuggucuacacugu

SEQ ID NO: 2587097 - RNA, 15 nt, Human
ccucuuugcauggaa

SEQ ID NO: 2587098 - RNA, 15 nt, Human
ccucuuggcagucac

SEQ ID NO: 2587099 - RNA, 11 nt, Human
ccucuuugcuu

SEQ ID NO: 2587100 - RNA, 16 nt, Human
ccucuuugagugaagc

SEQ ID NO: 2587101 - RNA, 13 nt, Human
ccucuuggccuga

SEQ ID NO: 2587102 - RNA, 15 nt, Human
ccucuuggcugccuu

SEQ ID NO: 2587103 - RNA, 21 nt, Human
ccucuuggaccucugcucuga

SEQ ID NO: 2587104 - RNA, 19 nt, Human
ccucuuggaccucugcucu

SEQ ID NO: 2587105 - RNA, 18 nt, Human
ccucuuggaccucugcuc

SEQ ID NO: 2587106 - RNA, 17 nt, Human
ccucuuggaccucugcu

SEQ ID NO: 2587107 - RNA, 15 nt, Human
ccucuuggaccucug

SEQ ID NO: 2587108 - RNA, 15 nt, Human
ccucuucuucuucag

SEQ ID NO: 2587109 - RNA, 16 nt, Human
ccucuucuucuucaga

SEQ ID NO: 2587110 - RNA, 17 nt, Human
ccucuucuucuucagaa

SEQ ID NO: 2587111 - RNA, 20 nt, Human
ccugccuccuuugugaggaa

SEQ ID NO: 2587112 - RNA, 19 nt, Human
ccugccuccuuugugagga

SEQ ID NO: 2587113 - RNA, 15 nt, Human
ccugccuccuuugug

SEQ ID NO: 2587114 - RNA, 13 nt, Human
ccugccuccuuug

SEQ ID NO: 2587115 - RNA, 22 nt, Human
ccugccuccuuugugaggaagc

SEQ ID NO: 2587116 - RNA, 21 nt, Human
ccugccuccuuugugaggaag

SEQ ID NO: 2587117 - RNA, 23 nt, Human
ccugccuccuuugugaggaagcc

SEQ ID NO: 2587118 - RNA, 17 nt, Human
ccugccucucugcaggu

SEQ ID NO: 2587119 - RNA, 16 nt, Human
ccugcugcaguugcca

SEQ ID NO: 2587120 - RNA, 12 nt, Human
ccugcugcaguu

SEQ ID NO: 2587121 - RNA, 23 nt, Human
ccugcugcaggggcucuggagag

SEQ ID NO: 2587122 - RNA, 22 nt, Human
ccugcugcaggggcucuggaga

SEQ ID NO: 2587123 - RNA, 21 nt, Human
ccugcugcaggggcucuggag

SEQ ID NO: 2587124 - RNA, 20 nt, Human
ccugcugcaggggcucugga

SEQ ID NO: 2587125 - RNA, 17 nt, Human
ccugcugcaggggcucu

SEQ ID NO: 2587126 - RNA, 15 nt, Human
ccugcugcaggggcu

SEQ ID NO: 2587127 - RNA, 13 nt, Human
ccugccuggagcg

SEQ ID NO: 2587128 - RNA, 14 nt, Human
ccugcugcaggggc

SEQ ID NO: 2587129 - RNA, 11 nt, Human
ccugcugcagu

SEQ ID NO: 2587130 - RNA, 14 nt, Human
ccugcugccgccuc

SEQ ID NO: 2587131 - RNA, 15 nt, Human
ccugcugccgccucc

SEQ ID NO: 2587132 - RNA, 18 nt, Human
ccugcugccgccucccag

SEQ ID NO: 2587133 - RNA, 21 nt, Human
ccugcugccgccucccagccu

SEQ ID NO: 2587134 - RNA, 22 nt, Human
ccugcugcaguugccagucacc

SEQ ID NO: 2587135 - RNA, 10 nt, Human
ccugcugcau

SEQ ID NO: 2587136 - RNA, 12 nt, Human
ccugccuggagc

SEQ ID NO: 2587137 - RNA, 22 nt, Human
ccugccugagggccccucugcc

SEQ ID NO: 2587138 - RNA, 21 nt, Human
ccugccugagggccccucugc

SEQ ID NO: 2587139 - RNA, 20 nt, Human
ccugccugagggccccucug

SEQ ID NO: 2587140 - RNA, 19 nt, Human
ccugccugagggccccucu

SEQ ID NO: 2587141 - RNA, 18 nt, Human
ccugccugagggccccuc

SEQ ID NO: 2587142 - RNA, 14 nt, Human
ccugccugagggcc

SEQ ID NO: 2587143 - RNA, 15 nt, Human
ccugccucuguuuga

SEQ ID NO: 2587144 - RNA, 21 nt, Human
ccugccucucugcaggucccu

SEQ ID NO: 2587145 - RNA, 20 nt, Human
ccugccucucugcagguccc

SEQ ID NO: 2587146 - RNA, 20 nt, Human
ccugccuccugccugccccu

SEQ ID NO: 2587147 - RNA, 14 nt, Human
ccugccucuguuug

SEQ ID NO: 2587148 - RNA, 13 nt, Human
ccugccucugccc

SEQ ID NO: 2587149 - RNA, 13 nt, Human
ccugccuccugcc

SEQ ID NO: 2587150 - RNA, 15 nt, Human
ccugccucuucucua

SEQ ID NO: 2587151 - RNA, 20 nt, Human
ccucugccugaagucacaca

SEQ ID NO: 2587152 - RNA, 11 nt, Human
ccucugccuga

SEQ ID NO: 2587153 - RNA, 23 nt, Human
ccucugccucugacacacagcuc

SEQ ID NO: 2587154 - RNA, 21 nt, Human
ccucugccucugacacacagc

SEQ ID NO: 2587155 - RNA, 11 nt, Human
ccucugcccug

SEQ ID NO: 2587156 - RNA, 12 nt, Human
ccucugcccugc

SEQ ID NO: 2587157 - RNA, 13 nt, Human
ccucugcccugcg

SEQ ID NO: 2587158 - RNA, 14 nt, Human
ccucugcccugcgg

SEQ ID NO: 2587159 - RNA, 20 nt, Human
ccucugccucugacacacag

SEQ ID NO: 2587160 - RNA, 11 nt, Human
ccucugccuca

SEQ ID NO: 2587161 - RNA, 12 nt, Human
ccucugccucaa

SEQ ID NO: 2587162 - RNA, 13 nt, Human
ccucugccucaau

SEQ ID NO: 2587163 - RNA, 12 nt, Human
ccucucucacuc

SEQ ID NO: 2587164 - RNA, 19 nt, Human
ccucucugcaggucccuaa

SEQ ID NO: 2587165 - RNA, 18 nt, Human
ccucucugcaggucccua

SEQ ID NO: 2587166 - RNA, 17 nt, Human
ccucucugcaggucccu

SEQ ID NO: 2587167 - RNA, 16 nt, Human
ccucucugcagguccc

SEQ ID NO: 2587168 - RNA, 21 nt, Human
ccucucggaaggcuggcuggg

SEQ ID NO: 2587169 - RNA, 19 nt, Human
ccucucgguggccagcagg

SEQ ID NO: 2587170 - RNA, 17 nt, Human
ccucgagggcagggacu

SEQ ID NO: 2587171 - RNA, 13 nt, Human
ccucgccugacaa

SEQ ID NO: 2587172 - RNA, 18 nt, Human
ccucgccuggccugaggu

SEQ ID NO: 2587173 - RNA, 16 nt, Human
ccucgccuggccugag

SEQ ID NO: 2587174 - RNA, 15 nt, Human
ccucgccuggccuga

SEQ ID NO: 2587175 - RNA, 14 nt, Human
ccucgccuggccug

SEQ ID NO: 2587176 - RNA, 13 nt, Human
ccucgccuggccu

SEQ ID NO: 2587177 - RNA, 12 nt, Human
ccucgccuggcc

SEQ ID NO: 2587178 - RNA, 13 nt, Human
ccucgcugccagc

SEQ ID NO: 2587179 - RNA, 14 nt, Human
ccucgcugccagcu

SEQ ID NO: 2587180 - RNA, 19 nt, Human
ccucgcugccagcucugua

SEQ ID NO: 2587181 - RNA, 20 nt, Human
ccucgcugccagcucuguau

SEQ ID NO: 2587182 - RNA, 15 nt, Human
ccucgggcccagccc

SEQ ID NO: 2587183 - RNA, 14 nt, Human
ccucgggcccagcc

SEQ ID NO: 2587184 - RNA, 13 nt, Human
ccucgggcccagc

SEQ ID NO: 2587185 - RNA, 22 nt, Human
ccucgggcccaccuggccaccu

SEQ ID NO: 2587186 - RNA, 21 nt, Human
ccucgggcccaccuggccacc

SEQ ID NO: 2587187 - RNA, 20 nt, Human
ccucgggcccaccuggccac

SEQ ID NO: 2587188 - RNA, 19 nt, Human
ccucgggcccaccuggcca

SEQ ID NO: 2587189 - RNA, 17 nt, Human
ccucgggcccaccuggc

SEQ ID NO: 2587190 - RNA, 16 nt, Human
ccucgggcccaccugg

SEQ ID NO: 2587191 - RNA, 15 nt, Human
ccucgggcccaccug

SEQ ID NO: 2587192 - RNA, 14 nt, Human
ccucgggcccaccu

SEQ ID NO: 2587193 - RNA, 13 nt, Human
ccucgggcccacc

SEQ ID NO: 2587194 - RNA, 23 nt, Human
ccucgggaaccucacucuugcca

SEQ ID NO: 2587195 - RNA, 21 nt, Human
ccucgggaaccucacucuugc

SEQ ID NO: 2587196 - RNA, 17 nt, Human
ccucgggaaccucacuc

SEQ ID NO: 2587197 - RNA, 22 nt, Human
ccucggcuccugcugcaccaac

SEQ ID NO: 2587198 - RNA, 20 nt, Human
ccucggcuccugcugcacca

SEQ ID NO: 2587199 - RNA, 19 nt, Human
ccucggcuccugcugcacc

SEQ ID NO: 2587200 - RNA, 18 nt, Human
ccucggcuccugcugcac

SEQ ID NO: 2587201 - RNA, 17 nt, Human
ccucggcuccugcugca

SEQ ID NO: 2587202 - RNA, 16 nt, Human
ccucggcuccugcugc

SEQ ID NO: 2587203 - RNA, 15 nt, Human
ccucggcuccugcug

SEQ ID NO: 2587204 - RNA, 12 nt, Human
ccucgcugcuuc

SEQ ID NO: 2587205 - RNA, 19 nt, Human
ccucggcuuuucucagcug

SEQ ID NO: 2587206 - RNA, 20 nt, Human
ccucggcuuuucucagcugg

SEQ ID NO: 2587207 - RNA, 13 nt, Human
ccucuccuuccug

SEQ ID NO: 2587208 - RNA, 15 nt, Human
ccucuccuuccugug

SEQ ID NO: 2587209 - RNA, 18 nt, Human
ccucuccuuuguauauua

SEQ ID NO: 2587210 - RNA, 16 nt, Human
ccucuccuuuguauau

SEQ ID NO: 2587211 - RNA, 15 nt, Human
ccucuccuuuguaua

SEQ ID NO: 2587212 - RNA, 14 nt, Human
ccucuccuuuguau

SEQ ID NO: 2587213 - RNA, 21 nt, Human
ccucuccuuguggccugggcc

SEQ ID NO: 2587214 - RNA, 16 nt, Human
ccucucgagggcaggg

SEQ ID NO: 2587215 - RNA, 22 nt, Human
ccucuccuuuguauauuauuuc

SEQ ID NO: 2587216 - RNA, 17 nt, Human
ccucucggaaggcuggc

SEQ ID NO: 2587217 - RNA, 17 nt, Human
ccucgggcccagccccc

SEQ ID NO: 2587218 - RNA, 16 nt, Human
ccucgggcccagcccc

SEQ ID NO: 2587219 - RNA, 18 nt, Human
ccucgggcccagccccca

SEQ ID NO: 2587220 - RNA, 20 nt, Human
ccuccuuugugaggaagccg

SEQ ID NO: 2587221 - RNA, 19 nt, Human
ccuccuuugugaggaagcc

SEQ ID NO: 2587222 - RNA, 18 nt, Human
ccuccuuugugaggaagc

SEQ ID NO: 2587223 - RNA, 16 nt, Human
ccuccuuucucuucuc

SEQ ID NO: 2587224 - RNA, 15 nt, Human
ccuccuuucucuucu

SEQ ID NO: 2587225 - RNA, 15 nt, Human
ccucgaacuggcugc

SEQ ID NO: 2587226 - RNA, 16 nt, Human
ccucgaacuggcugca

SEQ ID NO: 2587227 - RNA, 16 nt, Human
ccucgagggcagggac

SEQ ID NO: 2587228 - RNA, 14 nt, Human
ccucgagggcaggg

SEQ ID NO: 2587229 - RNA, 16 nt, Human
ccucgagcagaugaug

SEQ ID NO: 2587230 - RNA, 14 nt, Human
ccucgcccuggguc

SEQ ID NO: 2587231 - RNA, 21 nt, Human
ccuccuuucucuucucuguuc

SEQ ID NO: 2587232 - RNA, 20 nt, Human
ccuccuuucucuucucuguu

SEQ ID NO: 2587233 - RNA, 18 nt, Human
ccucgaagcgcgccacuc

SEQ ID NO: 2587234 - RNA, 19 nt, Human
ccucgaagcgcgccacucg

SEQ ID NO: 2587235 - RNA, 23 nt, Human
ccuccggcgucagccuccagccu

SEQ ID NO: 2587236 - RNA, 18 nt, Human
ccuccgggaccuggugcu

SEQ ID NO: 2587237 - RNA, 13 nt, Human
ccuccgccucccg

SEQ ID NO: 2587238 - RNA, 16 nt, Human
ccuccgccucccgggu

SEQ ID NO: 2587239 - RNA, 18 nt, Human
ccuccgcccugccacuca

SEQ ID NO: 2587240 - RNA, 16 nt, Human
ccuccgcccugccacu

SEQ ID NO: 2587241 - RNA, 15 nt, Human
ccuccgcccugccac

SEQ ID NO: 2587242 - RNA, 14 nt, Human
ccuccgcccugcca

SEQ ID NO: 2587243 - RNA, 13 nt, Human
ccuccgcccugcc

SEQ ID NO: 2587244 - RNA, 12 nt, Human
ccuccgcccugc

SEQ ID NO: 2587245 - RNA, 23 nt, Human
ccuccgccauucucaagcccugc

SEQ ID NO: 2587246 - RNA, 14 nt, Human
ccuccgccaggcga

SEQ ID NO: 2587247 - RNA, 16 nt, Human
ccuccgccaggcgaga

SEQ ID NO: 2587248 - RNA, 16 nt, Human
ccuccguugggcccca

SEQ ID NO: 2587249 - RNA, 14 nt, Human
ccuccgugcuuccu

SEQ ID NO: 2587250 - RNA, 18 nt, Human
ccuccguccaggagccug

SEQ ID NO: 2587251 - RNA, 16 nt, Human
ccuccguauuucagac

SEQ ID NO: 2587252 - RNA, 15 nt, Human
ccuccguauuucaga

SEQ ID NO: 2587253 - RNA, 15 nt, Human
ccuccuaccccuccc

SEQ ID NO: 2587254 - RNA, 15 nt, Human
ccuccuaagagagag

SEQ ID NO: 2587255 - RNA, 19 nt, Human
ccuccuaccccucccagcu

SEQ ID NO: 2587256 - RNA, 18 nt, Human
ccuccuaccccucccagc

SEQ ID NO: 2587257 - RNA, 17 nt, Human
ccuccuaccccucccag

SEQ ID NO: 2587258 - RNA, 16 nt, Human
ccuccuaccccuccca

SEQ ID NO: 2587259 - RNA, 21 nt, Human
ccuccuaccccucccagcuga

SEQ ID NO: 2587260 - RNA, 20 nt, Human
ccuccuaccccucccagcug

SEQ ID NO: 2587261 - RNA, 16 nt, Human
ccuccuacccugcgcc

SEQ ID NO: 2587262 - RNA, 20 nt, Human
ccucccugcuguccccucuu

SEQ ID NO: 2587263 - RNA, 19 nt, Human
ccucccugcuguccccucu

SEQ ID NO: 2587264 - RNA, 15 nt, Human
ccucccugcuguccc

SEQ ID NO: 2587265 - RNA, 14 nt, Human
ccucccugcugucc

SEQ ID NO: 2587266 - RNA, 13 nt, Human
ccucccuggagug

SEQ ID NO: 2587267 - RNA, 12 nt, Human
ccucccuggagu

SEQ ID NO: 2587268 - RNA, 14 nt, Human
ccucccuggccugu

SEQ ID NO: 2587269 - RNA, 22 nt, Human
ccucccugcuguccccucuugc

SEQ ID NO: 2587270 - RNA, 21 nt, Human
ccucccugcuguccccucuug

SEQ ID NO: 2587271 - RNA, 23 nt, Human
ccucccugcuguccccucuugcc

SEQ ID NO: 2587272 - RNA, 23 nt, Human
ccucccuggaguguggcugagga

SEQ ID NO: 2587273 - RNA, 15 nt, Human
ccucccuggccuguu

SEQ ID NO: 2587274 - RNA, 12 nt, Human
ccucccuggcuc

SEQ ID NO: 2587275 - RNA, 13 nt, Human
ccucccuggcucc

SEQ ID NO: 2587276 - RNA, 14 nt, Human
ccucccuggcuccc

SEQ ID NO: 2587277 - RNA, 21 nt, Human
ccucccuggcugcccuggccc

SEQ ID NO: 2587278 - RNA, 20 nt, Human
ccucccuggcugcccuggcc

SEQ ID NO: 2587279 - RNA, 18 nt, Human
ccucccuggcugcccugg

SEQ ID NO: 2587280 - RNA, 17 nt, Human
ccucccuggcugcccug

SEQ ID NO: 2587281 - RNA, 16 nt, Human
ccucccuggcugcccu

SEQ ID NO: 2587282 - RNA, 15 nt, Human
ccucccuggcugccc

SEQ ID NO: 2587283 - RNA, 14 nt, Human
ccucccuggcugcc

SEQ ID NO: 2587284 - RNA, 12 nt, Human
ccucccuggcug

SEQ ID NO: 2587285 - RNA, 15 nt, Human
ccucccuggcuccca

SEQ ID NO: 2587286 - RNA, 16 nt, Human
ccucccuggcucccau

SEQ ID NO: 2587287 - RNA, 18 nt, Human
ccucccuggcucccauga

SEQ ID NO: 2587288 - RNA, 20 nt, Human
ccucccuggcucccaugacc

SEQ ID NO: 2587289 - RNA, 19 nt, Human
ccucccuguuccccagaga

SEQ ID NO: 2587290 - RNA, 20 nt, Human
ccucccuguuccccagagaa

SEQ ID NO: 2587291 - RNA, 18 nt, Human
ccucccuguuccccagag

SEQ ID NO: 2587292 - RNA, 16 nt, Human
ccucccuguccuccuc

SEQ ID NO: 2587293 - RNA, 19 nt, Human
ccuccgauccuuccuccca

SEQ ID NO: 2587294 - RNA, 13 nt, Human
ccucccuuagcuc

SEQ ID NO: 2587295 - RNA, 14 nt, Human
ccucccuguuugaa

SEQ ID NO: 2587296 - RNA, 23 nt, Human
ccucccuguugacgaagucucuu

SEQ ID NO: 2587297 - RNA, 22 nt, Human
ccucccuguugacgaagucucu

SEQ ID NO: 2587298 - RNA, 15 nt, Human
ccucccuguccuccu

SEQ ID NO: 2587299 - RNA, 21 nt, Human
ccucccuguugaagcucuggu

SEQ ID NO: 2587300 - RNA, 23 nt, Human
ccucccugucaaagcugucacuu

SEQ ID NO: 2587301 - RNA, 12 nt, Human
ccucccugucaa

SEQ ID NO: 2587302 - RNA, 12 nt, Human
ccucccuguccu

SEQ ID NO: 2587303 - RNA, 11 nt, Human
ccucccugucc

SEQ ID NO: 2587304 - RNA, 14 nt, Human
ccucccuguccucc

SEQ ID NO: 2587305 - RNA, 12 nt, Human
ccucccuggguu

SEQ ID NO: 2587306 - RNA, 10 nt, Human
ccucccuggg

SEQ ID NO: 2587307 - RNA, 23 nt, Human
ccucccuggcugcccuggcccug

SEQ ID NO: 2587308 - RNA, 22 nt, Human
ccucccuggcugcccuggcccu

SEQ ID NO: 2587309 - RNA, 14 nt, Human
ccucccuggguuca

SEQ ID NO: 2587310 - RNA, 13 nt, Human
ccucccuggguuc

SEQ ID NO: 2587311 - RNA, 15 nt, Human
ccucccuggguucag

SEQ ID NO: 2587312 - RNA, 12 nt, Human
ccuccccagggg

SEQ ID NO: 2587313 - RNA, 14 nt, Human
ccuccccaggggag

SEQ ID NO: 2587314 - RNA, 13 nt, Human
ccuccccaggccg

SEQ ID NO: 2587315 - RNA, 21 nt, Human
ccuagcugugaccucuccccu

SEQ ID NO: 2587316 - RNA, 22 nt, Human
ccuagcuuuagacccugggugg

SEQ ID NO: 2587317 - RNA, 21 nt, Human
ccuagcuuuagacccugggug

SEQ ID NO: 2587318 - RNA, 20 nt, Human
ccuagcuuuagacccugggu

SEQ ID NO: 2587319 - RNA, 18 nt, Human
ccuagcuuuagacccugg

SEQ ID NO: 2587320 - RNA, 23 nt, Human
ccuagcuuuagacccuggguggg

SEQ ID NO: 2587321 - RNA, 17 nt, Human
ccuagcuuuagacccug

SEQ ID NO: 2587322 - RNA, 21 nt, Human
ccuagcuugggaggcuucccc

SEQ ID NO: 2587323 - RNA, 15 nt, Human
ccuagcuuagagccu

SEQ ID NO: 2587324 - RNA, 20 nt, Human
ccuagcuugggaggcuuccc

SEQ ID NO: 2587325 - RNA, 22 nt, Human
ccuagcugcacagggcagcugg

SEQ ID NO: 2587326 - RNA, 21 nt, Human
ccuagcugcacagggcagcug

SEQ ID NO: 2587327 - RNA, 19 nt, Human
ccuagcugcacagggcagc

SEQ ID NO: 2587328 - RNA, 17 nt, Human
ccuagcugcuacaaaga

SEQ ID NO: 2587329 - RNA, 15 nt, Human
ccuagcugcuacaaa

SEQ ID NO: 2587330 - RNA, 14 nt, Human
ccuagcugcuacaa

SEQ ID NO: 2587331 - RNA, 23 nt, Human
ccuagcugcacagggcagcuggg

SEQ ID NO: 2587332 - RNA, 18 nt, Human
ccuagcugcuacaaagaa

SEQ ID NO: 2587333 - RNA, 22 nt, Human
ccuagccuuauccucugaucuc

SEQ ID NO: 2587334 - RNA, 19 nt, Human
ccuagccuuauccucugau

SEQ ID NO: 2587335 - RNA, 15 nt, Human
ccucaggcagcucaa

SEQ ID NO: 2587336 - RNA, 14 nt, Human
ccucaggcagcuca

SEQ ID NO: 2587337 - RNA, 22 nt, Human
ccucaggcacuagccuuuggcu

SEQ ID NO: 2587338 - RNA, 19 nt, Human
ccucaggcacuagccuuug

SEQ ID NO: 2587339 - RNA, 13 nt, Human
ccucaggcagcuc

SEQ ID NO: 2587340 - RNA, 18 nt, Human
ccucaggcacuagccuuu

SEQ ID NO: 2587341 - RNA, 17 nt, Human
ccucaggcacuagccuu

SEQ ID NO: 2587342 - RNA, 16 nt, Human
ccucaggcacuagccu

SEQ ID NO: 2587343 - RNA, 15 nt, Human
ccucaggcacuagcc

SEQ ID NO: 2587344 - RNA, 15 nt, Human
ccucagccuggccag

SEQ ID NO: 2587345 - RNA, 16 nt, Human
ccucagccuggccaga

SEQ ID NO: 2587346 - RNA, 17 nt, Human
ccucagccuggccagac

SEQ ID NO: 2587347 - RNA, 18 nt, Human
ccucagccuggccagaca

SEQ ID NO: 2587348 - RNA, 19 nt, Human
ccucaggaggcaggaccuu

SEQ ID NO: 2587349 - RNA, 20 nt, Human
ccucaggcaaggucuggccu

SEQ ID NO: 2587350 - RNA, 11 nt, Human
ccucagccugg

SEQ ID NO: 2587351 - RNA, 12 nt, Human
ccucagccuggc

SEQ ID NO: 2587352 - RNA, 13 nt, Human
ccucagccuggcc

SEQ ID NO: 2587353 - RNA, 14 nt, Human
ccucagccuggcca

SEQ ID NO: 2587354 - RNA, 16 nt, Human
ccuaggaauucccagc

SEQ ID NO: 2587355 - RNA, 17 nt, Human
ccuaggaauucccagcc

SEQ ID NO: 2587356 - RNA, 18 nt, Human
ccucagccuccugaguag

SEQ ID NO: 2587357 - RNA, 15 nt, Human
ccucagccuccugag

SEQ ID NO: 2587358 - RNA, 23 nt, Human
ccucccaacucaccccagcccca

SEQ ID NO: 2587359 - RNA, 21 nt, Human
ccucccaacucaccccagccc

SEQ ID NO: 2587360 - RNA, 20 nt, Human
ccucccaacucaccccagcc

SEQ ID NO: 2587361 - RNA, 17 nt, Human
ccucccaacucacccca

SEQ ID NO: 2587362 - RNA, 11 nt, Human
ccucaggcagg

SEQ ID NO: 2587363 - RNA, 13 nt, Human
ccucaugcaucuc

SEQ ID NO: 2587364 - RNA, 24 nt, Human
ccucaugcccacccccugcccugc

SEQ ID NO: 2587365 - RNA, 20 nt, Human
ccucaugcccacccccugcc

SEQ ID NO: 2587366 - RNA, 15 nt, Human
ccucaugcccacccc

SEQ ID NO: 2587367 - RNA, 14 nt, Human
ccucaugcccaccc

SEQ ID NO: 2587368 - RNA, 18 nt, Human
ccucaugcaucuccaccu

SEQ ID NO: 2587369 - RNA, 15 nt, Human
ccucaugcaucucca

SEQ ID NO: 2587370 - RNA, 13 nt, Human
ccucaugcccacc

SEQ ID NO: 2587371 - RNA, 22 nt, Human
ccuccccagccccuagcccagg

SEQ ID NO: 2587372 - RNA, 17 nt, Human
ccuccccagccccuagc

SEQ ID NO: 2587373 - RNA, 16 nt, Human
ccuccccagccccuag

SEQ ID NO: 2587374 - RNA, 15 nt, Human
ccuccccagccccua

SEQ ID NO: 2587375 - RNA, 14 nt, Human
ccuccccagccccu

SEQ ID NO: 2587376 - RNA, 12 nt, Human
ccuccccagccc

SEQ ID NO: 2587377 - RNA, 22 nt, Human
ccuccccagcauuccagccccu

SEQ ID NO: 2587378 - RNA, 12 nt, Human
ccuccccagcuc

SEQ ID NO: 2587379 - RNA, 22 nt, Human
ccuccccacggccgcuccaggg

SEQ ID NO: 2587380 - RNA, 17 nt, Human
ccuccccacgcccuccc

SEQ ID NO: 2587381 - RNA, 15 nt, Human
ccuccccacgcccuc

SEQ ID NO: 2587382 - RNA, 13 nt, Human
ccuccccacgccc

SEQ ID NO: 2587383 - RNA, 12 nt, Human
ccuccccagcag

SEQ ID NO: 2587384 - RNA, 16 nt, Human
ccuccccagcaggugg

SEQ ID NO: 2587385 - RNA, 17 nt, Human
ccuccccagcagguggg

SEQ ID NO: 2587386 - RNA, 20 nt, Human
ccuccccagcagguggggag

SEQ ID NO: 2587387 - RNA, 23 nt, Human
ccucaugcccacccccugcccug

SEQ ID NO: 2587388 - RNA, 22 nt, Human
ccucaugcccacccccugcccu

SEQ ID NO: 2587389 - RNA, 21 nt, Human
ccucaugcccacccccugccc

SEQ ID NO: 2587390 - RNA, 15 nt, Human
ccucccaccucugug

SEQ ID NO: 2587391 - RNA, 14 nt, Human
ccucccaccucugu

SEQ ID NO: 2587392 - RNA, 13 nt, Human
ccucccaccucug

SEQ ID NO: 2587393 - RNA, 12 nt, Human
ccucccaccucu

SEQ ID NO: 2587394 - RNA, 19 nt, Human
ccucccaccucugugaccu

SEQ ID NO: 2587395 - RNA, 17 nt, Human
ccucccagaacacacuc

SEQ ID NO: 2587396 - RNA, 21 nt, Human
ccucccagaccugccucuucc

SEQ ID NO: 2587397 - RNA, 18 nt, Human
ccucccagaacacacucc

SEQ ID NO: 2587398 - RNA, 13 nt, Human
ccucccacugggg

SEQ ID NO: 2587399 - RNA, 15 nt, Human
ccucccacugggguc

SEQ ID NO: 2587400 - RNA, 22 nt, Human
cccugugauggggcccugccuc

SEQ ID NO: 2587401 - RNA, 21 nt, Human
cccugugauggggcccugccu

SEQ ID NO: 2587402 - RNA, 23 nt, Human
cccugugauggggcccugccucc

SEQ ID NO: 2587403 - RNA, 22 nt, Human
cccugugcaaccucuuggccug

SEQ ID NO: 2587404 - RNA, 14 nt, Human
cccugucuaaaaaa

SEQ ID NO: 2587405 - RNA, 21 nt, Human
cccuuccucuccacugccuuc

SEQ ID NO: 2587406 - RNA, 23 nt, Human
cccuguccugauggucagcuccc

SEQ ID NO: 2587407 - RNA, 22 nt, Human
cccuguccugauggucagcucc

SEQ ID NO: 2587408 - RNA, 20 nt, Human
cccuguccucucuggcuggg

SEQ ID NO: 2587409 - RNA, 15 nt, Human
cccugucgagacacu

SEQ ID NO: 2587410 - RNA, 20 nt, Human
cccugucgagacacuugccu

SEQ ID NO: 2587411 - RNA, 16 nt, Human
cccugucgagacacuu

SEQ ID NO: 2587412 - RNA, 24 nt, Human
cccugucccucccaccucugugac

SEQ ID NO: 2587413 - RNA, 23 nt, Human
cccugucccucccaccucuguga

SEQ ID NO: 2587414 - RNA, 13 nt, Human
cccugucccucua

SEQ ID NO: 2587415 - RNA, 13 nt, Human
cccuguccucacu

SEQ ID NO: 2587416 - RNA, 17 nt, Human
cccuguccucacugcuc

SEQ ID NO: 2587417 - RNA, 16 nt, Human
cccuguccucacugcu

SEQ ID NO: 2587418 - RNA, 15 nt, Human
cccuguccucacugc

SEQ ID NO: 2587419 - RNA, 14 nt, Human
cccuguccucacug

SEQ ID NO: 2587420 - RNA, 18 nt, Human
cccuguccucacugcucc

SEQ ID NO: 2587421 - RNA, 14 nt, Human
cccuguccuccucg

SEQ ID NO: 2587422 - RNA, 15 nt, Human
cccuguccuccucgg

SEQ ID NO: 2587423 - RNA, 16 nt, Human
cccuguccuccucgga

SEQ ID NO: 2587424 - RNA, 17 nt, Human
ccgcagacaggaccagg

SEQ ID NO: 2587425 - RNA, 16 nt, Human
ccgcagacaggaccag

SEQ ID NO: 2587426 - RNA, 19 nt, Human
ccgcagaccuccccagccc

SEQ ID NO: 2587427 - RNA, 18 nt, Human
ccgcagaccuccccagcc

SEQ ID NO: 2587428 - RNA, 17 nt, Human
ccgcagaccuccccagc

SEQ ID NO: 2587429 - RNA, 16 nt, Human
ccgcagaccuccccag

SEQ ID NO: 2587430 - RNA, 15 nt, Human
ccgcagaccucccca

SEQ ID NO: 2587431 - RNA, 13 nt, Human
ccgcagaccuccc

SEQ ID NO: 2587432 - RNA, 16 nt, Human
ccgaccacaccagagc

SEQ ID NO: 2587433 - RNA, 21 nt, Human
ccgcagaccuccccagccccu

SEQ ID NO: 2587434 - RNA, 20 nt, Human
ccgcagaccuccccagcccc

SEQ ID NO: 2587435 - RNA, 18 nt, Human
ccgcccaggcuggccagc

SEQ ID NO: 2587436 - RNA, 17 nt, Human
ccgcccaggcuggccag

SEQ ID NO: 2587437 - RNA, 16 nt, Human
ccgcccaggcuggcca

SEQ ID NO: 2587438 - RNA, 14 nt, Human
ccgcccaggcuggc

SEQ ID NO: 2587439 - RNA, 22 nt, Human
ccgcccaggcuggccagcccca

SEQ ID NO: 2587440 - RNA, 20 nt, Human
ccgcccaggcuggccagccc

SEQ ID NO: 2587441 - RNA, 12 nt, Human
ccgcccaggcuu

SEQ ID NO: 2587442 - RNA, 15 nt, Human
ccgcccacuguccug

SEQ ID NO: 2587443 - RNA, 13 nt, Human
ccgcccacugucc

SEQ ID NO: 2587444 - RNA, 23 nt, Human
ccgcccacaggaagccugcaguc

SEQ ID NO: 2587445 - RNA, 22 nt, Human
ccgcccagagacccaagcugcc

SEQ ID NO: 2587446 - RNA, 18 nt, Human
ccgcccacuguccugggc

SEQ ID NO: 2587447 - RNA, 16 nt, Human
ccgcccacuguccugg

SEQ ID NO: 2587448 - RNA, 19 nt, Human
ccgcccacuguccugggcg

SEQ ID NO: 2587449 - RNA, 17 nt, Human
ccgcccagcugcaccug

SEQ ID NO: 2587450 - RNA, 22 nt, Human
ccgcccagcugcaccugccagc

SEQ ID NO: 2587451 - RNA, 15 nt, Human
cccuuccucuuucca

SEQ ID NO: 2587452 - RNA, 17 nt, Human
ccgaaaacguggcugcu

SEQ ID NO: 2587453 - RNA, 16 nt, Human
ccgaaaacguggcugc

SEQ ID NO: 2587454 - RNA, 18 nt, Human
cccuuccuuuucccugcu

SEQ ID NO: 2587455 - RNA, 17 nt, Human
ccgaaaccaaagaagaa

SEQ ID NO: 2587456 - RNA, 17 nt, Human
cccuuccuuuucccugc

SEQ ID NO: 2587457 - RNA, 14 nt, Human
cccuuccuugcucu

SEQ ID NO: 2587458 - RNA, 24 nt, Human
ccgaaacaggcuacucuccucggc

SEQ ID NO: 2587459 - RNA, 19 nt, Human
ccgaaagggacuuggaagc

SEQ ID NO: 2587460 - RNA, 17 nt, Human
ccgaccagacaccuuga

SEQ ID NO: 2587461 - RNA, 13 nt, Human
ccgaccagacacc

SEQ ID NO: 2587462 - RNA, 15 nt, Human
ccgcagacaggacca

SEQ ID NO: 2587463 - RNA, 15 nt, Human
ccgaccaccugccca

SEQ ID NO: 2587464 - RNA, 18 nt, Human
ccgaccagacaccuugac

SEQ ID NO: 2587465 - RNA, 17 nt, Human
ccgaauagcugggacua

SEQ ID NO: 2587466 - RNA, 16 nt, Human
ccgaauagcugggacu

SEQ ID NO: 2587467 - RNA, 23 nt, Human
ccgaaggugaggagcuugaaacc

SEQ ID NO: 2587468 - RNA, 21 nt, Human
ccgaaguggacuggccccugg

SEQ ID NO: 2587469 - RNA, 22 nt, Human
ccgaaaaauccucuuccucuga

SEQ ID NO: 2587470 - RNA, 13 nt, Human
ccgaagucuuuug

SEQ ID NO: 2587471 - RNA, 23 nt, Human
ccgaaggugcuggaggugggagc

SEQ ID NO: 2587472 - RNA, 15 nt, Human
ccgaaggugcuggag

SEQ ID NO: 2587473 - RNA, 15 nt, Human
ccuaaggacacacua

SEQ ID NO: 2587474 - RNA, 14 nt, Human
ccuaaggacacacu

SEQ ID NO: 2587475 - RNA, 14 nt, Human
ccuaaucuucugaa

SEQ ID NO: 2587476 - RNA, 20 nt, Human
ccuaaucuauggucgggaga

SEQ ID NO: 2587477 - RNA, 22 nt, Human
ccuaaucccugggcauugcuuu

SEQ ID NO: 2587478 - RNA, 19 nt, Human
ccuaaggaucucucaggag

SEQ ID NO: 2587479 - RNA, 17 nt, Human
ccuaaggaucucucagg

SEQ ID NO: 2587480 - RNA, 16 nt, Human
ccuaaggaucucucag

SEQ ID NO: 2587481 - RNA, 17 nt, Human
ccuaaggacacacuaau

SEQ ID NO: 2587482 - RNA, 23 nt, Human
ccuaaggaucucucaggagcaca

SEQ ID NO: 2587483 - RNA, 22 nt, Human
ccuaaggaucucucaggagcac

SEQ ID NO: 2587484 - RNA, 18 nt, Human
ccuaauccaggcagaucc

SEQ ID NO: 2587485 - RNA, 19 nt, Human
ccuaauccaggcagaucca

SEQ ID NO: 2587486 - RNA, 20 nt, Human
ccuaauccaggcagauccag

SEQ ID NO: 2587487 - RNA, 21 nt, Human
ccuaauccaggcagauccagg

SEQ ID NO: 2587488 - RNA, 21 nt, Human
ccuaaucccugggcauugcuu

SEQ ID NO: 2587489 - RNA, 20 nt, Human
ccuagccugugccucuggga

SEQ ID NO: 2587490 - RNA, 12 nt, Human
ccuagcagagag

SEQ ID NO: 2587491 - RNA, 20 nt, Human
ccuagccgaccucagccuuc

SEQ ID NO: 2587492 - RNA, 18 nt, Human
ccuagccgaccucagccu

SEQ ID NO: 2587493 - RNA, 19 nt, Human
ccuagccgaccucagccuu

SEQ ID NO: 2587494 - RNA, 20 nt, Human
ccuagcccucucacauuuau

SEQ ID NO: 2587495 - RNA, 13 nt, Human
ccuagcccucuca

SEQ ID NO: 2587496 - RNA, 14 nt, Human
ccuagccgaccuca

SEQ ID NO: 2587497 - RNA, 15 nt, Human
ccuagccgaccucag

SEQ ID NO: 2587498 - RNA, 16 nt, Human
ccuagccgaccucagc

SEQ ID NO: 2587499 - RNA, 17 nt, Human
ccuagccgaccucagcc

SEQ ID NO: 2587500 - RNA, 20 nt, Human
ccuagcagcaccguucugug

SEQ ID NO: 2587501 - RNA, 21 nt, Human
ccuagcagcaccguucugugc

SEQ ID NO: 2587502 - RNA, 23 nt, Human
ccuagcagcaccguucugugcac

SEQ ID NO: 2587503 - RNA, 19 nt, Human
ccuagcauacguacacauu

SEQ ID NO: 2587504 - RNA, 22 nt, Human
ccuaaugacaucaccacaguuu

SEQ ID NO: 2587505 - RNA, 12 nt, Human
ccuagcagcacc

SEQ ID NO: 2587506 - RNA, 17 nt, Human
ccuagcacuuugggagg

SEQ ID NO: 2587507 - RNA, 20 nt, Human
ccuaagaccggcggccauga

SEQ ID NO: 2587508 - RNA, 17 nt, Human
ccuaagaaucuuuagag

SEQ ID NO: 2587509 - RNA, 13 nt, Human
ccuaacucauacu

SEQ ID NO: 2587510 - RNA, 14 nt, Human
ccgugaggauguca

SEQ ID NO: 2587511 - RNA, 18 nt, Human
ccuaacucauacugugcu

SEQ ID NO: 2587512 - RNA, 15 nt, Human
ccuaacucauacugu

SEQ ID NO: 2587513 - RNA, 20 nt, Human
ccuaacgaaguauccuucag

SEQ ID NO: 2587514 - RNA, 16 nt, Human
ccgugaggccagagac

SEQ ID NO: 2587515 - RNA, 14 nt, Human
ccgugaggccagag

SEQ ID NO: 2587516 - RNA, 13 nt, Human
ccgugaggccaga

SEQ ID NO: 2587517 - RNA, 12 nt, Human
ccgugaggccag

SEQ ID NO: 2587518 - RNA, 17 nt, Human
ccgucuaccugaggggc

SEQ ID NO: 2587519 - RNA, 14 nt, Human
ccggcuccaggcuc

SEQ ID NO: 2587520 - RNA, 13 nt, Human
ccggcuccaggcu

SEQ ID NO: 2587521 - RNA, 16 nt, Human
ccggccucucuggccu

SEQ ID NO: 2587522 - RNA, 15 nt, Human
ccggccucucuggcc

SEQ ID NO: 2587523 - RNA, 13 nt, Human
ccggccucucugg

SEQ ID NO: 2587524 - RNA, 12 nt, Human
ccggccucucug

SEQ ID NO: 2587525 - RNA, 23 nt, Human
ccggccucagcaccccugucucu

SEQ ID NO: 2587526 - RNA, 12 nt, Human
ccggcuccaggc

SEQ ID NO: 2587527 - RNA, 15 nt, Human
ccgucuaccugaggg

SEQ ID NO: 2587528 - RNA, 14 nt, Human
ccgucuaccugagg

SEQ ID NO: 2587529 - RNA, 21 nt, Human
ccgucgaggggcucucagcuc

SEQ ID NO: 2587530 - RNA, 16 nt, Human
ccguccugccuguggc

SEQ ID NO: 2587531 - RNA, 22 nt, Human
ccgucgaggggcucucagcuca

SEQ ID NO: 2587532 - RNA, 15 nt, Human
ccggcuccaggcucc

SEQ ID NO: 2587533 - RNA, 18 nt, Human
ccggcaggguccuagaaa

SEQ ID NO: 2587534 - RNA, 15 nt, Human
ccggccaccucugcg

SEQ ID NO: 2587535 - RNA, 14 nt, Human
ccggccaccucugc

SEQ ID NO: 2587536 - RNA, 13 nt, Human
ccggccaccucug

SEQ ID NO: 2587537 - RNA, 12 nt, Human
ccggccaccucu

SEQ ID NO: 2587538 - RNA, 14 nt, Human
ccggcaugggaaag

SEQ ID NO: 2587539 - RNA, 14 nt, Human
ccggcauggcuggg

SEQ ID NO: 2587540 - RNA, 17 nt, Human
ccggcaguucugggugc

SEQ ID NO: 2587541 - RNA, 22 nt, Human
ccggcaguucugggugcucccu

SEQ ID NO: 2587542 - RNA, 16 nt, Human
ccggccaccugcggug

SEQ ID NO: 2587543 - RNA, 15 nt, Human
ccggccccugcuggu

SEQ ID NO: 2587544 - RNA, 13 nt, Human
ccggcccuggggc

SEQ ID NO: 2587545 - RNA, 24 nt, Human
ccggcccugggcucggaggcugcc

SEQ ID NO: 2587546 - RNA, 22 nt, Human
ccggcccugggcucggaggcug

SEQ ID NO: 2587547 - RNA, 12 nt, Human
ccggcccugggg

SEQ ID NO: 2587548 - RNA, 19 nt, Human
ccggcccugggcucggagg

SEQ ID NO: 2587549 - RNA, 21 nt, Human
ccggcccuccuacccugcgcc

SEQ ID NO: 2587550 - RNA, 20 nt, Human
cccuggccuccccugccacc

SEQ ID NO: 2587551 - RNA, 19 nt, Human
cccuggccuccccugccac

SEQ ID NO: 2587552 - RNA, 20 nt, Human
cccuggccuccggcgucagc

SEQ ID NO: 2587553 - RNA, 13 nt, Human
cccuggccucugu

SEQ ID NO: 2587554 - RNA, 15 nt, Human
cccuggccucugugc

SEQ ID NO: 2587555 - RNA, 18 nt, Human
cccuggccucugugccuu

SEQ ID NO: 2587556 - RNA, 19 nt, Human
cccuggccucugugccuuc

SEQ ID NO: 2587557 - RNA, 19 nt, Human
cccuggcucccacaggccc

SEQ ID NO: 2587558 - RNA, 20 nt, Human
cccuggcucccacaggcccu

SEQ ID NO: 2587559 - RNA, 13 nt, Human
cccuggcucccau

SEQ ID NO: 2587560 - RNA, 14 nt, Human
cccuggcucccaug

SEQ ID NO: 2587561 - RNA, 21 nt, Human
cccuggccuccggcgucagcc

SEQ ID NO: 2587562 - RNA, 15 nt, Human
cccuggcucccauga

SEQ ID NO: 2587563 - RNA, 23 nt, Human
cccuggcucccaugaccauacug

SEQ ID NO: 2587564 - RNA, 18 nt, Human
cccuggcugcccuggccc

SEQ ID NO: 2587565 - RNA, 17 nt, Human
cccuggcugcccuggcc

SEQ ID NO: 2587566 - RNA, 16 nt, Human
cccuggcugcccuggc

SEQ ID NO: 2587567 - RNA, 15 nt, Human
cccuggcugcccugg

SEQ ID NO: 2587568 - RNA, 14 nt, Human
cccuggcugcccug

SEQ ID NO: 2587569 - RNA, 13 nt, Human
cccuggcugcccu

SEQ ID NO: 2587570 - RNA, 23 nt, Human
cccuggcugaccccaaagagccu

SEQ ID NO: 2587571 - RNA, 19 nt, Human
cccuggcugaccccaaaga

SEQ ID NO: 2587572 - RNA, 19 nt, Human
cccuggcugaaggacugug

SEQ ID NO: 2587573 - RNA, 18 nt, Human
cccuggcugaaggacugu

SEQ ID NO: 2587574 - RNA, 15 nt, Human
cccuggcugaaggac

SEQ ID NO: 2587575 - RNA, 14 nt, Human
cccuggcugaagga

SEQ ID NO: 2587576 - RNA, 13 nt, Human
cccuggcucugca

SEQ ID NO: 2587577 - RNA, 19 nt, Human
cccuggcucucagaaggua

SEQ ID NO: 2587578 - RNA, 21 nt, Human
cccuggaugcagccucacagu

SEQ ID NO: 2587579 - RNA, 17 nt, Human
cccuggaugcagccuca

SEQ ID NO: 2587580 - RNA, 13 nt, Human
cccuggaugcagc

SEQ ID NO: 2587581 - RNA, 23 nt, Human
cccuggaguguggcugaggaggc

SEQ ID NO: 2587582 - RNA, 23 nt, Human
cccuggaucaguccuuugaucag

SEQ ID NO: 2587583 - RNA, 14 nt, Human
cccuggccuccccu

SEQ ID NO: 2587584 - RNA, 13 nt, Human
cccuggccucccc

SEQ ID NO: 2587585 - RNA, 11 nt, Human
cccuggccucc

SEQ ID NO: 2587586 - RNA, 17 nt, Human
cccuggcccugaggugu

SEQ ID NO: 2587587 - RNA, 16 nt, Human
cccuggcccugaggug

SEQ ID NO: 2587588 - RNA, 14 nt, Human
cccuggcccugagg

SEQ ID NO: 2587589 - RNA, 23 nt, Human
cccuggcccucaaggccucccac

SEQ ID NO: 2587590 - RNA, 22 nt, Human
cccuggcccucaaggccuccca

SEQ ID NO: 2587591 - RNA, 15 nt, Human
cccuggccgcccccu

SEQ ID NO: 2587592 - RNA, 20 nt, Human
cccuggccgaguccaagcug

SEQ ID NO: 2587593 - RNA, 19 nt, Human
cccuggauccaucaggcca

SEQ ID NO: 2587594 - RNA, 20 nt, Human
cccuggcccucaaggccucc

SEQ ID NO: 2587595 - RNA, 23 nt, Human
cccugcccugguuuccugcccug

SEQ ID NO: 2587596 - RNA, 18 nt, Human
cccugcccugguccaggg

SEQ ID NO: 2587597 - RNA, 13 nt, Human
cccuggaggugcc

SEQ ID NO: 2587598 - RNA, 22 nt, Human
cccugcccugguuuccugcccu

SEQ ID NO: 2587599 - RNA, 14 nt, Human
cccugcccuggucc

SEQ ID NO: 2587600 - RNA, 15 nt, Human
cccugcccuggucca

SEQ ID NO: 2587601 - RNA, 21 nt, Human
cccuggaguguggcugaggag

SEQ ID NO: 2587602 - RNA, 20 nt, Human
cccuggaguguggcugagga

SEQ ID NO: 2587603 - RNA, 15 nt, Human
cccuggagugcaguu

SEQ ID NO: 2587604 - RNA, 18 nt, Human
cccuggagucaugccaag

SEQ ID NO: 2587605 - RNA, 23 nt, Human
cccuggaggugccagcaaagccc

SEQ ID NO: 2587606 - RNA, 13 nt, Human
cccuggagguggc

SEQ ID NO: 2587607 - RNA, 22 nt, Human
cccuggaggugccagcaaagcc

SEQ ID NO: 2587608 - RNA, 20 nt, Human
cccuggaggugccagcaaag

SEQ ID NO: 2587609 - RNA, 18 nt, Human
cccuggaggugccagcaa

SEQ ID NO: 2587610 - RNA, 17 nt, Human
cccuggaggugccagca

SEQ ID NO: 2587611 - RNA, 16 nt, Human
cccuggaggugccagc

SEQ ID NO: 2587612 - RNA, 15 nt, Human
cccuggaggugccag

SEQ ID NO: 2587613 - RNA, 14 nt, Human
cccuggaggugcca

SEQ ID NO: 2587614 - RNA, 13 nt, Human
cccugcccuggga

SEQ ID NO: 2587615 - RNA, 11 nt, Human
cccugcccugg

SEQ ID NO: 2587616 - RNA, 12 nt, Human
cccugcccuggu

SEQ ID NO: 2587617 - RNA, 13 nt, Human
cccugcccugcug

SEQ ID NO: 2587618 - RNA, 22 nt, Human
cccugcccucguggccagcccg

SEQ ID NO: 2587619 - RNA, 21 nt, Human
cccugcccucguggccagccc

SEQ ID NO: 2587620 - RNA, 20 nt, Human
cccugcccucguggccagcc

SEQ ID NO: 2587621 - RNA, 13 nt, Human
cccugcccugcac

SEQ ID NO: 2587622 - RNA, 12 nt, Human
cccugcccugca

SEQ ID NO: 2587623 - RNA, 11 nt, Human
cccugcccugc

SEQ ID NO: 2587624 - RNA, 19 nt, Human
cccugcccucguggccagc

SEQ ID NO: 2587625 - RNA, 18 nt, Human
cccugcccucguggccag

SEQ ID NO: 2587626 - RNA, 17 nt, Human
cccugcccucguggcca

SEQ ID NO: 2587627 - RNA, 16 nt, Human
cccugcccucguggcc

SEQ ID NO: 2587628 - RNA, 14 nt, Human
cccugcccucgugg

SEQ ID NO: 2587629 - RNA, 13 nt, Human
cccugcccucgug

SEQ ID NO: 2587630 - RNA, 15 nt, Human
cccugcccuccccuc

SEQ ID NO: 2587631 - RNA, 22 nt, Human
cccugcccccaggacugggcca

SEQ ID NO: 2587632 - RNA, 20 nt, Human
cccugcccccaggacugggc

SEQ ID NO: 2587633 - RNA, 18 nt, Human
cccugcccccaggacugg

SEQ ID NO: 2587634 - RNA, 17 nt, Human
cccugcccccaggacug

SEQ ID NO: 2587635 - RNA, 16 nt, Human
cccugcccccaggacu

SEQ ID NO: 2587636 - RNA, 14 nt, Human
cccugcccccagga

SEQ ID NO: 2587637 - RNA, 18 nt, Human
cccugcccccagccccgg

SEQ ID NO: 2587638 - RNA, 20 nt, Human
cccugcccccacuuccuguu

SEQ ID NO: 2587639 - RNA, 13 nt, Human
cccugcccccagg

SEQ ID NO: 2587640 - RNA, 12 nt, Human
cccugcccccca

SEQ ID NO: 2587641 - RNA, 23 nt, Human
cccugcccccaggacugggccac

SEQ ID NO: 2587642 - RNA, 14 nt, Human
cccugccccccagc

SEQ ID NO: 2587643 - RNA, 20 nt, Human
cccugccccccagcccuccu

SEQ ID NO: 2587644 - RNA, 15 nt, Human
cccugccccccagcc

SEQ ID NO: 2587645 - RNA, 22 nt, Human
cccugcccaccuggccucugca

SEQ ID NO: 2587646 - RNA, 14 nt, Human
cccugagcugaggg

SEQ ID NO: 2587647 - RNA, 14 nt, Human
cccugaggagccag

SEQ ID NO: 2587648 - RNA, 18 nt, Human
cccugcccccacuuccug

SEQ ID NO: 2587649 - RNA, 17 nt, Human
cccugcccccacuuccu

SEQ ID NO: 2587650 - RNA, 16 nt, Human
cccugcccccacuucc

SEQ ID NO: 2587651 - RNA, 14 nt, Human
cccugcccccacca

SEQ ID NO: 2587652 - RNA, 20 nt, Human
cccugcccccaaauaagaag

SEQ ID NO: 2587653 - RNA, 20 nt, Human
cccugccccagcccaagucc

SEQ ID NO: 2587654 - RNA, 19 nt, Human
cccugccccagcccaaguc

SEQ ID NO: 2587655 - RNA, 17 nt, Human
cccugccccagcccaag

SEQ ID NO: 2587656 - RNA, 12 nt, Human
cccugcccaugu

SEQ ID NO: 2587657 - RNA, 15 nt, Human
cccugccccagccca

SEQ ID NO: 2587658 - RNA, 13 nt, Human
cccugccccagcc

SEQ ID NO: 2587659 - RNA, 16 nt, Human
cccugccccagcaaga

SEQ ID NO: 2587660 - RNA, 21 nt, Human
cccugccccccagccucuggc

SEQ ID NO: 2587661 - RNA, 19 nt, Human
cccugccccccagccucug

SEQ ID NO: 2587662 - RNA, 16 nt, Human
cccugccccccagccu

SEQ ID NO: 2587663 - RNA, 17 nt, Human
cccugccccucccuuca

SEQ ID NO: 2587664 - RNA, 15 nt, Human
cccugccccgucacc

SEQ ID NO: 2587665 - RNA, 23 nt, Human
cccugccccucccuucaaccauu

SEQ ID NO: 2587666 - RNA, 21 nt, Human
cccugccccgucaccaucuca

SEQ ID NO: 2587667 - RNA, 12 nt, Human
cccugccccugc

SEQ ID NO: 2587668 - RNA, 19 nt, Human
cccugccccucccuucaac

SEQ ID NO: 2587669 - RNA, 18 nt, Human
cccugccccucccuucaa

SEQ ID NO: 2587670 - RNA, 17 nt, Human
cccugcccggcugcgga

SEQ ID NO: 2587671 - RNA, 14 nt, Human
cccugcccggcugc

SEQ ID NO: 2587672 - RNA, 13 nt, Human
cccugccccugcc

SEQ ID NO: 2587673 - RNA, 17 nt, Human
cccugccccugccccgu

SEQ ID NO: 2587674 - RNA, 18 nt, Human
cccugccccugccccguc

SEQ ID NO: 2587675 - RNA, 19 nt, Human
cccugccccugccccguca

SEQ ID NO: 2587676 - RNA, 14 nt, Human
cccugcccuagcuc

SEQ ID NO: 2587677 - RNA, 16 nt, Human
cccugcccuagcucca

SEQ ID NO: 2587678 - RNA, 10 nt, Human
cccugcccuc

SEQ ID NO: 2587679 - RNA, 17 nt, Human
cccugcccuagcuccac

SEQ ID NO: 2587680 - RNA, 18 nt, Human
cccugcccucaucucucu

SEQ ID NO: 2587681 - RNA, 13 nt, Human
cccugcccucauc

SEQ ID NO: 2587682 - RNA, 14 nt, Human
cccugcccuccccu

SEQ ID NO: 2587683 - RNA, 12 nt, Human
cccugagccccu

SEQ ID NO: 2587684 - RNA, 17 nt, Human
cccugagccccuuccuu

SEQ ID NO: 2587685 - RNA, 15 nt, Human
cccugagccccuucc

SEQ ID NO: 2587686 - RNA, 21 nt, Human
cccugagccccuuccuugcuc

SEQ ID NO: 2587687 - RNA, 12 nt, Human
cccugagcucgg

SEQ ID NO: 2587688 - RNA, 14 nt, Human
cccugagcaggauu

SEQ ID NO: 2587689 - RNA, 21 nt, Human
cccugagcaaugucugugcua

SEQ ID NO: 2587690 - RNA, 20 nt, Human
cccugagcaaugucugugcu

SEQ ID NO: 2587691 - RNA, 18 nt, Human
cccugagcaaugucugug

SEQ ID NO: 2587692 - RNA, 16 nt, Human
cccugagcaaugucug

SEQ ID NO: 2587693 - RNA, 20 nt, Human
cccugcccaccuggccucug

SEQ ID NO: 2587694 - RNA, 16 nt, Human
cccugagcuuucugcu

SEQ ID NO: 2587695 - RNA, 16 nt, Human
cccugagcugaggcag

SEQ ID NO: 2587696 - RNA, 17 nt, Human
cccugagcugaggcagc

SEQ ID NO: 2587697 - RNA, 19 nt, Human
cccugagcugaggcagcag

SEQ ID NO: 2587698 - RNA, 21 nt, Human
cccugagcugaggcagcagug

SEQ ID NO: 2587699 - RNA, 13 nt, Human
cccugagcugagg

SEQ ID NO: 2587700 - RNA, 14 nt, Human
cccugagcugaggc

SEQ ID NO: 2587701 - RNA, 22 nt, Human
cccugagcucgguggacccagg

SEQ ID NO: 2587702 - RNA, 14 nt, Human
cccugacuggugcu

SEQ ID NO: 2587703 - RNA, 17 nt, Human
cccugagacaaauggag

SEQ ID NO: 2587704 - RNA, 16 nt, Human
cccugagacaaaugga

SEQ ID NO: 2587705 - RNA, 18 nt, Human
cccugagaucucugcagg

SEQ ID NO: 2587706 - RNA, 23 nt, Human
cccugagacaaauggaggccugu

SEQ ID NO: 2587707 - RNA, 20 nt, Human
cccugagacaaauggaggcc

SEQ ID NO: 2587708 - RNA, 19 nt, Human
cccugacucauucugaagg

SEQ ID NO: 2587709 - RNA, 21 nt, Human
cccugacucauucugaaggag

SEQ ID NO: 2587710 - RNA, 15 nt, Human
cccugacucauucug

SEQ ID NO: 2587711 - RNA, 20 nt, Human
cccugaccugugagcccagc

SEQ ID NO: 2587712 - RNA, 13 nt, Human
cccugacugggag

SEQ ID NO: 2587713 - RNA, 18 nt, Human
cccugacucucugugacc

SEQ ID NO: 2587714 - RNA, 13 nt, Human
cccugacucucug

SEQ ID NO: 2587715 - RNA, 17 nt, Human
cccugacucucugugac

SEQ ID NO: 2587716 - RNA, 20 nt, Human
cccugaccucccagcccuau

SEQ ID NO: 2587717 - RNA, 19 nt, Human
cccugaccucccagcccua

SEQ ID NO: 2587718 - RNA, 18 nt, Human
cccugaccucccagcccu

SEQ ID NO: 2587719 - RNA, 17 nt, Human
cccugaccucccagccc

SEQ ID NO: 2587720 - RNA, 16 nt, Human
cccugaccucccagcc

SEQ ID NO: 2587721 - RNA, 15 nt, Human
cccugaccucccagc

SEQ ID NO: 2587722 - RNA, 14 nt, Human
cccugaccucccag

SEQ ID NO: 2587723 - RNA, 11 nt, Human
cccugaccucc

SEQ ID NO: 2587724 - RNA, 16 nt, Human
cccugaccugugagcc

SEQ ID NO: 2587725 - RNA, 22 nt, Human
cccugaccucccagcccuaugg

SEQ ID NO: 2587726 - RNA, 21 nt, Human
cccugaccucccagcccuaug

SEQ ID NO: 2587727 - RNA, 17 nt, Human
cccugaccucccucuaa

SEQ ID NO: 2587728 - RNA, 12 nt, Human
cccugacccugu

SEQ ID NO: 2587729 - RNA, 19 nt, Human
cccugacccuguggaagca

SEQ ID NO: 2587730 - RNA, 15 nt, Human
cccugacccugugga

SEQ ID NO: 2587731 - RNA, 16 nt, Human
cccugacccuguauau

SEQ ID NO: 2587732 - RNA, 13 nt, Human
ccccggcccuacc

SEQ ID NO: 2587733 - RNA, 18 nt, Human
ccccggccccggccccag

SEQ ID NO: 2587734 - RNA, 13 nt, Human
ccccggcccccug

SEQ ID NO: 2587735 - RNA, 12 nt, Human
ccccggcccccu

SEQ ID NO: 2587736 - RNA, 19 nt, Human
ccccggccccagccagagu

SEQ ID NO: 2587737 - RNA, 18 nt, Human
ccccggccccagccagag

SEQ ID NO: 2587738 - RNA, 17 nt, Human
ccccggccccagccaga

SEQ ID NO: 2587739 - RNA, 16 nt, Human
ccccggccccagccag

SEQ ID NO: 2587740 - RNA, 18 nt, Human
ccccggcccuaccagcgc

SEQ ID NO: 2587741 - RNA, 19 nt, Human
cccuccgcccugccacuca

SEQ ID NO: 2587742 - RNA, 16 nt, Human
cccuccgcccugccac

SEQ ID NO: 2587743 - RNA, 15 nt, Human
cccuccgcccugcca

SEQ ID NO: 2587744 - RNA, 14 nt, Human
cccuccgcccugcc

SEQ ID NO: 2587745 - RNA, 20 nt, Human
cccugacacugcggggcuug

SEQ ID NO: 2587746 - RNA, 20 nt, Human
cccugaaugguuccaugccu

SEQ ID NO: 2587747 - RNA, 23 nt, Human
cccugaaucccccuugccacccc

SEQ ID NO: 2587748 - RNA, 21 nt, Human
cccugaaucccccuugccacc

SEQ ID NO: 2587749 - RNA, 22 nt, Human
cccugacaacacucauugaccu

SEQ ID NO: 2587750 - RNA, 16 nt, Human
cccugacaacacucau

SEQ ID NO: 2587751 - RNA, 22 nt, Human
cccugaaggccccgcccaggcu

SEQ ID NO: 2587752 - RNA, 20 nt, Human
cccugaaggccccgcccagg

SEQ ID NO: 2587753 - RNA, 20 nt, Human
cccugaaucccccuugccac

SEQ ID NO: 2587754 - RNA, 15 nt, Human
cccugaaucccccuu

SEQ ID NO: 2587755 - RNA, 20 nt, Human
cccugaagugagcacagccu

SEQ ID NO: 2587756 - RNA, 23 nt, Human
cccugaaggaacauuccuuaguc

SEQ ID NO: 2587757 - RNA, 17 nt, Human
cccugaaggggccauga

SEQ ID NO: 2587758 - RNA, 14 nt, Human
cccugacaacacuc

SEQ ID NO: 2587759 - RNA, 19 nt, Human
cccugaaggccccgcccag

SEQ ID NO: 2587760 - RNA, 16 nt, Human
cccugaaggccccgcc

SEQ ID NO: 2587761 - RNA, 14 nt, Human
cccugaaggccccg

SEQ ID NO: 2587762 - RNA, 13 nt, Human
cccugaaggcccc

SEQ ID NO: 2587763 - RNA, 12 nt, Human
cccugaaggccc

SEQ ID NO: 2587764 - RNA, 17 nt, Human
cccugaagccagccuuc

SEQ ID NO: 2587765 - RNA, 16 nt, Human
cccugaagccagccuu

SEQ ID NO: 2587766 - RNA, 18 nt, Human
cccugaagccagccuucu

SEQ ID NO: 2587767 - RNA, 14 nt, Human
cccugaaggaacca

SEQ ID NO: 2587768 - RNA, 14 nt, Human
cccugaacaagaau

SEQ ID NO: 2587769 - RNA, 13 nt, Human
cccugaaccaucc

SEQ ID NO: 2587770 - RNA, 15 nt, Human
cccugaagccagccu

SEQ ID NO: 2587771 - RNA, 14 nt, Human
cccugaagccagcc

SEQ ID NO: 2587772 - RNA, 11 nt, Human
cccugaagcca

SEQ ID NO: 2587773 - RNA, 18 nt, Human
cccugaaccaucccugau

SEQ ID NO: 2587774 - RNA, 16 nt, Human
cccuccucucccaucc

SEQ ID NO: 2587775 - RNA, 15 nt, Human
cccuccucucccauc

SEQ ID NO: 2587776 - RNA, 23 nt, Human
cccuccucccuuuuuccuugucc

SEQ ID NO: 2587777 - RNA, 14 nt, Human
cccuccucucccau

SEQ ID NO: 2587778 - RNA, 14 nt, Human
cccuccucucugcc

SEQ ID NO: 2587779 - RNA, 19 nt, Human
cccuccucuagcugugggg

SEQ ID NO: 2587780 - RNA, 13 nt, Human
cccuccucuccca

SEQ ID NO: 2587781 - RNA, 18 nt, Human
cccuccucuagcuguggg

SEQ ID NO: 2587782 - RNA, 20 nt, Human
cccuccuaucaccuccccuc

SEQ ID NO: 2587783 - RNA, 20 nt, Human
cccuccucccuuuuuccuug

SEQ ID NO: 2587784 - RNA, 22 nt, Human
cccucgaggcggaucuuuggac

SEQ ID NO: 2587785 - RNA, 23 nt, Human
cccucgaggcggaucuuuggaca

SEQ ID NO: 2587786 - RNA, 15 nt, Human
cccuccuuuuuaugu

SEQ ID NO: 2587787 - RNA, 15 nt, Human
cccucgaagcgcgcc

SEQ ID NO: 2587788 - RNA, 19 nt, Human
cccucgaagcgcgccacuc

SEQ ID NO: 2587789 - RNA, 21 nt, Human
cccucgaagcgcgccacucgc

SEQ ID NO: 2587790 - RNA, 22 nt, Human
cccuccgccuucacuccggugu

SEQ ID NO: 2587791 - RNA, 13 nt, Human
cccuccgccuuca

SEQ ID NO: 2587792 - RNA, 21 nt, Human
cccuccgccuucacuccggug

SEQ ID NO: 2587793 - RNA, 22 nt, Human
cccuccuaccccucccagcuga

SEQ ID NO: 2587794 - RNA, 21 nt, Human
cccuccuaccccucccagcug

SEQ ID NO: 2587795 - RNA, 20 nt, Human
cccuccuaccccucccagcu

SEQ ID NO: 2587796 - RNA, 18 nt, Human
cccuccuaccccucccag

SEQ ID NO: 2587797 - RNA, 15 nt, Human
cccuccuaccccucc

SEQ ID NO: 2587798 - RNA, 18 nt, Human
cccuccguggcaucaccu

SEQ ID NO: 2587799 - RNA, 23 nt, Human
cccuccguggcaucaccuuaggc

SEQ ID NO: 2587800 - RNA, 16 nt, Human
cccuccuccuggacuc

SEQ ID NO: 2587801 - RNA, 18 nt, Human
cccuccuccuggacuccu

SEQ ID NO: 2587802 - RNA, 11 nt, Human
cccuccuccug

SEQ ID NO: 2587803 - RNA, 18 nt, Human
cccuccuacccugcgccc

SEQ ID NO: 2587804 - RNA, 17 nt, Human
cccuccuacccugcgcc

SEQ ID NO: 2587805 - RNA, 19 nt, Human
cccucgggcccaccuggcc

SEQ ID NO: 2587806 - RNA, 18 nt, Human
cccucgggcccaccuggc

SEQ ID NO: 2587807 - RNA, 16 nt, Human
cccucgggcccaccug

SEQ ID NO: 2587808 - RNA, 15 nt, Human
cccucgggcccaccu

SEQ ID NO: 2587809 - RNA, 17 nt, Human
cccucgcugcuucugug

SEQ ID NO: 2587810 - RNA, 14 nt, Human
cccucgggcccacc

SEQ ID NO: 2587811 - RNA, 14 nt, Human
cccucgggcccagc

SEQ ID NO: 2587812 - RNA, 13 nt, Human
cccucgggcccag

SEQ ID NO: 2587813 - RNA, 21 nt, Human
cccucgggcccaccuggccac

SEQ ID NO: 2587814 - RNA, 20 nt, Human
cccucgggcccaccuggcca

SEQ ID NO: 2587815 - RNA, 19 nt, Human
cccucgggcccagccccca

SEQ ID NO: 2587816 - RNA, 15 nt, Human
cccucgggcccagcc

SEQ ID NO: 2587817 - RNA, 22 nt, Human
cccucgggcccagcccccacag

SEQ ID NO: 2587818 - RNA, 17 nt, Human
cccucgggcgagucacu

SEQ ID NO: 2587819 - RNA, 18 nt, Human
cccucgggucuccucacu

SEQ ID NO: 2587820 - RNA, 21 nt, Human
cccucgggucuccucacuccc

SEQ ID NO: 2587821 - RNA, 19 nt, Human
cccucgggucuccucacuc

SEQ ID NO: 2587822 - RNA, 18 nt, Human
cccugaaagcccugagcu

SEQ ID NO: 2587823 - RNA, 15 nt, Human
cccucgcugcuucug

SEQ ID NO: 2587824 - RNA, 14 nt, Human
cccucgcugcuucu

SEQ ID NO: 2587825 - RNA, 14 nt, Human
cccucgcugccagc

SEQ ID NO: 2587826 - RNA, 13 nt, Human
cccucgcccccgc

SEQ ID NO: 2587827 - RNA, 17 nt, Human
cccuccucucccauccc

SEQ ID NO: 2587828 - RNA, 22 nt, Human
cccucgaagcgcgccacucgcu

SEQ ID NO: 2587829 - RNA, 13 nt, Human
cccucggagaaga

SEQ ID NO: 2587830 - RNA, 23 nt, Human
cccucgcuuggacggcugggcac

SEQ ID NO: 2587831 - RNA, 21 nt, Human
cccucgcuuggacggcugggc

SEQ ID NO: 2587832 - RNA, 11 nt, Human
ccacucugugc

SEQ ID NO: 2587833 - RNA, 22 nt, Human
ccacucugugccugaccuugag

SEQ ID NO: 2587834 - RNA, 14 nt, Human
ccacugaagcuggg

SEQ ID NO: 2587835 - RNA, 15 nt, Human
ccacugaagcuggga

SEQ ID NO: 2587836 - RNA, 16 nt, Human
ccacugaagcugggau

SEQ ID NO: 2587837 - RNA, 21 nt, Human
ccacugaaguagugugcaguu

SEQ ID NO: 2587838 - RNA, 15 nt, Human
ccacugacagccucc

SEQ ID NO: 2587839 - RNA, 16 nt, Human
ccacugacagccuccc

SEQ ID NO: 2587840 - RNA, 17 nt, Human
ccacugacagccuccca

SEQ ID NO: 2587841 - RNA, 19 nt, Human
ccacugacagccucccacc

SEQ ID NO: 2587842 - RNA, 18 nt, Human
ccacugcaccccgucuca

SEQ ID NO: 2587843 - RNA, 23 nt, Human
ccacugcacccccuccugcugca

SEQ ID NO: 2587844 - RNA, 22 nt, Human
ccacugcacccccuccugcugc

SEQ ID NO: 2587845 - RNA, 21 nt, Human
ccacugcacccccuccugcug

SEQ ID NO: 2587846 - RNA, 20 nt, Human
ccacugcacccccuccugcu

SEQ ID NO: 2587847 - RNA, 19 nt, Human
ccacugcacccccuccugc

SEQ ID NO: 2587848 - RNA, 18 nt, Human
ccacugcacccccuccug

SEQ ID NO: 2587849 - RNA, 17 nt, Human
ccacugcacccccuccu

SEQ ID NO: 2587850 - RNA, 14 nt, Human
ccacugcacccccu

SEQ ID NO: 2587851 - RNA, 13 nt, Human
ccacugcaccccc

SEQ ID NO: 2587852 - RNA, 11 nt, Human
ccacugcaccc

SEQ ID NO: 2587853 - RNA, 23 nt, Human
ccacugcacagagcucuccagcu

SEQ ID NO: 2587854 - RNA, 20 nt, Human
ccacugcacagagcucucca

SEQ ID NO: 2587855 - RNA, 16 nt, Human
ccacugcacagagcuc

SEQ ID NO: 2587856 - RNA, 14 nt, Human
ccacugcacagagc

SEQ ID NO: 2587857 - RNA, 18 nt, Human
ccacugcacacaccucag

SEQ ID NO: 2587858 - RNA, 13 nt, Human
ccacugaccagaa

SEQ ID NO: 2587859 - RNA, 11 nt, Human
ccacugagcuc

SEQ ID NO: 2587860 - RNA, 22 nt, Human
ccacugauagaugucuauucuu

SEQ ID NO: 2587861 - RNA, 13 nt, Human
ccacugagggcag

SEQ ID NO: 2587862 - RNA, 13 nt, Human
ccacugcacacac

SEQ ID NO: 2587863 - RNA, 12 nt, Human
ccacugagcucc

SEQ ID NO: 2587864 - RNA, 19 nt, Human
ccacugcaccgggccacag

SEQ ID NO: 2587865 - RNA, 17 nt, Human
ccacugcaccgggccac

SEQ ID NO: 2587866 - RNA, 14 nt, Human
ccacugcaccgggc

SEQ ID NO: 2587867 - RNA, 13 nt, Human
ccacugcaccggg

SEQ ID NO: 2587868 - RNA, 20 nt, Human
ccacugcacuauagccuagg

SEQ ID NO: 2587869 - RNA, 19 nt, Human
ccacugcacuauagccuag

SEQ ID NO: 2587870 - RNA, 14 nt, Human
ccacuucccaggua

SEQ ID NO: 2587871 - RNA, 23 nt, Human
ccacuucauucuugaaagcugug

SEQ ID NO: 2587872 - RNA, 21 nt, Human
ccacuucauucuugaaagcug

SEQ ID NO: 2587873 - RNA, 14 nt, Human
ccacugcacuccag

SEQ ID NO: 2587874 - RNA, 17 nt, Human
ccacugcacuccagccu

SEQ ID NO: 2587875 - RNA, 12 nt, Human
ccacuuggucug

SEQ ID NO: 2587876 - RNA, 17 nt, Human
ccacuuggccaagcagg

SEQ ID NO: 2587877 - RNA, 18 nt, Human
ccacuuggcaucagcugg

SEQ ID NO: 2587878 - RNA, 21 nt, Human
ccacuuggcuacacagggaug

SEQ ID NO: 2587879 - RNA, 16 nt, Human
ccacuugggucuuccc

SEQ ID NO: 2587880 - RNA, 12 nt, Human
ccacuuggccaa

SEQ ID NO: 2587881 - RNA, 21 nt, Human
ccacuuggaggccuuucaucc

SEQ ID NO: 2587882 - RNA, 22 nt, Human
ccacuugccucuuccuugaaga

SEQ ID NO: 2587883 - RNA, 19 nt, Human
ccacuugccucuuccuuga

SEQ ID NO: 2587884 - RNA, 17 nt, Human
ccacuugccucuuccuu

SEQ ID NO: 2587885 - RNA, 16 nt, Human
ccacuugccucuuccu

SEQ ID NO: 2587886 - RNA, 13 nt, Human
ccacuugccucuu

SEQ ID NO: 2587887 - RNA, 12 nt, Human
ccacuugccucu

SEQ ID NO: 2587888 - RNA, 14 nt, Human
ccacuucccugggc

SEQ ID NO: 2587889 - RNA, 19 nt, Human
ccacuuccccuccuacccc

SEQ ID NO: 2587890 - RNA, 14 nt, Human
ccacuuccccuccu

SEQ ID NO: 2587891 - RNA, 13 nt, Human
ccacuuccccucc

SEQ ID NO: 2587892 - RNA, 23 nt, Human
ccacuucccagguaagcaggagg

SEQ ID NO: 2587893 - RNA, 15 nt, Human
ccacuucccugacac

SEQ ID NO: 2587894 - RNA, 12 nt, Human
ccacuucccuca

SEQ ID NO: 2587895 - RNA, 17 nt, Human
ccacuucccugacacug

SEQ ID NO: 2587896 - RNA, 15 nt, Human
ccacuucuggguggg

SEQ ID NO: 2587897 - RNA, 19 nt, Human
ccacuucuuguuccccacu

SEQ ID NO: 2587898 - RNA, 20 nt, Human
ccacuucuuguuccccacug

SEQ ID NO: 2587899 - RNA, 16 nt, Human
ccacuucuuuuauaac

SEQ ID NO: 2587900 - RNA, 20 nt, Human
ccacuuggucugugagaugc

SEQ ID NO: 2587901 - RNA, 22 nt, Human
ccacuuggucugugagaugcua

SEQ ID NO: 2587902 - RNA, 20 nt, Human
ccacuugucccacuaucugg

SEQ ID NO: 2587903 - RNA, 21 nt, Human
ccacuuguccgcuggguggua

SEQ ID NO: 2587904 - RNA, 15 nt, Human
ccacuuguccgcugg

SEQ ID NO: 2587905 - RNA, 17 nt, Human
ccacuugggucuucccu

SEQ ID NO: 2587906 - RNA, 19 nt, Human
ccacuugucccacuaucug

SEQ ID NO: 2587907 - RNA, 15 nt, Human
ccacuuggucuguga

SEQ ID NO: 2587908 - RNA, 16 nt, Human
ccacuuggucugugag

SEQ ID NO: 2587909 - RNA, 17 nt, Human
ccacuuggucugugaga

SEQ ID NO: 2587910 - RNA, 19 nt, Human
ccacuuggucugugagaug

SEQ ID NO: 2587911 - RNA, 13 nt, Human
ccacuuucuagcc

SEQ ID NO: 2587912 - RNA, 19 nt, Human
ccacuuucuagccagagga

SEQ ID NO: 2587913 - RNA, 18 nt, Human
ccacuuucuagccagagg

SEQ ID NO: 2587914 - RNA, 20 nt, Human
ccacuuucuagccagaggag

SEQ ID NO: 2587915 - RNA, 20 nt, Human
ccacuuugcacagcucuccg

SEQ ID NO: 2587916 - RNA, 22 nt, Human
ccacuuuguuucguggggaggu

SEQ ID NO: 2587917 - RNA, 16 nt, Human
ccacuuuuauucauuu

SEQ ID NO: 2587918 - RNA, 14 nt, Human
ccacuuuguuggaa

SEQ ID NO: 2587919 - RNA, 20 nt, Human
ccacuuuguucuuuaggaga

SEQ ID NO: 2587920 - RNA, 15 nt, Human
ccacuuuguucuuua

SEQ ID NO: 2587921 - RNA, 17 nt, Human
ccacuuuggccuccguu

SEQ ID NO: 2587922 - RNA, 21 nt, Human
ccacuuuggucccgugcagcu

SEQ ID NO: 2587923 - RNA, 18 nt, Human
ccacuuuggucccgugca

SEQ ID NO: 2587924 - RNA, 21 nt, Human
ccacuuugguacauggccagu

SEQ ID NO: 2587925 - RNA, 14 nt, Human
ccacuuuuguucuu

SEQ ID NO: 2587926 - RNA, 15 nt, Human
ccacuuuuguucuug

SEQ ID NO: 2587927 - RNA, 21 nt, Human
ccacuuuuguucuugguuugu

SEQ ID NO: 2587928 - RNA, 22 nt, Human
ccacuuuuguucuugguuugua

SEQ ID NO: 2587929 - RNA, 15 nt, Human
ccagaccugauccug

SEQ ID NO: 2587930 - RNA, 16 nt, Human
ccagaccugauccugg

SEQ ID NO: 2587931 - RNA, 17 nt, Human
ccagaccugauccugga

SEQ ID NO: 2587932 - RNA, 18 nt, Human
ccagaccugauccuggag

SEQ ID NO: 2587933 - RNA, 19 nt, Human
ccagaccugauccuggagg

SEQ ID NO: 2587934 - RNA, 20 nt, Human
ccagaccugauccuggaggc

SEQ ID NO: 2587935 - RNA, 21 nt, Human
ccagaccugauccuggaggcc

SEQ ID NO: 2587936 - RNA, 23 nt, Human
ccagaccugauccuggaggccca

SEQ ID NO: 2587937 - RNA, 13 nt, Human
ccagaccugagcu

SEQ ID NO: 2587938 - RNA, 15 nt, Human
ccagaccugagcucc

SEQ ID NO: 2587939 - RNA, 16 nt, Human
ccagacccggcugcgu

SEQ ID NO: 2587940 - RNA, 17 nt, Human
ccagacccggcugcgug

SEQ ID NO: 2587941 - RNA, 13 nt, Human
ccagacgaugucu

SEQ ID NO: 2587942 - RNA, 20 nt, Human
ccagacgaugucuucauacc

SEQ ID NO: 2587943 - RNA, 19 nt, Human
ccagaccuuguucacacuc

SEQ ID NO: 2587944 - RNA, 15 nt, Human
ccagaccuucuagga

SEQ ID NO: 2587945 - RNA, 14 nt, Human
ccagaccuuuuauc

SEQ ID NO: 2587946 - RNA, 18 nt, Human
ccagaccuuugaggauau

SEQ ID NO: 2587947 - RNA, 23 nt, Human
ccagacgcacgugggucuucagg

SEQ ID NO: 2587948 - RNA, 18 nt, Human
ccagacgcacgugggucu

SEQ ID NO: 2587949 - RNA, 21 nt, Human
ccagaccugccucuucccccu

SEQ ID NO: 2587950 - RNA, 20 nt, Human
ccagaccuguuagcagacag

SEQ ID NO: 2587951 - RNA, 21 nt, Human
ccagaccuguuagcagacagg

SEQ ID NO: 2587952 - RNA, 23 nt, Human
ccagaccuguuagcagacaggcc

SEQ ID NO: 2587953 - RNA, 14 nt, Human
ccagaccugccucu

SEQ ID NO: 2587954 - RNA, 24 nt, Human
ccagaccugauccuggaggcccag

SEQ ID NO: 2587955 - RNA, 14 nt, Human
ccagacuccaccaa

SEQ ID NO: 2587956 - RNA, 18 nt, Human
ccagacuccaccaagccu

SEQ ID NO: 2587957 - RNA, 17 nt, Human
ccagacguaggggaggg

SEQ ID NO: 2587958 - RNA, 20 nt, Human
ccagacgguucaccagccuc

SEQ ID NO: 2587959 - RNA, 16 nt, Human
ccagacgguucaccag

SEQ ID NO: 2587960 - RNA, 16 nt, Human
ccagacggcacccacc

SEQ ID NO: 2587961 - RNA, 17 nt, Human
ccagacgguucaccagc

SEQ ID NO: 2587962 - RNA, 18 nt, Human
ccagacgguucaccagcc

SEQ ID NO: 2587963 - RNA, 19 nt, Human
ccagacgguucaccagccu

SEQ ID NO: 2587964 - RNA, 15 nt, Human
ccagacggcacccac

SEQ ID NO: 2587965 - RNA, 18 nt, Human
ccagagacacaagccuuc

SEQ ID NO: 2587966 - RNA, 16 nt, Human
ccagagacacaagccu

SEQ ID NO: 2587967 - RNA, 17 nt, Human
ccagagacauacuugaa

SEQ ID NO: 2587968 - RNA, 18 nt, Human
ccagagacauacuugaag

SEQ ID NO: 2587969 - RNA, 13 nt, Human
ccagagacaggaa

SEQ ID NO: 2587970 - RNA, 14 nt, Human
ccagagacaggaaa

SEQ ID NO: 2587971 - RNA, 15 nt, Human
ccagagacaggaaaa

SEQ ID NO: 2587972 - RNA, 20 nt, Human
ccagagaagugacagggaag

SEQ ID NO: 2587973 - RNA, 19 nt, Human
ccagagaagugacagggaa

SEQ ID NO: 2587974 - RNA, 18 nt, Human
ccagagaagugacaggga

SEQ ID NO: 2587975 - RNA, 17 nt, Human
ccagagaagugacaggg

SEQ ID NO: 2587976 - RNA, 16 nt, Human
ccagagaauucuuaga

SEQ ID NO: 2587977 - RNA, 22 nt, Human
ccagagaagugacagggaagcu

SEQ ID NO: 2587978 - RNA, 12 nt, Human
ccagagacagga

SEQ ID NO: 2587979 - RNA, 14 nt, Human
ccagagagagaagu

SEQ ID NO: 2587980 - RNA, 18 nt, Human
ccagagagagaagugccc

SEQ ID NO: 2587981 - RNA, 19 nt, Human
ccagagagagaagugcccc

SEQ ID NO: 2587982 - RNA, 20 nt, Human
ccagagagagaagugccccu

SEQ ID NO: 2587983 - RNA, 15 nt, Human
ccagagacucagagg

SEQ ID NO: 2587984 - RNA, 19 nt, Human
ccagagacggaagccuuuu

SEQ ID NO: 2587985 - RNA, 21 nt, Human
ccagagaccguccucaccccu

SEQ ID NO: 2587986 - RNA, 19 nt, Human
ccagagaccguccucaccc

SEQ ID NO: 2587987 - RNA, 18 nt, Human
ccagagaccguccucacc

SEQ ID NO: 2587988 - RNA, 20 nt, Human
ccagagacauacuugaaggg

SEQ ID NO: 2587989 - RNA, 22 nt, Human
ccagagacauacuugaagggcc

SEQ ID NO: 2587990 - RNA, 23 nt, Human
ccagagacauacuugaagggcca

SEQ ID NO: 2587991 - RNA, 23 nt, Human
ccagagacaggaaaauccucugg

SEQ ID NO: 2587992 - RNA, 16 nt, Human
ccagagaagugacagg

SEQ ID NO: 2587993 - RNA, 15 nt, Human
ccagagaagugacag

SEQ ID NO: 2587994 - RNA, 14 nt, Human
ccagagaagugaca

SEQ ID NO: 2587995 - RNA, 20 nt, Human
ccagagaagccccuucccca

SEQ ID NO: 2587996 - RNA, 18 nt, Human
ccagagaagccccuuccc

SEQ ID NO: 2587997 - RNA, 14 nt, Human
ccagagaagccccu

SEQ ID NO: 2587998 - RNA, 12 nt, Human
ccagagaagcua

SEQ ID NO: 2587999 - RNA, 23 nt, Human
ccagagaaaggggagcccacugu

SEQ ID NO: 2588000 - RNA, 23 nt, Human
ccagagaagcaucggagggaauu

SEQ ID NO: 2588001 - RNA, 20 nt, Human
ccagacuuuacaugacacag

SEQ ID NO: 2588002 - RNA, 21 nt, Human
ccagacuuuacaugacacagc

SEQ ID NO: 2588003 - RNA, 19 nt, Human
ccagagaaaggggagccca

SEQ ID NO: 2588004 - RNA, 20 nt, Human
ccagagaaaggggagcccac

SEQ ID NO: 2588005 - RNA, 16 nt, Human
ccagagaaaggggagc

SEQ ID NO: 2588006 - RNA, 22 nt, Human
ccagacuuuacaugacacagcu

SEQ ID NO: 2588007 - RNA, 15 nt, Human
ccagacuguuagaaa

SEQ ID NO: 2588008 - RNA, 17 nt, Human
ccagacuguguauucau

SEQ ID NO: 2588009 - RNA, 13 nt, Human
ccagacuguguau

SEQ ID NO: 2588010 - RNA, 18 nt, Human
ccagacuguggagaaaua

SEQ ID NO: 2588011 - RNA, 15 nt, Human
ccagacuuccuugag

SEQ ID NO: 2588012 - RNA, 13 nt, Human
ccagacuuccuug

SEQ ID NO: 2588013 - RNA, 14 nt, Human
ccagacuuccuuga

SEQ ID NO: 2588014 - RNA, 16 nt, Human
ccagacuguggagaaa

SEQ ID NO: 2588015 - RNA, 13 nt, Human
ccagacuguggag

SEQ ID NO: 2588016 - RNA, 12 nt, Human
ccagacugugga

SEQ ID NO: 2588017 - RNA, 22 nt, Human
ccagacugcuuccaauuuucug

SEQ ID NO: 2588018 - RNA, 14 nt, Human
ccagacucucugug

SEQ ID NO: 2588019 - RNA, 22 nt, Human
ccagaggugggcaggugguggc

SEQ ID NO: 2588020 - RNA, 18 nt, Human
ccagaggugggcaggugg

SEQ ID NO: 2588021 - RNA, 17 nt, Human
ccagaggugggcaggug

SEQ ID NO: 2588022 - RNA, 16 nt, Human
ccagaggugggcaggu

SEQ ID NO: 2588023 - RNA, 15 nt, Human
ccagaggugggcagg

SEQ ID NO: 2588024 - RNA, 14 nt, Human
ccagaggugggcag

SEQ ID NO: 2588025 - RNA, 22 nt, Human
ccagagguaacagaacagcuuc

SEQ ID NO: 2588026 - RNA, 21 nt, Human
ccagaguugcugggagcugaa

SEQ ID NO: 2588027 - RNA, 15 nt, Human
ccagaguugcuggga

SEQ ID NO: 2588028 - RNA, 12 nt, Human
ccagaguugcug

SEQ ID NO: 2588029 - RNA, 11 nt, Human
ccagaguugcu

SEQ ID NO: 2588030 - RNA, 17 nt, Human
ccagaguuccugcggag

SEQ ID NO: 2588031 - RNA, 13 nt, Human
ccagaguuccugc

SEQ ID NO: 2588032 - RNA, 19 nt, Human
ccagaggugggcagguggu

SEQ ID NO: 2588033 - RNA, 23 nt, Human
ccagagguaacagaacagcuuca

SEQ ID NO: 2588034 - RNA, 21 nt, Human
ccagagguaacagaacagcuu

SEQ ID NO: 2588035 - RNA, 19 nt, Human
ccagagguaacagaacagc

SEQ ID NO: 2588036 - RNA, 18 nt, Human
ccagagguaacagaacag

SEQ ID NO: 2588037 - RNA, 17 nt, Human
ccagagguaacagaaca

SEQ ID NO: 2588038 - RNA, 16 nt, Human
ccagagggugggcuuc

SEQ ID NO: 2588039 - RNA, 23 nt, Human
ccagagggguggguuccucuucc

SEQ ID NO: 2588040 - RNA, 13 nt, Human
ccagagagggugg

SEQ ID NO: 2588041 - RNA, 23 nt, Human
ccagagagggacugacacccaug

SEQ ID NO: 2588042 - RNA, 19 nt, Human
ccagagagggacugacacc

SEQ ID NO: 2588043 - RNA, 16 nt, Human
ccagagaggaaucaga

SEQ ID NO: 2588044 - RNA, 21 nt, Human
ccagagagccuggugcugcug

SEQ ID NO: 2588045 - RNA, 22 nt, Human
ccagagagccuggugcugcugc

SEQ ID NO: 2588046 - RNA, 21 nt, Human
ccagagagcaacucugagauc

SEQ ID NO: 2588047 - RNA, 20 nt, Human
ccagagagcaacucugagau

SEQ ID NO: 2588048 - RNA, 21 nt, Human
ccagagagagaagugccccug

SEQ ID NO: 2588049 - RNA, 22 nt, Human
ccagagagagaagugccccugc

SEQ ID NO: 2588050 - RNA, 18 nt, Human
ccagagagcaacucugag

SEQ ID NO: 2588051 - RNA, 23 nt, Human
ccagagagagaagugccccugcu

SEQ ID NO: 2588052 - RNA, 21 nt, Human
ccagaucaccagcccggccug

SEQ ID NO: 2588053 - RNA, 18 nt, Human
ccagaucaccagcccggc

SEQ ID NO: 2588054 - RNA, 22 nt, Human
ccagaucggaucuguugcaaac

SEQ ID NO: 2588055 - RNA, 19 nt, Human
ccagaucggaucuguugca

SEQ ID NO: 2588056 - RNA, 13 nt, Human
ccagaucuggucc

SEQ ID NO: 2588057 - RNA, 19 nt, Human
ccagauaaaauuauagaug

SEQ ID NO: 2588058 - RNA, 20 nt, Human
ccagaguuuuuauguagcag

SEQ ID NO: 2588059 - RNA, 22 nt, Human
ccagauaaaauuauagauggga

SEQ ID NO: 2588060 - RNA, 14 nt, Human
ccagauaagaaugc

SEQ ID NO: 2588061 - RNA, 21 nt, Human
ccagauacacccaaaguauca

SEQ ID NO: 2588062 - RNA, 16 nt, Human
ccagauaccagccccu

SEQ ID NO: 2588063 - RNA, 13 nt, Human
ccagauaccagcc

SEQ ID NO: 2588064 - RNA, 21 nt, Human
ccagauacuucccauuuugga

SEQ ID NO: 2588065 - RNA, 20 nt, Human
ccagauaccagccccuguau

SEQ ID NO: 2588066 - RNA, 19 nt, Human
ccagauauucaagucaccu

SEQ ID NO: 2588067 - RNA, 19 nt, Human
ccagaugaugggggagggg

SEQ ID NO: 2588068 - RNA, 14 nt, Human
ccagaugcaccagc

SEQ ID NO: 2588069 - RNA, 13 nt, Human
ccagaugcaccag

SEQ ID NO: 2588070 - RNA, 19 nt, Human
ccagaugaggcuggccaag

SEQ ID NO: 2588071 - RNA, 19 nt, Human
ccagaucuggucccuugca

SEQ ID NO: 2588072 - RNA, 17 nt, Human
ccagccccuucugaccc

SEQ ID NO: 2588073 - RNA, 16 nt, Human
ccagccccuucugacc

SEQ ID NO: 2588074 - RNA, 15 nt, Human
ccagccccuucugac

SEQ ID NO: 2588075 - RNA, 18 nt, Human
ccagccccuggaugcagc

SEQ ID NO: 2588076 - RNA, 14 nt, Human
ccagcgcccgcugg

SEQ ID NO: 2588077 - RNA, 17 nt, Human
ccagccccggcccuggg

SEQ ID NO: 2588078 - RNA, 16 nt, Human
ccagcgaggaggcucc

SEQ ID NO: 2588079 - RNA, 18 nt, Human
ccagccccuucugaccca

SEQ ID NO: 2588080 - RNA, 21 nt, Human
ccagcgagcccugguggcagu

SEQ ID NO: 2588081 - RNA, 15 nt, Human
ccagccccuggaugc

SEQ ID NO: 2588082 - RNA, 14 nt, Human
ccagccccuggaug

SEQ ID NO: 2588083 - RNA, 23 nt, Human
ccagcccccuuugggcccaggga

SEQ ID NO: 2588084 - RNA, 22 nt, Human
ccagcccccuuugggcccaggg

SEQ ID NO: 2588085 - RNA, 21 nt, Human
ccagcccccuuugggcccagg

SEQ ID NO: 2588086 - RNA, 20 nt, Human
ccagcccccuuugggcccag

SEQ ID NO: 2588087 - RNA, 13 nt, Human
ccagccccuggau

SEQ ID NO: 2588088 - RNA, 15 nt, Human
ccagcccccuuuggg

SEQ ID NO: 2588089 - RNA, 21 nt, Human
ccagcccccacagugcugucu

SEQ ID NO: 2588090 - RNA, 18 nt, Human
ccagcccccacagugcug

SEQ ID NO: 2588091 - RNA, 16 nt, Human
ccagcccccacagugc

SEQ ID NO: 2588092 - RNA, 13 nt, Human
ccagcccccacag

SEQ ID NO: 2588093 - RNA, 23 nt, Human
ccagccccauccucuguacagag

SEQ ID NO: 2588094 - RNA, 13 nt, Human
ccagcagccugga

SEQ ID NO: 2588095 - RNA, 16 nt, Human
ccagcagaaaugccuu

SEQ ID NO: 2588096 - RNA, 17 nt, Human
ccagcagaaaugccuua

SEQ ID NO: 2588097 - RNA, 22 nt, Human
ccagcagaaaugccuuacccuc

SEQ ID NO: 2588098 - RNA, 21 nt, Human
ccagcagcccuaaggaucucu

SEQ ID NO: 2588099 - RNA, 12 nt, Human
ccagcagcccua

SEQ ID NO: 2588100 - RNA, 21 nt, Human
ccagcagccagcucucagcca

SEQ ID NO: 2588101 - RNA, 12 nt, Human
ccagcagaaaug

SEQ ID NO: 2588102 - RNA, 11 nt, Human
ccagcagccug

SEQ ID NO: 2588103 - RNA, 12 nt, Human
ccagcagccugg

SEQ ID NO: 2588104 - RNA, 19 nt, Human
ccaggaaaggcuccaggag

SEQ ID NO: 2588105 - RNA, 18 nt, Human
ccaggaaaggcuccagga

SEQ ID NO: 2588106 - RNA, 23 nt, Human
ccagcuuguggagccccacacug

SEQ ID NO: 2588107 - RNA, 22 nt, Human
ccagcuuguggagccccacacu

SEQ ID NO: 2588108 - RNA, 19 nt, Human
ccagcuuguggagccccac

SEQ ID NO: 2588109 - RNA, 18 nt, Human
ccagcuuguggagcccca

SEQ ID NO: 2588110 - RNA, 17 nt, Human
ccagcuuguggagcccc

SEQ ID NO: 2588111 - RNA, 17 nt, Human
ccaggaaaggcuccagg

SEQ ID NO: 2588112 - RNA, 20 nt, Human
ccaggaaaggcuccaggagc

SEQ ID NO: 2588113 - RNA, 16 nt, Human
ccagcuuguuauuuau

SEQ ID NO: 2588114 - RNA, 15 nt, Human
ccagcuuguuauuua

SEQ ID NO: 2588115 - RNA, 17 nt, Human
ccagcuuguuauuuaua

SEQ ID NO: 2588116 - RNA, 23 nt, Human
ccagcuugggcccagcugggcuc

SEQ ID NO: 2588117 - RNA, 24 nt, Human
ccagcuugggcccagcugggcucu

SEQ ID NO: 2588118 - RNA, 22 nt, Human
ccagcuugggcccagcugggcu

SEQ ID NO: 2588119 - RNA, 21 nt, Human
ccagcuugggcccagcugggc

SEQ ID NO: 2588120 - RNA, 19 nt, Human
ccagcuugggcccagcugg

SEQ ID NO: 2588121 - RNA, 18 nt, Human
ccagcuugggcccagcug

SEQ ID NO: 2588122 - RNA, 22 nt, Human
ccagcgucccagucucuggcag

SEQ ID NO: 2588123 - RNA, 14 nt, Human
ccagcuugcucuuc

SEQ ID NO: 2588124 - RNA, 16 nt, Human
ccagcuugcucuucag

SEQ ID NO: 2588125 - RNA, 23 nt, Human
ccagcuugcucuucagugggaga

SEQ ID NO: 2588126 - RNA, 17 nt, Human
ccagcguccuccucugu

SEQ ID NO: 2588127 - RNA, 20 nt, Human
ccagcuugaaaccuucacuu

SEQ ID NO: 2588128 - RNA, 21 nt, Human
ccagcgucccagucucuggca

SEQ ID NO: 2588129 - RNA, 15 nt, Human
ccagcgucccagucu

SEQ ID NO: 2588130 - RNA, 13 nt, Human
ccagcguccuccu

SEQ ID NO: 2588131 - RNA, 22 nt, Human
ccagcgcccgcugggcugagcc

SEQ ID NO: 2588132 - RNA, 19 nt, Human
ccagcgcccgcugggcuga

SEQ ID NO: 2588133 - RNA, 18 nt, Human
ccagcgcccgcugggcug

SEQ ID NO: 2588134 - RNA, 17 nt, Human
ccagcgcccgcugggcu

SEQ ID NO: 2588135 - RNA, 16 nt, Human
ccagcgcccgcugggc

SEQ ID NO: 2588136 - RNA, 22 nt, Human
ccagcgccuaguggggucuccc

SEQ ID NO: 2588137 - RNA, 15 nt, Human
ccagcggccccuccc

SEQ ID NO: 2588138 - RNA, 14 nt, Human
ccagcggccccucc

SEQ ID NO: 2588139 - RNA, 13 nt, Human
ccagcggcugagu

SEQ ID NO: 2588140 - RNA, 17 nt, Human
ccagcgggaauggcagc

SEQ ID NO: 2588141 - RNA, 23 nt, Human
ccagcgggaauggcagcugccac

SEQ ID NO: 2588142 - RNA, 13 nt, Human
ccagcggccccuc

SEQ ID NO: 2588143 - RNA, 17 nt, Human
ccaggaguuugaggcug

SEQ ID NO: 2588144 - RNA, 20 nt, Human
ccaggaguuugaggcugcag

SEQ ID NO: 2588145 - RNA, 21 nt, Human
ccaggaguuugaggcugcagc

SEQ ID NO: 2588146 - RNA, 22 nt, Human
ccaggaguuugaggcugcagcg

SEQ ID NO: 2588147 - RNA, 17 nt, Human
ccaggaguuugagacca

SEQ ID NO: 2588148 - RNA, 18 nt, Human
ccaggaguuugagaccag

SEQ ID NO: 2588149 - RNA, 22 nt, Human
ccaggcagggguggggguggag

SEQ ID NO: 2588150 - RNA, 21 nt, Human
ccaggcaggggugggggugga

SEQ ID NO: 2588151 - RNA, 15 nt, Human
ccaggcagggguggg

SEQ ID NO: 2588152 - RNA, 21 nt, Human
ccaggcaggcuaaggcgugga

SEQ ID NO: 2588153 - RNA, 18 nt, Human
ccaggcagguagccaggg

SEQ ID NO: 2588154 - RNA, 14 nt, Human
ccaggcagguagcc

SEQ ID NO: 2588155 - RNA, 13 nt, Human
ccaggcucugugc

SEQ ID NO: 2588156 - RNA, 22 nt, Human
ccaggcucuuuggggucagcca

SEQ ID NO: 2588157 - RNA, 23 nt, Human
ccaggcucugugcugacccuccu

SEQ ID NO: 2588158 - RNA, 22 nt, Human
ccaggcucugugcugacccucc

SEQ ID NO: 2588159 - RNA, 20 nt, Human
ccaggcucugugcugacccu

SEQ ID NO: 2588160 - RNA, 19 nt, Human
ccaggcucugugcugaccc

SEQ ID NO: 2588161 - RNA, 15 nt, Human
ccaggcucugugcug

SEQ ID NO: 2588162 - RNA, 14 nt, Human
ccaggcucugugcu

SEQ ID NO: 2588163 - RNA, 13 nt, Human
ccaggcugaagca

SEQ ID NO: 2588164 - RNA, 20 nt, Human
ccaggcugaagcagguuccc

SEQ ID NO: 2588165 - RNA, 15 nt, Human
ccaggcugaccacag

SEQ ID NO: 2588166 - RNA, 16 nt, Human
ccaggcugaccacagc

SEQ ID NO: 2588167 - RNA, 17 nt, Human
ccaggcugaccacagca

SEQ ID NO: 2588168 - RNA, 18 nt, Human
ccaggcugaccacagcac

SEQ ID NO: 2588169 - RNA, 19 nt, Human
ccaggcugaccacagcaca

SEQ ID NO: 2588170 - RNA, 20 nt, Human
ccaggcugaccacagcacag

SEQ ID NO: 2588171 - RNA, 23 nt, Human
ccaggcagaucugugccccaugc

SEQ ID NO: 2588172 - RNA, 20 nt, Human
ccaggcagaucugugcccca

SEQ ID NO: 2588173 - RNA, 21 nt, Human
ccaggcagaucugugccccau

SEQ ID NO: 2588174 - RNA, 18 nt, Human
ccaggcaggcuaaggcgu

SEQ ID NO: 2588175 - RNA, 20 nt, Human
ccaggcaggcuaaggcgugg

SEQ ID NO: 2588176 - RNA, 14 nt, Human
ccaggcaggcugug

SEQ ID NO: 2588177 - RNA, 23 nt, Human
ccaggcagggccaacccuucucc

SEQ ID NO: 2588178 - RNA, 19 nt, Human
ccaggcagggccaacccuu

SEQ ID NO: 2588179 - RNA, 15 nt, Human
ccaguaugagcccua

SEQ ID NO: 2588180 - RNA, 20 nt, Human
ccaggggccccuccagcuug

SEQ ID NO: 2588181 - RNA, 19 nt, Human
ccaggggccccuccagcuu

SEQ ID NO: 2588182 - RNA, 18 nt, Human
ccaggggccccuccagcu

SEQ ID NO: 2588183 - RNA, 16 nt, Human
ccagucaccccggcca

SEQ ID NO: 2588184 - RNA, 22 nt, Human
ccaguaucuugaagacuuuucu

SEQ ID NO: 2588185 - RNA, 19 nt, Human
ccaguaucuugaagacuuu

SEQ ID NO: 2588186 - RNA, 13 nt, Human
ccaguaucuugaa

SEQ ID NO: 2588187 - RNA, 22 nt, Human
ccaggggugggacacccuguga

SEQ ID NO: 2588188 - RNA, 21 nt, Human
ccaggggugggacacccugug

SEQ ID NO: 2588189 - RNA, 20 nt, Human
ccaggggugggacacccugu

SEQ ID NO: 2588190 - RNA, 21 nt, Human
ccaggcugaccacagcacagc

SEQ ID NO: 2588191 - RNA, 23 nt, Human
ccaggcugaccacagcacagcca

SEQ ID NO: 2588192 - RNA, 13 nt, Human
ccaggcugagccu

SEQ ID NO: 2588193 - RNA, 14 nt, Human
ccaggcugagccuc

SEQ ID NO: 2588194 - RNA, 16 nt, Human
ccaggcugagccucag

SEQ ID NO: 2588195 - RNA, 17 nt, Human
ccaggcugagccucagu

SEQ ID NO: 2588196 - RNA, 19 nt, Human
ccaggcugagccucagucu

SEQ ID NO: 2588197 - RNA, 22 nt, Human
ccaggcugagccucagucuccc

SEQ ID NO: 2588198 - RNA, 13 nt, Human
ccaggcugccaag

SEQ ID NO: 2588199 - RNA, 18 nt, Human
ccaggggaugaguggagg

SEQ ID NO: 2588200 - RNA, 17 nt, Human
ccaggggccccuccagc

SEQ ID NO: 2588201 - RNA, 14 nt, Human
ccaggggccccucc

SEQ ID NO: 2588202 - RNA, 12 nt, Human
ccaggggccccu

SEQ ID NO: 2588203 - RNA, 19 nt, Human
ccaggggcccacagggaac

SEQ ID NO: 2588204 - RNA, 18 nt, Human
ccaggggcccacagggaa

SEQ ID NO: 2588205 - RNA, 22 nt, Human
ccaggggcccaaggcggccccu

SEQ ID NO: 2588206 - RNA, 19 nt, Human
ccaggggcccaaggcggcc

SEQ ID NO: 2588207 - RNA, 23 nt, Human
ccaggggcauguauuggccugga

SEQ ID NO: 2588208 - RNA, 22 nt, Human
ccaggggcauguauuggccugg

SEQ ID NO: 2588209 - RNA, 21 nt, Human
ccaggggcauguauuggccug

SEQ ID NO: 2588210 - RNA, 19 nt, Human
ccaggggcaggcacagcac

SEQ ID NO: 2588211 - RNA, 18 nt, Human
ccaggggcaggcacagca

SEQ ID NO: 2588212 - RNA, 15 nt, Human
ccaggggccaugaau

SEQ ID NO: 2588213 - RNA, 17 nt, Human
ccaggggcaggcacagc

SEQ ID NO: 2588214 - RNA, 16 nt, Human
ccaggggcaggcacag

SEQ ID NO: 2588215 - RNA, 15 nt, Human
ccaggggcaggcaca

SEQ ID NO: 2588216 - RNA, 23 nt, Human
ccaggcucuuuggggucagccag

SEQ ID NO: 2588217 - RNA, 16 nt, Human
ccaggggaugggaggu

SEQ ID NO: 2588218 - RNA, 18 nt, Human
ccagucaccccggccacc

SEQ ID NO: 2588219 - RNA, 17 nt, Human
ccagucaccccggccac

SEQ ID NO: 2588220 - RNA, 19 nt, Human
ccagucaccccggccaccu

SEQ ID NO: 2588221 - RNA, 12 nt, Human
ccaguauucuug

SEQ ID NO: 2588222 - RNA, 22 nt, Human
ccaguauucuagguagugcccu

SEQ ID NO: 2588223 - RNA, 14 nt, Human
ccaguccugccugg

SEQ ID NO: 2588224 - RNA, 15 nt, Human
ccaguccugccuggc

SEQ ID NO: 2588225 - RNA, 16 nt, Human
ccaguccugccuggcc

SEQ ID NO: 2588226 - RNA, 17 nt, Human
ccaguccugccuggcca

SEQ ID NO: 2588227 - RNA, 20 nt, Human
ccaguccuggccuggcuucu

SEQ ID NO: 2588228 - RNA, 15 nt, Human
ccaguccuggccugg

SEQ ID NO: 2588229 - RNA, 13 nt, Human
ccaguccuggccu

SEQ ID NO: 2588230 - RNA, 14 nt, Human
ccaguauucuuguc

SEQ ID NO: 2588231 - RNA, 12 nt, Human
ccaguccuggcc

SEQ ID NO: 2588232 - RNA, 18 nt, Human
ccaguccugccuggccag

SEQ ID NO: 2588233 - RNA, 19 nt, Human
ccaguccugccuggccagg

SEQ ID NO: 2588234 - RNA, 21 nt, Human
ccaguccugccuggccaggca

SEQ ID NO: 2588235 - RNA, 22 nt, Human
ccaguccugccuggccaggcag

SEQ ID NO: 2588236 - RNA, 18 nt, Human
ccagucgcgcugccugug

SEQ ID NO: 2588237 - RNA, 17 nt, Human
ccagucgcgcugccugu

SEQ ID NO: 2588238 - RNA, 16 nt, Human
ccagucgcgcugccug

SEQ ID NO: 2588239 - RNA, 15 nt, Human
ccagucgcgcugccu

SEQ ID NO: 2588240 - RNA, 14 nt, Human
ccagucgcgcugcc

SEQ ID NO: 2588241 - RNA, 18 nt, Human
ccagucgauaucucacuu

SEQ ID NO: 2588242 - RNA, 17 nt, Human
ccaguccuuccaccucg

SEQ ID NO: 2588243 - RNA, 13 nt, Human
ccaguccuuccac

SEQ ID NO: 2588244 - RNA, 14 nt, Human
ccaugguacccccu

SEQ ID NO: 2588245 - RNA, 23 nt, Human
ccaugggguaggaggaugggcuc

SEQ ID NO: 2588246 - RNA, 18 nt, Human
ccaugguacccccuucug

SEQ ID NO: 2588247 - RNA, 16 nt, Human
ccaugguacccccuuc

SEQ ID NO: 2588248 - RNA, 15 nt, Human
ccaugguacccccuu

SEQ ID NO: 2588249 - RNA, 18 nt, Human
ccauggggagggauucug

SEQ ID NO: 2588250 - RNA, 12 nt, Human
ccauggggaggg

SEQ ID NO: 2588251 - RNA, 20 nt, Human
ccauggggagggauucuggu

SEQ ID NO: 2588252 - RNA, 13 nt, Human
ccaugggggcagg

SEQ ID NO: 2588253 - RNA, 14 nt, Human
ccaugggggcaggg

SEQ ID NO: 2588254 - RNA, 11 nt, Human
ccauggggaag

SEQ ID NO: 2588255 - RNA, 21 nt, Human
ccaugggcuucacuguauaaa

SEQ ID NO: 2588256 - RNA, 20 nt, Human
ccaugggcuucacuguauaa

SEQ ID NO: 2588257 - RNA, 19 nt, Human
ccaugggcuucacuguaua

SEQ ID NO: 2588258 - RNA, 16 nt, Human
ccaugggcuucacugu

SEQ ID NO: 2588259 - RNA, 13 nt, Human
ccaugggcuucac

SEQ ID NO: 2588260 - RNA, 13 nt, Human
ccaugggcucuga

SEQ ID NO: 2588261 - RNA, 17 nt, Human
ccaugggcagagcccaa

SEQ ID NO: 2588262 - RNA, 17 nt, Human
ccaugggccuccugugu

SEQ ID NO: 2588263 - RNA, 18 nt, Human
ccaugucgcgcucagcau

SEQ ID NO: 2588264 - RNA, 19 nt, Human
ccaugguacccccuucugg

SEQ ID NO: 2588265 - RNA, 19 nt, Human
ccaugucgccucugcauuc

SEQ ID NO: 2588266 - RNA, 14 nt, Human
ccaugucucgacuc

SEQ ID NO: 2588267 - RNA, 15 nt, Human
ccaugucucgacuca

SEQ ID NO: 2588268 - RNA, 14 nt, Human
ccaugucggccucu

SEQ ID NO: 2588269 - RNA, 13 nt, Human
ccaugucggccuc

SEQ ID NO: 2588270 - RNA, 15 nt, Human
ccaugucggccucua

SEQ ID NO: 2588271 - RNA, 16 nt, Human
ccaugucucucagaau

SEQ ID NO: 2588272 - RNA, 20 nt, Human
ccaugucucugagcauuaga

SEQ ID NO: 2588273 - RNA, 13 nt, Human
ccaugucugcauu

SEQ ID NO: 2588274 - RNA, 17 nt, Human
ccaugucugccccauca

SEQ ID NO: 2588275 - RNA, 16 nt, Human
ccaugaccuuacauuu

SEQ ID NO: 2588276 - RNA, 21 nt, Human
ccaugagaagagggccugugg

SEQ ID NO: 2588277 - RNA, 19 nt, Human
ccaugagaagagggccugu

SEQ ID NO: 2588278 - RNA, 18 nt, Human
ccaugagaagagggccug

SEQ ID NO: 2588279 - RNA, 17 nt, Human
ccaugagaagagggccu

SEQ ID NO: 2588280 - RNA, 13 nt, Human
ccaugagaagagg

SEQ ID NO: 2588281 - RNA, 18 nt, Human
ccaugacuugagaaacaa

SEQ ID NO: 2588282 - RNA, 22 nt, Human
ccaugagaauaagagaaagaaa

SEQ ID NO: 2588283 - RNA, 23 nt, Human
ccaugagaugauacauccaaagc

SEQ ID NO: 2588284 - RNA, 18 nt, Human
ccaugaggaacaaggcaa

SEQ ID NO: 2588285 - RNA, 17 nt, Human
ccaugaggaacaaggca

SEQ ID NO: 2588286 - RNA, 16 nt, Human
ccaugaggaacaaggc

SEQ ID NO: 2588287 - RNA, 13 nt, Human
ccaugagccucag

SEQ ID NO: 2588288 - RNA, 18 nt, Human
ccaugggcacugugggua

SEQ ID NO: 2588289 - RNA, 22 nt, Human
ccaugggcacugcuggguggcc

SEQ ID NO: 2588290 - RNA, 20 nt, Human
ccaugggcacugcugggugg

SEQ ID NO: 2588291 - RNA, 17 nt, Human
ccaugggcacugcuggg

SEQ ID NO: 2588292 - RNA, 16 nt, Human
ccaugggcacugcugg

SEQ ID NO: 2588293 - RNA, 14 nt, Human
ccaugggcagagcc

SEQ ID NO: 2588294 - RNA, 16 nt, Human
ccaugggcagagccca

SEQ ID NO: 2588295 - RNA, 22 nt, Human
ccaugagcaccccaaggcugcg

SEQ ID NO: 2588296 - RNA, 21 nt, Human
ccaugagcaccccaaggcugc

SEQ ID NO: 2588297 - RNA, 15 nt, Human
ccaugggcacugcug

SEQ ID NO: 2588298 - RNA, 14 nt, Human
ccaugggcacugcu

SEQ ID NO: 2588299 - RNA, 15 nt, Human
cccacuguccugggc

SEQ ID NO: 2588300 - RNA, 16 nt, Human
cccacuguccugggcc

SEQ ID NO: 2588301 - RNA, 22 nt, Human
cccacuguccugggccugcaga

SEQ ID NO: 2588302 - RNA, 16 nt, Human
cccacuguccugggcg

SEQ ID NO: 2588303 - RNA, 14 nt, Human
cccacuguccuggg

SEQ ID NO: 2588304 - RNA, 13 nt, Human
cccacuguccugg

SEQ ID NO: 2588305 - RNA, 23 nt, Human
cccacuguacuugcucuugaugc

SEQ ID NO: 2588306 - RNA, 19 nt, Human
cccacuguacuugcucuug

SEQ ID NO: 2588307 - RNA, 18 nt, Human
cccacuguacuugcucuu

SEQ ID NO: 2588308 - RNA, 18 nt, Human
cccaccgcagacaggacc

SEQ ID NO: 2588309 - RNA, 15 nt, Human
cccaccgcagacagg

SEQ ID NO: 2588310 - RNA, 15 nt, Human
cccacccugggcucu

SEQ ID NO: 2588311 - RNA, 18 nt, Human
cccacccuggugggccaa

SEQ ID NO: 2588312 - RNA, 14 nt, Human
cccacccugggccc

SEQ ID NO: 2588313 - RNA, 13 nt, Human
cccacccugggcc

SEQ ID NO: 2588314 - RNA, 21 nt, Human
cccaccccggggacccuguga

SEQ ID NO: 2588315 - RNA, 20 nt, Human
cccaccccggggacccugug

SEQ ID NO: 2588316 - RNA, 14 nt, Human
cccacccugggacc

SEQ ID NO: 2588317 - RNA, 13 nt, Human
ccauugguguuga

SEQ ID NO: 2588318 - RNA, 20 nt, Human
ccauuguggcuccuaucugu

SEQ ID NO: 2588319 - RNA, 20 nt, Human
ccauugucuuguucugugau

SEQ ID NO: 2588320 - RNA, 22 nt, Human
ccauuguggucacaggaaguag

SEQ ID NO: 2588321 - RNA, 23 nt, Human
ccauuguaacuuggauguagcca

SEQ ID NO: 2588322 - RNA, 19 nt, Human
ccauuguccaauccuaugu

SEQ ID NO: 2588323 - RNA, 15 nt, Human
ccauugucccucugc

SEQ ID NO: 2588324 - RNA, 17 nt, Human
ccauugucccucugccc

SEQ ID NO: 2588325 - RNA, 19 nt, Human
ccauugucccucugcccca

SEQ ID NO: 2588326 - RNA, 15 nt, Human
ccauugucuuguucu

SEQ ID NO: 2588327 - RNA, 22 nt, Human
ccauugucccucugccccaucc

SEQ ID NO: 2588328 - RNA, 10 nt, Human
ccauugucuu

SEQ ID NO: 2588329 - RNA, 17 nt, Human
ccauugucuuguucugu

SEQ ID NO: 2588330 - RNA, 16 nt, Human
ccauugucuuguucug

SEQ ID NO: 2588331 - RNA, 14 nt, Human
cccaaccugcugaa

SEQ ID NO: 2588332 - RNA, 23 nt, Human
cccaaccugcucuccucuugcca

SEQ ID NO: 2588333 - RNA, 20 nt, Human
cccaacucuccccugaccug

SEQ ID NO: 2588334 - RNA, 15 nt, Human
cccaacucuccccug

SEQ ID NO: 2588335 - RNA, 13 nt, Human
cccaacugucuuu

SEQ ID NO: 2588336 - RNA, 15 nt, Human
cccaacugucuuuuu

SEQ ID NO: 2588337 - RNA, 12 nt, Human
cccaacuguuau

SEQ ID NO: 2588338 - RNA, 15 nt, Human
cccaacucuccugga

SEQ ID NO: 2588339 - RNA, 12 nt, Human
cccaacucuccu

SEQ ID NO: 2588340 - RNA, 11 nt, Human
cccaacugucu

SEQ ID NO: 2588341 - RNA, 21 nt, Human
cccaaccugcucuccucuugc

SEQ ID NO: 2588342 - RNA, 14 nt, Human
cccaaccugcucuc

SEQ ID NO: 2588343 - RNA, 13 nt, Human
cccaaccugcucu

SEQ ID NO: 2588344 - RNA, 13 nt, Human
ccauuuaaagcuu

SEQ ID NO: 2588345 - RNA, 15 nt, Human
ccauuguuugaaaca

SEQ ID NO: 2588346 - RNA, 12 nt, Human
ccauugugugag

SEQ ID NO: 2588347 - RNA, 21 nt, Human
ccauuguuugaaacaaagaag

SEQ ID NO: 2588348 - RNA, 22 nt, Human
ccauuguuugaaacaaagaagg

SEQ ID NO: 2588349 - RNA, 22 nt, Human
cccacccaagcuuggcagccga

SEQ ID NO: 2588350 - RNA, 18 nt, Human
cccacccaagcuuggcag

SEQ ID NO: 2588351 - RNA, 16 nt, Human
cccacccaagcuuggc

SEQ ID NO: 2588352 - RNA, 13 nt, Human
cccacccccucaa

SEQ ID NO: 2588353 - RNA, 17 nt, Human
cccacccccugcccugc

SEQ ID NO: 2588354 - RNA, 16 nt, Human
cccacccccugcccug

SEQ ID NO: 2588355 - RNA, 15 nt, Human
cccacccccugcccu

SEQ ID NO: 2588356 - RNA, 14 nt, Human
cccacccccugccc

SEQ ID NO: 2588357 - RNA, 15 nt, Human
cccacccccucaagc

SEQ ID NO: 2588358 - RNA, 17 nt, Human
cccacccccuccccagg

SEQ ID NO: 2588359 - RNA, 13 nt, Human
cccacccccugcc

SEQ ID NO: 2588360 - RNA, 19 nt, Human
cccacccccuccccagggg

SEQ ID NO: 2588361 - RNA, 19 nt, Human
cccacccccugcccugcac

SEQ ID NO: 2588362 - RNA, 18 nt, Human
cccacccccugcccugca

SEQ ID NO: 2588363 - RNA, 19 nt, Human
cccacccccuucagugccc

SEQ ID NO: 2588364 - RNA, 23 nt, Human
cccacccccuucagugcccacca

SEQ ID NO: 2588365 - RNA, 16 nt, Human
cccacccccuucucug

SEQ ID NO: 2588366 - RNA, 19 nt, Human
cccacccccuucucugcuc

SEQ ID NO: 2588367 - RNA, 18 nt, Human
cccaccccggggacccug

SEQ ID NO: 2588368 - RNA, 17 nt, Human
cccaccccggggacccu

SEQ ID NO: 2588369 - RNA, 14 nt, Human
cccaccccggggac

SEQ ID NO: 2588370 - RNA, 13 nt, Human
cccaccccgggga

SEQ ID NO: 2588371 - RNA, 16 nt, Human
cccaccccgcucugca

SEQ ID NO: 2588372 - RNA, 15 nt, Human
cccaccccgcucugc

SEQ ID NO: 2588373 - RNA, 22 nt, Human
cccacccccuucucugcuccac

SEQ ID NO: 2588374 - RNA, 18 nt, Human
cccaccaucaugucuggc

SEQ ID NO: 2588375 - RNA, 22 nt, Human
cccaagcuuggcagccgagcuc

SEQ ID NO: 2588376 - RNA, 20 nt, Human
cccaagcuuggcagccgagc

SEQ ID NO: 2588377 - RNA, 18 nt, Human
cccaagcuuggcagccga

SEQ ID NO: 2588378 - RNA, 14 nt, Human
cccaagcuuggcag

SEQ ID NO: 2588379 - RNA, 14 nt, Human
cccaaggaaagccc

SEQ ID NO: 2588380 - RNA, 19 nt, Human
cccaaggaaagccccagca

SEQ ID NO: 2588381 - RNA, 15 nt, Human
cccacccaagggccu

SEQ ID NO: 2588382 - RNA, 15 nt, Human
cccacccaagcuugg

SEQ ID NO: 2588383 - RNA, 18 nt, Human
cccaccaugucugcccca

SEQ ID NO: 2588384 - RNA, 12 nt, Human
cccaagcucaga

SEQ ID NO: 2588385 - RNA, 17 nt, Human
cccaagcucugcuccuc

SEQ ID NO: 2588386 - RNA, 22 nt, Human
cccaagcugggccccagcccac

SEQ ID NO: 2588387 - RNA, 21 nt, Human
cccaagcugggccccagccca

SEQ ID NO: 2588388 - RNA, 18 nt, Human
cccaagcugggccccagc

SEQ ID NO: 2588389 - RNA, 14 nt, Human
cccaagcugggccc

SEQ ID NO: 2588390 - RNA, 19 nt, Human
cccaagcuguuuucuucua

SEQ ID NO: 2588391 - RNA, 14 nt, Human
cccaagcuuagaac

SEQ ID NO: 2588392 - RNA, 13 nt, Human
cccaagcugggcc

SEQ ID NO: 2588393 - RNA, 17 nt, Human
cccaagcucuuguggua

SEQ ID NO: 2588394 - RNA, 16 nt, Human
cccaagccuggcaagg

SEQ ID NO: 2588395 - RNA, 23 nt, Human
cccaagcccgacuugcuguuuug

SEQ ID NO: 2588396 - RNA, 18 nt, Human
cccaagcccgacuugcug

SEQ ID NO: 2588397 - RNA, 20 nt, Human
cccaagcccccuccuugucu

SEQ ID NO: 2588398 - RNA, 16 nt, Human
cccaagccagaggcug

SEQ ID NO: 2588399 - RNA, 23 nt, Human
cccaagccuacuuuugccauuga

SEQ ID NO: 2588400 - RNA, 21 nt, Human
cccaagaauagaugcugacug

SEQ ID NO: 2588401 - RNA, 20 nt, Human
cccaagaauagaugcugacu

SEQ ID NO: 2588402 - RNA, 15 nt, Human
cccaagccagaggcu

SEQ ID NO: 2588403 - RNA, 14 nt, Human
cccaagccagaggc

SEQ ID NO: 2588404 - RNA, 20 nt, Human
cccaacuuuguggaugucuu

SEQ ID NO: 2588405 - RNA, 19 nt, Human
cccauccucuguacagagc

SEQ ID NO: 2588406 - RNA, 15 nt, Human
cccauccucuguaca

SEQ ID NO: 2588407 - RNA, 19 nt, Human
cccauccccauccuccagc

SEQ ID NO: 2588408 - RNA, 20 nt, Human
cccauccucuguacagagcc

SEQ ID NO: 2588409 - RNA, 22 nt, Human
cccagggcacuucacagagugu

SEQ ID NO: 2588410 - RNA, 20 nt, Human
cccagggcacuucacagagu

SEQ ID NO: 2588411 - RNA, 18 nt, Human
cccagggcacuucacaga

SEQ ID NO: 2588412 - RNA, 18 nt, Human
cccagggccacucugccu

SEQ ID NO: 2588413 - RNA, 15 nt, Human
cccagggccagggcc

SEQ ID NO: 2588414 - RNA, 17 nt, Human
cccagggccagggcccu

SEQ ID NO: 2588415 - RNA, 14 nt, Human
cccaucaucccagc

SEQ ID NO: 2588416 - RNA, 12 nt, Human
cccaucauccca

SEQ ID NO: 2588417 - RNA, 18 nt, Human
cccagggccagggcccug

SEQ ID NO: 2588418 - RNA, 23 nt, Human
cccagggccacucugccucugcc

SEQ ID NO: 2588419 - RNA, 17 nt, Human
cccaucauacacuuccu

SEQ ID NO: 2588420 - RNA, 15 nt, Human
cccaucauucaugcu

SEQ ID NO: 2588421 - RNA, 12 nt, Human
cccaucauucau

SEQ ID NO: 2588422 - RNA, 20 nt, Human
cccaucauucaugcuacugc

SEQ ID NO: 2588423 - RNA, 13 nt, Human
cccauccaggcag

SEQ ID NO: 2588424 - RNA, 14 nt, Human
cccauccaguucau

SEQ ID NO: 2588425 - RNA, 21 nt, Human
cccauccaguucaugagaauc

SEQ ID NO: 2588426 - RNA, 13 nt, Human
cccauccagggcc

SEQ ID NO: 2588427 - RNA, 20 nt, Human
cccauccagucucccaacuu

SEQ ID NO: 2588428 - RNA, 14 nt, Human
cccauccucuguac

SEQ ID NO: 2588429 - RNA, 14 nt, Human
cccauccaggcagu

SEQ ID NO: 2588430 - RNA, 13 nt, Human
cccaucccacacc

SEQ ID NO: 2588431 - RNA, 15 nt, Human
cccaucccacacccu

SEQ ID NO: 2588432 - RNA, 20 nt, Human
cccaggcuggcgugcagugg

SEQ ID NO: 2588433 - RNA, 19 nt, Human
cccaggcuggcgugcagug

SEQ ID NO: 2588434 - RNA, 21 nt, Human
cccagggagcggaaagcagcu

SEQ ID NO: 2588435 - RNA, 22 nt, Human
cccagggagcggaaagcagcuc

SEQ ID NO: 2588436 - RNA, 20 nt, Human
cccagggagcggaaagcagc

SEQ ID NO: 2588437 - RNA, 17 nt, Human
cccagcugugagccuug

SEQ ID NO: 2588438 - RNA, 16 nt, Human
cccagcugugagccuu

SEQ ID NO: 2588439 - RNA, 15 nt, Human
cccagcugugagccu

SEQ ID NO: 2588440 - RNA, 23 nt, Human
cccagcuggggccaggcuggguc

SEQ ID NO: 2588441 - RNA, 22 nt, Human
cccagcuggggccaggcugggu

SEQ ID NO: 2588442 - RNA, 18 nt, Human
cccaggcuggcgugcagu

SEQ ID NO: 2588443 - RNA, 17 nt, Human
cccagcugggucaggca

SEQ ID NO: 2588444 - RNA, 19 nt, Human
cccagcugggucaggcagg

SEQ ID NO: 2588445 - RNA, 22 nt, Human
cccagcccauucucucuccugu

SEQ ID NO: 2588446 - RNA, 16 nt, Human
cccagcuggugggaag

SEQ ID NO: 2588447 - RNA, 19 nt, Human
cccagcuggugggaagcgu

SEQ ID NO: 2588448 - RNA, 22 nt, Human
cccagcuggugggaagcgucug

SEQ ID NO: 2588449 - RNA, 18 nt, Human
cccagcauuccagccccu

SEQ ID NO: 2588450 - RNA, 16 nt, Human
cccagcaguuugggag

SEQ ID NO: 2588451 - RNA, 19 nt, Human
cccagcagguggggagggg

SEQ ID NO: 2588452 - RNA, 17 nt, Human
cccagcauaugggggcc

SEQ ID NO: 2588453 - RNA, 21 nt, Human
cccagcauccuuuucugcaga

SEQ ID NO: 2588454 - RNA, 20 nt, Human
cccagcauuccagccccucu

SEQ ID NO: 2588455 - RNA, 19 nt, Human
cccagcauuccagccccuc

SEQ ID NO: 2588456 - RNA, 22 nt, Human
cccagcauuccagccccucugg

SEQ ID NO: 2588457 - RNA, 18 nt, Human
cccagcauugcugguucu

SEQ ID NO: 2588458 - RNA, 15 nt, Human
cccagcauugcuggu

SEQ ID NO: 2588459 - RNA, 17 nt, Human
cccagccaaacccuguc

SEQ ID NO: 2588460 - RNA, 19 nt, Human
cccagcccacuucugccau

SEQ ID NO: 2588461 - RNA, 11 nt, Human
cccagcccaga

SEQ ID NO: 2588462 - RNA, 20 nt, Human
cccagcauuuuacugauuca

SEQ ID NO: 2588463 - RNA, 12 nt, Human
cccagccacccc

SEQ ID NO: 2588464 - RNA, 17 nt, Human
cccagcccacuucugcc

SEQ ID NO: 2588465 - RNA, 12 nt, Human
cccagcccagag

SEQ ID NO: 2588466 - RNA, 13 nt, Human
cccagcccagaga

SEQ ID NO: 2588467 - RNA, 14 nt, Human
cccagcccagagac

SEQ ID NO: 2588468 - RNA, 15 nt, Human
cccagcccagagaca

SEQ ID NO: 2588469 - RNA, 13 nt, Human
cccagcccagcug

SEQ ID NO: 2588470 - RNA, 16 nt, Human
cccagcccagcuggug

SEQ ID NO: 2588471 - RNA, 21 nt, Human
cccagccccaaaacucuccuc

SEQ ID NO: 2588472 - RNA, 11 nt, Human
cccagcccagg

SEQ ID NO: 2588473 - RNA, 16 nt, Human
cccagcccagagacau

SEQ ID NO: 2588474 - RNA, 18 nt, Human
cccagcccagggcuccug

SEQ ID NO: 2588475 - RNA, 21 nt, Human
cccagcccaggguucccccag

SEQ ID NO: 2588476 - RNA, 23 nt, Human
cccagccccaaaacucuccucug

SEQ ID NO: 2588477 - RNA, 20 nt, Human
cccagcuggggccaggcugg

SEQ ID NO: 2588478 - RNA, 21 nt, Human
cccagcccauucucucuccug

SEQ ID NO: 2588479 - RNA, 18 nt, Human
cccagcccagcugguggg

SEQ ID NO: 2588480 - RNA, 21 nt, Human
cccauucuuccuaguuuucuc

SEQ ID NO: 2588481 - RNA, 12 nt, Human
cccauucuuccu

SEQ ID NO: 2588482 - RNA, 23 nt, Human
cccauucugccugcccaggcccc

SEQ ID NO: 2588483 - RNA, 15 nt, Human
ccccauuguggucac

SEQ ID NO: 2588484 - RNA, 17 nt, Human
ccccauugccuccuccu

SEQ ID NO: 2588485 - RNA, 15 nt, Human
ccccauucuuuugua

SEQ ID NO: 2588486 - RNA, 14 nt, Human
cccccuuccaugga

SEQ ID NO: 2588487 - RNA, 14 nt, Human
cccccuucagugcc

SEQ ID NO: 2588488 - RNA, 15 nt, Human
cccccuucagugccc

SEQ ID NO: 2588489 - RNA, 23 nt, Human
cccccuucagugcccaccaacau

SEQ ID NO: 2588490 - RNA, 11 nt, Human
cccccuuccac

SEQ ID NO: 2588491 - RNA, 13 nt, Human
cccccuucuccca

SEQ ID NO: 2588492 - RNA, 14 nt, Human
cccccuucucccac

SEQ ID NO: 2588493 - RNA, 15 nt, Human
cccccuucucccaca

SEQ ID NO: 2588494 - RNA, 17 nt, Human
cccccuucucccacacu

SEQ ID NO: 2588495 - RNA, 15 nt, Human
cccccuucucugcuc

SEQ ID NO: 2588496 - RNA, 16 nt, Human
cccccuucucugcucc

SEQ ID NO: 2588497 - RNA, 23 nt, Human
ccccgcagaccuccccagccccu

SEQ ID NO: 2588498 - RNA, 21 nt, Human
ccccgcagaccuccccagccc

SEQ ID NO: 2588499 - RNA, 20 nt, Human
ccccgcagaccuccccagcc

SEQ ID NO: 2588500 - RNA, 17 nt, Human
cccccuucucugcucca

SEQ ID NO: 2588501 - RNA, 22 nt, Human
cccccuucucugcuccaccaca

SEQ ID NO: 2588502 - RNA, 19 nt, Human
ccccgcagaccuccccagc

SEQ ID NO: 2588503 - RNA, 12 nt, Human
ccccgcccaggc

SEQ ID NO: 2588504 - RNA, 17 nt, Human
ccccgcccagcugcacc

SEQ ID NO: 2588505 - RNA, 23 nt, Human
ccccgcccagcugcaccugccag

SEQ ID NO: 2588506 - RNA, 18 nt, Human
ccccggccaccugcggug

SEQ ID NO: 2588507 - RNA, 14 nt, Human
ccccggccaccugc

SEQ ID NO: 2588508 - RNA, 13 nt, Human
ccccggccaccug

SEQ ID NO: 2588509 - RNA, 14 nt, Human
ccccgccuguuccc

SEQ ID NO: 2588510 - RNA, 13 nt, Human
ccccgccccgccc

SEQ ID NO: 2588511 - RNA, 14 nt, Human
ccccgcccaggcuu

SEQ ID NO: 2588512 - RNA, 19 nt, Human
ccccgcccaggcuggccag

SEQ ID NO: 2588513 - RNA, 16 nt, Human
ccccgcccaggcuggc

SEQ ID NO: 2588514 - RNA, 15 nt, Human
ccccgcccaggcugg

SEQ ID NO: 2588515 - RNA, 14 nt, Human
ccccgcccaggcug

SEQ ID NO: 2588516 - RNA, 13 nt, Human
ccccgccccacau

SEQ ID NO: 2588517 - RNA, 16 nt, Human
ccccgccccacauucc

SEQ ID NO: 2588518 - RNA, 17 nt, Human
ccccgccccacauuccg

SEQ ID NO: 2588519 - RNA, 20 nt, Human
ccccgccccacauuccgaca

SEQ ID NO: 2588520 - RNA, 18 nt, Human
ccccgccugcccucaugg

SEQ ID NO: 2588521 - RNA, 16 nt, Human
ccccgccccgccccac

SEQ ID NO: 2588522 - RNA, 21 nt, Human
ccccgcccccugcccuccccu

SEQ ID NO: 2588523 - RNA, 18 nt, Human
ccccgcccccugcccucc

SEQ ID NO: 2588524 - RNA, 17 nt, Human
ccccgcccccugcccuc

SEQ ID NO: 2588525 - RNA, 16 nt, Human
ccccgcccccaguccc

SEQ ID NO: 2588526 - RNA, 12 nt, Human
ccccgcccccag

SEQ ID NO: 2588527 - RNA, 13 nt, Human
ccccgcccccugc

SEQ ID NO: 2588528 - RNA, 12 nt, Human
ccccagccccaa

SEQ ID NO: 2588529 - RNA, 10 nt, Human
ccccagcccc

SEQ ID NO: 2588530 - RNA, 16 nt, Human
ccccagcccaagucca

SEQ ID NO: 2588531 - RNA, 15 nt, Human
ccccagcccaagucc

SEQ ID NO: 2588532 - RNA, 14 nt, Human
ccccagcccaaguc

SEQ ID NO: 2588533 - RNA, 13 nt, Human
ccccagcccaagu

SEQ ID NO: 2588534 - RNA, 23 nt, Human
ccccagccagauggacuccagcc

SEQ ID NO: 2588535 - RNA, 11 nt, Human
ccccagccaga

SEQ ID NO: 2588536 - RNA, 14 nt, Human
ccccagccccaaaa

SEQ ID NO: 2588537 - RNA, 14 nt, Human
ccccagccccaucc

SEQ ID NO: 2588538 - RNA, 21 nt, Human
ccccauucugccugcccaggc

SEQ ID NO: 2588539 - RNA, 21 nt, Human
ccccauucuuccuaguuuucu

SEQ ID NO: 2588540 - RNA, 23 nt, Human
ccccauucuuccuaguuuucucc

SEQ ID NO: 2588541 - RNA, 16 nt, Human
ccccauucuuccuagu

SEQ ID NO: 2588542 - RNA, 12 nt, Human
ccccagcccacc

SEQ ID NO: 2588543 - RNA, 20 nt, Human
ccccaaaacucuccucugcu

SEQ ID NO: 2588544 - RNA, 16 nt, Human
ccccagcacugaggaa

SEQ ID NO: 2588545 - RNA, 23 nt, Human
ccccaaaaccacagcccugucag

SEQ ID NO: 2588546 - RNA, 20 nt, Human
ccccaaaaccacagcccugu

SEQ ID NO: 2588547 - RNA, 22 nt, Human
ccccaaaaccacagcccuguca

SEQ ID NO: 2588548 - RNA, 9 nt, Human
ccccagcca

SEQ ID NO: 2588549 - RNA, 12 nt, Human
ccccagcaggug

SEQ ID NO: 2588550 - RNA, 23 nt, Human
ccccagcaguugaaugacaacag

SEQ ID NO: 2588551 - RNA, 19 nt, Human
ccccagcauuccagccccu

SEQ ID NO: 2588552 - RNA, 18 nt, Human
ccccagcaggugcugacu

SEQ ID NO: 2588553 - RNA, 11 nt, Human
ccccagcaggu

SEQ ID NO: 2588554 - RNA, 18 nt, Human
ccccaaaacucuccucug

SEQ ID NO: 2588555 - RNA, 15 nt, Human
ccccaaaaccacagc

SEQ ID NO: 2588556 - RNA, 16 nt, Human
ccccaaaaccacagcc

SEQ ID NO: 2588557 - RNA, 19 nt, Human
ccccaaaaccacagcccug

SEQ ID NO: 2588558 - RNA, 20 nt, Human
ccccaaaaaccucacccgag

SEQ ID NO: 2588559 - RNA, 17 nt, Human
cccauugccuccuccuu

SEQ ID NO: 2588560 - RNA, 14 nt, Human
cccauugccuccuc

SEQ ID NO: 2588561 - RNA, 14 nt, Human
cccauugcccuggu

SEQ ID NO: 2588562 - RNA, 22 nt, Human
cccauucuuuuguaauuuaaau

SEQ ID NO: 2588563 - RNA, 21 nt, Human
cccauucuuuuguaauuuaaa

SEQ ID NO: 2588564 - RNA, 20 nt, Human
cccauucuuuuguaauuuaa

SEQ ID NO: 2588565 - RNA, 17 nt, Human
cccauucuuuuguaauu

SEQ ID NO: 2588566 - RNA, 20 nt, Human
cccauucuuccuaguuuucu

SEQ ID NO: 2588567 - RNA, 14 nt, Human
cccauucuuuugua

SEQ ID NO: 2588568 - RNA, 16 nt, Human
cgagucucuucuccac

SEQ ID NO: 2588569 - RNA, 16 nt, Human
cgaggguccuggcucc

SEQ ID NO: 2588570 - RNA, 23 nt, Human
cgaggguccuggcuccugagggg

SEQ ID NO: 2588571 - RNA, 18 nt, Human
cgagucucuucuccacug

SEQ ID NO: 2588572 - RNA, 17 nt, Human
cgagucucuucuccacu

SEQ ID NO: 2588573 - RNA, 20 nt, Human
cgaggggcucucagcucagc

SEQ ID NO: 2588574 - RNA, 17 nt, Human
cgaggggcucaggaaaa

SEQ ID NO: 2588575 - RNA, 16 nt, Human
cgaggggcucaggaaa

SEQ ID NO: 2588576 - RNA, 21 nt, Human
cgaggggcgggacccaggcac

SEQ ID NO: 2588577 - RNA, 17 nt, Human
cgaggggcgggacccag

SEQ ID NO: 2588578 - RNA, 19 nt, Human
cgaggggugucuugggcag

SEQ ID NO: 2588579 - RNA, 18 nt, Human
cgaggggugucuugggca

SEQ ID NO: 2588580 - RNA, 14 nt, Human
cgaggguccuggcu

SEQ ID NO: 2588581 - RNA, 15 nt, Human
cgaggguccuggcuc

SEQ ID NO: 2588582 - RNA, 12 nt, Human
cgagggcaggga

SEQ ID NO: 2588583 - RNA, 21 nt, Human
cgagggcagggaccacacccu

SEQ ID NO: 2588584 - RNA, 18 nt, Human
cgaggggaggguggcagg

SEQ ID NO: 2588585 - RNA, 19 nt, Human
cgaggggaggguggcaggu

SEQ ID NO: 2588586 - RNA, 17 nt, Human
cgcagucaggggcagcu

SEQ ID NO: 2588587 - RNA, 13 nt, Human
cgcaggggaaacg

SEQ ID NO: 2588588 - RNA, 16 nt, Human
cgcagggguugcagug

SEQ ID NO: 2588589 - RNA, 15 nt, Human
cgcagucgucgcaca

SEQ ID NO: 2588590 - RNA, 21 nt, Human
cgcaggcuggcccugcccugg

SEQ ID NO: 2588591 - RNA, 22 nt, Human
cgcaggcuggcccugcccuggu

SEQ ID NO: 2588592 - RNA, 14 nt, Human
cgagguagaguuug

SEQ ID NO: 2588593 - RNA, 14 nt, Human
cgagugccaggacu

SEQ ID NO: 2588594 - RNA, 11 nt, Human
cgagugccagg

SEQ ID NO: 2588595 - RNA, 21 nt, Human
cgagucucuucuccacuggau

SEQ ID NO: 2588596 - RNA, 20 nt, Human
cgagucucuucuccacugga

SEQ ID NO: 2588597 - RNA, 22 nt, Human
cgccaagguagccaucccauga

SEQ ID NO: 2588598 - RNA, 21 nt, Human
cgccaagguagccaucccaug

SEQ ID NO: 2588599 - RNA, 23 nt, Human
cgccaaggcugggggaagaagcu

SEQ ID NO: 2588600 - RNA, 17 nt, Human
cgcagugugcacuaagg

SEQ ID NO: 2588601 - RNA, 22 nt, Human
cgcagugugcacuaaggggccc

SEQ ID NO: 2588602 - RNA, 23 nt, Human
cgcagugugcacuaaggggcccg

SEQ ID NO: 2588603 - RNA, 19 nt, Human
cgcagucgucgcacagucu

SEQ ID NO: 2588604 - RNA, 17 nt, Human
cgcagucgucgcacagu

SEQ ID NO: 2588605 - RNA, 16 nt, Human
cgcagucgucgcacag

SEQ ID NO: 2588606 - RNA, 22 nt, Human
cgcagucgucgcacagucucuc

SEQ ID NO: 2588607 - RNA, 21 nt, Human
cgcagucgucgcacagucucu

SEQ ID NO: 2588608 - RNA, 15 nt, Human
cgcagugccucuggu

SEQ ID NO: 2588609 - RNA, 19 nt, Human
cgcagugcuucucuacaga

SEQ ID NO: 2588610 - RNA, 19 nt, Human
ccuuuucccugcuuccagg

SEQ ID NO: 2588611 - RNA, 16 nt, Human
ccuuuucccggggagg

SEQ ID NO: 2588612 - RNA, 21 nt, Human
ccuuuuccauuugaaagaaag

SEQ ID NO: 2588613 - RNA, 18 nt, Human
ccuuuuccauuugaaaga

SEQ ID NO: 2588614 - RNA, 15 nt, Human
ccuuuucccugcuuc

SEQ ID NO: 2588615 - RNA, 14 nt, Human
ccuuuucccugcuu

SEQ ID NO: 2588616 - RNA, 13 nt, Human
ccuuuucccugcu

SEQ ID NO: 2588617 - RNA, 21 nt, Human
ccuuuucccggggaggagaga

SEQ ID NO: 2588618 - RNA, 20 nt, Human
ccuuuucgcaggauucuucc

SEQ ID NO: 2588619 - RNA, 22 nt, Human
ccuuuccuggacacucagaccu

SEQ ID NO: 2588620 - RNA, 16 nt, Human
ccuuuccucaggcaag

SEQ ID NO: 2588621 - RNA, 16 nt, Human
ccuuuccuuccauccc

SEQ ID NO: 2588622 - RNA, 18 nt, Human
ccuuuccuuccaucccua

SEQ ID NO: 2588623 - RNA, 12 nt, Human
ccuuuccuuccu

SEQ ID NO: 2588624 - RNA, 12 nt, Human
ccuuuucccaac

SEQ ID NO: 2588625 - RNA, 21 nt, Human
ccuuuccuuccuucccuggcu

SEQ ID NO: 2588626 - RNA, 13 nt, Human
ccuuuccuguagc

SEQ ID NO: 2588627 - RNA, 13 nt, Human
ccuuuccuuccuu

SEQ ID NO: 2588628 - RNA, 18 nt, Human
cgcuggagugcagugagc

SEQ ID NO: 2588629 - RNA, 17 nt, Human
cgcuggagugcagugag

SEQ ID NO: 2588630 - RNA, 13 nt, Human
cgcugccugugug

SEQ ID NO: 2588631 - RNA, 15 nt, Human
cgcugccugcccaca

SEQ ID NO: 2588632 - RNA, 20 nt, Human
cgcugccgcaccccagagug

SEQ ID NO: 2588633 - RNA, 21 nt, Human
cgcugccgcaccccagagugu

SEQ ID NO: 2588634 - RNA, 17 nt, Human
cgcugccuaaguggcug

SEQ ID NO: 2588635 - RNA, 20 nt, Human
cgcugccuaaguggcugcug

SEQ ID NO: 2588636 - RNA, 20 nt, Human
cgcugcccggcgcccucugu

SEQ ID NO: 2588637 - RNA, 19 nt, Human
cgcugcccggcgcccucug

SEQ ID NO: 2588638 - RNA, 20 nt, Human
cgcugaguggcaggggacag

SEQ ID NO: 2588639 - RNA, 22 nt, Human
cgcugcccggcgcccucugucc

SEQ ID NO: 2588640 - RNA, 21 nt, Human
cgcugcccggcgcccucuguc

SEQ ID NO: 2588641 - RNA, 13 nt, Human
cgcugccgcaccc

SEQ ID NO: 2588642 - RNA, 18 nt, Human
cgcugccgcaccccagag

SEQ ID NO: 2588643 - RNA, 16 nt, Human
cgcuggcccagccggc

SEQ ID NO: 2588644 - RNA, 15 nt, Human
cgcuggcccagccgg

SEQ ID NO: 2588645 - RNA, 14 nt, Human
cgcuggcccagccg

SEQ ID NO: 2588646 - RNA, 13 nt, Human
cgcuggcccagcc

SEQ ID NO: 2588647 - RNA, 12 nt, Human
cgcuggcccagc

SEQ ID NO: 2588648 - RNA, 11 nt, Human
cgcuggcccag

SEQ ID NO: 2588649 - RNA, 10 nt, Human
cgcuggccca

SEQ ID NO: 2588650 - RNA, 18 nt, Human
cgcuggagguggggccug

SEQ ID NO: 2588651 - RNA, 24 nt, Human
cgcuggcccagccggccucucugg

SEQ ID NO: 2588652 - RNA, 23 nt, Human
cgcuggcccagccggccucucug

SEQ ID NO: 2588653 - RNA, 23 nt, Human
cgcucugcaugcggcccagcccg

SEQ ID NO: 2588654 - RNA, 22 nt, Human
cgcucugcaugcggcccagccc

SEQ ID NO: 2588655 - RNA, 21 nt, Human
cgcucugcaugcggcccagcc

SEQ ID NO: 2588656 - RNA, 20 nt, Human
cgcucugcaugcggcccagc

SEQ ID NO: 2588657 - RNA, 19 nt, Human
cgcucugcaugcggcccag

SEQ ID NO: 2588658 - RNA, 12 nt, Human
cgcucugcaugc

SEQ ID NO: 2588659 - RNA, 19 nt, Human
cgccugccuccccugugca

SEQ ID NO: 2588660 - RNA, 20 nt, Human
cgccugcccuccccagagca

SEQ ID NO: 2588661 - RNA, 17 nt, Human
cgccugcccuccccaga

SEQ ID NO: 2588662 - RNA, 13 nt, Human
cgccugcccuccc

SEQ ID NO: 2588663 - RNA, 22 nt, Human
cgccugcccucauggccccucu

SEQ ID NO: 2588664 - RNA, 20 nt, Human
cgccugcccucauggccccu

SEQ ID NO: 2588665 - RNA, 23 nt, Human
cgccugcccgucucucucccaug

SEQ ID NO: 2588666 - RNA, 20 nt, Human
cgccugcccgucucucuccc

SEQ ID NO: 2588667 - RNA, 17 nt, Human
cgccugcccucauggcc

SEQ ID NO: 2588668 - RNA, 15 nt, Human
cgccugccaguccua

SEQ ID NO: 2588669 - RNA, 14 nt, Human
cgccugccaguccu

SEQ ID NO: 2588670 - RNA, 15 nt, Human
cgccugccccuccca

SEQ ID NO: 2588671 - RNA, 16 nt, Human
cgccugccccucccag

SEQ ID NO: 2588672 - RNA, 11 nt, Human
cgccaccauuc

SEQ ID NO: 2588673 - RNA, 23 nt, Human
cgccaccauccugcagccuccuc

SEQ ID NO: 2588674 - RNA, 13 nt, Human
cgccaccauccug

SEQ ID NO: 2588675 - RNA, 16 nt, Human
cgccaccauuccugga

SEQ ID NO: 2588676 - RNA, 15 nt, Human
cgccaccauuccugg

SEQ ID NO: 2588677 - RNA, 17 nt, Human
cgccaccccuccuuccu

SEQ ID NO: 2588678 - RNA, 23 nt, Human
cgccacauggcuuccuccugcgc

SEQ ID NO: 2588679 - RNA, 22 nt, Human
cgccacauggcuuccuccugcg

SEQ ID NO: 2588680 - RNA, 18 nt, Human
cgccacauggcuuccucc

SEQ ID NO: 2588681 - RNA, 17 nt, Human
cgccacauggcuuccuc

SEQ ID NO: 2588682 - RNA, 16 nt, Human
cgccacauggcuuccu

SEQ ID NO: 2588683 - RNA, 15 nt, Human
cgccacauggcuucc

SEQ ID NO: 2588684 - RNA, 22 nt, Human
cgccugcaaacgcugccugccc

SEQ ID NO: 2588685 - RNA, 22 nt, Human
cgccugcaaacgcugccugccg

SEQ ID NO: 2588686 - RNA, 17 nt, Human
cgccugcauguaaacac

SEQ ID NO: 2588687 - RNA, 22 nt, Human
cgccugcauguaaacacgccug

SEQ ID NO: 2588688 - RNA, 20 nt, Human
cgccugcaaacgcugccugc

SEQ ID NO: 2588689 - RNA, 21 nt, Human
cgccugcaaacgcugccugcc

SEQ ID NO: 2588690 - RNA, 20 nt, Human
cgccaccuggcauuccuucu

SEQ ID NO: 2588691 - RNA, 21 nt, Human
cgccaccuggcauuccuucug

SEQ ID NO: 2588692 - RNA, 19 nt, Human
cgccugcaaacgcugccug

SEQ ID NO: 2588693 - RNA, 20 nt, Human
cgcugccccuggcagccccu

SEQ ID NO: 2588694 - RNA, 19 nt, Human
cgcugccccuggcagcccc

SEQ ID NO: 2588695 - RNA, 16 nt, Human
cgcugaguggcagggg

SEQ ID NO: 2588696 - RNA, 14 nt, Human
cgcugaguggcagg

SEQ ID NO: 2588697 - RNA, 17 nt, Human
cgcugaguggacuggag

SEQ ID NO: 2588698 - RNA, 13 nt, Human
cgcugaguggcag

SEQ ID NO: 2588699 - RNA, 15 nt, Human
cgcugaauaaauguc

SEQ ID NO: 2588700 - RNA, 14 nt, Human
cgcugaauaaaugu

SEQ ID NO: 2588701 - RNA, 23 nt, Human
cgcugacaaccaccgcuccccag

SEQ ID NO: 2588702 - RNA, 13 nt, Human
cgcugaauaaaug

SEQ ID NO: 2588703 - RNA, 21 nt, Human
cgcucuuggcagguacucagc

SEQ ID NO: 2588704 - RNA, 22 nt, Human
cgcucuguugcccaggcuggag

SEQ ID NO: 2588705 - RNA, 18 nt, Human
cgcucugcuggccuggcc

SEQ ID NO: 2588706 - RNA, 17 nt, Human
cgcucugcuggccuggc

SEQ ID NO: 2588707 - RNA, 16 nt, Human
cgcucugcuggccugg

SEQ ID NO: 2588708 - RNA, 15 nt, Human
cgcucugcuggccug

SEQ ID NO: 2588709 - RNA, 21 nt, Human
cgcucugcuggccuggccggc

SEQ ID NO: 2588710 - RNA, 20 nt, Human
cgcucugcuggccuggccgg

SEQ ID NO: 2588711 - RNA, 15 nt, Human
cgcucugucacccag

SEQ ID NO: 2588712 - RNA, 20 nt, Human
cgcucugucgcccaggcugg

SEQ ID NO: 2588713 - RNA, 19 nt, Human
cgcucuguugcccaggcug

SEQ ID NO: 2588714 - RNA, 19 nt, Human
cggcgucagccuccagccu

SEQ ID NO: 2588715 - RNA, 18 nt, Human
cggcgucagccuccagcc

SEQ ID NO: 2588716 - RNA, 17 nt, Human
cggcgucagccuccagc

SEQ ID NO: 2588717 - RNA, 16 nt, Human
cggcgucagccuccag

SEQ ID NO: 2588718 - RNA, 15 nt, Human
cggcgucagccucca

SEQ ID NO: 2588719 - RNA, 14 nt, Human
cggcgucagccucc

SEQ ID NO: 2588720 - RNA, 18 nt, Human
cggcuaauuuuuguauuu

SEQ ID NO: 2588721 - RNA, 23 nt, Human
cggcgucagccuccagccucugu

SEQ ID NO: 2588722 - RNA, 20 nt, Human
cggcgucagccuccagccuc

SEQ ID NO: 2588723 - RNA, 15 nt, Human
cggagucguggggug

SEQ ID NO: 2588724 - RNA, 15 nt, Human
cggaggggccuggca

SEQ ID NO: 2588725 - RNA, 23 nt, Human
cggagucccaccuuggcugcagg

SEQ ID NO: 2588726 - RNA, 22 nt, Human
cggagucccaccuuggcugcag

SEQ ID NO: 2588727 - RNA, 21 nt, Human
cggagucccaccuuggcugca

SEQ ID NO: 2588728 - RNA, 17 nt, Human
cggagggauuccccuaa

SEQ ID NO: 2588729 - RNA, 19 nt, Human
cggagggaauugaggucug

SEQ ID NO: 2588730 - RNA, 19 nt, Human
cggaggcuugucagagcug

SEQ ID NO: 2588731 - RNA, 20 nt, Human
cggaggcuugucagagcugg

SEQ ID NO: 2588732 - RNA, 21 nt, Human
cggaggcuugucagagcuggg

SEQ ID NO: 2588733 - RNA, 23 nt, Human
cggaggcuugucagagcugggag

SEQ ID NO: 2588734 - RNA, 22 nt, Human
cggaggcugcccccggcccccu

SEQ ID NO: 2588735 - RNA, 19 nt, Human
cggaggcugcccccggccc

SEQ ID NO: 2588736 - RNA, 16 nt, Human
cggaggcugcccccgg

SEQ ID NO: 2588737 - RNA, 16 nt, Human
cggaggcuugggaccg

SEQ ID NO: 2588738 - RNA, 15 nt, Human
cggaggcuugggacc

SEQ ID NO: 2588739 - RNA, 17 nt, Human
cggaggcuugggaccgc

SEQ ID NO: 2588740 - RNA, 18 nt, Human
cggaggcuugucagagcu

SEQ ID NO: 2588741 - RNA, 17 nt, Human
cggagacggagucccac

SEQ ID NO: 2588742 - RNA, 20 nt, Human
cggagacggagucccaccuu

SEQ ID NO: 2588743 - RNA, 15 nt, Human
cggagacgggaccgg

SEQ ID NO: 2588744 - RNA, 14 nt, Human
cggagacgggaccg

SEQ ID NO: 2588745 - RNA, 21 nt, Human
cggagaguacagugagccaag

SEQ ID NO: 2588746 - RNA, 19 nt, Human
cggagaguacagugagcca

SEQ ID NO: 2588747 - RNA, 18 nt, Human
cggagaguacagugagcc

SEQ ID NO: 2588748 - RNA, 17 nt, Human
cggagaguacagugagc

SEQ ID NO: 2588749 - RNA, 23 nt, Human
cggagagcgccugccccucccag

SEQ ID NO: 2588750 - RNA, 18 nt, Human
cggaggccccaaaggaaa

SEQ ID NO: 2588751 - RNA, 13 nt, Human
cggaggcugcccc

SEQ ID NO: 2588752 - RNA, 15 nt, Human
cggaggccccaaagg

SEQ ID NO: 2588753 - RNA, 13 nt, Human
cgggcccaggcca

SEQ ID NO: 2588754 - RNA, 23 nt, Human
cgggcccagcccccacagugcug

SEQ ID NO: 2588755 - RNA, 18 nt, Human
cgggcccagcccccacag

SEQ ID NO: 2588756 - RNA, 15 nt, Human
cgggcccagccccca

SEQ ID NO: 2588757 - RNA, 12 nt, Human
cgggcccagccc

SEQ ID NO: 2588758 - RNA, 20 nt, Human
cgggcccaccuggccaccug

SEQ ID NO: 2588759 - RNA, 19 nt, Human
cgggcccaccuggccaccu

SEQ ID NO: 2588760 - RNA, 18 nt, Human
cgggcccaccuggccacc

SEQ ID NO: 2588761 - RNA, 17 nt, Human
cgggcccaccuggccac

SEQ ID NO: 2588762 - RNA, 16 nt, Human
cgggcccaccuggcca

SEQ ID NO: 2588763 - RNA, 15 nt, Human
cgggcccaccuggcc

SEQ ID NO: 2588764 - RNA, 13 nt, Human
cgggcccaccugg

SEQ ID NO: 2588765 - RNA, 11 nt, Human
cgggcccaccu

SEQ ID NO: 2588766 - RNA, 17 nt, Human
cgggcccucccuuggaa

SEQ ID NO: 2588767 - RNA, 11 nt, Human
cgggcccuccc

SEQ ID NO: 2588768 - RNA, 22 nt, Human
cgggcccguugaggaugaggcc

SEQ ID NO: 2588769 - RNA, 18 nt, Human
cgggcccguugaggauga

SEQ ID NO: 2588770 - RNA, 21 nt, Human
cgggcccuucccacaggacau

SEQ ID NO: 2588771 - RNA, 15 nt, Human
cgggcccaggccauc

SEQ ID NO: 2588772 - RNA, 23 nt, Human
cgggccccugggcuuggccugcu

SEQ ID NO: 2588773 - RNA, 15 nt, Human
cgggccccugggcuu

SEQ ID NO: 2588774 - RNA, 12 nt, Human
cgggccccucau

SEQ ID NO: 2588775 - RNA, 16 nt, Human
cgggccagccaggcgg

SEQ ID NO: 2588776 - RNA, 15 nt, Human
cgggccagccaggcg

SEQ ID NO: 2588777 - RNA, 14 nt, Human
cgggccagccaggc

SEQ ID NO: 2588778 - RNA, 13 nt, Human
cgggccagccagg

SEQ ID NO: 2588779 - RNA, 21 nt, Human
cgggccagccaggcgggcuca

SEQ ID NO: 2588780 - RNA, 20 nt, Human
cgggccagccaggcgggcuc

SEQ ID NO: 2588781 - RNA, 18 nt, Human
cgggccagccaggcgggc

SEQ ID NO: 2588782 - RNA, 17 nt, Human
cgggccagccaggcggg

SEQ ID NO: 2588783 - RNA, 23 nt, Human
cgggccagccaggcgggcucaag

SEQ ID NO: 2588784 - RNA, 21 nt, Human
cggcuacucagcagcccuccu

SEQ ID NO: 2588785 - RNA, 12 nt, Human
cggcuacucagc

SEQ ID NO: 2588786 - RNA, 13 nt, Human
cggcuacucagca

SEQ ID NO: 2588787 - RNA, 14 nt, Human
cggcuacucagcag

SEQ ID NO: 2588788 - RNA, 16 nt, Human
cggcuacucagcagcc

SEQ ID NO: 2588789 - RNA, 18 nt, Human
cggcuacucagcagcccu

SEQ ID NO: 2588790 - RNA, 19 nt, Human
cggcuacucagcagcccuc

SEQ ID NO: 2588791 - RNA, 20 nt, Human
cggcuacucagcagcccucc

SEQ ID NO: 2588792 - RNA, 19 nt, Human
cgggccgacggagccggga

SEQ ID NO: 2588793 - RNA, 18 nt, Human
cgggcucagggaccacag

SEQ ID NO: 2588794 - RNA, 16 nt, Human
cgggcuccugugcccu

SEQ ID NO: 2588795 - RNA, 15 nt, Human
cgggcuccugugccc

SEQ ID NO: 2588796 - RNA, 14 nt, Human
cgggcuccugugcc

SEQ ID NO: 2588797 - RNA, 20 nt, Human
cgggcucagggaccacagca

SEQ ID NO: 2588798 - RNA, 14 nt, Human
cgggcucucugcug

SEQ ID NO: 2588799 - RNA, 15 nt, Human
cgggcucucugcugu

SEQ ID NO: 2588800 - RNA, 20 nt, Human
cgggccuggagaacuagaga

SEQ ID NO: 2588801 - RNA, 16 nt, Human
cgggccuggagaacua

SEQ ID NO: 2588802 - RNA, 19 nt, Human
cgggcucagcaaaagaugc

SEQ ID NO: 2588803 - RNA, 16 nt, Human
cgggcugccugggcug

SEQ ID NO: 2588804 - RNA, 15 nt, Human
cgggcugccugggcu

SEQ ID NO: 2588805 - RNA, 14 nt, Human
cgggcugccugggc

SEQ ID NO: 2588806 - RNA, 17 nt, Human
cgggcuccugugcccuu

SEQ ID NO: 2588807 - RNA, 13 nt, Human
cgggcugccuggg

SEQ ID NO: 2588808 - RNA, 12 nt, Human
cgggcucugccu

SEQ ID NO: 2588809 - RNA, 20 nt, Human
cgggcugggagcucugcaga

SEQ ID NO: 2588810 - RNA, 16 nt, Human
cgggcugggagcucug

SEQ ID NO: 2588811 - RNA, 17 nt, Human
cgggcugggcagcuguu

SEQ ID NO: 2588812 - RNA, 16 nt, Human
cgggcugggcagcugu

SEQ ID NO: 2588813 - RNA, 15 nt, Human
cgggcugggcagcug

SEQ ID NO: 2588814 - RNA, 14 nt, Human
cgggcugggcagcu

SEQ ID NO: 2588815 - RNA, 23 nt, Human
cguagaaguuuuuguacuguaaa

SEQ ID NO: 2588816 - RNA, 19 nt, Human
cguagaaguuuuuguacug

SEQ ID NO: 2588817 - RNA, 18 nt, Human
cguagaaguuuuuguacu

SEQ ID NO: 2588818 - RNA, 22 nt, Human
cguacuuagcagcuaucucuca

SEQ ID NO: 2588819 - RNA, 16 nt, Human
cguaaguuuaaaggau

SEQ ID NO: 2588820 - RNA, 22 nt, Human
cguacacauuuuauuuuauuau

SEQ ID NO: 2588821 - RNA, 22 nt, Human
cguacaguucuucgggaagaga

SEQ ID NO: 2588822 - RNA, 13 nt, Human
cguacaguucuuc

SEQ ID NO: 2588823 - RNA, 14 nt, Human
cguacaugugaggc

SEQ ID NO: 2588824 - RNA, 15 nt, Human
cguaccccacccuca

SEQ ID NO: 2588825 - RNA, 14 nt, Human
cguaccccacccuc

SEQ ID NO: 2588826 - RNA, 13 nt, Human
cguaccccacccu

SEQ ID NO: 2588827 - RNA, 17 nt, Human
cguacauucaauguuua

SEQ ID NO: 2588828 - RNA, 19 nt, Human
cguaacccaacucuccugg

SEQ ID NO: 2588829 - RNA, 14 nt, Human
cguaacccaacucu

SEQ ID NO: 2588830 - RNA, 12 nt, Human
cguaacccaacu

SEQ ID NO: 2588831 - RNA, 23 nt, Human
cguaaccagccagauccucuugg

SEQ ID NO: 2588832 - RNA, 14 nt, Human
cguaaccagccaga

SEQ ID NO: 2588833 - RNA, 13 nt, Human
cguaaccagccag

SEQ ID NO: 2588834 - RNA, 12 nt, Human
cguaaccagcca

SEQ ID NO: 2588835 - RNA, 15 nt, Human
cguaacuggcugugu

SEQ ID NO: 2588836 - RNA, 20 nt, Human
cguaaauacacaacacacac

SEQ ID NO: 2588837 - RNA, 15 nt, Human
cguaaccacggaaaa

SEQ ID NO: 2588838 - RNA, 20 nt, Human
cgguggcugacaccuguaau

SEQ ID NO: 2588839 - RNA, 16 nt, Human
cguaaagcuagaaaug

SEQ ID NO: 2588840 - RNA, 17 nt, Human
cguaaagcuagaaauga

SEQ ID NO: 2588841 - RNA, 23 nt, Human
cggugggcacccacccugggacc

SEQ ID NO: 2588842 - RNA, 19 nt, Human
cggugggcacccacccugg

SEQ ID NO: 2588843 - RNA, 12 nt, Human
cgggcugugccc

SEQ ID NO: 2588844 - RNA, 15 nt, Human
cgggcuuuuccccgg

SEQ ID NO: 2588845 - RNA, 14 nt, Human
cggggaacuccugg

SEQ ID NO: 2588846 - RNA, 15 nt, Human
cggggaacuccugga

SEQ ID NO: 2588847 - RNA, 20 nt, Human
cgguggcuagucaagcuccu

SEQ ID NO: 2588848 - RNA, 21 nt, Human
cgguggcuagucaagcuccuc

SEQ ID NO: 2588849 - RNA, 11 nt, Human
cgguggcucac

SEQ ID NO: 2588850 - RNA, 22 nt, Human
cgguggcuagucaagcuccucc

SEQ ID NO: 2588851 - RNA, 20 nt, Human
cgguggcucaggccuauaac

SEQ ID NO: 2588852 - RNA, 18 nt, Human
cggugggcacccacccug

SEQ ID NO: 2588853 - RNA, 15 nt, Human
cggugggcacccacc

SEQ ID NO: 2588854 - RNA, 20 nt, Human
cgguggcucacgccuguaau

SEQ ID NO: 2588855 - RNA, 23 nt, Human
cuaagacuccucggccuggcucc

SEQ ID NO: 2588856 - RNA, 22 nt, Human
cuaagacuccucggccuggcuc

SEQ ID NO: 2588857 - RNA, 11 nt, Human
cuaagagaagu

SEQ ID NO: 2588858 - RNA, 16 nt, Human
cuaagagaaguuauuu

SEQ ID NO: 2588859 - RNA, 17 nt, Human
cuaagaauucaaacugg

SEQ ID NO: 2588860 - RNA, 14 nt, Human
cuaagacuacagca

SEQ ID NO: 2588861 - RNA, 18 nt, Human
cuaauuucuccucccuuc

SEQ ID NO: 2588862 - RNA, 20 nt, Human
cuaauuucuccucccuuccu

SEQ ID NO: 2588863 - RNA, 15 nt, Human
cuaauuugauguuua

SEQ ID NO: 2588864 - RNA, 13 nt, Human
cuaauuugcauua

SEQ ID NO: 2588865 - RNA, 14 nt, Human
cuaauuugcauuaa

SEQ ID NO: 2588866 - RNA, 12 nt, Human
cuaauuugcauu

SEQ ID NO: 2588867 - RNA, 16 nt, Human
cuaauuugauguuuac

SEQ ID NO: 2588868 - RNA, 13 nt, Human
cuaauaaaagcau

SEQ ID NO: 2588869 - RNA, 20 nt, Human
cuacaaaaacacagcaaggg

SEQ ID NO: 2588870 - RNA, 19 nt, Human
cuacaaaaagcauaaaaau

SEQ ID NO: 2588871 - RNA, 19 nt, Human
cuaauuugcauuaaauuca

SEQ ID NO: 2588872 - RNA, 21 nt, Human
cuaauuugcauuaaauucaca

SEQ ID NO: 2588873 - RNA, 19 nt, Human
cuaauuucuccucccuucc

SEQ ID NO: 2588874 - RNA, 22 nt, Human
cuaauuugcauuaaauucacaa

SEQ ID NO: 2588875 - RNA, 12 nt, Human
cuaauuuuuaag

SEQ ID NO: 2588876 - RNA, 13 nt, Human
cuaaguuucaguu

SEQ ID NO: 2588877 - RNA, 20 nt, Human
cuaaguuccacugagcucca

SEQ ID NO: 2588878 - RNA, 18 nt, Human
cuaaguuccacugagcuc

SEQ ID NO: 2588879 - RNA, 13 nt, Human
cuaaguauuuccc

SEQ ID NO: 2588880 - RNA, 16 nt, Human
cuaaguauuucccagc

SEQ ID NO: 2588881 - RNA, 14 nt, Human
cuaaguauuuccca

SEQ ID NO: 2588882 - RNA, 17 nt, Human
cuaaguauuucccagca

SEQ ID NO: 2588883 - RNA, 15 nt, Human
cuaaguccuuuaugu

SEQ ID NO: 2588884 - RNA, 10 nt, Human
cuaauaaaac

SEQ ID NO: 2588885 - RNA, 14 nt, Human
cuaaguuuuuaugg

SEQ ID NO: 2588886 - RNA, 19 nt, Human
cuaaguuucaguugauuuu

SEQ ID NO: 2588887 - RNA, 15 nt, Human
cgugacaacacuugu

SEQ ID NO: 2588888 - RNA, 14 nt, Human
cgugacaacacuug

SEQ ID NO: 2588889 - RNA, 20 nt, Human
cgugagccacugcaccgggc

SEQ ID NO: 2588890 - RNA, 15 nt, Human
cgugagccacugcac

SEQ ID NO: 2588891 - RNA, 19 nt, Human
cgugacaauaaaacauuaa

SEQ ID NO: 2588892 - RNA, 17 nt, Human
cgugacaauaaaacauu

SEQ ID NO: 2588893 - RNA, 14 nt, Human
cgugagccacugca

SEQ ID NO: 2588894 - RNA, 14 nt, Human
cgugaggccagaga

SEQ ID NO: 2588895 - RNA, 19 nt, Human
cgugagcgacaaagaugau

SEQ ID NO: 2588896 - RNA, 15 nt, Human
cgugagcucuuguga

SEQ ID NO: 2588897 - RNA, 19 nt, Human
cgugaggaugucacucaga

SEQ ID NO: 2588898 - RNA, 21 nt, Human
cgugagccagguaaugaggga

SEQ ID NO: 2588899 - RNA, 13 nt, Human
cgugagccaggua

SEQ ID NO: 2588900 - RNA, 12 nt, Human
cgugagccaggu

SEQ ID NO: 2588901 - RNA, 16 nt, Human
cgugacagacuccuga

SEQ ID NO: 2588902 - RNA, 15 nt, Human
cgugacagacuccug

SEQ ID NO: 2588903 - RNA, 22 nt, Human
cgugagccacugcaccgggcca

SEQ ID NO: 2588904 - RNA, 20 nt, Human
cuaacgaaguauccuucagc

SEQ ID NO: 2588905 - RNA, 19 nt, Human
cuaaaguguauuuuuuuac

SEQ ID NO: 2588906 - RNA, 15 nt, Human
cuaaagugagcucua

SEQ ID NO: 2588907 - RNA, 20 nt, Human
cuaacgacuucagggcaggg

SEQ ID NO: 2588908 - RNA, 17 nt, Human
cuaacguugagccccug

SEQ ID NO: 2588909 - RNA, 15 nt, Human
cuaacguaaauacac

SEQ ID NO: 2588910 - RNA, 23 nt, Human
cuaaaguaaaaacaaagaaauua

SEQ ID NO: 2588911 - RNA, 17 nt, Human
cuaaagcccaaccuccu

SEQ ID NO: 2588912 - RNA, 19 nt, Human
cuaaagguguugucccuuc

SEQ ID NO: 2588913 - RNA, 20 nt, Human
cuaaagguguugucccuucu

SEQ ID NO: 2588914 - RNA, 20 nt, Human
cuaaaguauguaaaguaugu

SEQ ID NO: 2588915 - RNA, 16 nt, Human
cuaaaguauguaaagu

SEQ ID NO: 2588916 - RNA, 15 nt, Human
cuaaaguaugaagca

SEQ ID NO: 2588917 - RNA, 17 nt, Human
cuaaaguagacuucauu

SEQ ID NO: 2588918 - RNA, 22 nt, Human
cuaacuugucuuuggacccuga

SEQ ID NO: 2588919 - RNA, 14 nt, Human
cuaacuugucuuug

SEQ ID NO: 2588920 - RNA, 22 nt, Human
cuaacguugagccccuggaggc

SEQ ID NO: 2588921 - RNA, 19 nt, Human
cuaacuaaacucucuuugg

SEQ ID NO: 2588922 - RNA, 13 nt, Human
cuaacuaaacucu

SEQ ID NO: 2588923 - RNA, 12 nt, Human
cuaacuaaacuc

SEQ ID NO: 2588924 - RNA, 17 nt, Human
cuaacuuggagccccag

SEQ ID NO: 2588925 - RNA, 20 nt, Human
cuaacuuggagccccagugc

SEQ ID NO: 2588926 - RNA, 21 nt, Human
cuaacuuggagccccagugcc

SEQ ID NO: 2588927 - RNA, 23 nt, Human
cuaagaagaaaauugcugugccu

SEQ ID NO: 2588928 - RNA, 15 nt, Human
cuaagaaccuggaac

SEQ ID NO: 2588929 - RNA, 16 nt, Human
cuaagaaccuggaacu

SEQ ID NO: 2588930 - RNA, 20 nt, Human
cuaagaaauaaaacuguuaa

SEQ ID NO: 2588931 - RNA, 21 nt, Human
cuaagaaagaggagugcuugu

SEQ ID NO: 2588932 - RNA, 14 nt, Human
cuaagaaccuggaa

SEQ ID NO: 2588933 - RNA, 20 nt, Human
cuaagaaagaggagugcuug

SEQ ID NO: 2588934 - RNA, 14 nt, Human
cuaacuuggagccg

SEQ ID NO: 2588935 - RNA, 22 nt, Human
cuaacuuggagccccagugcca

SEQ ID NO: 2588936 - RNA, 19 nt, Human
cuaagaaagaggagugcuu

SEQ ID NO: 2588937 - RNA, 20 nt, Human
cuaagaaauaugcacaauag

SEQ ID NO: 2588938 - RNA, 22 nt, Human
cuaagaaagcccuuaggaagaa

SEQ ID NO: 2588939 - RNA, 11 nt, Human
cuaaagcugcc

SEQ ID NO: 2588940 - RNA, 18 nt, Human
cuaaagcaguggacacca

SEQ ID NO: 2588941 - RNA, 20 nt, Human
cuaaagcaauaaugguccca

SEQ ID NO: 2588942 - RNA, 11 nt, Human
cuaaagcagug

SEQ ID NO: 2588943 - RNA, 20 nt, Human
cguucaccccuccacccuug

SEQ ID NO: 2588944 - RNA, 17 nt, Human
cguuagcuccuguggcc

SEQ ID NO: 2588945 - RNA, 16 nt, Human
cguuagcuccuguggc

SEQ ID NO: 2588946 - RNA, 15 nt, Human
cguuagcuccugugg

SEQ ID NO: 2588947 - RNA, 14 nt, Human
cguuagcuccugug

SEQ ID NO: 2588948 - RNA, 14 nt, Human
cguguuucugacuc

SEQ ID NO: 2588949 - RNA, 15 nt, Human
cguguuucugacucu

SEQ ID NO: 2588950 - RNA, 13 nt, Human
cguuagcuccugu

SEQ ID NO: 2588951 - RNA, 16 nt, Human
cguuaugguguuucuc

SEQ ID NO: 2588952 - RNA, 20 nt, Human
cguuagucgugagcucuugu

SEQ ID NO: 2588953 - RNA, 15 nt, Human
cguuauuguugacuu

SEQ ID NO: 2588954 - RNA, 16 nt, Human
cguuauuauaauugua

SEQ ID NO: 2588955 - RNA, 14 nt, Human
cguuauuauaauug

SEQ ID NO: 2588956 - RNA, 22 nt, Human
cguuauguguguauauguaugu

SEQ ID NO: 2588957 - RNA, 19 nt, Human
cguucaacuuuuccuuuga

SEQ ID NO: 2588958 - RNA, 15 nt, Human
cguucaccccuccac

SEQ ID NO: 2588959 - RNA, 18 nt, Human
cgugaguccuggcauggg

SEQ ID NO: 2588960 - RNA, 19 nt, Human
cgugaguccuggcauggga

SEQ ID NO: 2588961 - RNA, 14 nt, Human
cgugaguucucagg

SEQ ID NO: 2588962 - RNA, 19 nt, Human
cgugagugaaccaucauua

SEQ ID NO: 2588963 - RNA, 19 nt, Human
cgugaguucucagggcucc

SEQ ID NO: 2588964 - RNA, 18 nt, Human
cgugaguucucagggcuc

SEQ ID NO: 2588965 - RNA, 16 nt, Human
cgugaguucucagggc

SEQ ID NO: 2588966 - RNA, 15 nt, Human
cgugaguucucaggg

SEQ ID NO: 2588967 - RNA, 21 nt, Human
cgugaguucucagggcuccug

SEQ ID NO: 2588968 - RNA, 20 nt, Human
cgugaguucucagggcuccu

SEQ ID NO: 2588969 - RNA, 14 nt, Human
cgugaucaaagcca

SEQ ID NO: 2588970 - RNA, 19 nt, Human
cguguuaugacuccagaau

SEQ ID NO: 2588971 - RNA, 22 nt, Human
cguguugccuugaaccacuucc

SEQ ID NO: 2588972 - RNA, 15 nt, Human
cguguugccuugaac

SEQ ID NO: 2588973 - RNA, 16 nt, Human
cguguucuccuuuucc

SEQ ID NO: 2588974 - RNA, 15 nt, Human
cguguuaugacucca

SEQ ID NO: 2588975 - RNA, 18 nt, Human
cgugaucaaagccacacu

SEQ ID NO: 2588976 - RNA, 21 nt, Human
cgugaucaaagccacacucug

SEQ ID NO: 2588977 - RNA, 9 nt, Human
ccugcuggc

SEQ ID NO: 2588978 - RNA, 12 nt, Human
ccugcuggcccc

SEQ ID NO: 2588979 - RNA, 13 nt, Human
ccugcuggccccu

SEQ ID NO: 2588980 - RNA, 15 nt, Human
ccugcuggcacccac

SEQ ID NO: 2588981 - RNA, 19 nt, Human
ccugcuggcacccaccgug

SEQ ID NO: 2588982 - RNA, 11 nt, Human
ccugcuggccc

SEQ ID NO: 2588983 - RNA, 20 nt, Human
ccugcugcuguguuuuugcu

SEQ ID NO: 2588984 - RNA, 17 nt, Human
ccuguuaccuacuuuga

SEQ ID NO: 2588985 - RNA, 18 nt, Human
ccuguuaccuacuuugac

SEQ ID NO: 2588986 - RNA, 22 nt, Human
ccuguuacuugaaauaccagug

SEQ ID NO: 2588987 - RNA, 14 nt, Human
ccuguuacuuaccu

SEQ ID NO: 2588988 - RNA, 19 nt, Human
ccuguuaccuacuuugacu

SEQ ID NO: 2588989 - RNA, 23 nt, Human
ccuguuacuugaaauaccaguga

SEQ ID NO: 2588990 - RNA, 15 nt, Human
ccuguuagcagacag

SEQ ID NO: 2588991 - RNA, 16 nt, Human
ccuguuagcagacagg

SEQ ID NO: 2588992 - RNA, 21 nt, Human
ccuguucacucuacuuagcau

SEQ ID NO: 2588993 - RNA, 18 nt, Human
ccuguuagcuguuauuuc

SEQ ID NO: 2588994 - RNA, 13 nt, Human
ccuguucagcucc

SEQ ID NO: 2588995 - RNA, 23 nt, Human
ccuguuaccuaauuagagcagau

SEQ ID NO: 2588996 - RNA, 22 nt, Human
ccuguuaccuaauuagagcaga

SEQ ID NO: 2588997 - RNA, 21 nt, Human
ccuguuaccuaauuagagcag

SEQ ID NO: 2588998 - RNA, 19 nt, Human
ccuguucagcuccagcuca

SEQ ID NO: 2588999 - RNA, 16 nt, Human
ccuguucagcuccagc

SEQ ID NO: 2589000 - RNA, 15 nt, Human
ccuguucagcuccag

SEQ ID NO: 2589001 - RNA, 14 nt, Human
ccuguucagcucca

SEQ ID NO: 2589002 - RNA, 21 nt, Human
ccuguucagcuccagcucacc

SEQ ID NO: 2589003 - RNA, 20 nt, Human
ccuguucagcuccagcucac

SEQ ID NO: 2589004 - RNA, 23 nt, Human
ccuguucagcuccagcucaccag

SEQ ID NO: 2589005 - RNA, 20 nt, Human
ccuguucaguuacagaaagu

SEQ ID NO: 2589006 - RNA, 19 nt, Human
ccuguucaguuacagaaag

SEQ ID NO: 2589007 - RNA, 17 nt, Human
ccuguucaguuacagaa

SEQ ID NO: 2589008 - RNA, 15 nt, Human
ccuguucaguuacag

SEQ ID NO: 2589009 - RNA, 11 nt, Human
ccuguucaguu

SEQ ID NO: 2589010 - RNA, 19 nt, Human
ccuguucagugucccgggc

SEQ ID NO: 2589011 - RNA, 17 nt, Human
ccuguucuggcagaguu

SEQ ID NO: 2589012 - RNA, 12 nt, Human
ccuguucuggca

SEQ ID NO: 2589013 - RNA, 16 nt, Human
ccuguucugcuuuccu

SEQ ID NO: 2589014 - RNA, 17 nt, Human
ccuguugacacaggucu

SEQ ID NO: 2589015 - RNA, 19 nt, Human
ccuguugacacaggucuuu

SEQ ID NO: 2589016 - RNA, 22 nt, Human
ccuguugacacaggucuuuccu

SEQ ID NO: 2589017 - RNA, 13 nt, Human
ccuguucugaacu

SEQ ID NO: 2589018 - RNA, 14 nt, Human
ccuguucugaacug

SEQ ID NO: 2589019 - RNA, 21 nt, Human
ccuguucugaacuguggggug

SEQ ID NO: 2589020 - RNA, 22 nt, Human
ccuguuccccucacuggaugaa

SEQ ID NO: 2589021 - RNA, 18 nt, Human
ccuguuccccucacugga

SEQ ID NO: 2589022 - RNA, 15 nt, Human
ccuguuccccagaga

SEQ ID NO: 2589023 - RNA, 16 nt, Human
ccuguuccccagagaa

SEQ ID NO: 2589024 - RNA, 17 nt, Human
ccuguuccccucacugg

SEQ ID NO: 2589025 - RNA, 22 nt, Human
ccuguucccccgccgcuuuucu

SEQ ID NO: 2589026 - RNA, 23 nt, Human
ccuguuccccagagaaaggggag

SEQ ID NO: 2589027 - RNA, 18 nt, Human
ccuguucccaugagauga

SEQ ID NO: 2589028 - RNA, 12 nt, Human
ccuguucccauu

SEQ ID NO: 2589029 - RNA, 13 nt, Human
ccuguuccccaga

SEQ ID NO: 2589030 - RNA, 20 nt, Human
ccuguugggccaggagccuc

SEQ ID NO: 2589031 - RNA, 19 nt, Human
ccuguugggccaggagccu

SEQ ID NO: 2589032 - RNA, 18 nt, Human
ccuguugggccaggagcc

SEQ ID NO: 2589033 - RNA, 17 nt, Human
ccuguugggccaggagc

SEQ ID NO: 2589034 - RNA, 17 nt, Human
ccuguugcacccagccc

SEQ ID NO: 2589035 - RNA, 16 nt, Human
ccuguugcacccagcc

SEQ ID NO: 2589036 - RNA, 15 nt, Human
ccuguugcacccagc

SEQ ID NO: 2589037 - RNA, 14 nt, Human
ccuguugcacccag

SEQ ID NO: 2589038 - RNA, 23 nt, Human
ccuguugacgaagucucuuuucu

SEQ ID NO: 2589039 - RNA, 20 nt, Human
ccuguugacgaagucucuuu

SEQ ID NO: 2589040 - RNA, 21 nt, Human
ccuguugcacccagcccuggu

SEQ ID NO: 2589041 - RNA, 20 nt, Human
ccuguugcacccagcccugg

SEQ ID NO: 2589042 - RNA, 19 nt, Human
ccuguugcacccagcccug

SEQ ID NO: 2589043 - RNA, 18 nt, Human
ccuguugcacccagcccu

SEQ ID NO: 2589044 - RNA, 23 nt, Human
ccuguugcacccagcccuggucu

SEQ ID NO: 2589045 - RNA, 22 nt, Human
ccuguugcacccagcccugguc

SEQ ID NO: 2589046 - RNA, 12 nt, Human
ccuguugcuaag

SEQ ID NO: 2589047 - RNA, 16 nt, Human
ccuguugggccaggag

SEQ ID NO: 2589048 - RNA, 14 nt, Human
ccuguugcuaagcc

SEQ ID NO: 2589049 - RNA, 13 nt, Human
ccuguugcuaagc

SEQ ID NO: 2589050 - RNA, 22 nt, Human
ccuguugcuaagccccagcaag

SEQ ID NO: 2589051 - RNA, 16 nt, Human
ccuguugcuuacaauu

SEQ ID NO: 2589052 - RNA, 20 nt, Human
ccuuagcagggaaacagcua

SEQ ID NO: 2589053 - RNA, 19 nt, Human
ccuuagcagggaaacagcu

SEQ ID NO: 2589054 - RNA, 16 nt, Human
ccuuagcaaauucugu

SEQ ID NO: 2589055 - RNA, 24 nt, Human
ccuguuggauuuguuuaaaaggau

SEQ ID NO: 2589056 - RNA, 17 nt, Human
ccuguuggauuuguuua

SEQ ID NO: 2589057 - RNA, 23 nt, Human
ccuguuggacccgcucuggacca

SEQ ID NO: 2589058 - RNA, 20 nt, Human
ccuguuggacccgcucugga

SEQ ID NO: 2589059 - RNA, 17 nt, Human
ccuguugcuuacaauuu

SEQ ID NO: 2589060 - RNA, 19 nt, Human
ccuguuggacccgcucugg

SEQ ID NO: 2589061 - RNA, 20 nt, Human
ccuuagcacuaccacuccug

SEQ ID NO: 2589062 - RNA, 22 nt, Human
ccuuagcacaggggggccgccg

SEQ ID NO: 2589063 - RNA, 19 nt, Human
ccuuagcauguuugcugaa

SEQ ID NO: 2589064 - RNA, 16 nt, Human
ccuuagcauguuugcu

SEQ ID NO: 2589065 - RNA, 10 nt, Human
ccuuagccag

SEQ ID NO: 2589066 - RNA, 15 nt, Human
ccuuagcccccaccc

SEQ ID NO: 2589067 - RNA, 21 nt, Human
ccuuagcccccacccacuucc

SEQ ID NO: 2589068 - RNA, 18 nt, Human
ccuuagcccccacccacu

SEQ ID NO: 2589069 - RNA, 14 nt, Human
ccuuagccucccug

SEQ ID NO: 2589070 - RNA, 15 nt, Human
ccuuagccucccuga

SEQ ID NO: 2589071 - RNA, 16 nt, Human
ccuuagccucccugaa

SEQ ID NO: 2589072 - RNA, 19 nt, Human
ccuuagcuggcauuacagc

SEQ ID NO: 2589073 - RNA, 22 nt, Human
ccuuagcuggcauuacagcugg

SEQ ID NO: 2589074 - RNA, 17 nt, Human
ccuuagcuuagaccuca

SEQ ID NO: 2589075 - RNA, 18 nt, Human
ccuuagcuuagaccucag

SEQ ID NO: 2589076 - RNA, 19 nt, Human
ccuucccaccucucucacu

SEQ ID NO: 2589077 - RNA, 14 nt, Human
ccuucccaccucuc

SEQ ID NO: 2589078 - RNA, 22 nt, Human
ccuucccacccaucgcugugug

SEQ ID NO: 2589079 - RNA, 15 nt, Human
ccuuauucaggaaaa

SEQ ID NO: 2589080 - RNA, 12 nt, Human
ccuucccaccuc

SEQ ID NO: 2589081 - RNA, 17 nt, Human
ccuucccacucaccccg

SEQ ID NO: 2589082 - RNA, 15 nt, Human
ccuucccacucaccc

SEQ ID NO: 2589083 - RNA, 18 nt, Human
ccuucccacucaccccgg

SEQ ID NO: 2589084 - RNA, 12 nt, Human
ccuucccagcuc

SEQ ID NO: 2589085 - RNA, 13 nt, Human
ccuucccagcucu

SEQ ID NO: 2589086 - RNA, 14 nt, Human
ccuucccagcucuc

SEQ ID NO: 2589087 - RNA, 17 nt, Human
ccuucccagcucucccu

SEQ ID NO: 2589088 - RNA, 18 nt, Human
ccuucccagcucucccuc

SEQ ID NO: 2589089 - RNA, 15 nt, Human
ccuucccaugcccug

SEQ ID NO: 2589090 - RNA, 21 nt, Human
ccuucccaugacccaggcugg

SEQ ID NO: 2589091 - RNA, 18 nt, Human
ccuucccaugacccaggc

SEQ ID NO: 2589092 - RNA, 15 nt, Human
ccuucccaucucuuc

SEQ ID NO: 2589093 - RNA, 22 nt, Human
ccuucccagcucucccucuggc

SEQ ID NO: 2589094 - RNA, 15 nt, Human
ccuucccaucgcugu

SEQ ID NO: 2589095 - RNA, 14 nt, Human
ccuucccaucgcug

SEQ ID NO: 2589096 - RNA, 19 nt, Human
ccuucccagcucucccucu

SEQ ID NO: 2589097 - RNA, 21 nt, Human
ccuucccagcucucccucugg

SEQ ID NO: 2589098 - RNA, 19 nt, Human
ccuucccaggaguggagga

SEQ ID NO: 2589099 - RNA, 18 nt, Human
ccuuauggaacacucuga

SEQ ID NO: 2589100 - RNA, 17 nt, Human
ccuuauggaacacucug

SEQ ID NO: 2589101 - RNA, 16 nt, Human
ccuuauggaacacucu

SEQ ID NO: 2589102 - RNA, 14 nt, Human
ccuuauggaacacu

SEQ ID NO: 2589103 - RNA, 20 nt, Human
ccuuauggaacacucugaga

SEQ ID NO: 2589104 - RNA, 19 nt, Human
ccuuauggaacacucugag

SEQ ID NO: 2589105 - RNA, 22 nt, Human
ccuuauggaacacucugagacu

SEQ ID NO: 2589106 - RNA, 16 nt, Human
ccuuauuagagugucu

SEQ ID NO: 2589107 - RNA, 21 nt, Human
ccuuauuagagugucuuucca

SEQ ID NO: 2589108 - RNA, 22 nt, Human
ccuuauuacacggaaaacggug

SEQ ID NO: 2589109 - RNA, 21 nt, Human
ccuuaucugugcgugaaacac

SEQ ID NO: 2589110 - RNA, 19 nt, Human
ccuuaguguuucugugcau

SEQ ID NO: 2589111 - RNA, 16 nt, Human
ccuuaguguuucugug

SEQ ID NO: 2589112 - RNA, 14 nt, Human
ccuuaguguuucug

SEQ ID NO: 2589113 - RNA, 12 nt, Human
ccuuaguguuuc

SEQ ID NO: 2589114 - RNA, 20 nt, Human
ccuuaguguuucugugcaug

SEQ ID NO: 2589115 - RNA, 13 nt, Human
ccuuaucaaagga

SEQ ID NO: 2589116 - RNA, 20 nt, Human
ccuuagucucaguuugugug

SEQ ID NO: 2589117 - RNA, 14 nt, Human
ccuuagucucaguu

SEQ ID NO: 2589118 - RNA, 20 nt, Human
ccuuagguuuuuuuccuucu

SEQ ID NO: 2589119 - RNA, 20 nt, Human
ccuuaguggcuuuuuuccuc

SEQ ID NO: 2589120 - RNA, 16 nt, Human
ccuuaguggcuuuuuu

SEQ ID NO: 2589121 - RNA, 14 nt, Human
ccuuagucuucuca

SEQ ID NO: 2589122 - RNA, 14 nt, Human
ccuuaguacugagu

SEQ ID NO: 2589123 - RNA, 13 nt, Human
ccuuagucuucuc

SEQ ID NO: 2589124 - RNA, 23 nt, Human
ccuuagcuuagaccucagccugu

SEQ ID NO: 2589125 - RNA, 13 nt, Human
ccuuaggcaggga

SEQ ID NO: 2589126 - RNA, 15 nt, Human
ccuuaggcagggaag

SEQ ID NO: 2589127 - RNA, 19 nt, Human
ccuuagcuuagaccucagc

SEQ ID NO: 2589128 - RNA, 20 nt, Human
ccuuagcuuagaccucagcc

SEQ ID NO: 2589129 - RNA, 21 nt, Human
ccuuagcuuagaccucagccu

SEQ ID NO: 2589130 - RNA, 22 nt, Human
ccuuagcuuagaccucagccug

SEQ ID NO: 2589131 - RNA, 23 nt, Human
ccuuaggccuuccucucuccaga

SEQ ID NO: 2589132 - RNA, 20 nt, Human
ccuuaggugauccacucgcc

SEQ ID NO: 2589133 - RNA, 14 nt, Human
ccuuaggccuuccu

SEQ ID NO: 2589134 - RNA, 15 nt, Human
ccuuaggccuuccuc

SEQ ID NO: 2589135 - RNA, 13 nt, Human
ccuuaggccuucc

SEQ ID NO: 2589136 - RNA, 16 nt, Human
ccuuaggcagggaagu

SEQ ID NO: 2589137 - RNA, 20 nt, Human
ccuuaucaccagcugccucu

SEQ ID NO: 2589138 - RNA, 13 nt, Human
ccuuaucaccagc

SEQ ID NO: 2589139 - RNA, 16 nt, Human
ccuuaucaagugucuu

SEQ ID NO: 2589140 - RNA, 15 nt, Human
ccuuaucaagugucu

SEQ ID NO: 2589141 - RNA, 14 nt, Human
ccuuaucaaguguc

SEQ ID NO: 2589142 - RNA, 13 nt, Human
ccuuaucaagugu

SEQ ID NO: 2589143 - RNA, 12 nt, Human
ccuuaucaagug

SEQ ID NO: 2589144 - RNA, 14 nt, Human
ccuuaucaaaggac

SEQ ID NO: 2589145 - RNA, 18 nt, Human
ccuuaucaaaggacacca

SEQ ID NO: 2589146 - RNA, 13 nt, Human
ccuuauccucuga

SEQ ID NO: 2589147 - RNA, 17 nt, Human
ccuuauccaggacucug

SEQ ID NO: 2589148 - RNA, 15 nt, Human
ccuuauccaggacuc

SEQ ID NO: 2589149 - RNA, 14 nt, Human
ccuuauccaggacu

SEQ ID NO: 2589150 - RNA, 13 nt, Human
ccuuauccaggac

SEQ ID NO: 2589151 - RNA, 17 nt, Human
ccuuaucauucauucuu

SEQ ID NO: 2589152 - RNA, 16 nt, Human
ccuuaucauucauucu

SEQ ID NO: 2589153 - RNA, 17 nt, Human
ccuuaucaccagcugcc

SEQ ID NO: 2589154 - RNA, 15 nt, Human
ccuuaucauucauuc

SEQ ID NO: 2589155 - RNA, 13 nt, Human
ccuuaucuugcac

SEQ ID NO: 2589156 - RNA, 15 nt, Human
ccuuaucugugcuca

SEQ ID NO: 2589157 - RNA, 17 nt, Human
ccuuaucugugcucagg

SEQ ID NO: 2589158 - RNA, 12 nt, Human
ccuuauggaaca

SEQ ID NO: 2589159 - RNA, 18 nt, Human
ccuuauccucugaucucc

SEQ ID NO: 2589160 - RNA, 15 nt, Human
ccuuauccucugauc

SEQ ID NO: 2589161 - RNA, 16 nt, Human
ccuuauccucugaucu

SEQ ID NO: 2589162 - RNA, 13 nt, Human
ccuuaucugugcg

SEQ ID NO: 2589163 - RNA, 20 nt, Human
ccuuaucugugcgugaaaca

SEQ ID NO: 2589164 - RNA, 16 nt, Human
ccuuaucuccaagacc

SEQ ID NO: 2589165 - RNA, 22 nt, Human
ccuuaucuccaagaccagagau

SEQ ID NO: 2589166 - RNA, 18 nt, Human
ccuugcacacucagaagc

SEQ ID NO: 2589167 - RNA, 19 nt, Human
ccuugcacacuccccugca

SEQ ID NO: 2589168 - RNA, 22 nt, Human
ccuugcacacuccccugcacug

SEQ ID NO: 2589169 - RNA, 15 nt, Human
ccuugcaagaaucag

SEQ ID NO: 2589170 - RNA, 17 nt, Human
ccuugcaccccucacuc

SEQ ID NO: 2589171 - RNA, 14 nt, Human
ccuugcaccccuca

SEQ ID NO: 2589172 - RNA, 13 nt, Human
ccuugcaccccuc

SEQ ID NO: 2589173 - RNA, 14 nt, Human
ccuugcacauagua

SEQ ID NO: 2589174 - RNA, 18 nt, Human
ccuugcaccccucacucu

SEQ ID NO: 2589175 - RNA, 12 nt, Human
ccuugcaccugc

SEQ ID NO: 2589176 - RNA, 13 nt, Human
ccuugcaccugca

SEQ ID NO: 2589177 - RNA, 14 nt, Human
ccuugcaccugcau

SEQ ID NO: 2589178 - RNA, 16 nt, Human
ccuugcaccugcaucc

SEQ ID NO: 2589179 - RNA, 21 nt, Human
ccuugcagcacucacacagga

SEQ ID NO: 2589180 - RNA, 20 nt, Human
ccuugcagcacucacacagg

SEQ ID NO: 2589181 - RNA, 15 nt, Human
ccuugcagcuaguuu

SEQ ID NO: 2589182 - RNA, 17 nt, Human
ccuugcaguucagcacc

SEQ ID NO: 2589183 - RNA, 19 nt, Human
ccuugcaguucagcaccac

SEQ ID NO: 2589184 - RNA, 20 nt, Human
ccuugcaguucagcaccacc

SEQ ID NO: 2589185 - RNA, 22 nt, Human
ccuugcaguucagcaccacccu

SEQ ID NO: 2589186 - RNA, 14 nt, Human
ccuugcauaauggu

SEQ ID NO: 2589187 - RNA, 19 nt, Human
ccuugccaccccacccucc

SEQ ID NO: 2589188 - RNA, 17 nt, Human
ccuugccaccccacccu

SEQ ID NO: 2589189 - RNA, 13 nt, Human
ccuugccacccca

SEQ ID NO: 2589190 - RNA, 23 nt, Human
ccuugcaguucagcaccacccua

SEQ ID NO: 2589191 - RNA, 23 nt, Human
ccuuuauguggaaaacagaacau

SEQ ID NO: 2589192 - RNA, 19 nt, Human
ccuuuauguggaaaacaga

SEQ ID NO: 2589193 - RNA, 22 nt, Human
ccuuuauaaugaggaugauuau

SEQ ID NO: 2589194 - RNA, 19 nt, Human
ccuuuauauuuagugaacu

SEQ ID NO: 2589195 - RNA, 23 nt, Human
ccuugcucaaccauggcugaagg

SEQ ID NO: 2589196 - RNA, 18 nt, Human
ccuuuaguaccugaaaag

SEQ ID NO: 2589197 - RNA, 19 nt, Human
ccuuuaguaccugaaaagu

SEQ ID NO: 2589198 - RNA, 18 nt, Human
ccuuuagugguggccauu

SEQ ID NO: 2589199 - RNA, 18 nt, Human
ccuugcucgcuguaaaau

SEQ ID NO: 2589200 - RNA, 21 nt, Human
ccuugcggggauaaagagaga

SEQ ID NO: 2589201 - RNA, 20 nt, Human
ccuugcgguauccgccccca

SEQ ID NO: 2589202 - RNA, 14 nt, Human
ccuugcuacccaga

SEQ ID NO: 2589203 - RNA, 11 nt, Human
ccuugcuaccu

SEQ ID NO: 2589204 - RNA, 12 nt, Human
ccuugcuaccuc

SEQ ID NO: 2589205 - RNA, 14 nt, Human
ccuugcuaccucaa

SEQ ID NO: 2589206 - RNA, 17 nt, Human
ccuugcuaccucaaggg

SEQ ID NO: 2589207 - RNA, 16 nt, Human
ccuugccagagaucca

SEQ ID NO: 2589208 - RNA, 23 nt, Human
ccuugccaccccacccucccugg

SEQ ID NO: 2589209 - RNA, 12 nt, Human
ccuugccagaga

SEQ ID NO: 2589210 - RNA, 13 nt, Human
ccuugccagagau

SEQ ID NO: 2589211 - RNA, 24 nt, Human
ccuugccaccccacccucccugga

SEQ ID NO: 2589212 - RNA, 13 nt, Human
ccuugccagacau

SEQ ID NO: 2589213 - RNA, 21 nt, Human
ccuugccaggguuucgagaag

SEQ ID NO: 2589214 - RNA, 21 nt, Human
ccuugccugaacauccuuccu

SEQ ID NO: 2589215 - RNA, 16 nt, Human
ccuugccuccugugua

SEQ ID NO: 2589216 - RNA, 15 nt, Human
ccuugccuccugugu

SEQ ID NO: 2589217 - RNA, 23 nt, Human
ccuugccugaacauccuuccuuc

SEQ ID NO: 2589218 - RNA, 15 nt, Human
ccuugcgcuguugcg

SEQ ID NO: 2589219 - RNA, 21 nt, Human
ccuugcgcuuuugcuggucac

SEQ ID NO: 2589220 - RNA, 17 nt, Human
ccuuucaauaggaaaaa

SEQ ID NO: 2589221 - RNA, 18 nt, Human
ccuuucaauaggaaaaac

SEQ ID NO: 2589222 - RNA, 15 nt, Human
ccuuucaaauuucac

SEQ ID NO: 2589223 - RNA, 16 nt, Human
ccuuucaaauuucaca

SEQ ID NO: 2589224 - RNA, 20 nt, Human
ccuuucccuccacuccuucc

SEQ ID NO: 2589225 - RNA, 15 nt, Human
ccuuucccuucuugg

SEQ ID NO: 2589226 - RNA, 12 nt, Human
ccuuucccuucu

SEQ ID NO: 2589227 - RNA, 12 nt, Human
ccuuucccucca

SEQ ID NO: 2589228 - RNA, 20 nt, Human
ccuuuauuguguuugucauu

SEQ ID NO: 2589229 - RNA, 15 nt, Human
ccuuuauuguguuug

SEQ ID NO: 2589230 - RNA, 13 nt, Human
ccuuuauugugau

SEQ ID NO: 2589231 - RNA, 12 nt, Human
ccuuuauugugu

SEQ ID NO: 2589232 - RNA, 14 nt, Human
ccuuuauucuggca

SEQ ID NO: 2589233 - RNA, 23 nt, Human
ccuuuauuacccccuccuucaga

SEQ ID NO: 2589234 - RNA, 14 nt, Human
ccuuuauuaaaauc

SEQ ID NO: 2589235 - RNA, 16 nt, Human
ccuuuauuaaaaucuu

SEQ ID NO: 2589236 - RNA, 15 nt, Human
ccuuucaauaggaaa

SEQ ID NO: 2589237 - RNA, 21 nt, Human
ccuuuauuguguuugucauua

SEQ ID NO: 2589238 - RNA, 13 nt, Human
ccuuuauuuuaga

SEQ ID NO: 2589239 - RNA, 19 nt, Human
ccuucucugucucaugugu

SEQ ID NO: 2589240 - RNA, 13 nt, Human
ccuucucuguuca

SEQ ID NO: 2589241 - RNA, 17 nt, Human
ccuucucuguucauuuc

SEQ ID NO: 2589242 - RNA, 18 nt, Human
ccuucucuguucauuucc

SEQ ID NO: 2589243 - RNA, 17 nt, Human
ccuucucuucacaguca

SEQ ID NO: 2589244 - RNA, 21 nt, Human
ccuucuguccuacucuguguc

SEQ ID NO: 2589245 - RNA, 20 nt, Human
ccuucuguccuacucugugu

SEQ ID NO: 2589246 - RNA, 17 nt, Human
ccuucuguccugguguc

SEQ ID NO: 2589247 - RNA, 16 nt, Human
ccuucuguccuggugu

SEQ ID NO: 2589248 - RNA, 19 nt, Human
ccuucucuguucauuuccu

SEQ ID NO: 2589249 - RNA, 21 nt, Human
ccuucucuguucauuuccuca

SEQ ID NO: 2589250 - RNA, 15 nt, Human
ccuucuguccuggug

SEQ ID NO: 2589251 - RNA, 14 nt, Human
ccuucucuuaauuu

SEQ ID NO: 2589252 - RNA, 22 nt, Human
ccuucuguccuacucuguguca

SEQ ID NO: 2589253 - RNA, 16 nt, Human
ccuucucugaaggaca

SEQ ID NO: 2589254 - RNA, 14 nt, Human
ccuucucugaagga

SEQ ID NO: 2589255 - RNA, 13 nt, Human
ccuucucugcucc

SEQ ID NO: 2589256 - RNA, 14 nt, Human
ccuucucugcucca

SEQ ID NO: 2589257 - RNA, 16 nt, Human
ccuucucugcuccacc

SEQ ID NO: 2589258 - RNA, 17 nt, Human
ccuucucugcuccacca

SEQ ID NO: 2589259 - RNA, 20 nt, Human
ccuucucugcuccaccacau

SEQ ID NO: 2589260 - RNA, 17 nt, Human
ccuucucugucucaugu

SEQ ID NO: 2589261 - RNA, 21 nt, Human
ccuucucuguagggaacucug

SEQ ID NO: 2589262 - RNA, 22 nt, Human
ccuucucugcuccaccacaucc

SEQ ID NO: 2589263 - RNA, 23 nt, Human
ccuucucuccagccccuggaugc

SEQ ID NO: 2589264 - RNA, 21 nt, Human
ccuucucuccagccccuggau

SEQ ID NO: 2589265 - RNA, 20 nt, Human
ccuucucuccuccccaaauc

SEQ ID NO: 2589266 - RNA, 17 nt, Human
ccuucucuccuccccaa

SEQ ID NO: 2589267 - RNA, 20 nt, Human
ccuucucucucaauuuuugg

SEQ ID NO: 2589268 - RNA, 16 nt, Human
ccuucucuccucccca

SEQ ID NO: 2589269 - RNA, 15 nt, Human
ccuucucuccucccc

SEQ ID NO: 2589270 - RNA, 22 nt, Human
ccuuccucuccacccucccaga

SEQ ID NO: 2589271 - RNA, 20 nt, Human
ccuuccucuccacugccuuc

SEQ ID NO: 2589272 - RNA, 16 nt, Human
ccuuccuacagauagu

SEQ ID NO: 2589273 - RNA, 20 nt, Human
ccuuccuacacccuuggacu

SEQ ID NO: 2589274 - RNA, 21 nt, Human
ccuuccuaauuccacagcugc

SEQ ID NO: 2589275 - RNA, 22 nt, Human
ccuuccucaguuuaauccuucu

SEQ ID NO: 2589276 - RNA, 15 nt, Human
ccuuccucacuucca

SEQ ID NO: 2589277 - RNA, 14 nt, Human
ccuuccucacugcc

SEQ ID NO: 2589278 - RNA, 19 nt, Human
ccuuccucauccaccccau

SEQ ID NO: 2589279 - RNA, 18 nt, Human
ccuuccucauccacccca

SEQ ID NO: 2589280 - RNA, 17 nt, Human
ccuuccucauccacccc

SEQ ID NO: 2589281 - RNA, 16 nt, Human
ccuuccucauccaccc

SEQ ID NO: 2589282 - RNA, 21 nt, Human
ccuuccucauccaccccaucc

SEQ ID NO: 2589283 - RNA, 20 nt, Human
ccuuccucauccaccccauc

SEQ ID NO: 2589284 - RNA, 22 nt, Human
ccuuccucccaccucccccucc

SEQ ID NO: 2589285 - RNA, 15 nt, Human
ccuuccucuccacug

SEQ ID NO: 2589286 - RNA, 14 nt, Human
ccuuccucuccacu

SEQ ID NO: 2589287 - RNA, 12 nt, Human
ccuuccuccugg

SEQ ID NO: 2589288 - RNA, 13 nt, Human
ccuuccuccuggg

SEQ ID NO: 2589289 - RNA, 17 nt, Human
ccuuccucgcagagagg

SEQ ID NO: 2589290 - RNA, 15 nt, Human
ccuuccucgcagaga

SEQ ID NO: 2589291 - RNA, 19 nt, Human
ccuuccucgcagagaggcc

SEQ ID NO: 2589292 - RNA, 21 nt, Human
ccuuccucuccacccucccag

SEQ ID NO: 2589293 - RNA, 20 nt, Human
ccuucucuccagccccugga

SEQ ID NO: 2589294 - RNA, 17 nt, Human
ccuuccucuccacugcc

SEQ ID NO: 2589295 - RNA, 16 nt, Human
ccuuccucuccacugc

SEQ ID NO: 2589296 - RNA, 20 nt, Human
ccuucccccucccagggcca

SEQ ID NO: 2589297 - RNA, 16 nt, Human
ccuucccccucccagg

SEQ ID NO: 2589298 - RNA, 17 nt, Human
ccuucccccucccaggg

SEQ ID NO: 2589299 - RNA, 15 nt, Human
ccuuccccagcgucc

SEQ ID NO: 2589300 - RNA, 13 nt, Human
ccuuccccauggg

SEQ ID NO: 2589301 - RNA, 19 nt, Human
ccuucccccuccaauccca

SEQ ID NO: 2589302 - RNA, 19 nt, Human
ccuuccccacugcacacac

SEQ ID NO: 2589303 - RNA, 20 nt, Human
ccuuccccacugccugccca

SEQ ID NO: 2589304 - RNA, 23 nt, Human
ccuucccaugacccaggcugggc

SEQ ID NO: 2589305 - RNA, 12 nt, Human
ccuuccccacug

SEQ ID NO: 2589306 - RNA, 13 nt, Human
ccuuccccagccu

SEQ ID NO: 2589307 - RNA, 22 nt, Human
ccuuccccacugccugcccacc

SEQ ID NO: 2589308 - RNA, 15 nt, Human
ccuuccccagccucu

SEQ ID NO: 2589309 - RNA, 16 nt, Human
ccuuccccuccuucuc

SEQ ID NO: 2589310 - RNA, 19 nt, Human
ccuuccccucccuggcucc

SEQ ID NO: 2589311 - RNA, 22 nt, Human
ccuuccccucccuggcucccau

SEQ ID NO: 2589312 - RNA, 23 nt, Human
ccuuccccgagggaugaugccac

SEQ ID NO: 2589313 - RNA, 13 nt, Human
ccuuccccgaggg

SEQ ID NO: 2589314 - RNA, 15 nt, Human
ccuuccccucccugg

SEQ ID NO: 2589315 - RNA, 17 nt, Human
ccuuccccucccuggcu

SEQ ID NO: 2589316 - RNA, 18 nt, Human
ccuuccccucccuggcuc

SEQ ID NO: 2589317 - RNA, 18 nt, Human
ccuuccccuugcccaggg

SEQ ID NO: 2589318 - RNA, 20 nt, Human
ccuuccccuugcccagggcu

SEQ ID NO: 2589319 - RNA, 15 nt, Human
ccuucccuagcuuua

SEQ ID NO: 2589320 - RNA, 12 nt, Human
ccuucccuagcu

SEQ ID NO: 2589321 - RNA, 23 nt, Human
ccuucccucaccuuggcaccaga

SEQ ID NO: 2589322 - RNA, 22 nt, Human
ccuuccccuugcccagggcuca

SEQ ID NO: 2589323 - RNA, 19 nt, Human
ccuuccuaauuccacagcu

SEQ ID NO: 2589324 - RNA, 20 nt, Human
ccuuccuaauuccacagcug

SEQ ID NO: 2589325 - RNA, 19 nt, Human
ccuuccguaacccaacucu

SEQ ID NO: 2589326 - RNA, 18 nt, Human
ccuuccuaauuccacagc

SEQ ID NO: 2589327 - RNA, 17 nt, Human
ccuucccuucuccaucu

SEQ ID NO: 2589328 - RNA, 16 nt, Human
ccuucccuugagcccu

SEQ ID NO: 2589329 - RNA, 24 nt, Human
ccuucccucaccuuggcaccagac

SEQ ID NO: 2589330 - RNA, 12 nt, Human
ccuucccucucc

SEQ ID NO: 2589331 - RNA, 11 nt, Human
ccuucccuggc

SEQ ID NO: 2589332 - RNA, 14 nt, Human
ccuucccugggcug

SEQ ID NO: 2589333 - RNA, 12 nt, Human
ccuucccugcaa

SEQ ID NO: 2589334 - RNA, 16 nt, Human
ccuucccugucccucu

SEQ ID NO: 2589335 - RNA, 15 nt, Human
ccuucccugucccuc

SEQ ID NO: 2589336 - RNA, 14 nt, Human
ccuucccugucccu

SEQ ID NO: 2589337 - RNA, 13 nt, Human
ccuucccuguccc

SEQ ID NO: 2589338 - RNA, 12 nt, Human
ccuucccugucc

SEQ ID NO: 2589339 - RNA, 19 nt, Human
ccuucccugggcugugcua

SEQ ID NO: 2589340 - RNA, 18 nt, Human
ccuucccugggcugugcu

SEQ ID NO: 2589341 - RNA, 15 nt, Human
ccuucccugggcugu

SEQ ID NO: 2589342 - RNA, 17 nt, Human
ccuucccugucccucua

SEQ ID NO: 2589343 - RNA, 18 nt, Human
ccuucccugucugccagg

SEQ ID NO: 2589344 - RNA, 16 nt, Human
cucccugacccgucua

SEQ ID NO: 2589345 - RNA, 19 nt, Human
cucccugaagccagccuuc

SEQ ID NO: 2589346 - RNA, 18 nt, Human
cucccugaagccuuugca

SEQ ID NO: 2589347 - RNA, 17 nt, Human
cucccuccugccgacuc

SEQ ID NO: 2589348 - RNA, 18 nt, Human
cucccugaagccagccuu

SEQ ID NO: 2589349 - RNA, 17 nt, Human
cucccugaagccagccu

SEQ ID NO: 2589350 - RNA, 16 nt, Human
cucccugaagccagcc

SEQ ID NO: 2589351 - RNA, 15 nt, Human
cucccugaagccagc

SEQ ID NO: 2589352 - RNA, 20 nt, Human
cucccugaaguaagcaaaga

SEQ ID NO: 2589353 - RNA, 14 nt, Human
cucccugaagccag

SEQ ID NO: 2589354 - RNA, 13 nt, Human
cucccugaagcca

SEQ ID NO: 2589355 - RNA, 19 nt, Human
cucccugaaccaucccuga

SEQ ID NO: 2589356 - RNA, 21 nt, Human
cucccugaaaauguuuuucug

SEQ ID NO: 2589357 - RNA, 23 nt, Human
cucccugaaaauguuuuucugcc

SEQ ID NO: 2589358 - RNA, 16 nt, Human
cucccucucacugucu

SEQ ID NO: 2589359 - RNA, 15 nt, Human
cucccucucacuguc

SEQ ID NO: 2589360 - RNA, 14 nt, Human
cucccucucacugu

SEQ ID NO: 2589361 - RNA, 10 nt, Human
cucccucuca

SEQ ID NO: 2589362 - RNA, 14 nt, Human
cucccucuauuuau

SEQ ID NO: 2589363 - RNA, 20 nt, Human
cucccucuacugggagccua

SEQ ID NO: 2589364 - RNA, 19 nt, Human
cucccuccugccgacuccu

SEQ ID NO: 2589365 - RNA, 22 nt, Human
cucccucucacugucugagagu

SEQ ID NO: 2589366 - RNA, 21 nt, Human
cucccucucacugucugagag

SEQ ID NO: 2589367 - RNA, 20 nt, Human
cucccucuuucccucccuuc

SEQ ID NO: 2589368 - RNA, 12 nt, Human
cucccucccaca

SEQ ID NO: 2589369 - RNA, 13 nt, Human
cucccucuacugg

SEQ ID NO: 2589370 - RNA, 19 nt, Human
cucccucuacugggagccu

SEQ ID NO: 2589371 - RNA, 17 nt, Human
cucccucgucgagcugg

SEQ ID NO: 2589372 - RNA, 18 nt, Human
cuccccucacagccucug

SEQ ID NO: 2589373 - RNA, 17 nt, Human
cuccccucacagccucu

SEQ ID NO: 2589374 - RNA, 16 nt, Human
cuccccucacagccuc

SEQ ID NO: 2589375 - RNA, 15 nt, Human
cuccccucacagccu

SEQ ID NO: 2589376 - RNA, 18 nt, Human
cuccccucaaagucugca

SEQ ID NO: 2589377 - RNA, 10 nt, Human
cuccccucaa

SEQ ID NO: 2589378 - RNA, 21 nt, Human
cuccccuauccacccagccca

SEQ ID NO: 2589379 - RNA, 23 nt, Human
cuccccuauccacccagcccauu

SEQ ID NO: 2589380 - RNA, 14 nt, Human
cuccccucacagcc

SEQ ID NO: 2589381 - RNA, 20 nt, Human
cuccccucaaagucugcaac

SEQ ID NO: 2589382 - RNA, 13 nt, Human
cuccccucacagc

SEQ ID NO: 2589383 - RNA, 16 nt, Human
cuccccggcccuacca

SEQ ID NO: 2589384 - RNA, 14 nt, Human
cuccccggcccuac

SEQ ID NO: 2589385 - RNA, 14 nt, Human
cuccccggcucgag

SEQ ID NO: 2589386 - RNA, 15 nt, Human
cuccccuaccacugu

SEQ ID NO: 2589387 - RNA, 17 nt, Human
cuccccuauccacccag

SEQ ID NO: 2589388 - RNA, 18 nt, Human
cuccccuauccacccagc

SEQ ID NO: 2589389 - RNA, 19 nt, Human
cuccccuauccacccagcc

SEQ ID NO: 2589390 - RNA, 16 nt, Human
cuccccuaaugccugc

SEQ ID NO: 2589391 - RNA, 15 nt, Human
cuccccuaaugccug

SEQ ID NO: 2589392 - RNA, 23 nt, Human
cucccagcugacaguccucucca

SEQ ID NO: 2589393 - RNA, 20 nt, Human
cucccagcugacaguccucu

SEQ ID NO: 2589394 - RNA, 18 nt, Human
cucccagcugacaguccu

SEQ ID NO: 2589395 - RNA, 11 nt, Human
cucccaggaac

SEQ ID NO: 2589396 - RNA, 21 nt, Human
cucccagcugacaguccucuc

SEQ ID NO: 2589397 - RNA, 18 nt, Human
cucccaggaacugggcca

SEQ ID NO: 2589398 - RNA, 16 nt, Human
cucccaggagacaguu

SEQ ID NO: 2589399 - RNA, 11 nt, Human
cucccaggaag

SEQ ID NO: 2589400 - RNA, 18 nt, Human
cucccccccaugcacugu

SEQ ID NO: 2589401 - RNA, 15 nt, Human
cucccccccaugcac

SEQ ID NO: 2589402 - RNA, 19 nt, Human
cucccaggagacaguucaa

SEQ ID NO: 2589403 - RNA, 19 nt, Human
cucccccccggggcugggu

SEQ ID NO: 2589404 - RNA, 18 nt, Human
cucccccccggggcuggg

SEQ ID NO: 2589405 - RNA, 15 nt, Human
cucccccccggggcu

SEQ ID NO: 2589406 - RNA, 14 nt, Human
cucccccccggggc

SEQ ID NO: 2589407 - RNA, 14 nt, Human
cucccccgccacuc

SEQ ID NO: 2589408 - RNA, 21 nt, Human
cucccccccggggcuggguug

SEQ ID NO: 2589409 - RNA, 12 nt, Human
cucccccgccac

SEQ ID NO: 2589410 - RNA, 13 nt, Human
cucccccccgggg

SEQ ID NO: 2589411 - RNA, 17 nt, Human
cuccccccccccuccaa

SEQ ID NO: 2589412 - RNA, 16 nt, Human
cuccccccccccucca

SEQ ID NO: 2589413 - RNA, 20 nt, Human
cucccccccaugcacuguga

SEQ ID NO: 2589414 - RNA, 21 nt, Human
cucccccccaugcacugugaa

SEQ ID NO: 2589415 - RNA, 17 nt, Human
cucccccgggaggggcc

SEQ ID NO: 2589416 - RNA, 13 nt, Human
cucccccgggagg

SEQ ID NO: 2589417 - RNA, 15 nt, Human
cucccccgccacucc

SEQ ID NO: 2589418 - RNA, 21 nt, Human
cucccccgggaggggcccgcu

SEQ ID NO: 2589419 - RNA, 18 nt, Human
cucccccgggaggggccc

SEQ ID NO: 2589420 - RNA, 22 nt, Human
cucccccgggaggggcccgcuu

SEQ ID NO: 2589421 - RNA, 13 nt, Human
cuccccggcccua

SEQ ID NO: 2589422 - RNA, 17 nt, Human
cucccccucccccuucu

SEQ ID NO: 2589423 - RNA, 11 nt, Human
cucccccugcc

SEQ ID NO: 2589424 - RNA, 17 nt, Human
cucauguaucaucugga

SEQ ID NO: 2589425 - RNA, 20 nt, Human
cucaugcaucuccaccugcu

SEQ ID NO: 2589426 - RNA, 19 nt, Human
cucauguaucaucuggaua

SEQ ID NO: 2589427 - RNA, 16 nt, Human
cucauguacauacccu

SEQ ID NO: 2589428 - RNA, 16 nt, Human
cucauguaucaucugg

SEQ ID NO: 2589429 - RNA, 20 nt, Human
cucauggccccucugaccug

SEQ ID NO: 2589430 - RNA, 16 nt, Human
cucaugggguccaagu

SEQ ID NO: 2589431 - RNA, 15 nt, Human
cucaugguggguuca

SEQ ID NO: 2589432 - RNA, 20 nt, Human
cuccaggcuguaucccauga

SEQ ID NO: 2589433 - RNA, 23 nt, Human
cuccaggcuccuuuagcgcccag

SEQ ID NO: 2589434 - RNA, 15 nt, Human
cuccaggcuccuuua

SEQ ID NO: 2589435 - RNA, 17 nt, Human
cuccagguggcucugag

SEQ ID NO: 2589436 - RNA, 14 nt, Human
cuccagguggcucu

SEQ ID NO: 2589437 - RNA, 23 nt, Human
cuccaggugcacaagcuccaagc

SEQ ID NO: 2589438 - RNA, 17 nt, Human
cuccagguuuuucaauu

SEQ ID NO: 2589439 - RNA, 16 nt, Human
cuccagguuuuucaau

SEQ ID NO: 2589440 - RNA, 15 nt, Human
cuccagguuuuucaa

SEQ ID NO: 2589441 - RNA, 14 nt, Human
cuccagguuuuuca

SEQ ID NO: 2589442 - RNA, 13 nt, Human
cuccagguuuuuc

SEQ ID NO: 2589443 - RNA, 12 nt, Human
cuccagguuuuu

SEQ ID NO: 2589444 - RNA, 14 nt, Human
cuccaggugugcac

SEQ ID NO: 2589445 - RNA, 21 nt, Human
cuccagguuuuucaauuaaac

SEQ ID NO: 2589446 - RNA, 20 nt, Human
cuccagguuuuucaauuaaa

SEQ ID NO: 2589447 - RNA, 19 nt, Human
cuccagguuuuucaauuaa

SEQ ID NO: 2589448 - RNA, 18 nt, Human
cuccagguuuuucaauua

SEQ ID NO: 2589449 - RNA, 23 nt, Human
cuccagguuuuucaauuaaacgg

SEQ ID NO: 2589450 - RNA, 22 nt, Human
cuccagguuuuucaauuaaacg

SEQ ID NO: 2589451 - RNA, 14 nt, Human
cuccaguauucuug

SEQ ID NO: 2589452 - RNA, 21 nt, Human
cucccacgugggagacaagaa

SEQ ID NO: 2589453 - RNA, 20 nt, Human
cucccacagugacucgggcu

SEQ ID NO: 2589454 - RNA, 14 nt, Human
cucccacagugacu

SEQ ID NO: 2589455 - RNA, 14 nt, Human
cucccacugaguuu

SEQ ID NO: 2589456 - RNA, 12 nt, Human
cucccacaguga

SEQ ID NO: 2589457 - RNA, 11 nt, Human
cucccacagug

SEQ ID NO: 2589458 - RNA, 21 nt, Human
cucccacaggcccuuccucuc

SEQ ID NO: 2589459 - RNA, 20 nt, Human
cucccacaggcccuuccucu

SEQ ID NO: 2589460 - RNA, 16 nt, Human
cucccacaggcccuuc

SEQ ID NO: 2589461 - RNA, 14 nt, Human
cucccacaggcccu

SEQ ID NO: 2589462 - RNA, 15 nt, Human
cucccacaggcccuu

SEQ ID NO: 2589463 - RNA, 23 nt, Human
cucccagcucuagacaacccugc

SEQ ID NO: 2589464 - RNA, 11 nt, Human
cucccagcuga

SEQ ID NO: 2589465 - RNA, 20 nt, Human
cucccagaccugccucuucc

SEQ ID NO: 2589466 - RNA, 17 nt, Human
cucccagaccugccucu

SEQ ID NO: 2589467 - RNA, 22 nt, Human
cucccacuuggccaagcaggga

SEQ ID NO: 2589468 - RNA, 15 nt, Human
cucccagaccugccu

SEQ ID NO: 2589469 - RNA, 16 nt, Human
cucccagaacacacuc

SEQ ID NO: 2589470 - RNA, 15 nt, Human
cucccacuuggccaa

SEQ ID NO: 2589471 - RNA, 13 nt, Human
cucccacuuggcc

SEQ ID NO: 2589472 - RNA, 24 nt, Human
cucccagaacacacuccaucagcu

SEQ ID NO: 2589473 - RNA, 18 nt, Human
cucccacuucccugacac

SEQ ID NO: 2589474 - RNA, 19 nt, Human
cucccacuucccugacacu

SEQ ID NO: 2589475 - RNA, 23 nt, Human
cucccacugggguccagggagca

SEQ ID NO: 2589476 - RNA, 23 nt, Human
cuccgcuuucuacccagcgagcc

SEQ ID NO: 2589477 - RNA, 22 nt, Human
cuccggcgucagccuccagccu

SEQ ID NO: 2589478 - RNA, 21 nt, Human
cuccggcgucagccuccagcc

SEQ ID NO: 2589479 - RNA, 20 nt, Human
cuccggcgucagccuccagc

SEQ ID NO: 2589480 - RNA, 18 nt, Human
cuccggcgucagccucca

SEQ ID NO: 2589481 - RNA, 17 nt, Human
cuccggcgucagccucc

SEQ ID NO: 2589482 - RNA, 16 nt, Human
cuccggcgucagccuc

SEQ ID NO: 2589483 - RNA, 14 nt, Human
cuccggcgucagcc

SEQ ID NO: 2589484 - RNA, 22 nt, Human
cuccggccugaugacagagcga

SEQ ID NO: 2589485 - RNA, 23 nt, Human
cuccggcgucagccuccagccuc

SEQ ID NO: 2589486 - RNA, 17 nt, Human
cuccuaccccucccagc

SEQ ID NO: 2589487 - RNA, 16 nt, Human
cuccuaccccucccag

SEQ ID NO: 2589488 - RNA, 14 nt, Human
cuccuaccccuccc

SEQ ID NO: 2589489 - RNA, 13 nt, Human
cuccggagacagg

SEQ ID NO: 2589490 - RNA, 16 nt, Human
cuccggaucgaggccu

SEQ ID NO: 2589491 - RNA, 22 nt, Human
cuccggagugagaagcuuugcc

SEQ ID NO: 2589492 - RNA, 20 nt, Human
cuccggccugaugacagagc

SEQ ID NO: 2589493 - RNA, 14 nt, Human
cuccggccuccccu

SEQ ID NO: 2589494 - RNA, 15 nt, Human
cuccggccuccccuc

SEQ ID NO: 2589495 - RNA, 21 nt, Human
cuccggcccuccuacccugcg

SEQ ID NO: 2589496 - RNA, 13 nt, Human
cuccucugacuca

SEQ ID NO: 2589497 - RNA, 18 nt, Human
cuccucugacucagggcu

SEQ ID NO: 2589498 - RNA, 19 nt, Human
cuccucugacucagggcuc

SEQ ID NO: 2589499 - RNA, 20 nt, Human
cuccucugacucagggcucc

SEQ ID NO: 2589500 - RNA, 22 nt, Human
cuccucugacucagggcuccug

SEQ ID NO: 2589501 - RNA, 16 nt, Human
cuccucugcagugccu

SEQ ID NO: 2589502 - RNA, 18 nt, Human
cuccucugcagugccuug

SEQ ID NO: 2589503 - RNA, 17 nt, Human
cuccucugcagugccuu

SEQ ID NO: 2589504 - RNA, 11 nt, Human
cuccucugcca

SEQ ID NO: 2589505 - RNA, 12 nt, Human
cuccucugccac

SEQ ID NO: 2589506 - RNA, 14 nt, Human
cuccucugccaccu

SEQ ID NO: 2589507 - RNA, 15 nt, Human
cuccucugccaccuc

SEQ ID NO: 2589508 - RNA, 16 nt, Human
cuccucugccaccucc

SEQ ID NO: 2589509 - RNA, 17 nt, Human
cuccucugccaccuccc

SEQ ID NO: 2589510 - RNA, 12 nt, Human
cuccuagacuga

SEQ ID NO: 2589511 - RNA, 22 nt, Human
cuccuaccgaaaccuugccuuu

SEQ ID NO: 2589512 - RNA, 13 nt, Human
cuccuaccuggua

SEQ ID NO: 2589513 - RNA, 16 nt, Human
cuccuaccucagccua

SEQ ID NO: 2589514 - RNA, 18 nt, Human
cuccuaccucagccuaga

SEQ ID NO: 2589515 - RNA, 12 nt, Human
cuccuaccucag

SEQ ID NO: 2589516 - RNA, 13 nt, Human
cuccuaccucagc

SEQ ID NO: 2589517 - RNA, 14 nt, Human
cuccuaccucagcc

SEQ ID NO: 2589518 - RNA, 15 nt, Human
cuccuaccucagccu

SEQ ID NO: 2589519 - RNA, 21 nt, Human
cuccuaccgaaaccuugccuu

SEQ ID NO: 2589520 - RNA, 23 nt, Human
cuccuaccccucccagcugacag

SEQ ID NO: 2589521 - RNA, 18 nt, Human
cuccuacccugcgcccag

SEQ ID NO: 2589522 - RNA, 19 nt, Human
cuccuaccccucccagcug

SEQ ID NO: 2589523 - RNA, 18 nt, Human
cuccuaccccucccagcu

SEQ ID NO: 2589524 - RNA, 15 nt, Human
cuccuacccugcgcc

SEQ ID NO: 2589525 - RNA, 23 nt, Human
cuccuguaacauacuggccugga

SEQ ID NO: 2589526 - RNA, 22 nt, Human
cuccuguaacauacuggccugg

SEQ ID NO: 2589527 - RNA, 21 nt, Human
cuccuguaaaugguguacaua

SEQ ID NO: 2589528 - RNA, 17 nt, Human
cuccugguggguccagg

SEQ ID NO: 2589529 - RNA, 20 nt, Human
cuccuguaacauacuggccu

SEQ ID NO: 2589530 - RNA, 16 nt, Human
cuccuguaccucuuga

SEQ ID NO: 2589531 - RNA, 20 nt, Human
cuccuguccucccauccccu

SEQ ID NO: 2589532 - RNA, 15 nt, Human
cuccuguccucccau

SEQ ID NO: 2589533 - RNA, 13 nt, Human
cuccuguccuccc

SEQ ID NO: 2589534 - RNA, 12 nt, Human
cuccuguccucc

SEQ ID NO: 2589535 - RNA, 18 nt, Human
cuccuguaauuccuaccu

SEQ ID NO: 2589536 - RNA, 14 nt, Human
cuccuguccaaccu

SEQ ID NO: 2589537 - RNA, 16 nt, Human
cuccuguaauuccuac

SEQ ID NO: 2589538 - RNA, 14 nt, Human
cuccuguaauuccu

SEQ ID NO: 2589539 - RNA, 17 nt, Human
cuccuguacuuuuucca

SEQ ID NO: 2589540 - RNA, 21 nt, Human
cuccugggcccucucugcucu

SEQ ID NO: 2589541 - RNA, 22 nt, Human
cuccugggcccucucugcucug

SEQ ID NO: 2589542 - RNA, 13 nt, Human
cuccugggcucag

SEQ ID NO: 2589543 - RNA, 23 nt, Human
cuccuggguuuuguauucucuga

SEQ ID NO: 2589544 - RNA, 22 nt, Human
cuccuggguuuuguauucucug

SEQ ID NO: 2589545 - RNA, 20 nt, Human
cuccugguggguccaggggc

SEQ ID NO: 2589546 - RNA, 14 nt, Human
cuccuggugggucc

SEQ ID NO: 2589547 - RNA, 15 nt, Human
cuccuggucuugaga

SEQ ID NO: 2589548 - RNA, 23 nt, Human
cuccuggucuugagaugucuucu

SEQ ID NO: 2589549 - RNA, 17 nt, Human
cuccuuucacaaccuuc

SEQ ID NO: 2589550 - RNA, 16 nt, Human
cuccuuucacaaccuu

SEQ ID NO: 2589551 - RNA, 15 nt, Human
cuccuuucaccacau

SEQ ID NO: 2589552 - RNA, 17 nt, Human
cuccuugugguuuaugu

SEQ ID NO: 2589553 - RNA, 18 nt, Human
cuccuugugguuuauguc

SEQ ID NO: 2589554 - RNA, 12 nt, Human
cuccuuguuccu

SEQ ID NO: 2589555 - RNA, 13 nt, Human
cuccuuguuccua

SEQ ID NO: 2589556 - RNA, 14 nt, Human
cuccuuguuccuag

SEQ ID NO: 2589557 - RNA, 15 nt, Human
cuccuuguuccuaga

SEQ ID NO: 2589558 - RNA, 13 nt, Human
cuccuuucacaac

SEQ ID NO: 2589559 - RNA, 18 nt, Human
cuccuuguggccugggcc

SEQ ID NO: 2589560 - RNA, 16 nt, Human
cuccuuguccacccac

SEQ ID NO: 2589561 - RNA, 20 nt, Human
cuccuuguggccugggccuc

SEQ ID NO: 2589562 - RNA, 15 nt, Human
cuccuuguccaccca

SEQ ID NO: 2589563 - RNA, 17 nt, Human
cuccugucuaacugcug

SEQ ID NO: 2589564 - RNA, 16 nt, Human
cuccuuguggccuggg

SEQ ID NO: 2589565 - RNA, 14 nt, Human
cuccuuguguuacu

SEQ ID NO: 2589566 - RNA, 21 nt, Human
cuccuguccucccauccccug

SEQ ID NO: 2589567 - RNA, 13 nt, Human
cuccuguccuuua

SEQ ID NO: 2589568 - RNA, 13 nt, Human
cuccugucugcca

SEQ ID NO: 2589569 - RNA, 16 nt, Human
cuccuuguaaagacug

SEQ ID NO: 2589570 - RNA, 16 nt, Human
cuccugucugccagcc

SEQ ID NO: 2589571 - RNA, 14 nt, Human
cuccugucugccag

SEQ ID NO: 2589572 - RNA, 15 nt, Human
cuccugucugccagc

SEQ ID NO: 2589573 - RNA, 15 nt, Human
cuccucuguccaggc

SEQ ID NO: 2589574 - RNA, 15 nt, Human
cuccucuguccaggg

SEQ ID NO: 2589575 - RNA, 16 nt, Human
cuccucuguccagggc

SEQ ID NO: 2589576 - RNA, 12 nt, Human
cuccucugucca

SEQ ID NO: 2589577 - RNA, 15 nt, Human
cuccucugggcagga

SEQ ID NO: 2589578 - RNA, 23 nt, Human
cuccucugggcaggaccucagag

SEQ ID NO: 2589579 - RNA, 14 nt, Human
cuccucuguccagg

SEQ ID NO: 2589580 - RNA, 17 nt, Human
cuccucuguccagggcc

SEQ ID NO: 2589581 - RNA, 18 nt, Human
cuccucuguccagggccc

SEQ ID NO: 2589582 - RNA, 14 nt, Human
cuccucuuccaggc

SEQ ID NO: 2589583 - RNA, 13 nt, Human
cuccucugucccu

SEQ ID NO: 2589584 - RNA, 14 nt, Human
cuccucugcugcug

SEQ ID NO: 2589585 - RNA, 13 nt, Human
cuccucugcugcu

SEQ ID NO: 2589586 - RNA, 15 nt, Human
cuccucugcugcugg

SEQ ID NO: 2589587 - RNA, 21 nt, Human
cuccucuggacggcaggcuca

SEQ ID NO: 2589588 - RNA, 12 nt, Human
cuccucugggca

SEQ ID NO: 2589589 - RNA, 13 nt, Human
cuccucugggcag

SEQ ID NO: 2589590 - RNA, 15 nt, Human
cuccugggcccucuc

SEQ ID NO: 2589591 - RNA, 17 nt, Human
cuccugggcccucucug

SEQ ID NO: 2589592 - RNA, 19 nt, Human
cuccugggcccucucugcu

SEQ ID NO: 2589593 - RNA, 20 nt, Human
cuccugggcccucucugcuc

SEQ ID NO: 2589594 - RNA, 18 nt, Human
cuccugggcuaagugauc

SEQ ID NO: 2589595 - RNA, 19 nt, Human
cuccuggccucaagugauu

SEQ ID NO: 2589596 - RNA, 22 nt, Human
cuccuggcucuugauacccccc

SEQ ID NO: 2589597 - RNA, 16 nt, Human
cuccucuugccacugc

SEQ ID NO: 2589598 - RNA, 15 nt, Human
cuccucuugccacug

SEQ ID NO: 2589599 - RNA, 12 nt, Human
cuccucuugcca

SEQ ID NO: 2589600 - RNA, 19 nt, Human
cuccucuucugacgugccu

SEQ ID NO: 2589601 - RNA, 23 nt, Human
cuccucuucuuuuuuuucauuau

SEQ ID NO: 2589602 - RNA, 19 nt, Human
cuccuggcccacugcaucg

SEQ ID NO: 2589603 - RNA, 20 nt, Human
cucugcacaagcugcacccu

SEQ ID NO: 2589604 - RNA, 21 nt, Human
cucugcacaagcugcacccuc

SEQ ID NO: 2589605 - RNA, 16 nt, Human
cucugcacuccccugc

SEQ ID NO: 2589606 - RNA, 15 nt, Human
cucugcacuccccug

SEQ ID NO: 2589607 - RNA, 14 nt, Human
cucugcacuccccu

SEQ ID NO: 2589608 - RNA, 14 nt, Human
cucugcacaugucu

SEQ ID NO: 2589609 - RNA, 13 nt, Human
cucugcacauguc

SEQ ID NO: 2589610 - RNA, 10 nt, Human
cucugcacag

SEQ ID NO: 2589611 - RNA, 14 nt, Human
cucugcacagaugg

SEQ ID NO: 2589612 - RNA, 15 nt, Human
cucugcacagaugga

SEQ ID NO: 2589613 - RNA, 21 nt, Human
cucuguccccuucucucaucu

SEQ ID NO: 2589614 - RNA, 18 nt, Human
cucuguccccuucucuca

SEQ ID NO: 2589615 - RNA, 17 nt, Human
cucuguccccuucucuc

SEQ ID NO: 2589616 - RNA, 15 nt, Human
cucuguccccuucuc

SEQ ID NO: 2589617 - RNA, 14 nt, Human
cucugcuggccgga

SEQ ID NO: 2589618 - RNA, 14 nt, Human
cucuguccccuucu

SEQ ID NO: 2589619 - RNA, 16 nt, Human
cucuguacagagccca

SEQ ID NO: 2589620 - RNA, 22 nt, Human
cucugucccacuuggcaucagc

SEQ ID NO: 2589621 - RNA, 22 nt, Human
cucuguccagggcccugagcuc

SEQ ID NO: 2589622 - RNA, 18 nt, Human
cucuguccugacuucagg

SEQ ID NO: 2589623 - RNA, 12 nt, Human
cucuuagcugag

SEQ ID NO: 2589624 - RNA, 19 nt, Human
cucuuagcuccccuccaac

SEQ ID NO: 2589625 - RNA, 13 nt, Human
cucuguccugacu

SEQ ID NO: 2589626 - RNA, 11 nt, Human
cucuguccuga

SEQ ID NO: 2589627 - RNA, 23 nt, Human
cucuguccccuucucucaucucu

SEQ ID NO: 2589628 - RNA, 21 nt, Human
cucuuauagaauauuuauuac

SEQ ID NO: 2589629 - RNA, 20 nt, Human
cucuuauagaauauuuauua

SEQ ID NO: 2589630 - RNA, 18 nt, Human
cucuuauagaauauuuau

SEQ ID NO: 2589631 - RNA, 17 nt, Human
cucuuauagaauauuua

SEQ ID NO: 2589632 - RNA, 13 nt, Human
cucuuagcugagu

SEQ ID NO: 2589633 - RNA, 16 nt, Human
cucuuauagaauauuu

SEQ ID NO: 2589634 - RNA, 13 nt, Human
cucuuagcugucu

SEQ ID NO: 2589635 - RNA, 19 nt, Human
cucuuaggaagagaaacca

SEQ ID NO: 2589636 - RNA, 15 nt, Human
cucugcugcuggcug

SEQ ID NO: 2589637 - RNA, 14 nt, Human
cucugcugcuggcu

SEQ ID NO: 2589638 - RNA, 22 nt, Human
cucugcugcugucccucccccu

SEQ ID NO: 2589639 - RNA, 21 nt, Human
cucugcugcugucccuccccc

SEQ ID NO: 2589640 - RNA, 21 nt, Human
cucugcugccgccccacccag

SEQ ID NO: 2589641 - RNA, 16 nt, Human
cucugcugcugucccu

SEQ ID NO: 2589642 - RNA, 16 nt, Human
cucugcugcuggcugg

SEQ ID NO: 2589643 - RNA, 15 nt, Human
cucuguacagagccc

SEQ ID NO: 2589644 - RNA, 14 nt, Human
cucuguacagagcc

SEQ ID NO: 2589645 - RNA, 13 nt, Human
cucuguacagagc

SEQ ID NO: 2589646 - RNA, 11 nt, Human
cucugcugcuu

SEQ ID NO: 2589647 - RNA, 13 nt, Human
cucugcugccgcc

SEQ ID NO: 2589648 - RNA, 13 nt, Human
cucugcugcuuag

SEQ ID NO: 2589649 - RNA, 14 nt, Human
cucugcuggcccag

SEQ ID NO: 2589650 - RNA, 18 nt, Human
cucugcuggcccagccaa

SEQ ID NO: 2589651 - RNA, 14 nt, Human
cucugcucugcccu

SEQ ID NO: 2589652 - RNA, 13 nt, Human
cucugcucugccc

SEQ ID NO: 2589653 - RNA, 15 nt, Human
cucugcucugcccuu

SEQ ID NO: 2589654 - RNA, 12 nt, Human
cucugcucugcc

SEQ ID NO: 2589655 - RNA, 11 nt, Human
cucugcucugc

SEQ ID NO: 2589656 - RNA, 23 nt, Human
cucugcugacagacacaggcccg

SEQ ID NO: 2589657 - RNA, 13 nt, Human
cucugcugcuggc

SEQ ID NO: 2589658 - RNA, 13 nt, Human
cucugcugccaug

SEQ ID NO: 2589659 - RNA, 15 nt, Human
cucugcugccauggc

SEQ ID NO: 2589660 - RNA, 16 nt, Human
cucugcucgccuuagc

SEQ ID NO: 2589661 - RNA, 17 nt, Human
cucugcucgccuuagca

SEQ ID NO: 2589662 - RNA, 15 nt, Human
cucugcucugaggcu

SEQ ID NO: 2589663 - RNA, 17 nt, Human
cucugcuccuggagccu

SEQ ID NO: 2589664 - RNA, 20 nt, Human
cucugcugacagacacaggc

SEQ ID NO: 2589665 - RNA, 22 nt, Human
cucugcugacagacacaggccc

SEQ ID NO: 2589666 - RNA, 21 nt, Human
cucugcugacagacacaggcc

SEQ ID NO: 2589667 - RNA, 16 nt, Human
cucugcagcccaggga

SEQ ID NO: 2589668 - RNA, 14 nt, Human
cucugcagcccagg

SEQ ID NO: 2589669 - RNA, 16 nt, Human
cucugcagcugaccuc

SEQ ID NO: 2589670 - RNA, 15 nt, Human
cucugcagcugaccu

SEQ ID NO: 2589671 - RNA, 14 nt, Human
cucugcagcugacc

SEQ ID NO: 2589672 - RNA, 12 nt, Human
cucugcagcuga

SEQ ID NO: 2589673 - RNA, 20 nt, Human
cucugcaggaaauggcugug

SEQ ID NO: 2589674 - RNA, 17 nt, Human
cucugcacuccccugcu

SEQ ID NO: 2589675 - RNA, 15 nt, Human
cucugcagccagccc

SEQ ID NO: 2589676 - RNA, 16 nt, Human
cucugcagccagccca

SEQ ID NO: 2589677 - RNA, 17 nt, Human
cucugcagccagcccag

SEQ ID NO: 2589678 - RNA, 18 nt, Human
cucugcagccagcccagc

SEQ ID NO: 2589679 - RNA, 19 nt, Human
cucugcagccagcccagcc

SEQ ID NO: 2589680 - RNA, 22 nt, Human
cucugcuccuggagccuuugaa

SEQ ID NO: 2589681 - RNA, 14 nt, Human
cucugcuccuggag

SEQ ID NO: 2589682 - RNA, 14 nt, Human
cucugcaggcaccu

SEQ ID NO: 2589683 - RNA, 13 nt, Human
cucugcucgccuu

SEQ ID NO: 2589684 - RNA, 15 nt, Human
cucugcucgccuuag

SEQ ID NO: 2589685 - RNA, 21 nt, Human
cucugcuccucuccccagcaa

SEQ ID NO: 2589686 - RNA, 15 nt, Human
cucugcaggcaccuu

SEQ ID NO: 2589687 - RNA, 18 nt, Human
cucugcagcugaccucug

SEQ ID NO: 2589688 - RNA, 21 nt, Human
cucgugccagucgcgcugccu

SEQ ID NO: 2589689 - RNA, 18 nt, Human
cucgugauuggcauauaa

SEQ ID NO: 2589690 - RNA, 22 nt, Human
cucgugccagucgcgcugccug

SEQ ID NO: 2589691 - RNA, 24 nt, Human
cucgugccagucgcgcugccugug

SEQ ID NO: 2589692 - RNA, 18 nt, Human
cucuaucuugcucuguaa

SEQ ID NO: 2589693 - RNA, 16 nt, Human
cucuaucuugcucugu

SEQ ID NO: 2589694 - RNA, 20 nt, Human
cucuaugaacucuguuuucu

SEQ ID NO: 2589695 - RNA, 15 nt, Human
cucuaucuugcucug

SEQ ID NO: 2589696 - RNA, 17 nt, Human
cucuaugccagcucagu

SEQ ID NO: 2589697 - RNA, 16 nt, Human
cucguccucccccugc

SEQ ID NO: 2589698 - RNA, 17 nt, Human
cucguccucccccugcc

SEQ ID NO: 2589699 - RNA, 18 nt, Human
cucguccucccccugcca

SEQ ID NO: 2589700 - RNA, 20 nt, Human
cucguccucccccugccagu

SEQ ID NO: 2589701 - RNA, 22 nt, Human
cucguccucccccugccagugc

SEQ ID NO: 2589702 - RNA, 14 nt, Human
cucgucuucauuaa

SEQ ID NO: 2589703 - RNA, 17 nt, Human
cucgucugacugugugu

SEQ ID NO: 2589704 - RNA, 24 nt, Human
cucguccucccccugccagugccu

SEQ ID NO: 2589705 - RNA, 20 nt, Human
cucgucggggggacagcucc

SEQ ID NO: 2589706 - RNA, 17 nt, Human
cucgguguggagaagcg

SEQ ID NO: 2589707 - RNA, 15 nt, Human
cucguccucccccug

SEQ ID NO: 2589708 - RNA, 16 nt, Human
cucgguguggagaagc

SEQ ID NO: 2589709 - RNA, 19 nt, Human
cucggugguaccaggucuc

SEQ ID NO: 2589710 - RNA, 11 nt, Human
cucggugguac

SEQ ID NO: 2589711 - RNA, 18 nt, Human
cucgguggacccagggau

SEQ ID NO: 2589712 - RNA, 13 nt, Human
cuccuuuguauau

SEQ ID NO: 2589713 - RNA, 12 nt, Human
cuccuuuguaua

SEQ ID NO: 2589714 - RNA, 17 nt, Human
cuccuuuggccauucca

SEQ ID NO: 2589715 - RNA, 18 nt, Human
cuccuuugugaggaagcc

SEQ ID NO: 2589716 - RNA, 17 nt, Human
cuccuuugugaggaagc

SEQ ID NO: 2589717 - RNA, 20 nt, Human
cuccuuucacaaccuucugu

SEQ ID NO: 2589718 - RNA, 20 nt, Human
cuccuuuguacuuugugcuu

SEQ ID NO: 2589719 - RNA, 17 nt, Human
cuccuuuguacuuugug

SEQ ID NO: 2589720 - RNA, 14 nt, Human
cuccuuuguacuuu

SEQ ID NO: 2589721 - RNA, 13 nt, Human
cuccuuuguacuu

SEQ ID NO: 2589722 - RNA, 11 nt, Human
cucuccucccc

SEQ ID NO: 2589723 - RNA, 13 nt, Human
cucucuggcuggg

SEQ ID NO: 2589724 - RNA, 19 nt, Human
cucucuggccuuuuccuau

SEQ ID NO: 2589725 - RNA, 17 nt, Human
cucucuggccuuuuccu

SEQ ID NO: 2589726 - RNA, 15 nt, Human
cucuccuccccaaau

SEQ ID NO: 2589727 - RNA, 15 nt, Human
cucucuggcugggga

SEQ ID NO: 2589728 - RNA, 20 nt, Human
cucucuggggccacacagaa

SEQ ID NO: 2589729 - RNA, 19 nt, Human
cucucuggggccacacaga

SEQ ID NO: 2589730 - RNA, 18 nt, Human
cucucuggggccacacag

SEQ ID NO: 2589731 - RNA, 23 nt, Human
cucucuggggcaggguuauuccu

SEQ ID NO: 2589732 - RNA, 23 nt, Human
cucucuuauagaauauuuauuac

SEQ ID NO: 2589733 - RNA, 12 nt, Human
cucucuucugcu

SEQ ID NO: 2589734 - RNA, 14 nt, Human
cucucuucugcucc

SEQ ID NO: 2589735 - RNA, 15 nt, Human
cucucuucugcucca

SEQ ID NO: 2589736 - RNA, 16 nt, Human
cucucuucugcuccac

SEQ ID NO: 2589737 - RNA, 21 nt, Human
cucucuuauagaauauuuauu

SEQ ID NO: 2589738 - RNA, 19 nt, Human
cucucuuauagaauauuua

SEQ ID NO: 2589739 - RNA, 19 nt, Human
cucucugugggcuggcagu

SEQ ID NO: 2589740 - RNA, 16 nt, Human
cucucugugcugugga

SEQ ID NO: 2589741 - RNA, 18 nt, Human
cucucuuauagaauauuu

SEQ ID NO: 2589742 - RNA, 20 nt, Human
cucucuuaggagcagagcuc

SEQ ID NO: 2589743 - RNA, 15 nt, Human
cucuccccaugaugu

SEQ ID NO: 2589744 - RNA, 16 nt, Human
cucuccccaugauguu

SEQ ID NO: 2589745 - RNA, 19 nt, Human
cucuauguucuaagaagug

SEQ ID NO: 2589746 - RNA, 22 nt, Human
cucuaugggcagaucuaccccu

SEQ ID NO: 2589747 - RNA, 21 nt, Human
cucuaugccagcucaguccca

SEQ ID NO: 2589748 - RNA, 21 nt, Human
cucucccgucagggcccaagu

SEQ ID NO: 2589749 - RNA, 17 nt, Human
cucucccgucagggccc

SEQ ID NO: 2589750 - RNA, 16 nt, Human
cucucccgucagggcc

SEQ ID NO: 2589751 - RNA, 15 nt, Human
cucucccgucagggc

SEQ ID NO: 2589752 - RNA, 13 nt, Human
cucucccuccccu

SEQ ID NO: 2589753 - RNA, 17 nt, Human
cucucccuccccugcca

SEQ ID NO: 2589754 - RNA, 23 nt, Human
cucucccucaacaagggagagac

SEQ ID NO: 2589755 - RNA, 12 nt, Human
cucucccucugg

SEQ ID NO: 2589756 - RNA, 13 nt, Human
cucucccucuggc

SEQ ID NO: 2589757 - RNA, 18 nt, Human
cucucccucuggcccugc

SEQ ID NO: 2589758 - RNA, 19 nt, Human
cucucccucuggcccugcc

SEQ ID NO: 2589759 - RNA, 21 nt, Human
cucucccucuggcccugccuu

SEQ ID NO: 2589760 - RNA, 22 nt, Human
cucucccucuggcccugccuuc

SEQ ID NO: 2589761 - RNA, 23 nt, Human
cucuccccccccccuccaauccu

SEQ ID NO: 2589762 - RNA, 21 nt, Human
cucuccccccccccuccaauc

SEQ ID NO: 2589763 - RNA, 19 nt, Human
cucuccccccccccuccaa

SEQ ID NO: 2589764 - RNA, 17 nt, Human
cucuccccccccccucc

SEQ ID NO: 2589765 - RNA, 16 nt, Human
cucucccccacccccu

SEQ ID NO: 2589766 - RNA, 13 nt, Human
cucucccccaccc

SEQ ID NO: 2589767 - RNA, 14 nt, Human
cucuccccucaaag

SEQ ID NO: 2589768 - RNA, 12 nt, Human
cucuccccucaa

SEQ ID NO: 2589769 - RNA, 21 nt, Human
cucuccccucaaagucugcaa

SEQ ID NO: 2589770 - RNA, 18 nt, Human
cucuccccucaaagucug

SEQ ID NO: 2589771 - RNA, 19 nt, Human
cucucccgguucuuccagu

SEQ ID NO: 2589772 - RNA, 14 nt, Human
cucucuggccuucg

SEQ ID NO: 2589773 - RNA, 16 nt, Human
cucucuggccuucggc

SEQ ID NO: 2589774 - RNA, 13 nt, Human
cucucuggccuuc

SEQ ID NO: 2589775 - RNA, 16 nt, Human
cucuccuccagaguca

SEQ ID NO: 2589776 - RNA, 15 nt, Human
cucuccuccagaguc

SEQ ID NO: 2589777 - RNA, 13 nt, Human
cucuccuccagag

SEQ ID NO: 2589778 - RNA, 16 nt, Human
cucucccucuucucaa

SEQ ID NO: 2589779 - RNA, 12 nt, Human
cucuccuccaga

SEQ ID NO: 2589780 - RNA, 20 nt, Human
cucucccugacccuguauau

SEQ ID NO: 2589781 - RNA, 14 nt, Human
cucucccugacccu

SEQ ID NO: 2589782 - RNA, 13 nt, Human
cucucccugaccc

SEQ ID NO: 2589783 - RNA, 12 nt, Human
cucucccugacc

SEQ ID NO: 2589784 - RNA, 17 nt, Human
cucaguccauagcagag

SEQ ID NO: 2589785 - RNA, 15 nt, Human
cucaguccauagcag

SEQ ID NO: 2589786 - RNA, 18 nt, Human
cucagucaugcauaaaua

SEQ ID NO: 2589787 - RNA, 16 nt, Human
cucagucaugcauaaa

SEQ ID NO: 2589788 - RNA, 15 nt, Human
cucagucaugcauaa

SEQ ID NO: 2589789 - RNA, 14 nt, Human
cucagucaugcaua

SEQ ID NO: 2589790 - RNA, 13 nt, Human
cucagucaguauu

SEQ ID NO: 2589791 - RNA, 13 nt, Human
cucagucauaauc

SEQ ID NO: 2589792 - RNA, 14 nt, Human
cucagguugucuga

SEQ ID NO: 2589793 - RNA, 19 nt, Human
cucagguuguaguaaagaa

SEQ ID NO: 2589794 - RNA, 22 nt, Human
cucagguuguaguaaagaaauu

SEQ ID NO: 2589795 - RNA, 16 nt, Human
cucaguccaugaagau

SEQ ID NO: 2589796 - RNA, 23 nt, Human
cucagucaugcauaaauaugcag

SEQ ID NO: 2589797 - RNA, 22 nt, Human
cucagucaugcauaaauaugca

SEQ ID NO: 2589798 - RNA, 18 nt, Human
cucagucauuagacuccu

SEQ ID NO: 2589799 - RNA, 16 nt, Human
cucaguccaccugagc

SEQ ID NO: 2589800 - RNA, 17 nt, Human
cucaguccaccugagcu

SEQ ID NO: 2589801 - RNA, 18 nt, Human
cucaguccaccugagcug

SEQ ID NO: 2589802 - RNA, 20 nt, Human
cucaguccuccccucacagc

SEQ ID NO: 2589803 - RNA, 19 nt, Human
cucaguccuccccucacag

SEQ ID NO: 2589804 - RNA, 18 nt, Human
cucaguccuccccucaca

SEQ ID NO: 2589805 - RNA, 17 nt, Human
cucaguccuccccucac

SEQ ID NO: 2589806 - RNA, 16 nt, Human
cucaguccuccccuca

SEQ ID NO: 2589807 - RNA, 14 nt, Human
cucaguccuccccu

SEQ ID NO: 2589808 - RNA, 17 nt, Human
cucagucccccaacaga

SEQ ID NO: 2589809 - RNA, 20 nt, Human
cucagucuggcccuuccuuu

SEQ ID NO: 2589810 - RNA, 22 nt, Human
cucagucuggcccuuccuuuuc

SEQ ID NO: 2589811 - RNA, 23 nt, Human
cucaugauagaaggcuaugggga

SEQ ID NO: 2589812 - RNA, 22 nt, Human
cucaugaggggcccgagcagaa

SEQ ID NO: 2589813 - RNA, 19 nt, Human
cucaugcaaaucaauuacu

SEQ ID NO: 2589814 - RNA, 20 nt, Human
cucaugcaaaucaauuacug

SEQ ID NO: 2589815 - RNA, 16 nt, Human
cucaugcaaaucaauu

SEQ ID NO: 2589816 - RNA, 19 nt, Human
cucaugaucuugugacaua

SEQ ID NO: 2589817 - RNA, 20 nt, Human
cucaugaucuugugacauau

SEQ ID NO: 2589818 - RNA, 19 nt, Human
cucauggccccucugaccu

SEQ ID NO: 2589819 - RNA, 17 nt, Human
cucauggccccucugac

SEQ ID NO: 2589820 - RNA, 15 nt, Human
cucauggccccucug

SEQ ID NO: 2589821 - RNA, 14 nt, Human
cucauggccccucu

SEQ ID NO: 2589822 - RNA, 18 nt, Human
cucaugcaucuccaccug

SEQ ID NO: 2589823 - RNA, 17 nt, Human
cucaugcaucuccaccu

SEQ ID NO: 2589824 - RNA, 16 nt, Human
cucaugcaucuccacc

SEQ ID NO: 2589825 - RNA, 14 nt, Human
cucaugcaucucca

SEQ ID NO: 2589826 - RNA, 15 nt, Human
cucaugcagccguga

SEQ ID NO: 2589827 - RNA, 14 nt, Human
cucaugcagccgug

SEQ ID NO: 2589828 - RNA, 12 nt, Human
cucaugcaucuc

SEQ ID NO: 2589829 - RNA, 23 nt, Human
cucagguugcugguugcugugug

SEQ ID NO: 2589830 - RNA, 22 nt, Human
cucagguugcugguugcugugu

SEQ ID NO: 2589831 - RNA, 21 nt, Human
cucagguugcugguugcugug

SEQ ID NO: 2589832 - RNA, 20 nt, Human
cucagguugcugguugcugu

SEQ ID NO: 2589833 - RNA, 20 nt, Human
cucagguuccuauggcuggc

SEQ ID NO: 2589834 - RNA, 12 nt, Human
cucagguuccua

SEQ ID NO: 2589835 - RNA, 15 nt, Human
cucagguguugccaa

SEQ ID NO: 2589836 - RNA, 14 nt, Human
cucagguguugcca

SEQ ID NO: 2589837 - RNA, 23 nt, Human
cucaggugucccugcacuugcag

SEQ ID NO: 2589838 - RNA, 20 nt, Human
cucaggcgauccaccugucu

SEQ ID NO: 2589839 - RNA, 13 nt, Human
cucaggcucugcc

SEQ ID NO: 2589840 - RNA, 21 nt, Human
cucaggcgauccaccugucuc

SEQ ID NO: 2589841 - RNA, 14 nt, Human
cucaggcucugccc

SEQ ID NO: 2589842 - RNA, 15 nt, Human
cucaggcucugcccu

SEQ ID NO: 2589843 - RNA, 16 nt, Human
cucaggcucugcccug

SEQ ID NO: 2589844 - RNA, 17 nt, Human
cucaggcucugcccugc

SEQ ID NO: 2589845 - RNA, 19 nt, Human
cucaggcucugcccugccc

SEQ ID NO: 2589846 - RNA, 22 nt, Human
cucaggcucugcccugcccuag

SEQ ID NO: 2589847 - RNA, 11 nt, Human
cucaggcugcu

SEQ ID NO: 2589848 - RNA, 12 nt, Human
cucaggcugcug

SEQ ID NO: 2589849 - RNA, 13 nt, Human
cucaggcugcugg

SEQ ID NO: 2589850 - RNA, 14 nt, Human
cucaggcugcugga

SEQ ID NO: 2589851 - RNA, 15 nt, Human
cucaggcugcuggag

SEQ ID NO: 2589852 - RNA, 16 nt, Human
cucaggcugcuggagg

SEQ ID NO: 2589853 - RNA, 17 nt, Human
cucaggcugcuggagga

SEQ ID NO: 2589854 - RNA, 14 nt, Human
cucagggacagaga

SEQ ID NO: 2589855 - RNA, 20 nt, Human
cucagggaaaagcagcucuc

SEQ ID NO: 2589856 - RNA, 22 nt, Human
cucagggaaaagcagcucuccc

SEQ ID NO: 2589857 - RNA, 15 nt, Human
cucaggcuugaaaug

SEQ ID NO: 2589858 - RNA, 17 nt, Human
cucaggcuggugggagg

SEQ ID NO: 2589859 - RNA, 17 nt, Human
cucaggcuuccuuggca

SEQ ID NO: 2589860 - RNA, 22 nt, Human
cucaggcuuucacuauuuccuu

SEQ ID NO: 2589861 - RNA, 21 nt, Human
cucaggcuuucacuauuuccu

SEQ ID NO: 2589862 - RNA, 17 nt, Human
cucagggaaaagcagcu

SEQ ID NO: 2589863 - RNA, 20 nt, Human
cucagggacagagacaccug

SEQ ID NO: 2589864 - RNA, 17 nt, Human
cucagggaaaggccagu

SEQ ID NO: 2589865 - RNA, 19 nt, Human
cucagggacagagacaccu

SEQ ID NO: 2589866 - RNA, 23 nt, Human
cucagggaaaagcagcucucccc

SEQ ID NO: 2589867 - RNA, 20 nt, Human
cucaggccaaacucaccugc

SEQ ID NO: 2589868 - RNA, 19 nt, Human
cucaggccaaacucaccug

SEQ ID NO: 2589869 - RNA, 21 nt, Human
cucaggccaaacucaccugcc

SEQ ID NO: 2589870 - RNA, 20 nt, Human
cucaggccaagaaacgucuu

SEQ ID NO: 2589871 - RNA, 19 nt, Human
cucaggccaacaagccaac

SEQ ID NO: 2589872 - RNA, 15 nt, Human
cucaggccagcugcu

SEQ ID NO: 2589873 - RNA, 16 nt, Human
cucagccuggccagac

SEQ ID NO: 2589874 - RNA, 17 nt, Human
cucagccuggccagaca

SEQ ID NO: 2589875 - RNA, 19 nt, Human
cucagccuggccagacaca

SEQ ID NO: 2589876 - RNA, 20 nt, Human
cucagccuggccagacacag

SEQ ID NO: 2589877 - RNA, 13 nt, Human
cucagccuggcca

SEQ ID NO: 2589878 - RNA, 14 nt, Human
cucagccuggccag

SEQ ID NO: 2589879 - RNA, 15 nt, Human
cucagccuggccaga

SEQ ID NO: 2589880 - RNA, 23 nt, Human
cucagccuccuguguagcuggga

SEQ ID NO: 2589881 - RNA, 17 nt, Human
cucagccucugaauaug

SEQ ID NO: 2589882 - RNA, 23 nt, Human
cucaggccgaaggaggagucagg

SEQ ID NO: 2589883 - RNA, 18 nt, Human
cucaggccagcugcuugg

SEQ ID NO: 2589884 - RNA, 17 nt, Human
cucaggccagcugcuug

SEQ ID NO: 2589885 - RNA, 16 nt, Human
cucaggccagcugcuu

SEQ ID NO: 2589886 - RNA, 11 nt, Human
cucaggccugg

SEQ ID NO: 2589887 - RNA, 22 nt, Human
cucaggccugggggcugggcag

SEQ ID NO: 2589888 - RNA, 15 nt, Human
cucaggccacaccgg

SEQ ID NO: 2589889 - RNA, 20 nt, Human
cucaggccugacucucagca

SEQ ID NO: 2589890 - RNA, 23 nt, Human
cucaggccuauaaccccagcucc

SEQ ID NO: 2589891 - RNA, 22 nt, Human
cucagaagacacugaugggcaa

SEQ ID NO: 2589892 - RNA, 20 nt, Human
cucagaagacacugaugggc

SEQ ID NO: 2589893 - RNA, 17 nt, Human
cucagaagacacugaug

SEQ ID NO: 2589894 - RNA, 15 nt, Human
cucagaagacacuga

SEQ ID NO: 2589895 - RNA, 21 nt, Human
cucagaaauuuuuauuuuucu

SEQ ID NO: 2589896 - RNA, 17 nt, Human
cucagaaauuuuuauuu

SEQ ID NO: 2589897 - RNA, 20 nt, Human
cucacuaccuccucagggau

SEQ ID NO: 2589898 - RNA, 22 nt, Human
cucacuaggcccccacuugccu

SEQ ID NO: 2589899 - RNA, 18 nt, Human
cucacuaggcccccacuu

SEQ ID NO: 2589900 - RNA, 16 nt, Human
cucacuaccuccucag

SEQ ID NO: 2589901 - RNA, 15 nt, Human
cucacuaccuccuca

SEQ ID NO: 2589902 - RNA, 12 nt, Human
cucacuaccucc

SEQ ID NO: 2589903 - RNA, 20 nt, Human
cucacuacccuauucucucu

SEQ ID NO: 2589904 - RNA, 18 nt, Human
cucacuaccuccucaggg

SEQ ID NO: 2589905 - RNA, 17 nt, Human
cucacuaccuccucagg

SEQ ID NO: 2589906 - RNA, 15 nt, Human
cucacuaggccccca

SEQ ID NO: 2589907 - RNA, 14 nt, Human
cucagaacccuugg

SEQ ID NO: 2589908 - RNA, 21 nt, Human
cucagaacccuuggcuugccc

SEQ ID NO: 2589909 - RNA, 13 nt, Human
cucagaagacacu

SEQ ID NO: 2589910 - RNA, 13 nt, Human
cucacgccuguaa

SEQ ID NO: 2589911 - RNA, 18 nt, Human
cucacgccuguaauccca

SEQ ID NO: 2589912 - RNA, 19 nt, Human
cucacgccuguaaucccag

SEQ ID NO: 2589913 - RNA, 20 nt, Human
cucacgccuguaaucccagc

SEQ ID NO: 2589914 - RNA, 21 nt, Human
cucacgccuguaaucccagca

SEQ ID NO: 2589915 - RNA, 22 nt, Human
cucacgccuguaaucccagcau

SEQ ID NO: 2589916 - RNA, 22 nt, Human
cucacgccuguaaucccagcag

SEQ ID NO: 2589917 - RNA, 23 nt, Human
cucacgccuguaaucccagcagu

SEQ ID NO: 2589918 - RNA, 17 nt, Human
cucacgggcaugggcac

SEQ ID NO: 2589919 - RNA, 19 nt, Human
cucacgggcaguagcugug

SEQ ID NO: 2589920 - RNA, 13 nt, Human
cucacguguguga

SEQ ID NO: 2589921 - RNA, 21 nt, Human
cucacgggcaugggcacuccc

SEQ ID NO: 2589922 - RNA, 16 nt, Human
cucacgugagaguguc

SEQ ID NO: 2589923 - RNA, 16 nt, Human
cucaccuuuucccggg

SEQ ID NO: 2589924 - RNA, 20 nt, Human
cucacgaauauuaugcccag

SEQ ID NO: 2589925 - RNA, 15 nt, Human
cucacgcaccuccca

SEQ ID NO: 2589926 - RNA, 16 nt, Human
cucacgcaccucccau

SEQ ID NO: 2589927 - RNA, 19 nt, Human
cucacgcaccucccauccu

SEQ ID NO: 2589928 - RNA, 20 nt, Human
cucacgccuaugaucccagc

SEQ ID NO: 2589929 - RNA, 17 nt, Human
cucaccuuucccaucuu

SEQ ID NO: 2589930 - RNA, 18 nt, Human
cucagcccugacuggugc

SEQ ID NO: 2589931 - RNA, 13 nt, Human
cucagcccugacu

SEQ ID NO: 2589932 - RNA, 16 nt, Human
cucagacuuaccagga

SEQ ID NO: 2589933 - RNA, 19 nt, Human
cucagcccugacuggugcu

SEQ ID NO: 2589934 - RNA, 13 nt, Human
cucagcccugagg

SEQ ID NO: 2589935 - RNA, 14 nt, Human
cucagcccugaggu

SEQ ID NO: 2589936 - RNA, 15 nt, Human
cucagcccugaggug

SEQ ID NO: 2589937 - RNA, 14 nt, Human
cucagcccuggagg

SEQ ID NO: 2589938 - RNA, 13 nt, Human
cucagcccuggag

SEQ ID NO: 2589939 - RNA, 12 nt, Human
cucagcccugga

SEQ ID NO: 2589940 - RNA, 11 nt, Human
cucagcccugg

SEQ ID NO: 2589941 - RNA, 20 nt, Human
cucagcccuggaggugccag

SEQ ID NO: 2589942 - RNA, 19 nt, Human
cucagcccuggaggugcca

SEQ ID NO: 2589943 - RNA, 18 nt, Human
cucagcccuggaggugcc

SEQ ID NO: 2589944 - RNA, 15 nt, Human
cucagcccuggaggu

SEQ ID NO: 2589945 - RNA, 22 nt, Human
cucagcccuggaggugccagca

SEQ ID NO: 2589946 - RNA, 12 nt, Human
cucagcccuggg

SEQ ID NO: 2589947 - RNA, 13 nt, Human
cucagcccugggc

SEQ ID NO: 2589948 - RNA, 14 nt, Human
cucagcccugggcc

SEQ ID NO: 2589949 - RNA, 22 nt, Human
cucagccucccgaauagcuggg

SEQ ID NO: 2589950 - RNA, 20 nt, Human
cucagccucaauaagccuug

SEQ ID NO: 2589951 - RNA, 22 nt, Human
cucagccuccuguguagcuggg

SEQ ID NO: 2589952 - RNA, 15 nt, Human
cucagcccugggccc

SEQ ID NO: 2589953 - RNA, 19 nt, Human
cucagcccugggccccacc

SEQ ID NO: 2589954 - RNA, 11 nt, Human
cucagcccugu

SEQ ID NO: 2589955 - RNA, 21 nt, Human
cucagcccugggccccaccac

SEQ ID NO: 2589956 - RNA, 21 nt, Human
cucagccucccgaauagcugg

SEQ ID NO: 2589957 - RNA, 19 nt, Human
cucagccucccgaauagcu

SEQ ID NO: 2589958 - RNA, 23 nt, Human
cucagaagacacugaugggcaac

SEQ ID NO: 2589959 - RNA, 13 nt, Human
cucagaagaaaga

SEQ ID NO: 2589960 - RNA, 15 nt, Human
cucagaagccucugg

SEQ ID NO: 2589961 - RNA, 11 nt, Human
cucagaagccu

SEQ ID NO: 2589962 - RNA, 17 nt, Human
cucagaagccucugggu

SEQ ID NO: 2589963 - RNA, 13 nt, Human
cucagaagccuga

SEQ ID NO: 2589964 - RNA, 14 nt, Human
cucagaagccugag

SEQ ID NO: 2589965 - RNA, 15 nt, Human
cucagaagccugagg

SEQ ID NO: 2589966 - RNA, 18 nt, Human
cucagaagccugaggcug

SEQ ID NO: 2589967 - RNA, 16 nt, Human
cucagaagccugaggc

SEQ ID NO: 2589968 - RNA, 17 nt, Human
cucagaagccugaggcu

SEQ ID NO: 2589969 - RNA, 22 nt, Human
cucagacucuuuuuguaccugg

SEQ ID NO: 2589970 - RNA, 23 nt, Human
cucagacccccacucucauuccc

SEQ ID NO: 2589971 - RNA, 14 nt, Human
cucagacuccauuu

SEQ ID NO: 2589972 - RNA, 14 nt, Human
cucagacccccacu

SEQ ID NO: 2589973 - RNA, 15 nt, Human
cucagacccccacuc

SEQ ID NO: 2589974 - RNA, 16 nt, Human
cucagacccccacucu

SEQ ID NO: 2589975 - RNA, 22 nt, Human
cucagacccccacucucauucc

SEQ ID NO: 2589976 - RNA, 13 nt, Human
cucagacccccac

SEQ ID NO: 2589977 - RNA, 16 nt, Human
cucagaccagcucuuc

SEQ ID NO: 2589978 - RNA, 14 nt, Human
cucagaccagcucu

SEQ ID NO: 2589979 - RNA, 15 nt, Human
cucagaccagcucuu

SEQ ID NO: 2589980 - RNA, 20 nt, Human
cuacaaacaaaauuucuauu

SEQ ID NO: 2589981 - RNA, 17 nt, Human
cuacaaacaaaauuucu

SEQ ID NO: 2589982 - RNA, 15 nt, Human
cuacaaacaaaauuu

SEQ ID NO: 2589983 - RNA, 13 nt, Human
cuacaaacaaaau

SEQ ID NO: 2589984 - RNA, 21 nt, Human
cuacaaaaccugauguuaaaa

SEQ ID NO: 2589985 - RNA, 17 nt, Human
cuacaaaauuugaaauu

SEQ ID NO: 2589986 - RNA, 18 nt, Human
cuacaaaauuugaaauuu

SEQ ID NO: 2589987 - RNA, 20 nt, Human
cuacaaaaccugauguuaaa

SEQ ID NO: 2589988 - RNA, 15 nt, Human
cuaauuuuggaugga

SEQ ID NO: 2589989 - RNA, 19 nt, Human
cuauccugaaaauucugua

SEQ ID NO: 2589990 - RNA, 13 nt, Human
cuauccucuguaa

SEQ ID NO: 2589991 - RNA, 12 nt, Human
cuauccucugua

SEQ ID NO: 2589992 - RNA, 17 nt, Human
cuauccuacuuccccuu

SEQ ID NO: 2589993 - RNA, 23 nt, Human
cuaucagugugccccccauccug

SEQ ID NO: 2589994 - RNA, 21 nt, Human
cuaucagugugccccccaucc

SEQ ID NO: 2589995 - RNA, 18 nt, Human
cuaucagugugcccccca

SEQ ID NO: 2589996 - RNA, 17 nt, Human
cuaucagugugcccccc

SEQ ID NO: 2589997 - RNA, 14 nt, Human
cuaucauggaguga

SEQ ID NO: 2589998 - RNA, 13 nt, Human
cuauccuacccca

SEQ ID NO: 2589999 - RNA, 16 nt, Human
cuaucaccuauuucca

SEQ ID NO: 2590000 - RNA, 17 nt, Human
cuaucaccuauuuccau

SEQ ID NO: 2590001 - RNA, 14 nt, Human
cuaucaccuccccu

SEQ ID NO: 2590002 - RNA, 15 nt, Human
cuaucaccuccccuc

SEQ ID NO: 2590003 - RNA, 16 nt, Human
cuaucagugugccccc

SEQ ID NO: 2590004 - RNA, 12 nt, Human
cuaucagugugc

SEQ ID NO: 2590005 - RNA, 20 nt, Human
cuaucagccugucucuucca

SEQ ID NO: 2590006 - RNA, 15 nt, Human
cuaucagccugucuc

SEQ ID NO: 2590007 - RNA, 19 nt, Human
cuaucagaguugcugcaaa

SEQ ID NO: 2590008 - RNA, 13 nt, Human
cuaucagaagacc

SEQ ID NO: 2590009 - RNA, 21 nt, Human
cuaucagaggugaaagcuaua

SEQ ID NO: 2590010 - RNA, 16 nt, Human
cuaucaccuccccucc

SEQ ID NO: 2590011 - RNA, 17 nt, Human
cuaucaccuccccuccu

SEQ ID NO: 2590012 - RNA, 19 nt, Human
cuaucaccuccccuccuug

SEQ ID NO: 2590013 - RNA, 18 nt, Human
cuauguucuaagaaguga

SEQ ID NO: 2590014 - RNA, 12 nt, Human
cuaugugacaau

SEQ ID NO: 2590015 - RNA, 22 nt, Human
cuauguugcccaggcaggucuu

SEQ ID NO: 2590016 - RNA, 21 nt, Human
cuauguugcccaggcaggucu

SEQ ID NO: 2590017 - RNA, 19 nt, Human
cuauguugcccaggcaggu

SEQ ID NO: 2590018 - RNA, 18 nt, Human
cuauguugcccaggcagg

SEQ ID NO: 2590019 - RNA, 14 nt, Human
cuaucucccccagc

SEQ ID NO: 2590020 - RNA, 13 nt, Human
cuaucucccccag

SEQ ID NO: 2590021 - RNA, 18 nt, Human
cuaucucauuuccaagca

SEQ ID NO: 2590022 - RNA, 18 nt, Human
cuaucucaauccuaauuu

SEQ ID NO: 2590023 - RNA, 19 nt, Human
cuauccuggcucuuuggag

SEQ ID NO: 2590024 - RNA, 13 nt, Human
cuauccuggcucu

SEQ ID NO: 2590025 - RNA, 12 nt, Human
cuaucucaucua

SEQ ID NO: 2590026 - RNA, 21 nt, Human
cuaucucaucuaucucaaucc

SEQ ID NO: 2590027 - RNA, 13 nt, Human
cuaugucccuugc

SEQ ID NO: 2590028 - RNA, 14 nt, Human
cuauguccuaagga

SEQ ID NO: 2590029 - RNA, 16 nt, Human
cuaugucccuugcugu

SEQ ID NO: 2590030 - RNA, 14 nt, Human
cuaugugagaccau

SEQ ID NO: 2590031 - RNA, 21 nt, Human
cuauguccuaaggacacacua

SEQ ID NO: 2590032 - RNA, 20 nt, Human
cuauguccuaaggacacacu

SEQ ID NO: 2590033 - RNA, 18 nt, Human
cuauguccuaaggacaca

SEQ ID NO: 2590034 - RNA, 15 nt, Human
cuauguccuaaggac

SEQ ID NO: 2590035 - RNA, 23 nt, Human
cuauguccuaaggacacacuaau

SEQ ID NO: 2590036 - RNA, 22 nt, Human
cuauguccuaaggacacacuaa

SEQ ID NO: 2590037 - RNA, 22 nt, Human
cuauguuuuuguucaaagccag

SEQ ID NO: 2590038 - RNA, 21 nt, Human
cucaagugauucuccugccuc

SEQ ID NO: 2590039 - RNA, 19 nt, Human
cuauguuuugacauuuuua

SEQ ID NO: 2590040 - RNA, 18 nt, Human
cuauguuuugacauuuuu

SEQ ID NO: 2590041 - RNA, 20 nt, Human
cuaugugacuugcaucgugg

SEQ ID NO: 2590042 - RNA, 20 nt, Human
cuauguuuacaaauggacau

SEQ ID NO: 2590043 - RNA, 20 nt, Human
cuauguuuuuguucaaagcc

SEQ ID NO: 2590044 - RNA, 15 nt, Human
cucaagugcccucuc

SEQ ID NO: 2590045 - RNA, 9 nt, Human
cucaagugc

SEQ ID NO: 2590046 - RNA, 22 nt, Human
cucaagugggaacgacugggca

SEQ ID NO: 2590047 - RNA, 22 nt, Human
cucaagugcccucuccgagcug

SEQ ID NO: 2590048 - RNA, 22 nt, Human
cucaagugucucaguccaccug

SEQ ID NO: 2590049 - RNA, 14 nt, Human
cucaaguugaaaga

SEQ ID NO: 2590050 - RNA, 19 nt, Human
cucaaguuuuucagaaagc

SEQ ID NO: 2590051 - RNA, 18 nt, Human
cucaaguuuuucagaaag

SEQ ID NO: 2590052 - RNA, 20 nt, Human
cucaaguuuuucagaaagca

SEQ ID NO: 2590053 - RNA, 13 nt, Human
cucaauaaaauca

SEQ ID NO: 2590054 - RNA, 22 nt, Human
cucaauaaaaucauguacauuu

SEQ ID NO: 2590055 - RNA, 23 nt, Human
cucaauaaaaucauguacauuuc

SEQ ID NO: 2590056 - RNA, 13 nt, Human
cucaauauuuucc

SEQ ID NO: 2590057 - RNA, 19 nt, Human
cucaauauuuuccaugaaa

SEQ ID NO: 2590058 - RNA, 18 nt, Human
cucaauauuuuccaugaa

SEQ ID NO: 2590059 - RNA, 23 nt, Human
cucaauuauuuugcauuuuuucu

SEQ ID NO: 2590060 - RNA, 16 nt, Human
cucaaugugaccaggg

SEQ ID NO: 2590061 - RNA, 15 nt, Human
cucaaugugaccagg

SEQ ID NO: 2590062 - RNA, 18 nt, Human
cucaaugugaccaggggu

SEQ ID NO: 2590063 - RNA, 20 nt, Human
cucaaugugaaucagacccu

SEQ ID NO: 2590064 - RNA, 14 nt, Human
cucaaugugaccag

SEQ ID NO: 2590065 - RNA, 21 nt, Human
cucaaugugaaucagacccua

SEQ ID NO: 2590066 - RNA, 19 nt, Human
cucaauucccccuggccac

SEQ ID NO: 2590067 - RNA, 18 nt, Human
cucaauucccccuggcca

SEQ ID NO: 2590068 - RNA, 19 nt, Human
cucaauguuacuaucugcu

SEQ ID NO: 2590069 - RNA, 20 nt, Human
cucaauggacuggaagggga

SEQ ID NO: 2590070 - RNA, 17 nt, Human
cucaauggacuggaagg

SEQ ID NO: 2590071 - RNA, 14 nt, Human
cucaauggacugga

SEQ ID NO: 2590072 - RNA, 20 nt, Human
cucaauccuaauuucuccuc

SEQ ID NO: 2590073 - RNA, 19 nt, Human
cucaauccuaauuucuccu

SEQ ID NO: 2590074 - RNA, 14 nt, Human
cucaauccuaauuu

SEQ ID NO: 2590075 - RNA, 23 nt, Human
cucaauccuaauuucuccucccu

SEQ ID NO: 2590076 - RNA, 22 nt, Human
cucaauccuaauuucuccuccc

SEQ ID NO: 2590077 - RNA, 14 nt, Human
cucaauccucuaag

SEQ ID NO: 2590078 - RNA, 14 nt, Human
cucaauccauguuc

SEQ ID NO: 2590079 - RNA, 15 nt, Human
cucaauccauguucu

SEQ ID NO: 2590080 - RNA, 18 nt, Human
cucaaucccagcuacuca

SEQ ID NO: 2590081 - RNA, 15 nt, Human
cucaaucaagaaaau

SEQ ID NO: 2590082 - RNA, 22 nt, Human
cucaauauuuuccaugaaaaug

SEQ ID NO: 2590083 - RNA, 17 nt, Human
aaauuucagcagcugca

SEQ ID NO: 2590084 - RNA, 18 nt, Human
aaauuucagcagcugcag

SEQ ID NO: 2590085 - RNA, 23 nt, Human
aaauuccuauugugauuugacug

SEQ ID NO: 2590086 - RNA, 14 nt, Human
aaauuccucuuugc

SEQ ID NO: 2590087 - RNA, 18 nt, Human
aaauuccucuuugcuuug

SEQ ID NO: 2590088 - RNA, 19 nt, Human
aaauuccucuuugcuuugc

SEQ ID NO: 2590089 - RNA, 17 nt, Human
aaauuuaauucauguuu

SEQ ID NO: 2590090 - RNA, 18 nt, Human
aaauuuaauucauguuuc

SEQ ID NO: 2590091 - RNA, 22 nt, Human
aaauuccuauugugauuugacu

SEQ ID NO: 2590092 - RNA, 18 nt, Human
aaauuccuauugugauuu

SEQ ID NO: 2590093 - RNA, 17 nt, Human
aaauuccuauugugauu

SEQ ID NO: 2590094 - RNA, 16 nt, Human
aaauuccuauugugau

SEQ ID NO: 2590095 - RNA, 18 nt, Human
aaauucccuucaucugga

SEQ ID NO: 2590096 - RNA, 15 nt, Human
aaauuccuauuguga

SEQ ID NO: 2590097 - RNA, 14 nt, Human
guauuuuuuuacua

SEQ ID NO: 2590098 - RNA, 15 nt, Human
guauuuuuuuacuaa

SEQ ID NO: 2590099 - RNA, 15 nt, Human
aaauuuaguuuuugu

SEQ ID NO: 2590100 - RNA, 20 nt, Human
aaauuuauacaccaauugau

SEQ ID NO: 2590101 - RNA, 18 nt, Human
aaauuuaguuuuuguucu

SEQ ID NO: 2590102 - RNA, 20 nt, Human
aaauuuccccaacaguguga

SEQ ID NO: 2590103 - RNA, 19 nt, Human
aaauuuccccaacagugug

SEQ ID NO: 2590104 - RNA, 18 nt, Human
aaauuuccccaacagugu

SEQ ID NO: 2590105 - RNA, 17 nt, Human
aaauuuccccaacagug

SEQ ID NO: 2590106 - RNA, 22 nt, Human
aaauuuccaguaccuuugucac

SEQ ID NO: 2590107 - RNA, 23 nt, Human
aaauuuccaguaccuuugucaca

SEQ ID NO: 2590108 - RNA, 16 nt, Human
aaauuuccccaacagu

SEQ ID NO: 2590109 - RNA, 19 nt, Human
aaauuuccagugagcuuau

SEQ ID NO: 2590110 - RNA, 12 nt, Human
aaauuucagauu

SEQ ID NO: 2590111 - RNA, 16 nt, Human
aaauuuccaguaccuu

SEQ ID NO: 2590112 - RNA, 20 nt, Human
gucacacaguauuacuucug

SEQ ID NO: 2590113 - RNA, 16 nt, Human
gucacacacuuuggcu

SEQ ID NO: 2590114 - RNA, 21 nt, Human
gucacaaauccuaaaagaagc

SEQ ID NO: 2590115 - RNA, 16 nt, Human
gucaaccuccuggaca

SEQ ID NO: 2590116 - RNA, 17 nt, Human
gucaacuucaacauuua

SEQ ID NO: 2590117 - RNA, 13 nt, Human
gucacacacugau

SEQ ID NO: 2590118 - RNA, 17 nt, Human
gucacaagagcccagca

SEQ ID NO: 2590119 - RNA, 15 nt, Human
gucaaccuccuggac

SEQ ID NO: 2590120 - RNA, 14 nt, Human
gucaaccuccugga

SEQ ID NO: 2590121 - RNA, 14 nt, Human
gucaaccugggcaa

SEQ ID NO: 2590122 - RNA, 19 nt, Human
gucaaccugggcaaagccu

SEQ ID NO: 2590123 - RNA, 13 nt, Human
gucaaccuccugg

SEQ ID NO: 2590124 - RNA, 22 nt, Human
gucaaaugguaggcauuuccua

SEQ ID NO: 2590125 - RNA, 15 nt, Human
gucaaauuauguauu

SEQ ID NO: 2590126 - RNA, 23 nt, Human
gucaaaaaguuugguucuguguc

SEQ ID NO: 2590127 - RNA, 18 nt, Human
gucaaaguggugagaggc

SEQ ID NO: 2590128 - RNA, 17 nt, Human
gucaaauaaacacugug

SEQ ID NO: 2590129 - RNA, 15 nt, Human
gucaaauaaacacug

SEQ ID NO: 2590130 - RNA, 14 nt, Human
gucaaauaaacacu

SEQ ID NO: 2590131 - RNA, 13 nt, Human
gucaaauaaacac

SEQ ID NO: 2590132 - RNA, 12 nt, Human
gucaaauaaaca

SEQ ID NO: 2590133 - RNA, 19 nt, Human
gucaaaguggugagaggca

SEQ ID NO: 2590134 - RNA, 17 nt, Human
guauuuuuuuacuaaua

SEQ ID NO: 2590135 - RNA, 21 nt, Human
guauuuuuuuacuaauagaca

SEQ ID NO: 2590136 - RNA, 16 nt, Human
guauuuuuuuuucuaa

SEQ ID NO: 2590137 - RNA, 17 nt, Human
guauuuuuuugcaagug

SEQ ID NO: 2590138 - RNA, 16 nt, Human
guauuuuuuugcaagu

SEQ ID NO: 2590139 - RNA, 14 nt, Human
guauuuuuuugcaa

SEQ ID NO: 2590140 - RNA, 22 nt, Human
guauuuuuuuuucuaagagaag

SEQ ID NO: 2590141 - RNA, 18 nt, Human
guauuuuuuuuucuaaga

SEQ ID NO: 2590142 - RNA, 20 nt, Human
gucaaaaaguuugguucugu

SEQ ID NO: 2590143 - RNA, 23 nt, Human
guauuuuuuuaucuugggacugg

SEQ ID NO: 2590144 - RNA, 23 nt, Human
aaauuuccccaacagugugaagu

SEQ ID NO: 2590145 - RNA, 22 nt, Human
aaauuuccccaacagugugaag

SEQ ID NO: 2590146 - RNA, 20 nt, Human
aaauuauagaugggaaugaa

SEQ ID NO: 2590147 - RNA, 14 nt, Human
aaauuagaugaacu

SEQ ID NO: 2590148 - RNA, 17 nt, Human
aaauuacuuugugaaua

SEQ ID NO: 2590149 - RNA, 14 nt, Human
aaauuacuuuguga

SEQ ID NO: 2590150 - RNA, 12 nt, Human
aaauuagaaaau

SEQ ID NO: 2590151 - RNA, 23 nt, Human
aaauuagaaaccuuaauaugugg

SEQ ID NO: 2590152 - RNA, 11 nt, Human
aaauuagaaaa

SEQ ID NO: 2590153 - RNA, 20 nt, Human
aaauuagaaaauguuauuua

SEQ ID NO: 2590154 - RNA, 15 nt, Human
aaauuauaucaauuu

SEQ ID NO: 2590155 - RNA, 23 nt, Human
aaauuauuuguguaauagaaaac

SEQ ID NO: 2590156 - RNA, 22 nt, Human
aaauuauuuguguaauagaaaa

SEQ ID NO: 2590157 - RNA, 16 nt, Human
aaauuauuuuaaacaa

SEQ ID NO: 2590158 - RNA, 15 nt, Human
aaauuauuuuaaaca

SEQ ID NO: 2590159 - RNA, 16 nt, Human
aaauuauuuuggauuu

SEQ ID NO: 2590160 - RNA, 12 nt, Human
aaauucauuuua

SEQ ID NO: 2590161 - RNA, 13 nt, Human
aaauucauuuuuu

SEQ ID NO: 2590162 - RNA, 21 nt, Human
aaauucaucaaauggaagaca

SEQ ID NO: 2590163 - RNA, 16 nt, Human
aaauucauauucuguc

SEQ ID NO: 2590164 - RNA, 17 nt, Human
aaauucaguccuaagaa

SEQ ID NO: 2590165 - RNA, 19 nt, Human
aaauucccuucaucuggaa

SEQ ID NO: 2590166 - RNA, 16 nt, Human
aaauucccuucaucug

SEQ ID NO: 2590167 - RNA, 18 nt, Human
aaauucccuggccuuuca

SEQ ID NO: 2590168 - RNA, 22 nt, Human
aaauucauuuuuuucacuggag

SEQ ID NO: 2590169 - RNA, 15 nt, Human
aaauucccuggccuu

SEQ ID NO: 2590170 - RNA, 14 nt, Human
aaauucaaaaagug

SEQ ID NO: 2590171 - RNA, 17 nt, Human
aaauuauuuuaaacaaa

SEQ ID NO: 2590172 - RNA, 22 nt, Human
aaauucacccccuuuccuggac

SEQ ID NO: 2590173 - RNA, 14 nt, Human
aaauucaugcugcu

SEQ ID NO: 2590174 - RNA, 18 nt, Human
aaauucacuauuggcugg

SEQ ID NO: 2590175 - RNA, 16 nt, Human
aaauucacuauuggcu

SEQ ID NO: 2590176 - RNA, 20 nt, Human
aaauucagauauauuuuuca

SEQ ID NO: 2590177 - RNA, 22 nt, Human
guauuggcuagagguucaaaga

SEQ ID NO: 2590178 - RNA, 14 nt, Human
guauuggccuggag

SEQ ID NO: 2590179 - RNA, 12 nt, Human
guauuggccugg

SEQ ID NO: 2590180 - RNA, 12 nt, Human
guauuuaauuag

SEQ ID NO: 2590181 - RNA, 15 nt, Human
guauuggccuggagg

SEQ ID NO: 2590182 - RNA, 21 nt, Human
guauuuaauuagugcuaagug

SEQ ID NO: 2590183 - RNA, 20 nt, Human
guauuuaauuagugcuaagu

SEQ ID NO: 2590184 - RNA, 19 nt, Human
guauuuaauuagugcuaag

SEQ ID NO: 2590185 - RNA, 18 nt, Human
guauuuaauuagugcuaa

SEQ ID NO: 2590186 - RNA, 16 nt, Human
guauuuaauucauguu

SEQ ID NO: 2590187 - RNA, 16 nt, Human
aaauguuaaaauguau

SEQ ID NO: 2590188 - RNA, 13 nt, Human
guauuuaauuuug

SEQ ID NO: 2590189 - RNA, 21 nt, Human
aaauuaacuuuuauaaacuuu

SEQ ID NO: 2590190 - RNA, 15 nt, Human
aaauguuauuuaaca

SEQ ID NO: 2590191 - RNA, 19 nt, Human
aaauuaacuuuuauaaacu

SEQ ID NO: 2590192 - RNA, 20 nt, Human
aaauguuaaguugaugguga

SEQ ID NO: 2590193 - RNA, 22 nt, Human
aaauuaacuuuuauaaacuuua

SEQ ID NO: 2590194 - RNA, 23 nt, Human
aaauuaacuuuuauaaacuuuac

SEQ ID NO: 2590195 - RNA, 19 nt, Human
aaauuaccagaguuguucu

SEQ ID NO: 2590196 - RNA, 15 nt, Human
aaauuacuacaaaau

SEQ ID NO: 2590197 - RNA, 21 nt, Human
aaauuacuuaucauccacauu

SEQ ID NO: 2590198 - RNA, 20 nt, Human
aaauuacucaggaagaacac

SEQ ID NO: 2590199 - RNA, 21 nt, Human
guauguguacgugugugugcg

SEQ ID NO: 2590200 - RNA, 11 nt, Human
guauucucuga

SEQ ID NO: 2590201 - RNA, 12 nt, Human
guauucucugag

SEQ ID NO: 2590202 - RNA, 13 nt, Human
guauucucugagc

SEQ ID NO: 2590203 - RNA, 19 nt, Human
guauucucugagcugugca

SEQ ID NO: 2590204 - RNA, 21 nt, Human
guauucucuccuguaccucuu

SEQ ID NO: 2590205 - RNA, 16 nt, Human
guauugcacauuguaa

SEQ ID NO: 2590206 - RNA, 14 nt, Human
guauugcacauugu

SEQ ID NO: 2590207 - RNA, 13 nt, Human
guauugcacauug

SEQ ID NO: 2590208 - RNA, 15 nt, Human
guauucuucaaccuc

SEQ ID NO: 2590209 - RNA, 21 nt, Human
guauugcacauuguaaaaagu

SEQ ID NO: 2590210 - RNA, 18 nt, Human
guauugcacauuguaaaa

SEQ ID NO: 2590211 - RNA, 23 nt, Human
guauugcaucuguauaaguaaga

SEQ ID NO: 2590212 - RNA, 15 nt, Human
guauugcaucuguau

SEQ ID NO: 2590213 - RNA, 22 nt, Human
guauucuucucuuccuuuuauc

SEQ ID NO: 2590214 - RNA, 16 nt, Human
guauucuucucuuccu

SEQ ID NO: 2590215 - RNA, 15 nt, Human
guauucuuauuuaau

SEQ ID NO: 2590216 - RNA, 13 nt, Human
guaugguggcugg

SEQ ID NO: 2590217 - RNA, 13 nt, Human
guaugucuccagu

SEQ ID NO: 2590218 - RNA, 14 nt, Human
guaugggcaaaaaa

SEQ ID NO: 2590219 - RNA, 15 nt, Human
guaugggagagaaga

SEQ ID NO: 2590220 - RNA, 16 nt, Human
guaugggacuggccuc

SEQ ID NO: 2590221 - RNA, 21 nt, Human
guauggguuagggaaaacauu

SEQ ID NO: 2590222 - RNA, 15 nt, Human
guauggguguguguu

SEQ ID NO: 2590223 - RNA, 18 nt, Human
guauguggaagugugggu

SEQ ID NO: 2590224 - RNA, 21 nt, Human
guauguggaagugugggucug

SEQ ID NO: 2590225 - RNA, 19 nt, Human
guaugugggggucugugug

SEQ ID NO: 2590226 - RNA, 20 nt, Human
guaugugggggucugugugu

SEQ ID NO: 2590227 - RNA, 16 nt, Human
guauguggaagugugg

SEQ ID NO: 2590228 - RNA, 17 nt, Human
guauguggaaguguggg

SEQ ID NO: 2590229 - RNA, 15 nt, Human
guauguggaagugug

SEQ ID NO: 2590230 - RNA, 16 nt, Human
guaugugcacugucac

SEQ ID NO: 2590231 - RNA, 16 nt, Human
guaugcuuugaaugua

SEQ ID NO: 2590232 - RNA, 15 nt, Human
guaugcaugugaaga

SEQ ID NO: 2590233 - RNA, 12 nt, Human
guaugcauguga

SEQ ID NO: 2590234 - RNA, 13 nt, Human
guauggaaauaaa

SEQ ID NO: 2590235 - RNA, 14 nt, Human
guaugauucccagc

SEQ ID NO: 2590236 - RNA, 17 nt, Human
guaugauguguugugau

SEQ ID NO: 2590237 - RNA, 16 nt, Human
guaugauguguuguga

SEQ ID NO: 2590238 - RNA, 13 nt, Human
guaugauguguug

SEQ ID NO: 2590239 - RNA, 20 nt, Human
guauccuccagguuuuucaa

SEQ ID NO: 2590240 - RNA, 14 nt, Human
guaugggagagaag

SEQ ID NO: 2590241 - RNA, 22 nt, Human
guauggcacuggcauugucccu

SEQ ID NO: 2590242 - RNA, 15 nt, Human
guauggagcucagag

SEQ ID NO: 2590243 - RNA, 18 nt, Human
guauggagcucagagagg

SEQ ID NO: 2590244 - RNA, 18 nt, Human
guauggagagaaaacaga

SEQ ID NO: 2590245 - RNA, 13 nt, Human
guauggagcucag

SEQ ID NO: 2590246 - RNA, 18 nt, Human
guauggaauacaguguua

SEQ ID NO: 2590247 - RNA, 18 nt, Human
guauggacuaucugucug

SEQ ID NO: 2590248 - RNA, 19 nt, Human
guauggaauacaauguaau

SEQ ID NO: 2590249 - RNA, 17 nt, Human
guauggaauacaguguu

SEQ ID NO: 2590250 - RNA, 18 nt, Human
guaucccuguuacugaua

SEQ ID NO: 2590251 - RNA, 18 nt, Human
guauccccccaucuugcu

SEQ ID NO: 2590252 - RNA, 17 nt, Human
guauccccccaucuugc

SEQ ID NO: 2590253 - RNA, 15 nt, Human
guaucccuacuguaa

SEQ ID NO: 2590254 - RNA, 22 nt, Human
guaugaucacggcucacugcag

SEQ ID NO: 2590255 - RNA, 19 nt, Human
guauccuccagguuuuuca

SEQ ID NO: 2590256 - RNA, 17 nt, Human
guauccuccagguuuuu

SEQ ID NO: 2590257 - RNA, 16 nt, Human
guauccuccagguuuu

SEQ ID NO: 2590258 - RNA, 15 nt, Human
guauccuccagguuu

SEQ ID NO: 2590259 - RNA, 14 nt, Human
guauccuccagguu

SEQ ID NO: 2590260 - RNA, 13 nt, Human
guauccuccaggu

SEQ ID NO: 2590261 - RNA, 20 nt, Human
guauccccccccuguauagu

SEQ ID NO: 2590262 - RNA, 22 nt, Human
guauccucauuugggguagcua

SEQ ID NO: 2590263 - RNA, 14 nt, Human
guauccccccaucu

SEQ ID NO: 2590264 - RNA, 22 nt, Human
guaucaggacccagaggaaggg

SEQ ID NO: 2590265 - RNA, 18 nt, Human
guaucaggacccagagga

SEQ ID NO: 2590266 - RNA, 21 nt, Human
guaucaggacccagaggaagg

SEQ ID NO: 2590267 - RNA, 14 nt, Human
guaucaggacccag

SEQ ID NO: 2590268 - RNA, 17 nt, Human
guaucagaggccuauaa

SEQ ID NO: 2590269 - RNA, 21 nt, Human
guaucaggaaauauauaugug

SEQ ID NO: 2590270 - RNA, 16 nt, Human
guaucagaggccuaua

SEQ ID NO: 2590271 - RNA, 15 nt, Human
guaucagaggccuau

SEQ ID NO: 2590272 - RNA, 14 nt, Human
guaucagaggccua

SEQ ID NO: 2590273 - RNA, 12 nt, Human
guaucagaggcc

SEQ ID NO: 2590274 - RNA, 17 nt, Human
guaucacugucuuuccu

SEQ ID NO: 2590275 - RNA, 18 nt, Human
guaucacugucuuuccua

SEQ ID NO: 2590276 - RNA, 20 nt, Human
guaucacugucuuuccuaga

SEQ ID NO: 2590277 - RNA, 18 nt, Human
guaucaauccuuguucag

SEQ ID NO: 2590278 - RNA, 16 nt, Human
guauaaguaagaaaau

SEQ ID NO: 2590279 - RNA, 15 nt, Human
guauaaguaagaaaa

SEQ ID NO: 2590280 - RNA, 20 nt, Human
guauaacuucuuaaaaguug

SEQ ID NO: 2590281 - RNA, 12 nt, Human
guauaaauuuau

SEQ ID NO: 2590282 - RNA, 13 nt, Human
guauaaauuuauu

SEQ ID NO: 2590283 - RNA, 14 nt, Human
guauaaauuuauuu

SEQ ID NO: 2590284 - RNA, 23 nt, Human
guauaaauuuauuuacugcuagu

SEQ ID NO: 2590285 - RNA, 22 nt, Human
guauaacagguuauuuuaguuu

SEQ ID NO: 2590286 - RNA, 20 nt, Human
guauaacagguuauuuuagu

SEQ ID NO: 2590287 - RNA, 15 nt, Human
guauaacagguuauu

SEQ ID NO: 2590288 - RNA, 13 nt, Human
guauaacagguua

SEQ ID NO: 2590289 - RNA, 20 nt, Human
guauaacacaauaugaauac

SEQ ID NO: 2590290 - RNA, 22 nt, Human
guauauuauuucuaggaagaau

SEQ ID NO: 2590291 - RNA, 11 nt, Human
guauauuauuu

SEQ ID NO: 2590292 - RNA, 23 nt, Human
guauauuauguauuuauauuuug

SEQ ID NO: 2590293 - RNA, 21 nt, Human
guauauuauguauuuauauuu

SEQ ID NO: 2590294 - RNA, 16 nt, Human
guauauuauguauuua

SEQ ID NO: 2590295 - RNA, 15 nt, Human
guauauuauuucuag

SEQ ID NO: 2590296 - RNA, 12 nt, Human
guauauucacuu

SEQ ID NO: 2590297 - RNA, 15 nt, Human
guauauucauauauu

SEQ ID NO: 2590298 - RNA, 14 nt, Human
guauauucauuuca

SEQ ID NO: 2590299 - RNA, 22 nt, Human
guauauugauccagaaagaaaa

SEQ ID NO: 2590300 - RNA, 24 nt, Human
guaucaaauauuagaugugauuua

SEQ ID NO: 2590301 - RNA, 21 nt, Human
guaucaaauauuagaugugau

SEQ ID NO: 2590302 - RNA, 20 nt, Human
guaucaaauauuagauguga

SEQ ID NO: 2590303 - RNA, 19 nt, Human
guaucaaauauuagaugug

SEQ ID NO: 2590304 - RNA, 16 nt, Human
guauauucauuucaaa

SEQ ID NO: 2590305 - RNA, 18 nt, Human
guauaaagcaacuguuau

SEQ ID NO: 2590306 - RNA, 20 nt, Human
guauaaagcaacuguuauga

SEQ ID NO: 2590307 - RNA, 23 nt, Human
guauaaagcaacuguuaugaaau

SEQ ID NO: 2590308 - RNA, 21 nt, Human
guauaaagcaacuguuaugaa

SEQ ID NO: 2590309 - RNA, 13 nt, Human
guauaaauaggag

SEQ ID NO: 2590310 - RNA, 17 nt, Human
guauaaaugguugucug

SEQ ID NO: 2590311 - RNA, 12 nt, Human
guauaaaugguu

SEQ ID NO: 2590312 - RNA, 18 nt, Human
guauaaauaggagaggau

SEQ ID NO: 2590313 - RNA, 17 nt, Human
guauaaacuaucaguuu

SEQ ID NO: 2590314 - RNA, 13 nt, Human
guauaaacuauca

SEQ ID NO: 2590315 - RNA, 12 nt, Human
guauaaagaaca

SEQ ID NO: 2590316 - RNA, 14 nt, Human
guauaaagaaaagu

SEQ ID NO: 2590317 - RNA, 13 nt, Human
guauaaagaaaag

SEQ ID NO: 2590318 - RNA, 21 nt, Human
guauaaaagccuguuuaagag

SEQ ID NO: 2590319 - RNA, 18 nt, Human
guauaaaagccuguuuaa

SEQ ID NO: 2590320 - RNA, 23 nt, Human
guauaaaagauggggucuguaaa

SEQ ID NO: 2590321 - RNA, 13 nt, Human
guauaaaagaugg

SEQ ID NO: 2590322 - RNA, 17 nt, Human
guauaaaaucagccaau

SEQ ID NO: 2590323 - RNA, 15 nt, Human
guauaaaaucagcca

SEQ ID NO: 2590324 - RNA, 23 nt, Human
guauaaaaucagccaauuauguu

SEQ ID NO: 2590325 - RNA, 14 nt, Human
guauaaacaaaguu

SEQ ID NO: 2590326 - RNA, 22 nt, Human
aaaugggacuucuuuucacauu

SEQ ID NO: 2590327 - RNA, 21 nt, Human
aaaugggacuucuuuucacau

SEQ ID NO: 2590328 - RNA, 20 nt, Human
aaaugggacuucuuuucaca

SEQ ID NO: 2590329 - RNA, 16 nt, Human
aaaugggacuucuuuu

SEQ ID NO: 2590330 - RNA, 13 nt, Human
aaauggggccaga

SEQ ID NO: 2590331 - RNA, 16 nt, Human
aaauggggccagaucc

SEQ ID NO: 2590332 - RNA, 17 nt, Human
aaauggggccagaucca

SEQ ID NO: 2590333 - RNA, 21 nt, Human
aaauggggccagauccagccu

SEQ ID NO: 2590334 - RNA, 22 nt, Human
aaauggggccagauccagccug

SEQ ID NO: 2590335 - RNA, 15 nt, Human
aaaugggggugcauu

SEQ ID NO: 2590336 - RNA, 16 nt, Human
aaaugggggugcauuu

SEQ ID NO: 2590337 - RNA, 17 nt, Human
aaaugggggugcauuug

SEQ ID NO: 2590338 - RNA, 18 nt, Human
aaaugggggugcauuuga

SEQ ID NO: 2590339 - RNA, 22 nt, Human
aaauguaagggaaacugccagc

SEQ ID NO: 2590340 - RNA, 12 nt, Human
aaauguaauuga

SEQ ID NO: 2590341 - RNA, 17 nt, Human
guauaaaagccuguuua

SEQ ID NO: 2590342 - RNA, 12 nt, Human
guauaaaagaug

SEQ ID NO: 2590343 - RNA, 11 nt, Human
guauaaaagau

SEQ ID NO: 2590344 - RNA, 13 nt, Human
guaguucccugaa

SEQ ID NO: 2590345 - RNA, 17 nt, Human
guaguucccugaaaacc

SEQ ID NO: 2590346 - RNA, 20 nt, Human
guaguucccugaaaacccag

SEQ ID NO: 2590347 - RNA, 15 nt, Human
guaguuccugcuaca

SEQ ID NO: 2590348 - RNA, 23 nt, Human
guaguucccugaaaacccagaga

SEQ ID NO: 2590349 - RNA, 16 nt, Human
guaguuaguagcaugu

SEQ ID NO: 2590350 - RNA, 13 nt, Human
guaguuaguagca

SEQ ID NO: 2590351 - RNA, 20 nt, Human
aaauguaggcuuaguuugug

SEQ ID NO: 2590352 - RNA, 16 nt, Human
aaauguagguaugaau

SEQ ID NO: 2590353 - RNA, 15 nt, Human
aaauguacugagauu

SEQ ID NO: 2590354 - RNA, 16 nt, Human
aaaggacucugggguu

SEQ ID NO: 2590355 - RNA, 15 nt, Human
aaaggacucuggggu

SEQ ID NO: 2590356 - RNA, 12 nt, Human
aaaggacucugg

SEQ ID NO: 2590357 - RNA, 20 nt, Human
aaaggacuguuuuuuccuga

SEQ ID NO: 2590358 - RNA, 22 nt, Human
aaaggacuguuuuuuccugagc

SEQ ID NO: 2590359 - RNA, 19 nt, Human
aaaggagagaagagagaaa

SEQ ID NO: 2590360 - RNA, 13 nt, Human
aaaggaggcuggc

SEQ ID NO: 2590361 - RNA, 14 nt, Human
aaaggaggcuggca

SEQ ID NO: 2590362 - RNA, 16 nt, Human
aaaggagucaaaacua

SEQ ID NO: 2590363 - RNA, 17 nt, Human
guagcugcaaaggacag

SEQ ID NO: 2590364 - RNA, 19 nt, Human
aaaggaucuuuguggccaa

SEQ ID NO: 2590365 - RNA, 18 nt, Human
aaaggauacuguaacacu

SEQ ID NO: 2590366 - RNA, 16 nt, Human
aaaggauacuguaaca

SEQ ID NO: 2590367 - RNA, 18 nt, Human
aaaggaucuuuguggcca

SEQ ID NO: 2590368 - RNA, 15 nt, Human
aaaggauauuuucuu

SEQ ID NO: 2590369 - RNA, 12 nt, Human
aaaggauauuuu

SEQ ID NO: 2590370 - RNA, 20 nt, Human
guagcuguaaggcaugaagg

SEQ ID NO: 2590371 - RNA, 22 nt, Human
guagcuuaccagaagcuuccau

SEQ ID NO: 2590372 - RNA, 18 nt, Human
guagcuguggugaggugg

SEQ ID NO: 2590373 - RNA, 18 nt, Human
guagcugggauuacaggc

SEQ ID NO: 2590374 - RNA, 21 nt, Human
guagcugggacuacaggcacc

SEQ ID NO: 2590375 - RNA, 19 nt, Human
guagcugggacuacaggca

SEQ ID NO: 2590376 - RNA, 18 nt, Human
guagcugggacuacaggc

SEQ ID NO: 2590377 - RNA, 12 nt, Human
guagcugggacu

SEQ ID NO: 2590378 - RNA, 16 nt, Human
guagcugccccuggcu

SEQ ID NO: 2590379 - RNA, 12 nt, Human
guagcugccccu

SEQ ID NO: 2590380 - RNA, 15 nt, Human
guagcugccccuggc

SEQ ID NO: 2590381 - RNA, 17 nt, Human
guagcuggauuacaggc

SEQ ID NO: 2590382 - RNA, 13 nt, Human
guaggauuacuag

SEQ ID NO: 2590383 - RNA, 13 nt, Human
guaggcagagccu

SEQ ID NO: 2590384 - RNA, 23 nt, Human
guaggcagacacagggacuugaa

SEQ ID NO: 2590385 - RNA, 22 nt, Human
guaggcagacacagggacuuga

SEQ ID NO: 2590386 - RNA, 13 nt, Human
guaggcagacaca

SEQ ID NO: 2590387 - RNA, 12 nt, Human
guaggcagacac

SEQ ID NO: 2590388 - RNA, 11 nt, Human
guaggcagaca

SEQ ID NO: 2590389 - RNA, 18 nt, Human
guaggagcccagcucuga

SEQ ID NO: 2590390 - RNA, 14 nt, Human
guaggagcugccuu

SEQ ID NO: 2590391 - RNA, 22 nt, Human
guaggagcugccuuggcucaga

SEQ ID NO: 2590392 - RNA, 17 nt, Human
guaggaggaugggcucg

SEQ ID NO: 2590393 - RNA, 23 nt, Human
guaggagcugccuuggcucagac

SEQ ID NO: 2590394 - RNA, 14 nt, Human
guaggagguuugga

SEQ ID NO: 2590395 - RNA, 15 nt, Human
guaggcagagccuuu

SEQ ID NO: 2590396 - RNA, 14 nt, Human
guaggcagagccuu

SEQ ID NO: 2590397 - RNA, 17 nt, Human
guaggcaugagggauca

SEQ ID NO: 2590398 - RNA, 20 nt, Human
guaggcaugagggaucacag

SEQ ID NO: 2590399 - RNA, 22 nt, Human
guaggcaugagggaucacaggg

SEQ ID NO: 2590400 - RNA, 14 nt, Human
guaggcauuuccua

SEQ ID NO: 2590401 - RNA, 23 nt, Human
guaggcaugagggaucacagggc

SEQ ID NO: 2590402 - RNA, 17 nt, Human
guagcuuucccaaauaa

SEQ ID NO: 2590403 - RNA, 17 nt, Human
guagcuuaccagaagcu

SEQ ID NO: 2590404 - RNA, 12 nt, Human
guagcuuugcuc

SEQ ID NO: 2590405 - RNA, 18 nt, Human
guaggaacgguaaauuuc

SEQ ID NO: 2590406 - RNA, 15 nt, Human
guaggaagacuuugg

SEQ ID NO: 2590407 - RNA, 16 nt, Human
guaggaacugcugggc

SEQ ID NO: 2590408 - RNA, 21 nt, Human
guaggaacgguaaauuucugu

SEQ ID NO: 2590409 - RNA, 17 nt, Human
guaggaagaguagcauu

SEQ ID NO: 2590410 - RNA, 19 nt, Human
guaggaaaaauaaaaacag

SEQ ID NO: 2590411 - RNA, 15 nt, Human
guaggaaguaggaag

SEQ ID NO: 2590412 - RNA, 18 nt, Human
guaggaagguuaauguuc

SEQ ID NO: 2590413 - RNA, 19 nt, Human
guaggaccaagcaucuugg

SEQ ID NO: 2590414 - RNA, 15 nt, Human
guaggacuguagaaa

SEQ ID NO: 2590415 - RNA, 19 nt, Human
guaggacuuuccuaaaugu

SEQ ID NO: 2590416 - RNA, 13 nt, Human
aaaucgaugcagu

SEQ ID NO: 2590417 - RNA, 15 nt, Human
aaaucgauuggcuuu

SEQ ID NO: 2590418 - RNA, 14 nt, Human
aaaucgauuggcuu

SEQ ID NO: 2590419 - RNA, 17 nt, Human
aaauccuuuuucuuuau

SEQ ID NO: 2590420 - RNA, 18 nt, Human
aaauccuuuuucuuuaua

SEQ ID NO: 2590421 - RNA, 19 nt, Human
aaauccuuuuucuuuauaa

SEQ ID NO: 2590422 - RNA, 14 nt, Human
aaauccuugaagau

SEQ ID NO: 2590423 - RNA, 16 nt, Human
aaauccuuuacuguua

SEQ ID NO: 2590424 - RNA, 16 nt, Human
aaauccuuccaugaaa

SEQ ID NO: 2590425 - RNA, 14 nt, Human
aaauccuaugugau

SEQ ID NO: 2590426 - RNA, 16 nt, Human
aaauccuaugugauuu

SEQ ID NO: 2590427 - RNA, 21 nt, Human
aaauccuaugugauuuuaacu

SEQ ID NO: 2590428 - RNA, 21 nt, Human
aaauccgaaccuccucuguga

SEQ ID NO: 2590429 - RNA, 15 nt, Human
aaauccuacugaaug

SEQ ID NO: 2590430 - RNA, 17 nt, Human
aaaucccuguuuaauau

SEQ ID NO: 2590431 - RNA, 15 nt, Human
aaauccgaaccuccu

SEQ ID NO: 2590432 - RNA, 19 nt, Human
aaauccgaaccuccucugu

SEQ ID NO: 2590433 - RNA, 20 nt, Human
aaauccgaaccuccucugug

SEQ ID NO: 2590434 - RNA, 13 nt, Human
aaauccccuucuc

SEQ ID NO: 2590435 - RNA, 21 nt, Human
aaaucccauucauaacuuuca

SEQ ID NO: 2590436 - RNA, 18 nt, Human
aaauccucuuccucugag

SEQ ID NO: 2590437 - RNA, 17 nt, Human
aaauccucuuccucuga

SEQ ID NO: 2590438 - RNA, 15 nt, Human
aaauccucuuccucu

SEQ ID NO: 2590439 - RNA, 14 nt, Human
aaauccucuuccuc

SEQ ID NO: 2590440 - RNA, 23 nt, Human
aaauccuaugugauuuuaacucu

SEQ ID NO: 2590441 - RNA, 11 nt, Human
aaauccucugg

SEQ ID NO: 2590442 - RNA, 13 nt, Human
aaauccucuuccu

SEQ ID NO: 2590443 - RNA, 12 nt, Human
aaauccucuggc

SEQ ID NO: 2590444 - RNA, 21 nt, Human
aaauccucuuccucugaggcu

SEQ ID NO: 2590445 - RNA, 15 nt, Human
aaaucccauuuaaaa

SEQ ID NO: 2590446 - RNA, 18 nt, Human
aaaucccuuaccucggug

SEQ ID NO: 2590447 - RNA, 15 nt, Human
aaaucucaaauuucu

SEQ ID NO: 2590448 - RNA, 16 nt, Human
aaaucucaaauuucua

SEQ ID NO: 2590449 - RNA, 17 nt, Human
aaaucucaaauuucuaa

SEQ ID NO: 2590450 - RNA, 19 nt, Human
aaaucucaaauuucuaaau

SEQ ID NO: 2590451 - RNA, 11 nt, Human
aaaugaaaauu

SEQ ID NO: 2590452 - RNA, 12 nt, Human
aaaugaaagaaa

SEQ ID NO: 2590453 - RNA, 16 nt, Human
aaaugaaaaugucuug

SEQ ID NO: 2590454 - RNA, 17 nt, Human
aaaugaaaaugucuugu

SEQ ID NO: 2590455 - RNA, 15 nt, Human
aaaugaaaaugucuu

SEQ ID NO: 2590456 - RNA, 18 nt, Human
aaaugaaaacauguaaua

SEQ ID NO: 2590457 - RNA, 17 nt, Human
aaaugaaaaucgugaca

SEQ ID NO: 2590458 - RNA, 14 nt, Human
aaaugaaaaaauau

SEQ ID NO: 2590459 - RNA, 23 nt, Human
aaaucggaucuggggcucuggga

SEQ ID NO: 2590460 - RNA, 17 nt, Human
aaaucuaauauuaaaaa

SEQ ID NO: 2590461 - RNA, 13 nt, Human
aaaucgcuuuuga

SEQ ID NO: 2590462 - RNA, 14 nt, Human
aaaucgcuuuugau

SEQ ID NO: 2590463 - RNA, 15 nt, Human
aaaucgcuuuugaua

SEQ ID NO: 2590464 - RNA, 22 nt, Human
aaaucggaucuggggcucuggg

SEQ ID NO: 2590465 - RNA, 19 nt, Human
aaaucuacacuccagugag

SEQ ID NO: 2590466 - RNA, 18 nt, Human
aaaucuaauauuaaaaau

SEQ ID NO: 2590467 - RNA, 19 nt, Human
aaaucuaauauuaaaaaua

SEQ ID NO: 2590468 - RNA, 15 nt, Human
aaaucuaccuucugu

SEQ ID NO: 2590469 - RNA, 14 nt, Human
aaaucuacaguaca

SEQ ID NO: 2590470 - RNA, 22 nt, Human
aaaucuaguauuucaugcuggg

SEQ ID NO: 2590471 - RNA, 18 nt, Human
aaaucuaccuucuguagu

SEQ ID NO: 2590472 - RNA, 17 nt, Human
aaaucuaccuucuguag

SEQ ID NO: 2590473 - RNA, 16 nt, Human
aaaucuaccuucugua

SEQ ID NO: 2590474 - RNA, 22 nt, Human
aaaucuagacucaagguuccca

SEQ ID NO: 2590475 - RNA, 14 nt, Human
aaaucuaugauucc

SEQ ID NO: 2590476 - RNA, 16 nt, Human
aaaucuaugauuccag

SEQ ID NO: 2590477 - RNA, 19 nt, Human
aaaucuauucagacaagca

SEQ ID NO: 2590478 - RNA, 13 nt, Human
aaaucuauucaga

SEQ ID NO: 2590479 - RNA, 20 nt, Human
aaaucuaugccacucagaau

SEQ ID NO: 2590480 - RNA, 14 nt, Human
aaaucuaugccacu

SEQ ID NO: 2590481 - RNA, 13 nt, Human
aaaucuaugccac

SEQ ID NO: 2590482 - RNA, 11 nt, Human
aaaugagaaau

SEQ ID NO: 2590483 - RNA, 17 nt, Human
aaaugacuaaaaauauu

SEQ ID NO: 2590484 - RNA, 20 nt, Human
aaaugacuaaaaauauuaua

SEQ ID NO: 2590485 - RNA, 19 nt, Human
aaaugaccaguaauuguga

SEQ ID NO: 2590486 - RNA, 15 nt, Human
aaaugaccaauauua

SEQ ID NO: 2590487 - RNA, 14 nt, Human
aaaugacagauguu

SEQ ID NO: 2590488 - RNA, 17 nt, Human
aaaugacccaaagacca

SEQ ID NO: 2590489 - RNA, 16 nt, Human
aaaugacccaaagacc

SEQ ID NO: 2590490 - RNA, 14 nt, Human
aaaugacccaaaga

SEQ ID NO: 2590491 - RNA, 21 nt, Human
aaaugaccaguaauugugaaa

SEQ ID NO: 2590492 - RNA, 19 nt, Human
aaaugacuaaaaaacaaag

SEQ ID NO: 2590493 - RNA, 22 nt, Human
aaaugacuaaaaaacaaagaag

SEQ ID NO: 2590494 - RNA, 16 nt, Human
aaaugaauggcucacu

SEQ ID NO: 2590495 - RNA, 20 nt, Human
aaaugaagugcaaauuugau

SEQ ID NO: 2590496 - RNA, 22 nt, Human
aaaugaagguuaggauuuaaca

SEQ ID NO: 2590497 - RNA, 15 nt, Human
aaaugaauaauuucc

SEQ ID NO: 2590498 - RNA, 17 nt, Human
aaaugaauaauuuccca

SEQ ID NO: 2590499 - RNA, 18 nt, Human
aaaugaauaauuucccaa

SEQ ID NO: 2590500 - RNA, 19 nt, Human
aaaugaaugugugugguuu

SEQ ID NO: 2590501 - RNA, 17 nt, Human
aaaugaauguguguggu

SEQ ID NO: 2590502 - RNA, 15 nt, Human
aaaugaaugugugug

SEQ ID NO: 2590503 - RNA, 14 nt, Human
aaaugaaugugugu

SEQ ID NO: 2590504 - RNA, 12 nt, Human
aaaugaaugugu

SEQ ID NO: 2590505 - RNA, 11 nt, Human
aaaugaaugug

SEQ ID NO: 2590506 - RNA, 15 nt, Human
aaaugaauguugucu

SEQ ID NO: 2590507 - RNA, 22 nt, Human
aaaugaaugugugugguuuuuu

SEQ ID NO: 2590508 - RNA, 11 nt, Human
aaaugaauuuu

SEQ ID NO: 2590509 - RNA, 21 nt, Human
aaaugaaagcagggacuugaa

SEQ ID NO: 2590510 - RNA, 22 nt, Human
aaaugaaagcagggacuugaac

SEQ ID NO: 2590511 - RNA, 20 nt, Human
aaaugaaaguauaacugagu

SEQ ID NO: 2590512 - RNA, 22 nt, Human
aaaugaaauuacuacaaaauuu

SEQ ID NO: 2590513 - RNA, 18 nt, Human
aaaugaaagcaugucuca

SEQ ID NO: 2590514 - RNA, 15 nt, Human
aaaugaaagcaugug

SEQ ID NO: 2590515 - RNA, 15 nt, Human
aaaugaaauuguaaa

SEQ ID NO: 2590516 - RNA, 14 nt, Human
aaaugaaauuguaa

SEQ ID NO: 2590517 - RNA, 12 nt, Human
aaaugaaauugu

SEQ ID NO: 2590518 - RNA, 18 nt, Human
aaaugaagcagcuuuaaa

SEQ ID NO: 2590519 - RNA, 19 nt, Human
aaaugaagguuaggauuua

SEQ ID NO: 2590520 - RNA, 11 nt, Human
aaaugaagugc

SEQ ID NO: 2590521 - RNA, 11 nt, Human
aaaugaagaaa

SEQ ID NO: 2590522 - RNA, 21 nt, Human
aaaugaacugaaguuucacau

SEQ ID NO: 2590523 - RNA, 14 nt, Human
aaaugaacugaagu

SEQ ID NO: 2590524 - RNA, 14 nt, Human
aaaugagaaaucua

SEQ ID NO: 2590525 - RNA, 13 nt, Human
aaaugagaaaucu

SEQ ID NO: 2590526 - RNA, 16 nt, Human
aaaugagaaaucuaaa

SEQ ID NO: 2590527 - RNA, 13 nt, Human
aaaugagaaggaa

SEQ ID NO: 2590528 - RNA, 15 nt, Human
aaaugagaucaggcu

SEQ ID NO: 2590529 - RNA, 20 nt, Human
aaaugagagggcaguguuuc

SEQ ID NO: 2590530 - RNA, 21 nt, Human
aaaugagaaggcagccaccag

SEQ ID NO: 2590531 - RNA, 20 nt, Human
aaaugagacccucguggccu

SEQ ID NO: 2590532 - RNA, 13 nt, Human
aaaugagccuggc

SEQ ID NO: 2590533 - RNA, 19 nt, Human
aaaugagccuggcaagaau

SEQ ID NO: 2590534 - RNA, 22 nt, Human
aaaugagaucaggcucugccuc

SEQ ID NO: 2590535 - RNA, 17 nt, Human
aaaugagaucaggcucu

SEQ ID NO: 2590536 - RNA, 13 nt, Human
aaaugagccauga

SEQ ID NO: 2590537 - RNA, 23 nt, Human
aaaugagcucgcauuugucaaug

SEQ ID NO: 2590538 - RNA, 16 nt, Human
aaaugaggacauguuu

SEQ ID NO: 2590539 - RNA, 14 nt, Human
aaaugaggacaugu

SEQ ID NO: 2590540 - RNA, 19 nt, Human
aaaugaggaauguauaugu

SEQ ID NO: 2590541 - RNA, 18 nt, Human
aaaugaggaauguauaug

SEQ ID NO: 2590542 - RNA, 17 nt, Human
aaaugaggaauguauau

SEQ ID NO: 2590543 - RNA, 14 nt, Human
aaaugaggaaugua

SEQ ID NO: 2590544 - RNA, 13 nt, Human
aaaugaggaaacu

SEQ ID NO: 2590545 - RNA, 19 nt, Human
aaaugaggucagagccugc

SEQ ID NO: 2590546 - RNA, 17 nt, Human
aaaugaggucagagccu

SEQ ID NO: 2590547 - RNA, 16 nt, Human
aaaugagguacucucc

SEQ ID NO: 2590548 - RNA, 23 nt, Human
aaaugagguacucuccuggaaau

SEQ ID NO: 2590549 - RNA, 9 nt, Human
aaaugaggg

SEQ ID NO: 2590550 - RNA, 12 nt, Human
aaaugagugugu

SEQ ID NO: 2590551 - RNA, 18 nt, Human
aaaugaguguguuuguca

SEQ ID NO: 2590552 - RNA, 15 nt, Human
aaaugaucaguuuuu

SEQ ID NO: 2590553 - RNA, 23 nt, Human
aaaugauccccagcuguuuaugc

SEQ ID NO: 2590554 - RNA, 22 nt, Human
aaaugaguuuuuauggggcuga

SEQ ID NO: 2590555 - RNA, 21 nt, Human
aaaugaguuaccuacauuuua

SEQ ID NO: 2590556 - RNA, 14 nt, Human
aaaugcauuucuaa

SEQ ID NO: 2590557 - RNA, 13 nt, Human
aaaugcccagccc

SEQ ID NO: 2590558 - RNA, 13 nt, Human
aaaugcauuguau

SEQ ID NO: 2590559 - RNA, 20 nt, Human
aaaugcauuguaucgauguu

SEQ ID NO: 2590560 - RNA, 12 nt, Human
aaaugcauugua

SEQ ID NO: 2590561 - RNA, 13 nt, Human
aaaugcauggagg

SEQ ID NO: 2590562 - RNA, 15 nt, Human
aaaugcccagccccu

SEQ ID NO: 2590563 - RNA, 14 nt, Human
aaaugcccagcccc

SEQ ID NO: 2590564 - RNA, 18 nt, Human
aaaugcccagccccuucu

SEQ ID NO: 2590565 - RNA, 13 nt, Human
aaaugcccagcuu

SEQ ID NO: 2590566 - RNA, 20 nt, Human
aaaugggcagagcagagacc

SEQ ID NO: 2590567 - RNA, 18 nt, Human
aaaugggcagagcagaga

SEQ ID NO: 2590568 - RNA, 15 nt, Human
aaaugggcagagcag

SEQ ID NO: 2590569 - RNA, 23 nt, Human
aaaugccucaguguauuuguauu

SEQ ID NO: 2590570 - RNA, 22 nt, Human
aaaugccucaguguauuuguau

SEQ ID NO: 2590571 - RNA, 15 nt, Human
aaaugggacuucuuu

SEQ ID NO: 2590572 - RNA, 16 nt, Human
aaaugggacuuaacuc

SEQ ID NO: 2590573 - RNA, 19 nt, Human
aaauggcuuccuggcaaua

SEQ ID NO: 2590574 - RNA, 21 nt, Human
aaaugccucaguguauuugua

SEQ ID NO: 2590575 - RNA, 19 nt, Human
aaaugccucaguguauuug

SEQ ID NO: 2590576 - RNA, 18 nt, Human
aaaugccucaguguauuu

SEQ ID NO: 2590577 - RNA, 17 nt, Human
aaaugccucaguguauu

SEQ ID NO: 2590578 - RNA, 16 nt, Human
aaaugccucaguguau

SEQ ID NO: 2590579 - RNA, 22 nt, Human
aaaugcccuuacacuuacuguu

SEQ ID NO: 2590580 - RNA, 18 nt, Human
aaaugcaccuggaauaua

SEQ ID NO: 2590581 - RNA, 22 nt, Human
aaaugcaccuggaauauauaac

SEQ ID NO: 2590582 - RNA, 15 nt, Human
aaaugcauaaaugca

SEQ ID NO: 2590583 - RNA, 12 nt, Human
aaaugcagugaa

SEQ ID NO: 2590584 - RNA, 22 nt, Human
aaaugcagggauugcugccacu

SEQ ID NO: 2590585 - RNA, 21 nt, Human
aaaugcagcgaaccaauauuu

SEQ ID NO: 2590586 - RNA, 23 nt, Human
aaaugcagcgaaccaauauuugu

SEQ ID NO: 2590587 - RNA, 20 nt, Human
aaaugcacccaacuagcucu

SEQ ID NO: 2590588 - RNA, 19 nt, Human
aaaugcacauagcuaucaa

SEQ ID NO: 2590589 - RNA, 20 nt, Human
aaaugcauuauaggaucauu

SEQ ID NO: 2590590 - RNA, 20 nt, Human
aaaugcaugauuuuguaacc

SEQ ID NO: 2590591 - RNA, 21 nt, Human
aaaugcaugauuuuguaaccc

SEQ ID NO: 2590592 - RNA, 14 nt, Human
aaaugcaugauuuu

SEQ ID NO: 2590593 - RNA, 18 nt, Human
aaaugcaugauuuuguaa

SEQ ID NO: 2590594 - RNA, 13 nt, Human
aaaugcauguugc

SEQ ID NO: 2590595 - RNA, 23 nt, Human
aaaugcauccauuccucagggac

SEQ ID NO: 2590596 - RNA, 15 nt, Human
aaaugcauauuguau

SEQ ID NO: 2590597 - RNA, 11 nt, Human
aaaugcauauu

SEQ ID NO: 2590598 - RNA, 19 nt, Human
aaaugcauauccugagcca

SEQ ID NO: 2590599 - RNA, 20 nt, Human
aaaugcauauccugagccau

SEQ ID NO: 2590600 - RNA, 16 nt, Human
aaaugcauccauuccu

SEQ ID NO: 2590601 - RNA, 20 nt, Human
aaaugcauccauuccucagg

SEQ ID NO: 2590602 - RNA, 22 nt, Human
aaaugcauccauuccucaggga

SEQ ID NO: 2590603 - RNA, 23 nt, Human
aaaugauuuuuacaaguuuuaaa

SEQ ID NO: 2590604 - RNA, 21 nt, Human
aaaugauuuuaucugugaauu

SEQ ID NO: 2590605 - RNA, 22 nt, Human
aaaugauuguaaaauagcuugu

SEQ ID NO: 2590606 - RNA, 15 nt, Human
aaaugauuguaaaau

SEQ ID NO: 2590607 - RNA, 15 nt, Human
aaaugauucuuagug

SEQ ID NO: 2590608 - RNA, 23 nt, Human
aaaugauguucauuuagauugaa

SEQ ID NO: 2590609 - RNA, 18 nt, Human
aaaugauguguacccaaa

SEQ ID NO: 2590610 - RNA, 20 nt, Human
aaaugaucugagucccagga

SEQ ID NO: 2590611 - RNA, 22 nt, Human
aaaugaugauguggaagaacuu

SEQ ID NO: 2590612 - RNA, 22 nt, Human
aaaugauccccaagugugaaca

SEQ ID NO: 2590613 - RNA, 16 nt, Human
aaaugaucaguuuuuu

SEQ ID NO: 2590614 - RNA, 19 nt, Human
aaaugaucugagucccagg

SEQ ID NO: 2590615 - RNA, 19 nt, Human
aaaugaugauguggaagaa

SEQ ID NO: 2590616 - RNA, 16 nt, Human
aaaugaucuuuucaag

SEQ ID NO: 2590617 - RNA, 14 nt, Human
aaaugcaccuggaa

SEQ ID NO: 2590618 - RNA, 21 nt, Human
aaaugcaaauccuaugugauu

SEQ ID NO: 2590619 - RNA, 13 nt, Human
aaaugcaauaugu

SEQ ID NO: 2590620 - RNA, 14 nt, Human
aaaugcaagauuuu

SEQ ID NO: 2590621 - RNA, 17 nt, Human
aaaugcaauauuaaugc

SEQ ID NO: 2590622 - RNA, 14 nt, Human
aaaugcaauauuaa

SEQ ID NO: 2590623 - RNA, 15 nt, Human
aaaugcaauauguau

SEQ ID NO: 2590624 - RNA, 16 nt, Human
aaaugcaauauguauu

SEQ ID NO: 2590625 - RNA, 17 nt, Human
aaaugcaaacacacaaa

SEQ ID NO: 2590626 - RNA, 13 nt, Human
aaaugcaaauccu

SEQ ID NO: 2590627 - RNA, 21 nt, Human
aaaugcaaacacacaaaggua

SEQ ID NO: 2590628 - RNA, 14 nt, Human
aaaugcaaauccua

SEQ ID NO: 2590629 - RNA, 16 nt, Human
aaaugcaacaacaugu

SEQ ID NO: 2590630 - RNA, 15 nt, Human
aacauacucccaucu

SEQ ID NO: 2590631 - RNA, 14 nt, Human
aacauacucccauc

SEQ ID NO: 2590632 - RNA, 17 nt, Human
aacauaauucuuguaua

SEQ ID NO: 2590633 - RNA, 19 nt, Human
aacaguuuuccaugaaaac

SEQ ID NO: 2590634 - RNA, 18 nt, Human
aacauaauucuuguauau

SEQ ID NO: 2590635 - RNA, 15 nt, Human
aacaguuuuccauga

SEQ ID NO: 2590636 - RNA, 16 nt, Human
aacaguuuuccaugaa

SEQ ID NO: 2590637 - RNA, 17 nt, Human
aacaguuuuccaugaaa

SEQ ID NO: 2590638 - RNA, 18 nt, Human
aacaguuuuccaugaaaa

SEQ ID NO: 2590639 - RNA, 16 nt, Human
aacauucugauuugga

SEQ ID NO: 2590640 - RNA, 18 nt, Human
aacauucugauuuggaaa

SEQ ID NO: 2590641 - RNA, 16 nt, Human
aacauugaaguaauga

SEQ ID NO: 2590642 - RNA, 18 nt, Human
aacauugaaguaaugaau

SEQ ID NO: 2590643 - RNA, 19 nt, Human
aacauugaaguaaugaauu

SEQ ID NO: 2590644 - RNA, 18 nt, Human
aacauuugguaaggggaa

SEQ ID NO: 2590645 - RNA, 20 nt, Human
aacauuuguucuauagcuuu

SEQ ID NO: 2590646 - RNA, 16 nt, Human
aacauuucucaauaau

SEQ ID NO: 2590647 - RNA, 22 nt, Human
aacauuucaagggcaauaccgu

SEQ ID NO: 2590648 - RNA, 19 nt, Human
aacauuguuccagauucaa

SEQ ID NO: 2590649 - RNA, 18 nt, Human
aacauuguuccagauuca

SEQ ID NO: 2590650 - RNA, 17 nt, Human
aacauuguuccagauuc

SEQ ID NO: 2590651 - RNA, 15 nt, Human
aacauuguuccagau

SEQ ID NO: 2590652 - RNA, 23 nt, Human
aacauuguguucccauuucagcu

SEQ ID NO: 2590653 - RNA, 14 nt, Human
aacauuuacaugua

SEQ ID NO: 2590654 - RNA, 17 nt, Human
aacauucugauuuggaa

SEQ ID NO: 2590655 - RNA, 13 nt, Human
aacauuguguucc

SEQ ID NO: 2590656 - RNA, 20 nt, Human
aacauugcauauaacuuaua

SEQ ID NO: 2590657 - RNA, 21 nt, Human
aacauugcauauaacuuauau

SEQ ID NO: 2590658 - RNA, 14 nt, Human
guccucuugccucc

SEQ ID NO: 2590659 - RNA, 13 nt, Human
guccucuucugca

SEQ ID NO: 2590660 - RNA, 21 nt, Human
guccugaccacccuccccucu

SEQ ID NO: 2590661 - RNA, 19 nt, Human
guccugaccacccuccccu

SEQ ID NO: 2590662 - RNA, 17 nt, Human
guccugaccacccuccc

SEQ ID NO: 2590663 - RNA, 17 nt, Human
guccucuugccuccugg

SEQ ID NO: 2590664 - RNA, 16 nt, Human
guccugaccacccucc

SEQ ID NO: 2590665 - RNA, 16 nt, Human
guccugaccugucuca

SEQ ID NO: 2590666 - RNA, 15 nt, Human
guccugaccugucuc

SEQ ID NO: 2590667 - RNA, 23 nt, Human
guccugacuucaggggcugcccg

SEQ ID NO: 2590668 - RNA, 21 nt, Human
guccugacuucaggggcugcc

SEQ ID NO: 2590669 - RNA, 20 nt, Human
guccugacuucaggggcugc

SEQ ID NO: 2590670 - RNA, 13 nt, Human
guccugagaccug

SEQ ID NO: 2590671 - RNA, 17 nt, Human
guccugacuucaggggc

SEQ ID NO: 2590672 - RNA, 23 nt, Human
guccugaccacccuccccucucu

SEQ ID NO: 2590673 - RNA, 13 nt, Human
guccugacucaac

SEQ ID NO: 2590674 - RNA, 21 nt, Human
guccucuggauggcaccagag

SEQ ID NO: 2590675 - RNA, 18 nt, Human
guccucuggauggcacca

SEQ ID NO: 2590676 - RNA, 11 nt, Human
guccucuggau

SEQ ID NO: 2590677 - RNA, 19 nt, Human
guccucugauacccagagc

SEQ ID NO: 2590678 - RNA, 18 nt, Human
guccucucuggcugggga

SEQ ID NO: 2590679 - RNA, 18 nt, Human
guccucugucagucacag

SEQ ID NO: 2590680 - RNA, 19 nt, Human
guccucugucagucacagc

SEQ ID NO: 2590681 - RNA, 20 nt, Human
guccucugucagucacagcc

SEQ ID NO: 2590682 - RNA, 23 nt, Human
guccucugucagucacagccacc

SEQ ID NO: 2590683 - RNA, 17 nt, Human
guccucucuggcugggg

SEQ ID NO: 2590684 - RNA, 16 nt, Human
guccucucuggcuggg

SEQ ID NO: 2590685 - RNA, 13 nt, Human
guccucugaauga

SEQ ID NO: 2590686 - RNA, 17 nt, Human
guccucugaaugaaccu

SEQ ID NO: 2590687 - RNA, 21 nt, Human
guccugaggguccccaccugg

SEQ ID NO: 2590688 - RNA, 18 nt, Human
guccugaggguccccacc

SEQ ID NO: 2590689 - RNA, 19 nt, Human
guccugcagucuggcugag

SEQ ID NO: 2590690 - RNA, 15 nt, Human
guccugaucagagcc

SEQ ID NO: 2590691 - RNA, 14 nt, Human
guccugccaccugg

SEQ ID NO: 2590692 - RNA, 16 nt, Human
guccugccaccugggg

SEQ ID NO: 2590693 - RNA, 17 nt, Human
guccugccaccuggggc

SEQ ID NO: 2590694 - RNA, 18 nt, Human
guccugccaccuggggca

SEQ ID NO: 2590695 - RNA, 15 nt, Human
guccugccucagccu

SEQ ID NO: 2590696 - RNA, 17 nt, Human
guccugccucagccucc

SEQ ID NO: 2590697 - RNA, 13 nt, Human
guccugccuggcc

SEQ ID NO: 2590698 - RNA, 14 nt, Human
guccugccuggcca

SEQ ID NO: 2590699 - RNA, 15 nt, Human
guccugccuggccag

SEQ ID NO: 2590700 - RNA, 14 nt, Human
guccugccuguggc

SEQ ID NO: 2590701 - RNA, 13 nt, Human
guccugccugugg

SEQ ID NO: 2590702 - RNA, 11 nt, Human
guccugccugu

SEQ ID NO: 2590703 - RNA, 23 nt, Human
guccugccugucugaagccaaug

SEQ ID NO: 2590704 - RNA, 19 nt, Human
guccugccuggccaggcag

SEQ ID NO: 2590705 - RNA, 20 nt, Human
guccugccuggccaggcaga

SEQ ID NO: 2590706 - RNA, 15 nt, Human
guccuucaccucacu

SEQ ID NO: 2590707 - RNA, 15 nt, Human
guccuucagauggaa

SEQ ID NO: 2590708 - RNA, 21 nt, Human
guccuucaccucacugaaaac

SEQ ID NO: 2590709 - RNA, 14 nt, Human
guccuuccaccucg

SEQ ID NO: 2590710 - RNA, 13 nt, Human
guccgagcuuuga

SEQ ID NO: 2590711 - RNA, 15 nt, Human
guccgaucuuugacu

SEQ ID NO: 2590712 - RNA, 23 nt, Human
gucccaagcugggccccagccca

SEQ ID NO: 2590713 - RNA, 20 nt, Human
guccgcccugcuccucccug

SEQ ID NO: 2590714 - RNA, 18 nt, Human
guccgcccugcuccuccc

SEQ ID NO: 2590715 - RNA, 12 nt, Human
guccgcccugcu

SEQ ID NO: 2590716 - RNA, 21 nt, Human
gucccaacaggaggacaauuc

SEQ ID NO: 2590717 - RNA, 20 nt, Human
gucccaacaggaggacaauu

SEQ ID NO: 2590718 - RNA, 15 nt, Human
gucccaacuuguaaa

SEQ ID NO: 2590719 - RNA, 16 nt, Human
gucccaagcugggccc

SEQ ID NO: 2590720 - RNA, 15 nt, Human
gucccaagcugggcc

SEQ ID NO: 2590721 - RNA, 13 nt, Human
gucccaagcuggg

SEQ ID NO: 2590722 - RNA, 23 nt, Human
gucccaacaggaggacaauucau

SEQ ID NO: 2590723 - RNA, 22 nt, Human
gucccaagcugggccccagccc

SEQ ID NO: 2590724 - RNA, 21 nt, Human
gucccaagcugggccccagcc

SEQ ID NO: 2590725 - RNA, 16 nt, Human
gucccaaggaaagccc

SEQ ID NO: 2590726 - RNA, 17 nt, Human
guccggacacuccuaga

SEQ ID NO: 2590727 - RNA, 18 nt, Human
aacacuuuacaauguuca

SEQ ID NO: 2590728 - RNA, 13 nt, Human
aacagaaacaaaa

SEQ ID NO: 2590729 - RNA, 19 nt, Human
aacagaaaacauucugauu

SEQ ID NO: 2590730 - RNA, 14 nt, Human
aacagaaaacauuc

SEQ ID NO: 2590731 - RNA, 23 nt, Human
guccgcccugcuccucccuggcu

SEQ ID NO: 2590732 - RNA, 21 nt, Human
guccgcccugcuccucccugg

SEQ ID NO: 2590733 - RNA, 22 nt, Human
guccgcugggugguacccucug

SEQ ID NO: 2590734 - RNA, 18 nt, Human
guccggacacuccuagag

SEQ ID NO: 2590735 - RNA, 23 nt, Human
guccgcgcgccagcacagaaaca

SEQ ID NO: 2590736 - RNA, 21 nt, Human
guccggucccugucccagugc

SEQ ID NO: 2590737 - RNA, 10 nt, Human
aacagaaaug

SEQ ID NO: 2590738 - RNA, 11 nt, Human
aacagaaaugu

SEQ ID NO: 2590739 - RNA, 21 nt, Human
aacagaaauguacagcaagga

SEQ ID NO: 2590740 - RNA, 22 nt, Human
aacagaaagccugggugacauu

SEQ ID NO: 2590741 - RNA, 16 nt, Human
aacagaaacaaaaaca

SEQ ID NO: 2590742 - RNA, 18 nt, Human
aacagaaagggcaacaau

SEQ ID NO: 2590743 - RNA, 16 nt, Human
aacagaacagcuucag

SEQ ID NO: 2590744 - RNA, 15 nt, Human
aacagaacagcuuca

SEQ ID NO: 2590745 - RNA, 14 nt, Human
aacagaacagcuuc

SEQ ID NO: 2590746 - RNA, 13 nt, Human
aacagaacagcuu

SEQ ID NO: 2590747 - RNA, 18 nt, Human
aacagacauuguuuugcc

SEQ ID NO: 2590748 - RNA, 15 nt, Human
aacagacauuguuuu

SEQ ID NO: 2590749 - RNA, 14 nt, Human
aacagacauuguuu

SEQ ID NO: 2590750 - RNA, 13 nt, Human
aacagacauuguu

SEQ ID NO: 2590751 - RNA, 18 nt, Human
aacagaccuaaugcuccu

SEQ ID NO: 2590752 - RNA, 19 nt, Human
aacagacccccucuagaaa

SEQ ID NO: 2590753 - RNA, 22 nt, Human
aacagacauuguuuugccaaca

SEQ ID NO: 2590754 - RNA, 18 nt, Human
aacagacccccucuagaa

SEQ ID NO: 2590755 - RNA, 20 nt, Human
aacagaacaucauuagaaca

SEQ ID NO: 2590756 - RNA, 11 nt, Human
aacagacagga

SEQ ID NO: 2590757 - RNA, 19 nt, Human
aacagacaccaucuuuugu

SEQ ID NO: 2590758 - RNA, 12 nt, Human
aacagacauugu

SEQ ID NO: 2590759 - RNA, 11 nt, Human
aacagacauug

SEQ ID NO: 2590760 - RNA, 14 nt, Human
aacagacaggagaa

SEQ ID NO: 2590761 - RNA, 15 nt, Human
aacagacaggagaaa

SEQ ID NO: 2590762 - RNA, 16 nt, Human
aacagugcuaaaaaug

SEQ ID NO: 2590763 - RNA, 15 nt, Human
aacagugcuaaaaau

SEQ ID NO: 2590764 - RNA, 23 nt, Human
aacagugcuaaaaaugggacuuc

SEQ ID NO: 2590765 - RNA, 20 nt, Human
aacagugcuugccacagagc

SEQ ID NO: 2590766 - RNA, 15 nt, Human
aacaguggaauauaa

SEQ ID NO: 2590767 - RNA, 12 nt, Human
aacaguagcaua

SEQ ID NO: 2590768 - RNA, 20 nt, Human
aacagugugaaguuagaauu

SEQ ID NO: 2590769 - RNA, 18 nt, Human
aacagugugaaguuagaa

SEQ ID NO: 2590770 - RNA, 17 nt, Human
aacagugugaaguuaga

SEQ ID NO: 2590771 - RNA, 16 nt, Human
aacagugugaaguuag

SEQ ID NO: 2590772 - RNA, 15 nt, Human
aacagugugaaguua

SEQ ID NO: 2590773 - RNA, 14 nt, Human
aacagugugaaguu

SEQ ID NO: 2590774 - RNA, 13 nt, Human
aacagugugaagu

SEQ ID NO: 2590775 - RNA, 22 nt, Human
aacagugugaaguuagaauucc

SEQ ID NO: 2590776 - RNA, 20 nt, Human
aacaguguuaggccuggcac

SEQ ID NO: 2590777 - RNA, 13 nt, Human
aacaguuuguaca

SEQ ID NO: 2590778 - RNA, 15 nt, Human
aacagugccugcuga

SEQ ID NO: 2590779 - RNA, 14 nt, Human
aacaguuuguacag

SEQ ID NO: 2590780 - RNA, 11 nt, Human
aacaguuuucc

SEQ ID NO: 2590781 - RNA, 13 nt, Human
aacaguuuuccau

SEQ ID NO: 2590782 - RNA, 14 nt, Human
aacaguuuuccaug

SEQ ID NO: 2590783 - RNA, 15 nt, Human
aacaguguuucccau

SEQ ID NO: 2590784 - RNA, 23 nt, Human
aacaguguuaggccuggcacagu

SEQ ID NO: 2590785 - RNA, 22 nt, Human
aacaguguuaggccuggcacag

SEQ ID NO: 2590786 - RNA, 13 nt, Human
aacaguguuuccc

SEQ ID NO: 2590787 - RNA, 18 nt, Human
aacaguguuucccauaau

SEQ ID NO: 2590788 - RNA, 22 nt, Human
aacaguagugauaguuguaccg

SEQ ID NO: 2590789 - RNA, 14 nt, Human
aacaguaaaugugc

SEQ ID NO: 2590790 - RNA, 23 nt, Human
aacaggcugggcuucaguggcag

SEQ ID NO: 2590791 - RNA, 13 nt, Human
aacaggcugggcu

SEQ ID NO: 2590792 - RNA, 22 nt, Human
aacaggcugggcuucaguggca

SEQ ID NO: 2590793 - RNA, 19 nt, Human
aacagacuggaagcacagc

SEQ ID NO: 2590794 - RNA, 17 nt, Human
aacagacuauuuaacuu

SEQ ID NO: 2590795 - RNA, 13 nt, Human
aacagacuauuua

SEQ ID NO: 2590796 - RNA, 20 nt, Human
aacagacuauuuaacuugag

SEQ ID NO: 2590797 - RNA, 13 nt, Human
aacagacucaggu

SEQ ID NO: 2590798 - RNA, 19 nt, Human
aacagacucgauucauauu

SEQ ID NO: 2590799 - RNA, 16 nt, Human
aacaagaccacguuuc

SEQ ID NO: 2590800 - RNA, 17 nt, Human
aacaagaccacguuucu

SEQ ID NO: 2590801 - RNA, 19 nt, Human
aacaagaccacguuucuaa

SEQ ID NO: 2590802 - RNA, 20 nt, Human
aacaagaccacguuucuaaa

SEQ ID NO: 2590803 - RNA, 22 nt, Human
aacaagaccaccacuucgaaac

SEQ ID NO: 2590804 - RNA, 21 nt, Human
aacaagccuccuuuuaaagua

SEQ ID NO: 2590805 - RNA, 15 nt, Human
aacaaggaugaauua

SEQ ID NO: 2590806 - RNA, 14 nt, Human
aacaaggaagucaa

SEQ ID NO: 2590807 - RNA, 15 nt, Human
gucacaggcaggucc

SEQ ID NO: 2590808 - RNA, 13 nt, Human
gucacaggcaggu

SEQ ID NO: 2590809 - RNA, 14 nt, Human
gucacacagggcag

SEQ ID NO: 2590810 - RNA, 16 nt, Human
gucacaggcaggucca

SEQ ID NO: 2590811 - RNA, 21 nt, Human
aaauuuuucagaugcuucugg

SEQ ID NO: 2590812 - RNA, 17 nt, Human
aaauuuuucagaugcuu

SEQ ID NO: 2590813 - RNA, 18 nt, Human
aaauuuuucagaugcuuc

SEQ ID NO: 2590814 - RNA, 20 nt, Human
aaauuuuucagaugcuucug

SEQ ID NO: 2590815 - RNA, 23 nt, Human
aaauuuuuaaucuuuaauuuuac

SEQ ID NO: 2590816 - RNA, 15 nt, Human
aaauuuuuauuuuuc

SEQ ID NO: 2590817 - RNA, 21 nt, Human
aaauuuugugauauggagccc

SEQ ID NO: 2590818 - RNA, 23 nt, Human
aacaaggcaaggcugucaauuac

SEQ ID NO: 2590819 - RNA, 20 nt, Human
aacaagggagagaccucauc

SEQ ID NO: 2590820 - RNA, 21 nt, Human
aacaagggagagaccucauca

SEQ ID NO: 2590821 - RNA, 19 nt, Human
aacaaggguggcaucccag

SEQ ID NO: 2590822 - RNA, 16 nt, Human
aacaagguaguuuuua

SEQ ID NO: 2590823 - RNA, 16 nt, Human
aacaagucccuguaau

SEQ ID NO: 2590824 - RNA, 15 nt, Human
aacaauaaaugugca

SEQ ID NO: 2590825 - RNA, 19 nt, Human
aacaauacucauaauguga

SEQ ID NO: 2590826 - RNA, 19 nt, Human
aacaauaaauguuggcuug

SEQ ID NO: 2590827 - RNA, 15 nt, Human
aacaauaacuacugu

SEQ ID NO: 2590828 - RNA, 17 nt, Human
aacaauaacuacugugu

SEQ ID NO: 2590829 - RNA, 18 nt, Human
aacaauaacuacuguguu

SEQ ID NO: 2590830 - RNA, 19 nt, Human
aacaauaacuacuguguuc

SEQ ID NO: 2590831 - RNA, 20 nt, Human
aacaauaacuacuguguucc

SEQ ID NO: 2590832 - RNA, 21 nt, Human
aacaauaacuacuguguuccu

SEQ ID NO: 2590833 - RNA, 18 nt, Human
aacaauaguaauucucag

SEQ ID NO: 2590834 - RNA, 18 nt, Human
aacaauaggcuguuccca

SEQ ID NO: 2590835 - RNA, 20 nt, Human
aacaauacucauaaugugaa

SEQ ID NO: 2590836 - RNA, 21 nt, Human
aacaauacucauaaugugaag

SEQ ID NO: 2590837 - RNA, 16 nt, Human
aacaauauuguuucua

SEQ ID NO: 2590838 - RNA, 22 nt, Human
aacaauccuagugcuuuccuuu

SEQ ID NO: 2590839 - RNA, 23 nt, Human
aacaaucaaagcacuuggacucu

SEQ ID NO: 2590840 - RNA, 20 nt, Human
aacaauuugagauguauuuc

SEQ ID NO: 2590841 - RNA, 23 nt, Human
aacaauuuuaggaggaccagagc

SEQ ID NO: 2590842 - RNA, 13 nt, Human
aacaauuuuaaug

SEQ ID NO: 2590843 - RNA, 13 nt, Human
aacaauuucuguc

SEQ ID NO: 2590844 - RNA, 22 nt, Human
aacaauuuccuuuauauuuagu

SEQ ID NO: 2590845 - RNA, 21 nt, Human
aacaauuuccuuuauauuuag

SEQ ID NO: 2590846 - RNA, 16 nt, Human
aacaauuuaugaauug

SEQ ID NO: 2590847 - RNA, 20 nt, Human
aacaauuuccuuuauauuua

SEQ ID NO: 2590848 - RNA, 13 nt, Human
aacaauuuaugaa

SEQ ID NO: 2590849 - RNA, 14 nt, Human
aacaauugugaagu

SEQ ID NO: 2590850 - RNA, 14 nt, Human
aacaaugaagauaa

SEQ ID NO: 2590851 - RNA, 18 nt, Human
aacaaugaagauaaaaag

SEQ ID NO: 2590852 - RNA, 17 nt, Human
aacaauccuagugcuuu

SEQ ID NO: 2590853 - RNA, 15 nt, Human
aacaaugacauuuau

SEQ ID NO: 2590854 - RNA, 15 nt, Human
aacaaugauauaugg

SEQ ID NO: 2590855 - RNA, 14 nt, Human
aacaaugauauaug

SEQ ID NO: 2590856 - RNA, 24 nt, Human
guccaagcauaccaacacgagcag

SEQ ID NO: 2590857 - RNA, 22 nt, Human
gucauuugcugagcauguacug

SEQ ID NO: 2590858 - RNA, 21 nt, Human
gucauuuuaacuuuaucacau

SEQ ID NO: 2590859 - RNA, 21 nt, Human
gucauuugcugagcauguacu

SEQ ID NO: 2590860 - RNA, 22 nt, Human
gucauuugagcagggcucagcg

SEQ ID NO: 2590861 - RNA, 11 nt, Human
aacacuuccau

SEQ ID NO: 2590862 - RNA, 21 nt, Human
gucauuugagcagggcucagc

SEQ ID NO: 2590863 - RNA, 21 nt, Human
aacacuguucucugcccucca

SEQ ID NO: 2590864 - RNA, 22 nt, Human
aacacuuaaggguuuuagaaaa

SEQ ID NO: 2590865 - RNA, 15 nt, Human
guccacaacacacag

SEQ ID NO: 2590866 - RNA, 15 nt, Human
guccacagaugccuc

SEQ ID NO: 2590867 - RNA, 17 nt, Human
guccacagaugccucca

SEQ ID NO: 2590868 - RNA, 12 nt, Human
guccaauguggc

SEQ ID NO: 2590869 - RNA, 20 nt, Human
guccacaaaauaaccaaucc

SEQ ID NO: 2590870 - RNA, 19 nt, Human
guccaauuuguaaaaacag

SEQ ID NO: 2590871 - RNA, 22 nt, Human
guccauuuggcagggguggcug

SEQ ID NO: 2590872 - RNA, 21 nt, Human
guccauuguccaauccuaugu

SEQ ID NO: 2590873 - RNA, 16 nt, Human
guccauuguccaaucc

SEQ ID NO: 2590874 - RNA, 22 nt, Human
guccauugacauguacagagaa

SEQ ID NO: 2590875 - RNA, 16 nt, Human
guccacagaugccucc

SEQ ID NO: 2590876 - RNA, 21 nt, Human
guccaagcauuuagauguaua

SEQ ID NO: 2590877 - RNA, 22 nt, Human
guccaaggaaaccacagcugcu

SEQ ID NO: 2590878 - RNA, 17 nt, Human
guccaaggaaaccacag

SEQ ID NO: 2590879 - RNA, 15 nt, Human
guccaagcugggaga

SEQ ID NO: 2590880 - RNA, 22 nt, Human
guccaaggaaacuugaaucaaa

SEQ ID NO: 2590881 - RNA, 17 nt, Human
guccaauccuauguuuu

SEQ ID NO: 2590882 - RNA, 12 nt, Human
guccaauccuau

SEQ ID NO: 2590883 - RNA, 19 nt, Human
guccaagugugugugcgug

SEQ ID NO: 2590884 - RNA, 15 nt, Human
guccaagugugugug

SEQ ID NO: 2590885 - RNA, 16 nt, Human
guccaagugugugugc

SEQ ID NO: 2590886 - RNA, 17 nt, Human
guccaagugugugugcg

SEQ ID NO: 2590887 - RNA, 17 nt, Human
aacacucauugaccuga

SEQ ID NO: 2590888 - RNA, 17 nt, Human
aacacuccaauuaagga

SEQ ID NO: 2590889 - RNA, 21 nt, Human
aacacucauugaccugaggcc

SEQ ID NO: 2590890 - RNA, 11 nt, Human
aacacucugag

SEQ ID NO: 2590891 - RNA, 12 nt, Human
aacacuccuuca

SEQ ID NO: 2590892 - RNA, 13 nt, Human
aacacucugagac

SEQ ID NO: 2590893 - RNA, 12 nt, Human
aacacucugaga

SEQ ID NO: 2590894 - RNA, 14 nt, Human
aacacucugagacu

SEQ ID NO: 2590895 - RNA, 12 nt, Human
aacacucuuuug

SEQ ID NO: 2590896 - RNA, 13 nt, Human
aacacucuauauu

SEQ ID NO: 2590897 - RNA, 14 nt, Human
aacacugcuugugu

SEQ ID NO: 2590898 - RNA, 22 nt, Human
aacacugccaucuuaguuugga

SEQ ID NO: 2590899 - RNA, 14 nt, Human
aacacugcaggcau

SEQ ID NO: 2590900 - RNA, 17 nt, Human
aacacugcuuguguuuu

SEQ ID NO: 2590901 - RNA, 16 nt, Human
aacacucuuuugcuuu

SEQ ID NO: 2590902 - RNA, 19 nt, Human
aacacucuuuugcuuuauu

SEQ ID NO: 2590903 - RNA, 15 nt, Human
aacacugagcuguca

SEQ ID NO: 2590904 - RNA, 20 nt, Human
aacacuguucucugcccucc

SEQ ID NO: 2590905 - RNA, 15 nt, Human
aacacuguucucugc

SEQ ID NO: 2590906 - RNA, 16 nt, Human
aacacugugcccuggu

SEQ ID NO: 2590907 - RNA, 15 nt, Human
aacacugugcccugg

SEQ ID NO: 2590908 - RNA, 13 nt, Human
aacacugugcccu

SEQ ID NO: 2590909 - RNA, 12 nt, Human
aacacugugaaa

SEQ ID NO: 2590910 - RNA, 21 nt, Human
aacacugugcccugguggaga

SEQ ID NO: 2590911 - RNA, 18 nt, Human
aacacugugcccuggugg

SEQ ID NO: 2590912 - RNA, 20 nt, Human
aacacugugcacaucugugu

SEQ ID NO: 2590913 - RNA, 22 nt, Human
aacacugugcacaucugugucu

SEQ ID NO: 2590914 - RNA, 16 nt, Human
aacacugucuugaaga

SEQ ID NO: 2590915 - RNA, 12 nt, Human
gucucccaaggc

SEQ ID NO: 2590916 - RNA, 17 nt, Human
gucucccacgugggaga

SEQ ID NO: 2590917 - RNA, 15 nt, Human
gucucauccaucauc

SEQ ID NO: 2590918 - RNA, 16 nt, Human
gucucauccaucauca

SEQ ID NO: 2590919 - RNA, 12 nt, Human
gucucaucccau

SEQ ID NO: 2590920 - RNA, 11 nt, Human
gucucauccca

SEQ ID NO: 2590921 - RNA, 13 nt, Human
gucucauccccag

SEQ ID NO: 2590922 - RNA, 16 nt, Human
gucucauccccagggg

SEQ ID NO: 2590923 - RNA, 14 nt, Human
gucucauccccagg

SEQ ID NO: 2590924 - RNA, 15 nt, Human
gucucauccccaggg

SEQ ID NO: 2590925 - RNA, 19 nt, Human
gucucaguuugugugucuu

SEQ ID NO: 2590926 - RNA, 18 nt, Human
gucucaguuugugugucu

SEQ ID NO: 2590927 - RNA, 21 nt, Human
gucucaguuugugugucuuaa

SEQ ID NO: 2590928 - RNA, 11 nt, Human
guccuugaaaa

SEQ ID NO: 2590929 - RNA, 18 nt, Human
gucucaguggcuucaucu

SEQ ID NO: 2590930 - RNA, 22 nt, Human
gucucaguggcuucaucuguca

SEQ ID NO: 2590931 - RNA, 15 nt, Human
gucucaguuucacuu

SEQ ID NO: 2590932 - RNA, 14 nt, Human
guccuugaaaauau

SEQ ID NO: 2590933 - RNA, 19 nt, Human
guccuucucucaccuccua

SEQ ID NO: 2590934 - RNA, 18 nt, Human
guccuucucucaccuccu

SEQ ID NO: 2590935 - RNA, 17 nt, Human
guccuucucucaccucc

SEQ ID NO: 2590936 - RNA, 14 nt, Human
guccuuccaggccc

SEQ ID NO: 2590937 - RNA, 22 nt, Human
guccuuccaggcccccaccacu

SEQ ID NO: 2590938 - RNA, 12 nt, Human
guccuucccucu

SEQ ID NO: 2590939 - RNA, 21 nt, Human
guccuucccucuccccaagac

SEQ ID NO: 2590940 - RNA, 13 nt, Human
gucuccucagccu

SEQ ID NO: 2590941 - RNA, 21 nt, Human
gucuccucacucccuucuacc

SEQ ID NO: 2590942 - RNA, 15 nt, Human
gucuccucacucccu

SEQ ID NO: 2590943 - RNA, 14 nt, Human
gucuccucacuccc

SEQ ID NO: 2590944 - RNA, 18 nt, Human
gucuccuauccugguuuu

SEQ ID NO: 2590945 - RNA, 14 nt, Human
gucuccuauccugg

SEQ ID NO: 2590946 - RNA, 16 nt, Human
gucucccucccuuggg

SEQ ID NO: 2590947 - RNA, 17 nt, Human
gucuccucagccuccuc

SEQ ID NO: 2590948 - RNA, 14 nt, Human
gucuccucagccuc

SEQ ID NO: 2590949 - RNA, 23 nt, Human
gucuccucagccuccucaucugg

SEQ ID NO: 2590950 - RNA, 21 nt, Human
gucuccuccaccgccauggcu

SEQ ID NO: 2590951 - RNA, 12 nt, Human
gucuccuccacc

SEQ ID NO: 2590952 - RNA, 14 nt, Human
gucuccuccaccgc

SEQ ID NO: 2590953 - RNA, 15 nt, Human
gucuccucucagccc

SEQ ID NO: 2590954 - RNA, 14 nt, Human
gucuccucuuaaaa

SEQ ID NO: 2590955 - RNA, 22 nt, Human
gucuccucuuaaaaaauaaaaa

SEQ ID NO: 2590956 - RNA, 23 nt, Human
gucuccucuuaaaaaauaaaaac

SEQ ID NO: 2590957 - RNA, 22 nt, Human
aacauuuuguggucauuaagca

SEQ ID NO: 2590958 - RNA, 18 nt, Human
aaccaaaaagaccagacu

SEQ ID NO: 2590959 - RNA, 21 nt, Human
aaccaucauugaaaucuuuuu

SEQ ID NO: 2590960 - RNA, 23 nt, Human
aaccaucauugaaaucuuuuugc

SEQ ID NO: 2590961 - RNA, 20 nt, Human
aaccaucauugaaaucuuuu

SEQ ID NO: 2590962 - RNA, 19 nt, Human
aaccaucauugaaaucuuu

SEQ ID NO: 2590963 - RNA, 22 nt, Human
aaccacaucuugcucugcugac

SEQ ID NO: 2590964 - RNA, 20 nt, Human
aaccacaucuugcucugcug

SEQ ID NO: 2590965 - RNA, 12 nt, Human
aaccacagcagu

SEQ ID NO: 2590966 - RNA, 18 nt, Human
aaccacaucuugcucugc

SEQ ID NO: 2590967 - RNA, 21 nt, Human
aaccacaccacaucuaagccu

SEQ ID NO: 2590968 - RNA, 23 nt, Human
aaccacaccacaucuaagccuga

SEQ ID NO: 2590969 - RNA, 13 nt, Human
aaccacaccacau

SEQ ID NO: 2590970 - RNA, 16 nt, Human
aaccaaagagacugga

SEQ ID NO: 2590971 - RNA, 19 nt, Human
aaccaaagagggcuuccuc

SEQ ID NO: 2590972 - RNA, 23 nt, Human
aaccaaagagacuggagcaucug

SEQ ID NO: 2590973 - RNA, 19 nt, Human
aaccaaagagacuggagca

SEQ ID NO: 2590974 - RNA, 13 nt, Human
aaccaaagaagaa

SEQ ID NO: 2590975 - RNA, 20 nt, Human
aaccaaaaagaccagacuaa

SEQ ID NO: 2590976 - RNA, 19 nt, Human
aaccaaaaagaccagacua

SEQ ID NO: 2590977 - RNA, 21 nt, Human
aaccaaaagaacaagaauuuc

SEQ ID NO: 2590978 - RNA, 19 nt, Human
aaccaaagcgaauuuuaaa

SEQ ID NO: 2590979 - RNA, 15 nt, Human
aaccaauauuuguag

SEQ ID NO: 2590980 - RNA, 13 nt, Human
aaccaauccugga

SEQ ID NO: 2590981 - RNA, 13 nt, Human
aaccuccuggaca

SEQ ID NO: 2590982 - RNA, 14 nt, Human
aaccuccucuguga

SEQ ID NO: 2590983 - RNA, 15 nt, Human
aaccuccucugugaa

SEQ ID NO: 2590984 - RNA, 19 nt, Human
aaccucuaauuuauuuugu

SEQ ID NO: 2590985 - RNA, 14 nt, Human
aaccuccugggcua

SEQ ID NO: 2590986 - RNA, 19 nt, Human
aaccuccgccucccggguu

SEQ ID NO: 2590987 - RNA, 12 nt, Human
aaccuccucugu

SEQ ID NO: 2590988 - RNA, 13 nt, Human
aaccuccucugug

SEQ ID NO: 2590989 - RNA, 17 nt, Human
aaccuccgccucuuggg

SEQ ID NO: 2590990 - RNA, 22 nt, Human
aaccucagacuuaccaggaagc

SEQ ID NO: 2590991 - RNA, 13 nt, Human
aaccucagccugg

SEQ ID NO: 2590992 - RNA, 14 nt, Human
aaccucagccuggc

SEQ ID NO: 2590993 - RNA, 19 nt, Human
aaccucagacuuaccagga

SEQ ID NO: 2590994 - RNA, 17 nt, Human
aaccucacucuugccaa

SEQ ID NO: 2590995 - RNA, 16 nt, Human
aaccucacucuugcca

SEQ ID NO: 2590996 - RNA, 15 nt, Human
aaccucacucuugcc

SEQ ID NO: 2590997 - RNA, 11 nt, Human
aaccucagccu

SEQ ID NO: 2590998 - RNA, 12 nt, Human
aaccucagccug

SEQ ID NO: 2590999 - RNA, 17 nt, Human
aaccucaacugccuacu

SEQ ID NO: 2591000 - RNA, 18 nt, Human
aaccucaacugccuacuc

SEQ ID NO: 2591001 - RNA, 16 nt, Human
aaccucaacugccuac

SEQ ID NO: 2591002 - RNA, 15 nt, Human
aaccucaaagugacu

SEQ ID NO: 2591003 - RNA, 21 nt, Human
aaccucacccgaggcugccca

SEQ ID NO: 2591004 - RNA, 13 nt, Human
aaccucacucuug

SEQ ID NO: 2591005 - RNA, 12 nt, Human
aaccucacucuu

SEQ ID NO: 2591006 - RNA, 19 nt, Human
aaccucacgcaccucccau

SEQ ID NO: 2591007 - RNA, 22 nt, Human
aaccucacgcaccucccauccu

SEQ ID NO: 2591008 - RNA, 15 nt, Human
aacccccagccugcu

SEQ ID NO: 2591009 - RNA, 14 nt, Human
aacccccagccugc

SEQ ID NO: 2591010 - RNA, 13 nt, Human
aacccccagccug

SEQ ID NO: 2591011 - RNA, 14 nt, Human
aaccccagcauccu

SEQ ID NO: 2591012 - RNA, 12 nt, Human
aaccccagcucc

SEQ ID NO: 2591013 - RNA, 13 nt, Human
aaccccaggcccc

SEQ ID NO: 2591014 - RNA, 11 nt, Human
aaccccagccg

SEQ ID NO: 2591015 - RNA, 19 nt, Human
aacccccagcacccgggcu

SEQ ID NO: 2591016 - RNA, 20 nt, Human
aaccuagggugauauuaacc

SEQ ID NO: 2591017 - RNA, 16 nt, Human
aaccuauaugauuuau

SEQ ID NO: 2591018 - RNA, 22 nt, Human
aaccuaugauauuuucugugcc

SEQ ID NO: 2591019 - RNA, 16 nt, Human
aaccuauuuugaaaaa

SEQ ID NO: 2591020 - RNA, 17 nt, Human
aaccucaaaaugucuaa

SEQ ID NO: 2591021 - RNA, 22 nt, Human
aaccuauuuugaaaaauuccua

SEQ ID NO: 2591022 - RNA, 21 nt, Human
aaccuauuuugaaaaauuccu

SEQ ID NO: 2591023 - RNA, 23 nt, Human
aaccuauuuugaaaaauuccuau

SEQ ID NO: 2591024 - RNA, 18 nt, Human
aacccaaauguucaucaa

SEQ ID NO: 2591025 - RNA, 11 nt, Human
aacccagcucu

SEQ ID NO: 2591026 - RNA, 14 nt, Human
aacccagcucuggu

SEQ ID NO: 2591027 - RNA, 13 nt, Human
aacccagcucugg

SEQ ID NO: 2591028 - RNA, 13 nt, Human
aacccaaauguuc

SEQ ID NO: 2591029 - RNA, 23 nt, Human
aaccauuuugcugucccuuuucc

SEQ ID NO: 2591030 - RNA, 20 nt, Human
aaccauuuuuuuucagcaga

SEQ ID NO: 2591031 - RNA, 21 nt, Human
aaccaugucagcaaaaagcaa

SEQ ID NO: 2591032 - RNA, 17 nt, Human
aaccaugucagcaaaaa

SEQ ID NO: 2591033 - RNA, 23 nt, Human
aaccaugucagcaaaaagcaaaa

SEQ ID NO: 2591034 - RNA, 20 nt, Human
aaccauguaaagaacauaaa

SEQ ID NO: 2591035 - RNA, 17 nt, Human
aaccauguagaaaauuu

SEQ ID NO: 2591036 - RNA, 16 nt, Human
aaccauggcugaagga

SEQ ID NO: 2591037 - RNA, 22 nt, Human
aaccauggcugaaggaaaccag

SEQ ID NO: 2591038 - RNA, 20 nt, Human
aaccccacccuugcccaccc

SEQ ID NO: 2591039 - RNA, 13 nt, Human
aacccauuuuagu

SEQ ID NO: 2591040 - RNA, 16 nt, Human
aaccccaacuccagua

SEQ ID NO: 2591041 - RNA, 15 nt, Human
aacccaugagauuca

SEQ ID NO: 2591042 - RNA, 11 nt, Human
aacccaggagg

SEQ ID NO: 2591043 - RNA, 15 nt, Human
aacccaucagaagga

SEQ ID NO: 2591044 - RNA, 17 nt, Human
aacccaucagaaggaga

SEQ ID NO: 2591045 - RNA, 19 nt, Human
aacccaucagaaggagaag

SEQ ID NO: 2591046 - RNA, 20 nt, Human
aacccauauuuguacaccaa

SEQ ID NO: 2591047 - RNA, 22 nt, Human
aacccaggagcauccaccuccu

SEQ ID NO: 2591048 - RNA, 20 nt, Human
aacccaggagcauccaccuc

SEQ ID NO: 2591049 - RNA, 20 nt, Human
aacccaucaacaaaaauugu

SEQ ID NO: 2591050 - RNA, 17 nt, Human
aacccagcucuggucca

SEQ ID NO: 2591051 - RNA, 16 nt, Human
aacccaggacgcuucu

SEQ ID NO: 2591052 - RNA, 13 nt, Human
aacccaggagcau

SEQ ID NO: 2591053 - RNA, 19 nt, Human
aacccaggacgcuucugaa

SEQ ID NO: 2591054 - RNA, 18 nt, Human
aacccaggacgcuucuga

SEQ ID NO: 2591055 - RNA, 17 nt, Human
aacccaggacgcuucug

SEQ ID NO: 2591056 - RNA, 12 nt, Human
aacccaggaggu

SEQ ID NO: 2591057 - RNA, 15 nt, Human
aacccaguugccauc

SEQ ID NO: 2591058 - RNA, 19 nt, Human
aacucuaaaagauccuuuu

SEQ ID NO: 2591059 - RNA, 23 nt, Human
aacuccccuuccucacugcccaa

SEQ ID NO: 2591060 - RNA, 14 nt, Human
aacucuaaaagauc

SEQ ID NO: 2591061 - RNA, 18 nt, Human
aacucguuaauuuguagu

SEQ ID NO: 2591062 - RNA, 13 nt, Human
aacucccuuucaa

SEQ ID NO: 2591063 - RNA, 14 nt, Human
aacucccuuucaac

SEQ ID NO: 2591064 - RNA, 12 nt, Human
gugaaccaaaga

SEQ ID NO: 2591065 - RNA, 24 nt, Human
gugaacauuuaucaaucaguauaa

SEQ ID NO: 2591066 - RNA, 21 nt, Human
gugaacacuagccagacacuc

SEQ ID NO: 2591067 - RNA, 23 nt, Human
aacucuagcugggggugggccag

SEQ ID NO: 2591068 - RNA, 19 nt, Human
gugaaccaccacacccagc

SEQ ID NO: 2591069 - RNA, 15 nt, Human
gugaacacaucagcu

SEQ ID NO: 2591070 - RNA, 15 nt, Human
aacucuaauagugcu

SEQ ID NO: 2591071 - RNA, 21 nt, Human
aacucuaauucccauuuugca

SEQ ID NO: 2591072 - RNA, 12 nt, Human
aacucuagcugg

SEQ ID NO: 2591073 - RNA, 19 nt, Human
aacucuagcuggggguggg

SEQ ID NO: 2591074 - RNA, 13 nt, Human
aacucuaauucua

SEQ ID NO: 2591075 - RNA, 22 nt, Human
aacucuaauucccauuuugcaa

SEQ ID NO: 2591076 - RNA, 21 nt, Human
aacuccagaaagugacaagcu

SEQ ID NO: 2591077 - RNA, 13 nt, Human
aacuccaguagcu

SEQ ID NO: 2591078 - RNA, 13 nt, Human
aacucccugcccc

SEQ ID NO: 2591079 - RNA, 19 nt, Human
aacucccugccccccagcc

SEQ ID NO: 2591080 - RNA, 19 nt, Human
aacuccccuuccucacugc

SEQ ID NO: 2591081 - RNA, 22 nt, Human
aacucccagcaacacaagcugg

SEQ ID NO: 2591082 - RNA, 18 nt, Human
aacuagccaccaacucuu

SEQ ID NO: 2591083 - RNA, 15 nt, Human
aacuagccaccaacu

SEQ ID NO: 2591084 - RNA, 14 nt, Human
aacuagcaccaggg

SEQ ID NO: 2591085 - RNA, 19 nt, Human
aacuagcauaucugccuuu

SEQ ID NO: 2591086 - RNA, 18 nt, Human
aacuagcauaucugccuu

SEQ ID NO: 2591087 - RNA, 17 nt, Human
aacuagcauaucugccu

SEQ ID NO: 2591088 - RNA, 14 nt, Human
aacuagcauaucug

SEQ ID NO: 2591089 - RNA, 20 nt, Human
aacuagauuacauucaguug

SEQ ID NO: 2591090 - RNA, 14 nt, Human
aacuccagaaagug

SEQ ID NO: 2591091 - RNA, 20 nt, Human
aacuagcucuauguuuacaa

SEQ ID NO: 2591092 - RNA, 18 nt, Human
aacuagcuuggaaacugg

SEQ ID NO: 2591093 - RNA, 15 nt, Human
aaccugcucuccucu

SEQ ID NO: 2591094 - RNA, 19 nt, Human
aaccugcccugccugaggg

SEQ ID NO: 2591095 - RNA, 17 nt, Human
aaccugcccugccugag

SEQ ID NO: 2591096 - RNA, 19 nt, Human
aaccugccugacauuugga

SEQ ID NO: 2591097 - RNA, 11 nt, Human
aaccugcucuc

SEQ ID NO: 2591098 - RNA, 15 nt, Human
aacguggcugcuuca

SEQ ID NO: 2591099 - RNA, 20 nt, Human
aaccugcucuccucuugcca

SEQ ID NO: 2591100 - RNA, 23 nt, Human
aaccugcuuggguggagaagcca

SEQ ID NO: 2591101 - RNA, 22 nt, Human
aaccugcuuggguggagaagcc

SEQ ID NO: 2591102 - RNA, 19 nt, Human
aacguggcugcuucaagga

SEQ ID NO: 2591103 - RNA, 16 nt, Human
aacguggcugcuucaa

SEQ ID NO: 2591104 - RNA, 22 nt, Human
aacguggcugcuucaaggaucc

SEQ ID NO: 2591105 - RNA, 15 nt, Human
aacuaaacucauuua

SEQ ID NO: 2591106 - RNA, 16 nt, Human
aacuaaacucauuuau

SEQ ID NO: 2591107 - RNA, 10 nt, Human
aaccuggaga

SEQ ID NO: 2591108 - RNA, 19 nt, Human
aaccuggagagcuagaacc

SEQ ID NO: 2591109 - RNA, 13 nt, Human
aacuaaacuuuca

SEQ ID NO: 2591110 - RNA, 16 nt, Human
aacuaaacucucuuug

SEQ ID NO: 2591111 - RNA, 17 nt, Human
aacuaaacucauuuaua

SEQ ID NO: 2591112 - RNA, 18 nt, Human
aacuaaacucauuuauaa

SEQ ID NO: 2591113 - RNA, 17 nt, Human
aacuaaacuuucacacc

SEQ ID NO: 2591114 - RNA, 15 nt, Human
aacuaaacuuucaca

SEQ ID NO: 2591115 - RNA, 16 nt, Human
aacuaaauuguaaacu

SEQ ID NO: 2591116 - RNA, 20 nt, Human
aacuaaauagcauguauugu

SEQ ID NO: 2591117 - RNA, 22 nt, Human
aacuaauaugggcauuguaguu

SEQ ID NO: 2591118 - RNA, 17 nt, Human
aacuaaauagcauguau

SEQ ID NO: 2591119 - RNA, 15 nt, Human
aacuaaauagcaugu

SEQ ID NO: 2591120 - RNA, 19 nt, Human
aacuacaaacaaaauuucu

SEQ ID NO: 2591121 - RNA, 15 nt, Human
aacuacaaacaaaau

SEQ ID NO: 2591122 - RNA, 12 nt, Human
aacuaaugccuu

SEQ ID NO: 2591123 - RNA, 15 nt, Human
aacuaaugccuuacu

SEQ ID NO: 2591124 - RNA, 19 nt, Human
aacuaaucuauuggguuca

SEQ ID NO: 2591125 - RNA, 20 nt, Human
aacuaaucuauuggguucau

SEQ ID NO: 2591126 - RNA, 22 nt, Human
aacuaaucuauuggguucauua

SEQ ID NO: 2591127 - RNA, 13 nt, Human
aacuacaugagaa

SEQ ID NO: 2591128 - RNA, 14 nt, Human
aacuagauggugcu

SEQ ID NO: 2591129 - RNA, 17 nt, Human
aacuagauggugcugag

SEQ ID NO: 2591130 - RNA, 20 nt, Human
aacuagauggugcugagaag

SEQ ID NO: 2591131 - RNA, 13 nt, Human
aacuacaaaucaa

SEQ ID NO: 2591132 - RNA, 22 nt, Human
aacuacaaccaagcucucugca

SEQ ID NO: 2591133 - RNA, 18 nt, Human
gucuucccuaccucaggc

SEQ ID NO: 2591134 - RNA, 21 nt, Human
gucuucccuaccucaggcagg

SEQ ID NO: 2591135 - RNA, 14 nt, Human
gucuuccugacacu

SEQ ID NO: 2591136 - RNA, 18 nt, Human
gucuuccugacacuuuaa

SEQ ID NO: 2591137 - RNA, 12 nt, Human
gucuuccugagu

SEQ ID NO: 2591138 - RNA, 19 nt, Human
gucuuccugacacuuuaau

SEQ ID NO: 2591139 - RNA, 23 nt, Human
gucuuccucccaaguggugccua

SEQ ID NO: 2591140 - RNA, 14 nt, Human
gucuuccucccaag

SEQ ID NO: 2591141 - RNA, 13 nt, Human
gucuuccucccaa

SEQ ID NO: 2591142 - RNA, 18 nt, Human
gucuuccugaaaugcagu

SEQ ID NO: 2591143 - RNA, 24 nt, Human
gucuuagacuugaaauacuacuua

SEQ ID NO: 2591144 - RNA, 18 nt, Human
gucuuagacuugaaauac

SEQ ID NO: 2591145 - RNA, 23 nt, Human
gucuuagacuugaaauacuacuu

SEQ ID NO: 2591146 - RNA, 15 nt, Human
gucuuaguuguacaa

SEQ ID NO: 2591147 - RNA, 16 nt, Human
gucuucccuaccucag

SEQ ID NO: 2591148 - RNA, 15 nt, Human
gucuucccuaccuca

SEQ ID NO: 2591149 - RNA, 15 nt, Human
gucuuagauguauau

SEQ ID NO: 2591150 - RNA, 19 nt, Human
gucuuaauuauuauuugug

SEQ ID NO: 2591151 - RNA, 19 nt, Human
gucuuagaaguggaccagg

SEQ ID NO: 2591152 - RNA, 20 nt, Human
gucuuagaaguggaccagga

SEQ ID NO: 2591153 - RNA, 22 nt, Human
gucuuagaaguggaccaggaca

SEQ ID NO: 2591154 - RNA, 23 nt, Human
gucuuagaaguggaccaggacag

SEQ ID NO: 2591155 - RNA, 19 nt, Human
gucuuuucuugcaugaggc

SEQ ID NO: 2591156 - RNA, 14 nt, Human
gucuuuucuugcau

SEQ ID NO: 2591157 - RNA, 24 nt, Human
gucuuuucuugcaugaggcuagug

SEQ ID NO: 2591158 - RNA, 19 nt, Human
gucuuuugaauauucccaa

SEQ ID NO: 2591159 - RNA, 16 nt, Human
aaccugcccugccuga

SEQ ID NO: 2591160 - RNA, 14 nt, Human
gucuuuugaauauu

SEQ ID NO: 2591161 - RNA, 15 nt, Human
gucuuuggacccuga

SEQ ID NO: 2591162 - RNA, 14 nt, Human
gucuuuggacccug

SEQ ID NO: 2591163 - RNA, 17 nt, Human
gucuuuggacccugagg

SEQ ID NO: 2591164 - RNA, 14 nt, Human
gucuuuucaucugg

SEQ ID NO: 2591165 - RNA, 21 nt, Human
gucuuaauuauuauuuguguu

SEQ ID NO: 2591166 - RNA, 18 nt, Human
gucuuaauuauuauuugu

SEQ ID NO: 2591167 - RNA, 13 nt, Human
gucuuaauuauua

SEQ ID NO: 2591168 - RNA, 22 nt, Human
gucuuaauuaaaagaauauuuu

SEQ ID NO: 2591169 - RNA, 19 nt, Human
gucuuaauuaaaagaauau

SEQ ID NO: 2591170 - RNA, 21 nt, Human
gucuuaauuaaaagaauauuu

SEQ ID NO: 2591171 - RNA, 12 nt, Human
gucuggcugcag

SEQ ID NO: 2591172 - RNA, 13 nt, Human
gucuggcugcaga

SEQ ID NO: 2591173 - RNA, 14 nt, Human
gucuggcugcagag

SEQ ID NO: 2591174 - RNA, 20 nt, Human
gucugggacuuccuugcucu

SEQ ID NO: 2591175 - RNA, 18 nt, Human
gucugggacuuccuugcu

SEQ ID NO: 2591176 - RNA, 15 nt, Human
gucuggcuucacaga

SEQ ID NO: 2591177 - RNA, 21 nt, Human
gucugggagaaauugacagau

SEQ ID NO: 2591178 - RNA, 16 nt, Human
gucugggagaaauuga

SEQ ID NO: 2591179 - RNA, 24 nt, Human
gucugggacuuccuugcucucccu

SEQ ID NO: 2591180 - RNA, 21 nt, Human
gucugggacuuccuugcucuc

SEQ ID NO: 2591181 - RNA, 20 nt, Human
gucugggaggaauggacaga

SEQ ID NO: 2591182 - RNA, 22 nt, Human
gucugcucuuucucugccagug

SEQ ID NO: 2591183 - RNA, 20 nt, Human
gucugcucuuucucugccag

SEQ ID NO: 2591184 - RNA, 19 nt, Human
gucugcucuuucucugcca

SEQ ID NO: 2591185 - RNA, 17 nt, Human
gucugcucuuucucugc

SEQ ID NO: 2591186 - RNA, 22 nt, Human
gucugcucgggcccaggccauc

SEQ ID NO: 2591187 - RNA, 21 nt, Human
gucugcucgggcccaggccau

SEQ ID NO: 2591188 - RNA, 15 nt, Human
gucugcucuuucucu

SEQ ID NO: 2591189 - RNA, 19 nt, Human
gucugcucgggcccaggcc

SEQ ID NO: 2591190 - RNA, 17 nt, Human
gucugcucgggcccagg

SEQ ID NO: 2591191 - RNA, 15 nt, Human
gucuggcugagcuga

SEQ ID NO: 2591192 - RNA, 16 nt, Human
gucuggcugagcccug

SEQ ID NO: 2591193 - RNA, 19 nt, Human
gucugcugaauaauaaacu

SEQ ID NO: 2591194 - RNA, 17 nt, Human
gucugcugaauaauaaa

SEQ ID NO: 2591195 - RNA, 13 nt, Human
gucugcugcccuc

SEQ ID NO: 2591196 - RNA, 15 nt, Human
gucugcugcccucca

SEQ ID NO: 2591197 - RNA, 16 nt, Human
gucugcugcccuccau

SEQ ID NO: 2591198 - RNA, 18 nt, Human
gucugcugcccuccaucc

SEQ ID NO: 2591199 - RNA, 19 nt, Human
gucugcugcccuccauccc

SEQ ID NO: 2591200 - RNA, 23 nt, Human
gucugcucagacagaaccccuac

SEQ ID NO: 2591201 - RNA, 17 nt, Human
aaccucuucuggcucaa

SEQ ID NO: 2591202 - RNA, 18 nt, Human
aaccucuguucaguguaa

SEQ ID NO: 2591203 - RNA, 14 nt, Human
aaccucuuccccag

SEQ ID NO: 2591204 - RNA, 11 nt, Human
aaccucuuccc

SEQ ID NO: 2591205 - RNA, 12 nt, Human
aaccucuucccc

SEQ ID NO: 2591206 - RNA, 18 nt, Human
aaccucuucagaggcccu

SEQ ID NO: 2591207 - RNA, 15 nt, Human
aaccucuguucagug

SEQ ID NO: 2591208 - RNA, 16 nt, Human
aaccucuguucagugu

SEQ ID NO: 2591209 - RNA, 12 nt, Human
aaccucuguuca

SEQ ID NO: 2591210 - RNA, 13 nt, Human
aaccucuguucag

SEQ ID NO: 2591211 - RNA, 21 nt, Human
aaccucuaauuuauuuugucg

SEQ ID NO: 2591212 - RNA, 20 nt, Human
aaccucuaauuuauuuuguc

SEQ ID NO: 2591213 - RNA, 23 nt, Human
aaccucuacuaaaaagaaggaaa

SEQ ID NO: 2591214 - RNA, 18 nt, Human
aaccucucacuucacccu

SEQ ID NO: 2591215 - RNA, 21 nt, Human
aaccucuccucauguucugcu

SEQ ID NO: 2591216 - RNA, 18 nt, Human
guugacaugggacauuug

SEQ ID NO: 2591217 - RNA, 14 nt, Human
guugacaugggaca

SEQ ID NO: 2591218 - RNA, 15 nt, Human
guucuuuaggagauu

SEQ ID NO: 2591219 - RNA, 14 nt, Human
guucuuuaauuuau

SEQ ID NO: 2591220 - RNA, 16 nt, Human
guucuuuaggagauuu

SEQ ID NO: 2591221 - RNA, 21 nt, Human
guugagcuucauauaccagca

SEQ ID NO: 2591222 - RNA, 17 nt, Human
guugagggaacagacag

SEQ ID NO: 2591223 - RNA, 22 nt, Human
guugaugaucuuugcagacagg

SEQ ID NO: 2591224 - RNA, 16 nt, Human
guugagguggucugaa

SEQ ID NO: 2591225 - RNA, 21 nt, Human
guugaguucagguagcugccc

SEQ ID NO: 2591226 - RNA, 22 nt, Human
guugaguucagguagcugcccc

SEQ ID NO: 2591227 - RNA, 18 nt, Human
guugauaaauuccacugg

SEQ ID NO: 2591228 - RNA, 21 nt, Human
guugauaaauuccacuggacu

SEQ ID NO: 2591229 - RNA, 19 nt, Human
guugagggaacagacagga

SEQ ID NO: 2591230 - RNA, 22 nt, Human
guugagggaacagacaggagaa

SEQ ID NO: 2591231 - RNA, 23 nt, Human
guugagggaacagacaggagaaa

SEQ ID NO: 2591232 - RNA, 16 nt, Human
guugaggggcuccugg

SEQ ID NO: 2591233 - RNA, 17 nt, Human
guugaggggcuccugga

SEQ ID NO: 2591234 - RNA, 22 nt, Human
guugagguccagcccuggcuga

SEQ ID NO: 2591235 - RNA, 21 nt, Human
guugagguccagcccuggcug

SEQ ID NO: 2591236 - RNA, 18 nt, Human
guugaggggcuccuggaa

SEQ ID NO: 2591237 - RNA, 20 nt, Human
guugagguggaagcccuccu

SEQ ID NO: 2591238 - RNA, 23 nt, Human
guugagguggaagcccuccuucc

SEQ ID NO: 2591239 - RNA, 23 nt, Human
guugagguggucugaauguucug

SEQ ID NO: 2591240 - RNA, 13 nt, Human
guugacaugggac

SEQ ID NO: 2591241 - RNA, 18 nt, Human
guucuuguauuaagaaug

SEQ ID NO: 2591242 - RNA, 21 nt, Human
guucuuguauuaagaaugaaa

SEQ ID NO: 2591243 - RNA, 12 nt, Human
guucuugucuga

SEQ ID NO: 2591244 - RNA, 17 nt, Human
guucuuguauuaagaau

SEQ ID NO: 2591245 - RNA, 17 nt, Human
guucuuaguuugcaguu

SEQ ID NO: 2591246 - RNA, 17 nt, Human
guucuuaauugcacucu

SEQ ID NO: 2591247 - RNA, 21 nt, Human
guucuugguuuguaaauuaac

SEQ ID NO: 2591248 - RNA, 17 nt, Human
guucuuaguucucacug

SEQ ID NO: 2591249 - RNA, 19 nt, Human
guucuuaguugcuguaugu

SEQ ID NO: 2591250 - RNA, 16 nt, Human
guucuacccaggugcu

SEQ ID NO: 2591251 - RNA, 22 nt, Human
guucccuuugacgccaucccag

SEQ ID NO: 2591252 - RNA, 21 nt, Human
guucccuuugacgccauccca

SEQ ID NO: 2591253 - RNA, 20 nt, Human
guucccuuugacgccauccc

SEQ ID NO: 2591254 - RNA, 23 nt, Human
guucuccguuagcuccuguggcc

SEQ ID NO: 2591255 - RNA, 22 nt, Human
guucuccguuagcuccuguggc

SEQ ID NO: 2591256 - RNA, 23 nt, Human
guucuagagaagaggcuggugcu

SEQ ID NO: 2591257 - RNA, 15 nt, Human
guucuagagaagagg

SEQ ID NO: 2591258 - RNA, 21 nt, Human
guucuccguuagcuccugugg

SEQ ID NO: 2591259 - RNA, 21 nt, Human
guucuaccucaggcagcucaa

SEQ ID NO: 2591260 - RNA, 20 nt, Human
guucuaccucaggcagcuca

SEQ ID NO: 2591261 - RNA, 16 nt, Human
guucccuuggccucag

SEQ ID NO: 2591262 - RNA, 22 nt, Human
guucccuuuccuuccaucccua

SEQ ID NO: 2591263 - RNA, 16 nt, Human
guucuacacucaucuu

SEQ ID NO: 2591264 - RNA, 19 nt, Human
guucuuaauugcacucuaa

SEQ ID NO: 2591265 - RNA, 22 nt, Human
guucuuaccuguaugucuccag

SEQ ID NO: 2591266 - RNA, 22 nt, Human
guucuguagaaaugguuguauu

SEQ ID NO: 2591267 - RNA, 18 nt, Human
guucuggugugaacuaaa

SEQ ID NO: 2591268 - RNA, 20 nt, Human
guucuggugaggccuugcuc

SEQ ID NO: 2591269 - RNA, 14 nt, Human
guucuguagaaaug

SEQ ID NO: 2591270 - RNA, 22 nt, Human
guucugguuuuuaaccauuguc

SEQ ID NO: 2591271 - RNA, 19 nt, Human
guucuggugaggccuugcu

SEQ ID NO: 2591272 - RNA, 16 nt, Human
guucuggugaggccuu

SEQ ID NO: 2591273 - RNA, 15 nt, Human
guucuggugugaacu

SEQ ID NO: 2591274 - RNA, 14 nt, Human
guucuggugaggcc

SEQ ID NO: 2591275 - RNA, 15 nt, Human
guucuggugaggccu

SEQ ID NO: 2591276 - RNA, 14 nt, Human
guucuggggccccu

SEQ ID NO: 2591277 - RNA, 15 nt, Human
guucuggggccccuu

SEQ ID NO: 2591278 - RNA, 16 nt, Human
guucucuccuccccaa

SEQ ID NO: 2591279 - RNA, 21 nt, Human
guucucucccaggggcuggcu

SEQ ID NO: 2591280 - RNA, 22 nt, Human
guucucuaucauuuaauaauau

SEQ ID NO: 2591281 - RNA, 18 nt, Human
guucucuaucauuuaaua

SEQ ID NO: 2591282 - RNA, 17 nt, Human
guucucuaucauuuaau

SEQ ID NO: 2591283 - RNA, 13 nt, Human
guucuccuuuucc

SEQ ID NO: 2591284 - RNA, 17 nt, Human
guucuccucuccccucu

SEQ ID NO: 2591285 - RNA, 18 nt, Human
guucuccucuccccucua

SEQ ID NO: 2591286 - RNA, 22 nt, Human
guucuccuuuuccucucucccg

SEQ ID NO: 2591287 - RNA, 18 nt, Human
guucuccuuuuccucucu

SEQ ID NO: 2591288 - RNA, 22 nt, Human
guucucuaaguuccacugagcu

SEQ ID NO: 2591289 - RNA, 18 nt, Human
aagcuucaaacugcauga

SEQ ID NO: 2591290 - RNA, 14 nt, Human
aagcuuauuuaauu

SEQ ID NO: 2591291 - RNA, 20 nt, Human
aagcuuccaugauucuauuu

SEQ ID NO: 2591292 - RNA, 23 nt, Human
aagcuuguauuccuuuuucucuc

SEQ ID NO: 2591293 - RNA, 21 nt, Human
aagcuuccaguccaaucucau

SEQ ID NO: 2591294 - RNA, 15 nt, Human
aagcuuccaugauuc

SEQ ID NO: 2591295 - RNA, 15 nt, Human
aagcuucaguuuccu

SEQ ID NO: 2591296 - RNA, 19 nt, Human
aagcuuccaguccaaucuc

SEQ ID NO: 2591297 - RNA, 17 nt, Human
aagcugaggcgggagaa

SEQ ID NO: 2591298 - RNA, 14 nt, Human
aagcugaggcggga

SEQ ID NO: 2591299 - RNA, 22 nt, Human
aagcugacgaacuuccauggcc

SEQ ID NO: 2591300 - RNA, 19 nt, Human
aagcugacgaacuuccaug

SEQ ID NO: 2591301 - RNA, 20 nt, Human
aagcugacgaacuuccaugg

SEQ ID NO: 2591302 - RNA, 22 nt, Human
aagcugaaguuucacuccggag

SEQ ID NO: 2591303 - RNA, 17 nt, Human
aagcugaccacaggcag

SEQ ID NO: 2591304 - RNA, 17 nt, Human
aagcugacgaacuucca

SEQ ID NO: 2591305 - RNA, 21 nt, Human
aagcugaagugcauccaaagg

SEQ ID NO: 2591306 - RNA, 19 nt, Human
aagcugaagugcauccaaa

SEQ ID NO: 2591307 - RNA, 17 nt, Human
aagcugaagugcaucca

SEQ ID NO: 2591308 - RNA, 14 nt, Human
aagcugaagugcau

SEQ ID NO: 2591309 - RNA, 13 nt, Human
aagcugaauacau

SEQ ID NO: 2591310 - RNA, 23 nt, Human
aagcugaauacauucugcuuuca

SEQ ID NO: 2591311 - RNA, 21 nt, Human
aagcuauggugagaugcagcu

SEQ ID NO: 2591312 - RNA, 18 nt, Human
aagcuauggugagaugca

SEQ ID NO: 2591313 - RNA, 15 nt, Human
aagcuauggugagau

SEQ ID NO: 2591314 - RNA, 12 nt, Human
aagcuaugguga

SEQ ID NO: 2591315 - RNA, 17 nt, Human
aagcuauccuggcucuu

SEQ ID NO: 2591316 - RNA, 17 nt, Human
aagcuauccaaauaacu

SEQ ID NO: 2591317 - RNA, 22 nt, Human
aagcuauaucaaucucucuuag

SEQ ID NO: 2591318 - RNA, 17 nt, Human
aagcuaucguaaaauua

SEQ ID NO: 2591319 - RNA, 19 nt, Human
aagcuauuagccaggauca

SEQ ID NO: 2591320 - RNA, 16 nt, Human
aagcuauuagccagga

SEQ ID NO: 2591321 - RNA, 23 nt, Human
aagcuauggugagaugcagcugg

SEQ ID NO: 2591322 - RNA, 22 nt, Human
aagcuauggugagaugcagcug

SEQ ID NO: 2591323 - RNA, 21 nt, Human
aagcuauuagccaggaucaug

SEQ ID NO: 2591324 - RNA, 18 nt, Human
aagcuauaaauuccucuu

SEQ ID NO: 2591325 - RNA, 18 nt, Human
aagcuccucuccccagcc

SEQ ID NO: 2591326 - RNA, 22 nt, Human
aagcuauucaguaauaacucua

SEQ ID NO: 2591327 - RNA, 18 nt, Human
aagcucgaaaacaauugu

SEQ ID NO: 2591328 - RNA, 22 nt, Human
aagcuccuguccucccaucccc

SEQ ID NO: 2591329 - RNA, 20 nt, Human
aagcuccuguccucccaucc

SEQ ID NO: 2591330 - RNA, 17 nt, Human
aagcuccuguccuccca

SEQ ID NO: 2591331 - RNA, 21 nt, Human
aagcucuacugaggugcuaug

SEQ ID NO: 2591332 - RNA, 19 nt, Human
aagcuccucuccccagccc

SEQ ID NO: 2591333 - RNA, 20 nt, Human
aagcuccucuccccagccca

SEQ ID NO: 2591334 - RNA, 21 nt, Human
aagcuccucuccccagcccag

SEQ ID NO: 2591335 - RNA, 22 nt, Human
aagcuccucuccccagcccaga

SEQ ID NO: 2591336 - RNA, 15 nt, Human
aagcuccuguccucc

SEQ ID NO: 2591337 - RNA, 14 nt, Human
aagcuccuguccuc

SEQ ID NO: 2591338 - RNA, 13 nt, Human
aagcuccuguccu

SEQ ID NO: 2591339 - RNA, 16 nt, Human
aagcuccucuccccag

SEQ ID NO: 2591340 - RNA, 23 nt, Human
aagcuccucuccccagcccagag

SEQ ID NO: 2591341 - RNA, 19 nt, Human
aagcuccuggucuugagau

SEQ ID NO: 2591342 - RNA, 18 nt, Human
guucccguuucuccaccu

SEQ ID NO: 2591343 - RNA, 16 nt, Human
guucccguuucuccac

SEQ ID NO: 2591344 - RNA, 14 nt, Human
guucccguuucucc

SEQ ID NO: 2591345 - RNA, 19 nt, Human
guucccguuucuccaccua

SEQ ID NO: 2591346 - RNA, 21 nt, Human
guucccuaggggacacuuccc

SEQ ID NO: 2591347 - RNA, 20 nt, Human
guucccuacuuccugugacu

SEQ ID NO: 2591348 - RNA, 15 nt, Human
guucccucucccugu

SEQ ID NO: 2591349 - RNA, 14 nt, Human
guucccucugagaa

SEQ ID NO: 2591350 - RNA, 12 nt, Human
guucccucugag

SEQ ID NO: 2591351 - RNA, 17 nt, Human
guucccucucccuguug

SEQ ID NO: 2591352 - RNA, 22 nt, Human
guucccucugagaauuccaagg

SEQ ID NO: 2591353 - RNA, 18 nt, Human
guucccuuggccucagaa

SEQ ID NO: 2591354 - RNA, 19 nt, Human
guucccuuggccucagaau

SEQ ID NO: 2591355 - RNA, 19 nt, Human
guucccuuuccuuccaucc

SEQ ID NO: 2591356 - RNA, 20 nt, Human
guucccauuugcuccuuucu

SEQ ID NO: 2591357 - RNA, 15 nt, Human
guuccccuuccacug

SEQ ID NO: 2591358 - RNA, 22 nt, Human
guuccccuuccacugagggcag

SEQ ID NO: 2591359 - RNA, 16 nt, Human
guucccauuugcuccu

SEQ ID NO: 2591360 - RNA, 18 nt, Human
guucccauguagcccccu

SEQ ID NO: 2591361 - RNA, 19 nt, Human
guucccauguagcccccug

SEQ ID NO: 2591362 - RNA, 16 nt, Human
guucccauuucagcug

SEQ ID NO: 2591363 - RNA, 14 nt, Human
guucccauguuaaa

SEQ ID NO: 2591364 - RNA, 19 nt, Human
guuccauuguuuggagaca

SEQ ID NO: 2591365 - RNA, 21 nt, Human
guuccauuguuuggagacauu

SEQ ID NO: 2591366 - RNA, 20 nt, Human
guuccaugccugagggugga

SEQ ID NO: 2591367 - RNA, 17 nt, Human
guuccaugccugagggu

SEQ ID NO: 2591368 - RNA, 20 nt, Human
guuccauggccucuucagau

SEQ ID NO: 2591369 - RNA, 19 nt, Human
guucccaagcucagaggcg

SEQ ID NO: 2591370 - RNA, 19 nt, Human
guucccaccaggcugcuca

SEQ ID NO: 2591371 - RNA, 14 nt, Human
guucccacuuggag

SEQ ID NO: 2591372 - RNA, 15 nt, Human
guucccagaaucaaa

SEQ ID NO: 2591373 - RNA, 21 nt, Human
guucccagugacacuucagag

SEQ ID NO: 2591374 - RNA, 22 nt, Human
guucccagugacacuucagaga

SEQ ID NO: 2591375 - RNA, 17 nt, Human
guucccauguagccccc

SEQ ID NO: 2591376 - RNA, 15 nt, Human
guuccaugccugagg

SEQ ID NO: 2591377 - RNA, 14 nt, Human
guuccaugccugag

SEQ ID NO: 2591378 - RNA, 16 nt, Human
guuccaugaugcuggg

SEQ ID NO: 2591379 - RNA, 23 nt, Human
guuccaugaagaccacauccaca

SEQ ID NO: 2591380 - RNA, 12 nt, Human
aagcuuuccugc

SEQ ID NO: 2591381 - RNA, 22 nt, Human
aagcuuuauacguguagcuaua

SEQ ID NO: 2591382 - RNA, 20 nt, Human
aagcuuuauacguguagcua

SEQ ID NO: 2591383 - RNA, 21 nt, Human
aagcuuucaguauuagugaug

SEQ ID NO: 2591384 - RNA, 22 nt, Human
aagcuuucauguaaacugugca

SEQ ID NO: 2591385 - RNA, 23 nt, Human
aagcuuucauguaaacugugcac

SEQ ID NO: 2591386 - RNA, 23 nt, Human
aagcuuguguauccauuaucaug

SEQ ID NO: 2591387 - RNA, 22 nt, Human
aagcuuguguauccauuaucau

SEQ ID NO: 2591388 - RNA, 21 nt, Human
aagcuuguguauccauuauca

SEQ ID NO: 2591389 - RNA, 16 nt, Human
aagcuuguguauccau

SEQ ID NO: 2591390 - RNA, 13 nt, Human
aagcuuguguauc

SEQ ID NO: 2591391 - RNA, 12 nt, Human
aagcuuguguau

SEQ ID NO: 2591392 - RNA, 16 nt, Human
aagcuuccaugauucu

SEQ ID NO: 2591393 - RNA, 19 nt, Human
aagcuuuauacguguagcu

SEQ ID NO: 2591394 - RNA, 15 nt, Human
aagccucgacacaga

SEQ ID NO: 2591395 - RNA, 11 nt, Human
aagccucugcu

SEQ ID NO: 2591396 - RNA, 14 nt, Human
aagccucugcugcc

SEQ ID NO: 2591397 - RNA, 12 nt, Human
aagccucuggcu

SEQ ID NO: 2591398 - RNA, 14 nt, Human
aagccucuggcuag

SEQ ID NO: 2591399 - RNA, 24 nt, Human
aagccucugugucacuggcugccu

SEQ ID NO: 2591400 - RNA, 23 nt, Human
aagccucugugucacuggcugcc

SEQ ID NO: 2591401 - RNA, 22 nt, Human
aagccucugugucacuggcugc

SEQ ID NO: 2591402 - RNA, 21 nt, Human
aagccucugugucacuggcug

SEQ ID NO: 2591403 - RNA, 22 nt, Human
aagccugcacaauaaaaauguu

SEQ ID NO: 2591404 - RNA, 10 nt, Human
aagccugccc

SEQ ID NO: 2591405 - RNA, 14 nt, Human
aagccugcaggagu

SEQ ID NO: 2591406 - RNA, 20 nt, Human
aagccucugugucacuggcu

SEQ ID NO: 2591407 - RNA, 18 nt, Human
aagccucugugucacugg

SEQ ID NO: 2591408 - RNA, 17 nt, Human
aagccucugugucacug

SEQ ID NO: 2591409 - RNA, 13 nt, Human
aagccucuguguc

SEQ ID NO: 2591410 - RNA, 12 nt, Human
aagccucuggga

SEQ ID NO: 2591411 - RNA, 20 nt, Human
guucauaggucacuggcucu

SEQ ID NO: 2591412 - RNA, 23 nt, Human
aagccucuggcuagaggccagcc

SEQ ID NO: 2591413 - RNA, 16 nt, Human
guucauacauuugagg

SEQ ID NO: 2591414 - RNA, 17 nt, Human
guucauagacccucuca

SEQ ID NO: 2591415 - RNA, 14 nt, Human
guucauacauuuga

SEQ ID NO: 2591416 - RNA, 13 nt, Human
guucauagcccag

SEQ ID NO: 2591417 - RNA, 19 nt, Human
aagccuccuccagccgcca

SEQ ID NO: 2591418 - RNA, 19 nt, Human
guucauauguaccauguac

SEQ ID NO: 2591419 - RNA, 20 nt, Human
guucauagggucucuucagg

SEQ ID NO: 2591420 - RNA, 22 nt, Human
guucauagggucucuucagguu

SEQ ID NO: 2591421 - RNA, 14 nt, Human
guucauagcccagu

SEQ ID NO: 2591422 - RNA, 17 nt, Human
guucauagggucucuuc

SEQ ID NO: 2591423 - RNA, 18 nt, Human
guucauagggucucuuca

SEQ ID NO: 2591424 - RNA, 15 nt, Human
aagccuggucagccc

SEQ ID NO: 2591425 - RNA, 17 nt, Human
aagccugggauugacag

SEQ ID NO: 2591426 - RNA, 21 nt, Human
aagccuggccuacaugguuga

SEQ ID NO: 2591427 - RNA, 19 nt, Human
aagccugcuuuuuaagugu

SEQ ID NO: 2591428 - RNA, 18 nt, Human
aagccugcccuugucuga

SEQ ID NO: 2591429 - RNA, 17 nt, Human
aagccugcccuugucug

SEQ ID NO: 2591430 - RNA, 15 nt, Human
aagccugcccuuguc

SEQ ID NO: 2591431 - RNA, 11 nt, Human
aagccugcccu

SEQ ID NO: 2591432 - RNA, 20 nt, Human
aagccugcccuugucugaga

SEQ ID NO: 2591433 - RNA, 21 nt, Human
aagccugccuaggaauuccca

SEQ ID NO: 2591434 - RNA, 23 nt, Human
aagccugccuaggaauucccagc

SEQ ID NO: 2591435 - RNA, 22 nt, Human
aagcuaggccuggccagaugca

SEQ ID NO: 2591436 - RNA, 16 nt, Human
aagcuaggccuggcca

SEQ ID NO: 2591437 - RNA, 17 nt, Human
aagccuggucagcccaa

SEQ ID NO: 2591438 - RNA, 21 nt, Human
aagcuauaaauuccucuuugc

SEQ ID NO: 2591439 - RNA, 20 nt, Human
aagcuauagacccgaggaaa

SEQ ID NO: 2591440 - RNA, 18 nt, Human
aagcuaggccuggccaga

SEQ ID NO: 2591441 - RNA, 17 nt, Human
aagcuaggccuggccag

SEQ ID NO: 2591442 - RNA, 17 nt, Human
guucagcuccagcucac

SEQ ID NO: 2591443 - RNA, 16 nt, Human
guucagcuccagcuca

SEQ ID NO: 2591444 - RNA, 18 nt, Human
guucagcuccagcucacc

SEQ ID NO: 2591445 - RNA, 15 nt, Human
guucagcuccagcuc

SEQ ID NO: 2591446 - RNA, 14 nt, Human
guuauuuguacagu

SEQ ID NO: 2591447 - RNA, 20 nt, Human
guucaggggacucagcccug

SEQ ID NO: 2591448 - RNA, 14 nt, Human
guuauuuauauauu

SEQ ID NO: 2591449 - RNA, 12 nt, Human
guuauuuagacu

SEQ ID NO: 2591450 - RNA, 14 nt, Human
guuauuuauaauca

SEQ ID NO: 2591451 - RNA, 17 nt, Human
guuauuuauuuaaaugu

SEQ ID NO: 2591452 - RNA, 19 nt, Human
guuauuucuuacaggcaca

SEQ ID NO: 2591453 - RNA, 14 nt, Human
guuauuucuuacag

SEQ ID NO: 2591454 - RNA, 13 nt, Human
guuauuuguacag

SEQ ID NO: 2591455 - RNA, 20 nt, Human
guuauuuauaaucacuuuuu

SEQ ID NO: 2591456 - RNA, 19 nt, Human
guuaguuauagaugucuag

SEQ ID NO: 2591457 - RNA, 15 nt, Human
guuauuuaaagaaga

SEQ ID NO: 2591458 - RNA, 23 nt, Human
guuauuuaacagcugaauuaucu

SEQ ID NO: 2591459 - RNA, 15 nt, Human
guuauuuaaaugagu

SEQ ID NO: 2591460 - RNA, 11 nt, Human
guuauuuaaau

SEQ ID NO: 2591461 - RNA, 17 nt, Human
guuaguuauagaugucu

SEQ ID NO: 2591462 - RNA, 23 nt, Human
guuagucuacucuuaagccaucu

SEQ ID NO: 2591463 - RNA, 13 nt, Human
guuauuuaaauga

SEQ ID NO: 2591464 - RNA, 19 nt, Human
guucaguguaauuucuuug

SEQ ID NO: 2591465 - RNA, 20 nt, Human
guuauuuguacaguucaguu

SEQ ID NO: 2591466 - RNA, 16 nt, Human
guucaguguaauuucu

SEQ ID NO: 2591467 - RNA, 16 nt, Human
guucagugucccgggc

SEQ ID NO: 2591468 - RNA, 11 nt, Human
guucaguuaca

SEQ ID NO: 2591469 - RNA, 19 nt, Human
guucaggguuggccccugc

SEQ ID NO: 2591470 - RNA, 18 nt, Human
guucaggguuggccccug

SEQ ID NO: 2591471 - RNA, 17 nt, Human
guucaggguuggccccu

SEQ ID NO: 2591472 - RNA, 12 nt, Human
guucauaaauga

SEQ ID NO: 2591473 - RNA, 20 nt, Human
guucaguuccucuuugcaug

SEQ ID NO: 2591474 - RNA, 17 nt, Human
guucaguuacagaaagu

SEQ ID NO: 2591475 - RNA, 16 nt, Human
guucaguuacagaaag

SEQ ID NO: 2591476 - RNA, 15 nt, Human
guucaguuacagaaa

SEQ ID NO: 2591477 - RNA, 14 nt, Human
guucaguuacagaa

SEQ ID NO: 2591478 - RNA, 13 nt, Human
guucaguuacaga

SEQ ID NO: 2591479 - RNA, 12 nt, Human
guucaguuacag

SEQ ID NO: 2591480 - RNA, 13 nt, Human
guucauaaaugaa

SEQ ID NO: 2591481 - RNA, 22 nt, Human
guuagucuacucuuaagccauc

SEQ ID NO: 2591482 - RNA, 21 nt, Human
guuagucuacucuuaagccau

SEQ ID NO: 2591483 - RNA, 16 nt, Human
guuagucuacucuuaa

SEQ ID NO: 2591484 - RNA, 22 nt, Human
guuagucgugagcucuugugag

SEQ ID NO: 2591485 - RNA, 20 nt, Human
guuagucgugagcucuugug

SEQ ID NO: 2591486 - RNA, 22 nt, Human
guuagucucuuguauuaaacuc

SEQ ID NO: 2591487 - RNA, 12 nt, Human
guuagucauuug

SEQ ID NO: 2591488 - RNA, 18 nt, Human
guuagucgugagcucuug

SEQ ID NO: 2591489 - RNA, 22 nt, Human
guuagucauuugcugagcaugu

SEQ ID NO: 2591490 - RNA, 20 nt, Human
guuaguaugaggcauuuguu

SEQ ID NO: 2591491 - RNA, 17 nt, Human
guuaguaugaggcauuu

SEQ ID NO: 2591492 - RNA, 23 nt, Human
guuaguaacaugaggggacauuu

SEQ ID NO: 2591493 - RNA, 21 nt, Human
guuaguagcauguugagccag

SEQ ID NO: 2591494 - RNA, 16 nt, Human
guuaguaucuaacaug

SEQ ID NO: 2591495 - RNA, 17 nt, Human
guuaguaucuaacaugu

SEQ ID NO: 2591496 - RNA, 16 nt, Human
guuaguagcauguuga

SEQ ID NO: 2591497 - RNA, 15 nt, Human
guuagcuccuguggc

SEQ ID NO: 2591498 - RNA, 14 nt, Human
guuagcuccugugg

SEQ ID NO: 2591499 - RNA, 11 nt, Human
guuagggaggg

SEQ ID NO: 2591500 - RNA, 13 nt, Human
guuagggaggggu

SEQ ID NO: 2591501 - RNA, 21 nt, Human
guuagguagagggaguuguca

SEQ ID NO: 2591502 - RNA, 23 nt, Human
guuagggugcucuggaagagagg

SEQ ID NO: 2591503 - RNA, 18 nt, Human
guuagguagagggaguug

SEQ ID NO: 2591504 - RNA, 17 nt, Human
guuacacaaaggaccuc

SEQ ID NO: 2591505 - RNA, 23 nt, Human
guuacaacagauuugugaacuca

SEQ ID NO: 2591506 - RNA, 22 nt, Human
guuacaacagauuugugaacuc

SEQ ID NO: 2591507 - RNA, 18 nt, Human
guuacaaucauugcugaa

SEQ ID NO: 2591508 - RNA, 21 nt, Human
guuacaacagauuugugaacu

SEQ ID NO: 2591509 - RNA, 20 nt, Human
guuacaacagauuugugaac

SEQ ID NO: 2591510 - RNA, 19 nt, Human
guuacaacagauuugugaa

SEQ ID NO: 2591511 - RNA, 18 nt, Human
guuacaacagauuuguga

SEQ ID NO: 2591512 - RNA, 14 nt, Human
guuacaacagauuu

SEQ ID NO: 2591513 - RNA, 13 nt, Human
guuacaacagauu

SEQ ID NO: 2591514 - RNA, 17 nt, Human
guuagccaauauuuuuc

SEQ ID NO: 2591515 - RNA, 18 nt, Human
guuagcagacaggccccg

SEQ ID NO: 2591516 - RNA, 15 nt, Human
guuagcaaacuuugu

SEQ ID NO: 2591517 - RNA, 13 nt, Human
guuagcagacagg

SEQ ID NO: 2591518 - RNA, 12 nt, Human
guuagcuccugu

SEQ ID NO: 2591519 - RNA, 21 nt, Human
guuagauuuuguauucagggg

SEQ ID NO: 2591520 - RNA, 20 nt, Human
guuagcucaggaggcuugga

SEQ ID NO: 2591521 - RNA, 22 nt, Human
guuagaguccaacguggggcag

SEQ ID NO: 2591522 - RNA, 21 nt, Human
guuacacaaaggaccucagcu

SEQ ID NO: 2591523 - RNA, 21 nt, Human
guuacacacuuuuuaagaaau

SEQ ID NO: 2591524 - RNA, 22 nt, Human
guuaaguuacuucacuuuaauu

SEQ ID NO: 2591525 - RNA, 12 nt, Human
guuaaucuuagg

SEQ ID NO: 2591526 - RNA, 16 nt, Human
guuaaugaaaauguca

SEQ ID NO: 2591527 - RNA, 18 nt, Human
guuaaugauagcuacugu

SEQ ID NO: 2591528 - RNA, 23 nt, Human
guuaaugaugguugauggguucu

SEQ ID NO: 2591529 - RNA, 22 nt, Human
guuaaugaugguugauggguuc

SEQ ID NO: 2591530 - RNA, 17 nt, Human
guuaaugaaaaugucag

SEQ ID NO: 2591531 - RNA, 20 nt, Human
guuaauguaaucugauggcu

SEQ ID NO: 2591532 - RNA, 15 nt, Human
guuaagucuguuuua

SEQ ID NO: 2591533 - RNA, 22 nt, Human
guuaagucuguuuuaugacuuc

SEQ ID NO: 2591534 - RNA, 22 nt, Human
guuaaguugauggugaugaaau

SEQ ID NO: 2591535 - RNA, 14 nt, Human
guuaaguaugugua

SEQ ID NO: 2591536 - RNA, 13 nt, Human
guuaagucuguuu

SEQ ID NO: 2591537 - RNA, 22 nt, Human
guuaagucuaaauauuuccuua

SEQ ID NO: 2591538 - RNA, 14 nt, Human
guuaagggaaggaa

SEQ ID NO: 2591539 - RNA, 13 nt, Human
guuaagggaagga

SEQ ID NO: 2591540 - RNA, 22 nt, Human
guuaagggaaggaacucuggcu

SEQ ID NO: 2591541 - RNA, 17 nt, Human
guuaaggcugaggaaag

SEQ ID NO: 2591542 - RNA, 16 nt, Human
guuaaggcugaggaaa

SEQ ID NO: 2591543 - RNA, 19 nt, Human
guuaaggaaacucuuaucu

SEQ ID NO: 2591544 - RNA, 16 nt, Human
guuaaggaaacucuua

SEQ ID NO: 2591545 - RNA, 21 nt, Human
guuaaggaaacucuuaucuca

SEQ ID NO: 2591546 - RNA, 14 nt, Human
guuaaggaaacucu

SEQ ID NO: 2591547 - RNA, 12 nt, Human
guuaaggaaacu

SEQ ID NO: 2591548 - RNA, 15 nt, Human
guguuucccauaauu

SEQ ID NO: 2591549 - RNA, 16 nt, Human
guguuucuagcacugg

SEQ ID NO: 2591550 - RNA, 18 nt, Human
guguuuccacagccugca

SEQ ID NO: 2591551 - RNA, 12 nt, Human
guguuucccaua

SEQ ID NO: 2591552 - RNA, 21 nt, Human
guguuugggucaccccuccag

SEQ ID NO: 2591553 - RNA, 22 nt, Human
guguuucuagcacuggccugca

SEQ ID NO: 2591554 - RNA, 19 nt, Human
guguuucuagcacuggccu

SEQ ID NO: 2591555 - RNA, 11 nt, Human
guguuucuagg

SEQ ID NO: 2591556 - RNA, 18 nt, Human
guguuuuaaaaugagaaa

SEQ ID NO: 2591557 - RNA, 15 nt, Human
guguuugucauuagc

SEQ ID NO: 2591558 - RNA, 13 nt, Human
guguuugucauua

SEQ ID NO: 2591559 - RNA, 12 nt, Human
guguuugucauu

SEQ ID NO: 2591560 - RNA, 20 nt, Human
guuaagcauuaccacucagg

SEQ ID NO: 2591561 - RNA, 13 nt, Human
guguuuuaauuua

SEQ ID NO: 2591562 - RNA, 15 nt, Human
guguuuuaauuccaa

SEQ ID NO: 2591563 - RNA, 12 nt, Human
guguuuguuccu

SEQ ID NO: 2591564 - RNA, 22 nt, Human
guguuuuaauuccaauaugaug

SEQ ID NO: 2591565 - RNA, 12 nt, Human
guguuuguguga

SEQ ID NO: 2591566 - RNA, 11 nt, Human
guguuuguguu

SEQ ID NO: 2591567 - RNA, 12 nt, Human
guuaagccuuug

SEQ ID NO: 2591568 - RNA, 13 nt, Human
guuaagccuuugg

SEQ ID NO: 2591569 - RNA, 16 nt, Human
guuaagccuuuggaaa

SEQ ID NO: 2591570 - RNA, 21 nt, Human
guuaagcauuaccacucaggc

SEQ ID NO: 2591571 - RNA, 23 nt, Human
aaggaugaucuaggaagacuuug

SEQ ID NO: 2591572 - RNA, 18 nt, Human
aaggaugaucuaggaaga

SEQ ID NO: 2591573 - RNA, 17 nt, Human
aaggauccugagccaga

SEQ ID NO: 2591574 - RNA, 15 nt, Human
aaggauccugagcca

SEQ ID NO: 2591575 - RNA, 13 nt, Human
aaggauccugagc

SEQ ID NO: 2591576 - RNA, 14 nt, Human
aaggauccugagcc

SEQ ID NO: 2591577 - RNA, 16 nt, Human
guugaugaggccucuu

SEQ ID NO: 2591578 - RNA, 15 nt, Human
guugaugaggccucu

SEQ ID NO: 2591579 - RNA, 13 nt, Human
guugauaacuuug

SEQ ID NO: 2591580 - RNA, 22 nt, Human
guugaucuggaacccagacuca

SEQ ID NO: 2591581 - RNA, 21 nt, Human
guugaugccugugaacugaac

SEQ ID NO: 2591582 - RNA, 23 nt, Human
guugaugaucuuugcagacaggc

SEQ ID NO: 2591583 - RNA, 17 nt, Human
aaggaugcuuguacaua

SEQ ID NO: 2591584 - RNA, 19 nt, Human
aaggaugcuuguacauaau

SEQ ID NO: 2591585 - RNA, 19 nt, Human
aaggaugccccgucccccu

SEQ ID NO: 2591586 - RNA, 17 nt, Human
aaggauguaaacagugc

SEQ ID NO: 2591587 - RNA, 19 nt, Human
aaggauguaaacagugccu

SEQ ID NO: 2591588 - RNA, 20 nt, Human
aaggauguaaacagugccug

SEQ ID NO: 2591589 - RNA, 23 nt, Human
aaggauguaaacagugccugcug

SEQ ID NO: 2591590 - RNA, 15 nt, Human
aaggauguacauuuc

SEQ ID NO: 2591591 - RNA, 14 nt, Human
aaggaugucacagg

SEQ ID NO: 2591592 - RNA, 16 nt, Human
aaggauguacauuucc

SEQ ID NO: 2591593 - RNA, 15 nt, Human
aaggaugcuuguaca

SEQ ID NO: 2591594 - RNA, 16 nt, Human
aaggaugcuuguacau

SEQ ID NO: 2591595 - RNA, 18 nt, Human
aaggaugcacagaguugu

SEQ ID NO: 2591596 - RNA, 23 nt, Human
aaggaugaaugaggucccaggca

SEQ ID NO: 2591597 - RNA, 17 nt, Human
guugcccaggcuggcgu

SEQ ID NO: 2591598 - RNA, 15 nt, Human
guugcccaggcaggu

SEQ ID NO: 2591599 - RNA, 21 nt, Human
guugcccaggcuggcgugcag

SEQ ID NO: 2591600 - RNA, 19 nt, Human
guugcccaggcaggucuug

SEQ ID NO: 2591601 - RNA, 18 nt, Human
guugcccaggcaggucuu

SEQ ID NO: 2591602 - RNA, 14 nt, Human
aaggcuccaggagc

SEQ ID NO: 2591603 - RNA, 17 nt, Human
guugcccaggcaggucu

SEQ ID NO: 2591604 - RNA, 19 nt, Human
aaggcuaccuuuguauucu

SEQ ID NO: 2591605 - RNA, 17 nt, Human
aaggccagaguggccug

SEQ ID NO: 2591606 - RNA, 19 nt, Human
aaggccagaguggccuggc

SEQ ID NO: 2591607 - RNA, 20 nt, Human
aaggccagaguggccuggcc

SEQ ID NO: 2591608 - RNA, 21 nt, Human
aaggccagaguggccuggcca

SEQ ID NO: 2591609 - RNA, 23 nt, Human
aaggcuauggggauagaugugug

SEQ ID NO: 2591610 - RNA, 22 nt, Human
aaggccagaguggccuggccag

SEQ ID NO: 2591611 - RNA, 23 nt, Human
aaggccagaguggccuggccagg

SEQ ID NO: 2591612 - RNA, 15 nt, Human
aaggcuauacuuguc

SEQ ID NO: 2591613 - RNA, 16 nt, Human
aaggcucagucucagg

SEQ ID NO: 2591614 - RNA, 17 nt, Human
aaggcucagucucagga

SEQ ID NO: 2591615 - RNA, 16 nt, Human
aaggaugucacagggc

SEQ ID NO: 2591616 - RNA, 15 nt, Human
aaggaugucacaggg

SEQ ID NO: 2591617 - RNA, 15 nt, Human
aaggaugugauugug

SEQ ID NO: 2591618 - RNA, 17 nt, Human
aaggaugugauugugga

SEQ ID NO: 2591619 - RNA, 22 nt, Human
aaggaugugauuguggaaugga

SEQ ID NO: 2591620 - RNA, 18 nt, Human
aaggccaaaggaagcaca

SEQ ID NO: 2591621 - RNA, 21 nt, Human
aaggccaauaaagaguuagaa

SEQ ID NO: 2591622 - RNA, 17 nt, Human
aaggaugucacagggcc

SEQ ID NO: 2591623 - RNA, 21 nt, Human
aaggccaauuccuauacgcag

SEQ ID NO: 2591624 - RNA, 19 nt, Human
aaggccaagaggcuguucc

SEQ ID NO: 2591625 - RNA, 23 nt, Human
guuuaaggaauaugggagaaaua

SEQ ID NO: 2591626 - RNA, 20 nt, Human
guuuaagacauuuuuggaag

SEQ ID NO: 2591627 - RNA, 22 nt, Human
guuuaacuuaaucaauuaauuu

SEQ ID NO: 2591628 - RNA, 23 nt, Human
guuuaacucagaucacuacugca

SEQ ID NO: 2591629 - RNA, 20 nt, Human
guuuaagacuguaaugaauc

SEQ ID NO: 2591630 - RNA, 22 nt, Human
guuuaacucagaucacuacugc

SEQ ID NO: 2591631 - RNA, 19 nt, Human
guuuaacucagaucacuac

SEQ ID NO: 2591632 - RNA, 17 nt, Human
guuuaacucagaucacu

SEQ ID NO: 2591633 - RNA, 16 nt, Human
guuuaacucagaucac

SEQ ID NO: 2591634 - RNA, 23 nt, Human
guuuaagaaaaaauaacacacau

SEQ ID NO: 2591635 - RNA, 22 nt, Human
guuuaaccaaaaagaccagacu

SEQ ID NO: 2591636 - RNA, 15 nt, Human
guuuaacucagauca

SEQ ID NO: 2591637 - RNA, 14 nt, Human
guuuaacucagauc

SEQ ID NO: 2591638 - RNA, 23 nt, Human
guuuaaccaaaaagaccagacua

SEQ ID NO: 2591639 - RNA, 12 nt, Human
guuuaacucaga

SEQ ID NO: 2591640 - RNA, 10 nt, Human
guuuaaaauc

SEQ ID NO: 2591641 - RNA, 16 nt, Human
guuuaaaaucauuucu

SEQ ID NO: 2591642 - RNA, 23 nt, Human
guuguauuuuaacucauaccuuu

SEQ ID NO: 2591643 - RNA, 23 nt, Human
guuuaaacuucucugaagggagg

SEQ ID NO: 2591644 - RNA, 18 nt, Human
guuuaaacuucucugaag

SEQ ID NO: 2591645 - RNA, 12 nt, Human
guuuaaacugau

SEQ ID NO: 2591646 - RNA, 16 nt, Human
guuuaaacugauucau

SEQ ID NO: 2591647 - RNA, 17 nt, Human
guuuaaacuucucugaa

SEQ ID NO: 2591648 - RNA, 21 nt, Human
guuuaaacugauucauaauaa

SEQ ID NO: 2591649 - RNA, 13 nt, Human
guuuaugugugug

SEQ ID NO: 2591650 - RNA, 16 nt, Human
guuuaugugugugugu

SEQ ID NO: 2591651 - RNA, 15 nt, Human
guuuaugucuaaaga

SEQ ID NO: 2591652 - RNA, 13 nt, Human
guuuaugucuaaa

SEQ ID NO: 2591653 - RNA, 13 nt, Human
guuuauuaacaaa

SEQ ID NO: 2591654 - RNA, 18 nt, Human
guuuauuaacaaauuaug

SEQ ID NO: 2591655 - RNA, 23 nt, Human
guuuauuaacaaauuauguuaca

SEQ ID NO: 2591656 - RNA, 14 nt, Human
guuuauuuuucaua

SEQ ID NO: 2591657 - RNA, 20 nt, Human
guuuacaaauggacauagga

SEQ ID NO: 2591658 - RNA, 19 nt, Human
guuuacaagcccccccuuc

SEQ ID NO: 2591659 - RNA, 18 nt, Human
guuuacaagcccccccuu

SEQ ID NO: 2591660 - RNA, 23 nt, Human
guuuacaauuuacaaagugugua

SEQ ID NO: 2591661 - RNA, 19 nt, Human
guuuacaauuuacaaagug

SEQ ID NO: 2591662 - RNA, 18 nt, Human
guuuacaauuuacaaagu

SEQ ID NO: 2591663 - RNA, 16 nt, Human
guuuacaauuuacaaa

SEQ ID NO: 2591664 - RNA, 19 nt, Human
guuuaugucccuucacaua

SEQ ID NO: 2591665 - RNA, 21 nt, Human
guuuacacacgugcaauuugu

SEQ ID NO: 2591666 - RNA, 15 nt, Human
guuuacaauuuacaa

SEQ ID NO: 2591667 - RNA, 23 nt, Human
guuuacaaguguauaucagaaaa

SEQ ID NO: 2591668 - RNA, 19 nt, Human
guuuacaaguguauaucag

SEQ ID NO: 2591669 - RNA, 18 nt, Human
guuuacaaguguauauca

SEQ ID NO: 2591670 - RNA, 16 nt, Human
guuuacaaguguauau

SEQ ID NO: 2591671 - RNA, 22 nt, Human
guuuacaagcccccccuuccac

SEQ ID NO: 2591672 - RNA, 13 nt, Human
guuggguggaugc

SEQ ID NO: 2591673 - RNA, 14 nt, Human
guugcuuacaauuu

SEQ ID NO: 2591674 - RNA, 21 nt, Human
guugcuguuuuccucccuucu

SEQ ID NO: 2591675 - RNA, 23 nt, Human
guugcuguuuuccucccuucugc

SEQ ID NO: 2591676 - RNA, 15 nt, Human
guuggguucaucuga

SEQ ID NO: 2591677 - RNA, 13 nt, Human
guugguaguuucu

SEQ ID NO: 2591678 - RNA, 18 nt, Human
guuggucccccuuccaug

SEQ ID NO: 2591679 - RNA, 16 nt, Human
guuggucgguggguug

SEQ ID NO: 2591680 - RNA, 22 nt, Human
guugcugggagcugaaaaauca

SEQ ID NO: 2591681 - RNA, 16 nt, Human
guugcugggagcugaa

SEQ ID NO: 2591682 - RNA, 12 nt, Human
guugcugccuca

SEQ ID NO: 2591683 - RNA, 16 nt, Human
guugcugguugcugug

SEQ ID NO: 2591684 - RNA, 15 nt, Human
guugcugguugcugu

SEQ ID NO: 2591685 - RNA, 18 nt, Human
guugcugguugcugugug

SEQ ID NO: 2591686 - RNA, 17 nt, Human
guugcugguugcugugu

SEQ ID NO: 2591687 - RNA, 19 nt, Human
guugcugguugcugugugg

SEQ ID NO: 2591688 - RNA, 22 nt, Human
guugcugugggaacgagagggg

SEQ ID NO: 2591689 - RNA, 17 nt, Human
guugcuguuuuccuccc

SEQ ID NO: 2591690 - RNA, 18 nt, Human
guugcuguuuuccucccu

SEQ ID NO: 2591691 - RNA, 19 nt, Human
guugcuguuuuccucccuu

SEQ ID NO: 2591692 - RNA, 16 nt, Human
guugcugugugguuug

SEQ ID NO: 2591693 - RNA, 14 nt, Human
guugcugugggaac

SEQ ID NO: 2591694 - RNA, 19 nt, Human
guugcugucauaagaauga

SEQ ID NO: 2591695 - RNA, 18 nt, Human
guuguaccgcaaugugac

SEQ ID NO: 2591696 - RNA, 23 nt, Human
guuguacaaauaaagucccaggu

SEQ ID NO: 2591697 - RNA, 18 nt, Human
guugguguuccacguguu

SEQ ID NO: 2591698 - RNA, 15 nt, Human
guugguguugcagaa

SEQ ID NO: 2591699 - RNA, 23 nt, Human
guuguacauuuaugauuuaauaa

SEQ ID NO: 2591700 - RNA, 20 nt, Human
guuguacauuuaugauuuaa

SEQ ID NO: 2591701 - RNA, 18 nt, Human
guuguacauuuaugauuu

SEQ ID NO: 2591702 - RNA, 16 nt, Human
guuguacauuuaugau

SEQ ID NO: 2591703 - RNA, 14 nt, Human
guuguaguaaagaa

SEQ ID NO: 2591704 - RNA, 13 nt, Human
guuguagaaugua

SEQ ID NO: 2591705 - RNA, 20 nt, Human
guuguauucuuugauguuaa

SEQ ID NO: 2591706 - RNA, 14 nt, Human
guuguauucuuuga

SEQ ID NO: 2591707 - RNA, 13 nt, Human
guuguauucuuug

SEQ ID NO: 2591708 - RNA, 14 nt, Human
guuguaugccuuua

SEQ ID NO: 2591709 - RNA, 16 nt, Human
guugucaaagagaggg

SEQ ID NO: 2591710 - RNA, 22 nt, Human
guuguauucuuugauguuaaca

SEQ ID NO: 2591711 - RNA, 23 nt, Human
guuguaugccuuuaaaucuguga

SEQ ID NO: 2591712 - RNA, 14 nt, Human
guuguauuagaugu

SEQ ID NO: 2591713 - RNA, 15 nt, Human
guuguauuagauguu

SEQ ID NO: 2591714 - RNA, 16 nt, Human
guuguauaaauuuauu

SEQ ID NO: 2591715 - RNA, 17 nt, Human
guuguauaaauuuauuu

SEQ ID NO: 2591716 - RNA, 19 nt, Human
guuguauaaauuuauuuac

SEQ ID NO: 2591717 - RNA, 21 nt, Human
guuguauaaauuuauuuacug

SEQ ID NO: 2591718 - RNA, 18 nt, Human
guuguaucagcacgugug

SEQ ID NO: 2591719 - RNA, 20 nt, Human
guuguagaauguauuguacc

SEQ ID NO: 2591720 - RNA, 15 nt, Human
aaguaauaugcacac

SEQ ID NO: 2591721 - RNA, 16 nt, Human
aaguaauaugcacaca

SEQ ID NO: 2591722 - RNA, 19 nt, Human
guuucuaaaggcuaccuuu

SEQ ID NO: 2591723 - RNA, 12 nt, Human
aaguaauaugca

SEQ ID NO: 2591724 - RNA, 20 nt, Human
aaguaaaaacaaagaaauua

SEQ ID NO: 2591725 - RNA, 13 nt, Human
aaguaaaaacaaa

SEQ ID NO: 2591726 - RNA, 12 nt, Human
aagguaaaauug

SEQ ID NO: 2591727 - RNA, 19 nt, Human
aaggguuuuccacccugga

SEQ ID NO: 2591728 - RNA, 13 nt, Human
aaggguaaagaag

SEQ ID NO: 2591729 - RNA, 21 nt, Human
aaggguuuuccacccuggaau

SEQ ID NO: 2591730 - RNA, 20 nt, Human
aagggguugguugaggugga

SEQ ID NO: 2591731 - RNA, 16 nt, Human
aaggguaucaggugcu

SEQ ID NO: 2591732 - RNA, 15 nt, Human
aagguuuuauuuugu

SEQ ID NO: 2591733 - RNA, 13 nt, Human
aagguuuucucca

SEQ ID NO: 2591734 - RNA, 16 nt, Human
aagguuuuauuuugua

SEQ ID NO: 2591735 - RNA, 20 nt, Human
aagguuuuccucuucuauuu

SEQ ID NO: 2591736 - RNA, 14 nt, Human
aagguuuucuccac

SEQ ID NO: 2591737 - RNA, 13 nt, Human
aagguacuucaaa

SEQ ID NO: 2591738 - RNA, 17 nt, Human
aagguaauuucuugugc

SEQ ID NO: 2591739 - RNA, 16 nt, Human
aagguaaaauugaaag

SEQ ID NO: 2591740 - RNA, 17 nt, Human
guuucaaaaacuguauu

SEQ ID NO: 2591741 - RNA, 20 nt, Human
guuucaaaaacacaguguuu

SEQ ID NO: 2591742 - RNA, 19 nt, Human
guuucaaaaacacaguguu

SEQ ID NO: 2591743 - RNA, 17 nt, Human
guuuauuuuucauauug

SEQ ID NO: 2591744 - RNA, 18 nt, Human
guuuauuuuucauauugu

SEQ ID NO: 2591745 - RNA, 16 nt, Human
guuuauuuuucauauu

SEQ ID NO: 2591746 - RNA, 19 nt, Human
guuucaaaaacuguauuga

SEQ ID NO: 2591747 - RNA, 15 nt, Human
guuucaaaauaaaaa

SEQ ID NO: 2591748 - RNA, 16 nt, Human
guuucaaaauaaaaac

SEQ ID NO: 2591749 - RNA, 19 nt, Human
guuucaaaauaaaaaccaa

SEQ ID NO: 2591750 - RNA, 21 nt, Human
guuucaaacauauauaacaau

SEQ ID NO: 2591751 - RNA, 19 nt, Human
guuucaaacacaaaugcag

SEQ ID NO: 2591752 - RNA, 18 nt, Human
guuucaaacacaaaugca

SEQ ID NO: 2591753 - RNA, 23 nt, Human
guuucaaaauaaaaaccaagaag

SEQ ID NO: 2591754 - RNA, 17 nt, Human
aaggcuucucucucacc

SEQ ID NO: 2591755 - RNA, 18 nt, Human
aaggcuucucucuguggg

SEQ ID NO: 2591756 - RNA, 16 nt, Human
aaggcuucucucucac

SEQ ID NO: 2591757 - RNA, 15 nt, Human
aaggcuucucucuca

SEQ ID NO: 2591758 - RNA, 17 nt, Human
aaggcuucucucugugg

SEQ ID NO: 2591759 - RNA, 14 nt, Human
aaggcuucucucuc

SEQ ID NO: 2591760 - RNA, 12 nt, Human
aaggcuucucuc

SEQ ID NO: 2591761 - RNA, 13 nt, Human
aagggccuggccu

SEQ ID NO: 2591762 - RNA, 17 nt, Human
aagggccuggccugagc

SEQ ID NO: 2591763 - RNA, 14 nt, Human
aagggccuggccug

SEQ ID NO: 2591764 - RNA, 19 nt, Human
aagggccuggccugagcug

SEQ ID NO: 2591765 - RNA, 18 nt, Human
aagggcuuuguuuugcac

SEQ ID NO: 2591766 - RNA, 23 nt, Human
aagggcuucugcacccuccaccc

SEQ ID NO: 2591767 - RNA, 22 nt, Human
aagggcuucugcacccuccacc

SEQ ID NO: 2591768 - RNA, 19 nt, Human
aagggcuucugcacccucc

SEQ ID NO: 2591769 - RNA, 17 nt, Human
aagggcuagaaccugga

SEQ ID NO: 2591770 - RNA, 21 nt, Human
aagggguaggauuacuaggug

SEQ ID NO: 2591771 - RNA, 17 nt, Human
aaggggugcuuuuauag

SEQ ID NO: 2591772 - RNA, 14 nt, Human
aaggggugcuuuua

SEQ ID NO: 2591773 - RNA, 23 nt, Human
aaggggaauguuugccucugccu

SEQ ID NO: 2591774 - RNA, 22 nt, Human
aaggggaauguuugccucugcc

SEQ ID NO: 2591775 - RNA, 16 nt, Human
guuuucugggugucca

SEQ ID NO: 2591776 - RNA, 18 nt, Human
guuuucuggcuggagccu

SEQ ID NO: 2591777 - RNA, 17 nt, Human
guuuucuggcuggagcc

SEQ ID NO: 2591778 - RNA, 19 nt, Human
guuuucugagcccgggcug

SEQ ID NO: 2591779 - RNA, 12 nt, Human
guuuucuguucu

SEQ ID NO: 2591780 - RNA, 20 nt, Human
guuuucuuaaccagaucauu

SEQ ID NO: 2591781 - RNA, 19 nt, Human
guuuucuguucuuucuggc

SEQ ID NO: 2591782 - RNA, 17 nt, Human
guuuucuggguguccaa

SEQ ID NO: 2591783 - RNA, 16 nt, Human
guuuucuuaaccaucu

SEQ ID NO: 2591784 - RNA, 16 nt, Human
guuuucuuaacuuaaa

SEQ ID NO: 2591785 - RNA, 17 nt, Human
guuuucuuaaccaucuu

SEQ ID NO: 2591786 - RNA, 12 nt, Human
guuuucuuccca

SEQ ID NO: 2591787 - RNA, 15 nt, Human
guuuucuucccauca

SEQ ID NO: 2591788 - RNA, 20 nt, Human
guuuucuucccaucacugga

SEQ ID NO: 2591789 - RNA, 11 nt, Human
guuuucuguuc

SEQ ID NO: 2591790 - RNA, 17 nt, Human
guuuucugagcccgggc

SEQ ID NO: 2591791 - RNA, 15 nt, Human
guuuucugagcccgg

SEQ ID NO: 2591792 - RNA, 14 nt, Human
guuuucugagcccg

SEQ ID NO: 2591793 - RNA, 13 nt, Human
guuuucugagccc

SEQ ID NO: 2591794 - RNA, 14 nt, Human
guuuuaguugcaga

SEQ ID NO: 2591795 - RNA, 23 nt, Human
guuuucugagaaagacuauucaa

SEQ ID NO: 2591796 - RNA, 15 nt, Human
guuuuaguuaaauuu

SEQ ID NO: 2591797 - RNA, 21 nt, Human
guuuuaguugcagaaacauuu

SEQ ID NO: 2591798 - RNA, 12 nt, Human
guuuuacauugu

SEQ ID NO: 2591799 - RNA, 21 nt, Human
guuuuacauuguugagcuauu

SEQ ID NO: 2591800 - RNA, 13 nt, Human
guuuuagaaaaca

SEQ ID NO: 2591801 - RNA, 14 nt, Human
guuuuacuaaagaa

SEQ ID NO: 2591802 - RNA, 23 nt, Human
guuuuagacaaauacucaugugu

SEQ ID NO: 2591803 - RNA, 22 nt, Human
guuuuagacaaauacucaugug

SEQ ID NO: 2591804 - RNA, 19 nt, Human
guuuuagaguuaacaauga

SEQ ID NO: 2591805 - RNA, 18 nt, Human
guuuuagacaaauacuca

SEQ ID NO: 2591806 - RNA, 16 nt, Human
guuuuagaagguucuc

SEQ ID NO: 2591807 - RNA, 17 nt, Human
guuuuagacaaauacuc

SEQ ID NO: 2591808 - RNA, 21 nt, Human
guuuuagcuccuugacuccuu

SEQ ID NO: 2591809 - RNA, 20 nt, Human
guuuuagcuccuugacuccu

SEQ ID NO: 2591810 - RNA, 20 nt, Human
guuuuagccauuguuggcuu

SEQ ID NO: 2591811 - RNA, 21 nt, Human
guuuuaggacaaacagcucag

SEQ ID NO: 2591812 - RNA, 20 nt, Human
guuugggccccagaggcugg

SEQ ID NO: 2591813 - RNA, 16 nt, Human
guuugggccccucucc

SEQ ID NO: 2591814 - RNA, 22 nt, Human
guuuggggaaugcggccgcauu

SEQ ID NO: 2591815 - RNA, 15 nt, Human
guuuggggagcagag

SEQ ID NO: 2591816 - RNA, 18 nt, Human
guuuggggaugagaaagg

SEQ ID NO: 2591817 - RNA, 23 nt, Human
guuuuacaauaaaaucuugaaaa

SEQ ID NO: 2591818 - RNA, 20 nt, Human
guuuggggagcagagacacu

SEQ ID NO: 2591819 - RNA, 22 nt, Human
guuuggcugugucuaaacugca

SEQ ID NO: 2591820 - RNA, 22 nt, Human
guuucuaaaggcuaccuuugua

SEQ ID NO: 2591821 - RNA, 23 nt, Human
guuucuaaaggcuaccuuuguau

SEQ ID NO: 2591822 - RNA, 21 nt, Human
guuucugucaggagagcagcg

SEQ ID NO: 2591823 - RNA, 17 nt, Human
guuucugucaggagagc

SEQ ID NO: 2591824 - RNA, 17 nt, Human
guuucuguccugcuggu

SEQ ID NO: 2591825 - RNA, 22 nt, Human
guuugauucagacagcugccug

SEQ ID NO: 2591826 - RNA, 22 nt, Human
guuucuguucuguggaaagugu

SEQ ID NO: 2591827 - RNA, 18 nt, Human
guuucuguucuguggaaa

SEQ ID NO: 2591828 - RNA, 17 nt, Human
guuucuguucuguggaa

SEQ ID NO: 2591829 - RNA, 15 nt, Human
guuugauuucauuaa

SEQ ID NO: 2591830 - RNA, 20 nt, Human
guuucuguucuguggaaagu

SEQ ID NO: 2591831 - RNA, 15 nt, Human
guuucuguucugugg

SEQ ID NO: 2591832 - RNA, 14 nt, Human
guuucuguucugug

SEQ ID NO: 2591833 - RNA, 14 nt, Human
guuucuguuauuaa

SEQ ID NO: 2591834 - RNA, 16 nt, Human
guuucuguccugcugg

SEQ ID NO: 2591835 - RNA, 17 nt, Human
guuucugugcauggugg

SEQ ID NO: 2591836 - RNA, 13 nt, Human
guuucugugcaug

SEQ ID NO: 2591837 - RNA, 15 nt, Human
guuugcaaggaagcc

SEQ ID NO: 2591838 - RNA, 14 nt, Human
guuugcaaggaagc

SEQ ID NO: 2591839 - RNA, 13 nt, Human
guuugcaaggaag

SEQ ID NO: 2591840 - RNA, 22 nt, Human
guuugcacguuaugguguuucu

SEQ ID NO: 2591841 - RNA, 19 nt, Human
guuugcaucugaaaauuga

SEQ ID NO: 2591842 - RNA, 22 nt, Human
guuugcaaggaagccacagcug

SEQ ID NO: 2591843 - RNA, 17 nt, Human
guuugcaaggaagccac

SEQ ID NO: 2591844 - RNA, 20 nt, Human
guuugccacuuugcaaagga

SEQ ID NO: 2591845 - RNA, 15 nt, Human
guuugcacacuugug

SEQ ID NO: 2591846 - RNA, 12 nt, Human
guuugcauuccu

SEQ ID NO: 2591847 - RNA, 21 nt, Human
guuugauuuuagcugcagaac

SEQ ID NO: 2591848 - RNA, 15 nt, Human
guuugccauacuuug

SEQ ID NO: 2591849 - RNA, 14 nt, Human
guuugccauacuuu

SEQ ID NO: 2591850 - RNA, 22 nt, Human
guuugccauacuuugucugaaa

SEQ ID NO: 2591851 - RNA, 16 nt, Human
guuugccucugccucu

SEQ ID NO: 2591852 - RNA, 13 nt, Human
guuugccucugcc

SEQ ID NO: 2591853 - RNA, 16 nt, Human
guuugggaccccuggu

SEQ ID NO: 2591854 - RNA, 23 nt, Human
guuuggcugugucuaaacugcau

SEQ ID NO: 2591855 - RNA, 22 nt, Human
guuugggaccccuggugguuca

SEQ ID NO: 2591856 - RNA, 21 nt, Human
guuugggcagaagggagaagg

SEQ ID NO: 2591857 - RNA, 18 nt, Human
guguguaugcgugugugu

SEQ ID NO: 2591858 - RNA, 20 nt, Human
guguguagaguuaagaagcu

SEQ ID NO: 2591859 - RNA, 21 nt, Human
guguguaugacuaaagagaga

SEQ ID NO: 2591860 - RNA, 12 nt, Human
guguguaugugg

SEQ ID NO: 2591861 - RNA, 19 nt, Human
guguguccaaaacugccuc

SEQ ID NO: 2591862 - RNA, 18 nt, Human
guguguaugggugugugu

SEQ ID NO: 2591863 - RNA, 20 nt, Human
guguguaugugcgugugugc

SEQ ID NO: 2591864 - RNA, 19 nt, Human
guguguccacgacugucuc

SEQ ID NO: 2591865 - RNA, 20 nt, Human
guguguccacgacugucucc

SEQ ID NO: 2591866 - RNA, 16 nt, Human
gugugucccccucugu

SEQ ID NO: 2591867 - RNA, 17 nt, Human
gugugucccccucuguc

SEQ ID NO: 2591868 - RNA, 11 nt, Human
guguguccuug

SEQ ID NO: 2591869 - RNA, 10 nt, Human
guguguccuu

SEQ ID NO: 2591870 - RNA, 18 nt, Human
gugugucccccucugucc

SEQ ID NO: 2591871 - RNA, 18 nt, Human
guguguccuugugcauga

SEQ ID NO: 2591872 - RNA, 12 nt, Human
guguguccuugu

SEQ ID NO: 2591873 - RNA, 20 nt, Human
guguguccuugugcaugagc

SEQ ID NO: 2591874 - RNA, 21 nt, Human
gugugucuuaauuauuauuug

SEQ ID NO: 2591875 - RNA, 14 nt, Human
gugugucuuaauua

SEQ ID NO: 2591876 - RNA, 15 nt, Human
gugugucugcucagu

SEQ ID NO: 2591877 - RNA, 16 nt, Human
gugugucugcucagua

SEQ ID NO: 2591878 - RNA, 15 nt, Human
gugugucuguucacu

SEQ ID NO: 2591879 - RNA, 22 nt, Human
gugugucuguucacuuuuccuc

SEQ ID NO: 2591880 - RNA, 18 nt, Human
guguugccaagcuccaag

SEQ ID NO: 2591881 - RNA, 14 nt, Human
guguugccaagcuc

SEQ ID NO: 2591882 - RNA, 20 nt, Human
guguugccaaauauguccug

SEQ ID NO: 2591883 - RNA, 19 nt, Human
guguugccaaauauguccu

SEQ ID NO: 2591884 - RNA, 15 nt, Human
guguugaucccaaga

SEQ ID NO: 2591885 - RNA, 17 nt, Human
guguugccaaauauguc

SEQ ID NO: 2591886 - RNA, 19 nt, Human
guguugauuuucuguugua

SEQ ID NO: 2591887 - RNA, 13 nt, Human
guguugcagaagg

SEQ ID NO: 2591888 - RNA, 16 nt, Human
guguugucuugaaaga

SEQ ID NO: 2591889 - RNA, 14 nt, Human
guguugggauacug

SEQ ID NO: 2591890 - RNA, 15 nt, Human
guguugucucuugag

SEQ ID NO: 2591891 - RNA, 12 nt, Human
guguugucucua

SEQ ID NO: 2591892 - RNA, 14 nt, Human
guguugucccuucu

SEQ ID NO: 2591893 - RNA, 16 nt, Human
guguuuauuuuucaua

SEQ ID NO: 2591894 - RNA, 18 nt, Human
guguugucuugaaagauu

SEQ ID NO: 2591895 - RNA, 20 nt, Human
guguugugauagcuaacauu

SEQ ID NO: 2591896 - RNA, 15 nt, Human
guguuguguguggga

SEQ ID NO: 2591897 - RNA, 18 nt, Human
guguuucacuuuuaggga

SEQ ID NO: 2591898 - RNA, 20 nt, Human
guguuuauuuuucauauugu

SEQ ID NO: 2591899 - RNA, 18 nt, Human
guguuuccauauuuuaua

SEQ ID NO: 2591900 - RNA, 23 nt, Human
guguuuccuggcacugcuuccag

SEQ ID NO: 2591901 - RNA, 18 nt, Human
guguuggcccaagcucuu

SEQ ID NO: 2591902 - RNA, 17 nt, Human
guguuggcccaagcucu

SEQ ID NO: 2591903 - RNA, 16 nt, Human
guguuggcccaagcuc

SEQ ID NO: 2591904 - RNA, 18 nt, Human
guguugcgugucgugggu

SEQ ID NO: 2591905 - RNA, 15 nt, Human
guguugccacaggac

SEQ ID NO: 2591906 - RNA, 17 nt, Human
guguugccacaggacac

SEQ ID NO: 2591907 - RNA, 18 nt, Human
guguugccacaggacaca

SEQ ID NO: 2591908 - RNA, 21 nt, Human
guguugccuugaaccacuucc

SEQ ID NO: 2591909 - RNA, 20 nt, Human
guguugcccaggcuggucuc

SEQ ID NO: 2591910 - RNA, 22 nt, Human
guguugguuuugacuggauauu

SEQ ID NO: 2591911 - RNA, 21 nt, Human
guguugggauacugcagggcc

SEQ ID NO: 2591912 - RNA, 21 nt, Human
guguuggcuaaugaagggaaa

SEQ ID NO: 2591913 - RNA, 14 nt, Human
guguuguaugccuu

SEQ ID NO: 2591914 - RNA, 16 nt, Human
gugucuuuugcaugau

SEQ ID NO: 2591915 - RNA, 15 nt, Human
gugucuuuugcauga

SEQ ID NO: 2591916 - RNA, 13 nt, Human
gugugaaaauggg

SEQ ID NO: 2591917 - RNA, 17 nt, Human
gugugaaaaugugugug

SEQ ID NO: 2591918 - RNA, 18 nt, Human
gugucuuuuuucacuaca

SEQ ID NO: 2591919 - RNA, 17 nt, Human
gugugacuacuccccca

SEQ ID NO: 2591920 - RNA, 14 nt, Human
guguguaauuuaaa

SEQ ID NO: 2591921 - RNA, 17 nt, Human
guguguagacaaauauu

SEQ ID NO: 2591922 - RNA, 15 nt, Human
gugugaccugagggc

SEQ ID NO: 2591923 - RNA, 17 nt, Human
guguguagaguuaagaa

SEQ ID NO: 2591924 - RNA, 16 nt, Human
guguguagaguuaaga

SEQ ID NO: 2591925 - RNA, 13 nt, Human
guguguagaguua

SEQ ID NO: 2591926 - RNA, 19 nt, Human
guguguagacaaauauuug

SEQ ID NO: 2591927 - RNA, 21 nt, Human
guguguagaguuaagaagcug

SEQ ID NO: 2591928 - RNA, 14 nt, Human
guguguagccaagg

SEQ ID NO: 2591929 - RNA, 13 nt, Human
gugugaccugagg

SEQ ID NO: 2591930 - RNA, 22 nt, Human
gugugagaagugaaugcuggga

SEQ ID NO: 2591931 - RNA, 21 nt, Human
gugugagaagugaaugcuggg

SEQ ID NO: 2591932 - RNA, 13 nt, Human
gugugagcaguga

SEQ ID NO: 2591933 - RNA, 16 nt, Human
gugugaggagcugcug

SEQ ID NO: 2591934 - RNA, 18 nt, Human
gugugaggagcugcuggc

SEQ ID NO: 2591935 - RNA, 19 nt, Human
gugugaggagcugcuggcu

SEQ ID NO: 2591936 - RNA, 13 nt, Human
aagcaauaugcau

SEQ ID NO: 2591937 - RNA, 19 nt, Human
aagcaauaugcauuuaaau

SEQ ID NO: 2591938 - RNA, 15 nt, Human
aagcaauccuaggua

SEQ ID NO: 2591939 - RNA, 15 nt, Human
aagcaauuccaaccu

SEQ ID NO: 2591940 - RNA, 15 nt, Human
aagcaauuagacaag

SEQ ID NO: 2591941 - RNA, 16 nt, Human
aagcaaugcauuuugg

SEQ ID NO: 2591942 - RNA, 13 nt, Human
aagcaaugcauuu

SEQ ID NO: 2591943 - RNA, 11 nt, Human
aagcaaugcau

SEQ ID NO: 2591944 - RNA, 14 nt, Human
aagcaauuuuccuu

SEQ ID NO: 2591945 - RNA, 13 nt, Human
aagcaauuuuccu

SEQ ID NO: 2591946 - RNA, 16 nt, Human
aagcaauuccaaccuu

SEQ ID NO: 2591947 - RNA, 17 nt, Human
aagcaauuuuccuugaa

SEQ ID NO: 2591948 - RNA, 16 nt, Human
aagcaauuuuccuuga

SEQ ID NO: 2591949 - RNA, 12 nt, Human
gugucuuccaua

SEQ ID NO: 2591950 - RNA, 14 nt, Human
gugucuuccugugg

SEQ ID NO: 2591951 - RNA, 13 nt, Human
gugucuuccugug

SEQ ID NO: 2591952 - RNA, 12 nt, Human
gugucuuccugu

SEQ ID NO: 2591953 - RNA, 19 nt, Human
gugucuuccucccaagugg

SEQ ID NO: 2591954 - RNA, 15 nt, Human
gugucuuccucccaa

SEQ ID NO: 2591955 - RNA, 14 nt, Human
gugucuuccuccca

SEQ ID NO: 2591956 - RNA, 13 nt, Human
gugucuuccauaa

SEQ ID NO: 2591957 - RNA, 15 nt, Human
gugucuuccauaaug

SEQ ID NO: 2591958 - RNA, 18 nt, Human
gugucuugcaauggcagc

SEQ ID NO: 2591959 - RNA, 17 nt, Human
gugucuugcaauggcag

SEQ ID NO: 2591960 - RNA, 20 nt, Human
gugucuucuccaccacgcug

SEQ ID NO: 2591961 - RNA, 17 nt, Human
gugucuuuccacuccuc

SEQ ID NO: 2591962 - RNA, 18 nt, Human
gugucuuucacagcuccu

SEQ ID NO: 2591963 - RNA, 21 nt, Human
gugucuuuucuguagagcaua

SEQ ID NO: 2591964 - RNA, 18 nt, Human
aagaguaaaggaaaugau

SEQ ID NO: 2591965 - RNA, 17 nt, Human
aagaguaaaggaaauga

SEQ ID NO: 2591966 - RNA, 16 nt, Human
aagagguuuuucuuaa

SEQ ID NO: 2591967 - RNA, 13 nt, Human
aagaguagaaacu

SEQ ID NO: 2591968 - RNA, 19 nt, Human
aagauauaagugcuguaua

SEQ ID NO: 2591969 - RNA, 21 nt, Human
aagauauaagugcuguauaaa

SEQ ID NO: 2591970 - RNA, 20 nt, Human
aagauauaagugcuguauaa

SEQ ID NO: 2591971 - RNA, 18 nt, Human
aagagguuuuaaaaaaau

SEQ ID NO: 2591972 - RNA, 17 nt, Human
gugguuuucuguucuuu

SEQ ID NO: 2591973 - RNA, 24 nt, Human
gugguuuuccccucccuggguuca

SEQ ID NO: 2591974 - RNA, 21 nt, Human
gugguuuuccccucccugggu

SEQ ID NO: 2591975 - RNA, 20 nt, Human
gugguuuuccccucccuggg

SEQ ID NO: 2591976 - RNA, 17 nt, Human
aagagguguuuuuucua

SEQ ID NO: 2591977 - RNA, 19 nt, Human
gugguuuuccccucccugg

SEQ ID NO: 2591978 - RNA, 18 nt, Human
gugguuuuccccucccug

SEQ ID NO: 2591979 - RNA, 16 nt, Human
gugguuuuccccuccc

SEQ ID NO: 2591980 - RNA, 20 nt, Human
gugguuuuauacugaaggaa

SEQ ID NO: 2591981 - RNA, 16 nt, Human
gugguuugguguguuc

SEQ ID NO: 2591982 - RNA, 20 nt, Human
guggugguuuucuguucuuu

SEQ ID NO: 2591983 - RNA, 16 nt, Human
gugguuugagacacug

SEQ ID NO: 2591984 - RNA, 15 nt, Human
aagaucuuaaauuuu

SEQ ID NO: 2591985 - RNA, 14 nt, Human
aagaucuuaaauuu

SEQ ID NO: 2591986 - RNA, 17 nt, Human
aagaucuuaaauuuugu

SEQ ID NO: 2591987 - RNA, 19 nt, Human
aagaucugugcagccccgc

SEQ ID NO: 2591988 - RNA, 17 nt, Human
aagaucugugcagcccc

SEQ ID NO: 2591989 - RNA, 20 nt, Human
aagaucuguuuugaaggcaa

SEQ ID NO: 2591990 - RNA, 21 nt, Human
aagaucuguuuugaaggcaaa

SEQ ID NO: 2591991 - RNA, 22 nt, Human
aagaucuguuuugaaggcaaaa

SEQ ID NO: 2591992 - RNA, 12 nt, Human
aagaugcagccg

SEQ ID NO: 2591993 - RNA, 13 nt, Human
aagaucuuucagg

SEQ ID NO: 2591994 - RNA, 19 nt, Human
aagaucuguccucagccuu

SEQ ID NO: 2591995 - RNA, 20 nt, Human
aagaucuguccucagccuug

SEQ ID NO: 2591996 - RNA, 18 nt, Human
aagaucuguccucagccu

SEQ ID NO: 2591997 - RNA, 15 nt, Human
aagauauuuauauau

SEQ ID NO: 2591998 - RNA, 18 nt, Human
aagauauuuauauauauu

SEQ ID NO: 2591999 - RNA, 19 nt, Human
aagauauuuuaaaaucugu

SEQ ID NO: 2592000 - RNA, 13 nt, Human
aagauauuuauau

SEQ ID NO: 2592001 - RNA, 21 nt, Human
aagauauauuaaaaauauaaa

SEQ ID NO: 2592002 - RNA, 19 nt, Human
aagauauauuaaaaauaua

SEQ ID NO: 2592003 - RNA, 15 nt, Human
aagauauauuaaaaa

SEQ ID NO: 2592004 - RNA, 14 nt, Human
aagauauauuaaaa

SEQ ID NO: 2592005 - RNA, 11 nt, Human
aagauauauua

SEQ ID NO: 2592006 - RNA, 21 nt, Human
aagauauauacacaggauccu

SEQ ID NO: 2592007 - RNA, 12 nt, Human
aagauauggaca

SEQ ID NO: 2592008 - RNA, 16 nt, Human
aagauaugggacauuu

SEQ ID NO: 2592009 - RNA, 19 nt, Human
aagauaugggacauuuuug

SEQ ID NO: 2592010 - RNA, 20 nt, Human
aagauauauuaaaaauauaa

SEQ ID NO: 2592011 - RNA, 18 nt, Human
aagaugugacauguuuua

SEQ ID NO: 2592012 - RNA, 14 nt, Human
aagaugugacaugu

SEQ ID NO: 2592013 - RNA, 17 nt, Human
aagcaaagcaccagcuu

SEQ ID NO: 2592014 - RNA, 22 nt, Human
aagcaaagacuuuccucuuagu

SEQ ID NO: 2592015 - RNA, 21 nt, Human
aagaugcucuaucuugcucug

SEQ ID NO: 2592016 - RNA, 15 nt, Human
aagaugcucuaucuu

SEQ ID NO: 2592017 - RNA, 24 nt, Human
aagaugcccacugaggaaugauga

SEQ ID NO: 2592018 - RNA, 15 nt, Human
aagaugcucuucugu

SEQ ID NO: 2592019 - RNA, 22 nt, Human
aagaugcucuaucuugcucugu

SEQ ID NO: 2592020 - RNA, 15 nt, Human
aagaugcucuuuuaa

SEQ ID NO: 2592021 - RNA, 20 nt, Human
aagauguccuccuuguucua

SEQ ID NO: 2592022 - RNA, 16 nt, Human
aagaugucagacuggc

SEQ ID NO: 2592023 - RNA, 20 nt, Human
aagaugcuggguuggugcac

SEQ ID NO: 2592024 - RNA, 16 nt, Human
aagaugcuggguuggu

SEQ ID NO: 2592025 - RNA, 14 nt, Human
aagaugcuggguug

SEQ ID NO: 2592026 - RNA, 11 nt, Human
aagaugcuggg

SEQ ID NO: 2592027 - RNA, 22 nt, Human
aagaugcuggaugucugccaau

SEQ ID NO: 2592028 - RNA, 10 nt, Human
aagaugcugg

SEQ ID NO: 2592029 - RNA, 17 nt, Human
aagaugcucuucugugg

SEQ ID NO: 2592030 - RNA, 21 nt, Human
aagaugcugaaacaggagaga

SEQ ID NO: 2592031 - RNA, 22 nt, Human
aagcaauaauggucccauccag

SEQ ID NO: 2592032 - RNA, 21 nt, Human
aagcaauaauggucccaucca

SEQ ID NO: 2592033 - RNA, 20 nt, Human
aagcaauaauggucccaucc

SEQ ID NO: 2592034 - RNA, 14 nt, Human
aagcaauaaaugaa

SEQ ID NO: 2592035 - RNA, 16 nt, Human
aagcaauaaaugaaug

SEQ ID NO: 2592036 - RNA, 17 nt, Human
aagcaauaaagaagagu

SEQ ID NO: 2592037 - RNA, 17 nt, Human
aagcaagagagauguuu

SEQ ID NO: 2592038 - RNA, 22 nt, Human
aagcaagugauugggacagagg

SEQ ID NO: 2592039 - RNA, 23 nt, Human
aagcaacugucuauuucugcuga

SEQ ID NO: 2592040 - RNA, 22 nt, Human
aagcaacugucuauuucugcug

SEQ ID NO: 2592041 - RNA, 21 nt, Human
aagcaacugucuauuucugcu

SEQ ID NO: 2592042 - RNA, 18 nt, Human
aagcaacugucuauuucu

SEQ ID NO: 2592043 - RNA, 17 nt, Human
aagcaacugucuauuuc

SEQ ID NO: 2592044 - RNA, 23 nt, Human
aagcaaccuggguccaaauaaaa

SEQ ID NO: 2592045 - RNA, 16 nt, Human
aagcaacugucuauuu

SEQ ID NO: 2592046 - RNA, 15 nt, Human
aagcaagagagaugu

SEQ ID NO: 2592047 - RNA, 18 nt, Human
aagcaagagagauguuuu

SEQ ID NO: 2592048 - RNA, 14 nt, Human
aagcaacuguuaug

SEQ ID NO: 2592049 - RNA, 15 nt, Human
aagcaagaaagaaac

SEQ ID NO: 2592050 - RNA, 13 nt, Human
aagcaaaggagau

SEQ ID NO: 2592051 - RNA, 12 nt, Human
aagcaaaggaga

SEQ ID NO: 2592052 - RNA, 22 nt, Human
aagcaaccuggguccaaauaaa

SEQ ID NO: 2592053 - RNA, 21 nt, Human
aagcaaccuggguccaaauaa

SEQ ID NO: 2592054 - RNA, 20 nt, Human
aagcaaccuggguccaaaua

SEQ ID NO: 2592055 - RNA, 18 nt, Human
aagcaaccuggguccaaa

SEQ ID NO: 2592056 - RNA, 17 nt, Human
aagcaaaggugaagaga

SEQ ID NO: 2592057 - RNA, 11 nt, Human
aagcaaaggug

SEQ ID NO: 2592058 - RNA, 19 nt, Human
guggggugugcugggagcu

SEQ ID NO: 2592059 - RNA, 16 nt, Human
guggggugugcuggga

SEQ ID NO: 2592060 - RNA, 13 nt, Human
guggggugugcug

SEQ ID NO: 2592061 - RNA, 12 nt, Human
gugggggcugca

SEQ ID NO: 2592062 - RNA, 17 nt, Human
guggggugaggaccacu

SEQ ID NO: 2592063 - RNA, 14 nt, Human
guggguacgggagg

SEQ ID NO: 2592064 - RNA, 22 nt, Human
gugggguguguuccaacugccc

SEQ ID NO: 2592065 - RNA, 15 nt, Human
guggguacagagagg

SEQ ID NO: 2592066 - RNA, 15 nt, Human
gugggagucaucuca

SEQ ID NO: 2592067 - RNA, 17 nt, Human
gugggauaucccuaugc

SEQ ID NO: 2592068 - RNA, 14 nt, Human
gugggggcagaggg

SEQ ID NO: 2592069 - RNA, 17 nt, Human
gugggggcagagggcag

SEQ ID NO: 2592070 - RNA, 18 nt, Human
gugggggcagagggcaga

SEQ ID NO: 2592071 - RNA, 20 nt, Human
gugggggaucacagccucug

SEQ ID NO: 2592072 - RNA, 16 nt, Human
guggggggcuucauac

SEQ ID NO: 2592073 - RNA, 15 nt, Human
guggggggcuucaua

SEQ ID NO: 2592074 - RNA, 22 nt, Human
gugggggcagagggcagaggcu

SEQ ID NO: 2592075 - RNA, 16 nt, Human
gugguuucagaaaugu

SEQ ID NO: 2592076 - RNA, 14 nt, Human
guggugguuuucug

SEQ ID NO: 2592077 - RNA, 19 nt, Human
guggugguaacccuggugg

SEQ ID NO: 2592078 - RNA, 20 nt, Human
guggugguaacccugguggu

SEQ ID NO: 2592079 - RNA, 22 nt, Human
gugguggggaggggcgcuggcc

SEQ ID NO: 2592080 - RNA, 20 nt, Human
gugguggggaggggcgcugg

SEQ ID NO: 2592081 - RNA, 22 nt, Human
gugguggguucuuuggaaggag

SEQ ID NO: 2592082 - RNA, 16 nt, Human
guggugguaacccugg

SEQ ID NO: 2592083 - RNA, 12 nt, Human
gugguggggagg

SEQ ID NO: 2592084 - RNA, 18 nt, Human
guggugggacagggaccc

SEQ ID NO: 2592085 - RNA, 21 nt, Human
guggguggauauaaauauaua

SEQ ID NO: 2592086 - RNA, 20 nt, Human
guggguggauauaaauauau

SEQ ID NO: 2592087 - RNA, 18 nt, Human
guggguggauauaaauau

SEQ ID NO: 2592088 - RNA, 23 nt, Human
gugggugagaugcuggagaagag

SEQ ID NO: 2592089 - RNA, 19 nt, Human
guggguggaaccaggaacc

SEQ ID NO: 2592090 - RNA, 20 nt, Human
gugggugagaugcuggagaa

SEQ ID NO: 2592091 - RNA, 15 nt, Human
gugggugagaugcug

SEQ ID NO: 2592092 - RNA, 21 nt, Human
gugggucuucagggggccagg

SEQ ID NO: 2592093 - RNA, 17 nt, Human
gugggucuucagggggc

SEQ ID NO: 2592094 - RNA, 13 nt, Human
gugggucugugug

SEQ ID NO: 2592095 - RNA, 16 nt, Human
gugggucugugugugu

SEQ ID NO: 2592096 - RNA, 17 nt, Human
guggguacuauucugau

SEQ ID NO: 2592097 - RNA, 13 nt, Human
gugggucuucagg

SEQ ID NO: 2592098 - RNA, 21 nt, Human
guggcgccgucuccaggggcu

SEQ ID NO: 2592099 - RNA, 17 nt, Human
guggcgccgucuccagg

SEQ ID NO: 2592100 - RNA, 22 nt, Human
guggcgccgucuccaggggcug

SEQ ID NO: 2592101 - RNA, 23 nt, Human
guggcgcagcauauucaggaagc

SEQ ID NO: 2592102 - RNA, 22 nt, Human
guggcccugccaucuucccagc

SEQ ID NO: 2592103 - RNA, 17 nt, Human
guggcccugccaucuuc

SEQ ID NO: 2592104 - RNA, 13 nt, Human
guggcccugccau

SEQ ID NO: 2592105 - RNA, 21 nt, Human
guggcccugccaucuucccag

SEQ ID NO: 2592106 - RNA, 13 nt, Human
guggcccuggccu

SEQ ID NO: 2592107 - RNA, 16 nt, Human
guggcccuggccugcu

SEQ ID NO: 2592108 - RNA, 17 nt, Human
guggcccuggccugcug

SEQ ID NO: 2592109 - RNA, 21 nt, Human
guggcccugucccucccaccu

SEQ ID NO: 2592110 - RNA, 17 nt, Human
guggcccugucccuccc

SEQ ID NO: 2592111 - RNA, 16 nt, Human
guggcccugucccucc

SEQ ID NO: 2592112 - RNA, 18 nt, Human
guggcccuggccugcugg

SEQ ID NO: 2592113 - RNA, 19 nt, Human
guggcccuggccugcuggg

SEQ ID NO: 2592114 - RNA, 22 nt, Human
gugggacacccugugauggggc

SEQ ID NO: 2592115 - RNA, 15 nt, Human
guggcgggcgccugu

SEQ ID NO: 2592116 - RNA, 13 nt, Human
guggcggugccug

SEQ ID NO: 2592117 - RNA, 14 nt, Human
guggcggugccugg

SEQ ID NO: 2592118 - RNA, 17 nt, Human
guggcggugccugggug

SEQ ID NO: 2592119 - RNA, 21 nt, Human
gugggacagucaccucaugga

SEQ ID NO: 2592120 - RNA, 15 nt, Human
gugggacagagucug

SEQ ID NO: 2592121 - RNA, 13 nt, Human
gugggagugugua

SEQ ID NO: 2592122 - RNA, 14 nt, Human
gugggaguguguaa

SEQ ID NO: 2592123 - RNA, 13 nt, Human
gugggauccucca

SEQ ID NO: 2592124 - RNA, 14 nt, Human
gugggagugggccc

SEQ ID NO: 2592125 - RNA, 13 nt, Human
gugggagugggcc

SEQ ID NO: 2592126 - RNA, 20 nt, Human
gugggacggugcccaagcca

SEQ ID NO: 2592127 - RNA, 19 nt, Human
gugggacggugcccaagcc

SEQ ID NO: 2592128 - RNA, 23 nt, Human
gugggaggaucucuugagccugg

SEQ ID NO: 2592129 - RNA, 19 nt, Human
gugggagggagcagacagg

SEQ ID NO: 2592130 - RNA, 15 nt, Human
gugggagggagcaga

SEQ ID NO: 2592131 - RNA, 14 nt, Human
gugggagggagcag

SEQ ID NO: 2592132 - RNA, 13 nt, Human
gugggagggagca

SEQ ID NO: 2592133 - RNA, 17 nt, Human
gugggagguggaagaag

SEQ ID NO: 2592134 - RNA, 15 nt, Human
gugggaggggcaggc

SEQ ID NO: 2592135 - RNA, 14 nt, Human
gugggaggggcagg

SEQ ID NO: 2592136 - RNA, 13 nt, Human
gugggaggggcag

SEQ ID NO: 2592137 - RNA, 12 nt, Human
gugggaggggca

SEQ ID NO: 2592138 - RNA, 17 nt, Human
gugggaggggcaggcug

SEQ ID NO: 2592139 - RNA, 16 nt, Human
gugggaggggcaggcu

SEQ ID NO: 2592140 - RNA, 21 nt, Human
gugggaggggcgcccaccucc

SEQ ID NO: 2592141 - RNA, 16 nt, Human
aagagccuggagaagc

SEQ ID NO: 2592142 - RNA, 14 nt, Human
aagagccuggagaa

SEQ ID NO: 2592143 - RNA, 13 nt, Human
aagagccuggaga

SEQ ID NO: 2592144 - RNA, 11 nt, Human
aagagccugga

SEQ ID NO: 2592145 - RNA, 22 nt, Human
aagagccugcaggugcugcugc

SEQ ID NO: 2592146 - RNA, 20 nt, Human
aagagccugcaggugcugcu

SEQ ID NO: 2592147 - RNA, 16 nt, Human
aagagccugcaggugc

SEQ ID NO: 2592148 - RNA, 12 nt, Human
aagagccugcag

SEQ ID NO: 2592149 - RNA, 19 nt, Human
aagagccggagccuccagc

SEQ ID NO: 2592150 - RNA, 14 nt, Human
aagagccggagccu

SEQ ID NO: 2592151 - RNA, 18 nt, Human
aagagcccuugccucccc

SEQ ID NO: 2592152 - RNA, 16 nt, Human
aagagcccuugccucc

SEQ ID NO: 2592153 - RNA, 14 nt, Human
aagagcccuugccu

SEQ ID NO: 2592154 - RNA, 13 nt, Human
aagagcccuugcc

SEQ ID NO: 2592155 - RNA, 21 nt, Human
aagagcacuuaagagaauauu

SEQ ID NO: 2592156 - RNA, 17 nt, Human
aagagcacuuaagagaa

SEQ ID NO: 2592157 - RNA, 16 nt, Human
aagagcacuuaagaga

SEQ ID NO: 2592158 - RNA, 19 nt, Human
aagagcaccuuccucacuu

SEQ ID NO: 2592159 - RNA, 19 nt, Human
aagagcacagcccucccgc

SEQ ID NO: 2592160 - RNA, 15 nt, Human
aagagcacagcccuc

SEQ ID NO: 2592161 - RNA, 14 nt, Human
aagagcacagcccu

SEQ ID NO: 2592162 - RNA, 13 nt, Human
aagagcacagccc

SEQ ID NO: 2592163 - RNA, 12 nt, Human
aagagcacagcc

SEQ ID NO: 2592164 - RNA, 13 nt, Human
aagagcacacuug

SEQ ID NO: 2592165 - RNA, 15 nt, Human
aagagcaagucugga

SEQ ID NO: 2592166 - RNA, 16 nt, Human
aagacuccucggccug

SEQ ID NO: 2592167 - RNA, 15 nt, Human
aagagauuucaagag

SEQ ID NO: 2592168 - RNA, 17 nt, Human
aagagauuuuucaugau

SEQ ID NO: 2592169 - RNA, 15 nt, Human
aagagauuuuucaug

SEQ ID NO: 2592170 - RNA, 14 nt, Human
aagagauuuuucau

SEQ ID NO: 2592171 - RNA, 14 nt, Human
aagagauuucaaga

SEQ ID NO: 2592172 - RNA, 13 nt, Human
aagagauuucaag

SEQ ID NO: 2592173 - RNA, 13 nt, Human
aagagauuuuuca

SEQ ID NO: 2592174 - RNA, 16 nt, Human
aagagauuuaauuaau

SEQ ID NO: 2592175 - RNA, 14 nt, Human
aagagauuuaauua

SEQ ID NO: 2592176 - RNA, 17 nt, Human
aagagauuguuguuugc

SEQ ID NO: 2592177 - RNA, 18 nt, Human
aagacuucaguauguugu

SEQ ID NO: 2592178 - RNA, 17 nt, Human
aagacuguugcucaaau

SEQ ID NO: 2592179 - RNA, 24 nt, Human
aagacuguugcucaaaucuauuca

SEQ ID NO: 2592180 - RNA, 16 nt, Human
aagacuguugcucaaa

SEQ ID NO: 2592181 - RNA, 18 nt, Human
aagacuguggcugcuagc

SEQ ID NO: 2592182 - RNA, 21 nt, Human
aagagccuggagaagcugaug

SEQ ID NO: 2592183 - RNA, 17 nt, Human
aagagccuggagaagcu

SEQ ID NO: 2592184 - RNA, 20 nt, Human
aagagccuugguguccaccu

SEQ ID NO: 2592185 - RNA, 21 nt, Human
aagagccuugguguccaccug

SEQ ID NO: 2592186 - RNA, 22 nt, Human
aagagccuugguguccaccugg

SEQ ID NO: 2592187 - RNA, 16 nt, Human
aagagcuuaacagugu

SEQ ID NO: 2592188 - RNA, 15 nt, Human
aagaggaaagaauga

SEQ ID NO: 2592189 - RNA, 14 nt, Human
aagaggaaagaaug

SEQ ID NO: 2592190 - RNA, 21 nt, Human
aagaggaaaaugaauaauaca

SEQ ID NO: 2592191 - RNA, 14 nt, Human
aagaggaaaaugaa

SEQ ID NO: 2592192 - RNA, 13 nt, Human
aagaggaaaauga

SEQ ID NO: 2592193 - RNA, 19 nt, Human
guggcccgacagccuggca

SEQ ID NO: 2592194 - RNA, 18 nt, Human
guggcccgacagccuggc

SEQ ID NO: 2592195 - RNA, 21 nt, Human
aagacugaguacguugugcau

SEQ ID NO: 2592196 - RNA, 17 nt, Human
aagacuguacaaaguag

SEQ ID NO: 2592197 - RNA, 19 nt, Human
aagacugagcaccugcuuc

SEQ ID NO: 2592198 - RNA, 15 nt, Human
aagacugagcaccug

SEQ ID NO: 2592199 - RNA, 12 nt, Human
aagacuguggcu

SEQ ID NO: 2592200 - RNA, 15 nt, Human
aagacuguggcugcu

SEQ ID NO: 2592201 - RNA, 22 nt, Human
aagacucuaccagacuguguau

SEQ ID NO: 2592202 - RNA, 17 nt, Human
aagacugaguacguugu

SEQ ID NO: 2592203 - RNA, 18 nt, Human
aagacuaucuaaauguug

SEQ ID NO: 2592204 - RNA, 13 nt, Human
aagacuauucaaa

SEQ ID NO: 2592205 - RNA, 19 nt, Human
aagaccuguugguuccaag

SEQ ID NO: 2592206 - RNA, 21 nt, Human
aagaccuucuccaaaugagau

SEQ ID NO: 2592207 - RNA, 21 nt, Human
aagacccuuguggucccaccc

SEQ ID NO: 2592208 - RNA, 18 nt, Human
aagacccuugugguccca

SEQ ID NO: 2592209 - RNA, 22 nt, Human
aagacccuuguggucccacccc

SEQ ID NO: 2592210 - RNA, 16 nt, Human
aagacuaucuaaaugu

SEQ ID NO: 2592211 - RNA, 17 nt, Human
aagacuaucuaaauguu

SEQ ID NO: 2592212 - RNA, 21 nt, Human
aagaccuggcaaggacacaga

SEQ ID NO: 2592213 - RNA, 12 nt, Human
aagaccuggcaa

SEQ ID NO: 2592214 - RNA, 17 nt, Human
aagaccuggcagcucug

SEQ ID NO: 2592215 - RNA, 17 nt, Human
aagaccuguugguucca

SEQ ID NO: 2592216 - RNA, 16 nt, Human
aagaccucaccuagaa

SEQ ID NO: 2592217 - RNA, 17 nt, Human
aagaccucaccuagaaa

SEQ ID NO: 2592218 - RNA, 18 nt, Human
guggauuuaacagaaaug

SEQ ID NO: 2592219 - RNA, 19 nt, Human
guggauuuaacagaaaugu

SEQ ID NO: 2592220 - RNA, 19 nt, Human
guggcaccagcagccugga

SEQ ID NO: 2592221 - RNA, 16 nt, Human
guggcacucaacauga

SEQ ID NO: 2592222 - RNA, 19 nt, Human
guggcacgucaucuaguuu

SEQ ID NO: 2592223 - RNA, 20 nt, Human
guggcaccagcgaagggagu

SEQ ID NO: 2592224 - RNA, 13 nt, Human
guggauugagggu

SEQ ID NO: 2592225 - RNA, 19 nt, Human
guggauugcacguggccuc

SEQ ID NO: 2592226 - RNA, 18 nt, Human
guggcaccagcagccugg

SEQ ID NO: 2592227 - RNA, 12 nt, Human
guggcacugcca

SEQ ID NO: 2592228 - RNA, 16 nt, Human
guggcacugagccccc

SEQ ID NO: 2592229 - RNA, 15 nt, Human
guggcacugagcccc

SEQ ID NO: 2592230 - RNA, 14 nt, Human
guggcacugagccc

SEQ ID NO: 2592231 - RNA, 12 nt, Human
guggcagcccug

SEQ ID NO: 2592232 - RNA, 13 nt, Human
guggcagcccugu

SEQ ID NO: 2592233 - RNA, 16 nt, Human
aagaaugauuaugaau

SEQ ID NO: 2592234 - RNA, 19 nt, Human
aagaaugaacaaauugaac

SEQ ID NO: 2592235 - RNA, 22 nt, Human
aagaaugagccuacgcugaaga

SEQ ID NO: 2592236 - RNA, 21 nt, Human
aagaaugagaaggagucagaa

SEQ ID NO: 2592237 - RNA, 14 nt, Human
aagaaugaaagagu

SEQ ID NO: 2592238 - RNA, 15 nt, Human
aagaaucuuuagaga

SEQ ID NO: 2592239 - RNA, 19 nt, Human
aagaaucuaucugcuuaug

SEQ ID NO: 2592240 - RNA, 17 nt, Human
aagaaucuaucugcuua

SEQ ID NO: 2592241 - RNA, 16 nt, Human
aagaaucuaucugcuu

SEQ ID NO: 2592242 - RNA, 16 nt, Human
guggcagcucaccucu

SEQ ID NO: 2592243 - RNA, 14 nt, Human
guggcagcucaccu

SEQ ID NO: 2592244 - RNA, 20 nt, Human
guggcagcucaccucucccu

SEQ ID NO: 2592245 - RNA, 23 nt, Human
aagaaucagucuauccacagaga

SEQ ID NO: 2592246 - RNA, 14 nt, Human
guggcagcccugua

SEQ ID NO: 2592247 - RNA, 18 nt, Human
aagaaugauuaugaauua

SEQ ID NO: 2592248 - RNA, 14 nt, Human
aagaaugcugaaac

SEQ ID NO: 2592249 - RNA, 13 nt, Human
aagaaugcugaaa

SEQ ID NO: 2592250 - RNA, 12 nt, Human
aagaaugcugaa

SEQ ID NO: 2592251 - RNA, 9 nt, Human
aagaaugcu

SEQ ID NO: 2592252 - RNA, 16 nt, Human
aagaaugcugaaacca

SEQ ID NO: 2592253 - RNA, 15 nt, Human
aagaaugcugguuuu

SEQ ID NO: 2592254 - RNA, 18 nt, Human
aagaaugcugguuuuccu

SEQ ID NO: 2592255 - RNA, 19 nt, Human
aagaaugcugguuuuccua

SEQ ID NO: 2592256 - RNA, 20 nt, Human
aagaauggggaucacagaga

SEQ ID NO: 2592257 - RNA, 21 nt, Human
aagaaugggcaguuacaugca

SEQ ID NO: 2592258 - RNA, 20 nt, Human
aagaaugggcaguuacaugc

SEQ ID NO: 2592259 - RNA, 16 nt, Human
aagaauugaagcagga

SEQ ID NO: 2592260 - RNA, 17 nt, Human
aagaaugggcaguuaca

SEQ ID NO: 2592261 - RNA, 18 nt, Human
aagaaugggcaguuacau

SEQ ID NO: 2592262 - RNA, 22 nt, Human
aagaaugcugguuuuccuaaau

SEQ ID NO: 2592263 - RNA, 16 nt, Human
aagacaaauucuguuu

SEQ ID NO: 2592264 - RNA, 18 nt, Human
aagacaaauucuguuucu

SEQ ID NO: 2592265 - RNA, 13 nt, Human
aagacccuccccg

SEQ ID NO: 2592266 - RNA, 13 nt, Human
aagacccuucucg

SEQ ID NO: 2592267 - RNA, 17 nt, Human
aagacaaagguuuuccu

SEQ ID NO: 2592268 - RNA, 17 nt, Human
aagacaaaucaaagcag

SEQ ID NO: 2592269 - RNA, 14 nt, Human
aagacaaacugcau

SEQ ID NO: 2592270 - RNA, 15 nt, Human
aagaauuuagggaga

SEQ ID NO: 2592271 - RNA, 20 nt, Human
aagaauugucuuucugucuc

SEQ ID NO: 2592272 - RNA, 19 nt, Human
aagaauugaacccaggagg

SEQ ID NO: 2592273 - RNA, 20 nt, Human
aagaauugaacccaggaggu

SEQ ID NO: 2592274 - RNA, 15 nt, Human
gugcucaggagcccu

SEQ ID NO: 2592275 - RNA, 21 nt, Human
gugcuauuuuguuuguuuugu

SEQ ID NO: 2592276 - RNA, 18 nt, Human
gugcucaggacucagaag

SEQ ID NO: 2592277 - RNA, 22 nt, Human
gugcucaggacucagaagccuc

SEQ ID NO: 2592278 - RNA, 20 nt, Human
gugcugggacugagccaguc

SEQ ID NO: 2592279 - RNA, 19 nt, Human
gugcugggacugagccagu

SEQ ID NO: 2592280 - RNA, 18 nt, Human
gugcugggacugagccag

SEQ ID NO: 2592281 - RNA, 17 nt, Human
gugcugggacugagcca

SEQ ID NO: 2592282 - RNA, 18 nt, Human
gugcuggcugcccagacc

SEQ ID NO: 2592283 - RNA, 13 nt, Human
gugcugggacuga

SEQ ID NO: 2592284 - RNA, 15 nt, Human
gugcuggcugcccag

SEQ ID NO: 2592285 - RNA, 23 nt, Human
gugcuauuguagagccagagguc

SEQ ID NO: 2592286 - RNA, 12 nt, Human
gugcuauguucu

SEQ ID NO: 2592287 - RNA, 22 nt, Human
gugcuaucucccccagccccau

SEQ ID NO: 2592288 - RNA, 19 nt, Human
gugcuauggauggcuucua

SEQ ID NO: 2592289 - RNA, 13 nt, Human
gugcuaugaauuu

SEQ ID NO: 2592290 - RNA, 19 nt, Human
gugcuaucucccccagccc

SEQ ID NO: 2592291 - RNA, 22 nt, Human
gugcugggauuacaagcgugag

SEQ ID NO: 2592292 - RNA, 21 nt, Human
gugcugggauuacaagcguga

SEQ ID NO: 2592293 - RNA, 22 nt, Human
gugcugggagcuccacucugcu

SEQ ID NO: 2592294 - RNA, 16 nt, Human
gugcugggagcuccac

SEQ ID NO: 2592295 - RNA, 22 nt, Human
gugcugggacugagccaguccc

SEQ ID NO: 2592296 - RNA, 17 nt, Human
gugcugggaggagggag

SEQ ID NO: 2592297 - RNA, 15 nt, Human
gugcugggaggaggg

SEQ ID NO: 2592298 - RNA, 23 nt, Human
gugcugggagcuccacucugcuu

SEQ ID NO: 2592299 - RNA, 19 nt, Human
gugcugggaggagggagag

SEQ ID NO: 2592300 - RNA, 18 nt, Human
gugcugggaggagggaga

SEQ ID NO: 2592301 - RNA, 23 nt, Human
gugcugggaggagggagagggag

SEQ ID NO: 2592302 - RNA, 15 nt, Human
gugcugggagggaua

SEQ ID NO: 2592303 - RNA, 14 nt, Human
guggaagugugggu

SEQ ID NO: 2592304 - RNA, 15 nt, Human
guggaaguguggguc

SEQ ID NO: 2592305 - RNA, 19 nt, Human
guggaagugugggucugug

SEQ ID NO: 2592306 - RNA, 20 nt, Human
guggaagugugggucugugu

SEQ ID NO: 2592307 - RNA, 20 nt, Human
gugcugggauuacaggugug

SEQ ID NO: 2592308 - RNA, 20 nt, Human
gugcugggauuacaggcgug

SEQ ID NO: 2592309 - RNA, 22 nt, Human
guggacacagcucuucuccagg

SEQ ID NO: 2592310 - RNA, 18 nt, Human
guggacacagcucuucuc

SEQ ID NO: 2592311 - RNA, 23 nt, Human
guggacacagcucuucuccaggc

SEQ ID NO: 2592312 - RNA, 19 nt, Human
guggaauuauuuuaaaaga

SEQ ID NO: 2592313 - RNA, 13 nt, Human
guggacaguccug

SEQ ID NO: 2592314 - RNA, 23 nt, Human
guggaauaguauccuccagguuu

SEQ ID NO: 2592315 - RNA, 22 nt, Human
guggaauaguauccuccagguu

SEQ ID NO: 2592316 - RNA, 21 nt, Human
guggaauaguauccuccaggu

SEQ ID NO: 2592317 - RNA, 20 nt, Human
guggaauaguauccuccagg

SEQ ID NO: 2592318 - RNA, 19 nt, Human
guggaauaguauccuccag

SEQ ID NO: 2592319 - RNA, 18 nt, Human
guggaauaguauccucca

SEQ ID NO: 2592320 - RNA, 14 nt, Human
guggaauaaaauac

SEQ ID NO: 2592321 - RNA, 21 nt, Human
guggaagugugggucugugug

SEQ ID NO: 2592322 - RNA, 22 nt, Human
guggaagugugggucugugugu

SEQ ID NO: 2592323 - RNA, 16 nt, Human
guggaauuauuuuaaa

SEQ ID NO: 2592324 - RNA, 18 nt, Human
guggaauuauuuuaaaag

SEQ ID NO: 2592325 - RNA, 15 nt, Human
guggaauuauuuuaa

SEQ ID NO: 2592326 - RNA, 13 nt, Human
guggaauauaaag

SEQ ID NO: 2592327 - RNA, 18 nt, Human
guggaauauaaggaaagc

SEQ ID NO: 2592328 - RNA, 17 nt, Human
guggaccuuaggccuuc

SEQ ID NO: 2592329 - RNA, 18 nt, Human
guggaccuuaggccuucc

SEQ ID NO: 2592330 - RNA, 15 nt, Human
guggaccuuccugcc

SEQ ID NO: 2592331 - RNA, 21 nt, Human
guggaccuuaggccuuccucu

SEQ ID NO: 2592332 - RNA, 13 nt, Human
guggaccuuccug

SEQ ID NO: 2592333 - RNA, 16 nt, Human
guggacaguccuggga

SEQ ID NO: 2592334 - RNA, 14 nt, Human
guggacaguccugg

SEQ ID NO: 2592335 - RNA, 15 nt, Human
guggacaguccuggg

SEQ ID NO: 2592336 - RNA, 13 nt, Human
guggaccaggaca

SEQ ID NO: 2592337 - RNA, 14 nt, Human
guggaccaggacag

SEQ ID NO: 2592338 - RNA, 18 nt, Human
guggaccaggacaggacc

SEQ ID NO: 2592339 - RNA, 22 nt, Human
guggacccagggaugacauguc

SEQ ID NO: 2592340 - RNA, 14 nt, Human
guggaccuuccugc

SEQ ID NO: 2592341 - RNA, 13 nt, Human
guggauggcccca

SEQ ID NO: 2592342 - RNA, 21 nt, Human
guggauggaaggggcugacag

SEQ ID NO: 2592343 - RNA, 21 nt, Human
guggaugccugguggcagcug

SEQ ID NO: 2592344 - RNA, 22 nt, Human
guggauggccccagcacagcuu

SEQ ID NO: 2592345 - RNA, 19 nt, Human
guggauggccccagcacag

SEQ ID NO: 2592346 - RNA, 16 nt, Human
guggauggccccagca

SEQ ID NO: 2592347 - RNA, 15 nt, Human
guggauggccccagc

SEQ ID NO: 2592348 - RNA, 16 nt, Human
guggaugucuuccuug

SEQ ID NO: 2592349 - RNA, 15 nt, Human
guggaugucuuccuu

SEQ ID NO: 2592350 - RNA, 13 nt, Human
guggaugucuucc

SEQ ID NO: 2592351 - RNA, 19 nt, Human
guggaugucuuccuuggag

SEQ ID NO: 2592352 - RNA, 21 nt, Human
aagaaacugaggaauuuucuu

SEQ ID NO: 2592353 - RNA, 19 nt, Human
aagaaacugaggaauuuuc

SEQ ID NO: 2592354 - RNA, 20 nt, Human
aagaaacugaggaauuuucu

SEQ ID NO: 2592355 - RNA, 16 nt, Human
aagaaacugaggaauu

SEQ ID NO: 2592356 - RNA, 18 nt, Human
aagaaaaaggaugcacag

SEQ ID NO: 2592357 - RNA, 21 nt, Human
aagaaacgucuauguguacag

SEQ ID NO: 2592358 - RNA, 17 nt, Human
aagaaacuauacaucau

SEQ ID NO: 2592359 - RNA, 16 nt, Human
aagaaacucaccccca

SEQ ID NO: 2592360 - RNA, 15 nt, Human
aagaaaaaggaugca

SEQ ID NO: 2592361 - RNA, 17 nt, Human
aagaaaaaggaugcaca

SEQ ID NO: 2592362 - RNA, 15 nt, Human
aagaaaaagaagaac

SEQ ID NO: 2592363 - RNA, 11 nt, Human
aagaaaaaagu

SEQ ID NO: 2592364 - RNA, 18 nt, Human
aagaaaaaagagaaaaga

SEQ ID NO: 2592365 - RNA, 20 nt, Human
aagaaaaaagagaaaagaaa

SEQ ID NO: 2592366 - RNA, 13 nt, Human
aagaaagaaggaa

SEQ ID NO: 2592367 - RNA, 14 nt, Human
aagaaagaaggaag

SEQ ID NO: 2592368 - RNA, 20 nt, Human
aagaaagacuaucuaaaugu

SEQ ID NO: 2592369 - RNA, 22 nt, Human
aagaaagacuaucuaaauguug

SEQ ID NO: 2592370 - RNA, 15 nt, Human
aagaaauacuguaca

SEQ ID NO: 2592371 - RNA, 13 nt, Human
aagaaauacugua

SEQ ID NO: 2592372 - RNA, 17 nt, Human
aagaaagagaaggagcc

SEQ ID NO: 2592373 - RNA, 15 nt, Human
aagaaagaaggaagu

SEQ ID NO: 2592374 - RNA, 13 nt, Human
aagaaauauaccu

SEQ ID NO: 2592375 - RNA, 18 nt, Human
gugcuaguaauuggaaag

SEQ ID NO: 2592376 - RNA, 21 nt, Human
gugcuaucucccccagcccca

SEQ ID NO: 2592377 - RNA, 20 nt, Human
gugcuagggaaacuucccgu

SEQ ID NO: 2592378 - RNA, 17 nt, Human
gugcuaggaacacuccu

SEQ ID NO: 2592379 - RNA, 22 nt, Human
gugcuaggaacacuccuucaca

SEQ ID NO: 2592380 - RNA, 18 nt, Human
gugcuaggaacacuccuu

SEQ ID NO: 2592381 - RNA, 13 nt, Human
aagaauacagaaa

SEQ ID NO: 2592382 - RNA, 16 nt, Human
aagaagugaaaaucua

SEQ ID NO: 2592383 - RNA, 22 nt, Human
aagaagugaaaaucuacacucc

SEQ ID NO: 2592384 - RNA, 16 nt, Human
aagaauacaaacauau

SEQ ID NO: 2592385 - RNA, 18 nt, Human
aagaauacaaacauauuu

SEQ ID NO: 2592386 - RNA, 22 nt, Human
aagaauacaaacauauuuguua

SEQ ID NO: 2592387 - RNA, 14 nt, Human
aagaauacagaaag

SEQ ID NO: 2592388 - RNA, 16 nt, Human
aagaaggcaaaaaugu

SEQ ID NO: 2592389 - RNA, 23 nt, Human
aagaagcuguuguacauuuauga

SEQ ID NO: 2592390 - RNA, 22 nt, Human
aagaagcuguuguacauuuaug

SEQ ID NO: 2592391 - RNA, 21 nt, Human
aagaagcuguuguacauuuau

SEQ ID NO: 2592392 - RNA, 19 nt, Human
aagaagcuguuguacauuu

SEQ ID NO: 2592393 - RNA, 18 nt, Human
aagaagcuguuguacauu

SEQ ID NO: 2592394 - RNA, 17 nt, Human
aagaagcuguuguacau

SEQ ID NO: 2592395 - RNA, 16 nt, Human
aagaagcuguuguaca

SEQ ID NO: 2592396 - RNA, 18 nt, Human
aagaaaucacagaaucau

SEQ ID NO: 2592397 - RNA, 14 nt, Human
aagaaaucacagaa

SEQ ID NO: 2592398 - RNA, 13 nt, Human
aagaaaucccugu

SEQ ID NO: 2592399 - RNA, 14 nt, Human
aagaaaucccuguu

SEQ ID NO: 2592400 - RNA, 14 nt, Human
aagaaggcaaaaau

SEQ ID NO: 2592401 - RNA, 16 nt, Human
aagaaggaaaaugauc

SEQ ID NO: 2592402 - RNA, 11 nt, Human
aagaaggaagu

SEQ ID NO: 2592403 - RNA, 21 nt, Human
aagaagcuuuaauauuuaaau

SEQ ID NO: 2592404 - RNA, 16 nt, Human
aagaagcuuaggcagg

SEQ ID NO: 2592405 - RNA, 23 nt, Human
aagaaggaaaaugaucugagucc

SEQ ID NO: 2592406 - RNA, 17 nt, Human
aagaaggaaaaggcagg

SEQ ID NO: 2592407 - RNA, 17 nt, Human
gugccuccaccaccacu

SEQ ID NO: 2592408 - RNA, 15 nt, Human
gugccuccaccacca

SEQ ID NO: 2592409 - RNA, 14 nt, Human
gugccucauugcuu

SEQ ID NO: 2592410 - RNA, 22 nt, Human
gugccuccaccaccacuggcca

SEQ ID NO: 2592411 - RNA, 21 nt, Human
gugccuccaccaccacuggcc

SEQ ID NO: 2592412 - RNA, 20 nt, Human
gugccuccaccaccacuggc

SEQ ID NO: 2592413 - RNA, 13 nt, Human
gugccucugccug

SEQ ID NO: 2592414 - RNA, 12 nt, Human
gugccucuggga

SEQ ID NO: 2592415 - RNA, 13 nt, Human
gugccucugggac

SEQ ID NO: 2592416 - RNA, 23 nt, Human
gugccuuauggaacacucugaga

SEQ ID NO: 2592417 - RNA, 21 nt, Human
gugccuuauggaacacucuga

SEQ ID NO: 2592418 - RNA, 14 nt, Human
gugccuuauggaac

SEQ ID NO: 2592419 - RNA, 15 nt, Human
gugccucugccuguc

SEQ ID NO: 2592420 - RNA, 21 nt, Human
gugccuaggauugugccugua

SEQ ID NO: 2592421 - RNA, 22 nt, Human
gugccguuacucuccaaccugg

SEQ ID NO: 2592422 - RNA, 15 nt, Human
gugccguuacucucc

SEQ ID NO: 2592423 - RNA, 18 nt, Human
gugccguuacucuccaac

SEQ ID NO: 2592424 - RNA, 21 nt, Human
gugccguuacucuccaaccug

SEQ ID NO: 2592425 - RNA, 15 nt, Human
gugccucaagagaag

SEQ ID NO: 2592426 - RNA, 14 nt, Human
gugccgccugcccg

SEQ ID NO: 2592427 - RNA, 13 nt, Human
gugccgccugccc

SEQ ID NO: 2592428 - RNA, 23 nt, Human
gugccgccgccucgcccaccgca

SEQ ID NO: 2592429 - RNA, 22 nt, Human
gugccgccgccucgcccaccgc

SEQ ID NO: 2592430 - RNA, 20 nt, Human
gugccgccgccucgcccacc

SEQ ID NO: 2592431 - RNA, 18 nt, Human
gugccgccgccucgccca

SEQ ID NO: 2592432 - RNA, 17 nt, Human
gugccgccgccucgccc

SEQ ID NO: 2592433 - RNA, 23 nt, Human
gugccgccugcccgucucucucc

SEQ ID NO: 2592434 - RNA, 23 nt, Human
gugaaccaaagagacuggagcau

SEQ ID NO: 2592435 - RNA, 22 nt, Human
gugaaccaaagagacuggagca

SEQ ID NO: 2592436 - RNA, 21 nt, Human
gugaaccaccacacccagccc

SEQ ID NO: 2592437 - RNA, 12 nt, Human
aacuugggaacu

SEQ ID NO: 2592438 - RNA, 21 nt, Human
aacuuggggaguuaagaccug

SEQ ID NO: 2592439 - RNA, 22 nt, Human
aacuuggggaguuaagaccugg

SEQ ID NO: 2592440 - RNA, 13 nt, Human
aacuuggggaaca

SEQ ID NO: 2592441 - RNA, 17 nt, Human
aacuuggcgcugccccu

SEQ ID NO: 2592442 - RNA, 11 nt, Human
gugccuuaugg

SEQ ID NO: 2592443 - RNA, 23 nt, Human
aacuuggcucgaaucucugugcc

SEQ ID NO: 2592444 - RNA, 22 nt, Human
aacuuggcucgaaucucugugc

SEQ ID NO: 2592445 - RNA, 21 nt, Human
aacuuggcucgaaucucugug

SEQ ID NO: 2592446 - RNA, 16 nt, Human
aacuuguauuaugugu

SEQ ID NO: 2592447 - RNA, 23 nt, Human
aacuuggggaguuaagaccuggc

SEQ ID NO: 2592448 - RNA, 15 nt, Human
aacuuguauuaugug

SEQ ID NO: 2592449 - RNA, 18 nt, Human
aacuugucuuuggacccu

SEQ ID NO: 2592450 - RNA, 22 nt, Human
aacuugucuuuggacccugagg

SEQ ID NO: 2592451 - RNA, 19 nt, Human
aacuugucuaaauaaguuu

SEQ ID NO: 2592452 - RNA, 17 nt, Human
aagaaaaaaaagaaagc

SEQ ID NO: 2592453 - RNA, 20 nt, Human
aacuuuacccaaaaacuaaa

SEQ ID NO: 2592454 - RNA, 14 nt, Human
aagaaaaaaaaaga

SEQ ID NO: 2592455 - RNA, 15 nt, Human
aagaaaaaaaaagaa

SEQ ID NO: 2592456 - RNA, 18 nt, Human
aagaaaaaaaaagaaaaa

SEQ ID NO: 2592457 - RNA, 19 nt, Human
aagaaaaaaaaagaaaaaa

SEQ ID NO: 2592458 - RNA, 16 nt, Human
aagaaaaaaaaaauau

SEQ ID NO: 2592459 - RNA, 13 nt, Human
aacuuuaccuuuu

SEQ ID NO: 2592460 - RNA, 21 nt, Human
aacuuuaauucucuuucaaag

SEQ ID NO: 2592461 - RNA, 20 nt, Human
aacuuuaauucucuuucaaa

SEQ ID NO: 2592462 - RNA, 21 nt, Human
aacuuuaaguuucaggauaca

SEQ ID NO: 2592463 - RNA, 18 nt, Human
aacuuuaaguuucaggau

SEQ ID NO: 2592464 - RNA, 18 nt, Human
aacuuuaagcagcucuug

SEQ ID NO: 2592465 - RNA, 16 nt, Human
aacuuuaagcagcucu

SEQ ID NO: 2592466 - RNA, 13 nt, Human
aacuuuaagagga

SEQ ID NO: 2592467 - RNA, 15 nt, Human
aacuuuaagaggaca

SEQ ID NO: 2592468 - RNA, 19 nt, Human
aacuuggggaacaagggug

SEQ ID NO: 2592469 - RNA, 13 nt, Human
aacuuguuuucug

SEQ ID NO: 2592470 - RNA, 20 nt, Human
uacaguaggagcccagcucu

SEQ ID NO: 2592471 - RNA, 22 nt, Human
uacaguaggagcccagcucuga

SEQ ID NO: 2592472 - RNA, 21 nt, Human
uacaguaagcugcucuauugu

SEQ ID NO: 2592473 - RNA, 18 nt, Human
uacaguaagcugcucuau

SEQ ID NO: 2592474 - RNA, 14 nt, Human
uacaguaagcugcu

SEQ ID NO: 2592475 - RNA, 21 nt, Human
uacaguagauuuuccaaaugu

SEQ ID NO: 2592476 - RNA, 17 nt, Human
uacaguagauuuuccaa

SEQ ID NO: 2592477 - RNA, 13 nt, Human
uacaguaggagcc

SEQ ID NO: 2592478 - RNA, 14 nt, Human
uacaguaggagccc

SEQ ID NO: 2592479 - RNA, 15 nt, Human
uacaguaggagccca

SEQ ID NO: 2592480 - RNA, 18 nt, Human
uacaguaggagcccagcu

SEQ ID NO: 2592481 - RNA, 23 nt, Human
uacaguaacuuuauguguaaaua

SEQ ID NO: 2592482 - RNA, 20 nt, Human
uacaguaacuuuauguguaa

SEQ ID NO: 2592483 - RNA, 18 nt, Human
uacaguaacuuuaugugu

SEQ ID NO: 2592484 - RNA, 17 nt, Human
uacaguaacuuuaugug

SEQ ID NO: 2592485 - RNA, 16 nt, Human
uacaguaacuuuaugu

SEQ ID NO: 2592486 - RNA, 20 nt, Human
uacagggaaugccugagugc

SEQ ID NO: 2592487 - RNA, 16 nt, Human
uacagggaaugccuga

SEQ ID NO: 2592488 - RNA, 17 nt, Human
uacaggcuccugccacc

SEQ ID NO: 2592489 - RNA, 14 nt, Human
uacaggcuccugcc

SEQ ID NO: 2592490 - RNA, 15 nt, Human
uacaggcuccugcca

SEQ ID NO: 2592491 - RNA, 22 nt, Human
uacaggcgugagccaccgugcc

SEQ ID NO: 2592492 - RNA, 16 nt, Human
uacagagcuucccuga

SEQ ID NO: 2592493 - RNA, 14 nt, Human
uacagaggacagua

SEQ ID NO: 2592494 - RNA, 23 nt, Human
uacagagcccacgcccccacugg

SEQ ID NO: 2592495 - RNA, 15 nt, Human
uacagagcuucccug

SEQ ID NO: 2592496 - RNA, 18 nt, Human
uacagaggccaugggccu

SEQ ID NO: 2592497 - RNA, 18 nt, Human
uacagaggacaguauuug

SEQ ID NO: 2592498 - RNA, 15 nt, Human
uacaggcauagaguu

SEQ ID NO: 2592499 - RNA, 17 nt, Human
uacacuccagccugagc

SEQ ID NO: 2592500 - RNA, 18 nt, Human
uacacuccagccugagca

SEQ ID NO: 2592501 - RNA, 18 nt, Human
uacacucaggcuuucacu

SEQ ID NO: 2592502 - RNA, 16 nt, Human
uacacucaggcuuuca

SEQ ID NO: 2592503 - RNA, 13 nt, Human
uacacuaucuuaa

SEQ ID NO: 2592504 - RNA, 15 nt, Human
uacacuccagccuga

SEQ ID NO: 2592505 - RNA, 16 nt, Human
uacacuccagccugag

SEQ ID NO: 2592506 - RNA, 19 nt, Human
uacacuaagagagaaugag

SEQ ID NO: 2592507 - RNA, 24 nt, Human
uacaccauguuugagcucagaccc

SEQ ID NO: 2592508 - RNA, 19 nt, Human
uacaccauuaucuuggaaa

SEQ ID NO: 2592509 - RNA, 14 nt, Human
uacacuaguuguuu

SEQ ID NO: 2592510 - RNA, 20 nt, Human
uacacuaaggguguaaguaa

SEQ ID NO: 2592511 - RNA, 15 nt, Human
uacaccacuacauuc

SEQ ID NO: 2592512 - RNA, 16 nt, Human
uacaccacuacauucu

SEQ ID NO: 2592513 - RNA, 17 nt, Human
uacaccacuacauucug

SEQ ID NO: 2592514 - RNA, 18 nt, Human
uacaccacuacauucugu

SEQ ID NO: 2592515 - RNA, 19 nt, Human
uacaccacuacauucuguu

SEQ ID NO: 2592516 - RNA, 20 nt, Human
uacaccacuacauucuguua

SEQ ID NO: 2592517 - RNA, 20 nt, Human
uacaccagcauuccuuuuga

SEQ ID NO: 2592518 - RNA, 18 nt, Human
uacaccagcauuccuuuu

SEQ ID NO: 2592519 - RNA, 19 nt, Human
uacaccauguuugagcuca

SEQ ID NO: 2592520 - RNA, 17 nt, Human
uacaccagcauuccuuu

SEQ ID NO: 2592521 - RNA, 20 nt, Human
uacaccagagauaauaugag

SEQ ID NO: 2592522 - RNA, 19 nt, Human
uacaccaccucacuccugu

SEQ ID NO: 2592523 - RNA, 19 nt, Human
uacaccagagauaauauga

SEQ ID NO: 2592524 - RNA, 19 nt, Human
aauggacuuuuguacauag

SEQ ID NO: 2592525 - RNA, 18 nt, Human
uacaccaccucacuccug

SEQ ID NO: 2592526 - RNA, 19 nt, Human
uacacauuuuucagauaua

SEQ ID NO: 2592527 - RNA, 21 nt, Human
uacacauuuuucagauauaaa

SEQ ID NO: 2592528 - RNA, 20 nt, Human
aauggagauuugaaggucug

SEQ ID NO: 2592529 - RNA, 20 nt, Human
aauggagauucaguuuucau

SEQ ID NO: 2592530 - RNA, 15 nt, Human
aauggaggaauauga

SEQ ID NO: 2592531 - RNA, 17 nt, Human
uacacauuuuucagaua

SEQ ID NO: 2592532 - RNA, 15 nt, Human
uacacauuuuucaga

SEQ ID NO: 2592533 - RNA, 15 nt, Human
aauguacugagauuu

SEQ ID NO: 2592534 - RNA, 17 nt, Human
aauguaugcuucauaca

SEQ ID NO: 2592535 - RNA, 18 nt, Human
aauguaugcuucauacag

SEQ ID NO: 2592536 - RNA, 18 nt, Human
aauguaugugcacuguca

SEQ ID NO: 2592537 - RNA, 13 nt, Human
aauguaugugcac

SEQ ID NO: 2592538 - RNA, 21 nt, Human
aauguaugcuucauacaggga

SEQ ID NO: 2592539 - RNA, 14 nt, Human
aauguacugcauau

SEQ ID NO: 2592540 - RNA, 18 nt, Human
aauguacugcauaugaaa

SEQ ID NO: 2592541 - RNA, 18 nt, Human
aauguauugaacuuggaa

SEQ ID NO: 2592542 - RNA, 14 nt, Human
aauguauuguaccu

SEQ ID NO: 2592543 - RNA, 13 nt, Human
aauguauuguacc

SEQ ID NO: 2592544 - RNA, 19 nt, Human
aauguauugaacuuggaaa

SEQ ID NO: 2592545 - RNA, 22 nt, Human
aauguauuauucugcagcauga

SEQ ID NO: 2592546 - RNA, 21 nt, Human
aauguaugugcacugucacuu

SEQ ID NO: 2592547 - RNA, 20 nt, Human
aauguaugugcacugucacu

SEQ ID NO: 2592548 - RNA, 18 nt, Human
aauguauuauucugcagc

SEQ ID NO: 2592549 - RNA, 17 nt, Human
aauguauuauucugcag

SEQ ID NO: 2592550 - RNA, 12 nt, Human
aauguaugugua

SEQ ID NO: 2592551 - RNA, 14 nt, Human
aauguauguguaag

SEQ ID NO: 2592552 - RNA, 16 nt, Human
aaugugauauuauaca

SEQ ID NO: 2592553 - RNA, 12 nt, Human
aaugugaugaau

SEQ ID NO: 2592554 - RNA, 20 nt, Human
aaugugaugaauacuguauu

SEQ ID NO: 2592555 - RNA, 11 nt, Human
aaugugauaug

SEQ ID NO: 2592556 - RNA, 16 nt, Human
aaugugaugaauacug

SEQ ID NO: 2592557 - RNA, 14 nt, Human
aauguggcuccugg

SEQ ID NO: 2592558 - RNA, 12 nt, Human
aauguggcuuga

SEQ ID NO: 2592559 - RNA, 16 nt, Human
aauguggcuugagaaa

SEQ ID NO: 2592560 - RNA, 21 nt, Human
aauguggcuugagaaauaugg

SEQ ID NO: 2592561 - RNA, 18 nt, Human
aaugugggagcagcgguu

SEQ ID NO: 2592562 - RNA, 21 nt, Human
aauguauuuauuuaaaagauu

SEQ ID NO: 2592563 - RNA, 23 nt, Human
aauguauuguaccuuuuaacacc

SEQ ID NO: 2592564 - RNA, 22 nt, Human
aauguauuguaccuuuuaacac

SEQ ID NO: 2592565 - RNA, 16 nt, Human
aauguauuguaccuuu

SEQ ID NO: 2592566 - RNA, 15 nt, Human
aauguauuguaccuu

SEQ ID NO: 2592567 - RNA, 16 nt, Human
aauguauuuuauugua

SEQ ID NO: 2592568 - RNA, 15 nt, Human
aauguauuuuauugu

SEQ ID NO: 2592569 - RNA, 19 nt, Human
aauguauuguugguaauua

SEQ ID NO: 2592570 - RNA, 21 nt, Human
aauguauuuuauuguaacaga

SEQ ID NO: 2592571 - RNA, 17 nt, Human
aauguauuuuauuguaa

SEQ ID NO: 2592572 - RNA, 23 nt, Human
aauguauuuuauuguaacagaca

SEQ ID NO: 2592573 - RNA, 17 nt, Human
uacauagaugcuuaguc

SEQ ID NO: 2592574 - RNA, 14 nt, Human
uacauagaugcuua

SEQ ID NO: 2592575 - RNA, 21 nt, Human
uacauagccuauauuuacagu

SEQ ID NO: 2592576 - RNA, 20 nt, Human
uacauagccuauauuuacag

SEQ ID NO: 2592577 - RNA, 15 nt, Human
uacauagccuauauu

SEQ ID NO: 2592578 - RNA, 13 nt, Human
uacauagccuaua

SEQ ID NO: 2592579 - RNA, 23 nt, Human
uacauagcaugacauuucuuugu

SEQ ID NO: 2592580 - RNA, 19 nt, Human
uacauaaugcgugcauacc

SEQ ID NO: 2592581 - RNA, 20 nt, Human
uacauaaugcgugcauacca

SEQ ID NO: 2592582 - RNA, 17 nt, Human
uacauaaugcgugcaua

SEQ ID NO: 2592583 - RNA, 15 nt, Human
uacaguaucucaggg

SEQ ID NO: 2592584 - RNA, 15 nt, Human
uacaguacaggcagc

SEQ ID NO: 2592585 - RNA, 21 nt, Human
uacauaugugcuggaauucua

SEQ ID NO: 2592586 - RNA, 18 nt, Human
uacauauuaggaaaauau

SEQ ID NO: 2592587 - RNA, 19 nt, Human
uacauauuaggaaaauaug

SEQ ID NO: 2592588 - RNA, 14 nt, Human
uacauauucuuuaa

SEQ ID NO: 2592589 - RNA, 19 nt, Human
uacauauaagugauugcug

SEQ ID NO: 2592590 - RNA, 23 nt, Human
uacauauuaggaaaauauggguu

SEQ ID NO: 2592591 - RNA, 15 nt, Human
uacauauucuuuaaa

SEQ ID NO: 2592592 - RNA, 17 nt, Human
uacauauuugagacuag

SEQ ID NO: 2592593 - RNA, 13 nt, Human
uacauauuuccaa

SEQ ID NO: 2592594 - RNA, 19 nt, Human
uacauauuugcauauguau

SEQ ID NO: 2592595 - RNA, 12 nt, Human
aauguacugcau

SEQ ID NO: 2592596 - RNA, 17 nt, Human
uacauauuuguggaaua

SEQ ID NO: 2592597 - RNA, 16 nt, Human
uacauauuuguggaau

SEQ ID NO: 2592598 - RNA, 21 nt, Human
uacauauuugcauauguauga

SEQ ID NO: 2592599 - RNA, 12 nt, Human
aauguacugaga

SEQ ID NO: 2592600 - RNA, 14 nt, Human
aauguacccaguau

SEQ ID NO: 2592601 - RNA, 19 nt, Human
uacaaaaccugauguuaaa

SEQ ID NO: 2592602 - RNA, 20 nt, Human
uacaaaaauauaaaauauga

SEQ ID NO: 2592603 - RNA, 20 nt, Human
uacaaaaaaaaaguuuuauu

SEQ ID NO: 2592604 - RNA, 15 nt, Human
uacaaaagcauguga

SEQ ID NO: 2592605 - RNA, 12 nt, Human
uacaaaacuucc

SEQ ID NO: 2592606 - RNA, 19 nt, Human
uacaaaauaaacaaauaac

SEQ ID NO: 2592607 - RNA, 18 nt, Human
uacaaaaauauaaaauau

SEQ ID NO: 2592608 - RNA, 17 nt, Human
uacaaaaauauaaaaua

SEQ ID NO: 2592609 - RNA, 14 nt, Human
uacaaaaauauaaa

SEQ ID NO: 2592610 - RNA, 20 nt, Human
uacaaaaagcauaaaaauua

SEQ ID NO: 2592611 - RNA, 15 nt, Human
uacaaaaacacagca

SEQ ID NO: 2592612 - RNA, 16 nt, Human
uacaaaaacacagcaa

SEQ ID NO: 2592613 - RNA, 15 nt, Human
uacaaaaagcauaaa

SEQ ID NO: 2592614 - RNA, 19 nt, Human
uaauuucaaaaauauaacu

SEQ ID NO: 2592615 - RNA, 18 nt, Human
uaauuucaaaaauauaac

SEQ ID NO: 2592616 - RNA, 17 nt, Human
uaauuucaaaaauauaa

SEQ ID NO: 2592617 - RNA, 18 nt, Human
uaauuuauuuuugcaugg

SEQ ID NO: 2592618 - RNA, 21 nt, Human
uaauuucaaaaauauaacuua

SEQ ID NO: 2592619 - RNA, 20 nt, Human
uaauuucaaaaauauaacuu

SEQ ID NO: 2592620 - RNA, 12 nt, Human
uaauuucaaaau

SEQ ID NO: 2592621 - RNA, 12 nt, Human
uaauuuauuuau

SEQ ID NO: 2592622 - RNA, 14 nt, Human
uaauuuauuuauua

SEQ ID NO: 2592623 - RNA, 17 nt, Human
uaauuuauuuauuaaga

SEQ ID NO: 2592624 - RNA, 19 nt, Human
uaauuuauuuauuaagaug

SEQ ID NO: 2592625 - RNA, 14 nt, Human
uaauuuauuuuguc

SEQ ID NO: 2592626 - RNA, 18 nt, Human
uaauuuauuuauuaagau

SEQ ID NO: 2592627 - RNA, 14 nt, Human
uaauuuauuauuga

SEQ ID NO: 2592628 - RNA, 17 nt, Human
uaauuuauuauugaaau

SEQ ID NO: 2592629 - RNA, 20 nt, Human
uaauuuauuaauugcuuuga

SEQ ID NO: 2592630 - RNA, 20 nt, Human
uaauuuauuauugaaauugu

SEQ ID NO: 2592631 - RNA, 18 nt, Human
uaauuuauuauugaaauu

SEQ ID NO: 2592632 - RNA, 20 nt, Human
uaauuuauuguuuuuccuug

SEQ ID NO: 2592633 - RNA, 20 nt, Human
uaauuuaugaguuuuugaua

SEQ ID NO: 2592634 - RNA, 18 nt, Human
uaauuuauuaauugcuuu

SEQ ID NO: 2592635 - RNA, 19 nt, Human
uaauuuauuaauugcuuug

SEQ ID NO: 2592636 - RNA, 17 nt, Human
uaauuuauuaauugcuu

SEQ ID NO: 2592637 - RNA, 13 nt, Human
uacaaaaacacag

SEQ ID NO: 2592638 - RNA, 14 nt, Human
uacaaaaacacagc

SEQ ID NO: 2592639 - RNA, 15 nt, Human
uaauuucaaaaugcu

SEQ ID NO: 2592640 - RNA, 16 nt, Human
uaauuucaaaaugcuu

SEQ ID NO: 2592641 - RNA, 20 nt, Human
uaauuucaaaaugcuuuuua

SEQ ID NO: 2592642 - RNA, 19 nt, Human
uacaaaaaaaaaguuuuau

SEQ ID NO: 2592643 - RNA, 14 nt, Human
aaugaggacauguu

SEQ ID NO: 2592644 - RNA, 13 nt, Human
aaugaggaaugua

SEQ ID NO: 2592645 - RNA, 16 nt, Human
aaugaggacauguuuu

SEQ ID NO: 2592646 - RNA, 16 nt, Human
aaugagcuauguauua

SEQ ID NO: 2592647 - RNA, 23 nt, Human
aaugagagaauaagucauguucc

SEQ ID NO: 2592648 - RNA, 18 nt, Human
aaugagagaauaagucau

SEQ ID NO: 2592649 - RNA, 22 nt, Human
aaugagcucgcauuugucaaug

SEQ ID NO: 2592650 - RNA, 12 nt, Human
uaauucaaagca

SEQ ID NO: 2592651 - RNA, 19 nt, Human
uaauucaaagcaccaaaau

SEQ ID NO: 2592652 - RNA, 22 nt, Human
uaauucaaagcucuauuaagau

SEQ ID NO: 2592653 - RNA, 21 nt, Human
uaauuauuuugguacuuuuau

SEQ ID NO: 2592654 - RNA, 21 nt, Human
uaauucaaagcaccaaaauaa

SEQ ID NO: 2592655 - RNA, 20 nt, Human
uaauuauuuugguacuuuua

SEQ ID NO: 2592656 - RNA, 16 nt, Human
uaauuauuuugguacu

SEQ ID NO: 2592657 - RNA, 13 nt, Human
uaauuauuuuggu

SEQ ID NO: 2592658 - RNA, 13 nt, Human
uaauucaagaaaa

SEQ ID NO: 2592659 - RNA, 18 nt, Human
uaauuccaauaugaugac

SEQ ID NO: 2592660 - RNA, 16 nt, Human
uaauuccaauaugaug

SEQ ID NO: 2592661 - RNA, 15 nt, Human
uaauuccaauaugau

SEQ ID NO: 2592662 - RNA, 15 nt, Human
uaauucauguuucuu

SEQ ID NO: 2592663 - RNA, 20 nt, Human
uaauuccaauaugaugacuc

SEQ ID NO: 2592664 - RNA, 19 nt, Human
uaauuccaauaugaugacu

SEQ ID NO: 2592665 - RNA, 15 nt, Human
uaauuccacaccuuu

SEQ ID NO: 2592666 - RNA, 13 nt, Human
uaauuccacagcu

SEQ ID NO: 2592667 - RNA, 14 nt, Human
uaauuccacagcug

SEQ ID NO: 2592668 - RNA, 17 nt, Human
uaauuccacagcugcuc

SEQ ID NO: 2592669 - RNA, 22 nt, Human
uaauuguuguuucuuucuagug

SEQ ID NO: 2592670 - RNA, 19 nt, Human
uaauuguuguuucuuucua

SEQ ID NO: 2592671 - RNA, 15 nt, Human
uaauuguuguuugua

SEQ ID NO: 2592672 - RNA, 18 nt, Human
uaauuguuguuuguaugu

SEQ ID NO: 2592673 - RNA, 19 nt, Human
uaauuguuguuuguaugua

SEQ ID NO: 2592674 - RNA, 16 nt, Human
uaauuguuguuucuuu

SEQ ID NO: 2592675 - RNA, 16 nt, Human
uaauucccauuuugca

SEQ ID NO: 2592676 - RNA, 15 nt, Human
uaauuguuguuucuu

SEQ ID NO: 2592677 - RNA, 17 nt, Human
uaauuccacaccuuuua

SEQ ID NO: 2592678 - RNA, 11 nt, Human
uaauuccauga

SEQ ID NO: 2592679 - RNA, 10 nt, Human
uaauuccaug

SEQ ID NO: 2592680 - RNA, 18 nt, Human
uaauuguuuugcacuuuu

SEQ ID NO: 2592681 - RNA, 16 nt, Human
uaauuguuuugcacuu

SEQ ID NO: 2592682 - RNA, 17 nt, Human
uaauuguuugucuuuaa

SEQ ID NO: 2592683 - RNA, 22 nt, Human
uaauuguuguuuguauguauaa

SEQ ID NO: 2592684 - RNA, 23 nt, Human
uaauuguuguuuguauguauaau

SEQ ID NO: 2592685 - RNA, 15 nt, Human
uaauuuaaaauugug

SEQ ID NO: 2592686 - RNA, 16 nt, Human
uaauuuaaaauuguga

SEQ ID NO: 2592687 - RNA, 23 nt, Human
uaauuuaucuugucucugggcuu

SEQ ID NO: 2592688 - RNA, 14 nt, Human
uaauuuaugaguuu

SEQ ID NO: 2592689 - RNA, 15 nt, Human
uaauuuaaaaaauaa

SEQ ID NO: 2592690 - RNA, 24 nt, Human
aaugcccagccccuucugacccau

SEQ ID NO: 2592691 - RNA, 23 nt, Human
aaugcccagccccuucugaccca

SEQ ID NO: 2592692 - RNA, 22 nt, Human
aaugcccagccccuucugaccc

SEQ ID NO: 2592693 - RNA, 20 nt, Human
aaugcccagccccuucugac

SEQ ID NO: 2592694 - RNA, 20 nt, Human
aaugcugugcccuaaagugu

SEQ ID NO: 2592695 - RNA, 21 nt, Human
aaugcugugcccuaaagugua

SEQ ID NO: 2592696 - RNA, 18 nt, Human
aaugcccccagcuggccc

SEQ ID NO: 2592697 - RNA, 17 nt, Human
aaugcugucaacuauga

SEQ ID NO: 2592698 - RNA, 17 nt, Human
aaugcccccagcuggcc

SEQ ID NO: 2592699 - RNA, 15 nt, Human
aaugcccccagcugg

SEQ ID NO: 2592700 - RNA, 13 nt, Human
aaugcugugcccu

SEQ ID NO: 2592701 - RNA, 18 nt, Human
aauggaagguuuguauau

SEQ ID NO: 2592702 - RNA, 20 nt, Human
aauggaagguuuguauauug

SEQ ID NO: 2592703 - RNA, 13 nt, Human
aauggaaacugaa

SEQ ID NO: 2592704 - RNA, 19 nt, Human
aauggaaaacagacucagg

SEQ ID NO: 2592705 - RNA, 16 nt, Human
aauggacguguuauga

SEQ ID NO: 2592706 - RNA, 19 nt, Human
aauggacauaggacucaaa

SEQ ID NO: 2592707 - RNA, 14 nt, Human
aauggaauacugaa

SEQ ID NO: 2592708 - RNA, 12 nt, Human
aauggaaacuga

SEQ ID NO: 2592709 - RNA, 12 nt, Human
aaugcuguguua

SEQ ID NO: 2592710 - RNA, 12 nt, Human
aaugcuuucgau

SEQ ID NO: 2592711 - RNA, 15 nt, Human
aaugcuuuccaaaac

SEQ ID NO: 2592712 - RNA, 17 nt, Human
aaugcuuuuugaauguu

SEQ ID NO: 2592713 - RNA, 14 nt, Human
aaugcuuuuugaau

SEQ ID NO: 2592714 - RNA, 11 nt, Human
aaugcuuuuug

SEQ ID NO: 2592715 - RNA, 19 nt, Human
aaugcuuuuuauuucugca

SEQ ID NO: 2592716 - RNA, 20 nt, Human
aaugcuuuuuauuucugcau

SEQ ID NO: 2592717 - RNA, 13 nt, Human
aaugcuuuuaaaa

SEQ ID NO: 2592718 - RNA, 19 nt, Human
aaugcuuugugugauugaa

SEQ ID NO: 2592719 - RNA, 21 nt, Human
aaugcauuuuguuugguauug

SEQ ID NO: 2592720 - RNA, 20 nt, Human
aaugcauuuuguuugguauu

SEQ ID NO: 2592721 - RNA, 18 nt, Human
aaugcauuuuguuuggua

SEQ ID NO: 2592722 - RNA, 12 nt, Human
aaugcauuuugu

SEQ ID NO: 2592723 - RNA, 12 nt, Human
aaugcauuguau

SEQ ID NO: 2592724 - RNA, 18 nt, Human
aaugcauuguaucgaugu

SEQ ID NO: 2592725 - RNA, 21 nt, Human
aaugcauuguaucgauguuau

SEQ ID NO: 2592726 - RNA, 14 nt, Human
aaugcauaaaugca

SEQ ID NO: 2592727 - RNA, 16 nt, Human
aaugcauaaaauguua

SEQ ID NO: 2592728 - RNA, 22 nt, Human
aaugcauuauaggaucauuugu

SEQ ID NO: 2592729 - RNA, 23 nt, Human
aaugcauuauaggaucauuuguu

SEQ ID NO: 2592730 - RNA, 17 nt, Human
aaugcauuauuuugaau

SEQ ID NO: 2592731 - RNA, 18 nt, Human
aaugcauauccugagcca

SEQ ID NO: 2592732 - RNA, 15 nt, Human
aaugcccagccccuu

SEQ ID NO: 2592733 - RNA, 14 nt, Human
aaugcccagccccu

SEQ ID NO: 2592734 - RNA, 23 nt, Human
aaugcauuuuguuugguauugua

SEQ ID NO: 2592735 - RNA, 22 nt, Human
aaugcauuguaucgauguuaug

SEQ ID NO: 2592736 - RNA, 23 nt, Human
aaugccaacuuguccuuuuguac

SEQ ID NO: 2592737 - RNA, 13 nt, Human
aaugcccagcccc

SEQ ID NO: 2592738 - RNA, 14 nt, Human
uacaaggacagccc

SEQ ID NO: 2592739 - RNA, 14 nt, Human
uacaaggcaacaua

SEQ ID NO: 2592740 - RNA, 17 nt, Human
uacaaggaagguggugg

SEQ ID NO: 2592741 - RNA, 18 nt, Human
uacaagggucuagggaga

SEQ ID NO: 2592742 - RNA, 20 nt, Human
uacaaaauaaacaaauaaca

SEQ ID NO: 2592743 - RNA, 16 nt, Human
uacaaacaaaauuucu

SEQ ID NO: 2592744 - RNA, 19 nt, Human
uacaaaauuugaaauuuag

SEQ ID NO: 2592745 - RNA, 20 nt, Human
uacaaguagggguugugggu

SEQ ID NO: 2592746 - RNA, 13 nt, Human
aaugcauaaaaug

SEQ ID NO: 2592747 - RNA, 17 nt, Human
aaugcagugaauuguga

SEQ ID NO: 2592748 - RNA, 22 nt, Human
uaaucauauaauaaauguacau

SEQ ID NO: 2592749 - RNA, 20 nt, Human
uaaucauauaauaaauguac

SEQ ID NO: 2592750 - RNA, 15 nt, Human
uaaucauauaauaaa

SEQ ID NO: 2592751 - RNA, 16 nt, Human
uaaucaugaaauuacu

SEQ ID NO: 2592752 - RNA, 13 nt, Human
uaaucaugaaauu

SEQ ID NO: 2592753 - RNA, 20 nt, Human
uaaugaaacaccuucucugg

SEQ ID NO: 2592754 - RNA, 14 nt, Human
uaaugaaacuugga

SEQ ID NO: 2592755 - RNA, 17 nt, Human
uaaucaucuauaaagaa

SEQ ID NO: 2592756 - RNA, 16 nt, Human
uaaucaucuauaaaga

SEQ ID NO: 2592757 - RNA, 17 nt, Human
uaaucauccaaugcuca

SEQ ID NO: 2592758 - RNA, 14 nt, Human
uaaugaaagacugu

SEQ ID NO: 2592759 - RNA, 17 nt, Human
uaaugaaagacuguaca

SEQ ID NO: 2592760 - RNA, 18 nt, Human
uaaugaaagacuguacaa

SEQ ID NO: 2592761 - RNA, 19 nt, Human
uaaugaaagacuguacaaa

SEQ ID NO: 2592762 - RNA, 21 nt, Human
uaaugacuuaagcacacuuga

SEQ ID NO: 2592763 - RNA, 15 nt, Human
uaaugacuuaagcac

SEQ ID NO: 2592764 - RNA, 20 nt, Human
uaaugacaucaccacaguuu

SEQ ID NO: 2592765 - RNA, 15 nt, Human
uaaugacagagccag

SEQ ID NO: 2592766 - RNA, 22 nt, Human
uaaugaaagacuguacaaagua

SEQ ID NO: 2592767 - RNA, 23 nt, Human
uaaugaaagacuguacaaaguag

SEQ ID NO: 2592768 - RNA, 15 nt, Human
uaaugaauggacuca

SEQ ID NO: 2592769 - RNA, 15 nt, Human
uaaugacacuugucc

SEQ ID NO: 2592770 - RNA, 21 nt, Human
uaaugaauuuuuaugauauuc

SEQ ID NO: 2592771 - RNA, 15 nt, Human
uaaugaaacuuggau

SEQ ID NO: 2592772 - RNA, 16 nt, Human
uaaugaauuuuuauga

SEQ ID NO: 2592773 - RNA, 20 nt, Human
uaaucaauuuaaacccauuu

SEQ ID NO: 2592774 - RNA, 13 nt, Human
uaaucaauuuaaa

SEQ ID NO: 2592775 - RNA, 23 nt, Human
uaaucaauuaauuuuuuuauugu

SEQ ID NO: 2592776 - RNA, 22 nt, Human
uaaucaauuaauuuuuuuauug

SEQ ID NO: 2592777 - RNA, 18 nt, Human
uaaucaauguuucuucua

SEQ ID NO: 2592778 - RNA, 23 nt, Human
uaaucagugugucuaaauuugaa

SEQ ID NO: 2592779 - RNA, 15 nt, Human
uaaucacgcuuuccu

SEQ ID NO: 2592780 - RNA, 17 nt, Human
uaaucaaucaucugugu

SEQ ID NO: 2592781 - RNA, 22 nt, Human
uaaucaauaaacgauuuaauuc

SEQ ID NO: 2592782 - RNA, 16 nt, Human
uaaucaauaaacgauu

SEQ ID NO: 2592783 - RNA, 14 nt, Human
uaaucaaguugaau

SEQ ID NO: 2592784 - RNA, 14 nt, Human
uaaucaagccucug

SEQ ID NO: 2592785 - RNA, 21 nt, Human
uaaucaacugggcugaacacu

SEQ ID NO: 2592786 - RNA, 15 nt, Human
uaauaguguuaauca

SEQ ID NO: 2592787 - RNA, 13 nt, Human
uaauaguguuaau

SEQ ID NO: 2592788 - RNA, 21 nt, Human
uaauagugcuuaaaaaucauu

SEQ ID NO: 2592789 - RNA, 20 nt, Human
uaauaguguuaaucaauuua

SEQ ID NO: 2592790 - RNA, 17 nt, Human
uaauaguguuaaucaau

SEQ ID NO: 2592791 - RNA, 21 nt, Human
uaauaguguuaaucaauuuaa

SEQ ID NO: 2592792 - RNA, 21 nt, Human
uaauagcuuuuauuguauaaa

SEQ ID NO: 2592793 - RNA, 18 nt, Human
uaauagcuuuuauuguau

SEQ ID NO: 2592794 - RNA, 20 nt, Human
aaucuucugaacuuggcgcu

SEQ ID NO: 2592795 - RNA, 13 nt, Human
aaucuucugaacu

SEQ ID NO: 2592796 - RNA, 20 nt, Human
aaucuuauuagggagaaaau

SEQ ID NO: 2592797 - RNA, 20 nt, Human
aaucuucaguuuuaucuuua

SEQ ID NO: 2592798 - RNA, 22 nt, Human
aaucuucaguuuuaucuuuaau

SEQ ID NO: 2592799 - RNA, 12 nt, Human
uaauacuguauu

SEQ ID NO: 2592800 - RNA, 14 nt, Human
uaauacuaccuuga

SEQ ID NO: 2592801 - RNA, 15 nt, Human
uaauacuaccuugaa

SEQ ID NO: 2592802 - RNA, 22 nt, Human
uaauacuaguugugaccuuagu

SEQ ID NO: 2592803 - RNA, 18 nt, Human
uaauacuaguugugaccu

SEQ ID NO: 2592804 - RNA, 15 nt, Human
uaauacuaguuguga

SEQ ID NO: 2592805 - RNA, 23 nt, Human
uaauacuaguugugaccuuagug

SEQ ID NO: 2592806 - RNA, 12 nt, Human
uaauacuauauu

SEQ ID NO: 2592807 - RNA, 22 nt, Human
aaucuuucuuuaccugagacca

SEQ ID NO: 2592808 - RNA, 21 nt, Human
aaucuuucuuuaccugagacc

SEQ ID NO: 2592809 - RNA, 19 nt, Human
aaucuuucuuuaccugaga

SEQ ID NO: 2592810 - RNA, 17 nt, Human
aaucuuucuuuaccuga

SEQ ID NO: 2592811 - RNA, 15 nt, Human
aaucuuucuuuaccu

SEQ ID NO: 2592812 - RNA, 13 nt, Human
aaucuuucugcag

SEQ ID NO: 2592813 - RNA, 20 nt, Human
aaucuugucucaaugcucau

SEQ ID NO: 2592814 - RNA, 18 nt, Human
aaucuugucucaaugcuc

SEQ ID NO: 2592815 - RNA, 21 nt, Human
aaucuugucucaaugcucaua

SEQ ID NO: 2592816 - RNA, 22 nt, Human
aaucuuucuuucuuagaaauuu

SEQ ID NO: 2592817 - RNA, 21 nt, Human
aaucuuucuuucuuagaaauu

SEQ ID NO: 2592818 - RNA, 20 nt, Human
aaucuuucuuucuuagaaau

SEQ ID NO: 2592819 - RNA, 19 nt, Human
aaucuuucuuucuuagaaa

SEQ ID NO: 2592820 - RNA, 18 nt, Human
aaucuuucuuucuuagaa

SEQ ID NO: 2592821 - RNA, 17 nt, Human
aaucuuucuuucuuaga

SEQ ID NO: 2592822 - RNA, 16 nt, Human
aaucuuucuuucuuag

SEQ ID NO: 2592823 - RNA, 14 nt, Human
aaucuuucuuucuu

SEQ ID NO: 2592824 - RNA, 22 nt, Human
aaucuuucuuuugauucuuccu

SEQ ID NO: 2592825 - RNA, 21 nt, Human
aaucuuuuaaaaauucaaaug

SEQ ID NO: 2592826 - RNA, 12 nt, Human
aaucuuuuacaa

SEQ ID NO: 2592827 - RNA, 21 nt, Human
aaucuuuuacaacugccucga

SEQ ID NO: 2592828 - RNA, 19 nt, Human
aaugaaaaauuuaagcauu

SEQ ID NO: 2592829 - RNA, 22 nt, Human
aaugaaaaauuuaagcauuguu

SEQ ID NO: 2592830 - RNA, 21 nt, Human
aaugaaaaauuuaagcauugu

SEQ ID NO: 2592831 - RNA, 16 nt, Human
uaaugauaacuggaaa

SEQ ID NO: 2592832 - RNA, 13 nt, Human
uaaugaggaaacu

SEQ ID NO: 2592833 - RNA, 18 nt, Human
uaauggucccauccaggc

SEQ ID NO: 2592834 - RNA, 16 nt, Human
uaauggucccauccag

SEQ ID NO: 2592835 - RNA, 15 nt, Human
uaauggucccaucca

SEQ ID NO: 2592836 - RNA, 14 nt, Human
uaauggucccaucc

SEQ ID NO: 2592837 - RNA, 21 nt, Human
uaauggucccauccaggcagu

SEQ ID NO: 2592838 - RNA, 20 nt, Human
uaauggucccauccaggcag

SEQ ID NO: 2592839 - RNA, 16 nt, Human
uaaugaggaugauuau

SEQ ID NO: 2592840 - RNA, 15 nt, Human
uaaugagggacugga

SEQ ID NO: 2592841 - RNA, 13 nt, Human
aaucuugucucaa

SEQ ID NO: 2592842 - RNA, 17 nt, Human
aaucuugucucaaugcu

SEQ ID NO: 2592843 - RNA, 15 nt, Human
aaucuugucucaaug

SEQ ID NO: 2592844 - RNA, 17 nt, Human
uaauguaaaauguugaa

SEQ ID NO: 2592845 - RNA, 14 nt, Human
uaauguaaaauguu

SEQ ID NO: 2592846 - RNA, 15 nt, Human
uaaugguuucaaaga

SEQ ID NO: 2592847 - RNA, 14 nt, Human
uaaugguguuuuaa

SEQ ID NO: 2592848 - RNA, 16 nt, Human
uaauggugccuucauu

SEQ ID NO: 2592849 - RNA, 18 nt, Human
uaauggugccuucauuug

SEQ ID NO: 2592850 - RNA, 15 nt, Human
uaaugguuugaauau

SEQ ID NO: 2592851 - RNA, 14 nt, Human
aaugacuuacugua

SEQ ID NO: 2592852 - RNA, 17 nt, Human
aaugacuuacuguacau

SEQ ID NO: 2592853 - RNA, 18 nt, Human
aaugacuuacuguacaug

SEQ ID NO: 2592854 - RNA, 13 nt, Human
aaugagaaucuac

SEQ ID NO: 2592855 - RNA, 17 nt, Human
aaugagaaggcagccac

SEQ ID NO: 2592856 - RNA, 15 nt, Human
aaugagaaggcagcc

SEQ ID NO: 2592857 - RNA, 14 nt, Human
aaugaccaauauua

SEQ ID NO: 2592858 - RNA, 16 nt, Human
aaugagacuugcucuc

SEQ ID NO: 2592859 - RNA, 15 nt, Human
aaugagacuugcucu

SEQ ID NO: 2592860 - RNA, 14 nt, Human
aaugagacuaugcg

SEQ ID NO: 2592861 - RNA, 19 nt, Human
aaugagacccucguggccu

SEQ ID NO: 2592862 - RNA, 21 nt, Human
aaugagagacacacugaagaa

SEQ ID NO: 2592863 - RNA, 15 nt, Human
aaugagccuggcaag

SEQ ID NO: 2592864 - RNA, 17 nt, Human
aaugaaaagcugaaucc

SEQ ID NO: 2592865 - RNA, 15 nt, Human
aaugaaaaccacauu

SEQ ID NO: 2592866 - RNA, 17 nt, Human
aaugacacuugucccca

SEQ ID NO: 2592867 - RNA, 13 nt, Human
aaugacacagucu

SEQ ID NO: 2592868 - RNA, 23 nt, Human
aaugaaaaugucagaaaccaguu

SEQ ID NO: 2592869 - RNA, 14 nt, Human
aaugaaaauaagaa

SEQ ID NO: 2592870 - RNA, 12 nt, Human
aaugaaaauguc

SEQ ID NO: 2592871 - RNA, 13 nt, Human
aaugaaaauguca

SEQ ID NO: 2592872 - RNA, 14 nt, Human
aaugaaaaugucag

SEQ ID NO: 2592873 - RNA, 20 nt, Human
aaugaaaaugucagaaacca

SEQ ID NO: 2592874 - RNA, 22 nt, Human
aaugacagguuugggaccccug

SEQ ID NO: 2592875 - RNA, 11 nt, Human
aaugacagagc

SEQ ID NO: 2592876 - RNA, 18 nt, Human
aaugacaucaccacaguu

SEQ ID NO: 2592877 - RNA, 18 nt, Human
aaugacaucuucaaagcu

SEQ ID NO: 2592878 - RNA, 18 nt, Human
aaugacauuuauaucaca

SEQ ID NO: 2592879 - RNA, 13 nt, Human
aaugacaucuuca

SEQ ID NO: 2592880 - RNA, 22 nt, Human
aaugacaucucaggggccagag

SEQ ID NO: 2592881 - RNA, 16 nt, Human
aaugacagagccagug

SEQ ID NO: 2592882 - RNA, 15 nt, Human
aaugacauuuugcca

SEQ ID NO: 2592883 - RNA, 20 nt, Human
aaugacucaggacauccccc

SEQ ID NO: 2592884 - RNA, 18 nt, Human
uaaguuucucagcuccca

SEQ ID NO: 2592885 - RNA, 12 nt, Human
uaaguuugaagg

SEQ ID NO: 2592886 - RNA, 16 nt, Human
uaaguuugauuucauu

SEQ ID NO: 2592887 - RNA, 23 nt, Human
uaaguuucucagcucccauuucu

SEQ ID NO: 2592888 - RNA, 19 nt, Human
uaaguuucucagcucccau

SEQ ID NO: 2592889 - RNA, 14 nt, Human
uaaguuucugggac

SEQ ID NO: 2592890 - RNA, 18 nt, Human
uaaguuuuuuuuuaaaaa

SEQ ID NO: 2592891 - RNA, 20 nt, Human
uaaguuuuuauggcuuuugu

SEQ ID NO: 2592892 - RNA, 20 nt, Human
uaaguucaaauucuucugaa

SEQ ID NO: 2592893 - RNA, 19 nt, Human
uaaguucaaauucuucuga

SEQ ID NO: 2592894 - RNA, 20 nt, Human
uaaguuauuuuuacauucug

SEQ ID NO: 2592895 - RNA, 20 nt, Human
uaaguuauugcaguuuauca

SEQ ID NO: 2592896 - RNA, 16 nt, Human
uaaguuauugcaguuu

SEQ ID NO: 2592897 - RNA, 15 nt, Human
uaaguuauugcaguu

SEQ ID NO: 2592898 - RNA, 14 nt, Human
uaaguuauugcagu

SEQ ID NO: 2592899 - RNA, 12 nt, Human
uaaguuauugca

SEQ ID NO: 2592900 - RNA, 17 nt, Human
uaaguaucuucauguau

SEQ ID NO: 2592901 - RNA, 14 nt, Human
uaaguauguuauuu

SEQ ID NO: 2592902 - RNA, 17 nt, Human
aaucagacuaugaaguu

SEQ ID NO: 2592903 - RNA, 14 nt, Human
aaucagacuaugaa

SEQ ID NO: 2592904 - RNA, 15 nt, Human
aaucagaucuuuauu

SEQ ID NO: 2592905 - RNA, 15 nt, Human
aaucagaucauuuca

SEQ ID NO: 2592906 - RNA, 14 nt, Human
aaucagaucauuuc

SEQ ID NO: 2592907 - RNA, 13 nt, Human
aaucagacaaagu

SEQ ID NO: 2592908 - RNA, 20 nt, Human
aaucagacccuaccccacca

SEQ ID NO: 2592909 - RNA, 20 nt, Human
uaaguauguguaaaauguga

SEQ ID NO: 2592910 - RNA, 15 nt, Human
uaaguaucugacauc

SEQ ID NO: 2592911 - RNA, 16 nt, Human
uaaguaucugacaucu

SEQ ID NO: 2592912 - RNA, 14 nt, Human
aaucagcaagaaga

SEQ ID NO: 2592913 - RNA, 14 nt, Human
uaaguacuguguac

SEQ ID NO: 2592914 - RNA, 19 nt, Human
uaaguacuauguaucaaug

SEQ ID NO: 2592915 - RNA, 16 nt, Human
aaucaugucaggccug

SEQ ID NO: 2592916 - RNA, 23 nt, Human
aaucauguaguaucaaauauuag

SEQ ID NO: 2592917 - RNA, 22 nt, Human
aaucauguaguaucaaauauua

SEQ ID NO: 2592918 - RNA, 18 nt, Human
aaucauguaguaucaaau

SEQ ID NO: 2592919 - RNA, 13 nt, Human
aaucauguaguau

SEQ ID NO: 2592920 - RNA, 16 nt, Human
aaucaugugaacccgg

SEQ ID NO: 2592921 - RNA, 15 nt, Human
aaucaugugaacccg

SEQ ID NO: 2592922 - RNA, 17 nt, Human
aaucauggugcucagag

SEQ ID NO: 2592923 - RNA, 18 nt, Human
aaucauggaaugguuaua

SEQ ID NO: 2592924 - RNA, 15 nt, Human
aaucaucugugugaa

SEQ ID NO: 2592925 - RNA, 21 nt, Human
aaucauggaaugguuauaaaa

SEQ ID NO: 2592926 - RNA, 15 nt, Human
aaucaugguuuuucu

SEQ ID NO: 2592927 - RNA, 14 nt, Human
aaucauguacauuu

SEQ ID NO: 2592928 - RNA, 16 nt, Human
aaucauguacauuucu

SEQ ID NO: 2592929 - RNA, 19 nt, Human
aaucauguacauuucugaa

SEQ ID NO: 2592930 - RNA, 17 nt, Human
aaucaugaauuaguuuu

SEQ ID NO: 2592931 - RNA, 19 nt, Human
aaucaugaauuaguuuuau

SEQ ID NO: 2592932 - RNA, 23 nt, Human
aaucaugaauuaguuuuauaugc

SEQ ID NO: 2592933 - RNA, 18 nt, Human
aaucaucuauaaagaaga

SEQ ID NO: 2592934 - RNA, 15 nt, Human
aaucaucuauaaaga

SEQ ID NO: 2592935 - RNA, 15 nt, Human
aaucauccaaugcuc

SEQ ID NO: 2592936 - RNA, 15 nt, Human
aaucaucaagucuuu

SEQ ID NO: 2592937 - RNA, 18 nt, Human
uaaguuugaaggaaacag

SEQ ID NO: 2592938 - RNA, 13 nt, Human
uaauaaaaggaaa

SEQ ID NO: 2592939 - RNA, 18 nt, Human
uaauaaaauaauucuaaa

SEQ ID NO: 2592940 - RNA, 16 nt, Human
uaauaaaauaauucua

SEQ ID NO: 2592941 - RNA, 19 nt, Human
uaauaaaauaauucuaaag

SEQ ID NO: 2592942 - RNA, 13 nt, Human
uaauaaaauaauu

SEQ ID NO: 2592943 - RNA, 20 nt, Human
uaauaaaaggaaaagcaaau

SEQ ID NO: 2592944 - RNA, 14 nt, Human
uaauaaaaggaaaa

SEQ ID NO: 2592945 - RNA, 17 nt, Human
uaauaaaaguacauguu

SEQ ID NO: 2592946 - RNA, 13 nt, Human
aaucuaaauggaa

SEQ ID NO: 2592947 - RNA, 15 nt, Human
aaucuaaauggaacc

SEQ ID NO: 2592948 - RNA, 18 nt, Human
aaucuaaauggaaccacu

SEQ ID NO: 2592949 - RNA, 15 nt, Human
aaucuacuaauucca

SEQ ID NO: 2592950 - RNA, 16 nt, Human
aaucuacuaauuccac

SEQ ID NO: 2592951 - RNA, 22 nt, Human
aaucuaccuucuguaguuuuau

SEQ ID NO: 2592952 - RNA, 21 nt, Human
aauccuucuaguuucccacaa

SEQ ID NO: 2592953 - RNA, 13 nt, Human
aauccuugcuuau

SEQ ID NO: 2592954 - RNA, 17 nt, Human
aauccuugcuuaugaca

SEQ ID NO: 2592955 - RNA, 18 nt, Human
aauccuugcuuaugacau

SEQ ID NO: 2592956 - RNA, 12 nt, Human
aaucuaaaugga

SEQ ID NO: 2592957 - RNA, 13 nt, Human
aauccuugaagau

SEQ ID NO: 2592958 - RNA, 20 nt, Human
aauccuucuaguuucccaca

SEQ ID NO: 2592959 - RNA, 16 nt, Human
aauccuucuaguuucc

SEQ ID NO: 2592960 - RNA, 14 nt, Human
aauccuucuaguuu

SEQ ID NO: 2592961 - RNA, 13 nt, Human
aauccuucuaguu

SEQ ID NO: 2592962 - RNA, 20 nt, Human
aaucauuucuauuucuccuc

SEQ ID NO: 2592963 - RNA, 12 nt, Human
aaucauuucuau

SEQ ID NO: 2592964 - RNA, 19 nt, Human
aaucauuucuauuucuccu

SEQ ID NO: 2592965 - RNA, 22 nt, Human
aaucauuguacaguuuguuuac

SEQ ID NO: 2592966 - RNA, 20 nt, Human
aaucauugcugaaaauggua

SEQ ID NO: 2592967 - RNA, 15 nt, Human
aaucauucucgauuu

SEQ ID NO: 2592968 - RNA, 17 nt, Human
aaucauucucgauuuaa

SEQ ID NO: 2592969 - RNA, 21 nt, Human
aaucauugcuuugaagcaguu

SEQ ID NO: 2592970 - RNA, 19 nt, Human
aaucauugcuuugaagcag

SEQ ID NO: 2592971 - RNA, 14 nt, Human
aaucauugcuuuga

SEQ ID NO: 2592972 - RNA, 20 nt, Human
aaucauuguacaguuuguuu

SEQ ID NO: 2592973 - RNA, 18 nt, Human
aaucauuguacaguuugu

SEQ ID NO: 2592974 - RNA, 17 nt, Human
aaucauuguacaguuug

SEQ ID NO: 2592975 - RNA, 16 nt, Human
aaucauuguacaguuu

SEQ ID NO: 2592976 - RNA, 15 nt, Human
aaucauuguacaguu

SEQ ID NO: 2592977 - RNA, 13 nt, Human
aaucauuguacag

SEQ ID NO: 2592978 - RNA, 22 nt, Human
aaucauugcuuugaagcaguug

SEQ ID NO: 2592979 - RNA, 12 nt, Human
aaucauuguaca

SEQ ID NO: 2592980 - RNA, 15 nt, Human
aauccuaccuguuuu

SEQ ID NO: 2592981 - RNA, 17 nt, Human
aauccuaccuguuuugu

SEQ ID NO: 2592982 - RNA, 16 nt, Human
aauccuaacacauuau

SEQ ID NO: 2592983 - RNA, 16 nt, Human
aauccuaauuucuccu

SEQ ID NO: 2592984 - RNA, 21 nt, Human
aauccuaauuucuccucccuu

SEQ ID NO: 2592985 - RNA, 19 nt, Human
aauccuaauuucuccuccc

SEQ ID NO: 2592986 - RNA, 24 nt, Human
aauccuaauuucuccucccuuccu

SEQ ID NO: 2592987 - RNA, 14 nt, Human
aauccuaugugauu

SEQ ID NO: 2592988 - RNA, 20 nt, Human
aauccuaugugauuuuaacu

SEQ ID NO: 2592989 - RNA, 20 nt, Human
aauccuauucucgggcugag

SEQ ID NO: 2592990 - RNA, 21 nt, Human
aauccuaugugauuuuaacuc

SEQ ID NO: 2592991 - RNA, 15 nt, Human
aauccucacugggug

SEQ ID NO: 2592992 - RNA, 16 nt, Human
aauccucacugggugg

SEQ ID NO: 2592993 - RNA, 14 nt, Human
aaucuuauaauuua

SEQ ID NO: 2592994 - RNA, 16 nt, Human
aaucuuauaauuuaaa

SEQ ID NO: 2592995 - RNA, 20 nt, Human
aaucucaaauucucaaccua

SEQ ID NO: 2592996 - RNA, 20 nt, Human
aaucuguccaaaggaggcug

SEQ ID NO: 2592997 - RNA, 21 nt, Human
aaucuguccaaaggaggcugg

SEQ ID NO: 2592998 - RNA, 14 nt, Human
aaucucaaauuucu

SEQ ID NO: 2592999 - RNA, 22 nt, Human
aaucugucacguagaacuugga

SEQ ID NO: 2593000 - RNA, 12 nt, Human
aaucucaaauuu

SEQ ID NO: 2593001 - RNA, 15 nt, Human
aaucucaaauaacua

SEQ ID NO: 2593002 - RNA, 22 nt, Human
aaucuagauaucgacuuguuuu

SEQ ID NO: 2593003 - RNA, 17 nt, Human
aaucuacuaauuccaca

SEQ ID NO: 2593004 - RNA, 19 nt, Human
aaucuaguauuucaugcug

SEQ ID NO: 2593005 - RNA, 16 nt, Human
aaucuagcuuauuuug

SEQ ID NO: 2593006 - RNA, 22 nt, Human
aauauugcugauggugcaauga

SEQ ID NO: 2593007 - RNA, 21 nt, Human
aauauugcugauggugcaaug

SEQ ID NO: 2593008 - RNA, 18 nt, Human
aauauugcugauggugca

SEQ ID NO: 2593009 - RNA, 15 nt, Human
aauauugcugauggu

SEQ ID NO: 2593010 - RNA, 13 nt, Human
aauauugcugaug

SEQ ID NO: 2593011 - RNA, 12 nt, Human
aauauugcugau

SEQ ID NO: 2593012 - RNA, 20 nt, Human
aauauugauuucugccuucc

SEQ ID NO: 2593013 - RNA, 17 nt, Human
aauaugcaaugugaagc

SEQ ID NO: 2593014 - RNA, 11 nt, Human
aauauugcuga

SEQ ID NO: 2593015 - RNA, 15 nt, Human
aauaugcaaagcacu

SEQ ID NO: 2593016 - RNA, 17 nt, Human
aauaugcaaagcacuga

SEQ ID NO: 2593017 - RNA, 18 nt, Human
aauaugauuaguaaagaa

SEQ ID NO: 2593018 - RNA, 19 nt, Human
aauaugauuaguaaagaaa

SEQ ID NO: 2593019 - RNA, 12 nt, Human
aauaugauuuua

SEQ ID NO: 2593020 - RNA, 20 nt, Human
aauaugauuaguaaagaaau

SEQ ID NO: 2593021 - RNA, 22 nt, Human
aauaugauuaguaaagaaauga

SEQ ID NO: 2593022 - RNA, 11 nt, Human
aauaugaugac

SEQ ID NO: 2593023 - RNA, 19 nt, Human
aauaugacggaagaacaua

SEQ ID NO: 2593024 - RNA, 17 nt, Human
aauaugauauugcauau

SEQ ID NO: 2593025 - RNA, 24 nt, Human
aauaugcaaagcacugacuucuaa

SEQ ID NO: 2593026 - RNA, 15 nt, Human
aauaugcacacauuu

SEQ ID NO: 2593027 - RNA, 18 nt, Human
aauauugauaugcuuaua

SEQ ID NO: 2593028 - RNA, 17 nt, Human
aauauugauaugcuuau

SEQ ID NO: 2593029 - RNA, 18 nt, Human
aauaugcacacagugcuu

SEQ ID NO: 2593030 - RNA, 16 nt, Human
aauauuuccauaugga

SEQ ID NO: 2593031 - RNA, 13 nt, Human
aauauuuccauau

SEQ ID NO: 2593032 - RNA, 16 nt, Human
aauauuuaaacagcag

SEQ ID NO: 2593033 - RNA, 17 nt, Human
aauauuuaaacagcagu

SEQ ID NO: 2593034 - RNA, 11 nt, Human
aauauuugaau

SEQ ID NO: 2593035 - RNA, 23 nt, Human
aauauuuccauauggauuuucua

SEQ ID NO: 2593036 - RNA, 19 nt, Human
aauauuuccuuaaacugug

SEQ ID NO: 2593037 - RNA, 15 nt, Human
aauauuucagauaau

SEQ ID NO: 2593038 - RNA, 14 nt, Human
aauauuuaaacagc

SEQ ID NO: 2593039 - RNA, 12 nt, Human
aauauuuaaaca

SEQ ID NO: 2593040 - RNA, 20 nt, Human
aauauuuaaaauuuauugcu

SEQ ID NO: 2593041 - RNA, 13 nt, Human
aauauuguuucua

SEQ ID NO: 2593042 - RNA, 20 nt, Human
aauauugcuuuggucauaug

SEQ ID NO: 2593043 - RNA, 18 nt, Human
aauauuguguugugaaug

SEQ ID NO: 2593044 - RNA, 13 nt, Human
aauauuguacagu

SEQ ID NO: 2593045 - RNA, 18 nt, Human
aauauuuuaaguauugca

SEQ ID NO: 2593046 - RNA, 17 nt, Human
aauauuuuaaguauugc

SEQ ID NO: 2593047 - RNA, 14 nt, Human
aauauuugaaucuu

SEQ ID NO: 2593048 - RNA, 15 nt, Human
aauauuuuaaguauu

SEQ ID NO: 2593049 - RNA, 21 nt, Human
aauauuuccuuaaacugugug

SEQ ID NO: 2593050 - RNA, 13 nt, Human
aauauuugaaucu

SEQ ID NO: 2593051 - RNA, 12 nt, Human
aauauuugaauc

SEQ ID NO: 2593052 - RNA, 13 nt, Human
aauauuuuaagua

SEQ ID NO: 2593053 - RNA, 12 nt, Human
aaucagaacuca

SEQ ID NO: 2593054 - RNA, 23 nt, Human
aaucagaacucaaauggggccag

SEQ ID NO: 2593055 - RNA, 11 nt, Human
aaucagaacuc

SEQ ID NO: 2593056 - RNA, 16 nt, Human
aaucacuuaggaaaug

SEQ ID NO: 2593057 - RNA, 18 nt, Human
aauauuuucauacagcau

SEQ ID NO: 2593058 - RNA, 11 nt, Human
aauauuuucau

SEQ ID NO: 2593059 - RNA, 17 nt, Human
aauauuuuauuauauau

SEQ ID NO: 2593060 - RNA, 21 nt, Human
aauauuuuccaugaaaaugca

SEQ ID NO: 2593061 - RNA, 20 nt, Human
uaagacaugauuuccuugaa

SEQ ID NO: 2593062 - RNA, 21 nt, Human
uaagacaugauuuccuugaau

SEQ ID NO: 2593063 - RNA, 17 nt, Human
uaagacauuuuuggaag

SEQ ID NO: 2593064 - RNA, 21 nt, Human
uaagaaugcugguuuuccuaa

SEQ ID NO: 2593065 - RNA, 23 nt, Human
uaagaaugcugguuuuccuaaau

SEQ ID NO: 2593066 - RNA, 17 nt, Human
uaagaaugguugccuua

SEQ ID NO: 2593067 - RNA, 22 nt, Human
uaagaaugcugguuuuccuaaa

SEQ ID NO: 2593068 - RNA, 18 nt, Human
uaagaccaccaccucaga

SEQ ID NO: 2593069 - RNA, 17 nt, Human
uaagaccaccaccucag

SEQ ID NO: 2593070 - RNA, 21 nt, Human
uaagacaugcacuaugaggaa

SEQ ID NO: 2593071 - RNA, 19 nt, Human
uaagaccauaacagccaac

SEQ ID NO: 2593072 - RNA, 15 nt, Human
uaagaauauuugaau

SEQ ID NO: 2593073 - RNA, 18 nt, Human
uaagaauauuugaaugua

SEQ ID NO: 2593074 - RNA, 15 nt, Human
uaagaaugaaauacu

SEQ ID NO: 2593075 - RNA, 21 nt, Human
uaagaaugaaauacuguuuga

SEQ ID NO: 2593076 - RNA, 15 nt, Human
uaagaaugcugguuu

SEQ ID NO: 2593077 - RNA, 14 nt, Human
uaagaaucuuuaga

SEQ ID NO: 2593078 - RNA, 13 nt, Human
uaagaaugaaaua

SEQ ID NO: 2593079 - RNA, 23 nt, Human
uaacuaauaugggcauuguaguu

SEQ ID NO: 2593080 - RNA, 23 nt, Human
uaacuaaucuauuggguucauua

SEQ ID NO: 2593081 - RNA, 19 nt, Human
uaacuaaucuauuggguuc

SEQ ID NO: 2593082 - RNA, 22 nt, Human
uaacuaaucuauuggguucauu

SEQ ID NO: 2593083 - RNA, 17 nt, Human
uaacuaaacucucuuug

SEQ ID NO: 2593084 - RNA, 14 nt, Human
uaacuaaacucucu

SEQ ID NO: 2593085 - RNA, 14 nt, Human
uaacuaaauuaaca

SEQ ID NO: 2593086 - RNA, 16 nt, Human
uaacuaaauuaacauu

SEQ ID NO: 2593087 - RNA, 17 nt, Human
uaacuuuuauaaacuuu

SEQ ID NO: 2593088 - RNA, 18 nt, Human
uaacuuuuauaaacuuua

SEQ ID NO: 2593089 - RNA, 15 nt, Human
uaacuuuuauaaacu

SEQ ID NO: 2593090 - RNA, 17 nt, Human
uaacuacuccggagaca

SEQ ID NO: 2593091 - RNA, 21 nt, Human
uaacuacuccggagacagggu

SEQ ID NO: 2593092 - RNA, 12 nt, Human
uaacuacugugu

SEQ ID NO: 2593093 - RNA, 14 nt, Human
uaacuacuguguuc

SEQ ID NO: 2593094 - RNA, 15 nt, Human
uaacuacuguguucc

SEQ ID NO: 2593095 - RNA, 16 nt, Human
uaacuacuguguuccu

SEQ ID NO: 2593096 - RNA, 17 nt, Human
uaacuacuguguuccug

SEQ ID NO: 2593097 - RNA, 23 nt, Human
aauaucuguauuuaauuuugaca

SEQ ID NO: 2593098 - RNA, 22 nt, Human
aauaucuguauuuaauuuugac

SEQ ID NO: 2593099 - RNA, 21 nt, Human
aauaucuguauuuaauuuuga

SEQ ID NO: 2593100 - RNA, 20 nt, Human
aauaucuguauuuaauuuug

SEQ ID NO: 2593101 - RNA, 14 nt, Human
aauaucuguauuua

SEQ ID NO: 2593102 - RNA, 13 nt, Human
aauaucuguauuu

SEQ ID NO: 2593103 - RNA, 20 nt, Human
aauaucugaaaauguaugug

SEQ ID NO: 2593104 - RNA, 13 nt, Human
aauaucugaaaug

SEQ ID NO: 2593105 - RNA, 21 nt, Human
aauaucugggauucuacuuua

SEQ ID NO: 2593106 - RNA, 13 nt, Human
aauaucugggauu

SEQ ID NO: 2593107 - RNA, 19 nt, Human
aauaucuuuuuuuuaauaa

SEQ ID NO: 2593108 - RNA, 15 nt, Human
aauaucuuuugaccu

SEQ ID NO: 2593109 - RNA, 13 nt, Human
aauaugaaaacuu

SEQ ID NO: 2593110 - RNA, 14 nt, Human
aauaugaaaacuua

SEQ ID NO: 2593111 - RNA, 19 nt, Human
aauaugaacggugagcauu

SEQ ID NO: 2593112 - RNA, 18 nt, Human
aauaugaagcucaccugu

SEQ ID NO: 2593113 - RNA, 18 nt, Human
aauaugaauacagggcau

SEQ ID NO: 2593114 - RNA, 12 nt, Human
aauaugaaugcc

SEQ ID NO: 2593115 - RNA, 12 nt, Human
aauaugaagcuc

SEQ ID NO: 2593116 - RNA, 22 nt, Human
aauaugaaugcccccagcuggc

SEQ ID NO: 2593117 - RNA, 16 nt, Human
aauaugacagcugucc

SEQ ID NO: 2593118 - RNA, 22 nt, Human
aauaugacagcugucccuguca

SEQ ID NO: 2593119 - RNA, 17 nt, Human
aauaugacggaagaaca

SEQ ID NO: 2593120 - RNA, 21 nt, Human
aauaugacggaagaacauaga

SEQ ID NO: 2593121 - RNA, 19 nt, Human
aauaugaggcauuuggcau

SEQ ID NO: 2593122 - RNA, 16 nt, Human
aauaugagaaucagau

SEQ ID NO: 2593123 - RNA, 16 nt, Human
aauaucugaaaaugua

SEQ ID NO: 2593124 - RNA, 17 nt, Human
aauaucugaaaauguau

SEQ ID NO: 2593125 - RNA, 18 nt, Human
aauaucugaaaauguaug

SEQ ID NO: 2593126 - RNA, 19 nt, Human
aauaucugaaaauguaugu

SEQ ID NO: 2593127 - RNA, 18 nt, Human
aauaucuaauaaaaaguc

SEQ ID NO: 2593128 - RNA, 11 nt, Human
uaagaccuggc

SEQ ID NO: 2593129 - RNA, 12 nt, Human
aauauccuuugc

SEQ ID NO: 2593130 - RNA, 23 nt, Human
aauauauggcagaguuguaaaua

SEQ ID NO: 2593131 - RNA, 15 nt, Human
aauaguauuugagag

SEQ ID NO: 2593132 - RNA, 22 nt, Human
aauauauggcagaguuguaaau

SEQ ID NO: 2593133 - RNA, 21 nt, Human
aauauauggcagaguuguaaa

SEQ ID NO: 2593134 - RNA, 18 nt, Human
aauaguauuuaugaaaug

SEQ ID NO: 2593135 - RNA, 20 nt, Human
aauaguauccuccagguuuu

SEQ ID NO: 2593136 - RNA, 18 nt, Human
aauaguauccuccagguu

SEQ ID NO: 2593137 - RNA, 17 nt, Human
aauaguauccuccaggu

SEQ ID NO: 2593138 - RNA, 15 nt, Human
aauaguauccuccag

SEQ ID NO: 2593139 - RNA, 23 nt, Human
aauaguauccuccagguuuuuca

SEQ ID NO: 2593140 - RNA, 21 nt, Human
aauaguauccuccagguuuuu

SEQ ID NO: 2593141 - RNA, 13 nt, Human
aauaguauuuaug

SEQ ID NO: 2593142 - RNA, 12 nt, Human
aauaucacuugu

SEQ ID NO: 2593143 - RNA, 23 nt, Human
aauauauguuuaccuuuuaauua

SEQ ID NO: 2593144 - RNA, 13 nt, Human
aauauauuauaau

SEQ ID NO: 2593145 - RNA, 16 nt, Human
aauauauuauaaucuu

SEQ ID NO: 2593146 - RNA, 12 nt, Human
aauauauguuua

SEQ ID NO: 2593147 - RNA, 20 nt, Human
aauauauguuuaccuuuuaa

SEQ ID NO: 2593148 - RNA, 13 nt, Human
aauauauguuuac

SEQ ID NO: 2593149 - RNA, 19 nt, Human
aauaucccuacauguauug

SEQ ID NO: 2593150 - RNA, 18 nt, Human
aauaucccuacauguauu

SEQ ID NO: 2593151 - RNA, 17 nt, Human
aauaucccuacauguau

SEQ ID NO: 2593152 - RNA, 16 nt, Human
aauaucccuacaugua

SEQ ID NO: 2593153 - RNA, 16 nt, Human
aauauccccucccagu

SEQ ID NO: 2593154 - RNA, 20 nt, Human
aauauauggcagaguuguaa

SEQ ID NO: 2593155 - RNA, 13 nt, Human
aauaucauuuauu

SEQ ID NO: 2593156 - RNA, 23 nt, Human
aauaucauuuauuuuuuacauua

SEQ ID NO: 2593157 - RNA, 15 nt, Human
aauaucacuugucaa

SEQ ID NO: 2593158 - RNA, 18 nt, Human
aauaucaucaguauugaa

SEQ ID NO: 2593159 - RNA, 16 nt, Human
aauaucaucaguauug

SEQ ID NO: 2593160 - RNA, 14 nt, Human
uaacuaaaagguau

SEQ ID NO: 2593161 - RNA, 12 nt, Human
uaaccuggugcu

SEQ ID NO: 2593162 - RNA, 15 nt, Human
uaaccuggugcugga

SEQ ID NO: 2593163 - RNA, 18 nt, Human
uaaccuggugcuggauau

SEQ ID NO: 2593164 - RNA, 19 nt, Human
uaaccuggugcuggauauu

SEQ ID NO: 2593165 - RNA, 22 nt, Human
uaaccuggugcuggauauuuuc

SEQ ID NO: 2593166 - RNA, 23 nt, Human
uaaccuggugcuggauauuuuca

SEQ ID NO: 2593167 - RNA, 19 nt, Human
uaaccuguacuucaaguua

SEQ ID NO: 2593168 - RNA, 15 nt, Human
uaacuaaaagguaug

SEQ ID NO: 2593169 - RNA, 15 nt, Human
uaacauggaaguacu

SEQ ID NO: 2593170 - RNA, 16 nt, Human
uaacauggaaguacua

SEQ ID NO: 2593171 - RNA, 18 nt, Human
uaaccucaucuucuucac

SEQ ID NO: 2593172 - RNA, 14 nt, Human
uaaccucugcacua

SEQ ID NO: 2593173 - RNA, 17 nt, Human
uaaccucuucagaggcc

SEQ ID NO: 2593174 - RNA, 20 nt, Human
uaaccugaccgugggcgggg

SEQ ID NO: 2593175 - RNA, 19 nt, Human
uaaccugccagggagacag

SEQ ID NO: 2593176 - RNA, 14 nt, Human
uaacauggaaguac

SEQ ID NO: 2593177 - RNA, 19 nt, Human
uaacauaauuuguacauau

SEQ ID NO: 2593178 - RNA, 14 nt, Human
uaacaugauuuggg

SEQ ID NO: 2593179 - RNA, 16 nt, Human
uaacauaauuuguaca

SEQ ID NO: 2593180 - RNA, 15 nt, Human
aauagauuauaguug

SEQ ID NO: 2593181 - RNA, 16 nt, Human
aauagaugcugacugu

SEQ ID NO: 2593182 - RNA, 21 nt, Human
aauagccaacacccaucuguu

SEQ ID NO: 2593183 - RNA, 20 nt, Human
aauagccacauuuggaauac

SEQ ID NO: 2593184 - RNA, 22 nt, Human
aauagccacauuuggaauacuu

SEQ ID NO: 2593185 - RNA, 23 nt, Human
aauagccacauuuggaauacuuu

SEQ ID NO: 2593186 - RNA, 14 nt, Human
aauagcugggacua

SEQ ID NO: 2593187 - RNA, 13 nt, Human
aauagcugggacu

SEQ ID NO: 2593188 - RNA, 20 nt, Human
aauagccugccucuucucua

SEQ ID NO: 2593189 - RNA, 22 nt, Human
aauagccacuuaccuucaauaa

SEQ ID NO: 2593190 - RNA, 22 nt, Human
aauagccaacacccaucuguuu

SEQ ID NO: 2593191 - RNA, 20 nt, Human
aauagccacuuaccuucaau

SEQ ID NO: 2593192 - RNA, 23 nt, Human
aauagccacugcauaccaaccug

SEQ ID NO: 2593193 - RNA, 18 nt, Human
aauagacaauuuauuaug

SEQ ID NO: 2593194 - RNA, 13 nt, Human
uaaauuuugugau

SEQ ID NO: 2593195 - RNA, 17 nt, Human
uaaauuuuguaugaaaa

SEQ ID NO: 2593196 - RNA, 15 nt, Human
uaaauuuugugucuc

SEQ ID NO: 2593197 - RNA, 19 nt, Human
uaaauuuugaguucuacau

SEQ ID NO: 2593198 - RNA, 18 nt, Human
uaaauuuugaguucuaca

SEQ ID NO: 2593199 - RNA, 20 nt, Human
uaaauuuugucuuuaacuca

SEQ ID NO: 2593200 - RNA, 18 nt, Human
uaaauuaaaacugaauug

SEQ ID NO: 2593201 - RNA, 14 nt, Human
uaaauuuuuuuccu

SEQ ID NO: 2593202 - RNA, 22 nt, Human
aauagacacuccccgaagucuu

SEQ ID NO: 2593203 - RNA, 23 nt, Human
aauagacacuccccgaagucuuu

SEQ ID NO: 2593204 - RNA, 23 nt, Human
aauagacaauuuauuauggcaca

SEQ ID NO: 2593205 - RNA, 15 nt, Human
aauagacaguauauu

SEQ ID NO: 2593206 - RNA, 20 nt, Human
aauagacaguauauuuauag

SEQ ID NO: 2593207 - RNA, 20 nt, Human
aauagauaagaguagaaacu

SEQ ID NO: 2593208 - RNA, 22 nt, Human
aauagaguuugcuauuagagca

SEQ ID NO: 2593209 - RNA, 21 nt, Human
aauagauauccacuugagaca

SEQ ID NO: 2593210 - RNA, 21 nt, Human
aauagggcugagcucucugug

SEQ ID NO: 2593211 - RNA, 22 nt, Human
aauaggcgaucacaacgugcau

SEQ ID NO: 2593212 - RNA, 22 nt, Human
aauaguaaaagauaacaagauc

SEQ ID NO: 2593213 - RNA, 14 nt, Human
aauaguauccucca

SEQ ID NO: 2593214 - RNA, 13 nt, Human
aauaguaauguuu

SEQ ID NO: 2593215 - RNA, 18 nt, Human
aauaggcguaacuaauuu

SEQ ID NO: 2593216 - RNA, 15 nt, Human
aauaggagaggauga

SEQ ID NO: 2593217 - RNA, 13 nt, Human
aauaggagaggau

SEQ ID NO: 2593218 - RNA, 20 nt, Human
aauaggagaggaugagagcc

SEQ ID NO: 2593219 - RNA, 21 nt, Human
aauagcuauauccauguacug

SEQ ID NO: 2593220 - RNA, 23 nt, Human
aauaggagaggaugagagcccag

SEQ ID NO: 2593221 - RNA, 13 nt, Human
aauaggcaaaggg

SEQ ID NO: 2593222 - RNA, 16 nt, Human
aauaggaaaaacugau

SEQ ID NO: 2593223 - RNA, 15 nt, Human
aauaggaaaaacuga

SEQ ID NO: 2593224 - RNA, 19 nt, Human
aauagcuuguauaguguaa

SEQ ID NO: 2593225 - RNA, 14 nt, Human
aauagcuuguauag

SEQ ID NO: 2593226 - RNA, 22 nt, Human
aauagcuauauccauguacugu

SEQ ID NO: 2593227 - RNA, 19 nt, Human
aauagcucuuucagggggg

SEQ ID NO: 2593228 - RNA, 23 nt, Human
aauagcuauauccauguacugua

SEQ ID NO: 2593229 - RNA, 18 nt, Human
aauaggaaaaacugauuu

SEQ ID NO: 2593230 - RNA, 17 nt, Human
aauaggaaaaacugauu

SEQ ID NO: 2593231 - RNA, 19 nt, Human
aauaggaaaaacugauuuu

SEQ ID NO: 2593232 - RNA, 17 nt, Human
aauagcuuuuauuguau

SEQ ID NO: 2593233 - RNA, 21 nt, Human
aauagcuuuacccucaggcau

SEQ ID NO: 2593234 - RNA, 21 nt, Human
uaaaucuaugaaguauauaau

SEQ ID NO: 2593235 - RNA, 19 nt, Human
uaaaucuaugaaguauaua

SEQ ID NO: 2593236 - RNA, 15 nt, Human
uaaauagcauucucu

SEQ ID NO: 2593237 - RNA, 21 nt, Human
uaaauagcauguauugugucu

SEQ ID NO: 2593238 - RNA, 19 nt, Human
uaaauagcauguauugugu

SEQ ID NO: 2593239 - RNA, 21 nt, Human
uaaaucuaguauacauugucu

SEQ ID NO: 2593240 - RNA, 14 nt, Human
uaaaucuccaaaau

SEQ ID NO: 2593241 - RNA, 15 nt, Human
uaaaucuccaaaaua

SEQ ID NO: 2593242 - RNA, 18 nt, Human
uaaaucuccaaaauaaaa

SEQ ID NO: 2593243 - RNA, 18 nt, Human
uaaauagcauguauugug

SEQ ID NO: 2593244 - RNA, 15 nt, Human
uaaauagcauguauu

SEQ ID NO: 2593245 - RNA, 14 nt, Human
uaaauagcauguau

SEQ ID NO: 2593246 - RNA, 13 nt, Human
uaaauagcaugua

SEQ ID NO: 2593247 - RNA, 12 nt, Human
uaaauagcaugu

SEQ ID NO: 2593248 - RNA, 18 nt, Human
uaaauagaguauaugcac

SEQ ID NO: 2593249 - RNA, 18 nt, Human
uaaauagaguuugcuauu

SEQ ID NO: 2593250 - RNA, 12 nt, Human
uaaaucugugau

SEQ ID NO: 2593251 - RNA, 20 nt, Human
uaaaucuguugccaagcugg

SEQ ID NO: 2593252 - RNA, 18 nt, Human
uaaaucuguugccaagcu

SEQ ID NO: 2593253 - RNA, 14 nt, Human
uaaaucugugauga

SEQ ID NO: 2593254 - RNA, 13 nt, Human
uaaaucugugaug

SEQ ID NO: 2593255 - RNA, 15 nt, Human
uaaaucugugaugau

SEQ ID NO: 2593256 - RNA, 15 nt, Human
uaaaucugacccagu

SEQ ID NO: 2593257 - RNA, 16 nt, Human
uaaaucugacccagug

SEQ ID NO: 2593258 - RNA, 17 nt, Human
uaaaucugacccagugc

SEQ ID NO: 2593259 - RNA, 20 nt, Human
uaaaucugcuggaguuucau

SEQ ID NO: 2593260 - RNA, 22 nt, Human
uaaaucuccaaaauaaaacuuu

SEQ ID NO: 2593261 - RNA, 20 nt, Human
uaaaucuaugaaguauauaa

SEQ ID NO: 2593262 - RNA, 14 nt, Human
uaaaucugacccag

SEQ ID NO: 2593263 - RNA, 18 nt, Human
uaaaucucuaauauggca

SEQ ID NO: 2593264 - RNA, 15 nt, Human
uaaaucucuaauaug

SEQ ID NO: 2593265 - RNA, 14 nt, Human
uaaaucucuaauau

SEQ ID NO: 2593266 - RNA, 10 nt, Human
uaaaugcaua

SEQ ID NO: 2593267 - RNA, 22 nt, Human
uaaaugcagcgaaccaauauuu

SEQ ID NO: 2593268 - RNA, 14 nt, Human
uaaaugcauuauag

SEQ ID NO: 2593269 - RNA, 16 nt, Human
uaaaugcauaaaugca

SEQ ID NO: 2593270 - RNA, 20 nt, Human
uaaaugcauauccugagcca

SEQ ID NO: 2593271 - RNA, 21 nt, Human
uaaaugcauauccugagccau

SEQ ID NO: 2593272 - RNA, 23 nt, Human
uaaaugcaccuggaauauauaac

SEQ ID NO: 2593273 - RNA, 14 nt, Human
uaaaucuuuuacaa

SEQ ID NO: 2593274 - RNA, 14 nt, Human
uaaaugcaauaugu

SEQ ID NO: 2593275 - RNA, 15 nt, Human
uaaaugcaauaugua

SEQ ID NO: 2593276 - RNA, 19 nt, Human
uaaaugcaauauuaaugcc

SEQ ID NO: 2593277 - RNA, 18 nt, Human
uaaaugcaauauguauua

SEQ ID NO: 2593278 - RNA, 15 nt, Human
uaaauguugaaagau

SEQ ID NO: 2593279 - RNA, 23 nt, Human
uaaauguuuuuuuuuaaagacuu

SEQ ID NO: 2593280 - RNA, 20 nt, Human
uaaauguugaaagaucaaaa

SEQ ID NO: 2593281 - RNA, 17 nt, Human
uaaauuuugaguucuac

SEQ ID NO: 2593282 - RNA, 18 nt, Human
uaaauuaacuuuuauaaa

SEQ ID NO: 2593283 - RNA, 17 nt, Human
uaaauuaacuuuuauaa

SEQ ID NO: 2593284 - RNA, 15 nt, Human
uaaauuaacuuuuau

SEQ ID NO: 2593285 - RNA, 16 nt, Human
uaaauuaacuuuuaua

SEQ ID NO: 2593286 - RNA, 12 nt, Human
uaaauuaacuuu

SEQ ID NO: 2593287 - RNA, 14 nt, Human
uaaauuaacuuuua

SEQ ID NO: 2593288 - RNA, 24 nt, Human
uaaauguuuuuuuuuaaagacuuu

SEQ ID NO: 2593289 - RNA, 20 nt, Human
uaaauaaaguaucaugcauu

SEQ ID NO: 2593290 - RNA, 15 nt, Human
uaaauaaaguaucau

SEQ ID NO: 2593291 - RNA, 14 nt, Human
uaaauaaaguauca

SEQ ID NO: 2593292 - RNA, 22 nt, Human
aauacaacauguagcugaguuu

SEQ ID NO: 2593293 - RNA, 14 nt, Human
uaaauaaauauaua

SEQ ID NO: 2593294 - RNA, 13 nt, Human
uaaauaaauauau

SEQ ID NO: 2593295 - RNA, 12 nt, Human
uaaauaaauaua

SEQ ID NO: 2593296 - RNA, 21 nt, Human
uaaauaaaguaucaugcauuc

SEQ ID NO: 2593297 - RNA, 21 nt, Human
uaaauaaaguuuguugaaaca

SEQ ID NO: 2593298 - RNA, 12 nt, Human
uaaauaaaguuu

SEQ ID NO: 2593299 - RNA, 20 nt, Human
aauaauuuuuauauuugaaa

SEQ ID NO: 2593300 - RNA, 12 nt, Human
aauacaaaacuu

SEQ ID NO: 2593301 - RNA, 20 nt, Human
aauacaaaaauuagccgggc

SEQ ID NO: 2593302 - RNA, 21 nt, Human
aauacaaaaaauuagccgggc

SEQ ID NO: 2593303 - RNA, 13 nt, Human
aauacaaaacuuc

SEQ ID NO: 2593304 - RNA, 17 nt, Human
aauacaaacaccuggac

SEQ ID NO: 2593305 - RNA, 13 nt, Human
aauacaaacaaug

SEQ ID NO: 2593306 - RNA, 21 nt, Human
aauacaaacauauuuguuaaa

SEQ ID NO: 2593307 - RNA, 17 nt, Human
aauacaaacauauuugu

SEQ ID NO: 2593308 - RNA, 20 nt, Human
aauacaaacauauuuguuaa

SEQ ID NO: 2593309 - RNA, 18 nt, Human
aauacaacuuaaauaaua

SEQ ID NO: 2593310 - RNA, 13 nt, Human
uaaauacagucuu

SEQ ID NO: 2593311 - RNA, 17 nt, Human
uaaauacagucuuccau

SEQ ID NO: 2593312 - RNA, 22 nt, Human
uaaauacagacacuaaguuaua

SEQ ID NO: 2593313 - RNA, 19 nt, Human
uaaauacagacacuaaguu

SEQ ID NO: 2593314 - RNA, 18 nt, Human
uaaauacagacacuaagu

SEQ ID NO: 2593315 - RNA, 17 nt, Human
uaaauacagacacuaag

SEQ ID NO: 2593316 - RNA, 20 nt, Human
uaaauacagucuuccauuug

SEQ ID NO: 2593317 - RNA, 22 nt, Human
uaaauacagucuuccauuugca

SEQ ID NO: 2593318 - RNA, 23 nt, Human
uaaauacagucuuccauuugcaa

SEQ ID NO: 2593319 - RNA, 17 nt, Human
uaaauaccagacacgua

SEQ ID NO: 2593320 - RNA, 23 nt, Human
uaaauaccucuuagcugagugga

SEQ ID NO: 2593321 - RNA, 13 nt, Human
uaaauaccucuua

SEQ ID NO: 2593322 - RNA, 22 nt, Human
uaaauaccucaaccuaugguau

SEQ ID NO: 2593323 - RNA, 19 nt, Human
uaaauaaugugaaacugga

SEQ ID NO: 2593324 - RNA, 20 nt, Human
uaaauaaguuugcaauuugg

SEQ ID NO: 2593325 - RNA, 21 nt, Human
uaaauaagaaacaacucuuug

SEQ ID NO: 2593326 - RNA, 22 nt, Human
uaaauaagaaacaacucuuuga

SEQ ID NO: 2593327 - RNA, 16 nt, Human
uaaauaaaucauuaau

SEQ ID NO: 2593328 - RNA, 15 nt, Human
uaaauaaauauauau

SEQ ID NO: 2593329 - RNA, 13 nt, Human
uaaauaacuuuuu

SEQ ID NO: 2593330 - RNA, 21 nt, Human
aauaauuuuaagaaaucaaag

SEQ ID NO: 2593331 - RNA, 16 nt, Human
aauaauuuuaaacaaa

SEQ ID NO: 2593332 - RNA, 14 nt, Human
aauaacuccuucuu

SEQ ID NO: 2593333 - RNA, 21 nt, Human
aauaauuuccuggugugaagg

SEQ ID NO: 2593334 - RNA, 20 nt, Human
aauaauuuccuggugugaag

SEQ ID NO: 2593335 - RNA, 22 nt, Human
aauaauuucccaauuaggaagu

SEQ ID NO: 2593336 - RNA, 19 nt, Human
aauaauuuuuauauuugaa

SEQ ID NO: 2593337 - RNA, 17 nt, Human
aauaauuuuuauauuug

SEQ ID NO: 2593338 - RNA, 16 nt, Human
aauaauuuuuauauuu

SEQ ID NO: 2593339 - RNA, 14 nt, Human
aauaagaauuuagg

SEQ ID NO: 2593340 - RNA, 14 nt, Human
aauaagaaugauuu

SEQ ID NO: 2593341 - RNA, 18 nt, Human
aauaagaauagaaauaaa

SEQ ID NO: 2593342 - RNA, 14 nt, Human
aauaagagaaagaa

SEQ ID NO: 2593343 - RNA, 17 nt, Human
aauaagacauaacguuu

SEQ ID NO: 2593344 - RNA, 15 nt, Human
aauaagagaaagaaa

SEQ ID NO: 2593345 - RNA, 20 nt, Human
aauaagagagucauaaaccu

SEQ ID NO: 2593346 - RNA, 18 nt, Human
aauaauuauuuauuuaau

SEQ ID NO: 2593347 - RNA, 21 nt, Human
aauaauugaucaaauucauuu

SEQ ID NO: 2593348 - RNA, 14 nt, Human
aauaauugguucuu

SEQ ID NO: 2593349 - RNA, 21 nt, Human
aauaauugcagaacuaaacuc

SEQ ID NO: 2593350 - RNA, 16 nt, Human
aauaauugcagaacua

SEQ ID NO: 2593351 - RNA, 20 nt, Human
aauaauugauuucaagaccu

SEQ ID NO: 2593352 - RNA, 16 nt, Human
aauaacugugaaguuu

SEQ ID NO: 2593353 - RNA, 14 nt, Human
aauaacugugaagu

SEQ ID NO: 2593354 - RNA, 20 nt, Human
aauaacugugaaguuuacau

SEQ ID NO: 2593355 - RNA, 15 nt, Human
aauaagaaaguuuca

SEQ ID NO: 2593356 - RNA, 22 nt, Human
aauaagaaacaacucuuugaga

SEQ ID NO: 2593357 - RNA, 13 nt, Human
aauaagaauagaa

SEQ ID NO: 2593358 - RNA, 12 nt, Human
aauaagaaaaga

SEQ ID NO: 2593359 - RNA, 12 nt, Human
aauaacuuuuuu

SEQ ID NO: 2593360 - RNA, 22 nt, Human
uaaaguaaaaacaaagaaauua

SEQ ID NO: 2593361 - RNA, 21 nt, Human
uaaaguaaaaacaaagaaauu

SEQ ID NO: 2593362 - RNA, 19 nt, Human
uaaaguaaaaacaaagaaa

SEQ ID NO: 2593363 - RNA, 22 nt, Human
uaaagguucaugcaaacuuuau

SEQ ID NO: 2593364 - RNA, 17 nt, Human
uaaaguaaagcuaaaau

SEQ ID NO: 2593365 - RNA, 15 nt, Human
uaaaguaaagcuaaa

SEQ ID NO: 2593366 - RNA, 14 nt, Human
uaaaguaaagcuaa

SEQ ID NO: 2593367 - RNA, 13 nt, Human
uaaaguaaagcua

SEQ ID NO: 2593368 - RNA, 20 nt, Human
uaaagguugacaauaaaugu

SEQ ID NO: 2593369 - RNA, 17 nt, Human
uaaaguaguccugugaa

SEQ ID NO: 2593370 - RNA, 19 nt, Human
uaaaguaguaaaaauuaaa

SEQ ID NO: 2593371 - RNA, 21 nt, Human
uaaaguagauuagaucuuuua

SEQ ID NO: 2593372 - RNA, 20 nt, Human
uaaaguaucaggauacuaua

SEQ ID NO: 2593373 - RNA, 14 nt, Human
uaaaguaucaugca

SEQ ID NO: 2593374 - RNA, 17 nt, Human
uaaaguauauauuuauu

SEQ ID NO: 2593375 - RNA, 19 nt, Human
uaaaguauauauagaaucu

SEQ ID NO: 2593376 - RNA, 14 nt, Human
uaaaguauauauuu

SEQ ID NO: 2593377 - RNA, 14 nt, Human
guuuucuuugaaug

SEQ ID NO: 2593378 - RNA, 18 nt, Human
guuuugaagcuacugugu

SEQ ID NO: 2593379 - RNA, 21 nt, Human
guuuugaaaagcuauuagcca

SEQ ID NO: 2593380 - RNA, 15 nt, Human
guuuugaaaagcuau

SEQ ID NO: 2593381 - RNA, 14 nt, Human
guuuugaaaagcua

SEQ ID NO: 2593382 - RNA, 13 nt, Human
guuuugaaaagcu

SEQ ID NO: 2593383 - RNA, 13 nt, Human
guuuugaaaugcu

SEQ ID NO: 2593384 - RNA, 17 nt, Human
guuuugaacuaauaaaa

SEQ ID NO: 2593385 - RNA, 22 nt, Human
guuuugaacuaauaaaagcaua

SEQ ID NO: 2593386 - RNA, 22 nt, Human
uaaagguuacaagccugcacaa

SEQ ID NO: 2593387 - RNA, 20 nt, Human
uaaaggugucuuccucccaa

SEQ ID NO: 2593388 - RNA, 19 nt, Human
uaaaggugucuuccuccca

SEQ ID NO: 2593389 - RNA, 17 nt, Human
uaaaggugucuuccucc

SEQ ID NO: 2593390 - RNA, 21 nt, Human
uaaagguggugaggcaauaaa

SEQ ID NO: 2593391 - RNA, 17 nt, Human
uaaaggugguaugugug

SEQ ID NO: 2593392 - RNA, 21 nt, Human
uaaaggugguaugugugugua

SEQ ID NO: 2593393 - RNA, 22 nt, Human
uaaaggugguauguguguguau

SEQ ID NO: 2593394 - RNA, 23 nt, Human
uaaaggugguauguguguguaug

SEQ ID NO: 2593395 - RNA, 20 nt, Human
uaaagguggugaggcaauaa

SEQ ID NO: 2593396 - RNA, 18 nt, Human
uaaaggguguacuuauau

SEQ ID NO: 2593397 - RNA, 19 nt, Human
guuuugaagcuacugugug

SEQ ID NO: 2593398 - RNA, 23 nt, Human
guuuugaacuaauaaaagcauaa

SEQ ID NO: 2593399 - RNA, 19 nt, Human
uaaaguaugguauugaaac

SEQ ID NO: 2593400 - RNA, 19 nt, Human
uaaaguaugaaucuaugcc

SEQ ID NO: 2593401 - RNA, 16 nt, Human
uaaaguaugaaucuau

SEQ ID NO: 2593402 - RNA, 15 nt, Human
uaaaguaugaaucua

SEQ ID NO: 2593403 - RNA, 14 nt, Human
uaaaguaugaaucu

SEQ ID NO: 2593404 - RNA, 17 nt, Human
uaaaguaucaugcauuc

SEQ ID NO: 2593405 - RNA, 16 nt, Human
uaaaguaucaugcauu

SEQ ID NO: 2593406 - RNA, 15 nt, Human
uaaaguaucaugcau

SEQ ID NO: 2593407 - RNA, 22 nt, Human
uaaaguauguaaacaggagaca

SEQ ID NO: 2593408 - RNA, 16 nt, Human
uaaaguauguaaacag

SEQ ID NO: 2593409 - RNA, 15 nt, Human
uaaaguauguaaaca

SEQ ID NO: 2593410 - RNA, 13 nt, Human
uaaaguauguaaa

SEQ ID NO: 2593411 - RNA, 22 nt, Human
uaaaguauguaaaguauguaaa

SEQ ID NO: 2593412 - RNA, 21 nt, Human
uaaaguauguaaaguauguaa

SEQ ID NO: 2593413 - RNA, 17 nt, Human
uaaaguauuuaauuagu

SEQ ID NO: 2593414 - RNA, 16 nt, Human
uaaaguauuuaauuag

SEQ ID NO: 2593415 - RNA, 14 nt, Human
uaaaguauuuaauu

SEQ ID NO: 2593416 - RNA, 12 nt, Human
uaaaguauuuaa

SEQ ID NO: 2593417 - RNA, 18 nt, Human
uaaaguauucuucucuuc

SEQ ID NO: 2593418 - RNA, 14 nt, Human
uaaaguauucuucu

SEQ ID NO: 2593419 - RNA, 13 nt, Human
uaaaguauucuuc

SEQ ID NO: 2593420 - RNA, 20 nt, Human
aaguuuuuauggcuuuugug

SEQ ID NO: 2593421 - RNA, 22 nt, Human
uaaaguauuuaauuagugcuaa

SEQ ID NO: 2593422 - RNA, 21 nt, Human
uaaaguauuuaauuagugcua

SEQ ID NO: 2593423 - RNA, 19 nt, Human
uaaaguauuuaauuagugc

SEQ ID NO: 2593424 - RNA, 14 nt, Human
aaguuuuguacaga

SEQ ID NO: 2593425 - RNA, 13 nt, Human
aaguuuuguacag

SEQ ID NO: 2593426 - RNA, 17 nt, Human
aauaaaaagaucacuuu

SEQ ID NO: 2593427 - RNA, 19 nt, Human
aauaaaaagaucacuuucu

SEQ ID NO: 2593428 - RNA, 13 nt, Human
aauaaaaaaaaga

SEQ ID NO: 2593429 - RNA, 14 nt, Human
aauaaaaaaaagaa

SEQ ID NO: 2593430 - RNA, 17 nt, Human
aaguuuuuguacuguaa

SEQ ID NO: 2593431 - RNA, 14 nt, Human
aaguuuuuguacug

SEQ ID NO: 2593432 - RNA, 13 nt, Human
aaguuuuuguacu

SEQ ID NO: 2593433 - RNA, 12 nt, Human
aaguuuuuguac

SEQ ID NO: 2593434 - RNA, 23 nt, Human
aauaaaaagaucacuuucucagu

SEQ ID NO: 2593435 - RNA, 11 nt, Human
aauaaaaaggc

SEQ ID NO: 2593436 - RNA, 13 nt, Human
aauaaaaaggcac

SEQ ID NO: 2593437 - RNA, 18 nt, Human
aauaaaaaggcaccuaua

SEQ ID NO: 2593438 - RNA, 19 nt, Human
aauaaaaagugacacagca

SEQ ID NO: 2593439 - RNA, 13 nt, Human
aauaaaaagugac

SEQ ID NO: 2593440 - RNA, 12 nt, Human
aauaaaaaguua

SEQ ID NO: 2593441 - RNA, 13 nt, Human
aauaaaaaguuaa

SEQ ID NO: 2593442 - RNA, 14 nt, Human
aauaaaaaguuaaa

SEQ ID NO: 2593443 - RNA, 20 nt, Human
aauaaaaagugacacagcag

SEQ ID NO: 2593444 - RNA, 15 nt, Human
aauaaaaaguuaaaa

SEQ ID NO: 2593445 - RNA, 13 nt, Human
aauaaaaccagcu

SEQ ID NO: 2593446 - RNA, 12 nt, Human
aauaaaaccuuu

SEQ ID NO: 2593447 - RNA, 13 nt, Human
aauaaaaccuuuc

SEQ ID NO: 2593448 - RNA, 14 nt, Human
aauaaaaccuuuca

SEQ ID NO: 2593449 - RNA, 23 nt, Human
aauaaaacauuuuaaauggacag

SEQ ID NO: 2593450 - RNA, 13 nt, Human
aauaaaacauuuu

SEQ ID NO: 2593451 - RNA, 12 nt, Human
aauaaaacauuu

SEQ ID NO: 2593452 - RNA, 11 nt, Human
aauaaaacauu

SEQ ID NO: 2593453 - RNA, 17 nt, Human
aauaaaacauuuucaca

SEQ ID NO: 2593454 - RNA, 19 nt, Human
aauaaaacauuuucacaca

SEQ ID NO: 2593455 - RNA, 18 nt, Human
aauaaaacuuuuuaaaau

SEQ ID NO: 2593456 - RNA, 15 nt, Human
aauaaaacuggcuuu

SEQ ID NO: 2593457 - RNA, 23 nt, Human
aauaaaaccuuucaaauuucaca

SEQ ID NO: 2593458 - RNA, 19 nt, Human
aauaaaguauuuaauuagu

SEQ ID NO: 2593459 - RNA, 16 nt, Human
aauaaaguauuuaauu

SEQ ID NO: 2593460 - RNA, 15 nt, Human
aauaaaguauuuaau

SEQ ID NO: 2593461 - RNA, 14 nt, Human
aauaaaguauuuaa

SEQ ID NO: 2593462 - RNA, 13 nt, Human
aauaaaguauuua

SEQ ID NO: 2593463 - RNA, 14 nt, Human
aauaaaguaucuac

SEQ ID NO: 2593464 - RNA, 19 nt, Human
aauaaaguaucaugcauuc

SEQ ID NO: 2593465 - RNA, 15 nt, Human
aauaaaguaucuaca

SEQ ID NO: 2593466 - RNA, 16 nt, Human
aauaaaguaucuacau

SEQ ID NO: 2593467 - RNA, 14 nt, Human
aauaaaacuuuuua

SEQ ID NO: 2593468 - RNA, 15 nt, Human
aauaaaacuuuuuaa

SEQ ID NO: 2593469 - RNA, 12 nt, Human
aauaaaacuuuu

SEQ ID NO: 2593470 - RNA, 15 nt, Human
aauaaaaccuuucaa

SEQ ID NO: 2593471 - RNA, 16 nt, Human
aauaaaaccuuucaaa

SEQ ID NO: 2593472 - RNA, 21 nt, Human
aauaaaaccuuucaaauuuca

SEQ ID NO: 2593473 - RNA, 22 nt, Human
aauaaaaccuuucaaauuucac

SEQ ID NO: 2593474 - RNA, 23 nt, Human
aauaaaguauuuaauuagugcua

SEQ ID NO: 2593475 - RNA, 22 nt, Human
aauaaaguauuuaauuagugcu

SEQ ID NO: 2593476 - RNA, 21 nt, Human
aauaaaguauuuaauuagugc

SEQ ID NO: 2593477 - RNA, 20 nt, Human
aauaaaguauuuaauuagug

SEQ ID NO: 2593478 - RNA, 11 nt, Human
aauaaauauga

SEQ ID NO: 2593479 - RNA, 10 nt, Human
aauaaauaug

SEQ ID NO: 2593480 - RNA, 15 nt, Human
aauaaauaucuguac

SEQ ID NO: 2593481 - RNA, 19 nt, Human
aauaaaguucugaguguuu

SEQ ID NO: 2593482 - RNA, 16 nt, Human
aauaaauaugccucuc

SEQ ID NO: 2593483 - RNA, 13 nt, Human
aauaaauaugccu

SEQ ID NO: 2593484 - RNA, 11 nt, Human
aauaaauaugc

SEQ ID NO: 2593485 - RNA, 13 nt, Human
aauaaauaugagu

SEQ ID NO: 2593486 - RNA, 20 nt, Human
aauaaauaugccucuccuuu

SEQ ID NO: 2593487 - RNA, 19 nt, Human
aauaaauaugccucuccuu

SEQ ID NO: 2593488 - RNA, 16 nt, Human
aauaaaucugacccag

SEQ ID NO: 2593489 - RNA, 17 nt, Human
aauaaaucugacccagu

SEQ ID NO: 2593490 - RNA, 20 nt, Human
aauaaaucugacccagugcc

SEQ ID NO: 2593491 - RNA, 22 nt, Human
aauaaaucuguugccaagcugg

SEQ ID NO: 2593492 - RNA, 20 nt, Human
aauaaaucugguagaaaaau

SEQ ID NO: 2593493 - RNA, 18 nt, Human
aauaaaugagcuauguau

SEQ ID NO: 2593494 - RNA, 16 nt, Human
aauaaaugagcuaugu

SEQ ID NO: 2593495 - RNA, 22 nt, Human
aauaaaugagcuauguauuaac

SEQ ID NO: 2593496 - RNA, 17 nt, Human
aauaaaugcaauaugua

SEQ ID NO: 2593497 - RNA, 19 nt, Human
aauaaaugcaauauguauu

SEQ ID NO: 2593498 - RNA, 16 nt, Human
aauaaaucauaaaacu

SEQ ID NO: 2593499 - RNA, 15 nt, Human
aauaaaucugaccca

SEQ ID NO: 2593500 - RNA, 21 nt, Human
aauaaaucauuaauacucuuc

SEQ ID NO: 2593501 - RNA, 14 nt, Human
aauaaauauuuaug

SEQ ID NO: 2593502 - RNA, 21 nt, Human
aauaacaaugaaaguugauaa

SEQ ID NO: 2593503 - RNA, 18 nt, Human
aauaaauuguauauucac

SEQ ID NO: 2593504 - RNA, 17 nt, Human
aauaaauuguauauuca

SEQ ID NO: 2593505 - RNA, 16 nt, Human
aauaaauuguauauuc

SEQ ID NO: 2593506 - RNA, 15 nt, Human
aauaaauuguauauu

SEQ ID NO: 2593507 - RNA, 13 nt, Human
aauaaauuguaua

SEQ ID NO: 2593508 - RNA, 12 nt, Human
aauaaauuguau

SEQ ID NO: 2593509 - RNA, 20 nt, Human
aauaaauuguaauuguaaag

SEQ ID NO: 2593510 - RNA, 20 nt, Human
aauaaauugcuccuugacau

SEQ ID NO: 2593511 - RNA, 16 nt, Human
aauaaauugcuccuug

SEQ ID NO: 2593512 - RNA, 14 nt, Human
aauaaaugucuugc

SEQ ID NO: 2593513 - RNA, 12 nt, Human
aauaaaugucuu

SEQ ID NO: 2593514 - RNA, 23 nt, Human
aauaaaugucuuuuuuuuaaugu

SEQ ID NO: 2593515 - RNA, 13 nt, Human
aauaaaugucuuu

SEQ ID NO: 2593516 - RNA, 23 nt, Human
aauaaaugguauagcaaauguuu

SEQ ID NO: 2593517 - RNA, 22 nt, Human
aauaaaugguauagcaaauguu

SEQ ID NO: 2593518 - RNA, 21 nt, Human
aauaaaugguauagcaaaugu

SEQ ID NO: 2593519 - RNA, 17 nt, Human
aauaaaugguauagcaa

SEQ ID NO: 2593520 - RNA, 21 nt, Human
aauaaauguaucuuauucaca

SEQ ID NO: 2593521 - RNA, 20 nt, Human
aauaaauguaucuuauucac

SEQ ID NO: 2593522 - RNA, 13 nt, Human
aauaaaugucauu

SEQ ID NO: 2593523 - RNA, 17 nt, Human
aauaaaugucauuaaaa

SEQ ID NO: 2593524 - RNA, 13 nt, Human
aauaacugugaag

SEQ ID NO: 2593525 - RNA, 21 nt, Human
aauaacuccuucuuguaguag

SEQ ID NO: 2593526 - RNA, 19 nt, Human
aauaacucuguggcauuau

SEQ ID NO: 2593527 - RNA, 15 nt, Human
aauaacgauaaaaga

SEQ ID NO: 2593528 - RNA, 17 nt, Human
aauaaccggauauauac

SEQ ID NO: 2593529 - RNA, 18 nt, Human
aauaaccucaaagugacu

SEQ ID NO: 2593530 - RNA, 22 nt, Human
aauaaccacuuaaaaaaugucc

SEQ ID NO: 2593531 - RNA, 18 nt, Human
aauaacccuuugguuuuu

SEQ ID NO: 2593532 - RNA, 24 nt, Human
aauaacaauguuaaggaaacucuu

SEQ ID NO: 2593533 - RNA, 20 nt, Human
aauaacaauguuaaggaaac

SEQ ID NO: 2593534 - RNA, 15 nt, Human
aauaacaauguuaag

SEQ ID NO: 2593535 - RNA, 14 nt, Human
aauaacaauguuaa

SEQ ID NO: 2593536 - RNA, 19 nt, Human
aauaacaaugugcucucgg

SEQ ID NO: 2593537 - RNA, 13 nt, Human
aauaacaauguua

SEQ ID NO: 2593538 - RNA, 13 nt, Human
aauaacaaugugc

SEQ ID NO: 2593539 - RNA, 13 nt, Human
aauaaauuguuug

SEQ ID NO: 2593540 - RNA, 13 nt, Human
aauaacauuaccu

SEQ ID NO: 2593541 - RNA, 15 nt, Human
aauaacacacagcua

SEQ ID NO: 2593542 - RNA, 12 nt, Human
aauaacacacau

SEQ ID NO: 2593543 - RNA, 20 nt, Human
aauaacacacauauaaacau

SEQ ID NO: 2593544 - RNA, 13 nt, Human
aauaacauuugug

SEQ ID NO: 2593545 - RNA, 20 nt, Human
aauaacauuaccuuacugug

SEQ ID NO: 2593546 - RNA, 15 nt, Human
aauaacauuaccuua

SEQ ID NO: 2593547 - RNA, 14 nt, Human
aauaacauuaccuu

SEQ ID NO: 2593548 - RNA, 14 nt, Human
aauaaccacuuaaa

SEQ ID NO: 2593549 - RNA, 21 nt, Human
aauaaccacuuaaaaaauguc

SEQ ID NO: 2593550 - RNA, 18 nt, Human
aauuuguuauuuugcaac

SEQ ID NO: 2593551 - RNA, 16 nt, Human
aauuuguuauaaugaa

SEQ ID NO: 2593552 - RNA, 22 nt, Human
aauuuguaaaaacagcauugcu

SEQ ID NO: 2593553 - RNA, 23 nt, Human
aauuuguaaaaacagcauugcuu

SEQ ID NO: 2593554 - RNA, 20 nt, Human
aauuugugauacaaugcugu

SEQ ID NO: 2593555 - RNA, 17 nt, Human
aauuugguucuaggccg

SEQ ID NO: 2593556 - RNA, 22 nt, Human
aauuugguucuaauagaacuca

SEQ ID NO: 2593557 - RNA, 18 nt, Human
aauuugggggacuuacau

SEQ ID NO: 2593558 - RNA, 21 nt, Human
aauuugggggacuuacaugau

SEQ ID NO: 2593559 - RNA, 16 nt, Human
aauuugguucuaauag

SEQ ID NO: 2593560 - RNA, 16 nt, Human
aauuugcuucacucaa

SEQ ID NO: 2593561 - RNA, 23 nt, Human
aauuugcauuaaauucacaaacu

SEQ ID NO: 2593562 - RNA, 15 nt, Human
aauuugcccucccau

SEQ ID NO: 2593563 - RNA, 13 nt, Human
uacuuuuuguuau

SEQ ID NO: 2593564 - RNA, 18 nt, Human
uacuuuuuucuuauuuaa

SEQ ID NO: 2593565 - RNA, 14 nt, Human
uacuuuuuucuuau

SEQ ID NO: 2593566 - RNA, 15 nt, Human
aauuugcauuaaauu

SEQ ID NO: 2593567 - RNA, 18 nt, Human
aauuugcauuaaauucac

SEQ ID NO: 2593568 - RNA, 21 nt, Human
aauuugcauuaaauucacaaa

SEQ ID NO: 2593569 - RNA, 17 nt, Human
aauuugcauuaaauuca

SEQ ID NO: 2593570 - RNA, 14 nt, Human
uacuuuuaaacugu

SEQ ID NO: 2593571 - RNA, 15 nt, Human
uacuuuuaaacugug

SEQ ID NO: 2593572 - RNA, 13 nt, Human
uacuuuuuccugg

SEQ ID NO: 2593573 - RNA, 21 nt, Human
uacuuuuaaacagugagccug

SEQ ID NO: 2593574 - RNA, 23 nt, Human
uacuuuguugcaaguacugcugu

SEQ ID NO: 2593575 - RNA, 22 nt, Human
aauuuuuucucuaggaaauauu

SEQ ID NO: 2593576 - RNA, 14 nt, Human
aauuuuuguaauuu

SEQ ID NO: 2593577 - RNA, 18 nt, Human
aauuuuugguugaauaaa

SEQ ID NO: 2593578 - RNA, 14 nt, Human
aauuuuugguugaa

SEQ ID NO: 2593579 - RNA, 16 nt, Human
aauuuuugguugaaua

SEQ ID NO: 2593580 - RNA, 17 nt, Human
aauuuuuuuaauuuugu

SEQ ID NO: 2593581 - RNA, 16 nt, Human
aauuuuuuuaauuuug

SEQ ID NO: 2593582 - RNA, 19 nt, Human
aauuuuuuuaauuuacaaa

SEQ ID NO: 2593583 - RNA, 20 nt, Human
aauuuuuuuaauuuuguauu

SEQ ID NO: 2593584 - RNA, 18 nt, Human
aauuuuuuuaauuuugua

SEQ ID NO: 2593585 - RNA, 15 nt, Human
aauuuuuuuagaaag

SEQ ID NO: 2593586 - RNA, 20 nt, Human
aauuuuuuuaaccaaaggug

SEQ ID NO: 2593587 - RNA, 19 nt, Human
aauuuuuuuaaccaaaggu

SEQ ID NO: 2593588 - RNA, 20 nt, Human
aauuuuuuuagaaagcauuu

SEQ ID NO: 2593589 - RNA, 18 nt, Human
aauuuuuuuagaaagcau

SEQ ID NO: 2593590 - RNA, 22 nt, Human
aauuuuuuuaucgucacugcuu

SEQ ID NO: 2593591 - RNA, 14 nt, Human
aauuuuuuuucaug

SEQ ID NO: 2593592 - RNA, 16 nt, Human
aauuuuugccuucauu

SEQ ID NO: 2593593 - RNA, 17 nt, Human
aauuuuugccuucauua

SEQ ID NO: 2593594 - RNA, 20 nt, Human
aauuuuugccuucauuaccu

SEQ ID NO: 2593595 - RNA, 21 nt, Human
aauuuuucuuauuucauuucu

SEQ ID NO: 2593596 - RNA, 13 nt, Human
aauuuuuaagcaa

SEQ ID NO: 2593597 - RNA, 20 nt, Human
aauuuuuaaauguaaaacau

SEQ ID NO: 2593598 - RNA, 22 nt, Human
aauuuuuaaaguauauauuuau

SEQ ID NO: 2593599 - RNA, 13 nt, Human
aauuuguuugugc

SEQ ID NO: 2593600 - RNA, 17 nt, Human
aauuuguuugaaaucuu

SEQ ID NO: 2593601 - RNA, 12 nt, Human
aauuuguugcau

SEQ ID NO: 2593602 - RNA, 18 nt, Human
aauuuguugaaauuaugu

SEQ ID NO: 2593603 - RNA, 16 nt, Human
aauuuguuugugcuuc

SEQ ID NO: 2593604 - RNA, 15 nt, Human
aauuuguuugugcuu

SEQ ID NO: 2593605 - RNA, 14 nt, Human
aauuuguuugugcu

SEQ ID NO: 2593606 - RNA, 22 nt, Human
aauuuuuaaucuuuaauuuuac

SEQ ID NO: 2593607 - RNA, 13 nt, Human
aauuuuuaaagua

SEQ ID NO: 2593608 - RNA, 19 nt, Human
aauuuuuaaaguauauauu

SEQ ID NO: 2593609 - RNA, 20 nt, Human
aauuuuuaaaguauauauuu

SEQ ID NO: 2593610 - RNA, 21 nt, Human
uagaugaaaaagcauguacag

SEQ ID NO: 2593611 - RNA, 20 nt, Human
uagaugaaaaagcauguaca

SEQ ID NO: 2593612 - RNA, 19 nt, Human
uagaugaaaaagcauguac

SEQ ID NO: 2593613 - RNA, 18 nt, Human
uagaugaaaaagcaugua

SEQ ID NO: 2593614 - RNA, 17 nt, Human
uagaugaaaaagcaugu

SEQ ID NO: 2593615 - RNA, 13 nt, Human
uagaugaaaaagc

SEQ ID NO: 2593616 - RNA, 23 nt, Human
uagaugaaaaagcauguacagug

SEQ ID NO: 2593617 - RNA, 22 nt, Human
uagaugaaaaagcauguacagu

SEQ ID NO: 2593618 - RNA, 15 nt, Human
uagaugaacucaacu

SEQ ID NO: 2593619 - RNA, 16 nt, Human
uagaugaaguuuuaca

SEQ ID NO: 2593620 - RNA, 15 nt, Human
uagaucccccagacu

SEQ ID NO: 2593621 - RNA, 18 nt, Human
uagauccacacacagagg

SEQ ID NO: 2593622 - RNA, 19 nt, Human
uagaucuccaggagaacug

SEQ ID NO: 2593623 - RNA, 20 nt, Human
uagaugcaguucugaagaag

SEQ ID NO: 2593624 - RNA, 21 nt, Human
uagaugcaguucugaagaaga

SEQ ID NO: 2593625 - RNA, 10 nt, Human
uagaugcuga

SEQ ID NO: 2593626 - RNA, 22 nt, Human
uagaugcucuaugugcuuguaa

SEQ ID NO: 2593627 - RNA, 17 nt, Human
uagcaaagauaucucau

SEQ ID NO: 2593628 - RNA, 19 nt, Human
uagcaaagauaucucaucu

SEQ ID NO: 2593629 - RNA, 12 nt, Human
acaaauauuuau

SEQ ID NO: 2593630 - RNA, 18 nt, Human
acaaauauuuauuuucuu

SEQ ID NO: 2593631 - RNA, 22 nt, Human
acaaauauuuauuuucuuucug

SEQ ID NO: 2593632 - RNA, 23 nt, Human
acaaauauuuauuuucuuucugu

SEQ ID NO: 2593633 - RNA, 12 nt, Human
acaaauaugcaa

SEQ ID NO: 2593634 - RNA, 17 nt, Human
acaaauauaagaauaaa

SEQ ID NO: 2593635 - RNA, 16 nt, Human
acaaauauaagaauaa

SEQ ID NO: 2593636 - RNA, 15 nt, Human
acaaauauaagaaua

SEQ ID NO: 2593637 - RNA, 14 nt, Human
acaaauauaagaau

SEQ ID NO: 2593638 - RNA, 19 nt, Human
acaaauaugcaaaagguuc

SEQ ID NO: 2593639 - RNA, 19 nt, Human
acaaauauaagaauaaaau

SEQ ID NO: 2593640 - RNA, 11 nt, Human
acaaauaugca

SEQ ID NO: 2593641 - RNA, 22 nt, Human
uagauaggucagugcaaauacu

SEQ ID NO: 2593642 - RNA, 17 nt, Human
uagauaggccaugggca

SEQ ID NO: 2593643 - RNA, 17 nt, Human
uagauaguuagaaccug

SEQ ID NO: 2593644 - RNA, 16 nt, Human
uagauagguaaauacc

SEQ ID NO: 2593645 - RNA, 16 nt, Human
uagauccacacacaga

SEQ ID NO: 2593646 - RNA, 23 nt, Human
acaaagcuucuaucccaggaggu

SEQ ID NO: 2593647 - RNA, 23 nt, Human
acaaagcuuggaagagccugcag

SEQ ID NO: 2593648 - RNA, 22 nt, Human
acaaagcuucuaucccaggagg

SEQ ID NO: 2593649 - RNA, 21 nt, Human
acaaagcuucuaucccaggag

SEQ ID NO: 2593650 - RNA, 20 nt, Human
acaaagcuucuaucccagga

SEQ ID NO: 2593651 - RNA, 21 nt, Human
acaaagcuuagcaggagagga

SEQ ID NO: 2593652 - RNA, 19 nt, Human
acaaagcuuagcaggagag

SEQ ID NO: 2593653 - RNA, 16 nt, Human
acaaagcuuagcagga

SEQ ID NO: 2593654 - RNA, 23 nt, Human
acaaagccuuaucaagugucuuc

SEQ ID NO: 2593655 - RNA, 19 nt, Human
acaaagccuuaucaagugu

SEQ ID NO: 2593656 - RNA, 15 nt, Human
acaaaguguguauua

SEQ ID NO: 2593657 - RNA, 13 nt, Human
acaaaguguguau

SEQ ID NO: 2593658 - RNA, 12 nt, Human
acaaagugugua

SEQ ID NO: 2593659 - RNA, 18 nt, Human
acaaagugagacagucca

SEQ ID NO: 2593660 - RNA, 19 nt, Human
acaaaguguguauuaaaaa

SEQ ID NO: 2593661 - RNA, 18 nt, Human
acaaaguguguauuaaaa

SEQ ID NO: 2593662 - RNA, 17 nt, Human
acaaaguguguauuaaa

SEQ ID NO: 2593663 - RNA, 16 nt, Human
acaaaguguguauuaa

SEQ ID NO: 2593664 - RNA, 15 nt, Human
acaaaguuguaugug

SEQ ID NO: 2593665 - RNA, 21 nt, Human
acaaaguuacuagguaacuuc

SEQ ID NO: 2593666 - RNA, 23 nt, Human
acaaaguuacuagguaacuucau

SEQ ID NO: 2593667 - RNA, 21 nt, Human
acaaagcgugguggacaugca

SEQ ID NO: 2593668 - RNA, 18 nt, Human
acaaagccuuaucaagug

SEQ ID NO: 2593669 - RNA, 20 nt, Human
acaaagcccaagggaucugg

SEQ ID NO: 2593670 - RNA, 18 nt, Human
acaaagcccuuccauguc

SEQ ID NO: 2593671 - RNA, 11 nt, Human
acaaagcccaa

SEQ ID NO: 2593672 - RNA, 13 nt, Human
acaaagcccaagg

SEQ ID NO: 2593673 - RNA, 16 nt, Human
acaaagccagaagcug

SEQ ID NO: 2593674 - RNA, 20 nt, Human
acaaagccagaagcugagca

SEQ ID NO: 2593675 - RNA, 14 nt, Human
acaaagcagccacg

SEQ ID NO: 2593676 - RNA, 17 nt, Human
acaaagccaacagucaa

SEQ ID NO: 2593677 - RNA, 11 nt, Human
acaaagccaga

SEQ ID NO: 2593678 - RNA, 23 nt, Human
acaaaagcaagacuguugcucaa

SEQ ID NO: 2593679 - RNA, 19 nt, Human
acaaagccaaacucugcca

SEQ ID NO: 2593680 - RNA, 11 nt, Human
acaaaacuucc

SEQ ID NO: 2593681 - RNA, 14 nt, Human
acaaaacuuuucua

SEQ ID NO: 2593682 - RNA, 16 nt, Human
acaaaacuagagacuc

SEQ ID NO: 2593683 - RNA, 17 nt, Human
acaaaacuacaugagaa

SEQ ID NO: 2593684 - RNA, 23 nt, Human
acaaaacuacaugagaacaaaca

SEQ ID NO: 2593685 - RNA, 23 nt, Human
aauuuuuuuucauguuuuaacaa

SEQ ID NO: 2593686 - RNA, 19 nt, Human
aauuuuuuuuuccuagccc

SEQ ID NO: 2593687 - RNA, 15 nt, Human
aauuuuuuuucaugu

SEQ ID NO: 2593688 - RNA, 19 nt, Human
uagcuagaaauaugauuuu

SEQ ID NO: 2593689 - RNA, 14 nt, Human
uagcuagaaguggg

SEQ ID NO: 2593690 - RNA, 19 nt, Human
uagcuagaagugggccagg

SEQ ID NO: 2593691 - RNA, 23 nt, Human
uagcuacaggaagcaccccaugc

SEQ ID NO: 2593692 - RNA, 21 nt, Human
uagcuaucagaagaccacaaa

SEQ ID NO: 2593693 - RNA, 15 nt, Human
uagcuauuacugucu

SEQ ID NO: 2593694 - RNA, 14 nt, Human
uagcuauuacuguc

SEQ ID NO: 2593695 - RNA, 13 nt, Human
uagcuauuacugu

SEQ ID NO: 2593696 - RNA, 20 nt, Human
uagcuagaagugggccagga

SEQ ID NO: 2593697 - RNA, 18 nt, Human
uagcucaaacguggcuuu

SEQ ID NO: 2593698 - RNA, 17 nt, Human
uagcucaaacguggcuu

SEQ ID NO: 2593699 - RNA, 11 nt, Human
uagcuauuuuu

SEQ ID NO: 2593700 - RNA, 16 nt, Human
uagcuauuuuuaugga

SEQ ID NO: 2593701 - RNA, 17 nt, Human
uagcuauuuuuauggaa

SEQ ID NO: 2593702 - RNA, 19 nt, Human
uagcuauuuuuauggaauu

SEQ ID NO: 2593703 - RNA, 22 nt, Human
uagcucaggaccugggaccucc

SEQ ID NO: 2593704 - RNA, 16 nt, Human
uagcucaggugucccu

SEQ ID NO: 2593705 - RNA, 16 nt, Human
uagcuuaccagaagcu

SEQ ID NO: 2593706 - RNA, 15 nt, Human
uagcuuagaccucag

SEQ ID NO: 2593707 - RNA, 21 nt, Human
uagcuuacaagccagcuggag

SEQ ID NO: 2593708 - RNA, 16 nt, Human
uagcuacuaauuuuaa

SEQ ID NO: 2593709 - RNA, 18 nt, Human
uagccuuuggcucuggag

SEQ ID NO: 2593710 - RNA, 16 nt, Human
uagccuuuggcucugg

SEQ ID NO: 2593711 - RNA, 16 nt, Human
uagccuucucuguuca

SEQ ID NO: 2593712 - RNA, 20 nt, Human
uagccuucucuguucauuuc

SEQ ID NO: 2593713 - RNA, 22 nt, Human
uagccuucucuguucauuuccu

SEQ ID NO: 2593714 - RNA, 22 nt, Human
uagccuugcccggauucuggga

SEQ ID NO: 2593715 - RNA, 23 nt, Human
uagccuuccuccacauccuuucu

SEQ ID NO: 2593716 - RNA, 18 nt, Human
uagccuuccuccacaucc

SEQ ID NO: 2593717 - RNA, 13 nt, Human
uagccuucucugu

SEQ ID NO: 2593718 - RNA, 14 nt, Human
uagccuucucuguu

SEQ ID NO: 2593719 - RNA, 15 nt, Human
uagccuucucuguuc

SEQ ID NO: 2593720 - RNA, 13 nt, Human
uagccuuccucca

SEQ ID NO: 2593721 - RNA, 22 nt, Human
uagccuuccguaacccaacucu

SEQ ID NO: 2593722 - RNA, 18 nt, Human
acaaugaagauaaaaaga

SEQ ID NO: 2593723 - RNA, 19 nt, Human
acaaucuuaaggggcagcu

SEQ ID NO: 2593724 - RNA, 18 nt, Human
acaaucuuaaggggcagc

SEQ ID NO: 2593725 - RNA, 20 nt, Human
acaaucuuaaggggcagcuu

SEQ ID NO: 2593726 - RNA, 18 nt, Human
acaaucugacauucucag

SEQ ID NO: 2593727 - RNA, 19 nt, Human
acaagcuccaagcucccag

SEQ ID NO: 2593728 - RNA, 17 nt, Human
acaagcuccaagcuccc

SEQ ID NO: 2593729 - RNA, 16 nt, Human
acaagcuccaagcucc

SEQ ID NO: 2593730 - RNA, 15 nt, Human
acaagcuccaagcuc

SEQ ID NO: 2593731 - RNA, 22 nt, Human
acaagcuccaagcucccaggca

SEQ ID NO: 2593732 - RNA, 14 nt, Human
acaaguuguguuug

SEQ ID NO: 2593733 - RNA, 15 nt, Human
acaagcucccaggcc

SEQ ID NO: 2593734 - RNA, 22 nt, Human
acaagcugcaaaucagccaugu

SEQ ID NO: 2593735 - RNA, 16 nt, Human
acaagcuccuggucuu

SEQ ID NO: 2593736 - RNA, 21 nt, Human
acaauauaaccacaaagcaca

SEQ ID NO: 2593737 - RNA, 19 nt, Human
acaauauaaaacuguacuu

SEQ ID NO: 2593738 - RNA, 18 nt, Human
acaauauaaaacuguacu

SEQ ID NO: 2593739 - RNA, 19 nt, Human
acaauaugcaaugugaagc

SEQ ID NO: 2593740 - RNA, 15 nt, Human
acaauaugaauacag

SEQ ID NO: 2593741 - RNA, 14 nt, Human
acaauaugcaaugu

SEQ ID NO: 2593742 - RNA, 21 nt, Human
acaauaugaauacagggcaug

SEQ ID NO: 2593743 - RNA, 18 nt, Human
acaaucucggcucacugc

SEQ ID NO: 2593744 - RNA, 20 nt, Human
acaaucucggcucacugcau

SEQ ID NO: 2593745 - RNA, 12 nt, Human
acaaucucaaau

SEQ ID NO: 2593746 - RNA, 14 nt, Human
acaauauugaacuu

SEQ ID NO: 2593747 - RNA, 15 nt, Human
acaauauugacuuug

SEQ ID NO: 2593748 - RNA, 16 nt, Human
acaauaaaacauuaau

SEQ ID NO: 2593749 - RNA, 12 nt, Human
acaauaaaacau

SEQ ID NO: 2593750 - RNA, 14 nt, Human
acaauaaaaauguu

SEQ ID NO: 2593751 - RNA, 16 nt, Human
acaauaaaaauguuua

SEQ ID NO: 2593752 - RNA, 14 nt, Human
acaaguuuuaaaua

SEQ ID NO: 2593753 - RNA, 15 nt, Human
acaaguuguguuuga

SEQ ID NO: 2593754 - RNA, 22 nt, Human
acaaguuuuucugucaagaaga

SEQ ID NO: 2593755 - RNA, 16 nt, Human
acaaguuuuucuguca

SEQ ID NO: 2593756 - RNA, 15 nt, Human
acaaguuuuucuguc

SEQ ID NO: 2593757 - RNA, 21 nt, Human
acaauacucauaaugugaagu

SEQ ID NO: 2593758 - RNA, 18 nt, Human
acaauaguaaccugggua

SEQ ID NO: 2593759 - RNA, 19 nt, Human
acaauagcuuuacccucag

SEQ ID NO: 2593760 - RNA, 20 nt, Human
acaauagcuuuacccucagg

SEQ ID NO: 2593761 - RNA, 20 nt, Human
acaauaaaaauggcucagau

SEQ ID NO: 2593762 - RNA, 20 nt, Human
acaauaaaauuuuuuuucau

SEQ ID NO: 2593763 - RNA, 20 nt, Human
acaauacucauaaugugaag

SEQ ID NO: 2593764 - RNA, 19 nt, Human
acaauacucauaaugugaa

SEQ ID NO: 2593765 - RNA, 18 nt, Human
acaauacucauaauguga

SEQ ID NO: 2593766 - RNA, 22 nt, Human
uagcaagugaauuuuucucuaa

SEQ ID NO: 2593767 - RNA, 16 nt, Human
uagcaaggcaugaugu

SEQ ID NO: 2593768 - RNA, 18 nt, Human
uagcaagugaauuuuucu

SEQ ID NO: 2593769 - RNA, 18 nt, Human
uagcaagacacaucccua

SEQ ID NO: 2593770 - RNA, 20 nt, Human
uagcaagauugcuuaaaaua

SEQ ID NO: 2593771 - RNA, 24 nt, Human
uagcaagauugcuuaaaauagcaa

SEQ ID NO: 2593772 - RNA, 12 nt, Human
uagcaaauacau

SEQ ID NO: 2593773 - RNA, 23 nt, Human
uagcaaauaauuuccugguguga

SEQ ID NO: 2593774 - RNA, 16 nt, Human
uagcaaagauaucuca

SEQ ID NO: 2593775 - RNA, 21 nt, Human
uagcaaauguuuugacaugaa

SEQ ID NO: 2593776 - RNA, 17 nt, Human
uagcaaauguuuugaca

SEQ ID NO: 2593777 - RNA, 12 nt, Human
uagcaagacaca

SEQ ID NO: 2593778 - RNA, 17 nt, Human
uagcaagacacaucccu

SEQ ID NO: 2593779 - RNA, 15 nt, Human
acaaaugccacacau

SEQ ID NO: 2593780 - RNA, 21 nt, Human
acaaauucugucucuggauua

SEQ ID NO: 2593781 - RNA, 16 nt, Human
acaaaugccacacauc

SEQ ID NO: 2593782 - RNA, 20 nt, Human
acaaaugccacacaucaccc

SEQ ID NO: 2593783 - RNA, 15 nt, Human
acaaauggacauagg

SEQ ID NO: 2593784 - RNA, 22 nt, Human
acaaaugcugcgcccuucccca

SEQ ID NO: 2593785 - RNA, 16 nt, Human
acaaauggaggccugu

SEQ ID NO: 2593786 - RNA, 18 nt, Human
acaacagauuugugaacu

SEQ ID NO: 2593787 - RNA, 23 nt, Human
acaacagugcuaaaaaugggacu

SEQ ID NO: 2593788 - RNA, 17 nt, Human
acaacagugcuaaaaau

SEQ ID NO: 2593789 - RNA, 17 nt, Human
acaacaucuuuuucuac

SEQ ID NO: 2593790 - RNA, 13 nt, Human
acaagacacagug

SEQ ID NO: 2593791 - RNA, 17 nt, Human
acaaauuuacagagaca

SEQ ID NO: 2593792 - RNA, 17 nt, Human
acaacagauuugugaac

SEQ ID NO: 2593793 - RNA, 16 nt, Human
acaacagauuugugaa

SEQ ID NO: 2593794 - RNA, 15 nt, Human
acaacagauuuguga

SEQ ID NO: 2593795 - RNA, 18 nt, Human
acaaauugcuugaaagaa

SEQ ID NO: 2593796 - RNA, 20 nt, Human
acaaauugcuuacuuuggaa

SEQ ID NO: 2593797 - RNA, 22 nt, Human
acaaauugaacucuuugaauga

SEQ ID NO: 2593798 - RNA, 15 nt, Human
acaaauucuguuucu

SEQ ID NO: 2593799 - RNA, 16 nt, Human
acaaauucuguuucuu

SEQ ID NO: 2593800 - RNA, 12 nt, Human
acaaauucuguu

SEQ ID NO: 2593801 - RNA, 13 nt, Human
acaaauguaugau

SEQ ID NO: 2593802 - RNA, 16 nt, Human
acaagaccacguuucu

SEQ ID NO: 2593803 - RNA, 19 nt, Human
acaagaccaccacuucgaa

SEQ ID NO: 2593804 - RNA, 15 nt, Human
acaagacagaagcug

SEQ ID NO: 2593805 - RNA, 14 nt, Human
acaagacacaguga

SEQ ID NO: 2593806 - RNA, 17 nt, Human
acaagaccacguuucua

SEQ ID NO: 2593807 - RNA, 22 nt, Human
acaagagcccaggccuccuaca

SEQ ID NO: 2593808 - RNA, 18 nt, Human
acaagagcuuaacagugu

SEQ ID NO: 2593809 - RNA, 19 nt, Human
acaagagcuuaacagugug

SEQ ID NO: 2593810 - RNA, 22 nt, Human
acaagaguuuauuuccaaauaa

SEQ ID NO: 2593811 - RNA, 13 nt, Human
acaagaucuuuca

SEQ ID NO: 2593812 - RNA, 14 nt, Human
acaagaucuuucag

SEQ ID NO: 2593813 - RNA, 16 nt, Human
acaagagcgaaacucc

SEQ ID NO: 2593814 - RNA, 17 nt, Human
acaagagcgaaacuccg

SEQ ID NO: 2593815 - RNA, 18 nt, Human
acaagaguuuauuuccaa

SEQ ID NO: 2593816 - RNA, 18 nt, Human
acaagauagagagcuauu

SEQ ID NO: 2593817 - RNA, 22 nt, Human
acaagcucacagaccuuugaac

SEQ ID NO: 2593818 - RNA, 13 nt, Human
acaagcuccaagc

SEQ ID NO: 2593819 - RNA, 17 nt, Human
acaagcgugagccacug

SEQ ID NO: 2593820 - RNA, 19 nt, Human
acaagccccaggcaggcug

SEQ ID NO: 2593821 - RNA, 18 nt, Human
acaagauucccagagaca

SEQ ID NO: 2593822 - RNA, 21 nt, Human
acaagauucccagagacagga

SEQ ID NO: 2593823 - RNA, 14 nt, Human
acaagauucccaga

SEQ ID NO: 2593824 - RNA, 15 nt, Human
acaagaucuuucagg

SEQ ID NO: 2593825 - RNA, 16 nt, Human
acaagaucuuucagga

SEQ ID NO: 2593826 - RNA, 20 nt, Human
acaagaucuuucaggaaaga

SEQ ID NO: 2593827 - RNA, 15 nt, Human
acaagauucccagag

SEQ ID NO: 2593828 - RNA, 16 nt, Human
acaagauucccagaga

SEQ ID NO: 2593829 - RNA, 17 nt, Human
acaagauucccagagac

SEQ ID NO: 2593830 - RNA, 16 nt, Human
acaagccccaggcagg

SEQ ID NO: 2593831 - RNA, 17 nt, Human
acaagccccaggcaggc

SEQ ID NO: 2593832 - RNA, 14 nt, Human
acaagcccccccuu

SEQ ID NO: 2593833 - RNA, 18 nt, Human
acaagcccccccuuccac

SEQ ID NO: 2593834 - RNA, 17 nt, Human
acaagcccccccuucca

SEQ ID NO: 2593835 - RNA, 20 nt, Human
acaagauuuuaaagacaugu

SEQ ID NO: 2593836 - RNA, 15 nt, Human
acaagccccaggcag

SEQ ID NO: 2593837 - RNA, 23 nt, Human
aauugauuugcauugaacacaaa

SEQ ID NO: 2593838 - RNA, 14 nt, Human
aauugcaaaucuug

SEQ ID NO: 2593839 - RNA, 18 nt, Human
aauugcaaaucuugaaau

SEQ ID NO: 2593840 - RNA, 14 nt, Human
aauugcacucuaaa

SEQ ID NO: 2593841 - RNA, 21 nt, Human
aauugcacaauauugaacuuu

SEQ ID NO: 2593842 - RNA, 14 nt, Human
aauugcacuuuuaa

SEQ ID NO: 2593843 - RNA, 15 nt, Human
aauugcacucuaaaa

SEQ ID NO: 2593844 - RNA, 18 nt, Human
aauugcacuuuuaaaccu

SEQ ID NO: 2593845 - RNA, 14 nt, Human
aauugcagaacuaa

SEQ ID NO: 2593846 - RNA, 13 nt, Human
aauugcagacugu

SEQ ID NO: 2593847 - RNA, 11 nt, Human
aauugcauuga

SEQ ID NO: 2593848 - RNA, 23 nt, Human
aauugcuuacuuuggaauacauu

SEQ ID NO: 2593849 - RNA, 19 nt, Human
aauugaggacuauggaaau

SEQ ID NO: 2593850 - RNA, 17 nt, Human
aauugaggggauuaaua

SEQ ID NO: 2593851 - RNA, 23 nt, Human
aauugauuauucugauuccacuu

SEQ ID NO: 2593852 - RNA, 22 nt, Human
aauugauuauucugauuccacu

SEQ ID NO: 2593853 - RNA, 14 nt, Human
aauugauuauucug

SEQ ID NO: 2593854 - RNA, 14 nt, Human
aauugauuugcauu

SEQ ID NO: 2593855 - RNA, 16 nt, Human
aauugauuugcauuga

SEQ ID NO: 2593856 - RNA, 20 nt, Human
aauugauuugcauugaacac

SEQ ID NO: 2593857 - RNA, 22 nt, Human
aauugauuugcauugaacacaa

SEQ ID NO: 2593858 - RNA, 13 nt, Human
aauugauuugcau

SEQ ID NO: 2593859 - RNA, 15 nt, Human
aauugauuucaagac

SEQ ID NO: 2593860 - RNA, 13 nt, Human
uacuguaauuccu

SEQ ID NO: 2593861 - RNA, 15 nt, Human
uacuguaauuccuca

SEQ ID NO: 2593862 - RNA, 16 nt, Human
uacuguaauuccucaa

SEQ ID NO: 2593863 - RNA, 19 nt, Human
uacuguacagacagaaaaa

SEQ ID NO: 2593864 - RNA, 23 nt, Human
uacuguacagacagaaaaaacug

SEQ ID NO: 2593865 - RNA, 12 nt, Human
uacuguaauuuu

SEQ ID NO: 2593866 - RNA, 14 nt, Human
uacuguaauuuuau

SEQ ID NO: 2593867 - RNA, 20 nt, Human
uacuguaauuuuauaugaag

SEQ ID NO: 2593868 - RNA, 19 nt, Human
uacuguacaaugacuuuau

SEQ ID NO: 2593869 - RNA, 18 nt, Human
aauugacuucgacuguga

SEQ ID NO: 2593870 - RNA, 20 nt, Human
uacugacauguggggccagg

SEQ ID NO: 2593871 - RNA, 21 nt, Human
aauugacuuauuuauauaaau

SEQ ID NO: 2593872 - RNA, 18 nt, Human
aauugaggacacugauau

SEQ ID NO: 2593873 - RNA, 22 nt, Human
aauugagagaauggaaaacaga

SEQ ID NO: 2593874 - RNA, 15 nt, Human
aauugagauuagagg

SEQ ID NO: 2593875 - RNA, 16 nt, Human
uacucuagauuuuguu

SEQ ID NO: 2593876 - RNA, 15 nt, Human
uacucuagauuuugu

SEQ ID NO: 2593877 - RNA, 12 nt, Human
uacucuagauuu

SEQ ID NO: 2593878 - RNA, 14 nt, Human
uacucuagaugaag

SEQ ID NO: 2593879 - RNA, 13 nt, Human
uacucuacugaua

SEQ ID NO: 2593880 - RNA, 16 nt, Human
uacucucccauggcuu

SEQ ID NO: 2593881 - RNA, 18 nt, Human
uacucuccaaccuggaca

SEQ ID NO: 2593882 - RNA, 14 nt, Human
uacucuccaaccug

SEQ ID NO: 2593883 - RNA, 16 nt, Human
uacucuccaaccugga

SEQ ID NO: 2593884 - RNA, 12 nt, Human
uacucuccuaga

SEQ ID NO: 2593885 - RNA, 13 nt, Human
uacucuuucugua

SEQ ID NO: 2593886 - RNA, 14 nt, Human
uacucuuucuguau

SEQ ID NO: 2593887 - RNA, 15 nt, Human
uacucuuucuguaua

SEQ ID NO: 2593888 - RNA, 22 nt, Human
uacucuuugagauagaagaacu

SEQ ID NO: 2593889 - RNA, 14 nt, Human
uacucuuuuuguuu

SEQ ID NO: 2593890 - RNA, 16 nt, Human
uacucuuucuguauau

SEQ ID NO: 2593891 - RNA, 14 nt, Human
uacucuccuagaga

SEQ ID NO: 2593892 - RNA, 17 nt, Human
uacucuuugagauagaa

SEQ ID NO: 2593893 - RNA, 22 nt, Human
uacugaacaaucaaagcacuug

SEQ ID NO: 2593894 - RNA, 22 nt, Human
uacugacauguggggccagguc

SEQ ID NO: 2593895 - RNA, 20 nt, Human
uacugaaagguuacccugua

SEQ ID NO: 2593896 - RNA, 17 nt, Human
uacugagagugaacaaa

SEQ ID NO: 2593897 - RNA, 14 nt, Human
uacugacuuucuca

SEQ ID NO: 2593898 - RNA, 17 nt, Human
uacugacugagaauaua

SEQ ID NO: 2593899 - RNA, 16 nt, Human
uacuguaauuugugau

SEQ ID NO: 2593900 - RNA, 17 nt, Human
uacuguaauuugugaua

SEQ ID NO: 2593901 - RNA, 23 nt, Human
uacugguccaaaagauugcugaa

SEQ ID NO: 2593902 - RNA, 18 nt, Human
uacuggucuuguggaauu

SEQ ID NO: 2593903 - RNA, 15 nt, Human
uacuguaauuuguga

SEQ ID NO: 2593904 - RNA, 20 nt, Human
uacugagaaaagccucucca

SEQ ID NO: 2593905 - RNA, 16 nt, Human
uacugggagccuaccc

SEQ ID NO: 2593906 - RNA, 19 nt, Human
uacugagagugaacaaauu

SEQ ID NO: 2593907 - RNA, 13 nt, Human
uacugguccaaaa

SEQ ID NO: 2593908 - RNA, 18 nt, Human
uacugguccaaaagauug

SEQ ID NO: 2593909 - RNA, 14 nt, Human
aaugugggcagaga

SEQ ID NO: 2593910 - RNA, 19 nt, Human
aaugugguuauuucucuga

SEQ ID NO: 2593911 - RNA, 18 nt, Human
aaugugguuauuucucug

SEQ ID NO: 2593912 - RNA, 19 nt, Human
aauguguaauuuuguucua

SEQ ID NO: 2593913 - RNA, 16 nt, Human
aauguguaauuuuguu

SEQ ID NO: 2593914 - RNA, 15 nt, Human
aauguguaauuuugu

SEQ ID NO: 2593915 - RNA, 23 nt, Human
aaugugguuauuucucugauuug

SEQ ID NO: 2593916 - RNA, 21 nt, Human
aaugugguuauuucucugauu

SEQ ID NO: 2593917 - RNA, 22 nt, Human
aauguguauuacaaauauuuug

SEQ ID NO: 2593918 - RNA, 16 nt, Human
aauguguacaacuuaa

SEQ ID NO: 2593919 - RNA, 19 nt, Human
aauguguaucggaugcuuu

SEQ ID NO: 2593920 - RNA, 22 nt, Human
aauugaauaaugguaccagaua

SEQ ID NO: 2593921 - RNA, 21 nt, Human
aauugaauaaugguaccagau

SEQ ID NO: 2593922 - RNA, 14 nt, Human
aauugaauaauggu

SEQ ID NO: 2593923 - RNA, 17 nt, Human
aaugugugugguuuuuu

SEQ ID NO: 2593924 - RNA, 23 nt, Human
aauugaauaaugguaccagauaa

SEQ ID NO: 2593925 - RNA, 16 nt, Human
aauguguggccugcac

SEQ ID NO: 2593926 - RNA, 19 nt, Human
aaugugugccauagaguuu

SEQ ID NO: 2593927 - RNA, 23 nt, Human
aauugacagaucaagcugugaga

SEQ ID NO: 2593928 - RNA, 24 nt, Human
uacgcuccaucgcugucaucucag

SEQ ID NO: 2593929 - RNA, 14 nt, Human
aauugacauugcuu

SEQ ID NO: 2593930 - RNA, 13 nt, Human
uacgcucuccuuu

SEQ ID NO: 2593931 - RNA, 21 nt, Human
aauugaaucaguauaaacaaa

SEQ ID NO: 2593932 - RNA, 21 nt, Human
aauugacagaucaagcuguga

SEQ ID NO: 2593933 - RNA, 19 nt, Human
aauugacagaucaagcugu

SEQ ID NO: 2593934 - RNA, 19 nt, Human
aauugaauggucagcguug

SEQ ID NO: 2593935 - RNA, 18 nt, Human
aauugacagaucaagcug

SEQ ID NO: 2593936 - RNA, 13 nt, Human
uacgcugaagaug

SEQ ID NO: 2593937 - RNA, 14 nt, Human
uacgcuuugauuca

SEQ ID NO: 2593938 - RNA, 15 nt, Human
uacgcuuugauucau

SEQ ID NO: 2593939 - RNA, 15 nt, Human
uacgcucuccuuucu

SEQ ID NO: 2593940 - RNA, 19 nt, Human
uacgcucuccuuucuuucu

SEQ ID NO: 2593941 - RNA, 22 nt, Human
uacgcugaagauggcauccugu

SEQ ID NO: 2593942 - RNA, 21 nt, Human
uacgcucuccuuucuuucuaa

SEQ ID NO: 2593943 - RNA, 15 nt, Human
uacgucugacaggca

SEQ ID NO: 2593944 - RNA, 14 nt, Human
uacggacacccccu

SEQ ID NO: 2593945 - RNA, 13 nt, Human
uacggacaccccc

SEQ ID NO: 2593946 - RNA, 14 nt, Human
uacuaaaaauacaa

SEQ ID NO: 2593947 - RNA, 13 nt, Human
uacgugaguccug

SEQ ID NO: 2593948 - RNA, 21 nt, Human
uacgucugggagaaauugaca

SEQ ID NO: 2593949 - RNA, 13 nt, Human
uacgucugggaga

SEQ ID NO: 2593950 - RNA, 16 nt, Human
uacgucugacaggcaa

SEQ ID NO: 2593951 - RNA, 22 nt, Human
uacuagaagaugaauacaaaca

SEQ ID NO: 2593952 - RNA, 17 nt, Human
uacuagaagaugaauac

SEQ ID NO: 2593953 - RNA, 15 nt, Human
uacuagaugucuuua

SEQ ID NO: 2593954 - RNA, 19 nt, Human
uacuagaugucuuuaggca

SEQ ID NO: 2593955 - RNA, 19 nt, Human
uacuagagucugaacagcu

SEQ ID NO: 2593956 - RNA, 14 nt, Human
uacuagaugucuuu

SEQ ID NO: 2593957 - RNA, 18 nt, Human
uacuaaaaauacaaaaaa

SEQ ID NO: 2593958 - RNA, 20 nt, Human
uacuaaaaguucuucuccaa

SEQ ID NO: 2593959 - RNA, 14 nt, Human
uacgugagccaggu

SEQ ID NO: 2593960 - RNA, 14 nt, Human
uacgucugggagaa

SEQ ID NO: 2593961 - RNA, 14 nt, Human
uacuaaaaaugcaa

SEQ ID NO: 2593962 - RNA, 19 nt, Human
uacuauuuuuacugccacu

SEQ ID NO: 2593963 - RNA, 18 nt, Human
uacuauuuuuacugccac

SEQ ID NO: 2593964 - RNA, 15 nt, Human
uacuauuuuuacugc

SEQ ID NO: 2593965 - RNA, 14 nt, Human
uacuauuuuuacug

SEQ ID NO: 2593966 - RNA, 16 nt, Human
uacucuacccucuuag

SEQ ID NO: 2593967 - RNA, 22 nt, Human
uacucuacccucuuagaaaaac

SEQ ID NO: 2593968 - RNA, 13 nt, Human
uacuauuuagaua

SEQ ID NO: 2593969 - RNA, 14 nt, Human
uacuauuuuacuuc

SEQ ID NO: 2593970 - RNA, 19 nt, Human
uacuauuuuacuucuagag

SEQ ID NO: 2593971 - RNA, 13 nt, Human
uacuauuuuuacu

SEQ ID NO: 2593972 - RNA, 18 nt, Human
uacuauuuuacuucuaga

SEQ ID NO: 2593973 - RNA, 19 nt, Human
uacuauuuaaagccuccuc

SEQ ID NO: 2593974 - RNA, 12 nt, Human
uacuauuuaaag

SEQ ID NO: 2593975 - RNA, 21 nt, Human
uacuagggaucccucaucugu

SEQ ID NO: 2593976 - RNA, 22 nt, Human
uacuauuuaaagccuccucauc

SEQ ID NO: 2593977 - RNA, 21 nt, Human
uacuauuuaaagccuccucau

SEQ ID NO: 2593978 - RNA, 13 nt, Human
uacuagguaacuu

SEQ ID NO: 2593979 - RNA, 18 nt, Human
uacuagggaaaugccuuu

SEQ ID NO: 2593980 - RNA, 17 nt, Human
uacuagcauaugaguuu

SEQ ID NO: 2593981 - RNA, 23 nt, Human
uacuaggcuuaauaccuggguga

SEQ ID NO: 2593982 - RNA, 18 nt, Human
uacuagggagaagguuuc

SEQ ID NO: 2593983 - RNA, 19 nt, Human
uacuucuuaggguuaugau

SEQ ID NO: 2593984 - RNA, 15 nt, Human
uacuucugcuacaua

SEQ ID NO: 2593985 - RNA, 20 nt, Human
uacuucuccacccugcucuc

SEQ ID NO: 2593986 - RNA, 13 nt, Human
uacuucugaggua

SEQ ID NO: 2593987 - RNA, 21 nt, Human
uacuucugagggcaucuuggu

SEQ ID NO: 2593988 - RNA, 22 nt, Human
uacuucguguccgacucuucug

SEQ ID NO: 2593989 - RNA, 21 nt, Human
uacuucuagagauaguacaua

SEQ ID NO: 2593990 - RNA, 14 nt, Human
uacuucuccagccu

SEQ ID NO: 2593991 - RNA, 14 nt, Human
uacuucuugaaggu

SEQ ID NO: 2593992 - RNA, 16 nt, Human
uacuucuuauacauuu

SEQ ID NO: 2593993 - RNA, 14 nt, Human
uacuucuuauacau

SEQ ID NO: 2593994 - RNA, 15 nt, Human
uacuucuuauacauu

SEQ ID NO: 2593995 - RNA, 14 nt, Human
uacuuugacuuuuu

SEQ ID NO: 2593996 - RNA, 14 nt, Human
uacuuugaagucau

SEQ ID NO: 2593997 - RNA, 18 nt, Human
uacuuugaagucauacca

SEQ ID NO: 2593998 - RNA, 19 nt, Human
uacuuugaaaccagaaaau

SEQ ID NO: 2593999 - RNA, 16 nt, Human
uacuuugucugaaaaa

SEQ ID NO: 2594000 - RNA, 14 nt, Human
uacuuugucugaaa

SEQ ID NO: 2594001 - RNA, 11 nt, Human
uacuuugucag

SEQ ID NO: 2594002 - RNA, 23 nt, Human
uacuuugauauuuucaacgcagc

SEQ ID NO: 2594003 - RNA, 20 nt, Human
uacuuuguccuuuuuguuau

SEQ ID NO: 2594004 - RNA, 20 nt, Human
uacuugaaaucuaggauuau

SEQ ID NO: 2594005 - RNA, 22 nt, Human
uacuuuccacuugauuuugcaa

SEQ ID NO: 2594006 - RNA, 19 nt, Human
uacuuuccuuuccccagcc

SEQ ID NO: 2594007 - RNA, 17 nt, Human
uacuuucguacauuggc

SEQ ID NO: 2594008 - RNA, 20 nt, Human
uacuuuccuuuccccagccc

SEQ ID NO: 2594009 - RNA, 15 nt, Human
uacuugaaaauuaac

SEQ ID NO: 2594010 - RNA, 16 nt, Human
uacuucuuugcuuugc

SEQ ID NO: 2594011 - RNA, 18 nt, Human
uacuucuucauucaauac

SEQ ID NO: 2594012 - RNA, 18 nt, Human
aauuugcaagucauggcu

SEQ ID NO: 2594013 - RNA, 13 nt, Human
aauuugauugauu

SEQ ID NO: 2594014 - RNA, 14 nt, Human
aauuugauugauuu

SEQ ID NO: 2594015 - RNA, 15 nt, Human
aauuugauugauuug

SEQ ID NO: 2594016 - RNA, 16 nt, Human
aauuugauugauuuga

SEQ ID NO: 2594017 - RNA, 17 nt, Human
aauuugauuauuaacau

SEQ ID NO: 2594018 - RNA, 12 nt, Human
aauuugauugau

SEQ ID NO: 2594019 - RNA, 15 nt, Human
aauuucuuugccugu

SEQ ID NO: 2594020 - RNA, 21 nt, Human
aauuucuucacuguugaaaau

SEQ ID NO: 2594021 - RNA, 18 nt, Human
aauuucuuugccuguuca

SEQ ID NO: 2594022 - RNA, 18 nt, Human
aauuugaaaauaauuguu

SEQ ID NO: 2594023 - RNA, 23 nt, Human
aauuugaaaacauaaucugcaaa

SEQ ID NO: 2594024 - RNA, 19 nt, Human
aauuugaaaauaauuguuc

SEQ ID NO: 2594025 - RNA, 15 nt, Human
aauuugauuucuauu

SEQ ID NO: 2594026 - RNA, 17 nt, Human
aauuugauugauuugaa

SEQ ID NO: 2594027 - RNA, 20 nt, Human
aauuugauugauuugaagaa

SEQ ID NO: 2594028 - RNA, 15 nt, Human
uacuuauuacugcua

SEQ ID NO: 2594029 - RNA, 14 nt, Human
uacuuauuacugcu

SEQ ID NO: 2594030 - RNA, 20 nt, Human
uacuuaucauccacauuguu

SEQ ID NO: 2594031 - RNA, 13 nt, Human
uacuuauuccaga

SEQ ID NO: 2594032 - RNA, 14 nt, Human
uacuuccccuuccu

SEQ ID NO: 2594033 - RNA, 15 nt, Human
uacuuccccuuccua

SEQ ID NO: 2594034 - RNA, 18 nt, Human
uacuuccccuuccuaauu

SEQ ID NO: 2594035 - RNA, 20 nt, Human
uacuuccccuuccuaauucc

SEQ ID NO: 2594036 - RNA, 17 nt, Human
uacuuauuuuugacagu

SEQ ID NO: 2594037 - RNA, 19 nt, Human
uacuuauuuuugacagugu

SEQ ID NO: 2594038 - RNA, 23 nt, Human
uacuucccauuuuggaaguuuuc

SEQ ID NO: 2594039 - RNA, 18 nt, Human
uacuucuccacccugcuc

SEQ ID NO: 2594040 - RNA, 13 nt, Human
uacuucuccaccc

SEQ ID NO: 2594041 - RNA, 23 nt, Human
uacuuccugugacuucagcucug

SEQ ID NO: 2594042 - RNA, 14 nt, Human
uacuuccuccuccc

SEQ ID NO: 2594043 - RNA, 19 nt, Human
uacuuccuaucaagccagu

SEQ ID NO: 2594044 - RNA, 18 nt, Human
uacuucgucuucuaauuu

SEQ ID NO: 2594045 - RNA, 17 nt, Human
uacuucgucuucuaauu

SEQ ID NO: 2594046 - RNA, 16 nt, Human
uacuuccuccucccca

SEQ ID NO: 2594047 - RNA, 17 nt, Human
aauuuacagagacagaa

SEQ ID NO: 2594048 - RNA, 18 nt, Human
aauuuacagagacagaaa

SEQ ID NO: 2594049 - RNA, 17 nt, Human
aauuuaccugaagucuu

SEQ ID NO: 2594050 - RNA, 15 nt, Human
aauuuacauacucug

SEQ ID NO: 2594051 - RNA, 15 nt, Human
aauuuaccugaaguc

SEQ ID NO: 2594052 - RNA, 14 nt, Human
aauuuacuugccau

SEQ ID NO: 2594053 - RNA, 21 nt, Human
aauuuacaaaguguguauuaa

SEQ ID NO: 2594054 - RNA, 19 nt, Human
aauuuacaaaguguguauu

SEQ ID NO: 2594055 - RNA, 15 nt, Human
aauuuaguuauugau

SEQ ID NO: 2594056 - RNA, 18 nt, Human
aauuuacaaaguguguau

SEQ ID NO: 2594057 - RNA, 14 nt, Human
aauuuaagugcgug

SEQ ID NO: 2594058 - RNA, 14 nt, Human
aauuuaaguaucuu

SEQ ID NO: 2594059 - RNA, 21 nt, Human
aauuuaagcauuguuugcuua

SEQ ID NO: 2594060 - RNA, 23 nt, Human
aauuuaagcauuguuugcuuauu

SEQ ID NO: 2594061 - RNA, 11 nt, Human
aauuuaagcau

SEQ ID NO: 2594062 - RNA, 12 nt, Human
aauuuaagcauu

SEQ ID NO: 2594063 - RNA, 13 nt, Human
aauuuaagcauug

SEQ ID NO: 2594064 - RNA, 14 nt, Human
aauuuaagcauugu

SEQ ID NO: 2594065 - RNA, 15 nt, Human
aauuuaagcauuguu

SEQ ID NO: 2594066 - RNA, 16 nt, Human
aauuuaagcauuguuu

SEQ ID NO: 2594067 - RNA, 23 nt, Human
aauuuaaauauaauucuguaaau

SEQ ID NO: 2594068 - RNA, 20 nt, Human
aauuuaaauauaauucugua

SEQ ID NO: 2594069 - RNA, 19 nt, Human
aauuuaaauauaauucugu

SEQ ID NO: 2594070 - RNA, 16 nt, Human
aauuuaaauauaauuc

SEQ ID NO: 2594071 - RNA, 18 nt, Human
aauuggaccauccuauuu

SEQ ID NO: 2594072 - RNA, 15 nt, Human
aauuggagcucgugg

SEQ ID NO: 2594073 - RNA, 20 nt, Human
aauuggaacagaauguuuua

SEQ ID NO: 2594074 - RNA, 20 nt, Human
aauuggaagcugcccugccc

SEQ ID NO: 2594075 - RNA, 11 nt, Human
aauugcuuuga

SEQ ID NO: 2594076 - RNA, 10 nt, Human
aauugcuuug

SEQ ID NO: 2594077 - RNA, 22 nt, Human
aauugcuuuaccuuuuuucuua

SEQ ID NO: 2594078 - RNA, 15 nt, Human
aauugcuugaaagaa

SEQ ID NO: 2594079 - RNA, 17 nt, Human
aauugcuugaaagaaaa

SEQ ID NO: 2594080 - RNA, 22 nt, Human
aauugcuugaaagaaaauaugc

SEQ ID NO: 2594081 - RNA, 13 nt, Human
aauuuauuauggc

SEQ ID NO: 2594082 - RNA, 14 nt, Human
aauuuauuauggca

SEQ ID NO: 2594083 - RNA, 19 nt, Human
aauuuauuaguuaauauau

SEQ ID NO: 2594084 - RNA, 13 nt, Human
aauuucuauuaaa

SEQ ID NO: 2594085 - RNA, 19 nt, Human
aauuucucccagucauuua

SEQ ID NO: 2594086 - RNA, 21 nt, Human
aauuucuuacuaaacauuuug

SEQ ID NO: 2594087 - RNA, 20 nt, Human
aauuucuucacuguugaaaa

SEQ ID NO: 2594088 - RNA, 20 nt, Human
aauuucuuacuaaacauuuu

SEQ ID NO: 2594089 - RNA, 22 nt, Human
aauuucuuuauguaaucuaugu

SEQ ID NO: 2594090 - RNA, 20 nt, Human
aauuucuugguaagaagccg

SEQ ID NO: 2594091 - RNA, 17 nt, Human
aauuucuugguaagaag

SEQ ID NO: 2594092 - RNA, 17 nt, Human
aauuuauuaauugcuuu

SEQ ID NO: 2594093 - RNA, 15 nt, Human
aauuuauuaaaauga

SEQ ID NO: 2594094 - RNA, 18 nt, Human
aauuuauuaauugcuuug

SEQ ID NO: 2594095 - RNA, 18 nt, Human
aauuuauuaguuaauaua

SEQ ID NO: 2594096 - RNA, 17 nt, Human
aauuuauuaguuaauau

SEQ ID NO: 2594097 - RNA, 19 nt, Human
aauuuauuaauugcuuuga

SEQ ID NO: 2594098 - RNA, 17 nt, Human
aauuuaucacacuucug

SEQ ID NO: 2594099 - RNA, 17 nt, Human
aauuuauacaauaucau

SEQ ID NO: 2594100 - RNA, 20 nt, Human
aauuuauauacaaccugcuu

SEQ ID NO: 2594101 - RNA, 22 nt, Human
aauuuauaaacuuuuuucuuac

SEQ ID NO: 2594102 - RNA, 15 nt, Human
aauuuauacaauauc

SEQ ID NO: 2594103 - RNA, 16 nt, Human
aauuuaguuuuuguuc

SEQ ID NO: 2594104 - RNA, 17 nt, Human
aauuuaguuuuuguucu

SEQ ID NO: 2594105 - RNA, 20 nt, Human
aauuuaguuuuuguucuuaa

SEQ ID NO: 2594106 - RNA, 18 nt, Human
aauuuaguuuuuguucuu

SEQ ID NO: 2594107 - RNA, 13 nt, Human
uaugaaauaaaga

SEQ ID NO: 2594108 - RNA, 23 nt, Human
uaugaaagauggcugugccucug

SEQ ID NO: 2594109 - RNA, 22 nt, Human
uaugaaagauggcugugccucu

SEQ ID NO: 2594110 - RNA, 20 nt, Human
uaugaaagauggcugugccu

SEQ ID NO: 2594111 - RNA, 17 nt, Human
uaucuuugauucuccuu

SEQ ID NO: 2594112 - RNA, 13 nt, Human
uaucuuucuacag

SEQ ID NO: 2594113 - RNA, 12 nt, Human
uaucuuucuaca

SEQ ID NO: 2594114 - RNA, 16 nt, Human
uaucuuugauucuccu

SEQ ID NO: 2594115 - RNA, 23 nt, Human
uaucuuucgugauaaacuuugcu

SEQ ID NO: 2594116 - RNA, 19 nt, Human
uaucuuucgcacagcaguu

SEQ ID NO: 2594117 - RNA, 14 nt, Human
uaucuuuauuaauc

SEQ ID NO: 2594118 - RNA, 15 nt, Human
uaucuuuauuaauca

SEQ ID NO: 2594119 - RNA, 22 nt, Human
uaucuuguuuuuccacuacugc

SEQ ID NO: 2594120 - RNA, 20 nt, Human
acagccgcagccucccucug

SEQ ID NO: 2594121 - RNA, 19 nt, Human
acagccgauucaccugagc

SEQ ID NO: 2594122 - RNA, 13 nt, Human
acagccgcagccu

SEQ ID NO: 2594123 - RNA, 17 nt, Human
uaucuugucucugggcu

SEQ ID NO: 2594124 - RNA, 14 nt, Human
uaucuuguuuuucc

SEQ ID NO: 2594125 - RNA, 18 nt, Human
uaucuuguuuuuccacua

SEQ ID NO: 2594126 - RNA, 23 nt, Human
uaucuuggugaauuuuuuuuucc

SEQ ID NO: 2594127 - RNA, 15 nt, Human
uaucuugucucuggg

SEQ ID NO: 2594128 - RNA, 21 nt, Human
acagcccuucuuuccacagaa

SEQ ID NO: 2594129 - RNA, 20 nt, Human
acagcccuucuuuccacaga

SEQ ID NO: 2594130 - RNA, 14 nt, Human
acagcaaccccagg

SEQ ID NO: 2594131 - RNA, 23 nt, Human
acagcccgggcucugccucccau

SEQ ID NO: 2594132 - RNA, 22 nt, Human
acagcccgggcucugccuccca

SEQ ID NO: 2594133 - RNA, 21 nt, Human
acagcccgggcucugccuccc

SEQ ID NO: 2594134 - RNA, 20 nt, Human
acagcaacaauuuaugaauu

SEQ ID NO: 2594135 - RNA, 17 nt, Human
acagcaacaauuuauga

SEQ ID NO: 2594136 - RNA, 20 nt, Human
acagauacuccuccaagguu

SEQ ID NO: 2594137 - RNA, 20 nt, Human
acagauagauauaugcucug

SEQ ID NO: 2594138 - RNA, 22 nt, Human
acagauacuggaaguuuugcau

SEQ ID NO: 2594139 - RNA, 21 nt, Human
acagauacuggaaguuuugca

SEQ ID NO: 2594140 - RNA, 13 nt, Human
acagaugccccag

SEQ ID NO: 2594141 - RNA, 14 nt, Human
acagaugccccaga

SEQ ID NO: 2594142 - RNA, 16 nt, Human
acagaugccccagagc

SEQ ID NO: 2594143 - RNA, 17 nt, Human
acagaugccccagagcu

SEQ ID NO: 2594144 - RNA, 18 nt, Human
acagaugccccagagcug

SEQ ID NO: 2594145 - RNA, 19 nt, Human
acagaugccccagagcugu

SEQ ID NO: 2594146 - RNA, 21 nt, Human
acagaguuguuacauuuuuaa

SEQ ID NO: 2594147 - RNA, 22 nt, Human
acagaguuguuacauuuuuaag

SEQ ID NO: 2594148 - RNA, 20 nt, Human
acagauaagcaagagagaug

SEQ ID NO: 2594149 - RNA, 14 nt, Human
acagauaaucagug

SEQ ID NO: 2594150 - RNA, 15 nt, Human
acagaguuguuacau

SEQ ID NO: 2594151 - RNA, 14 nt, Human
acagaggaagagca

SEQ ID NO: 2594152 - RNA, 16 nt, Human
acagaggaagagcagg

SEQ ID NO: 2594153 - RNA, 21 nt, Human
acagauaagcaagagagaugu

SEQ ID NO: 2594154 - RNA, 17 nt, Human
acagauuuuuacaaaug

SEQ ID NO: 2594155 - RNA, 16 nt, Human
acagauuuuuacaaau

SEQ ID NO: 2594156 - RNA, 16 nt, Human
acagauucacacuguc

SEQ ID NO: 2594157 - RNA, 24 nt, Human
acagauguuucuuuuguauguaaa

SEQ ID NO: 2594158 - RNA, 17 nt, Human
acagauucacacugucu

SEQ ID NO: 2594159 - RNA, 18 nt, Human
acagcaaaacuccaucuc

SEQ ID NO: 2594160 - RNA, 20 nt, Human
acagaugucagccgagccgg

SEQ ID NO: 2594161 - RNA, 19 nt, Human
acagauucacacugucugg

SEQ ID NO: 2594162 - RNA, 15 nt, Human
acagauucacacugu

SEQ ID NO: 2594163 - RNA, 23 nt, Human
acagauguuucuuuuguauguaa

SEQ ID NO: 2594164 - RNA, 12 nt, Human
acagauguugaa

SEQ ID NO: 2594165 - RNA, 14 nt, Human
acagaugcuuuucu

SEQ ID NO: 2594166 - RNA, 21 nt, Human
acagaugcuuuucugucucug

SEQ ID NO: 2594167 - RNA, 16 nt, Human
acagauggauuugccu

SEQ ID NO: 2594168 - RNA, 17 nt, Human
acagauggauuugccug

SEQ ID NO: 2594169 - RNA, 12 nt, Human
acagaugccucc

SEQ ID NO: 2594170 - RNA, 21 nt, Human
acagaugccccagagcuguuu

SEQ ID NO: 2594171 - RNA, 22 nt, Human
acagaugccccagagcuguuua

SEQ ID NO: 2594172 - RNA, 23 nt, Human
acagaugggugcuuggaggaagg

SEQ ID NO: 2594173 - RNA, 22 nt, Human
acagauggcacuuugaaggggc

SEQ ID NO: 2594174 - RNA, 16 nt, Human
acagaugggcaaauua

SEQ ID NO: 2594175 - RNA, 20 nt, Human
acagauguaaaagacuuuuu

SEQ ID NO: 2594176 - RNA, 21 nt, Human
uauccuccagguuuuucaauu

SEQ ID NO: 2594177 - RNA, 20 nt, Human
uauccuccagguuuuucaau

SEQ ID NO: 2594178 - RNA, 19 nt, Human
uauccuccagguuuuucaa

SEQ ID NO: 2594179 - RNA, 18 nt, Human
uauccuccagguuuuuca

SEQ ID NO: 2594180 - RNA, 17 nt, Human
uauccuccagguuuuuc

SEQ ID NO: 2594181 - RNA, 15 nt, Human
uauccuccagguuuu

SEQ ID NO: 2594182 - RNA, 14 nt, Human
uauccuccagguuu

SEQ ID NO: 2594183 - RNA, 13 nt, Human
uauccuccagguu

SEQ ID NO: 2594184 - RNA, 19 nt, Human
uauccuacaacaagaguuu

SEQ ID NO: 2594185 - RNA, 15 nt, Human
uauccuacaacaaga

SEQ ID NO: 2594186 - RNA, 12 nt, Human
uauccuccaggu

SEQ ID NO: 2594187 - RNA, 14 nt, Human
uauccuacuucccc

SEQ ID NO: 2594188 - RNA, 17 nt, Human
uauccuacuuccccuuc

SEQ ID NO: 2594189 - RNA, 12 nt, Human
uauccuacuucu

SEQ ID NO: 2594190 - RNA, 22 nt, Human
uauccuccagguuuuucaauua

SEQ ID NO: 2594191 - RNA, 16 nt, Human
uaucucacuugugcca

SEQ ID NO: 2594192 - RNA, 13 nt, Human
uaucucagggccu

SEQ ID NO: 2594193 - RNA, 15 nt, Human
uaucucagggccugg

SEQ ID NO: 2594194 - RNA, 19 nt, Human
uaucccuacuguaauuugu

SEQ ID NO: 2594195 - RNA, 20 nt, Human
uaucccuacuguaauuugug

SEQ ID NO: 2594196 - RNA, 15 nt, Human
uaucccucaccugua

SEQ ID NO: 2594197 - RNA, 15 nt, Human
uaucccuacauguau

SEQ ID NO: 2594198 - RNA, 16 nt, Human
uaucccggcugcccuu

SEQ ID NO: 2594199 - RNA, 12 nt, Human
uaucccucucca

SEQ ID NO: 2594200 - RNA, 15 nt, Human
uauauuuauuacugu

SEQ ID NO: 2594201 - RNA, 22 nt, Human
uauauuuauaacucaucauaaa

SEQ ID NO: 2594202 - RNA, 23 nt, Human
uauauuuauaacucaucauaaaa

SEQ ID NO: 2594203 - RNA, 19 nt, Human
uauauuuauuacuguaaga

SEQ ID NO: 2594204 - RNA, 24 nt, Human
uauauuuauaacucaucauaaaau

SEQ ID NO: 2594205 - RNA, 16 nt, Human
uauauuuauacuguau

SEQ ID NO: 2594206 - RNA, 15 nt, Human
uaucccggcugcccu

SEQ ID NO: 2594207 - RNA, 11 nt, Human
uaucucugugu

SEQ ID NO: 2594208 - RNA, 16 nt, Human
uaucucugugugcaca

SEQ ID NO: 2594209 - RNA, 17 nt, Human
uaucucugugugcacaa

SEQ ID NO: 2594210 - RNA, 18 nt, Human
uaucucugugugcacaaa

SEQ ID NO: 2594211 - RNA, 23 nt, Human
uaucucugugugcacaaauauuu

SEQ ID NO: 2594212 - RNA, 22 nt, Human
acagagagucccacugccucag

SEQ ID NO: 2594213 - RNA, 18 nt, Human
uaucucugaagcauguuu

SEQ ID NO: 2594214 - RNA, 23 nt, Human
uaucucugaagcauguuucaugu

SEQ ID NO: 2594215 - RNA, 17 nt, Human
uaucucugaagcauguu

SEQ ID NO: 2594216 - RNA, 16 nt, Human
uaucucugaagcaugu

SEQ ID NO: 2594217 - RNA, 15 nt, Human
uaucucugaagcaug

SEQ ID NO: 2594218 - RNA, 13 nt, Human
uaucucucugugc

SEQ ID NO: 2594219 - RNA, 12 nt, Human
uaucucucugug

SEQ ID NO: 2594220 - RNA, 20 nt, Human
uaucucucucucuuuuugga

SEQ ID NO: 2594221 - RNA, 20 nt, Human
uaucucuauuuaauauuuau

SEQ ID NO: 2594222 - RNA, 18 nt, Human
uaucucuauuuaauauuu

SEQ ID NO: 2594223 - RNA, 17 nt, Human
uaucucuauuuaauauu

SEQ ID NO: 2594224 - RNA, 16 nt, Human
uaucucuauuuaauau

SEQ ID NO: 2594225 - RNA, 16 nt, Human
uaucucgugggagagc

SEQ ID NO: 2594226 - RNA, 21 nt, Human
acagagcaagugagacccugu

SEQ ID NO: 2594227 - RNA, 11 nt, Human
acagagccagu

SEQ ID NO: 2594228 - RNA, 14 nt, Human
acagagcaggacug

SEQ ID NO: 2594229 - RNA, 15 nt, Human
acagagcaagacucu

SEQ ID NO: 2594230 - RNA, 17 nt, Human
acagaguuguuacauuu

SEQ ID NO: 2594231 - RNA, 18 nt, Human
acagaguuguuacauuuu

SEQ ID NO: 2594232 - RNA, 19 nt, Human
acagaguuguuacauuuuu

SEQ ID NO: 2594233 - RNA, 20 nt, Human
acagaguuguuacauuuuua

SEQ ID NO: 2594234 - RNA, 14 nt, Human
acagagcuucccug

SEQ ID NO: 2594235 - RNA, 15 nt, Human
acagagcuucccuga

SEQ ID NO: 2594236 - RNA, 20 nt, Human
acagaggaagaauuuguuau

SEQ ID NO: 2594237 - RNA, 19 nt, Human
acagaggaagaauuuguua

SEQ ID NO: 2594238 - RNA, 16 nt, Human
acagagcuucccugac

SEQ ID NO: 2594239 - RNA, 16 nt, Human
acagaguuguuacauu

SEQ ID NO: 2594240 - RNA, 21 nt, Human
acagagcugguugggaagaca

SEQ ID NO: 2594241 - RNA, 21 nt, Human
acagagcugggauguuucugu

SEQ ID NO: 2594242 - RNA, 18 nt, Human
acagagcugggauguuuc

SEQ ID NO: 2594243 - RNA, 10 nt, Human
acagagcugg

SEQ ID NO: 2594244 - RNA, 15 nt, Human
acagagcucuccagc

SEQ ID NO: 2594245 - RNA, 18 nt, Human
acagagcucuccagcucc

SEQ ID NO: 2594246 - RNA, 14 nt, Human
acagagcugggaug

SEQ ID NO: 2594247 - RNA, 18 nt, Human
uauauucccaauagcaac

SEQ ID NO: 2594248 - RNA, 19 nt, Human
uauauuccauauauuagca

SEQ ID NO: 2594249 - RNA, 21 nt, Human
uauauuccauauauuagcauu

SEQ ID NO: 2594250 - RNA, 14 nt, Human
uauauucauauauu

SEQ ID NO: 2594251 - RNA, 23 nt, Human
uauauuauuucuaggaagaauuu

SEQ ID NO: 2594252 - RNA, 22 nt, Human
uauauuauuucuaggaagaauu

SEQ ID NO: 2594253 - RNA, 16 nt, Human
uauauuauuucuagga

SEQ ID NO: 2594254 - RNA, 12 nt, Human
uauauuuacaaa

SEQ ID NO: 2594255 - RNA, 15 nt, Human
uauauuuaacaagau

SEQ ID NO: 2594256 - RNA, 15 nt, Human
uauauuuaaugauaa

SEQ ID NO: 2594257 - RNA, 14 nt, Human
uauauuuaaaagaa

SEQ ID NO: 2594258 - RNA, 19 nt, Human
acagaaagcagaacaguga

SEQ ID NO: 2594259 - RNA, 15 nt, Human
acagacacaggcccg

SEQ ID NO: 2594260 - RNA, 17 nt, Human
acagacacaggcccggc

SEQ ID NO: 2594261 - RNA, 22 nt, Human
acagacacaggcccggcuccag

SEQ ID NO: 2594262 - RNA, 18 nt, Human
acagacacaggcccggcu

SEQ ID NO: 2594263 - RNA, 22 nt, Human
uauauuaucaugcaaaugcugu

SEQ ID NO: 2594264 - RNA, 21 nt, Human
acagacuggaagcacagcuuc

SEQ ID NO: 2594265 - RNA, 19 nt, Human
acagacuggaagcacagcu

SEQ ID NO: 2594266 - RNA, 17 nt, Human
acagacuggaagcacag

SEQ ID NO: 2594267 - RNA, 13 nt, Human
acacuugugugug

SEQ ID NO: 2594268 - RNA, 16 nt, Human
acacuugugugugggc

SEQ ID NO: 2594269 - RNA, 18 nt, Human
acacuugugugugggcug

SEQ ID NO: 2594270 - RNA, 22 nt, Human
acacuugugugugggcugugag

SEQ ID NO: 2594271 - RNA, 19 nt, Human
acacuuguuccagcucuuu

SEQ ID NO: 2594272 - RNA, 20 nt, Human
acacuuguuccagcucuuug

SEQ ID NO: 2594273 - RNA, 19 nt, Human
acacuuguccccaaauccg

SEQ ID NO: 2594274 - RNA, 23 nt, Human
acacuguuucaaacuuuacuaug

SEQ ID NO: 2594275 - RNA, 13 nt, Human
acacuuaacagau

SEQ ID NO: 2594276 - RNA, 11 nt, Human
acacuuaacag

SEQ ID NO: 2594277 - RNA, 13 nt, Human
acacuuaaaaaug

SEQ ID NO: 2594278 - RNA, 15 nt, Human
acacuuaaaaauggu

SEQ ID NO: 2594279 - RNA, 15 nt, Human
acacuguuucaaacu

SEQ ID NO: 2594280 - RNA, 21 nt, Human
acacuguuuacaagaaaaaau

SEQ ID NO: 2594281 - RNA, 23 nt, Human
acacuguuuacaagaaaaaauga

SEQ ID NO: 2594282 - RNA, 20 nt, Human
acacuuguugauuaauggaa

SEQ ID NO: 2594283 - RNA, 23 nt, Human
acacuuguugauuaauggaaaug

SEQ ID NO: 2594284 - RNA, 22 nt, Human
acacuuuaugccggaugugcuu

SEQ ID NO: 2594285 - RNA, 21 nt, Human
acacuuuaugccggaugugcu

SEQ ID NO: 2594286 - RNA, 13 nt, Human
acacuuuacaaug

SEQ ID NO: 2594287 - RNA, 12 nt, Human
acacuuuacaau

SEQ ID NO: 2594288 - RNA, 22 nt, Human
acacuuuaauuaccaaccuguu

SEQ ID NO: 2594289 - RNA, 23 nt, Human
acacuugugugugggcugugagu

SEQ ID NO: 2594290 - RNA, 22 nt, Human
acacuuugcacugauauaucau

SEQ ID NO: 2594291 - RNA, 19 nt, Human
acacuuugcacugauauau

SEQ ID NO: 2594292 - RNA, 19 nt, Human
acacuuugccauauuuuca

SEQ ID NO: 2594293 - RNA, 21 nt, Human
acacuuugaaauguguuucug

SEQ ID NO: 2594294 - RNA, 20 nt, Human
acacuuugaaauguguuucu

SEQ ID NO: 2594295 - RNA, 17 nt, Human
acacuuugcacugauau

SEQ ID NO: 2594296 - RNA, 18 nt, Human
acacuuugaaauguguuu

SEQ ID NO: 2594297 - RNA, 17 nt, Human
acacuuugaaauguguu

SEQ ID NO: 2594298 - RNA, 23 nt, Human
acacuuuaugccggaugugcuuu

SEQ ID NO: 2594299 - RNA, 12 nt, Human
acagaaacaaaa

SEQ ID NO: 2594300 - RNA, 17 nt, Human
acagaaacaaaaacacu

SEQ ID NO: 2594301 - RNA, 18 nt, Human
acagaaaauucuucucca

SEQ ID NO: 2594302 - RNA, 23 nt, Human
acacuuugaaauguguuucugua

SEQ ID NO: 2594303 - RNA, 18 nt, Human
acagaaaccucuacuaaa

SEQ ID NO: 2594304 - RNA, 15 nt, Human
acagaaaccuuuuua

SEQ ID NO: 2594305 - RNA, 20 nt, Human
acagaaaccuuuuuaaaaau

SEQ ID NO: 2594306 - RNA, 14 nt, Human
acagaaacauuuuc

SEQ ID NO: 2594307 - RNA, 24 nt, Human
acacucgcccgcccacuguccugg

SEQ ID NO: 2594308 - RNA, 23 nt, Human
acacucgcccgcccacuguccug

SEQ ID NO: 2594309 - RNA, 16 nt, Human
acacucgcccgcccac

SEQ ID NO: 2594310 - RNA, 13 nt, Human
acacucugagacu

SEQ ID NO: 2594311 - RNA, 11 nt, Human
acacucugaga

SEQ ID NO: 2594312 - RNA, 14 nt, Human
acacuccagugaga

SEQ ID NO: 2594313 - RNA, 14 nt, Human
acacuccagugcca

SEQ ID NO: 2594314 - RNA, 13 nt, Human
acacuccagugcc

SEQ ID NO: 2594315 - RNA, 13 nt, Human
acacuccuucaca

SEQ ID NO: 2594316 - RNA, 21 nt, Human
acacuccaauuaaggauuuua

SEQ ID NO: 2594317 - RNA, 12 nt, Human
acacuccagccu

SEQ ID NO: 2594318 - RNA, 14 nt, Human
acacuccagccuga

SEQ ID NO: 2594319 - RNA, 15 nt, Human
acacuccagccugag

SEQ ID NO: 2594320 - RNA, 16 nt, Human
acacuccagccugagc

SEQ ID NO: 2594321 - RNA, 15 nt, Human
acacuccagccuggg

SEQ ID NO: 2594322 - RNA, 17 nt, Human
acacuccagccugagca

SEQ ID NO: 2594323 - RNA, 18 nt, Human
uauaaguaagaaaauauu

SEQ ID NO: 2594324 - RNA, 16 nt, Human
uauaaguaagaaaaua

SEQ ID NO: 2594325 - RNA, 15 nt, Human
uauaaguaagaaaau

SEQ ID NO: 2594326 - RNA, 14 nt, Human
uauaaguaagaaaa

SEQ ID NO: 2594327 - RNA, 16 nt, Human
acacucacccaacaau

SEQ ID NO: 2594328 - RNA, 17 nt, Human
uauaagguuuaaaaaga

SEQ ID NO: 2594329 - RNA, 15 nt, Human
uauaagguuuuaagu

SEQ ID NO: 2594330 - RNA, 16 nt, Human
uauaacuagcuagaag

SEQ ID NO: 2594331 - RNA, 19 nt, Human
acacucagaccugaauucu

SEQ ID NO: 2594332 - RNA, 14 nt, Human
acacucagaccuga

SEQ ID NO: 2594333 - RNA, 13 nt, Human
acacucagcacaa

SEQ ID NO: 2594334 - RNA, 18 nt, Human
acacuccaauuaaggauu

SEQ ID NO: 2594335 - RNA, 17 nt, Human
acacuccaauuaaggau

SEQ ID NO: 2594336 - RNA, 16 nt, Human
acacucagcacaaggc

SEQ ID NO: 2594337 - RNA, 16 nt, Human
acacucacuccugaga

SEQ ID NO: 2594338 - RNA, 19 nt, Human
acacucaccucuaaaacag

SEQ ID NO: 2594339 - RNA, 16 nt, Human
uauaaguagcaggcca

SEQ ID NO: 2594340 - RNA, 18 nt, Human
acacucaccucuaaaaca

SEQ ID NO: 2594341 - RNA, 21 nt, Human
acacucacuccugagaccccu

SEQ ID NO: 2594342 - RNA, 20 nt, Human
acacuguucucugcccucca

SEQ ID NO: 2594343 - RNA, 18 nt, Human
acacuguucucugcccuc

SEQ ID NO: 2594344 - RNA, 17 nt, Human
acacuguucucugcccu

SEQ ID NO: 2594345 - RNA, 16 nt, Human
acacuguucucugccc

SEQ ID NO: 2594346 - RNA, 23 nt, Human
acacuguucucugcccuccaaga

SEQ ID NO: 2594347 - RNA, 22 nt, Human
acacuguucucugcccuccaag

SEQ ID NO: 2594348 - RNA, 20 nt, Human
acacuguucugaaagugacu

SEQ ID NO: 2594349 - RNA, 14 nt, Human
acacuguucugaaa

SEQ ID NO: 2594350 - RNA, 22 nt, Human
acacugaaauauacacacagca

SEQ ID NO: 2594351 - RNA, 14 nt, Human
acacugaagaagca

SEQ ID NO: 2594352 - RNA, 12 nt, Human
acacugaagaag

SEQ ID NO: 2594353 - RNA, 15 nt, Human
acacuguucucugcc

SEQ ID NO: 2594354 - RNA, 14 nt, Human
acacuguucucugc

SEQ ID NO: 2594355 - RNA, 23 nt, Human
acacugaaaaaucuaagugauau

SEQ ID NO: 2594356 - RNA, 21 nt, Human
acacucuuuugcuuuauucca

SEQ ID NO: 2594357 - RNA, 17 nt, Human
acacugaaauauacaca

SEQ ID NO: 2594358 - RNA, 18 nt, Human
acacugaaauauacacac

SEQ ID NO: 2594359 - RNA, 20 nt, Human
acacugaaauauacacacag

SEQ ID NO: 2594360 - RNA, 21 nt, Human
acacugaaauauacacacagc

SEQ ID NO: 2594361 - RNA, 16 nt, Human
acacucuuuguaagag

SEQ ID NO: 2594362 - RNA, 12 nt, Human
acacucuuugua

SEQ ID NO: 2594363 - RNA, 14 nt, Human
acacucugcucugc

SEQ ID NO: 2594364 - RNA, 13 nt, Human
acacucugcucug

SEQ ID NO: 2594365 - RNA, 16 nt, Human
acacucugcucugccc

SEQ ID NO: 2594366 - RNA, 14 nt, Human
acacucuggcuggu

SEQ ID NO: 2594367 - RNA, 20 nt, Human
acacucugggcuccagagug

SEQ ID NO: 2594368 - RNA, 17 nt, Human
acacccacucagcuccg

SEQ ID NO: 2594369 - RNA, 12 nt, Human
acacccagccuc

SEQ ID NO: 2594370 - RNA, 16 nt, Human
acacccagccucaguc

SEQ ID NO: 2594371 - RNA, 14 nt, Human
acacccagccucag

SEQ ID NO: 2594372 - RNA, 13 nt, Human
acacccagccuca

SEQ ID NO: 2594373 - RNA, 23 nt, Human
acacccaccguccgcccugcucc

SEQ ID NO: 2594374 - RNA, 20 nt, Human
acacccagccucaguccucc

SEQ ID NO: 2594375 - RNA, 17 nt, Human
acacccagccucagucc

SEQ ID NO: 2594376 - RNA, 23 nt, Human
acacccagccucaguccuccccu

SEQ ID NO: 2594377 - RNA, 21 nt, Human
acaccccagacgaugucuuca

SEQ ID NO: 2594378 - RNA, 20 nt, Human
acaccccauugguggacuac

SEQ ID NO: 2594379 - RNA, 15 nt, Human
acacccaucuguuuu

SEQ ID NO: 2594380 - RNA, 13 nt, Human
acacccauguuuc

SEQ ID NO: 2594381 - RNA, 16 nt, Human
acaccucccugaacca

SEQ ID NO: 2594382 - RNA, 22 nt, Human
acaccucccugaaccaucccug

SEQ ID NO: 2594383 - RNA, 19 nt, Human
acaccucccaggagacagu

SEQ ID NO: 2594384 - RNA, 13 nt, Human
acaccucccugaa

SEQ ID NO: 2594385 - RNA, 13 nt, Human
acaccucccagga

SEQ ID NO: 2594386 - RNA, 23 nt, Human
acaccccuccccugcccuagagc

SEQ ID NO: 2594387 - RNA, 14 nt, Human
acacccccaccccu

SEQ ID NO: 2594388 - RNA, 16 nt, Human
acaccccuccccugcc

SEQ ID NO: 2594389 - RNA, 12 nt, Human
acaccucgcccc

SEQ ID NO: 2594390 - RNA, 18 nt, Human
acaccucugcacaagcug

SEQ ID NO: 2594391 - RNA, 16 nt, Human
acaccuugacagggca

SEQ ID NO: 2594392 - RNA, 15 nt, Human
acaccuugacagggc

SEQ ID NO: 2594393 - RNA, 14 nt, Human
acaccuucucugga

SEQ ID NO: 2594394 - RNA, 13 nt, Human
acaccuucucugg

SEQ ID NO: 2594395 - RNA, 14 nt, Human
acaccuugacaggg

SEQ ID NO: 2594396 - RNA, 13 nt, Human
acaccugcccugc

SEQ ID NO: 2594397 - RNA, 14 nt, Human
acaccugcccugcc

SEQ ID NO: 2594398 - RNA, 15 nt, Human
acaccugauguguac

SEQ ID NO: 2594399 - RNA, 18 nt, Human
acaccugauguguacauc

SEQ ID NO: 2594400 - RNA, 17 nt, Human
acaccugauguguacau

SEQ ID NO: 2594401 - RNA, 11 nt, Human
acaccugcacc

SEQ ID NO: 2594402 - RNA, 12 nt, Human
acaccugcaccu

SEQ ID NO: 2594403 - RNA, 14 nt, Human
acaccugcaccucc

SEQ ID NO: 2594404 - RNA, 15 nt, Human
acaccugcaccuccc

SEQ ID NO: 2594405 - RNA, 16 nt, Human
acaccugcaccucccc

SEQ ID NO: 2594406 - RNA, 18 nt, Human
acaccugcaccucccccc

SEQ ID NO: 2594407 - RNA, 19 nt, Human
acaccugcaccucccccca

SEQ ID NO: 2594408 - RNA, 24 nt, Human
acaccugcaccuccccccacugca

SEQ ID NO: 2594409 - RNA, 20 nt, Human
acaccuuggacauccuccuc

SEQ ID NO: 2594410 - RNA, 19 nt, Human
acacuaagagagaaugaga

SEQ ID NO: 2594411 - RNA, 18 nt, Human
acacuaagagagaaugag

SEQ ID NO: 2594412 - RNA, 17 nt, Human
acacuaagagagaauga

SEQ ID NO: 2594413 - RNA, 19 nt, Human
acacuaaccacgcuggacc

SEQ ID NO: 2594414 - RNA, 17 nt, Human
acacuaaccacgcugga

SEQ ID NO: 2594415 - RNA, 16 nt, Human
acacuaaccacgcugg

SEQ ID NO: 2594416 - RNA, 15 nt, Human
uauaaccccagcucc

SEQ ID NO: 2594417 - RNA, 19 nt, Human
uauaacuacuccggagaca

SEQ ID NO: 2594418 - RNA, 14 nt, Human
uauaacuaguccuu

SEQ ID NO: 2594419 - RNA, 16 nt, Human
uauaaggaaagcaaua

SEQ ID NO: 2594420 - RNA, 18 nt, Human
uauaacuaguccuuuacu

SEQ ID NO: 2594421 - RNA, 22 nt, Human
uauaaggaaagcaauaaaugaa

SEQ ID NO: 2594422 - RNA, 23 nt, Human
uauaaggaaagcaauaaaugaau

SEQ ID NO: 2594423 - RNA, 21 nt, Human
acacuagccagacacucugcu

SEQ ID NO: 2594424 - RNA, 19 nt, Human
acacuagccagacacucug

SEQ ID NO: 2594425 - RNA, 14 nt, Human
acacuacauuagaa

SEQ ID NO: 2594426 - RNA, 23 nt, Human
acacuaauuccuuucuauccuac

SEQ ID NO: 2594427 - RNA, 22 nt, Human
uauaaccaguguuguggauuua

SEQ ID NO: 2594428 - RNA, 17 nt, Human
acacuagcccaaugaaa

SEQ ID NO: 2594429 - RNA, 20 nt, Human
acacuagcccaaugaaauga

SEQ ID NO: 2594430 - RNA, 22 nt, Human
acacuagcuaauaucaauagaa

SEQ ID NO: 2594431 - RNA, 13 nt, Human
acacuagccucuc

SEQ ID NO: 2594432 - RNA, 15 nt, Human
acacuagccucucca

SEQ ID NO: 2594433 - RNA, 22 nt, Human
acacccaccguccgcccugcuc

SEQ ID NO: 2594434 - RNA, 21 nt, Human
acacccaccguccgcccugcu

SEQ ID NO: 2594435 - RNA, 15 nt, Human
acacccacucagcuc

SEQ ID NO: 2594436 - RNA, 17 nt, Human
acacccaccguccgccc

SEQ ID NO: 2594437 - RNA, 13 nt, Human
acacccagcccac

SEQ ID NO: 2594438 - RNA, 12 nt, Human
acacccagccca

SEQ ID NO: 2594439 - RNA, 22 nt, Human
acacauguccaagaagcccagg

SEQ ID NO: 2594440 - RNA, 21 nt, Human
acacauguccaagaagcccag

SEQ ID NO: 2594441 - RNA, 18 nt, Human
acacauucggcucccugg

SEQ ID NO: 2594442 - RNA, 17 nt, Human
acacauucaauaagcau

SEQ ID NO: 2594443 - RNA, 16 nt, Human
acacauucaauaagca

SEQ ID NO: 2594444 - RNA, 23 nt, Human
acacauuaucgggagcagugucu

SEQ ID NO: 2594445 - RNA, 20 nt, Human
acacauuaucgggagcagug

SEQ ID NO: 2594446 - RNA, 19 nt, Human
acacauguccaagaagccc

SEQ ID NO: 2594447 - RNA, 18 nt, Human
acacauguccaagaagcc

SEQ ID NO: 2594448 - RNA, 13 nt, Human
acacauguccaag

SEQ ID NO: 2594449 - RNA, 21 nt, Human
uauaaaaucagccaauuaugu

SEQ ID NO: 2594450 - RNA, 15 nt, Human
uauaaaauauuuuca

SEQ ID NO: 2594451 - RNA, 13 nt, Human
acacaugcauaca

SEQ ID NO: 2594452 - RNA, 14 nt, Human
acacaugcauacac

SEQ ID NO: 2594453 - RNA, 15 nt, Human
uauaaaauuaagcaa

SEQ ID NO: 2594454 - RNA, 15 nt, Human
acacaugcauacaca

SEQ ID NO: 2594455 - RNA, 16 nt, Human
acacaugcauacacac

SEQ ID NO: 2594456 - RNA, 17 nt, Human
acacaugcauacacaca

SEQ ID NO: 2594457 - RNA, 18 nt, Human
acacaugcauacacacac

SEQ ID NO: 2594458 - RNA, 19 nt, Human
acacaugcauacacacaca

SEQ ID NO: 2594459 - RNA, 21 nt, Human
uauaaaaauaaaaaacacugg

SEQ ID NO: 2594460 - RNA, 20 nt, Human
uauaaaaauaaaaaacacug

SEQ ID NO: 2594461 - RNA, 21 nt, Human
uaguuuuuguucuuaauugca

SEQ ID NO: 2594462 - RNA, 15 nt, Human
uaguuuuuguucuua

SEQ ID NO: 2594463 - RNA, 16 nt, Human
uauaaaacuguacuuc

SEQ ID NO: 2594464 - RNA, 22 nt, Human
uauaaaacugcguuaaaggcuc

SEQ ID NO: 2594465 - RNA, 19 nt, Human
uauaaaacugcguuaaagg

SEQ ID NO: 2594466 - RNA, 17 nt, Human
uauaaaacaggucaaua

SEQ ID NO: 2594467 - RNA, 20 nt, Human
uauaaaaucagccaauuaug

SEQ ID NO: 2594468 - RNA, 19 nt, Human
uauaaaaucagccaauuau

SEQ ID NO: 2594469 - RNA, 17 nt, Human
uauaaaaucagccaauu

SEQ ID NO: 2594470 - RNA, 16 nt, Human
uauaaaaucagccaau

SEQ ID NO: 2594471 - RNA, 21 nt, Human
uauaaaauaugaagacauaaa

SEQ ID NO: 2594472 - RNA, 23 nt, Human
uauaaaauaugaagacauaaacc

SEQ ID NO: 2594473 - RNA, 14 nt, Human
uauaaaaucagcca

SEQ ID NO: 2594474 - RNA, 15 nt, Human
uauaaaacuuuccuc

SEQ ID NO: 2594475 - RNA, 19 nt, Human
uauaaaacuguacuucacu

SEQ ID NO: 2594476 - RNA, 12 nt, Human
uauaaaacuucu

SEQ ID NO: 2594477 - RNA, 14 nt, Human
uauaaaagacugac

SEQ ID NO: 2594478 - RNA, 16 nt, Human
uaguuauaguuucaga

SEQ ID NO: 2594479 - RNA, 18 nt, Human
uaguucagguaacaggca

SEQ ID NO: 2594480 - RNA, 22 nt, Human
uaguuuuuaaaauaucuuuuga

SEQ ID NO: 2594481 - RNA, 15 nt, Human
uaguuuugucaaacu

SEQ ID NO: 2594482 - RNA, 18 nt, Human
uaguuuuuaccuaccaca

SEQ ID NO: 2594483 - RNA, 17 nt, Human
uaguuuuuguaauuuau

SEQ ID NO: 2594484 - RNA, 13 nt, Human
uaguuuuuguucu

SEQ ID NO: 2594485 - RNA, 17 nt, Human
uaguuuuucuucaacau

SEQ ID NO: 2594486 - RNA, 10 nt, Human
uaguuuuugu

SEQ ID NO: 2594487 - RNA, 21 nt, Human
uaguuuuuaaaauaucuuuug

SEQ ID NO: 2594488 - RNA, 13 nt, Human
uaguuuugucaaa

SEQ ID NO: 2594489 - RNA, 22 nt, Human
uaguuuugauuuaauguuuuca

SEQ ID NO: 2594490 - RNA, 13 nt, Human
uaguacugcucuu

SEQ ID NO: 2594491 - RNA, 15 nt, Human
uaguacugcucuugu

SEQ ID NO: 2594492 - RNA, 21 nt, Human
uaguacuccugcaaaauuuua

SEQ ID NO: 2594493 - RNA, 20 nt, Human
uaguaauagagcaaaauuga

SEQ ID NO: 2594494 - RNA, 17 nt, Human
uaguacuccugcaaaau

SEQ ID NO: 2594495 - RNA, 19 nt, Human
uaguacuccugcaaaauuu

SEQ ID NO: 2594496 - RNA, 20 nt, Human
uaguacuccugcaaaauuuu

SEQ ID NO: 2594497 - RNA, 22 nt, Human
uaguacuugaaaucuaggauua

SEQ ID NO: 2594498 - RNA, 13 nt, Human
uaguagagacagg

SEQ ID NO: 2594499 - RNA, 22 nt, Human
uaguccugugaaugccacugcc

SEQ ID NO: 2594500 - RNA, 12 nt, Human
uaguccugugaa

SEQ ID NO: 2594501 - RNA, 12 nt, Human
uagucgugagcu

SEQ ID NO: 2594502 - RNA, 22 nt, Human
uaguccuauucuauugcaguua

SEQ ID NO: 2594503 - RNA, 11 nt, Human
uaguccuguga

SEQ ID NO: 2594504 - RNA, 21 nt, Human
uagucuacucuuaagccaucu

SEQ ID NO: 2594505 - RNA, 20 nt, Human
uagucuacucuuaagccauc

SEQ ID NO: 2594506 - RNA, 22 nt, Human
uagucuacucuuaagccaucuu

SEQ ID NO: 2594507 - RNA, 18 nt, Human
uagucuagauggcuccuc

SEQ ID NO: 2594508 - RNA, 20 nt, Human
uagucuagauggcuccucuc

SEQ ID NO: 2594509 - RNA, 14 nt, Human
uagucuauuagcca

SEQ ID NO: 2594510 - RNA, 20 nt, Human
uagucguggagaugucuucg

SEQ ID NO: 2594511 - RNA, 19 nt, Human
uagucguggagaugucuuc

SEQ ID NO: 2594512 - RNA, 21 nt, Human
uagucgugagcucuugugagg

SEQ ID NO: 2594513 - RNA, 23 nt, Human
uagucuaaggaugcuaaaccuua

SEQ ID NO: 2594514 - RNA, 21 nt, Human
uagucguggagaugucuucgu

SEQ ID NO: 2594515 - RNA, 17 nt, Human
uaguguuggagaagaac

SEQ ID NO: 2594516 - RNA, 16 nt, Human
uaguguuggagaagaa

SEQ ID NO: 2594517 - RNA, 13 nt, Human
uaguguucauaaa

SEQ ID NO: 2594518 - RNA, 21 nt, Human
uagucuuuugcuuuuggcaaa

SEQ ID NO: 2594519 - RNA, 16 nt, Human
uagucuuuugcuuuug

SEQ ID NO: 2594520 - RNA, 15 nt, Human
uagucuuuugcuuuu

SEQ ID NO: 2594521 - RNA, 12 nt, Human
uaguguuggaga

SEQ ID NO: 2594522 - RNA, 17 nt, Human
uagucuuaagaacugcu

SEQ ID NO: 2594523 - RNA, 19 nt, Human
uagucuagauggcuccucu

SEQ ID NO: 2594524 - RNA, 12 nt, Human
uagucucaggac

SEQ ID NO: 2594525 - RNA, 15 nt, Human
uagucuucaagcaga

SEQ ID NO: 2594526 - RNA, 17 nt, Human
uagucuucaagcagauu

SEQ ID NO: 2594527 - RNA, 12 nt, Human
uagucuucucau

SEQ ID NO: 2594528 - RNA, 14 nt, Human
uagucuucucauag

SEQ ID NO: 2594529 - RNA, 18 nt, Human
uagucuucucauagcauu

SEQ ID NO: 2594530 - RNA, 14 nt, Human
uagucuuuugcuuu

SEQ ID NO: 2594531 - RNA, 19 nt, Human
uagucuucucauagcauua

SEQ ID NO: 2594532 - RNA, 14 nt, Human
acacacugaagaag

SEQ ID NO: 2594533 - RNA, 20 nt, Human
acacacgcaggaacucccag

SEQ ID NO: 2594534 - RNA, 16 nt, Human
acacacgcaggaacuc

SEQ ID NO: 2594535 - RNA, 14 nt, Human
acacacgcaggaac

SEQ ID NO: 2594536 - RNA, 18 nt, Human
acacacgcacgcacacac

SEQ ID NO: 2594537 - RNA, 15 nt, Human
acacacugaggcagg

SEQ ID NO: 2594538 - RNA, 16 nt, Human
acacacugaggcaggg

SEQ ID NO: 2594539 - RNA, 22 nt, Human
acacagcuuuaucaccagagag

SEQ ID NO: 2594540 - RNA, 21 nt, Human
acacagcuuuaucaccagaga

SEQ ID NO: 2594541 - RNA, 20 nt, Human
acacagcuuuaucaccagag

SEQ ID NO: 2594542 - RNA, 15 nt, Human
acacagcugggcugu

SEQ ID NO: 2594543 - RNA, 16 nt, Human
acacagcugggcugug

SEQ ID NO: 2594544 - RNA, 12 nt, Human
acacagcugggc

SEQ ID NO: 2594545 - RNA, 18 nt, Human
acacacugaggcagggaa

SEQ ID NO: 2594546 - RNA, 22 nt, Human
acacagcucuucuccaggcugu

SEQ ID NO: 2594547 - RNA, 22 nt, Human
acacagcugagagacuuuuaau

SEQ ID NO: 2594548 - RNA, 19 nt, Human
acacagcugcagagacaga

SEQ ID NO: 2594549 - RNA, 20 nt, Human
acacaggacccccuuccccu

SEQ ID NO: 2594550 - RNA, 18 nt, Human
acacaggacccccuuccc

SEQ ID NO: 2594551 - RNA, 17 nt, Human
acacaggacccccuucc

SEQ ID NO: 2594552 - RNA, 24 nt, Human
acacaggauccuauucucaccagg

SEQ ID NO: 2594553 - RNA, 15 nt, Human
acacaggcaacugag

SEQ ID NO: 2594554 - RNA, 16 nt, Human
acacaggcaacugagg

SEQ ID NO: 2594555 - RNA, 19 nt, Human
acacaggcaacugaggcag

SEQ ID NO: 2594556 - RNA, 20 nt, Human
acacaggcaacugaggcaga

SEQ ID NO: 2594557 - RNA, 11 nt, Human
acacagugagu

SEQ ID NO: 2594558 - RNA, 14 nt, Human
acacaggaggagaa

SEQ ID NO: 2594559 - RNA, 23 nt, Human
acacagucucacccagacuccag

SEQ ID NO: 2594560 - RNA, 19 nt, Human
acacagucuuggcucacug

SEQ ID NO: 2594561 - RNA, 17 nt, Human
acacagugaccauacua

SEQ ID NO: 2594562 - RNA, 21 nt, Human
uagguuggcaaaaaggcagga

SEQ ID NO: 2594563 - RNA, 15 nt, Human
uagguuggacuggaa

SEQ ID NO: 2594564 - RNA, 24 nt, Human
uagguuggaagcuagcuccccucc

SEQ ID NO: 2594565 - RNA, 16 nt, Human
acacagucugcaagau

SEQ ID NO: 2594566 - RNA, 15 nt, Human
acacagucugcaaga

SEQ ID NO: 2594567 - RNA, 20 nt, Human
uagguugccaauaauacacu

SEQ ID NO: 2594568 - RNA, 21 nt, Human
uagguuuaacucagaucacua

SEQ ID NO: 2594569 - RNA, 19 nt, Human
uagguuuaacucagaucac

SEQ ID NO: 2594570 - RNA, 17 nt, Human
uagguuuaacucagauc

SEQ ID NO: 2594571 - RNA, 15 nt, Human
uagguuuaacucaga

SEQ ID NO: 2594572 - RNA, 16 nt, Human
uaguaagaaaacauca

SEQ ID NO: 2594573 - RNA, 14 nt, Human
uaguaauagagcaa

SEQ ID NO: 2594574 - RNA, 14 nt, Human
uaguaagugccuuc

SEQ ID NO: 2594575 - RNA, 14 nt, Human
uaguaaggcugugu

SEQ ID NO: 2594576 - RNA, 13 nt, Human
uaguaaggcugug

SEQ ID NO: 2594577 - RNA, 12 nt, Human
acacacacagcc

SEQ ID NO: 2594578 - RNA, 13 nt, Human
acacacacagcca

SEQ ID NO: 2594579 - RNA, 14 nt, Human
acacacacagccac

SEQ ID NO: 2594580 - RNA, 15 nt, Human
acacacacagccaca

SEQ ID NO: 2594581 - RNA, 16 nt, Human
acacacacagccacac

SEQ ID NO: 2594582 - RNA, 11 nt, Human
acacacacagg

SEQ ID NO: 2594583 - RNA, 17 nt, Human
acacacagccacacaca

SEQ ID NO: 2594584 - RNA, 18 nt, Human
acacacagccacacacac

SEQ ID NO: 2594585 - RNA, 21 nt, Human
acacacagccacacacacaga

SEQ ID NO: 2594586 - RNA, 22 nt, Human
acacacagccacacacacagaa

SEQ ID NO: 2594587 - RNA, 14 nt, Human
acacacagccacac

SEQ ID NO: 2594588 - RNA, 15 nt, Human
acacacagccacaca

SEQ ID NO: 2594589 - RNA, 13 nt, Human
acacacagccaca

SEQ ID NO: 2594590 - RNA, 14 nt, Human
acacacacaggagg

SEQ ID NO: 2594591 - RNA, 12 nt, Human
acacacagcucu

SEQ ID NO: 2594592 - RNA, 11 nt, Human
acacacagcuc

SEQ ID NO: 2594593 - RNA, 21 nt, Human
acacacauauaaacaucacac

SEQ ID NO: 2594594 - RNA, 17 nt, Human
acacacaggcaacugag

SEQ ID NO: 2594595 - RNA, 19 nt, Human
acacacagcucuguccugg

SEQ ID NO: 2594596 - RNA, 20 nt, Human
acacacagcuaacacacagc

SEQ ID NO: 2594597 - RNA, 12 nt, Human
acacacagcucc

SEQ ID NO: 2594598 - RNA, 13 nt, Human
acacacaggagga

SEQ ID NO: 2594599 - RNA, 20 nt, Human
acacacucaaaucaagaaac

SEQ ID NO: 2594600 - RNA, 13 nt, Human
acacacugaagaa

SEQ ID NO: 2594601 - RNA, 20 nt, Human
acacaccuguagcacuuacu

SEQ ID NO: 2594602 - RNA, 11 nt, Human
acacaccugua

SEQ ID NO: 2594603 - RNA, 22 nt, Human
acacaccuaagggacauguuuu

SEQ ID NO: 2594604 - RNA, 21 nt, Human
acacaccuaagggacauguuu

SEQ ID NO: 2594605 - RNA, 17 nt, Human
acacaccuaagggacau

SEQ ID NO: 2594606 - RNA, 18 nt, Human
acacaccaggcugugggc

SEQ ID NO: 2594607 - RNA, 17 nt, Human
acacacgcacgcacaca

SEQ ID NO: 2594608 - RNA, 16 nt, Human
acacacgcacgcacac

SEQ ID NO: 2594609 - RNA, 15 nt, Human
acacacgcacgcaca

SEQ ID NO: 2594610 - RNA, 14 nt, Human
acacacgcacgcac

SEQ ID NO: 2594611 - RNA, 24 nt, Human
acacaccuguagucccagcuacuc

SEQ ID NO: 2594612 - RNA, 13 nt, Human
acacacgcacgca

SEQ ID NO: 2594613 - RNA, 23 nt, Human
acacacgcacacacacacacagg

SEQ ID NO: 2594614 - RNA, 20 nt, Human
acacacaugcauacacacac

SEQ ID NO: 2594615 - RNA, 21 nt, Human
acacacaugcauacacacaca

SEQ ID NO: 2594616 - RNA, 15 nt, Human
acacaccacacauac

SEQ ID NO: 2594617 - RNA, 12 nt, Human
acacaccaggcu

SEQ ID NO: 2594618 - RNA, 16 nt, Human
acacaccaggcugugg

SEQ ID NO: 2594619 - RNA, 22 nt, Human
acacaccaggcugugggccuca

SEQ ID NO: 2594620 - RNA, 16 nt, Human
acacacaugcauacac

SEQ ID NO: 2594621 - RNA, 17 nt, Human
acacacaugcauacaca

SEQ ID NO: 2594622 - RNA, 18 nt, Human
acacacaugcauacacac

SEQ ID NO: 2594623 - RNA, 19 nt, Human
acacacaugcauacacaca

SEQ ID NO: 2594624 - RNA, 14 nt, Human
acacacaugcauac

SEQ ID NO: 2594625 - RNA, 15 nt, Human
acacacaugcauaca

SEQ ID NO: 2594626 - RNA, 14 nt, Human
acacacacacgcac

SEQ ID NO: 2594627 - RNA, 13 nt, Human
acacacacacgca

SEQ ID NO: 2594628 - RNA, 17 nt, Human
acacacacacaugcaua

SEQ ID NO: 2594629 - RNA, 12 nt, Human
acacacacagaa

SEQ ID NO: 2594630 - RNA, 13 nt, Human
acacacacagaaa

SEQ ID NO: 2594631 - RNA, 14 nt, Human
acacacacagaaaa

SEQ ID NO: 2594632 - RNA, 15 nt, Human
acacacacagaaaau

SEQ ID NO: 2594633 - RNA, 16 nt, Human
acacacacacgcacgc

SEQ ID NO: 2594634 - RNA, 16 nt, Human
acacacacagaaaaua

SEQ ID NO: 2594635 - RNA, 22 nt, Human
acacaagaagaagggcacccua

SEQ ID NO: 2594636 - RNA, 15 nt, Human
acacacacacaugca

SEQ ID NO: 2594637 - RNA, 17 nt, Human
acaauguauuuauuuaa

SEQ ID NO: 2594638 - RNA, 14 nt, Human
acaauguauuuauu

SEQ ID NO: 2594639 - RNA, 19 nt, Human
acaauguauuuauuuaaaa

SEQ ID NO: 2594640 - RNA, 18 nt, Human
acacaacuauuuuuccaa

SEQ ID NO: 2594641 - RNA, 17 nt, Human
acacaacuauauuguuu

SEQ ID NO: 2594642 - RNA, 14 nt, Human
acacaacuauauug

SEQ ID NO: 2594643 - RNA, 21 nt, Human
acaaugguuuucuuguguguu

SEQ ID NO: 2594644 - RNA, 17 nt, Human
acaaugcugauuuggug

SEQ ID NO: 2594645 - RNA, 19 nt, Human
uagcuuagagccucccuca

SEQ ID NO: 2594646 - RNA, 17 nt, Human
uagcuuagagccucccu

SEQ ID NO: 2594647 - RNA, 13 nt, Human
uagcuuagagccu

SEQ ID NO: 2594648 - RNA, 20 nt, Human
uagcuuagaccucagccugu

SEQ ID NO: 2594649 - RNA, 23 nt, Human
uagcuuagaccucagccugugcu

SEQ ID NO: 2594650 - RNA, 16 nt, Human
uagcuuagaccucagc

SEQ ID NO: 2594651 - RNA, 17 nt, Human
uagcuuagaccucagcc

SEQ ID NO: 2594652 - RNA, 18 nt, Human
uagcuuagaccucagccu

SEQ ID NO: 2594653 - RNA, 19 nt, Human
uagcuuagaccucagccug

SEQ ID NO: 2594654 - RNA, 17 nt, Human
acaaugcuguauuuuaa

SEQ ID NO: 2594655 - RNA, 14 nt, Human
acaaugcuguauuu

SEQ ID NO: 2594656 - RNA, 15 nt, Human
acaaugguuuucuug

SEQ ID NO: 2594657 - RNA, 17 nt, Human
acaauggggauguugug

SEQ ID NO: 2594658 - RNA, 21 nt, Human
acaauggcuaauucccagagu

SEQ ID NO: 2594659 - RNA, 15 nt, Human
ucacaguucucuccu

SEQ ID NO: 2594660 - RNA, 22 nt, Human
ucacaguuacccuaaacucucu

SEQ ID NO: 2594661 - RNA, 13 nt, Human
ucacaguuccucg

SEQ ID NO: 2594662 - RNA, 14 nt, Human
ucacaguuccucgc

SEQ ID NO: 2594663 - RNA, 16 nt, Human
ucacaguuccucgccc

SEQ ID NO: 2594664 - RNA, 17 nt, Human
ucacaguuccucgcccu

SEQ ID NO: 2594665 - RNA, 18 nt, Human
ucacaguuccucgcccug

SEQ ID NO: 2594666 - RNA, 19 nt, Human
ucacaguuccucgcccugg

SEQ ID NO: 2594667 - RNA, 20 nt, Human
ucacaguuccucgcccuggg

SEQ ID NO: 2594668 - RNA, 21 nt, Human
ucacaguuccucgcccugggu

SEQ ID NO: 2594669 - RNA, 22 nt, Human
ucacaguuccucgcccuggguc

SEQ ID NO: 2594670 - RNA, 23 nt, Human
ucacauccuggccuggcacauca

SEQ ID NO: 2594671 - RNA, 18 nt, Human
ucacauccuguguuucua

SEQ ID NO: 2594672 - RNA, 19 nt, Human
ucacauccuguguuucuag

SEQ ID NO: 2594673 - RNA, 15 nt, Human
ucacauccuggccug

SEQ ID NO: 2594674 - RNA, 11 nt, Human
ucacauccugg

SEQ ID NO: 2594675 - RNA, 10 nt, Human
ucacauccug

SEQ ID NO: 2594676 - RNA, 19 nt, Human
ucacauccuggccuggcac

SEQ ID NO: 2594677 - RNA, 18 nt, Human
ucacauccuggccuggca

SEQ ID NO: 2594678 - RNA, 17 nt, Human
ucacauccuguguuucu

SEQ ID NO: 2594679 - RNA, 15 nt, Human
ucacauaucugucau

SEQ ID NO: 2594680 - RNA, 12 nt, Human
ucacauaucugu

SEQ ID NO: 2594681 - RNA, 20 nt, Human
ucacaaauccuaaaagaagc

SEQ ID NO: 2594682 - RNA, 16 nt, Human
ucacaacaaccugguc

SEQ ID NO: 2594683 - RNA, 21 nt, Human
ucacaacagauuauuaccuua

SEQ ID NO: 2594684 - RNA, 23 nt, Human
ucacaccugacucugaaaucuga

SEQ ID NO: 2594685 - RNA, 12 nt, Human
ucacaacagauc

SEQ ID NO: 2594686 - RNA, 19 nt, Human
ucacacgaggggccccgug

SEQ ID NO: 2594687 - RNA, 19 nt, Human
ucacaccuguaaucccaac

SEQ ID NO: 2594688 - RNA, 22 nt, Human
ucacacgucuggcuucacagau

SEQ ID NO: 2594689 - RNA, 17 nt, Human
ucacacgggguauuuua

SEQ ID NO: 2594690 - RNA, 18 nt, Human
ucacacgggggcagcuga

SEQ ID NO: 2594691 - RNA, 17 nt, Human
ucacacgggggcagcug

SEQ ID NO: 2594692 - RNA, 19 nt, Human
ucacacugagaauguaaga

SEQ ID NO: 2594693 - RNA, 12 nt, Human
ucacacugagaa

SEQ ID NO: 2594694 - RNA, 17 nt, Human
ucacacucucacauguu

SEQ ID NO: 2594695 - RNA, 16 nt, Human
ucacacucucacaugu

SEQ ID NO: 2594696 - RNA, 11 nt, Human
ucacacugaga

SEQ ID NO: 2594697 - RNA, 21 nt, Human
ucacacugagaauguaagaac

SEQ ID NO: 2594698 - RNA, 20 nt, Human
ucacacugagaauguaagaa

SEQ ID NO: 2594699 - RNA, 23 nt, Human
ucacacugagaauguaagaacua

SEQ ID NO: 2594700 - RNA, 17 nt, Human
ucacaguguugcccagg

SEQ ID NO: 2594701 - RNA, 23 nt, Human
ucacaguguuugcaaugguguug

SEQ ID NO: 2594702 - RNA, 22 nt, Human
ucacaguguuugcaaugguguu

SEQ ID NO: 2594703 - RNA, 18 nt, Human
ucacaguguuugcaaugg

SEQ ID NO: 2594704 - RNA, 14 nt, Human
ucacaguguuugca

SEQ ID NO: 2594705 - RNA, 11 nt, Human
ucacaguguuu

SEQ ID NO: 2594706 - RNA, 13 nt, Human
ucacacucugggu

SEQ ID NO: 2594707 - RNA, 14 nt, Human
ucacaguguuucga

SEQ ID NO: 2594708 - RNA, 14 nt, Human
ucacaugaccacau

SEQ ID NO: 2594709 - RNA, 13 nt, Human
ucacaugaccaca

SEQ ID NO: 2594710 - RNA, 21 nt, Human
ucacaugaacauacuggcugg

SEQ ID NO: 2594711 - RNA, 20 nt, Human
ucacaucuuucacacuucca

SEQ ID NO: 2594712 - RNA, 22 nt, Human
ucacaucuuucacacuuccacc

SEQ ID NO: 2594713 - RNA, 15 nt, Human
ucacaucuuggcaca

SEQ ID NO: 2594714 - RNA, 14 nt, Human
ucacaucuuucaca

SEQ ID NO: 2594715 - RNA, 17 nt, Human
ucacaucuuucacacuu

SEQ ID NO: 2594716 - RNA, 15 nt, Human
ucaccaggggcaggc

SEQ ID NO: 2594717 - RNA, 21 nt, Human
ucaccaggggcaggcacagca

SEQ ID NO: 2594718 - RNA, 19 nt, Human
ucaccaggggcaggcacag

SEQ ID NO: 2594719 - RNA, 18 nt, Human
ucaccaggggcaggcaca

SEQ ID NO: 2594720 - RNA, 23 nt, Human
ucacaugagcuauuuccauucca

SEQ ID NO: 2594721 - RNA, 18 nt, Human
ucacaugaccacauagca

SEQ ID NO: 2594722 - RNA, 20 nt, Human
ucacaugaccacauagcaug

SEQ ID NO: 2594723 - RNA, 17 nt, Human
ucaccagcugccucuuc

SEQ ID NO: 2594724 - RNA, 15 nt, Human
ucaccagcugccucu

SEQ ID NO: 2594725 - RNA, 20 nt, Human
ucaccagcugccucuucugu

SEQ ID NO: 2594726 - RNA, 22 nt, Human
ucaccaggaauguuaaagucag

SEQ ID NO: 2594727 - RNA, 22 nt, Human
ucaccaggggcaggcacagcac

SEQ ID NO: 2594728 - RNA, 13 nt, Human
ucaccaguguccc

SEQ ID NO: 2594729 - RNA, 19 nt, Human
ucaccagugcgauucugga

SEQ ID NO: 2594730 - RNA, 21 nt, Human
ucaccaguguccccuccacug

SEQ ID NO: 2594731 - RNA, 14 nt, Human
ucaccaucucaggc

SEQ ID NO: 2594732 - RNA, 20 nt, Human
ucaccaguguccccuccacu

SEQ ID NO: 2594733 - RNA, 17 nt, Human
ucaccaguguccccucc

SEQ ID NO: 2594734 - RNA, 17 nt, Human
ucacccaugaagacagg

SEQ ID NO: 2594735 - RNA, 21 nt, Human
ucacccagcuaaucuguaggg

SEQ ID NO: 2594736 - RNA, 17 nt, Human
ucacccagcuaaucugu

SEQ ID NO: 2594737 - RNA, 16 nt, Human
ucacccagccccaggg

SEQ ID NO: 2594738 - RNA, 15 nt, Human
ucaccaucucaggcc

SEQ ID NO: 2594739 - RNA, 16 nt, Human
ucaccaucucaggcca

SEQ ID NO: 2594740 - RNA, 15 nt, Human
ucaccccggccaccu

SEQ ID NO: 2594741 - RNA, 21 nt, Human
ucaccccaguggccacucagc

SEQ ID NO: 2594742 - RNA, 22 nt, Human
ucaccccaccccaccccaccuc

SEQ ID NO: 2594743 - RNA, 12 nt, Human
ucaccccauccc

SEQ ID NO: 2594744 - RNA, 13 nt, Human
ucaccccauccca

SEQ ID NO: 2594745 - RNA, 16 nt, Human
ucaccccagggccuga

SEQ ID NO: 2594746 - RNA, 19 nt, Human
ucaccccagggccugagcc

SEQ ID NO: 2594747 - RNA, 20 nt, Human
ucaccccagggccugagccu

SEQ ID NO: 2594748 - RNA, 21 nt, Human
ucaccccagggccugagccug

SEQ ID NO: 2594749 - RNA, 13 nt, Human
ucaccccagggcc

SEQ ID NO: 2594750 - RNA, 15 nt, Human
ucaccccagggccug

SEQ ID NO: 2594751 - RNA, 12 nt, Human
ucaccccagggc

SEQ ID NO: 2594752 - RNA, 13 nt, Human
ucaccccacccuu

SEQ ID NO: 2594753 - RNA, 20 nt, Human
ucaccccagccccaaaacuc

SEQ ID NO: 2594754 - RNA, 14 nt, Human
ucaccccagcccca

SEQ ID NO: 2594755 - RNA, 13 nt, Human
ucaccccagcccc

SEQ ID NO: 2594756 - RNA, 22 nt, Human
ucaccccacuuaucccucucca

SEQ ID NO: 2594757 - RNA, 12 nt, Human
ucacccaugugc

SEQ ID NO: 2594758 - RNA, 12 nt, Human
ucaccccacccu

SEQ ID NO: 2594759 - RNA, 22 nt, Human
accaacauacucccaucuguga

SEQ ID NO: 2594760 - RNA, 21 nt, Human
accaacauacucccaucugug

SEQ ID NO: 2594761 - RNA, 19 nt, Human
accaacauacucccaucug

SEQ ID NO: 2594762 - RNA, 20 nt, Human
ucaagugauucucaugccuc

SEQ ID NO: 2594763 - RNA, 17 nt, Human
accaacauacucccauc

SEQ ID NO: 2594764 - RNA, 15 nt, Human
ucaagugaaaaagga

SEQ ID NO: 2594765 - RNA, 15 nt, Human
ucaagucaaauuaau

SEQ ID NO: 2594766 - RNA, 15 nt, Human
ucaagucaccuccuu

SEQ ID NO: 2594767 - RNA, 17 nt, Human
ucaagugauucucaugc

SEQ ID NO: 2594768 - RNA, 15 nt, Human
ucaagucacucccaa

SEQ ID NO: 2594769 - RNA, 15 nt, Human
ucaagugaaucuaaa

SEQ ID NO: 2594770 - RNA, 19 nt, Human
ucaagugaaucuaaaagcu

SEQ ID NO: 2594771 - RNA, 23 nt, Human
ucaagugaaaaaggaggaagaga

SEQ ID NO: 2594772 - RNA, 15 nt, Human
accaaucaugaauua

SEQ ID NO: 2594773 - RNA, 15 nt, Human
accaauguucucucu

SEQ ID NO: 2594774 - RNA, 13 nt, Human
accaaucaugaau

SEQ ID NO: 2594775 - RNA, 11 nt, Human
accaauauuug

SEQ ID NO: 2594776 - RNA, 13 nt, Human
accaauauuugua

SEQ ID NO: 2594777 - RNA, 16 nt, Human
accaauauuuguagaa

SEQ ID NO: 2594778 - RNA, 17 nt, Human
accaauauuguacaguu

SEQ ID NO: 2594779 - RNA, 16 nt, Human
accaauauuguacagu

SEQ ID NO: 2594780 - RNA, 14 nt, Human
accaauauuguaca

SEQ ID NO: 2594781 - RNA, 15 nt, Human
accaauauuguacag

SEQ ID NO: 2594782 - RNA, 19 nt, Human
accaauauuguacaguuuu

SEQ ID NO: 2594783 - RNA, 18 nt, Human
accaacaucccauugccc

SEQ ID NO: 2594784 - RNA, 18 nt, Human
accaauauuguacaguuu

SEQ ID NO: 2594785 - RNA, 22 nt, Human
ucaauuuuaucccucaccugua

SEQ ID NO: 2594786 - RNA, 21 nt, Human
ucaauuuuaucccucaccugu

SEQ ID NO: 2594787 - RNA, 16 nt, Human
ucaauuuuaucccuca

SEQ ID NO: 2594788 - RNA, 23 nt, Human
ucaauucuucccuaucuuugcca

SEQ ID NO: 2594789 - RNA, 17 nt, Human
ucaauucuucccuaucu

SEQ ID NO: 2594790 - RNA, 19 nt, Human
ucaauucuucccuaucuuu

SEQ ID NO: 2594791 - RNA, 15 nt, Human
ucaauucuugccaaa

SEQ ID NO: 2594792 - RNA, 20 nt, Human
ucaauuuuucuuauuucauu

SEQ ID NO: 2594793 - RNA, 23 nt, Human
ucaauuuuucuuauuucauuucu

SEQ ID NO: 2594794 - RNA, 11 nt, Human
ucacaaauaaa

SEQ ID NO: 2594795 - RNA, 20 nt, Human
ucaauuuuugguugaauaaa

SEQ ID NO: 2594796 - RNA, 16 nt, Human
accacaccucccugaa

SEQ ID NO: 2594797 - RNA, 22 nt, Human
accacacguaaugaaacuugga

SEQ ID NO: 2594798 - RNA, 14 nt, Human
accacacuccagcu

SEQ ID NO: 2594799 - RNA, 13 nt, Human
accacacccugua

SEQ ID NO: 2594800 - RNA, 24 nt, Human
accacacccagccucaguccuccc

SEQ ID NO: 2594801 - RNA, 17 nt, Human
accacacccuguacugu

SEQ ID NO: 2594802 - RNA, 16 nt, Human
accacaccgcagaagc

SEQ ID NO: 2594803 - RNA, 15 nt, Human
accacaccucccuga

SEQ ID NO: 2594804 - RNA, 16 nt, Human
ucaauuccucugggaa

SEQ ID NO: 2594805 - RNA, 13 nt, Human
ucaauuccugggc

SEQ ID NO: 2594806 - RNA, 12 nt, Human
ucaauucucaaa

SEQ ID NO: 2594807 - RNA, 17 nt, Human
ucaauuccugggcccca

SEQ ID NO: 2594808 - RNA, 22 nt, Human
accacaccucccugaaccaucc

SEQ ID NO: 2594809 - RNA, 13 nt, Human
accacacuggacu

SEQ ID NO: 2594810 - RNA, 15 nt, Human
ucaauuccucuggga

SEQ ID NO: 2594811 - RNA, 16 nt, Human
accacacuggacuccg

SEQ ID NO: 2594812 - RNA, 14 nt, Human
accacaaaaauuga

SEQ ID NO: 2594813 - RNA, 17 nt, Human
accaauugauuuuaaac

SEQ ID NO: 2594814 - RNA, 22 nt, Human
accacacccagccucaguccuc

SEQ ID NO: 2594815 - RNA, 17 nt, Human
accacacccagccucag

SEQ ID NO: 2594816 - RNA, 16 nt, Human
accacacccagccuca

SEQ ID NO: 2594817 - RNA, 15 nt, Human
accacacccagccuc

SEQ ID NO: 2594818 - RNA, 14 nt, Human
accacaaaaaugaa

SEQ ID NO: 2594819 - RNA, 14 nt, Human
accacacccagccu

SEQ ID NO: 2594820 - RNA, 13 nt, Human
accaaucauuuua

SEQ ID NO: 2594821 - RNA, 13 nt, Human
accaaugucuuga

SEQ ID NO: 2594822 - RNA, 14 nt, Human
accaauugccaaag

SEQ ID NO: 2594823 - RNA, 16 nt, Human
accaauucaacccuuu

SEQ ID NO: 2594824 - RNA, 16 nt, Human
accaauugguuaaucu

SEQ ID NO: 2594825 - RNA, 11 nt, Human
accagacaggu

SEQ ID NO: 2594826 - RNA, 14 nt, Human
accagacaccuuga

SEQ ID NO: 2594827 - RNA, 16 nt, Human
accagacacccaggac

SEQ ID NO: 2594828 - RNA, 17 nt, Human
accagacacccaggacu

SEQ ID NO: 2594829 - RNA, 19 nt, Human
accagacgguucaccagcc

SEQ ID NO: 2594830 - RNA, 20 nt, Human
accagacgguucaccagccu

SEQ ID NO: 2594831 - RNA, 16 nt, Human
accagagcccaccuug

SEQ ID NO: 2594832 - RNA, 14 nt, Human
accagagcccaccu

SEQ ID NO: 2594833 - RNA, 12 nt, Human
accagagcccac

SEQ ID NO: 2594834 - RNA, 22 nt, Human
accacuuuuguucuugguuugu

SEQ ID NO: 2594835 - RNA, 13 nt, Human
accagaacaaggu

SEQ ID NO: 2594836 - RNA, 14 nt, Human
accagaagcccaga

SEQ ID NO: 2594837 - RNA, 16 nt, Human
accagaagcccagaau

SEQ ID NO: 2594838 - RNA, 13 nt, Human
accagaagcccag

SEQ ID NO: 2594839 - RNA, 14 nt, Human
accagacacccagg

SEQ ID NO: 2594840 - RNA, 15 nt, Human
accagacacccagga

SEQ ID NO: 2594841 - RNA, 15 nt, Human
accagaagcaacaga

SEQ ID NO: 2594842 - RNA, 14 nt, Human
accagaagccaaag

SEQ ID NO: 2594843 - RNA, 18 nt, Human
accacuuguguuuugcaa

SEQ ID NO: 2594844 - RNA, 15 nt, Human
accacuuuuguucuu

SEQ ID NO: 2594845 - RNA, 16 nt, Human
accacuuuuguucuug

SEQ ID NO: 2594846 - RNA, 21 nt, Human
accacuuuuguucuugguuug

SEQ ID NO: 2594847 - RNA, 15 nt, Human
accacugucuucuuc

SEQ ID NO: 2594848 - RNA, 17 nt, Human
accacuucauucuugaa

SEQ ID NO: 2594849 - RNA, 13 nt, Human
accacuucauucu

SEQ ID NO: 2594850 - RNA, 13 nt, Human
accacuucgaaac

SEQ ID NO: 2594851 - RNA, 15 nt, Human
accacuucuuuuaua

SEQ ID NO: 2594852 - RNA, 16 nt, Human
accacuucuuuuauaa

SEQ ID NO: 2594853 - RNA, 17 nt, Human
accacuucuuuuauaac

SEQ ID NO: 2594854 - RNA, 18 nt, Human
accacuggccaccaggcu

SEQ ID NO: 2594855 - RNA, 17 nt, Human
accacuggccaccaggc

SEQ ID NO: 2594856 - RNA, 16 nt, Human
accacuggccaccagg

SEQ ID NO: 2594857 - RNA, 15 nt, Human
accacuggccaccag

SEQ ID NO: 2594858 - RNA, 20 nt, Human
accacuggccaccaggcugg

SEQ ID NO: 2594859 - RNA, 19 nt, Human
accacuggccaccaggcug

SEQ ID NO: 2594860 - RNA, 16 nt, Human
accacuggucuguagg

SEQ ID NO: 2594861 - RNA, 16 nt, Human
accacuguguauuuaa

SEQ ID NO: 2594862 - RNA, 21 nt, Human
accacuggccaccaggcuggc

SEQ ID NO: 2594863 - RNA, 19 nt, Human
accacuguaaaaugaaauu

SEQ ID NO: 2594864 - RNA, 13 nt, Human
accacugucuucu

SEQ ID NO: 2594865 - RNA, 20 nt, Human
accacuguaaaaugaaauua

SEQ ID NO: 2594866 - RNA, 18 nt, Human
ucaccccggccaccugcg

SEQ ID NO: 2594867 - RNA, 17 nt, Human
ucaccccggccaccugc

SEQ ID NO: 2594868 - RNA, 17 nt, Human
accacugcacuccagcc

SEQ ID NO: 2594869 - RNA, 20 nt, Human
accacugcacuccagccugg

SEQ ID NO: 2594870 - RNA, 21 nt, Human
accacugcacuccagccuggg

SEQ ID NO: 2594871 - RNA, 18 nt, Human
accacugcacuccagccu

SEQ ID NO: 2594872 - RNA, 15 nt, Human
accacugcucugaug

SEQ ID NO: 2594873 - RNA, 17 nt, Human
accacugcucugaugaa

SEQ ID NO: 2594874 - RNA, 23 nt, Human
accacugcucugaugaagaggag

SEQ ID NO: 2594875 - RNA, 12 nt, Human
accacuggccac

SEQ ID NO: 2594876 - RNA, 14 nt, Human
accacuggccacca

SEQ ID NO: 2594877 - RNA, 19 nt, Human
ucaccugauucaacuaaaa

SEQ ID NO: 2594878 - RNA, 21 nt, Human
ucaccugauucaacuaaaaaa

SEQ ID NO: 2594879 - RNA, 16 nt, Human
ucaccugccccaacuc

SEQ ID NO: 2594880 - RNA, 14 nt, Human
ucaccugugcuucg

SEQ ID NO: 2594881 - RNA, 15 nt, Human
ucaccugccccucaa

SEQ ID NO: 2594882 - RNA, 13 nt, Human
ucaccugccccuc

SEQ ID NO: 2594883 - RNA, 19 nt, Human
ucaccugagucacccuacc

SEQ ID NO: 2594884 - RNA, 12 nt, Human
ucaccugauuca

SEQ ID NO: 2594885 - RNA, 18 nt, Human
ucaccugauucaacuaaa

SEQ ID NO: 2594886 - RNA, 17 nt, Human
ucaccugaggucgggag

SEQ ID NO: 2594887 - RNA, 17 nt, Human
ucaccucuuaaagaaaa

SEQ ID NO: 2594888 - RNA, 16 nt, Human
ucaccugaagacucau

SEQ ID NO: 2594889 - RNA, 18 nt, Human
ucaccucuggacuggcua

SEQ ID NO: 2594890 - RNA, 19 nt, Human
ucaccucuggacuggcuag

SEQ ID NO: 2594891 - RNA, 23 nt, Human
accaggcuggcgcagccaaggcc

SEQ ID NO: 2594892 - RNA, 12 nt, Human
ucaccucugccu

SEQ ID NO: 2594893 - RNA, 13 nt, Human
ucaccucugccuc

SEQ ID NO: 2594894 - RNA, 14 nt, Human
ucaccucugccuca

SEQ ID NO: 2594895 - RNA, 15 nt, Human
ucaccucugccucaa

SEQ ID NO: 2594896 - RNA, 15 nt, Human
ucaccucucccuugg

SEQ ID NO: 2594897 - RNA, 19 nt, Human
accaggcuugccugcaggc

SEQ ID NO: 2594898 - RNA, 20 nt, Human
ucaccucuaaaacaguccuu

SEQ ID NO: 2594899 - RNA, 21 nt, Human
accagccuccaugcugccucc

SEQ ID NO: 2594900 - RNA, 20 nt, Human
accagccuccaugcugccuc

SEQ ID NO: 2594901 - RNA, 19 nt, Human
accagccuccaugcugccu

SEQ ID NO: 2594902 - RNA, 14 nt, Human
accagccuccaugc

SEQ ID NO: 2594903 - RNA, 20 nt, Human
accagacuguggagaaauaa

SEQ ID NO: 2594904 - RNA, 18 nt, Human
accagacuguggagaaau

SEQ ID NO: 2594905 - RNA, 13 nt, Human
accagacugugga

SEQ ID NO: 2594906 - RNA, 21 nt, Human
accagacuguggagaaauaaa

SEQ ID NO: 2594907 - RNA, 16 nt, Human
accaggcuggcgcagc

SEQ ID NO: 2594908 - RNA, 19 nt, Human
accaggcugcucagggcug

SEQ ID NO: 2594909 - RNA, 20 nt, Human
accaggccguccucccgggc

SEQ ID NO: 2594910 - RNA, 19 nt, Human
accaggccguccucccggg

SEQ ID NO: 2594911 - RNA, 12 nt, Human
accaggccuggg

SEQ ID NO: 2594912 - RNA, 23 nt, Human
accaggcgagagacuuguggccu

SEQ ID NO: 2594913 - RNA, 17 nt, Human
accagccucgucuucau

SEQ ID NO: 2594914 - RNA, 20 nt, Human
accagccuccguauuucaga

SEQ ID NO: 2594915 - RNA, 18 nt, Human
accaggccguccucccgg

SEQ ID NO: 2594916 - RNA, 19 nt, Human
accagccucgucuucauua

SEQ ID NO: 2594917 - RNA, 16 nt, Human
accaggccguccuccc

SEQ ID NO: 2594918 - RNA, 14 nt, Human
accagggacugagg

SEQ ID NO: 2594919 - RNA, 22 nt, Human
accaggcuggcgcagccaaggc

SEQ ID NO: 2594920 - RNA, 20 nt, Human
accaggcuggcgcagccaag

SEQ ID NO: 2594921 - RNA, 19 nt, Human
accaggcuggcgcagccaa

SEQ ID NO: 2594922 - RNA, 17 nt, Human
accaggcuggcgcagcc

SEQ ID NO: 2594923 - RNA, 18 nt, Human
accaggcuugccugcagg

SEQ ID NO: 2594924 - RNA, 20 nt, Human
ucacuauguugcccaggcag

SEQ ID NO: 2594925 - RNA, 19 nt, Human
ucacuauguugcccaggca

SEQ ID NO: 2594926 - RNA, 17 nt, Human
ucacuauguugcccagg

SEQ ID NO: 2594927 - RNA, 18 nt, Human
ucacuauguugcccaggc

SEQ ID NO: 2594928 - RNA, 20 nt, Human
ucacucccuucuaccugcca

SEQ ID NO: 2594929 - RNA, 19 nt, Human
ucacucccuucuaccugcc

SEQ ID NO: 2594930 - RNA, 15 nt, Human
ucacucccuucuacc

SEQ ID NO: 2594931 - RNA, 13 nt, Human
ucacuccccucca

SEQ ID NO: 2594932 - RNA, 15 nt, Human
ucacucccuccauca

SEQ ID NO: 2594933 - RNA, 22 nt, Human
ucacuaggcccccacuugccuc

SEQ ID NO: 2594934 - RNA, 14 nt, Human
ucacucccagucca

SEQ ID NO: 2594935 - RNA, 14 nt, Human
ucacuccggugugc

SEQ ID NO: 2594936 - RNA, 17 nt, Human
ucacuccggugugccug

SEQ ID NO: 2594937 - RNA, 19 nt, Human
ucacuccggugugccugca

SEQ ID NO: 2594938 - RNA, 20 nt, Human
ucacuccggugugccugcag

SEQ ID NO: 2594939 - RNA, 21 nt, Human
ucacuccggugugccugcagc

SEQ ID NO: 2594940 - RNA, 22 nt, Human
ucacuccggugugccugcagcc

SEQ ID NO: 2594941 - RNA, 23 nt, Human
ucacuccggugugccugcagccc

SEQ ID NO: 2594942 - RNA, 20 nt, Human
ucaccuguuuuuaagcuguu

SEQ ID NO: 2594943 - RNA, 19 nt, Human
ucaccuguuuuuaagcugu

SEQ ID NO: 2594944 - RNA, 21 nt, Human
ucaccuguugcuuacaauuuu

SEQ ID NO: 2594945 - RNA, 20 nt, Human
ucaccuguugcuuacaauuu

SEQ ID NO: 2594946 - RNA, 18 nt, Human
ucaccuguuuuuaagcug

SEQ ID NO: 2594947 - RNA, 20 nt, Human
ucaccugugcuucgggcccu

SEQ ID NO: 2594948 - RNA, 21 nt, Human
ucaccugugcuucgggcccuu

SEQ ID NO: 2594949 - RNA, 19 nt, Human
ucaccuguugcuuacaauu

SEQ ID NO: 2594950 - RNA, 18 nt, Human
ucaccuguugcuuacaau

SEQ ID NO: 2594951 - RNA, 14 nt, Human
ucaccuguugcuua

SEQ ID NO: 2594952 - RNA, 23 nt, Human
ucaccugcccagaucccagaagg

SEQ ID NO: 2594953 - RNA, 22 nt, Human
ucaccuguuuuuaagcuguuuc

SEQ ID NO: 2594954 - RNA, 21 nt, Human
ucaccuguuuuuaagcuguuu

SEQ ID NO: 2594955 - RNA, 15 nt, Human
ucaccuuaggcaggg

SEQ ID NO: 2594956 - RNA, 18 nt, Human
ucaccuuaggcagggaag

SEQ ID NO: 2594957 - RNA, 20 nt, Human
ucaccuuaggcagggaagug

SEQ ID NO: 2594958 - RNA, 21 nt, Human
ucacuaggcccccacuugccu

SEQ ID NO: 2594959 - RNA, 19 nt, Human
ucacuaggcccccacuugc

SEQ ID NO: 2594960 - RNA, 14 nt, Human
ucacuagccaugau

SEQ ID NO: 2594961 - RNA, 14 nt, Human
ucacuacugcaguc

SEQ ID NO: 2594962 - RNA, 17 nt, Human
ucacuagauggcgagca

SEQ ID NO: 2594963 - RNA, 12 nt, Human
ucacuacugcag

SEQ ID NO: 2594964 - RNA, 21 nt, Human
ucacuacucacagucucuuua

SEQ ID NO: 2594965 - RNA, 22 nt, Human
ucacuacucacagucucuuuaa

SEQ ID NO: 2594966 - RNA, 19 nt, Human
ucacuaccuccucagggau

SEQ ID NO: 2594967 - RNA, 18 nt, Human
ucacuaccuccucaggga

SEQ ID NO: 2594968 - RNA, 16 nt, Human
ucacuaccuccucagg

SEQ ID NO: 2594969 - RNA, 15 nt, Human
ucacuaccuccucag

SEQ ID NO: 2594970 - RNA, 14 nt, Human
ucacuaccuccuca

SEQ ID NO: 2594971 - RNA, 20 nt, Human
ucacuacccuauucucucuu

SEQ ID NO: 2594972 - RNA, 21 nt, Human
ucaccuucguuuacuaugccu

SEQ ID NO: 2594973 - RNA, 19 nt, Human
ucacuacucacagucucuu

SEQ ID NO: 2594974 - RNA, 20 nt, Human
ucacuaccuccucagggaug

SEQ ID NO: 2594975 - RNA, 18 nt, Human
ucagagccugcaguuauu

SEQ ID NO: 2594976 - RNA, 15 nt, Human
ucagagccugcaguu

SEQ ID NO: 2594977 - RNA, 14 nt, Human
ucagagccugcagu

SEQ ID NO: 2594978 - RNA, 13 nt, Human
ucagagccugcag

SEQ ID NO: 2594979 - RNA, 21 nt, Human
ucagagagggugggagugggc

SEQ ID NO: 2594980 - RNA, 16 nt, Human
ucagagagggugggag

SEQ ID NO: 2594981 - RNA, 23 nt, Human
ucagagagggugggagugggccc

SEQ ID NO: 2594982 - RNA, 12 nt, Human
ucagagccugca

SEQ ID NO: 2594983 - RNA, 20 nt, Human
ucagagacuccugcaggcag

SEQ ID NO: 2594984 - RNA, 17 nt, Human
ucagagacuccugcagg

SEQ ID NO: 2594985 - RNA, 16 nt, Human
ucagagacuccugcag

SEQ ID NO: 2594986 - RNA, 16 nt, Human
ucagagaggccuuuug

SEQ ID NO: 2594987 - RNA, 21 nt, Human
ucagagacuccugcaggcagc

SEQ ID NO: 2594988 - RNA, 18 nt, Human
ucagaaucucaaauaacu

SEQ ID NO: 2594989 - RNA, 19 nt, Human
ucagaaucucaaauaacua

SEQ ID NO: 2594990 - RNA, 17 nt, Human
ucagaaucucucuucuu

SEQ ID NO: 2594991 - RNA, 20 nt, Human
ucagaaucuacccaaaggau

SEQ ID NO: 2594992 - RNA, 14 nt, Human
ucagaagacacuga

SEQ ID NO: 2594993 - RNA, 12 nt, Human
ucagaagauaac

SEQ ID NO: 2594994 - RNA, 17 nt, Human
acccagccucaguccuc

SEQ ID NO: 2594995 - RNA, 13 nt, Human
acccagccucagu

SEQ ID NO: 2594996 - RNA, 14 nt, Human
ucagaagauaacuu

SEQ ID NO: 2594997 - RNA, 16 nt, Human
ucagaagccucugggu

SEQ ID NO: 2594998 - RNA, 13 nt, Human
ucagaagccugag

SEQ ID NO: 2594999 - RNA, 15 nt, Human
ucagaagccugaggc

SEQ ID NO: 2595000 - RNA, 20 nt, Human
ucagaagccugaggcuggga

SEQ ID NO: 2595001 - RNA, 12 nt, Human
acccagccucag

SEQ ID NO: 2595002 - RNA, 18 nt, Human
acccagccgcugcccggc

SEQ ID NO: 2595003 - RNA, 16 nt, Human
acccagccgcugcccg

SEQ ID NO: 2595004 - RNA, 14 nt, Human
acccagccgcugcc

SEQ ID NO: 2595005 - RNA, 13 nt, Human
acccagccgcugc

SEQ ID NO: 2595006 - RNA, 21 nt, Human
acccagcccuggucucagcag

SEQ ID NO: 2595007 - RNA, 19 nt, Human
acccagcccuggucucagc

SEQ ID NO: 2595008 - RNA, 16 nt, Human
acccagcccuggucuc

SEQ ID NO: 2595009 - RNA, 15 nt, Human
acccagcccuggucu

SEQ ID NO: 2595010 - RNA, 14 nt, Human
acccagcccugguc

SEQ ID NO: 2595011 - RNA, 13 nt, Human
acccagcccuggu

SEQ ID NO: 2595012 - RNA, 12 nt, Human
acccagcccugg

SEQ ID NO: 2595013 - RNA, 15 nt, Human
acccagcccucaucc

SEQ ID NO: 2595014 - RNA, 16 nt, Human
acccagcccucauccc

SEQ ID NO: 2595015 - RNA, 21 nt, Human
acccagccccuugagaaaccu

SEQ ID NO: 2595016 - RNA, 20 nt, Human
acccagccccuugagaaacc

SEQ ID NO: 2595017 - RNA, 17 nt, Human
acccagccccuugagaa

SEQ ID NO: 2595018 - RNA, 16 nt, Human
acccagccccuugaga

SEQ ID NO: 2595019 - RNA, 22 nt, Human
acccagaggaaggggccagagg

SEQ ID NO: 2595020 - RNA, 19 nt, Human
acccagaguuuuuauguag

SEQ ID NO: 2595021 - RNA, 19 nt, Human
acccagcccauucucucuc

SEQ ID NO: 2595022 - RNA, 14 nt, Human
acccagccccaggg

SEQ ID NO: 2595023 - RNA, 22 nt, Human
acccagcccauucucucuccug

SEQ ID NO: 2595024 - RNA, 23 nt, Human
acccagcccauucucucuccugu

SEQ ID NO: 2595025 - RNA, 22 nt, Human
ucagaaguuucugccgcagccc

SEQ ID NO: 2595026 - RNA, 19 nt, Human
ucagaaguuucugccgcag

SEQ ID NO: 2595027 - RNA, 15 nt, Human
ucagaagugagcuuu

SEQ ID NO: 2595028 - RNA, 19 nt, Human
ucagaagugagcuuugcug

SEQ ID NO: 2595029 - RNA, 21 nt, Human
ucagaagugagcuuugcugcu

SEQ ID NO: 2595030 - RNA, 19 nt, Human
ucagaaguuucucagcucc

SEQ ID NO: 2595031 - RNA, 19 nt, Human
ucagaaggcaaaugacuuu

SEQ ID NO: 2595032 - RNA, 22 nt, Human
ucagaaggcaaaugacuuugga

SEQ ID NO: 2595033 - RNA, 18 nt, Human
ucagaaggcaaaugacuu

SEQ ID NO: 2595034 - RNA, 23 nt, Human
ucagaaggagaaggaaggagacu

SEQ ID NO: 2595035 - RNA, 14 nt, Human
ucagaagccuuugg

SEQ ID NO: 2595036 - RNA, 12 nt, Human
ucagaaggagaa

SEQ ID NO: 2595037 - RNA, 13 nt, Human
ucagaaggagaag

SEQ ID NO: 2595038 - RNA, 14 nt, Human
ucagaaggagaagg

SEQ ID NO: 2595039 - RNA, 16 nt, Human
ucagaaggagaaggaa

SEQ ID NO: 2595040 - RNA, 18 nt, Human
ucagaaggagaaggaagg

SEQ ID NO: 2595041 - RNA, 15 nt, Human
ucagaaggggagggg

SEQ ID NO: 2595042 - RNA, 16 nt, Human
ucagaagggaggcugg

SEQ ID NO: 2595043 - RNA, 20 nt, Human
ucagaaggggaggggagaca

SEQ ID NO: 2595044 - RNA, 12 nt, Human
ucagaaggcucu

SEQ ID NO: 2595045 - RNA, 19 nt, Human
ucagaaggagaaggaagga

SEQ ID NO: 2595046 - RNA, 13 nt, Human
ucagaagggaggc

SEQ ID NO: 2595047 - RNA, 20 nt, Human
ucagaaggcucuucugacua

SEQ ID NO: 2595048 - RNA, 12 nt, Human
ucagaagggagg

SEQ ID NO: 2595049 - RNA, 23 nt, Human
accauuucuugagguaaaagcau

SEQ ID NO: 2595050 - RNA, 22 nt, Human
accauuugcauggcuccagaaa

SEQ ID NO: 2595051 - RNA, 14 nt, Human
accauugucuuguu

SEQ ID NO: 2595052 - RNA, 21 nt, Human
acccacguucucacacccacc

SEQ ID NO: 2595053 - RNA, 20 nt, Human
acccacguguaacugucagc

SEQ ID NO: 2595054 - RNA, 23 nt, Human
acccaccuuguuggagccugcag

SEQ ID NO: 2595055 - RNA, 13 nt, Human
acccacucagcuc

SEQ ID NO: 2595056 - RNA, 15 nt, Human
acccacucaucagaa

SEQ ID NO: 2595057 - RNA, 18 nt, Human
acccacucuccucugccu

SEQ ID NO: 2595058 - RNA, 22 nt, Human
acccaccuuguuggagccugca

SEQ ID NO: 2595059 - RNA, 11 nt, Human
acccacugcuc

SEQ ID NO: 2595060 - RNA, 10 nt, Human
acccacugcu

SEQ ID NO: 2595061 - RNA, 11 nt, Human
acccacugcuu

SEQ ID NO: 2595062 - RNA, 15 nt, Human
acccacugcucuggu

SEQ ID NO: 2595063 - RNA, 14 nt, Human
acccacugcucugg

SEQ ID NO: 2595064 - RNA, 13 nt, Human
acccacugcucug

SEQ ID NO: 2595065 - RNA, 16 nt, Human
acccagagaauauaua

SEQ ID NO: 2595066 - RNA, 14 nt, Human
acccagagaauaua

SEQ ID NO: 2595067 - RNA, 22 nt, Human
acccagagaagccccuucccca

SEQ ID NO: 2595068 - RNA, 19 nt, Human
acccagagaagccccuucc

SEQ ID NO: 2595069 - RNA, 18 nt, Human
acccagagaagccccuuc

SEQ ID NO: 2595070 - RNA, 17 nt, Human
acccagagaagccccuu

SEQ ID NO: 2595071 - RNA, 15 nt, Human
acccagacucagaca

SEQ ID NO: 2595072 - RNA, 14 nt, Human
acccagcccauucu

SEQ ID NO: 2595073 - RNA, 24 nt, Human
acccagagcauuacgugagccagg

SEQ ID NO: 2595074 - RNA, 23 nt, Human
acccagagcauuacgugagccag

SEQ ID NO: 2595075 - RNA, 18 nt, Human
acccagagaauauauaca

SEQ ID NO: 2595076 - RNA, 17 nt, Human
acccagagaggaaucag

SEQ ID NO: 2595077 - RNA, 15 nt, Human
acccagacccagugg

SEQ ID NO: 2595078 - RNA, 14 nt, Human
acccagacccagug

SEQ ID NO: 2595079 - RNA, 13 nt, Human
acccagacccagu

SEQ ID NO: 2595080 - RNA, 10 nt, Human
acccagaccc

SEQ ID NO: 2595081 - RNA, 20 nt, Human
acccacucuccucugccuca

SEQ ID NO: 2595082 - RNA, 22 nt, Human
acccagaccuguuagcagacag

SEQ ID NO: 2595083 - RNA, 23 nt, Human
accauuaaaacugaagucugaaa

SEQ ID NO: 2595084 - RNA, 22 nt, Human
accauuaaaacugaagucugaa

SEQ ID NO: 2595085 - RNA, 21 nt, Human
accauuaaaacugaagucuga

SEQ ID NO: 2595086 - RNA, 20 nt, Human
accauuaaaacugaagucug

SEQ ID NO: 2595087 - RNA, 13 nt, Human
accauuaaaacug

SEQ ID NO: 2595088 - RNA, 20 nt, Human
accauguuugagcucagacc

SEQ ID NO: 2595089 - RNA, 21 nt, Human
accauguuugagcucagaccc

SEQ ID NO: 2595090 - RNA, 12 nt, Human
accauuaaaacu

SEQ ID NO: 2595091 - RNA, 18 nt, Human
accauuaugaagaagaga

SEQ ID NO: 2595092 - RNA, 18 nt, Human
accauugaauucuugguu

SEQ ID NO: 2595093 - RNA, 21 nt, Human
accauucagugauuacuguca

SEQ ID NO: 2595094 - RNA, 24 nt, Human
accauucugacucgguuucuccaa

SEQ ID NO: 2595095 - RNA, 23 nt, Human
ucacucuuauugcccacgcugga

SEQ ID NO: 2595096 - RNA, 21 nt, Human
ucacucuuauugcccacgcug

SEQ ID NO: 2595097 - RNA, 21 nt, Human
ucacucuuccagaaucccaag

SEQ ID NO: 2595098 - RNA, 17 nt, Human
ucacucuuccagaaucc

SEQ ID NO: 2595099 - RNA, 15 nt, Human
ucacucuuccagaau

SEQ ID NO: 2595100 - RNA, 21 nt, Human
ucacucccuucuaccugccac

SEQ ID NO: 2595101 - RNA, 15 nt, Human
ucacuccuaccuggu

SEQ ID NO: 2595102 - RNA, 13 nt, Human
ucacucuuggagc

SEQ ID NO: 2595103 - RNA, 19 nt, Human
ucacucuuccugcaaggac

SEQ ID NO: 2595104 - RNA, 18 nt, Human
ucacucuuccugcaagga

SEQ ID NO: 2595105 - RNA, 17 nt, Human
accauguagaaaauuug

SEQ ID NO: 2595106 - RNA, 17 nt, Human
accauguacaugaagaa

SEQ ID NO: 2595107 - RNA, 11 nt, Human
accauguacau

SEQ ID NO: 2595108 - RNA, 14 nt, Human
accauguacauagc

SEQ ID NO: 2595109 - RNA, 21 nt, Human
accauguaaagaacauaaaua

SEQ ID NO: 2595110 - RNA, 22 nt, Human
accauggucggaaaacaugcua

SEQ ID NO: 2595111 - RNA, 16 nt, Human
ucacucuugccaaccu

SEQ ID NO: 2595112 - RNA, 22 nt, Human
accccacccuugcccaccccac

SEQ ID NO: 2595113 - RNA, 14 nt, Human
accccacuacacag

SEQ ID NO: 2595114 - RNA, 20 nt, Human
accccacccuugcccacccc

SEQ ID NO: 2595115 - RNA, 18 nt, Human
accccacccuugcccacc

SEQ ID NO: 2595116 - RNA, 17 nt, Human
accccacccuugcccac

SEQ ID NO: 2595117 - RNA, 16 nt, Human
accccacccuugccca

SEQ ID NO: 2595118 - RNA, 15 nt, Human
accccacccuugccc

SEQ ID NO: 2595119 - RNA, 19 nt, Human
accccacccucccuggagu

SEQ ID NO: 2595120 - RNA, 19 nt, Human
accccacccuuccccuccu

SEQ ID NO: 2595121 - RNA, 12 nt, Human
acccagggccug

SEQ ID NO: 2595122 - RNA, 13 nt, Human
acccagggccugc

SEQ ID NO: 2595123 - RNA, 14 nt, Human
acccagggccugca

SEQ ID NO: 2595124 - RNA, 18 nt, Human
accccacccucccuggag

SEQ ID NO: 2595125 - RNA, 17 nt, Human
accccacccucccugga

SEQ ID NO: 2595126 - RNA, 16 nt, Human
accccacccucccugg

SEQ ID NO: 2595127 - RNA, 21 nt, Human
acccagggcccaggcaaauca

SEQ ID NO: 2595128 - RNA, 20 nt, Human
accccacccucccuggagug

SEQ ID NO: 2595129 - RNA, 13 nt, Human
accccacccuucc

SEQ ID NO: 2595130 - RNA, 24 nt, Human
acccagcgagcccugguggcagug

SEQ ID NO: 2595131 - RNA, 22 nt, Human
acccaggccgcagcucuugccc

SEQ ID NO: 2595132 - RNA, 15 nt, Human
acccaggcaccugca

SEQ ID NO: 2595133 - RNA, 15 nt, Human
acccaggccgcagcu

SEQ ID NO: 2595134 - RNA, 17 nt, Human
acccaggaguguggcca

SEQ ID NO: 2595135 - RNA, 20 nt, Human
acccaggcuggaguacagug

SEQ ID NO: 2595136 - RNA, 23 nt, Human
acccaggccgcagcucuugcccu

SEQ ID NO: 2595137 - RNA, 20 nt, Human
acccaggcuggagugcaaug

SEQ ID NO: 2595138 - RNA, 22 nt, Human
acccaggcugggcaaggaggcc

SEQ ID NO: 2595139 - RNA, 20 nt, Human
acccaggcugggcaaggagg

SEQ ID NO: 2595140 - RNA, 14 nt, Human
acccaggcugggca

SEQ ID NO: 2595141 - RNA, 13 nt, Human
acccaggcugggc

SEQ ID NO: 2595142 - RNA, 12 nt, Human
acccaggcuggg

SEQ ID NO: 2595143 - RNA, 19 nt, Human
acccaggcuggagugcagu

SEQ ID NO: 2595144 - RNA, 15 nt, Human
accccaggccccgag

SEQ ID NO: 2595145 - RNA, 14 nt, Human
accccaggccccga

SEQ ID NO: 2595146 - RNA, 13 nt, Human
accccaggccccg

SEQ ID NO: 2595147 - RNA, 12 nt, Human
accccaggcccc

SEQ ID NO: 2595148 - RNA, 22 nt, Human
accccagcugugagccuuggcu

SEQ ID NO: 2595149 - RNA, 21 nt, Human
accccagcugugagccuuggc

SEQ ID NO: 2595150 - RNA, 20 nt, Human
accccagcugugagccuugg

SEQ ID NO: 2595151 - RNA, 19 nt, Human
accccagcugugagccuug

SEQ ID NO: 2595152 - RNA, 18 nt, Human
accccagcugugagccuu

SEQ ID NO: 2595153 - RNA, 17 nt, Human
accccagcugugagccu

SEQ ID NO: 2595154 - RNA, 18 nt, Human
accccacuuaucccucuc

SEQ ID NO: 2595155 - RNA, 17 nt, Human
accccacuuaucccucu

SEQ ID NO: 2595156 - RNA, 23 nt, Human
accccagcuggggccaggcuggg

SEQ ID NO: 2595157 - RNA, 14 nt, Human
acccccacacacac

SEQ ID NO: 2595158 - RNA, 15 nt, Human
acccccacacacaca

SEQ ID NO: 2595159 - RNA, 20 nt, Human
acccccacacacacacacau

SEQ ID NO: 2595160 - RNA, 21 nt, Human
acccccacacacacacacaug

SEQ ID NO: 2595161 - RNA, 15 nt, Human
acccccacaccucag

SEQ ID NO: 2595162 - RNA, 17 nt, Human
acccccacaccucaguu

SEQ ID NO: 2595163 - RNA, 15 nt, Human
acccccaccaagggc

SEQ ID NO: 2595164 - RNA, 13 nt, Human
acccccaccaagg

SEQ ID NO: 2595165 - RNA, 10 nt, Human
acccccacca

SEQ ID NO: 2595166 - RNA, 16 nt, Human
acccccaaggggcagu

SEQ ID NO: 2595167 - RNA, 10 nt, Human
accccagggc

SEQ ID NO: 2595168 - RNA, 20 nt, Human
accccaggcugaagcagguu

SEQ ID NO: 2595169 - RNA, 12 nt, Human
acccccacacac

SEQ ID NO: 2595170 - RNA, 13 nt, Human
acccccacacaca

SEQ ID NO: 2595171 - RNA, 16 nt, Human
acccccaaauuuucuu

SEQ ID NO: 2595172 - RNA, 22 nt, Human
ucagccgagccgggccuggggc

SEQ ID NO: 2595173 - RNA, 16 nt, Human
ucagccgggcccugag

SEQ ID NO: 2595174 - RNA, 18 nt, Human
ucagccuagccgaccuca

SEQ ID NO: 2595175 - RNA, 19 nt, Human
ucagccuagccgaccucag

SEQ ID NO: 2595176 - RNA, 20 nt, Human
ucagccuagccgaccucagc

SEQ ID NO: 2595177 - RNA, 21 nt, Human
ucagccuagccgaccucagcc

SEQ ID NO: 2595178 - RNA, 22 nt, Human
ucagccuagccgaccucagccu

SEQ ID NO: 2595179 - RNA, 23 nt, Human
acccagcgagcccugguggcagu

SEQ ID NO: 2595180 - RNA, 19 nt, Human
acccagcgagcccuggugg

SEQ ID NO: 2595181 - RNA, 23 nt, Human
ucagccguguaaccauggaccca

SEQ ID NO: 2595182 - RNA, 21 nt, Human
ucagccgagccgggccugggg

SEQ ID NO: 2595183 - RNA, 20 nt, Human
ucagccgagccgggccuggg

SEQ ID NO: 2595184 - RNA, 19 nt, Human
ucagccgagccgggccugg

SEQ ID NO: 2595185 - RNA, 18 nt, Human
ucagccgagccgggccug

SEQ ID NO: 2595186 - RNA, 14 nt, Human
ucagcccacccccc

SEQ ID NO: 2595187 - RNA, 21 nt, Human
ucagcccugggccccaccacc

SEQ ID NO: 2595188 - RNA, 22 nt, Human
ucagcccugggccccaccaccu

SEQ ID NO: 2595189 - RNA, 23 nt, Human
ucagcccugggccccaccaccua

SEQ ID NO: 2595190 - RNA, 21 nt, Human
ucagcccaaaccaccagaagc

SEQ ID NO: 2595191 - RNA, 22 nt, Human
ucagcccaaaccaccagaagcc

SEQ ID NO: 2595192 - RNA, 12 nt, Human
ucagcccacccc

SEQ ID NO: 2595193 - RNA, 13 nt, Human
ucagcccaccccc

SEQ ID NO: 2595194 - RNA, 16 nt, Human
ucagcccaagaugcuu

SEQ ID NO: 2595195 - RNA, 16 nt, Human
ucagccauucacugcc

SEQ ID NO: 2595196 - RNA, 14 nt, Human
ucagccaugugcug

SEQ ID NO: 2595197 - RNA, 21 nt, Human
ucagccaugaggaguugcugu

SEQ ID NO: 2595198 - RNA, 14 nt, Human
ucagagcugacaca

SEQ ID NO: 2595199 - RNA, 18 nt, Human
ucagagcuacuugggcca

SEQ ID NO: 2595200 - RNA, 17 nt, Human
ucagagcuacuugggcc

SEQ ID NO: 2595201 - RNA, 16 nt, Human
ucagagcuacuugggc

SEQ ID NO: 2595202 - RNA, 21 nt, Human
ucagagaggccuuuuggaaug

SEQ ID NO: 2595203 - RNA, 22 nt, Human
ucagagaggccuuuuggaaugu

SEQ ID NO: 2595204 - RNA, 11 nt, Human
ucagagagggu

SEQ ID NO: 2595205 - RNA, 14 nt, Human
ucagccaaauguaa

SEQ ID NO: 2595206 - RNA, 16 nt, Human
ucagccaaauguaauu

SEQ ID NO: 2595207 - RNA, 22 nt, Human
ucagccaaauguaauugaauaa

SEQ ID NO: 2595208 - RNA, 21 nt, Human
ucagccaacgaguaauuuauu

SEQ ID NO: 2595209 - RNA, 18 nt, Human
ucagagcugacacaggau

SEQ ID NO: 2595210 - RNA, 19 nt, Human
ucagcauuuccacaccaag

SEQ ID NO: 2595211 - RNA, 22 nt, Human
ucagccaagaauucuuaaauau

SEQ ID NO: 2595212 - RNA, 13 nt, Human
ucagccaggagcu

SEQ ID NO: 2595213 - RNA, 22 nt, Human
ucagccaagguuuuauaaggcu

SEQ ID NO: 2595214 - RNA, 15 nt, Human
ucagccaagcacagu

SEQ ID NO: 2595215 - RNA, 14 nt, Human
ucagccaagcacag

SEQ ID NO: 2595216 - RNA, 12 nt, Human
ucagccaagcac

SEQ ID NO: 2595217 - RNA, 23 nt, Human
ucagccaaauguaauugaauaaa

SEQ ID NO: 2595218 - RNA, 18 nt, Human
ucagccagggccaggggu

SEQ ID NO: 2595219 - RNA, 16 nt, Human
ucagccagggccaggg

SEQ ID NO: 2595220 - RNA, 14 nt, Human
ucagccagggccag

SEQ ID NO: 2595221 - RNA, 13 nt, Human
ucagccagggcca

SEQ ID NO: 2595222 - RNA, 12 nt, Human
ucagccagggcc

SEQ ID NO: 2595223 - RNA, 20 nt, Human
ucagccaagcacaguggugg

SEQ ID NO: 2595224 - RNA, 19 nt, Human
ucagccaggagcugggcag

SEQ ID NO: 2595225 - RNA, 14 nt, Human
ucagccauguauuu

SEQ ID NO: 2595226 - RNA, 23 nt, Human
ucagccaugaggaguugcuguuu

SEQ ID NO: 2595227 - RNA, 18 nt, Human
ucagccaucaacaagagu

SEQ ID NO: 2595228 - RNA, 13 nt, Human
ucagcucacugca

SEQ ID NO: 2595229 - RNA, 16 nt, Human
ucagcucacugcaacc

SEQ ID NO: 2595230 - RNA, 23 nt, Human
ucagcuauuuaaaaaaaaaagag

SEQ ID NO: 2595231 - RNA, 20 nt, Human
ucagcuauuuacugccaaag

SEQ ID NO: 2595232 - RNA, 22 nt, Human
ucagcuauuuaaaaaaaaaaga

SEQ ID NO: 2595233 - RNA, 19 nt, Human
ucagcuauuuacugccaaa

SEQ ID NO: 2595234 - RNA, 19 nt, Human
ucagcuacugauuuuugug

SEQ ID NO: 2595235 - RNA, 14 nt, Human
ucagcggggacagc

SEQ ID NO: 2595236 - RNA, 19 nt, Human
ucagcuucguuuauuuuca

SEQ ID NO: 2595237 - RNA, 21 nt, Human
ucagcuucguuuauuuucaag

SEQ ID NO: 2595238 - RNA, 15 nt, Human
ucagcuucugcuggg

SEQ ID NO: 2595239 - RNA, 14 nt, Human
ucagcuucugcugg

SEQ ID NO: 2595240 - RNA, 20 nt, Human
ucagcuucuauccuugacuu

SEQ ID NO: 2595241 - RNA, 23 nt, Human
ucagcuuccuacccacaccucug

SEQ ID NO: 2595242 - RNA, 18 nt, Human
ucagcucagcgccagccu

SEQ ID NO: 2595243 - RNA, 14 nt, Human
ucagcucacuguuc

SEQ ID NO: 2595244 - RNA, 20 nt, Human
ucagcuuguaaauagcucag

SEQ ID NO: 2595245 - RNA, 19 nt, Human
ucagcuucugcugggcugg

SEQ ID NO: 2595246 - RNA, 18 nt, Human
ucagcuucugcugggcug

SEQ ID NO: 2595247 - RNA, 17 nt, Human
ucagcuucugcugggcu

SEQ ID NO: 2595248 - RNA, 16 nt, Human
ucagcuucugcugggc

SEQ ID NO: 2595249 - RNA, 22 nt, Human
ucagcuucugcugggcuggggc

SEQ ID NO: 2595250 - RNA, 21 nt, Human
ucagcuucugcugggcugggg

SEQ ID NO: 2595251 - RNA, 13 nt, Human
ucagcuucuuaau

SEQ ID NO: 2595252 - RNA, 20 nt, Human
ucaggaaaucaaauaugcaa

SEQ ID NO: 2595253 - RNA, 21 nt, Human
ucaggaaaucaaauaugcaaa

SEQ ID NO: 2595254 - RNA, 19 nt, Human
ucaggaaagagaacuucca

SEQ ID NO: 2595255 - RNA, 15 nt, Human
ucaggaaaggaauca

SEQ ID NO: 2595256 - RNA, 14 nt, Human
ucaggaaagacgga

SEQ ID NO: 2595257 - RNA, 13 nt, Human
ucaggaaagagaa

SEQ ID NO: 2595258 - RNA, 19 nt, Human
ucaggaaaagccucugugu

SEQ ID NO: 2595259 - RNA, 18 nt, Human
ucaggaaaagccucugug

SEQ ID NO: 2595260 - RNA, 17 nt, Human
ucaggaaaagccucugu

SEQ ID NO: 2595261 - RNA, 16 nt, Human
ucaggaaaagccucug

SEQ ID NO: 2595262 - RNA, 15 nt, Human
ucagcuugcugcccu

SEQ ID NO: 2595263 - RNA, 20 nt, Human
ucaggaaaacugacagagga

SEQ ID NO: 2595264 - RNA, 21 nt, Human
ucaggaaaacugacagaggag

SEQ ID NO: 2595265 - RNA, 22 nt, Human
ucaggaaaacugacagaggagg

SEQ ID NO: 2595266 - RNA, 20 nt, Human
ucagcuuuuugucuuuucug

SEQ ID NO: 2595267 - RNA, 14 nt, Human
ucagcuucuucauc

SEQ ID NO: 2595268 - RNA, 23 nt, Human
ucagcuucugcugggcuggggcc

SEQ ID NO: 2595269 - RNA, 14 nt, Human
ucagcuucuuaaua

SEQ ID NO: 2595270 - RNA, 14 nt, Human
accccugugcuccg

SEQ ID NO: 2595271 - RNA, 17 nt, Human
accccugucucuagcca

SEQ ID NO: 2595272 - RNA, 21 nt, Human
accccuguccucacugcuccc

SEQ ID NO: 2595273 - RNA, 19 nt, Human
accccuguccucacugcuc

SEQ ID NO: 2595274 - RNA, 18 nt, Human
accccuguccucacugcu

SEQ ID NO: 2595275 - RNA, 17 nt, Human
accccuguccucacugc

SEQ ID NO: 2595276 - RNA, 16 nt, Human
accccuguccucacug

SEQ ID NO: 2595277 - RNA, 15 nt, Human
accccuguccucacu

SEQ ID NO: 2595278 - RNA, 23 nt, Human
accccuuccccacugccugccca

SEQ ID NO: 2595279 - RNA, 19 nt, Human
accccuguggagcccgcac

SEQ ID NO: 2595280 - RNA, 22 nt, Human
accccugugcuccgugccucca

SEQ ID NO: 2595281 - RNA, 21 nt, Human
accccugugcuccgugccucc

SEQ ID NO: 2595282 - RNA, 13 nt, Human
accccuguggagc

SEQ ID NO: 2595283 - RNA, 18 nt, Human
accccuguggagcccgca

SEQ ID NO: 2595284 - RNA, 15 nt, Human
accccuucgcuccug

SEQ ID NO: 2595285 - RNA, 14 nt, Human
accccuucgcuccu

SEQ ID NO: 2595286 - RNA, 14 nt, Human
ucagccuugccaga

SEQ ID NO: 2595287 - RNA, 15 nt, Human
ucagccuugccagag

SEQ ID NO: 2595288 - RNA, 12 nt, Human
accccuuccugu

SEQ ID NO: 2595289 - RNA, 14 nt, Human
accccuuccugucc

SEQ ID NO: 2595290 - RNA, 16 nt, Human
accccuucgcuccugu

SEQ ID NO: 2595291 - RNA, 20 nt, Human
ucagcgacuccguuggccac

SEQ ID NO: 2595292 - RNA, 19 nt, Human
ucagcgacuccguuggcca

SEQ ID NO: 2595293 - RNA, 16 nt, Human
ucagccuugccagaga

SEQ ID NO: 2595294 - RNA, 17 nt, Human
ucagccuugccagagau

SEQ ID NO: 2595295 - RNA, 22 nt, Human
ucagcggccccuugacucuggg

SEQ ID NO: 2595296 - RNA, 21 nt, Human
ucagcgauguaugcagcuauc

SEQ ID NO: 2595297 - RNA, 23 nt, Human
ucagcgacuccguuggccacucc

SEQ ID NO: 2595298 - RNA, 18 nt, Human
ucagcgauguaugcagcu

SEQ ID NO: 2595299 - RNA, 22 nt, Human
ucagccuuggauaaugcuguug

SEQ ID NO: 2595300 - RNA, 12 nt, Human
acccccacccaa

SEQ ID NO: 2595301 - RNA, 14 nt, Human
accccccagcacug

SEQ ID NO: 2595302 - RNA, 13 nt, Human
accccccagcacu

SEQ ID NO: 2595303 - RNA, 12 nt, Human
acccccacccca

SEQ ID NO: 2595304 - RNA, 14 nt, Human
acccccaccccaca

SEQ ID NO: 2595305 - RNA, 12 nt, Human
accccccucauu

SEQ ID NO: 2595306 - RNA, 11 nt, Human
accccccucug

SEQ ID NO: 2595307 - RNA, 12 nt, Human
accccccugggc

SEQ ID NO: 2595308 - RNA, 15 nt, Human
accccccugggcuga

SEQ ID NO: 2595309 - RNA, 17 nt, Human
accccccagcacugagg

SEQ ID NO: 2595310 - RNA, 15 nt, Human
accccccagcacuga

SEQ ID NO: 2595311 - RNA, 19 nt, Human
accccccagcacugaggaa

SEQ ID NO: 2595312 - RNA, 20 nt, Human
accccccagaaccuguccuu

SEQ ID NO: 2595313 - RNA, 13 nt, Human
acccccgcccagg

SEQ ID NO: 2595314 - RNA, 22 nt, Human
acccccgaguuuggucccuggg

SEQ ID NO: 2595315 - RNA, 20 nt, Human
acccccgcccaggcuggcca

SEQ ID NO: 2595316 - RNA, 19 nt, Human
acccccgcccaggcuggcc

SEQ ID NO: 2595317 - RNA, 16 nt, Human
acccccgcccaggcug

SEQ ID NO: 2595318 - RNA, 15 nt, Human
acccccgcccaggcu

SEQ ID NO: 2595319 - RNA, 23 nt, Human
acccccgcccaggcuggccagcc

SEQ ID NO: 2595320 - RNA, 21 nt, Human
acccccgcccaggcuggccag

SEQ ID NO: 2595321 - RNA, 14 nt, Human
accccugguucuca

SEQ ID NO: 2595322 - RNA, 22 nt, Human
accccugguucucaucuuucuu

SEQ ID NO: 2595323 - RNA, 20 nt, Human
accccugguucucaucuuuc

SEQ ID NO: 2595324 - RNA, 16 nt, Human
accccugguucucauc

SEQ ID NO: 2595325 - RNA, 15 nt, Human
accccugguucucau

SEQ ID NO: 2595326 - RNA, 14 nt, Human
ucaacaucaauguu

SEQ ID NO: 2595327 - RNA, 15 nt, Human
ucaacaucaauguuc

SEQ ID NO: 2595328 - RNA, 16 nt, Human
ucaacaucaauguuca

SEQ ID NO: 2595329 - RNA, 17 nt, Human
ucaacaucaauguucau

SEQ ID NO: 2595330 - RNA, 18 nt, Human
ucaacaucaauguucauu

SEQ ID NO: 2595331 - RNA, 12 nt, Human
ucaacaucuuuu

SEQ ID NO: 2595332 - RNA, 19 nt, Human
ucaacaucaauguucauug

SEQ ID NO: 2595333 - RNA, 20 nt, Human
ucaacaucaauguucauugu

SEQ ID NO: 2595334 - RNA, 23 nt, Human
ucaacaucaauguucauuguaau

SEQ ID NO: 2595335 - RNA, 12 nt, Human
ucaagaaacuga

SEQ ID NO: 2595336 - RNA, 13 nt, Human
ucaagaaacugag

SEQ ID NO: 2595337 - RNA, 17 nt, Human
ucaagaaacugaggaau

SEQ ID NO: 2595338 - RNA, 18 nt, Human
ucaagaaacugaggaauu

SEQ ID NO: 2595339 - RNA, 20 nt, Human
ucaagaaacugaggaauuuu

SEQ ID NO: 2595340 - RNA, 22 nt, Human
ucaagaaacugaggaauuuucu

SEQ ID NO: 2595341 - RNA, 23 nt, Human
ucaagaaacugaggaauuuucuu

SEQ ID NO: 2595342 - RNA, 15 nt, Human
ucaacauguuacuga

SEQ ID NO: 2595343 - RNA, 19 nt, Human
ucaacauguuacugaccag

SEQ ID NO: 2595344 - RNA, 21 nt, Human
ucaacaucaauguucauugua

SEQ ID NO: 2595345 - RNA, 15 nt, Human
ucaacaucuuuuaca

SEQ ID NO: 2595346 - RNA, 22 nt, Human
ucaacauguuacugaccagcaa

SEQ ID NO: 2595347 - RNA, 20 nt, Human
ucaacauguuacugaccagc

SEQ ID NO: 2595348 - RNA, 21 nt, Human
ucaacauguuacugaccagca

SEQ ID NO: 2595349 - RNA, 23 nt, Human
ucaagaagcaggcuacacugaca

SEQ ID NO: 2595350 - RNA, 19 nt, Human
ucaagaagacauggagacu

SEQ ID NO: 2595351 - RNA, 12 nt, Human
ucaagaagacau

SEQ ID NO: 2595352 - RNA, 23 nt, Human
ucaagaagaagauggauuggugu

SEQ ID NO: 2595353 - RNA, 22 nt, Human
ucaagaaauaaaaggaagccaa

SEQ ID NO: 2595354 - RNA, 20 nt, Human
ucaagaaauaaaaggaagcc

SEQ ID NO: 2595355 - RNA, 21 nt, Human
ucaagaaauaaaaggaagcca

SEQ ID NO: 2595356 - RNA, 21 nt, Human
ucaagaaagcuucaaacugca

SEQ ID NO: 2595357 - RNA, 22 nt, Human
ucaagaauggggaucacagaga

SEQ ID NO: 2595358 - RNA, 21 nt, Human
ucaagaauaaucacgcuuucc

SEQ ID NO: 2595359 - RNA, 17 nt, Human
ucaagacauuaaaucua

SEQ ID NO: 2595360 - RNA, 20 nt, Human
ucaagacauuaaaucuauga

SEQ ID NO: 2595361 - RNA, 20 nt, Human
ucaagacuggaaggugggga

SEQ ID NO: 2595362 - RNA, 19 nt, Human
ucaagacuggaaggugggg

SEQ ID NO: 2595363 - RNA, 19 nt, Human
ucaagagaguaauggguuu

SEQ ID NO: 2595364 - RNA, 18 nt, Human
ucaagagauuuaauuaau

SEQ ID NO: 2595365 - RNA, 15 nt, Human
ucaagagauuuaauu

SEQ ID NO: 2595366 - RNA, 16 nt, Human
ucaagaccuucucccc

SEQ ID NO: 2595367 - RNA, 16 nt, Human
ucaagagcugcccucc

SEQ ID NO: 2595368 - RNA, 13 nt, Human
ucaagagcugccc

SEQ ID NO: 2595369 - RNA, 19 nt, Human
ucaagauacugcuacugua

SEQ ID NO: 2595370 - RNA, 21 nt, Human
ucaagauacugcuacuguaau

SEQ ID NO: 2595371 - RNA, 22 nt, Human
ucaagauacugcuacuguaauu

SEQ ID NO: 2595372 - RNA, 15 nt, Human
ucaagagcacacuug

SEQ ID NO: 2595373 - RNA, 22 nt, Human
ucaagaugaugaugaucuuuaa

SEQ ID NO: 2595374 - RNA, 16 nt, Human
ucaagaucaaugaaau

SEQ ID NO: 2595375 - RNA, 22 nt, Human
ucaagaucaaugaaaugauguc

SEQ ID NO: 2595376 - RNA, 17 nt, Human
ucaagaugucagacugg

SEQ ID NO: 2595377 - RNA, 16 nt, Human
ucaagggggacugucu

SEQ ID NO: 2595378 - RNA, 20 nt, Human
ucaagggaauguaacugcug

SEQ ID NO: 2595379 - RNA, 19 nt, Human
ucaagggaauguaacugcu

SEQ ID NO: 2595380 - RNA, 21 nt, Human
ucaagggaauguaacugcuga

SEQ ID NO: 2595381 - RNA, 18 nt, Human
ucaaggcugcuuagaauc

SEQ ID NO: 2595382 - RNA, 17 nt, Human
ucaaggcugcuuagaau

SEQ ID NO: 2595383 - RNA, 18 nt, Human
ucaagaugucagacuggc

SEQ ID NO: 2595384 - RNA, 15 nt, Human
ucaagaucauguacc

SEQ ID NO: 2595385 - RNA, 20 nt, Human
ucaagauguccuccuuguuc

SEQ ID NO: 2595386 - RNA, 16 nt, Human
ucaaguauuauaccuu

SEQ ID NO: 2595387 - RNA, 21 nt, Human
ucaaguauuauaccuuuuuua

SEQ ID NO: 2595388 - RNA, 23 nt, Human
ucaaguauuauaccuuuuuuaga

SEQ ID NO: 2595389 - RNA, 12 nt, Human
ucaaguauuugg

SEQ ID NO: 2595390 - RNA, 11 nt, Human
ucaaguauuau

SEQ ID NO: 2595391 - RNA, 15 nt, Human
ucaaguauuauaccu

SEQ ID NO: 2595392 - RNA, 16 nt, Human
ucaacagcuaugcugg

SEQ ID NO: 2595393 - RNA, 18 nt, Human
ucaacacucccuucccau

SEQ ID NO: 2595394 - RNA, 12 nt, Human
ucaacagagaag

SEQ ID NO: 2595395 - RNA, 17 nt, Human
ucaacagagaaggcagg

SEQ ID NO: 2595396 - RNA, 19 nt, Human
ucaacagagaaggcaggaa

SEQ ID NO: 2595397 - RNA, 22 nt, Human
ucaacagagaaggcaggaaugu

SEQ ID NO: 2595398 - RNA, 16 nt, Human
ucaacagguuuuccug

SEQ ID NO: 2595399 - RNA, 15 nt, Human
ucaacagcuccccau

SEQ ID NO: 2595400 - RNA, 18 nt, Human
ucaacagcuaugcuggua

SEQ ID NO: 2595401 - RNA, 18 nt, Human
ucaacaggagaauuuuac

SEQ ID NO: 2595402 - RNA, 17 nt, Human
ucaaauuucuaaaucuc

SEQ ID NO: 2595403 - RNA, 15 nt, Human
acauucuuauaaaua

SEQ ID NO: 2595404 - RNA, 17 nt, Human
ucaacaagggagagacc

SEQ ID NO: 2595405 - RNA, 22 nt, Human
ucaacaagggagagaccucauc

SEQ ID NO: 2595406 - RNA, 19 nt, Human
ucaacaagggagagaccuc

SEQ ID NO: 2595407 - RNA, 20 nt, Human
ucaacaagggagagaccuca

SEQ ID NO: 2595408 - RNA, 23 nt, Human
ucaacacuuaaggguuuuagaaa

SEQ ID NO: 2595409 - RNA, 12 nt, Human
acauucuguuaa

SEQ ID NO: 2595410 - RNA, 20 nt, Human
acauucuggcucagggaggu

SEQ ID NO: 2595411 - RNA, 18 nt, Human
acauucugcuuucaucuu

SEQ ID NO: 2595412 - RNA, 22 nt, Human
acauucugucgccuuagcaugu

SEQ ID NO: 2595413 - RNA, 14 nt, Human
acauucuguaaaau

SEQ ID NO: 2595414 - RNA, 16 nt, Human
acauucaugccuggcu

SEQ ID NO: 2595415 - RNA, 14 nt, Human
acauuccaagacag

SEQ ID NO: 2595416 - RNA, 13 nt, Human
acauuccaagaca

SEQ ID NO: 2595417 - RNA, 11 nt, Human
acauuccaaga

SEQ ID NO: 2595418 - RNA, 17 nt, Human
acauuccaagacaguau

SEQ ID NO: 2595419 - RNA, 15 nt, Human
acauuccaagacagu

SEQ ID NO: 2595420 - RNA, 19 nt, Human
acauucugauuuggaaaaa

SEQ ID NO: 2595421 - RNA, 16 nt, Human
acauucugccaggccc

SEQ ID NO: 2595422 - RNA, 12 nt, Human
acauucugcuuu

SEQ ID NO: 2595423 - RNA, 15 nt, Human
ucaaauuucuaaauc

SEQ ID NO: 2595424 - RNA, 16 nt, Human
ucaaauuucuaaaucu

SEQ ID NO: 2595425 - RNA, 15 nt, Human
acauucuguuaauca

SEQ ID NO: 2595426 - RNA, 14 nt, Human
ucaaauuucuaaau

SEQ ID NO: 2595427 - RNA, 14 nt, Human
acauucuuauaaau

SEQ ID NO: 2595428 - RNA, 23 nt, Human
acauucugucgccuuagcauguu

SEQ ID NO: 2595429 - RNA, 10 nt, Human
acauucuuau

SEQ ID NO: 2595430 - RNA, 18 nt, Human
acaugucuccuauccugg

SEQ ID NO: 2595431 - RNA, 16 nt, Human
acaugucuccuauccu

SEQ ID NO: 2595432 - RNA, 17 nt, Human
acaugucuguucuacau

SEQ ID NO: 2595433 - RNA, 16 nt, Human
acauguccuugugugu

SEQ ID NO: 2595434 - RNA, 21 nt, Human
acauguccuuguguguuuuga

SEQ ID NO: 2595435 - RNA, 15 nt, Human
acaugucccuacacc

SEQ ID NO: 2595436 - RNA, 18 nt, Human
acaugucuguucuacaua

SEQ ID NO: 2595437 - RNA, 11 nt, Human
acauuaacagu

SEQ ID NO: 2595438 - RNA, 12 nt, Human
acauuaacaguu

SEQ ID NO: 2595439 - RNA, 19 nt, Human
acauguccaagaagcccag

SEQ ID NO: 2595440 - RNA, 21 nt, Human
acauguccaagaagcccagga

SEQ ID NO: 2595441 - RNA, 17 nt, Human
acaugcugaagccaaag

SEQ ID NO: 2595442 - RNA, 14 nt, Human
acaugcugaagcca

SEQ ID NO: 2595443 - RNA, 19 nt, Human
acaugcucuuagaaaauuc

SEQ ID NO: 2595444 - RNA, 21 nt, Human
acaugcugagucucccaaggc

SEQ ID NO: 2595445 - RNA, 14 nt, Human
acaugcugagucuc

SEQ ID NO: 2595446 - RNA, 22 nt, Human
acauuagcaguuugcuuuguau

SEQ ID NO: 2595447 - RNA, 18 nt, Human
acauuagcaguuugcuuu

SEQ ID NO: 2595448 - RNA, 21 nt, Human
acauuaagaaaaucauauugc

SEQ ID NO: 2595449 - RNA, 17 nt, Human
acauuaagaaaaucaua

SEQ ID NO: 2595450 - RNA, 16 nt, Human
acauuaagaaaaucau

SEQ ID NO: 2595451 - RNA, 14 nt, Human
acauuaagaaaauc

SEQ ID NO: 2595452 - RNA, 13 nt, Human
acauuaagaaaau

SEQ ID NO: 2595453 - RNA, 12 nt, Human
acauuaagaaaa

SEQ ID NO: 2595454 - RNA, 22 nt, Human
acauuaacaguuuuccaugaaa

SEQ ID NO: 2595455 - RNA, 16 nt, Human
acauuaacaguuuucc

SEQ ID NO: 2595456 - RNA, 17 nt, Human
acauuaacaguuuucca

SEQ ID NO: 2595457 - RNA, 18 nt, Human
acauuaacaguuuuccau

SEQ ID NO: 2595458 - RNA, 20 nt, Human
acauuaacaguuuuccauga

SEQ ID NO: 2595459 - RNA, 13 nt, Human
acauucaaggcau

SEQ ID NO: 2595460 - RNA, 18 nt, Human
acauucaacccuggagag

SEQ ID NO: 2595461 - RNA, 15 nt, Human
acauucaauaagcau

SEQ ID NO: 2595462 - RNA, 14 nt, Human
acauucaccugccc

SEQ ID NO: 2595463 - RNA, 20 nt, Human
acauucaccugccccaacuc

SEQ ID NO: 2595464 - RNA, 13 nt, Human
acauucaccugcc

SEQ ID NO: 2595465 - RNA, 12 nt, Human
acauucaauguu

SEQ ID NO: 2595466 - RNA, 16 nt, Human
acauucaggaagauga

SEQ ID NO: 2595467 - RNA, 23 nt, Human
acauucaauaagcaucaaacucu

SEQ ID NO: 2595468 - RNA, 15 nt, Human
acauucaugccuggc

SEQ ID NO: 2595469 - RNA, 21 nt, Human
ucaaaauaugccccauucaac

SEQ ID NO: 2595470 - RNA, 15 nt, Human
ucaaaauauguucuu

SEQ ID NO: 2595471 - RNA, 23 nt, Human
ucaaaauaccaugccauuuaaag

SEQ ID NO: 2595472 - RNA, 21 nt, Human
ucaaaauaaaaagugacacag

SEQ ID NO: 2595473 - RNA, 20 nt, Human
ucaaaauaaaaagugacaca

SEQ ID NO: 2595474 - RNA, 13 nt, Human
ucaaaauaaaaac

SEQ ID NO: 2595475 - RNA, 20 nt, Human
ucaaaauaaaaaccaagaag

SEQ ID NO: 2595476 - RNA, 14 nt, Human
ucaaaauaauuuua

SEQ ID NO: 2595477 - RNA, 23 nt, Human
ucaaaauaaaaagugacacagca

SEQ ID NO: 2595478 - RNA, 21 nt, Human
ucaaaauaccaugccauuuaa

SEQ ID NO: 2595479 - RNA, 12 nt, Human
ucaaaauaaaaa

SEQ ID NO: 2595480 - RNA, 23 nt, Human
ucaaaagacaauucuuuauacaa

SEQ ID NO: 2595481 - RNA, 15 nt, Human
ucaaaagcuggauua

SEQ ID NO: 2595482 - RNA, 18 nt, Human
ucaaaagcaaaugagauc

SEQ ID NO: 2595483 - RNA, 14 nt, Human
ucaaaaguugaaau

SEQ ID NO: 2595484 - RNA, 15 nt, Human
ucaaaaguugaaauu

SEQ ID NO: 2595485 - RNA, 16 nt, Human
ucaaaaguugaaauua

SEQ ID NO: 2595486 - RNA, 16 nt, Human
ucaaaauauuuguaca

SEQ ID NO: 2595487 - RNA, 17 nt, Human
ucaaaauauuuguacau

SEQ ID NO: 2595488 - RNA, 19 nt, Human
ucaaaauauuuguacauag

SEQ ID NO: 2595489 - RNA, 18 nt, Human
ucaaaauauuuguacaua

SEQ ID NO: 2595490 - RNA, 15 nt, Human
ucaaaaugacagcca

SEQ ID NO: 2595491 - RNA, 19 nt, Human
ucaaaauuguuacaaauug

SEQ ID NO: 2595492 - RNA, 16 nt, Human
ucaaaauuguuacaaa

SEQ ID NO: 2595493 - RNA, 12 nt, Human
ucaaaaugcuuu

SEQ ID NO: 2595494 - RNA, 17 nt, Human
ucaaaaugcuuuuuauu

SEQ ID NO: 2595495 - RNA, 19 nt, Human
ucaaaaugcuuuuuauuuc

SEQ ID NO: 2595496 - RNA, 14 nt, Human
ucaaaaugucuaag

SEQ ID NO: 2595497 - RNA, 14 nt, Human
ucaaaaugucugua

SEQ ID NO: 2595498 - RNA, 13 nt, Human
uauuuuugcccug

SEQ ID NO: 2595499 - RNA, 17 nt, Human
uauuuuugcauggcacu

SEQ ID NO: 2595500 - RNA, 12 nt, Human
uauuuuugcaug

SEQ ID NO: 2595501 - RNA, 22 nt, Human
uauuuuugaaaggcauguuccu

SEQ ID NO: 2595502 - RNA, 18 nt, Human
ucaaaagaaagaaaauca

SEQ ID NO: 2595503 - RNA, 19 nt, Human
ucaaaagacaauucuuuau

SEQ ID NO: 2595504 - RNA, 18 nt, Human
ucaaaagacaauucuuua

SEQ ID NO: 2595505 - RNA, 16 nt, Human
ucaaaagacaauucuu

SEQ ID NO: 2595506 - RNA, 15 nt, Human
ucaaaagacaauucu

SEQ ID NO: 2595507 - RNA, 14 nt, Human
ucaaaagacaauuc

SEQ ID NO: 2595508 - RNA, 12 nt, Human
ucaaaagacaau

SEQ ID NO: 2595509 - RNA, 18 nt, Human
ucaaaagaaaaggcaaaa

SEQ ID NO: 2595510 - RNA, 19 nt, Human
ucaaaagaaucagaaacag

SEQ ID NO: 2595511 - RNA, 14 nt, Human
uauuuuucucauga

SEQ ID NO: 2595512 - RNA, 12 nt, Human
uauuuuuaucuu

SEQ ID NO: 2595513 - RNA, 14 nt, Human
uauuuuucuaaggu

SEQ ID NO: 2595514 - RNA, 21 nt, Human
uauuuuuauauuuaguuauag

SEQ ID NO: 2595515 - RNA, 16 nt, Human
uauuuuuacugccacu

SEQ ID NO: 2595516 - RNA, 15 nt, Human
uauuuuuacugccac

SEQ ID NO: 2595517 - RNA, 12 nt, Human
uauuuuuacugc

SEQ ID NO: 2595518 - RNA, 18 nt, Human
uauuuuuacauucugaau

SEQ ID NO: 2595519 - RNA, 19 nt, Human
uauuuuuauagauuugacc

SEQ ID NO: 2595520 - RNA, 18 nt, Human
uauuuuuacugccacucu

SEQ ID NO: 2595521 - RNA, 17 nt, Human
uauuuguguaauagaaa

SEQ ID NO: 2595522 - RNA, 17 nt, Human
uauuuuuaauuaaauaa

SEQ ID NO: 2595523 - RNA, 18 nt, Human
uauuuguguauuuaacag

SEQ ID NO: 2595524 - RNA, 17 nt, Human
uauuuguguauuuaaca

SEQ ID NO: 2595525 - RNA, 14 nt, Human
uauuuguguaauag

SEQ ID NO: 2595526 - RNA, 13 nt, Human
uauuuguguaaua

SEQ ID NO: 2595527 - RNA, 14 nt, Human
uauuuguggaauaa

SEQ ID NO: 2595528 - RNA, 12 nt, Human
uauuuguggaau

SEQ ID NO: 2595529 - RNA, 15 nt, Human
uauuuguguauuuaa

SEQ ID NO: 2595530 - RNA, 13 nt, Human
uauuuguguauuu

SEQ ID NO: 2595531 - RNA, 17 nt, Human
uauuuguaaauuuaugu

SEQ ID NO: 2595532 - RNA, 22 nt, Human
uauuuguaaauuuaugugaugg

SEQ ID NO: 2595533 - RNA, 16 nt, Human
uauuuguaaauuuaug

SEQ ID NO: 2595534 - RNA, 22 nt, Human
uauuugugacuaauuguauaac

SEQ ID NO: 2595535 - RNA, 17 nt, Human
uauuugugacuaauugu

SEQ ID NO: 2595536 - RNA, 14 nt, Human
uauuugugacuaau

SEQ ID NO: 2595537 - RNA, 12 nt, Human
uauuugugacua

SEQ ID NO: 2595538 - RNA, 20 nt, Human
uauuugugacuaauuguaua

SEQ ID NO: 2595539 - RNA, 19 nt, Human
uauuugugacuaauuguau

SEQ ID NO: 2595540 - RNA, 21 nt, Human
uauuugugacuaauuguauaa

SEQ ID NO: 2595541 - RNA, 18 nt, Human
uauuugugauagcacuuu

SEQ ID NO: 2595542 - RNA, 18 nt, Human
uauuugugaugacaacug

SEQ ID NO: 2595543 - RNA, 16 nt, Human
acaugaaguccaagca

SEQ ID NO: 2595544 - RNA, 22 nt, Human
acaugaagauucuuucccaauu

SEQ ID NO: 2595545 - RNA, 15 nt, Human
acaugaagauucuuu

SEQ ID NO: 2595546 - RNA, 17 nt, Human
acaugaagauucuuucc

SEQ ID NO: 2595547 - RNA, 18 nt, Human
acaugaagauucuuuccc

SEQ ID NO: 2595548 - RNA, 16 nt, Human
acaugaagaagcuaaa

SEQ ID NO: 2595549 - RNA, 13 nt, Human
acaugaagaagcu

SEQ ID NO: 2595550 - RNA, 16 nt, Human
ucaaauaaacacugug

SEQ ID NO: 2595551 - RNA, 13 nt, Human
ucaaauacaucuu

SEQ ID NO: 2595552 - RNA, 15 nt, Human
ucaaauaaacacugu

SEQ ID NO: 2595553 - RNA, 14 nt, Human
ucaaauaaacacug

SEQ ID NO: 2595554 - RNA, 13 nt, Human
ucaaauaaacacu

SEQ ID NO: 2595555 - RNA, 11 nt, Human
ucaaauaaaca

SEQ ID NO: 2595556 - RNA, 22 nt, Human
ucaaaguuuugaaaagcuauua

SEQ ID NO: 2595557 - RNA, 18 nt, Human
ucaaauaacuaaaaggua

SEQ ID NO: 2595558 - RNA, 19 nt, Human
acaugauccugcaauucca

SEQ ID NO: 2595559 - RNA, 19 nt, Human
acaugagcaucaggccagg

SEQ ID NO: 2595560 - RNA, 18 nt, Human
acaugagcaucaggccag

SEQ ID NO: 2595561 - RNA, 17 nt, Human
acaugagcaucaggcca

SEQ ID NO: 2595562 - RNA, 22 nt, Human
acaugcuacacacugcauguuu

SEQ ID NO: 2595563 - RNA, 20 nt, Human
acaugagcaucaggccaggc

SEQ ID NO: 2595564 - RNA, 18 nt, Human
acaugagucccaguggga

SEQ ID NO: 2595565 - RNA, 15 nt, Human
acaugaucuucuuua

SEQ ID NO: 2595566 - RNA, 17 nt, Human
acaugaucuucuuuaua

SEQ ID NO: 2595567 - RNA, 17 nt, Human
ucaaacacaaaugcagg

SEQ ID NO: 2595568 - RNA, 16 nt, Human
ucaaacacaaaugcag

SEQ ID NO: 2595569 - RNA, 15 nt, Human
ucaaacacaaaugca

SEQ ID NO: 2595570 - RNA, 17 nt, Human
ucaaacacaguuacacu

SEQ ID NO: 2595571 - RNA, 11 nt, Human
ucaaacacagu

SEQ ID NO: 2595572 - RNA, 12 nt, Human
ucaaacacugca

SEQ ID NO: 2595573 - RNA, 14 nt, Human
ucaaacacaaaugc

SEQ ID NO: 2595574 - RNA, 17 nt, Human
ucaaacaacacuggugu

SEQ ID NO: 2595575 - RNA, 15 nt, Human
ucaaacaacacuggu

SEQ ID NO: 2595576 - RNA, 21 nt, Human
ucaaacaaagccagaagcuga

SEQ ID NO: 2595577 - RNA, 24 nt, Human
ucaaaauuagugcuuuuuguguca

SEQ ID NO: 2595578 - RNA, 16 nt, Human
ucaaaauuugaagaau

SEQ ID NO: 2595579 - RNA, 14 nt, Human
ucaaacaaagccag

SEQ ID NO: 2595580 - RNA, 15 nt, Human
ucaaacaaagccaga

SEQ ID NO: 2595581 - RNA, 16 nt, Human
ucaaacaaagccagaa

SEQ ID NO: 2595582 - RNA, 17 nt, Human
ucaaacaaagccagaag

SEQ ID NO: 2595583 - RNA, 19 nt, Human
ucaaacaaacucucugaac

SEQ ID NO: 2595584 - RNA, 14 nt, Human
ucaaagcugaaaug

SEQ ID NO: 2595585 - RNA, 10 nt, Human
ucaaagcaga

SEQ ID NO: 2595586 - RNA, 22 nt, Human
ucaaagcaccaaaauaagaaaa

SEQ ID NO: 2595587 - RNA, 14 nt, Human
ucaaacacugcagg

SEQ ID NO: 2595588 - RNA, 20 nt, Human
ucaaacacaguuacacuugu

SEQ ID NO: 2595589 - RNA, 16 nt, Human
ucaaacacugcaggca

SEQ ID NO: 2595590 - RNA, 19 nt, Human
ucaaagcaggggaguaugc

SEQ ID NO: 2595591 - RNA, 18 nt, Human
ucaaagccaaguuuauau

SEQ ID NO: 2595592 - RNA, 15 nt, Human
ucaaagccacacucu

SEQ ID NO: 2595593 - RNA, 15 nt, Human
ucaaagcuuuuucca

SEQ ID NO: 2595594 - RNA, 20 nt, Human
ucaaagcuugaagaucguua

SEQ ID NO: 2595595 - RNA, 14 nt, Human
ucaaagcuugaaga

SEQ ID NO: 2595596 - RNA, 16 nt, Human
ucaaagcuuuuuccag

SEQ ID NO: 2595597 - RNA, 15 nt, Human
ucaaaggacaaagug

SEQ ID NO: 2595598 - RNA, 19 nt, Human
ucaaaggcacagugaaggc

SEQ ID NO: 2595599 - RNA, 12 nt, Human
ucaaagccagcg

SEQ ID NO: 2595600 - RNA, 22 nt, Human
ucaaagccagcguccuccucug

SEQ ID NO: 2595601 - RNA, 23 nt, Human
ucaaagccagcguccuccucugu

SEQ ID NO: 2595602 - RNA, 20 nt, Human
ucaaaguuuugaaaagcuau

SEQ ID NO: 2595603 - RNA, 19 nt, Human
ucaaaguuuugaaaagcua

SEQ ID NO: 2595604 - RNA, 18 nt, Human
ucaaaguuuugaaaagcu

SEQ ID NO: 2595605 - RNA, 17 nt, Human
ucaaaguuuugaaaagc

SEQ ID NO: 2595606 - RNA, 15 nt, Human
ucaaaguuuugaaaa

SEQ ID NO: 2595607 - RNA, 14 nt, Human
ucaaaguuuugaaa

SEQ ID NO: 2595608 - RNA, 13 nt, Human
ucaaaguuuugaa

SEQ ID NO: 2595609 - RNA, 18 nt, Human
ucaaagggcccacaguga

SEQ ID NO: 2595610 - RNA, 14 nt, Human
acauauugauuucc

SEQ ID NO: 2595611 - RNA, 16 nt, Human
acauauugauuuccgu

SEQ ID NO: 2595612 - RNA, 21 nt, Human
acauaugugcuggaauucuaa

SEQ ID NO: 2595613 - RNA, 13 nt, Human
acauaugugaaua

SEQ ID NO: 2595614 - RNA, 13 nt, Human
acauauguaaaau

SEQ ID NO: 2595615 - RNA, 14 nt, Human
acauauguaaaaua

SEQ ID NO: 2595616 - RNA, 18 nt, Human
acauauugauuuccguua

SEQ ID NO: 2595617 - RNA, 22 nt, Human
acauauugauuuccguuaaaau

SEQ ID NO: 2595618 - RNA, 23 nt, Human
acauauugauuuccguuaaaaua

SEQ ID NO: 2595619 - RNA, 18 nt, Human
acauauuaggaaaauaug

SEQ ID NO: 2595620 - RNA, 14 nt, Human
acauauuaugucuu

SEQ ID NO: 2595621 - RNA, 15 nt, Human
acauaucuuuauuaa

SEQ ID NO: 2595622 - RNA, 18 nt, Human
acauaugcaccuuguguc

SEQ ID NO: 2595623 - RNA, 17 nt, Human
acauaugcaccuugugu

SEQ ID NO: 2595624 - RNA, 16 nt, Human
acauaugcaccuugug

SEQ ID NO: 2595625 - RNA, 15 nt, Human
acauaugcaccuugu

SEQ ID NO: 2595626 - RNA, 20 nt, Human
acauaugcaccuugugucug

SEQ ID NO: 2595627 - RNA, 19 nt, Human
acauaugcaccuugugucu

SEQ ID NO: 2595628 - RNA, 23 nt, Human
acauauggacucugcacaugaau

SEQ ID NO: 2595629 - RNA, 21 nt, Human
acauaugaguguggaagccgg

SEQ ID NO: 2595630 - RNA, 19 nt, Human
acauaugaguguggaagcc

SEQ ID NO: 2595631 - RNA, 14 nt, Human
acauaugaggggga

SEQ ID NO: 2595632 - RNA, 19 nt, Human
acauaucuuuauuaaucac

SEQ ID NO: 2595633 - RNA, 15 nt, Human
acauaugaaauuuaa

SEQ ID NO: 2595634 - RNA, 18 nt, Human
acauaugaaauuuaauau

SEQ ID NO: 2595635 - RNA, 16 nt, Human
acauaucuuuauuaau

SEQ ID NO: 2595636 - RNA, 18 nt, Human
acauaucuuuauuaauca

SEQ ID NO: 2595637 - RNA, 15 nt, Human
acauaugaaaauaca

SEQ ID NO: 2595638 - RNA, 21 nt, Human
acauauaaagcacuauacaga

SEQ ID NO: 2595639 - RNA, 13 nt, Human
acauaguuuuuaa

SEQ ID NO: 2595640 - RNA, 20 nt, Human
acauauaaacaucacacaca

SEQ ID NO: 2595641 - RNA, 15 nt, Human
acauaguuauuuauu

SEQ ID NO: 2595642 - RNA, 19 nt, Human
acauauauaacaaugcugu

SEQ ID NO: 2595643 - RNA, 23 nt, Human
acauauaauguuguuauuuaaag

SEQ ID NO: 2595644 - RNA, 21 nt, Human
acauagugaugguuccccugu

SEQ ID NO: 2595645 - RNA, 16 nt, Human
acauagugaugguucc

SEQ ID NO: 2595646 - RNA, 16 nt, Human
acauaggacucaaagu

SEQ ID NO: 2595647 - RNA, 22 nt, Human
acauagcuugauaaagggccaa

SEQ ID NO: 2595648 - RNA, 14 nt, Human
acauagaauuaaca

SEQ ID NO: 2595649 - RNA, 18 nt, Human
acauagaauuaacacaug

SEQ ID NO: 2595650 - RNA, 22 nt, Human
acauagagaucauccuuuccag

SEQ ID NO: 2595651 - RNA, 23 nt, Human
acauagagagggagaagaaguca

SEQ ID NO: 2595652 - RNA, 20 nt, Human
acauagagagggagaagaag

SEQ ID NO: 2595653 - RNA, 13 nt, Human
acauagauguccc

SEQ ID NO: 2595654 - RNA, 19 nt, Human
acauagcccaucccugccu

SEQ ID NO: 2595655 - RNA, 18 nt, Human
acauagcccaucccugcc

SEQ ID NO: 2595656 - RNA, 14 nt, Human
acauagcccauccc

SEQ ID NO: 2595657 - RNA, 16 nt, Human
acauagcaugacauuu

SEQ ID NO: 2595658 - RNA, 18 nt, Human
acauagcaugacauuucu

SEQ ID NO: 2595659 - RNA, 19 nt, Human
acauagcaugacauuucuu

SEQ ID NO: 2595660 - RNA, 21 nt, Human
acauagcaugacauuucuuug

SEQ ID NO: 2595661 - RNA, 15 nt, Human
acauagaugucccuu

SEQ ID NO: 2595662 - RNA, 19 nt, Human
acauagcuaucaagugugc

SEQ ID NO: 2595663 - RNA, 21 nt, Human
acauagcuuacaagccagcug

SEQ ID NO: 2595664 - RNA, 17 nt, Human
acauagccuauauuuac

SEQ ID NO: 2595665 - RNA, 16 nt, Human
acauagccuauauuua

SEQ ID NO: 2595666 - RNA, 13 nt, Human
acauagccuauau

SEQ ID NO: 2595667 - RNA, 22 nt, Human
acauagcccaucccugccuggu

SEQ ID NO: 2595668 - RNA, 20 nt, Human
acauagccuauauuuacagu

SEQ ID NO: 2595669 - RNA, 19 nt, Human
acauagccuauauuuacag

SEQ ID NO: 2595670 - RNA, 19 nt, Human
acauagcgaauacaaaauu

SEQ ID NO: 2595671 - RNA, 16 nt, Human
acaucaacaucuuggu

SEQ ID NO: 2595672 - RNA, 18 nt, Human
acaucaacaucuugguca

SEQ ID NO: 2595673 - RNA, 18 nt, Human
acaucaacccgagucauu

SEQ ID NO: 2595674 - RNA, 14 nt, Human
acaucaagcacaga

SEQ ID NO: 2595675 - RNA, 18 nt, Human
acaucaagcacagaagga

SEQ ID NO: 2595676 - RNA, 20 nt, Human
acaucaauauugucauuccu

SEQ ID NO: 2595677 - RNA, 18 nt, Human
acaucaauauugucauuc

SEQ ID NO: 2595678 - RNA, 13 nt, Human
acaucaauguuca

SEQ ID NO: 2595679 - RNA, 20 nt, Human
acaucaauguucauuguaau

SEQ ID NO: 2595680 - RNA, 17 nt, Human
acaucaauguucauugu

SEQ ID NO: 2595681 - RNA, 18 nt, Human
acaucaauguucauugua

SEQ ID NO: 2595682 - RNA, 23 nt, Human
acaucaauauugucauuccugua

SEQ ID NO: 2595683 - RNA, 14 nt, Human
acaucaauguucau

SEQ ID NO: 2595684 - RNA, 15 nt, Human
acaucaauguucauu

SEQ ID NO: 2595685 - RNA, 16 nt, Human
acaucaauguucauug

SEQ ID NO: 2595686 - RNA, 13 nt, Human
acaucaacagaua

SEQ ID NO: 2595687 - RNA, 12 nt, Human
acaucaaagagg

SEQ ID NO: 2595688 - RNA, 20 nt, Human
acauauuuguuaaauauuua

SEQ ID NO: 2595689 - RNA, 18 nt, Human
acauauuuuauagaacuu

SEQ ID NO: 2595690 - RNA, 16 nt, Human
acauauuuuauagaac

SEQ ID NO: 2595691 - RNA, 14 nt, Human
acauauuuguuaaa

SEQ ID NO: 2595692 - RNA, 19 nt, Human
acauauuuguuaaauauuu

SEQ ID NO: 2595693 - RNA, 19 nt, Human
acauauuuguggaauaaug

SEQ ID NO: 2595694 - RNA, 17 nt, Human
acauauuuguggaauaa

SEQ ID NO: 2595695 - RNA, 16 nt, Human
acauauuuguggaaua

SEQ ID NO: 2595696 - RNA, 15 nt, Human
acauauuuguggaau

SEQ ID NO: 2595697 - RNA, 20 nt, Human
acauauucauuuggaaauaa

SEQ ID NO: 2595698 - RNA, 18 nt, Human
acauauuuccaagaaguu

SEQ ID NO: 2595699 - RNA, 12 nt, Human
acauauucauuu

SEQ ID NO: 2595700 - RNA, 14 nt, Human
acaucuauucucuc

SEQ ID NO: 2595701 - RNA, 18 nt, Human
acaucuauuuuggauugu

SEQ ID NO: 2595702 - RNA, 19 nt, Human
acaucuauuuuggauugua

SEQ ID NO: 2595703 - RNA, 21 nt, Human
acaucuaagccugaaggggcg

SEQ ID NO: 2595704 - RNA, 15 nt, Human
acaucagaaaggaau

SEQ ID NO: 2595705 - RNA, 15 nt, Human
acaucuaagccugaa

SEQ ID NO: 2595706 - RNA, 22 nt, Human
acaucucagacccuuuagccaa

SEQ ID NO: 2595707 - RNA, 12 nt, Human
acaucucagacc

SEQ ID NO: 2595708 - RNA, 23 nt, Human
acaucuauuuuggauuguauauu

SEQ ID NO: 2595709 - RNA, 19 nt, Human
acaucucaggggccagagg

SEQ ID NO: 2595710 - RNA, 20 nt, Human
acaucucaggggccagagga

SEQ ID NO: 2595711 - RNA, 15 nt, Human
acaucacuuguacaa

SEQ ID NO: 2595712 - RNA, 16 nt, Human
acaucacuuguacaaa

SEQ ID NO: 2595713 - RNA, 13 nt, Human
acaucagaaagga

SEQ ID NO: 2595714 - RNA, 11 nt, Human
acaucagaaag

SEQ ID NO: 2595715 - RNA, 19 nt, Human
acaucacuuguacaaaaua

SEQ ID NO: 2595716 - RNA, 19 nt, Human
acaucacucugcugcuuag

SEQ ID NO: 2595717 - RNA, 16 nt, Human
acaucacucugcugcu

SEQ ID NO: 2595718 - RNA, 22 nt, Human
acaucaccgacgcgucuccugu

SEQ ID NO: 2595719 - RNA, 23 nt, Human
acaucaccgacgcgucuccuguu

SEQ ID NO: 2595720 - RNA, 21 nt, Human
acaucaccgacgcgucuccug

SEQ ID NO: 2595721 - RNA, 20 nt, Human
acaucaccgacgcgucuccu

SEQ ID NO: 2595722 - RNA, 22 nt, Human
acaucacccuuaccaugugccu

SEQ ID NO: 2595723 - RNA, 16 nt, Human
acaucaccacaguuua

SEQ ID NO: 2595724 - RNA, 13 nt, Human
acaucacacacac

SEQ ID NO: 2595725 - RNA, 13 nt, Human
acaucacaggaca

SEQ ID NO: 2595726 - RNA, 19 nt, Human
acaucuugcucugcugaca

SEQ ID NO: 2595727 - RNA, 18 nt, Human
acaucuugcucugcugac

SEQ ID NO: 2595728 - RNA, 17 nt, Human
acaugaaaacacauuuu

SEQ ID NO: 2595729 - RNA, 21 nt, Human
acaucuugcucugcugacaga

SEQ ID NO: 2595730 - RNA, 18 nt, Human
acaugaaaacacauuuuu

SEQ ID NO: 2595731 - RNA, 19 nt, Human
acaugaaaacacauuuuuc

SEQ ID NO: 2595732 - RNA, 21 nt, Human
uauuugguuuggccaucucug

SEQ ID NO: 2595733 - RNA, 23 nt, Human
uauuuguaaaagaacaguaaaca

SEQ ID NO: 2595734 - RNA, 16 nt, Human
acaugaaaacacauuu

SEQ ID NO: 2595735 - RNA, 17 nt, Human
uauuugguacuguauuu

SEQ ID NO: 2595736 - RNA, 23 nt, Human
uauuugggccugcuccagaccug

SEQ ID NO: 2595737 - RNA, 14 nt, Human
acaucuuaguauuu

SEQ ID NO: 2595738 - RNA, 18 nt, Human
acaucuuaguauuugcau

SEQ ID NO: 2595739 - RNA, 17 nt, Human
acaucuguguuucaagu

SEQ ID NO: 2595740 - RNA, 23 nt, Human
acaucugccuuaaaaccaaagag

SEQ ID NO: 2595741 - RNA, 16 nt, Human
acaucuguuuuaaauu

SEQ ID NO: 2595742 - RNA, 17 nt, Human
acaucuguuuuaaauuu

SEQ ID NO: 2595743 - RNA, 14 nt, Human
acaucuugaucugc

SEQ ID NO: 2595744 - RNA, 23 nt, Human
acaucuucccuagaggguuccug

SEQ ID NO: 2595745 - RNA, 16 nt, Human
acaucuucagcaaaua

SEQ ID NO: 2595746 - RNA, 13 nt, Human
acaucuucaaagc

SEQ ID NO: 2595747 - RNA, 23 nt, Human
acaucuugaucugcucagcccug

SEQ ID NO: 2595748 - RNA, 22 nt, Human
acaucuugaucugcucagcccu

SEQ ID NO: 2595749 - RNA, 21 nt, Human
acaucuugaucugcucagccc

SEQ ID NO: 2595750 - RNA, 20 nt, Human
acaucuugaucugcucagcc

SEQ ID NO: 2595751 - RNA, 13 nt, Human
acaucuugcucug

SEQ ID NO: 2595752 - RNA, 22 nt, Human
acaucucugcacccuggggccu

SEQ ID NO: 2595753 - RNA, 21 nt, Human
acaucuccuccauacucagga

SEQ ID NO: 2595754 - RNA, 23 nt, Human
acaucucuuccuccgaggccagu

SEQ ID NO: 2595755 - RNA, 13 nt, Human
acaucucuuccuc

SEQ ID NO: 2595756 - RNA, 12 nt, Human
acaucucugcuu

SEQ ID NO: 2595757 - RNA, 15 nt, Human
acaucucugcuugag

SEQ ID NO: 2595758 - RNA, 17 nt, Human
acaucucuuugaauuuu

SEQ ID NO: 2595759 - RNA, 14 nt, Human
acaucucuuugaau

SEQ ID NO: 2595760 - RNA, 20 nt, Human
acaucucuuugaugucauau

SEQ ID NO: 2595761 - RNA, 15 nt, Human
acaucugugucuugu

SEQ ID NO: 2595762 - RNA, 16 nt, Human
acaucugugucuuguu

SEQ ID NO: 2595763 - RNA, 15 nt, Human
acaucuguccuguga

SEQ ID NO: 2595764 - RNA, 23 nt, Human
acaucucuuugaauuuucugugu

SEQ ID NO: 2595765 - RNA, 13 nt, Human
acaucugaaagcc

SEQ ID NO: 2595766 - RNA, 12 nt, Human
acaucugccuua

SEQ ID NO: 2595767 - RNA, 11 nt, Human
acaucugccuu

SEQ ID NO: 2595768 - RNA, 16 nt, Human
acaguuuguuaguaug

SEQ ID NO: 2595769 - RNA, 20 nt, Human
acaguuuguuaguaugaggc

SEQ ID NO: 2595770 - RNA, 16 nt, Human
acaguuuguuuacaca

SEQ ID NO: 2595771 - RNA, 15 nt, Human
acaguuuguuuacac

SEQ ID NO: 2595772 - RNA, 14 nt, Human
acaguuuguuuaca

SEQ ID NO: 2595773 - RNA, 14 nt, Human
acaguuugucacau

SEQ ID NO: 2595774 - RNA, 22 nt, Human
acaguuuguuuacacacgugca

SEQ ID NO: 2595775 - RNA, 12 nt, Human
acaguuuuccau

SEQ ID NO: 2595776 - RNA, 16 nt, Human
acaguuuucugagaaa

SEQ ID NO: 2595777 - RNA, 17 nt, Human
acaguuuucugagaaag

SEQ ID NO: 2595778 - RNA, 15 nt, Human
acaguuuucugagaa

SEQ ID NO: 2595779 - RNA, 14 nt, Human
acaguuuuccauga

SEQ ID NO: 2595780 - RNA, 15 nt, Human
acaguuuuccaugaa

SEQ ID NO: 2595781 - RNA, 16 nt, Human
acaguuuuccaugaaa

SEQ ID NO: 2595782 - RNA, 17 nt, Human
acaguuuuccaugaaaa

SEQ ID NO: 2595783 - RNA, 18 nt, Human
acaguuuuccaugaaaac

SEQ ID NO: 2595784 - RNA, 19 nt, Human
acaguuuuccaugaaaacg

SEQ ID NO: 2595785 - RNA, 21 nt, Human
acaguuuuccaugaaaacguu

SEQ ID NO: 2595786 - RNA, 23 nt, Human
acaguuuuccaugaaaacguuuu

SEQ ID NO: 2595787 - RNA, 18 nt, Human
acaguuuucugagaaaga

SEQ ID NO: 2595788 - RNA, 19 nt, Human
acaguuuucugagaaagac

SEQ ID NO: 2595789 - RNA, 20 nt, Human
acaguuuucugagaaagacu

SEQ ID NO: 2595790 - RNA, 21 nt, Human
acaguuuucugagaaagacua

SEQ ID NO: 2595791 - RNA, 15 nt, Human
acaguuuuuauugcu

SEQ ID NO: 2595792 - RNA, 21 nt, Human
acaguuuucuggcuggagccu

SEQ ID NO: 2595793 - RNA, 14 nt, Human
acaguuuuccuucu

SEQ ID NO: 2595794 - RNA, 22 nt, Human
acaguuuuccuucucaucugug

SEQ ID NO: 2595795 - RNA, 18 nt, Human
acaguuuugguugcuuua

SEQ ID NO: 2595796 - RNA, 19 nt, Human
acaguuuugguugcuuuaa

SEQ ID NO: 2595797 - RNA, 24 nt, Human
acaguuuugguugcuuuaauauca

SEQ ID NO: 2595798 - RNA, 23 nt, Human
acaguuuugucagucuuucuuag

SEQ ID NO: 2595799 - RNA, 23 nt, Human
acauacuuucauccugacucugc

SEQ ID NO: 2595800 - RNA, 12 nt, Human
acauagaaaguu

SEQ ID NO: 2595801 - RNA, 22 nt, Human
acauacuuucauccugacucug

SEQ ID NO: 2595802 - RNA, 16 nt, Human
acauagaaauugccug

SEQ ID NO: 2595803 - RNA, 21 nt, Human
acauagaaauugccugacgaa

SEQ ID NO: 2595804 - RNA, 16 nt, Human
acauacuugaagggcc

SEQ ID NO: 2595805 - RNA, 17 nt, Human
acauacuugaagggcca

SEQ ID NO: 2595806 - RNA, 18 nt, Human
acauacuugaagggccag

SEQ ID NO: 2595807 - RNA, 19 nt, Human
acauacuugaagggccaga

SEQ ID NO: 2595808 - RNA, 20 nt, Human
acauacuugaagggccagag

SEQ ID NO: 2595809 - RNA, 21 nt, Human
acauacuugaagggccagagc

SEQ ID NO: 2595810 - RNA, 22 nt, Human
acauacuugaagggccagagcc

SEQ ID NO: 2595811 - RNA, 23 nt, Human
acauacuugaagggccagagcca

SEQ ID NO: 2595812 - RNA, 17 nt, Human
acauacucccaucugug

SEQ ID NO: 2595813 - RNA, 14 nt, Human
acauacucugcuua

SEQ ID NO: 2595814 - RNA, 19 nt, Human
acauacuggccuggacugu

SEQ ID NO: 2595815 - RNA, 18 nt, Human
acauacuggccuggacug

SEQ ID NO: 2595816 - RNA, 15 nt, Human
acauacuugaagggc

SEQ ID NO: 2595817 - RNA, 16 nt, Human
acauacuggcugguga

SEQ ID NO: 2595818 - RNA, 12 nt, Human
acauacuucagc

SEQ ID NO: 2595819 - RNA, 24 nt, Human
acauacuccuuccaucaaauagaa

SEQ ID NO: 2595820 - RNA, 12 nt, Human
acauacugcugu

SEQ ID NO: 2595821 - RNA, 21 nt, Human
acauacuaaccagcagaaaug

SEQ ID NO: 2595822 - RNA, 22 nt, Human
acauacuaaccagcagaaaugc

SEQ ID NO: 2595823 - RNA, 13 nt, Human
acauacucccauc

SEQ ID NO: 2595824 - RNA, 20 nt, Human
acauacccuggccgcccccu

SEQ ID NO: 2595825 - RNA, 14 nt, Human
acauacccuccccc

SEQ ID NO: 2595826 - RNA, 15 nt, Human
acauaccagcuuaga

SEQ ID NO: 2595827 - RNA, 13 nt, Human
acauacuaaccag

SEQ ID NO: 2595828 - RNA, 21 nt, Human
acauacccuggccgcccccug

SEQ ID NO: 2595829 - RNA, 20 nt, Human
acaguucuuugggccagaca

SEQ ID NO: 2595830 - RNA, 22 nt, Human
acaguucuuugggccagacaug

SEQ ID NO: 2595831 - RNA, 20 nt, Human
acaguugaaaaacagcugag

SEQ ID NO: 2595832 - RNA, 18 nt, Human
acaguuggaaauccaucc

SEQ ID NO: 2595833 - RNA, 15 nt, Human
acaguugcugucaua

SEQ ID NO: 2595834 - RNA, 21 nt, Human
acaguugcugucauaagaaug

SEQ ID NO: 2595835 - RNA, 16 nt, Human
acaguuggccuucaga

SEQ ID NO: 2595836 - RNA, 22 nt, Human
acaguugcugucauaagaauga

SEQ ID NO: 2595837 - RNA, 22 nt, Human
uauuucuaggaagaauuuuaaa

SEQ ID NO: 2595838 - RNA, 21 nt, Human
acaguucuuugggccagacau

SEQ ID NO: 2595839 - RNA, 15 nt, Human
acaguugaaaaacag

SEQ ID NO: 2595840 - RNA, 16 nt, Human
acaguugaaaaacagc

SEQ ID NO: 2595841 - RNA, 11 nt, Human
acaguuguuug

SEQ ID NO: 2595842 - RNA, 12 nt, Human
acaguuguuuga

SEQ ID NO: 2595843 - RNA, 13 nt, Human
acaguuguuugau

SEQ ID NO: 2595844 - RNA, 15 nt, Human
acaguuguuugaugc

SEQ ID NO: 2595845 - RNA, 22 nt, Human
acaguuguuugaugcauuaaaa

SEQ ID NO: 2595846 - RNA, 14 nt, Human
acaguugggugaga

SEQ ID NO: 2595847 - RNA, 15 nt, Human
acaguuguuggccuc

SEQ ID NO: 2595848 - RNA, 20 nt, Human
acaguuuaauaccacagcuu

SEQ ID NO: 2595849 - RNA, 20 nt, Human
acaguuucuuagcuuuuuaa

SEQ ID NO: 2595850 - RNA, 18 nt, Human
acaguuucuuagcuuuuu

SEQ ID NO: 2595851 - RNA, 17 nt, Human
acaguuucuuagcuuuu

SEQ ID NO: 2595852 - RNA, 16 nt, Human
acaguuucuuagcuuu

SEQ ID NO: 2595853 - RNA, 14 nt, Human
acaguuucuuagcu

SEQ ID NO: 2595854 - RNA, 12 nt, Human
acaguuucuuag

SEQ ID NO: 2595855 - RNA, 13 nt, Human
acaguuugcugua

SEQ ID NO: 2595856 - RNA, 12 nt, Human
acaguuugcugu

SEQ ID NO: 2595857 - RNA, 14 nt, Human
acaguuugcucuag

SEQ ID NO: 2595858 - RNA, 15 nt, Human
acaguuugaacaaaa

SEQ ID NO: 2595859 - RNA, 22 nt, Human
acaguuucuuagcuuuuuaauu

SEQ ID NO: 2595860 - RNA, 19 nt, Human
acaguuucuuuuuucuuac

SEQ ID NO: 2595861 - RNA, 19 nt, Human
uauuucuaggaagaauuuu

SEQ ID NO: 2595862 - RNA, 17 nt, Human
uauuucuaggaagaauu

SEQ ID NO: 2595863 - RNA, 16 nt, Human
uauuucuaggaagaau

SEQ ID NO: 2595864 - RNA, 15 nt, Human
uauuucgaaagcugc

SEQ ID NO: 2595865 - RNA, 19 nt, Human
uauuuccucaugugaucac

SEQ ID NO: 2595866 - RNA, 15 nt, Human
uauuuccuuaaacug

SEQ ID NO: 2595867 - RNA, 19 nt, Human
uauuuccuuaaacugugug

SEQ ID NO: 2595868 - RNA, 18 nt, Human
uauuucccucucauuuug

SEQ ID NO: 2595869 - RNA, 23 nt, Human
uauuuccuauauuguuuucagug

SEQ ID NO: 2595870 - RNA, 21 nt, Human
uauuuccccaacauguaauaa

SEQ ID NO: 2595871 - RNA, 21 nt, Human
uauuuccauuccagaauaucu

SEQ ID NO: 2595872 - RNA, 22 nt, Human
uauuuccccaggggaaaaugaa

SEQ ID NO: 2595873 - RNA, 21 nt, Human
uauuuccccaggggaaaauga

SEQ ID NO: 2595874 - RNA, 20 nt, Human
uauuucccuccccuggggac

SEQ ID NO: 2595875 - RNA, 15 nt, Human
uauuucccuccccug

SEQ ID NO: 2595876 - RNA, 22 nt, Human
uauuucccugaaggaaccaaag

SEQ ID NO: 2595877 - RNA, 22 nt, Human
uauuucccucaccuuucccauc

SEQ ID NO: 2595878 - RNA, 19 nt, Human
uaugaaauaaagaaauugc

SEQ ID NO: 2595879 - RNA, 14 nt, Human
uaugaaauaaagaa

SEQ ID NO: 2595880 - RNA, 21 nt, Human
uaugaaauauuauguuaaaac

SEQ ID NO: 2595881 - RNA, 14 nt, Human
uaugaagaacugag

SEQ ID NO: 2595882 - RNA, 20 nt, Human
uaugaagaaaaaauacauuu

SEQ ID NO: 2595883 - RNA, 13 nt, Human
uaugaagaaaaaa

SEQ ID NO: 2595884 - RNA, 15 nt, Human
uaugaagaaaaaaua

SEQ ID NO: 2595885 - RNA, 16 nt, Human
uaugaagaaaaaauac

SEQ ID NO: 2595886 - RNA, 18 nt, Human
uauuuccauucaacaaga

SEQ ID NO: 2595887 - RNA, 19 nt, Human
uaugaagauaaguguauuu

SEQ ID NO: 2595888 - RNA, 14 nt, Human
uaugaagacauaaa

SEQ ID NO: 2595889 - RNA, 21 nt, Human
uaugaagcuaccucaaacuuc

SEQ ID NO: 2595890 - RNA, 13 nt, Human
uauuucauuucuu

SEQ ID NO: 2595891 - RNA, 16 nt, Human
uaugaagaacugagga

SEQ ID NO: 2595892 - RNA, 17 nt, Human
uaugaagaacugaggag

SEQ ID NO: 2595893 - RNA, 15 nt, Human
uaugaagaagagagu

SEQ ID NO: 2595894 - RNA, 20 nt, Human
uccaagcuggucccacucag

SEQ ID NO: 2595895 - RNA, 16 nt, Human
uccaagcuggucccac

SEQ ID NO: 2595896 - RNA, 12 nt, Human
uccaagaagccc

SEQ ID NO: 2595897 - RNA, 19 nt, Human
uccaacuguguucauuaga

SEQ ID NO: 2595898 - RNA, 20 nt, Human
uccaacuguauauauuccca

SEQ ID NO: 2595899 - RNA, 18 nt, Human
uccaacuguguucauuag

SEQ ID NO: 2595900 - RNA, 15 nt, Human
uccaacuucauuuga

SEQ ID NO: 2595901 - RNA, 21 nt, Human
uccaacuggauuauaaauaaa

SEQ ID NO: 2595902 - RNA, 21 nt, Human
uccaaccuggggggcaguggu

SEQ ID NO: 2595903 - RNA, 13 nt, Human
uccaacuccagga

SEQ ID NO: 2595904 - RNA, 18 nt, Human
uccaaccuaaccccuuuc

SEQ ID NO: 2595905 - RNA, 20 nt, Human
uccaaccuaaccccuuuccu

SEQ ID NO: 2595906 - RNA, 21 nt, Human
uccaaccuaaccccuuuccug

SEQ ID NO: 2595907 - RNA, 23 nt, Human
uccaaccuaaccccuuuccugcg

SEQ ID NO: 2595908 - RNA, 13 nt, Human
uccaaccuuccca

SEQ ID NO: 2595909 - RNA, 21 nt, Human
uccaaccugcaaagaucuguc

SEQ ID NO: 2595910 - RNA, 14 nt, Human
uccaaccuggacaa

SEQ ID NO: 2595911 - RNA, 17 nt, Human
uccaaccuggacaacaa

SEQ ID NO: 2595912 - RNA, 16 nt, Human
uccaauccuauguuuu

SEQ ID NO: 2595913 - RNA, 22 nt, Human
uccaaucccauagaugggucug

SEQ ID NO: 2595914 - RNA, 14 nt, Human
uccaauccucacug

SEQ ID NO: 2595915 - RNA, 15 nt, Human
uccaauccucacugg

SEQ ID NO: 2595916 - RNA, 16 nt, Human
uccaauccucacuggg

SEQ ID NO: 2595917 - RNA, 17 nt, Human
uccaauccucacugggu

SEQ ID NO: 2595918 - RNA, 16 nt, Human
uccaauccugcccccu

SEQ ID NO: 2595919 - RNA, 14 nt, Human
uccaauccugcccc

SEQ ID NO: 2595920 - RNA, 13 nt, Human
uccaauccugccc

SEQ ID NO: 2595921 - RNA, 18 nt, Human
uccaauccucacugggug

SEQ ID NO: 2595922 - RNA, 19 nt, Human
uccaaucuaaccacaucaa

SEQ ID NO: 2595923 - RNA, 18 nt, Human
uccaauccugcccccuga

SEQ ID NO: 2595924 - RNA, 20 nt, Human
uccaagugaacacuagccag

SEQ ID NO: 2595925 - RNA, 17 nt, Human
uccaagugaacacuagc

SEQ ID NO: 2595926 - RNA, 18 nt, Human
uccaagugccagaggugg

SEQ ID NO: 2595927 - RNA, 17 nt, Human
uccaagugccagaggug

SEQ ID NO: 2595928 - RNA, 15 nt, Human
uccaagugccaauau

SEQ ID NO: 2595929 - RNA, 21 nt, Human
uccaagugaacacuagccaga

SEQ ID NO: 2595930 - RNA, 18 nt, Human
uccaaucccaccaacccu

SEQ ID NO: 2595931 - RNA, 19 nt, Human
uccaaggaaaccacagcug

SEQ ID NO: 2595932 - RNA, 12 nt, Human
uccaagcuuuug

SEQ ID NO: 2595933 - RNA, 18 nt, Human
uccaaggguacuaaggaa

SEQ ID NO: 2595934 - RNA, 21 nt, Human
uccaagcuggucccacucagu

SEQ ID NO: 2595935 - RNA, 23 nt, Human
uccaagguggucugcucgggccc

SEQ ID NO: 2595936 - RNA, 20 nt, Human
uccaaggaaaccacagcugc

SEQ ID NO: 2595937 - RNA, 15 nt, Human
uccaagguggucugc

SEQ ID NO: 2595938 - RNA, 17 nt, Human
uccaagucucaguggcu

SEQ ID NO: 2595939 - RNA, 17 nt, Human
uccaacccucaucacca

SEQ ID NO: 2595940 - RNA, 16 nt, Human
uccaacccucaucacc

SEQ ID NO: 2595941 - RNA, 23 nt, Human
uccaacccucaucaccaacgucu

SEQ ID NO: 2595942 - RNA, 14 nt, Human
uccaacccucauca

SEQ ID NO: 2595943 - RNA, 22 nt, Human
uccaaccccccagcacugagga

SEQ ID NO: 2595944 - RNA, 21 nt, Human
uccaaccccccagcacugagg

SEQ ID NO: 2595945 - RNA, 20 nt, Human
uccaaccccccagcacugag

SEQ ID NO: 2595946 - RNA, 19 nt, Human
uccaaccccccagcacuga

SEQ ID NO: 2595947 - RNA, 23 nt, Human
uccaaccccccagcacugaggaa

SEQ ID NO: 2595948 - RNA, 16 nt, Human
uccaacccgaggcccg

SEQ ID NO: 2595949 - RNA, 15 nt, Human
accugccaggaagcc

SEQ ID NO: 2595950 - RNA, 16 nt, Human
accugccagccuggcu

SEQ ID NO: 2595951 - RNA, 18 nt, Human
accugccagccuggcuuc

SEQ ID NO: 2595952 - RNA, 21 nt, Human
accugccagccuggcuucugg

SEQ ID NO: 2595953 - RNA, 15 nt, Human
uccaacccaugauga

SEQ ID NO: 2595954 - RNA, 18 nt, Human
uccaaccccccagcacug

SEQ ID NO: 2595955 - RNA, 17 nt, Human
uccaaccccccagcacu

SEQ ID NO: 2595956 - RNA, 14 nt, Human
uccaaccccccagc

SEQ ID NO: 2595957 - RNA, 17 nt, Human
uccaaccccccaccugc

SEQ ID NO: 2595958 - RNA, 19 nt, Human
uccaaccccaacuccagua

SEQ ID NO: 2595959 - RNA, 18 nt, Human
uccaaccccaacuccagu

SEQ ID NO: 2595960 - RNA, 16 nt, Human
uccaaccccaacucca

SEQ ID NO: 2595961 - RNA, 15 nt, Human
uccaaccccaacucc

SEQ ID NO: 2595962 - RNA, 14 nt, Human
uccaaccccaacuc

SEQ ID NO: 2595963 - RNA, 17 nt, Human
uccaacccauuagccau

SEQ ID NO: 2595964 - RNA, 22 nt, Human
uccaacccaugaugagcuccuc

SEQ ID NO: 2595965 - RNA, 14 nt, Human
accugccaggaagc

SEQ ID NO: 2595966 - RNA, 12 nt, Human
accugccaggaa

SEQ ID NO: 2595967 - RNA, 22 nt, Human
accugccacucacacagccagg

SEQ ID NO: 2595968 - RNA, 21 nt, Human
accugccacucacacagccag

SEQ ID NO: 2595969 - RNA, 20 nt, Human
accugccacucacacagcca

SEQ ID NO: 2595970 - RNA, 19 nt, Human
accugccacucacacagcc

SEQ ID NO: 2595971 - RNA, 14 nt, Human
accugccagccugg

SEQ ID NO: 2595972 - RNA, 15 nt, Human
accugccagccuggc

SEQ ID NO: 2595973 - RNA, 17 nt, Human
accugccacucacacag

SEQ ID NO: 2595974 - RNA, 16 nt, Human
accugccacucacaca

SEQ ID NO: 2595975 - RNA, 14 nt, Human
accugccacucaca

SEQ ID NO: 2595976 - RNA, 13 nt, Human
accugccacucac

SEQ ID NO: 2595977 - RNA, 15 nt, Human
uccacccaggagccc

SEQ ID NO: 2595978 - RNA, 14 nt, Human
uccacccaggagcc

SEQ ID NO: 2595979 - RNA, 12 nt, Human
uccacccaggag

SEQ ID NO: 2595980 - RNA, 17 nt, Human
uccacccaccuuggccu

SEQ ID NO: 2595981 - RNA, 12 nt, Human
uccacccagcaa

SEQ ID NO: 2595982 - RNA, 12 nt, Human
uccacccagccc

SEQ ID NO: 2595983 - RNA, 19 nt, Human
uccacccaccucagccucc

SEQ ID NO: 2595984 - RNA, 18 nt, Human
uccacccaccucagccuc

SEQ ID NO: 2595985 - RNA, 17 nt, Human
uccacccaccucagccu

SEQ ID NO: 2595986 - RNA, 15 nt, Human
uccaaucucauggag

SEQ ID NO: 2595987 - RNA, 17 nt, Human
accuggccucugcacuc

SEQ ID NO: 2595988 - RNA, 16 nt, Human
accuggccucugcacu

SEQ ID NO: 2595989 - RNA, 16 nt, Human
accuggccaccugagg

SEQ ID NO: 2595990 - RNA, 13 nt, Human
accuggccaccug

SEQ ID NO: 2595991 - RNA, 18 nt, Human
accuggcacugcugugcu

SEQ ID NO: 2595992 - RNA, 21 nt, Human
accuggcaucgcaccauucug

SEQ ID NO: 2595993 - RNA, 17 nt, Human
accuggcagcucuggac

SEQ ID NO: 2595994 - RNA, 14 nt, Human
accuggccucugca

SEQ ID NO: 2595995 - RNA, 14 nt, Human
accuggcacugcug

SEQ ID NO: 2595996 - RNA, 23 nt, Human
accuggcaagcuagaaccuggag

SEQ ID NO: 2595997 - RNA, 22 nt, Human
accuggcaagcuagaaccugga

SEQ ID NO: 2595998 - RNA, 20 nt, Human
accuggcaagcuagaaccug

SEQ ID NO: 2595999 - RNA, 17 nt, Human
accuggcacugcugugc

SEQ ID NO: 2596000 - RNA, 15 nt, Human
accuggcacugcugu

SEQ ID NO: 2596001 - RNA, 14 nt, Human
accuggcagcucug

SEQ ID NO: 2596002 - RNA, 16 nt, Human
accuggaguuccugaa

SEQ ID NO: 2596003 - RNA, 22 nt, Human
accuggaggggcuagaaccuag

SEQ ID NO: 2596004 - RNA, 19 nt, Human
accuggaguuccugaaccu

SEQ ID NO: 2596005 - RNA, 14 nt, Human
accuggaggggcua

SEQ ID NO: 2596006 - RNA, 15 nt, Human
accuggagggcugga

SEQ ID NO: 2596007 - RNA, 22 nt, Human
accuggagggcuagaaccuggc

SEQ ID NO: 2596008 - RNA, 23 nt, Human
accuggagggcuagaaccuggag

SEQ ID NO: 2596009 - RNA, 22 nt, Human
accuggagggcuagaaccugga

SEQ ID NO: 2596010 - RNA, 20 nt, Human
accuggagggcuagaaccug

SEQ ID NO: 2596011 - RNA, 21 nt, Human
accuggagggcuagaaccuag

SEQ ID NO: 2596012 - RNA, 13 nt, Human
accuggagggcua

SEQ ID NO: 2596013 - RNA, 18 nt, Human
accuggagccccugggug

SEQ ID NO: 2596014 - RNA, 17 nt, Human
accuggagccccugggu

SEQ ID NO: 2596015 - RNA, 13 nt, Human
uccacccagccca

SEQ ID NO: 2596016 - RNA, 14 nt, Human
uccacccagcccau

SEQ ID NO: 2596017 - RNA, 15 nt, Human
uccacccagcccauu

SEQ ID NO: 2596018 - RNA, 17 nt, Human
uccacccagcccauucu

SEQ ID NO: 2596019 - RNA, 20 nt, Human
accuggccucugcacucccc

SEQ ID NO: 2596020 - RNA, 18 nt, Human
accuggccucugcacucc

SEQ ID NO: 2596021 - RNA, 23 nt, Human
accuggccucugcacuccccugc

SEQ ID NO: 2596022 - RNA, 14 nt, Human
accuggguccaaau

SEQ ID NO: 2596023 - RNA, 22 nt, Human
accuggcugagguuccucugcc

SEQ ID NO: 2596024 - RNA, 21 nt, Human
accuggcugagguuccucugc

SEQ ID NO: 2596025 - RNA, 19 nt, Human
accuggcugagguuccucu

SEQ ID NO: 2596026 - RNA, 13 nt, Human
accuggcugaggu

SEQ ID NO: 2596027 - RNA, 19 nt, Human
accuggcugagccuggcug

SEQ ID NO: 2596028 - RNA, 18 nt, Human
accuggguccaaauaaaa

SEQ ID NO: 2596029 - RNA, 17 nt, Human
accuggguccaaauaaa

SEQ ID NO: 2596030 - RNA, 16 nt, Human
accuggguccaaauaa

SEQ ID NO: 2596031 - RNA, 15 nt, Human
accuggguccaaaua

SEQ ID NO: 2596032 - RNA, 21 nt, Human
accuggguccaaauaaaaacu

SEQ ID NO: 2596033 - RNA, 20 nt, Human
accuggguccaaauaaaaac

SEQ ID NO: 2596034 - RNA, 23 nt, Human
accuggguccaaauaaaaacuaa

SEQ ID NO: 2596035 - RNA, 19 nt, Human
accugguacccuccuggcu

SEQ ID NO: 2596036 - RNA, 18 nt, Human
accugguacccuccuggc

SEQ ID NO: 2596037 - RNA, 16 nt, Human
accugguacccuccug

SEQ ID NO: 2596038 - RNA, 15 nt, Human
accuggguccuuuuc

SEQ ID NO: 2596039 - RNA, 17 nt, Human
accuggguucccuuucc

SEQ ID NO: 2596040 - RNA, 22 nt, Human
accuggguucccuuuccuucca

SEQ ID NO: 2596041 - RNA, 20 nt, Human
accuuagacagucccugcca

SEQ ID NO: 2596042 - RNA, 19 nt, Human
accuuagacagucccugcc

SEQ ID NO: 2596043 - RNA, 18 nt, Human
accuuagacagucccugc

SEQ ID NO: 2596044 - RNA, 19 nt, Human
accuguuucugcagccacu

SEQ ID NO: 2596045 - RNA, 21 nt, Human
accuggucacaggacucugcc

SEQ ID NO: 2596046 - RNA, 19 nt, Human
accuguuuuuaagcuguuu

SEQ ID NO: 2596047 - RNA, 18 nt, Human
accuguuuuuaagcuguu

SEQ ID NO: 2596048 - RNA, 18 nt, Human
accuguuuucgcaccuac

SEQ ID NO: 2596049 - RNA, 16 nt, Human
accuguuuuuaagcug

SEQ ID NO: 2596050 - RNA, 20 nt, Human
accuguuuuuaagcuguuuc

SEQ ID NO: 2596051 - RNA, 14 nt, Human
acgagaaaacaaua

SEQ ID NO: 2596052 - RNA, 21 nt, Human
accuuuuuuauacauaaacaa

SEQ ID NO: 2596053 - RNA, 22 nt, Human
accuuuuuuauacauaaacaag

SEQ ID NO: 2596054 - RNA, 14 nt, Human
uccagggaagcugg

SEQ ID NO: 2596055 - RNA, 16 nt, Human
uccagggaagcuggcc

SEQ ID NO: 2596056 - RNA, 19 nt, Human
accuuuuuuauacauaaac

SEQ ID NO: 2596057 - RNA, 20 nt, Human
accuuuuuuauacauaaaca

SEQ ID NO: 2596058 - RNA, 12 nt, Human
uccagggaagcu

SEQ ID NO: 2596059 - RNA, 17 nt, Human
uccaggcuuggauguaa

SEQ ID NO: 2596060 - RNA, 20 nt, Human
uccaggcugucuuucacuga

SEQ ID NO: 2596061 - RNA, 21 nt, Human
uccaggcuguaucccaugagc

SEQ ID NO: 2596062 - RNA, 19 nt, Human
acgaggcccucgggcccag

SEQ ID NO: 2596063 - RNA, 18 nt, Human
acgaggcccucgggccca

SEQ ID NO: 2596064 - RNA, 16 nt, Human
acgaggcccucgggcc

SEQ ID NO: 2596065 - RNA, 13 nt, Human
acgaggcccucgg

SEQ ID NO: 2596066 - RNA, 17 nt, Human
acgccagauucuuuccu

SEQ ID NO: 2596067 - RNA, 19 nt, Human
acgccagauucuuuccuga

SEQ ID NO: 2596068 - RNA, 16 nt, Human
acgagcaggcuucuuc

SEQ ID NO: 2596069 - RNA, 19 nt, Human
acgagcuguuuacuaggga

SEQ ID NO: 2596070 - RNA, 11 nt, Human
acgaggcccuc

SEQ ID NO: 2596071 - RNA, 12 nt, Human
acgaggaagccc

SEQ ID NO: 2596072 - RNA, 19 nt, Human
acgagcaggcuacugucag

SEQ ID NO: 2596073 - RNA, 20 nt, Human
acgagcaggcuacugucagc

SEQ ID NO: 2596074 - RNA, 19 nt, Human
acgagacccuacaggagag

SEQ ID NO: 2596075 - RNA, 20 nt, Human
acgagacccuacaggagagg

SEQ ID NO: 2596076 - RNA, 17 nt, Human
uccagggaagcuggccg

SEQ ID NO: 2596077 - RNA, 15 nt, Human
acgagaaagaucauu

SEQ ID NO: 2596078 - RNA, 18 nt, Human
uccagggaagcuggccga

SEQ ID NO: 2596079 - RNA, 20 nt, Human
acgagaggggaagaguguac

SEQ ID NO: 2596080 - RNA, 18 nt, Human
acgagagguaugccugua

SEQ ID NO: 2596081 - RNA, 21 nt, Human
acgagaggggaagaguguacu

SEQ ID NO: 2596082 - RNA, 19 nt, Human
acgagaucaagagaucaag

SEQ ID NO: 2596083 - RNA, 19 nt, Human
uccaggcacccuucuuucc

SEQ ID NO: 2596084 - RNA, 16 nt, Human
uccaggcacccuucuu

SEQ ID NO: 2596085 - RNA, 15 nt, Human
uccaggcacccuucu

SEQ ID NO: 2596086 - RNA, 21 nt, Human
uccaggcacccuucuuuccuc

SEQ ID NO: 2596087 - RNA, 20 nt, Human
uccaggcacccuucuuuccu

SEQ ID NO: 2596088 - RNA, 14 nt, Human
uccaggcacugaga

SEQ ID NO: 2596089 - RNA, 16 nt, Human
uccaggcacugagaua

SEQ ID NO: 2596090 - RNA, 13 nt, Human
uccaggcagaucc

SEQ ID NO: 2596091 - RNA, 13 nt, Human
uccagccccugga

SEQ ID NO: 2596092 - RNA, 23 nt, Human
uccagccccucuggucgcuccug

SEQ ID NO: 2596093 - RNA, 18 nt, Human
uccagccccucuggucgc

SEQ ID NO: 2596094 - RNA, 16 nt, Human
uccagccccucugguc

SEQ ID NO: 2596095 - RNA, 15 nt, Human
uccagccccucuggu

SEQ ID NO: 2596096 - RNA, 19 nt, Human
uccagagaguccucuggau

SEQ ID NO: 2596097 - RNA, 18 nt, Human
uccagagaguccucugga

SEQ ID NO: 2596098 - RNA, 14 nt, Human
uccagccccucugg

SEQ ID NO: 2596099 - RNA, 12 nt, Human
uccagccccugg

SEQ ID NO: 2596100 - RNA, 15 nt, Human
uccagagaguggcuc

SEQ ID NO: 2596101 - RNA, 21 nt, Human
uccagagagagaagugccccu

SEQ ID NO: 2596102 - RNA, 15 nt, Human
uccagagaguccucu

SEQ ID NO: 2596103 - RNA, 23 nt, Human
uccagagagagaagugccccugc

SEQ ID NO: 2596104 - RNA, 17 nt, Human
uccagagaguggcuccu

SEQ ID NO: 2596105 - RNA, 16 nt, Human
uccagagaguggcucc

SEQ ID NO: 2596106 - RNA, 14 nt, Human
uccaggcagaucca

SEQ ID NO: 2596107 - RNA, 15 nt, Human
uccaggcagauccag

SEQ ID NO: 2596108 - RNA, 16 nt, Human
uccaggcagauccagg

SEQ ID NO: 2596109 - RNA, 17 nt, Human
uccaggcagauccagga

SEQ ID NO: 2596110 - RNA, 18 nt, Human
uccaggcagauccaggac

SEQ ID NO: 2596111 - RNA, 19 nt, Human
uccaggcagauccaggacu

SEQ ID NO: 2596112 - RNA, 20 nt, Human
uccaggcagauccaggacua

SEQ ID NO: 2596113 - RNA, 21 nt, Human
uccaggcagauccaggacuau

SEQ ID NO: 2596114 - RNA, 23 nt, Human
uccaggcagucgggggcuggccu

SEQ ID NO: 2596115 - RNA, 14 nt, Human
uccaggcaggcuaa

SEQ ID NO: 2596116 - RNA, 22 nt, Human
uccaggcagucgggggcuggcc

SEQ ID NO: 2596117 - RNA, 16 nt, Human
uccaggccagggggcc

SEQ ID NO: 2596118 - RNA, 23 nt, Human
uccaggcacccuucuuuccucuu

SEQ ID NO: 2596119 - RNA, 14 nt, Human
uccaggcuguaucc

SEQ ID NO: 2596120 - RNA, 18 nt, Human
uccaggccagggggccag

SEQ ID NO: 2596121 - RNA, 17 nt, Human
uccaggccauggaggca

SEQ ID NO: 2596122 - RNA, 21 nt, Human
uccaggccccaaaaccacagc

SEQ ID NO: 2596123 - RNA, 16 nt, Human
uccagaauuucccaaa

SEQ ID NO: 2596124 - RNA, 12 nt, Human
uccacugccugg

SEQ ID NO: 2596125 - RNA, 15 nt, Human
uccacucccagugcu

SEQ ID NO: 2596126 - RNA, 10 nt, Human
uccacuggac

SEQ ID NO: 2596127 - RNA, 12 nt, Human
uccacuggacuu

SEQ ID NO: 2596128 - RNA, 16 nt, Human
uccacuggacuugagc

SEQ ID NO: 2596129 - RNA, 22 nt, Human
uccacugccuucgauacaccgg

SEQ ID NO: 2596130 - RNA, 15 nt, Human
uccacugccuucgau

SEQ ID NO: 2596131 - RNA, 13 nt, Human
uccacugccuucg

SEQ ID NO: 2596132 - RNA, 15 nt, Human
uccacugagggcagu

SEQ ID NO: 2596133 - RNA, 22 nt, Human
uccagaauuucccaaagcagug

SEQ ID NO: 2596134 - RNA, 20 nt, Human
uccagaauuucccaaagcag

SEQ ID NO: 2596135 - RNA, 13 nt, Human
uccagacacaugu

SEQ ID NO: 2596136 - RNA, 14 nt, Human
uccagacccggcug

SEQ ID NO: 2596137 - RNA, 18 nt, Human
uccacuggggauugggcc

SEQ ID NO: 2596138 - RNA, 22 nt, Human
uccacuggccggagucagugcc

SEQ ID NO: 2596139 - RNA, 17 nt, Human
uccacuggacuugagcu

SEQ ID NO: 2596140 - RNA, 18 nt, Human
uccagacccggcugcgug

SEQ ID NO: 2596141 - RNA, 15 nt, Human
uccagacccggcugc

SEQ ID NO: 2596142 - RNA, 19 nt, Human
uccagacccggcugcgugg

SEQ ID NO: 2596143 - RNA, 15 nt, Human
uccagaccugaagaa

SEQ ID NO: 2596144 - RNA, 16 nt, Human
uccagaccugaagaau

SEQ ID NO: 2596145 - RNA, 11 nt, Human
uccagaccuga

SEQ ID NO: 2596146 - RNA, 19 nt, Human
uccagacaaaccagaagca

SEQ ID NO: 2596147 - RNA, 24 nt, Human
uccagacaaaccagaagcaacaga

SEQ ID NO: 2596148 - RNA, 18 nt, Human
uccagacguaggggaggg

SEQ ID NO: 2596149 - RNA, 21 nt, Human
uccagaccuuguucacacucu

SEQ ID NO: 2596150 - RNA, 15 nt, Human
uccagacucucugug

SEQ ID NO: 2596151 - RNA, 14 nt, Human
uccagacucucugu

SEQ ID NO: 2596152 - RNA, 22 nt, Human
uccagacugcuuccaauuuucu

SEQ ID NO: 2596153 - RNA, 13 nt, Human
uccagaccugauc

SEQ ID NO: 2596154 - RNA, 18 nt, Human
uccagaccugauccugga

SEQ ID NO: 2596155 - RNA, 19 nt, Human
uccagaccugauccuggag

SEQ ID NO: 2596156 - RNA, 22 nt, Human
uccagaccugauccuggaggcc

SEQ ID NO: 2596157 - RNA, 23 nt, Human
uccagacugcuuccaauuuucug

SEQ ID NO: 2596158 - RNA, 14 nt, Human
uccagacuuccuug

SEQ ID NO: 2596159 - RNA, 19 nt, Human
uccagacuuccuugagaca

SEQ ID NO: 2596160 - RNA, 20 nt, Human
uccagacuuccuugagacac

SEQ ID NO: 2596161 - RNA, 19 nt, Human
uccagagagagaagugccc

SEQ ID NO: 2596162 - RNA, 14 nt, Human
uccagagacuggga

SEQ ID NO: 2596163 - RNA, 14 nt, Human
uccacgacugucuc

SEQ ID NO: 2596164 - RNA, 15 nt, Human
uccacgacugucucc

SEQ ID NO: 2596165 - RNA, 16 nt, Human
uccacgacugucucca

SEQ ID NO: 2596166 - RNA, 19 nt, Human
uccaccuucccaugcccug

SEQ ID NO: 2596167 - RNA, 18 nt, Human
uccaccuucccaugcccu

SEQ ID NO: 2596168 - RNA, 16 nt, Human
uccaccuucccaugcc

SEQ ID NO: 2596169 - RNA, 22 nt, Human
accuuuugggaauguuuuaaau

SEQ ID NO: 2596170 - RNA, 16 nt, Human
accuuuugggaauguu

SEQ ID NO: 2596171 - RNA, 19 nt, Human
accuuuugggaauguuuua

SEQ ID NO: 2596172 - RNA, 21 nt, Human
accuuuugcaccugcucucuu

SEQ ID NO: 2596173 - RNA, 23 nt, Human
accuucaauaaaguaucuacaug

SEQ ID NO: 2596174 - RNA, 13 nt, Human
uccacucccagug

SEQ ID NO: 2596175 - RNA, 19 nt, Human
uccacucccaggcagcccu

SEQ ID NO: 2596176 - RNA, 14 nt, Human
uccacucccaggca

SEQ ID NO: 2596177 - RNA, 13 nt, Human
uccacucccacuu

SEQ ID NO: 2596178 - RNA, 19 nt, Human
uccacgacugucuccaugg

SEQ ID NO: 2596179 - RNA, 12 nt, Human
uccacucccacu

SEQ ID NO: 2596180 - RNA, 15 nt, Human
uccacucaguugcaa

SEQ ID NO: 2596181 - RNA, 15 nt, Human
uccacuccuccuagc

SEQ ID NO: 2596182 - RNA, 18 nt, Human
uccacuccuccuagccac

SEQ ID NO: 2596183 - RNA, 17 nt, Human
uccacgacugucuccau

SEQ ID NO: 2596184 - RNA, 18 nt, Human
uccacgacugucuccaug

SEQ ID NO: 2596185 - RNA, 20 nt, Human
accuuuugagugccuuacac

SEQ ID NO: 2596186 - RNA, 17 nt, Human
accuuuugagugccuua

SEQ ID NO: 2596187 - RNA, 14 nt, Human
accuuuugagugcc

SEQ ID NO: 2596188 - RNA, 13 nt, Human
accuucaauaaag

SEQ ID NO: 2596189 - RNA, 14 nt, Human
accuucaauaaagu

SEQ ID NO: 2596190 - RNA, 15 nt, Human
accuucaauaaagua

SEQ ID NO: 2596191 - RNA, 17 nt, Human
accuucaauaaaguauc

SEQ ID NO: 2596192 - RNA, 19 nt, Human
accuucaauaaaguaucua

SEQ ID NO: 2596193 - RNA, 20 nt, Human
accuucaauaaaguaucuac

SEQ ID NO: 2596194 - RNA, 16 nt, Human
accuucaauuccuggg

SEQ ID NO: 2596195 - RNA, 22 nt, Human
accuuaucugugcgugaaacac

SEQ ID NO: 2596196 - RNA, 18 nt, Human
accuuauuguaccucucu

SEQ ID NO: 2596197 - RNA, 17 nt, Human
accuuauuguaccucuc

SEQ ID NO: 2596198 - RNA, 14 nt, Human
accuuauuguaccu

SEQ ID NO: 2596199 - RNA, 23 nt, Human
accuuaucugugcgugaaacaca

SEQ ID NO: 2596200 - RNA, 12 nt, Human
accuucaauaaa

SEQ ID NO: 2596201 - RNA, 19 nt, Human
accuucaaacuagggccaa

SEQ ID NO: 2596202 - RNA, 18 nt, Human
accuuauuuuuucccaaa

SEQ ID NO: 2596203 - RNA, 22 nt, Human
accuuauuguaccucucuuaua

SEQ ID NO: 2596204 - RNA, 20 nt, Human
accuuauuguaccucucuua

SEQ ID NO: 2596205 - RNA, 16 nt, Human
accuuauuuuuuccca

SEQ ID NO: 2596206 - RNA, 13 nt, Human
accuacauguauu

SEQ ID NO: 2596207 - RNA, 14 nt, Human
accuacauguauuu

SEQ ID NO: 2596208 - RNA, 15 nt, Human
accuacauguauuug

SEQ ID NO: 2596209 - RNA, 14 nt, Human
accuaccaaaaaau

SEQ ID NO: 2596210 - RNA, 15 nt, Human
accuaccacaguguc

SEQ ID NO: 2596211 - RNA, 20 nt, Human
accuacaguguacagucuug

SEQ ID NO: 2596212 - RNA, 18 nt, Human
accuacaguguacagucu

SEQ ID NO: 2596213 - RNA, 17 nt, Human
accuacaguguacaguc

SEQ ID NO: 2596214 - RNA, 16 nt, Human
accuacaguguacagu

SEQ ID NO: 2596215 - RNA, 22 nt, Human
accuaauccaggcagauccagg

SEQ ID NO: 2596216 - RNA, 21 nt, Human
accuaauccaggcagauccag

SEQ ID NO: 2596217 - RNA, 20 nt, Human
accuaaugcuccuuguuccu

SEQ ID NO: 2596218 - RNA, 12 nt, Human
accuaauguuua

SEQ ID NO: 2596219 - RNA, 19 nt, Human
accuaauguuuaugagcca

SEQ ID NO: 2596220 - RNA, 20 nt, Human
accuaauguuuaugagccag

SEQ ID NO: 2596221 - RNA, 16 nt, Human
accuaauuagagcaga

SEQ ID NO: 2596222 - RNA, 15 nt, Human
accuaauuagagcag

SEQ ID NO: 2596223 - RNA, 22 nt, Human
accuacaccauuaucuuggaaa

SEQ ID NO: 2596224 - RNA, 19 nt, Human
accuaauuagagcagauga

SEQ ID NO: 2596225 - RNA, 15 nt, Human
accuacaguguacag

SEQ ID NO: 2596226 - RNA, 21 nt, Human
accuagggugauauuaaccag

SEQ ID NO: 2596227 - RNA, 15 nt, Human
accuaccucagguug

SEQ ID NO: 2596228 - RNA, 14 nt, Human
accuaccucagguu

SEQ ID NO: 2596229 - RNA, 13 nt, Human
accuaccucaggu

SEQ ID NO: 2596230 - RNA, 12 nt, Human
accuaccucagg

SEQ ID NO: 2596231 - RNA, 14 nt, Human
accuaccaucaggg

SEQ ID NO: 2596232 - RNA, 21 nt, Human
accuaccaccccuuccugucc

SEQ ID NO: 2596233 - RNA, 19 nt, Human
accuaccaccccuuccugu

SEQ ID NO: 2596234 - RNA, 18 nt, Human
accuaccaccccuuccug

SEQ ID NO: 2596235 - RNA, 15 nt, Human
accuaccacaugcca

SEQ ID NO: 2596236 - RNA, 20 nt, Human
accuaccaccacgcccggcu

SEQ ID NO: 2596237 - RNA, 16 nt, Human
accuaccaccacgccc

SEQ ID NO: 2596238 - RNA, 16 nt, Human
accuaccacagugucu

SEQ ID NO: 2596239 - RNA, 17 nt, Human
accuaccacagugucug

SEQ ID NO: 2596240 - RNA, 12 nt, Human
accuaccacaug

SEQ ID NO: 2596241 - RNA, 19 nt, Human
accuaccacagugucugua

SEQ ID NO: 2596242 - RNA, 21 nt, Human
accuaguggcuguccagugcc

SEQ ID NO: 2596243 - RNA, 19 nt, Human
accuaguggcuguccagug

SEQ ID NO: 2596244 - RNA, 17 nt, Human
accuaguggcuguccag

SEQ ID NO: 2596245 - RNA, 16 nt, Human
accuaguggcugucca

SEQ ID NO: 2596246 - RNA, 23 nt, Human
accuaguggcuguccagugccca

SEQ ID NO: 2596247 - RNA, 14 nt, Human
accuaguuuuccau

SEQ ID NO: 2596248 - RNA, 16 nt, Human
accuaccucagguugc

SEQ ID NO: 2596249 - RNA, 13 nt, Human
accuagucuaagg

SEQ ID NO: 2596250 - RNA, 15 nt, Human
accuaguagucauuu

SEQ ID NO: 2596251 - RNA, 19 nt, Human
accucaaaaugucuaagau

SEQ ID NO: 2596252 - RNA, 22 nt, Human
accuaguggcuguccagugccc

SEQ ID NO: 2596253 - RNA, 15 nt, Human
accuauaaaacaggu

SEQ ID NO: 2596254 - RNA, 16 nt, Human
accuauaaaguaaagc

SEQ ID NO: 2596255 - RNA, 18 nt, Human
accuauaaaacaggucaa

SEQ ID NO: 2596256 - RNA, 23 nt, Human
accucaaacuuccagucagguag

SEQ ID NO: 2596257 - RNA, 18 nt, Human
accuauaaaguaaagcua

SEQ ID NO: 2596258 - RNA, 22 nt, Human
ucaggaaaucaaauaugcaaag

SEQ ID NO: 2596259 - RNA, 23 nt, Human
ucaggaaaucaaauaugcaaagc

SEQ ID NO: 2596260 - RNA, 12 nt, Human
ucaggaagcuca

SEQ ID NO: 2596261 - RNA, 22 nt, Human
ucaggaaaggaaucauuucuau

SEQ ID NO: 2596262 - RNA, 18 nt, Human
ucaggaaauauauaugug

SEQ ID NO: 2596263 - RNA, 19 nt, Human
ucaggaaauauauaugugu

SEQ ID NO: 2596264 - RNA, 20 nt, Human
ucaggaaauauauaugugug

SEQ ID NO: 2596265 - RNA, 21 nt, Human
ucaggaaauauauaugugugu

SEQ ID NO: 2596266 - RNA, 13 nt, Human
ucaggaacagaag

SEQ ID NO: 2596267 - RNA, 14 nt, Human
ucaggaagcucagg

SEQ ID NO: 2596268 - RNA, 13 nt, Human
ucaggaagcucag

SEQ ID NO: 2596269 - RNA, 15 nt, Human
ucaggaagcucaggg

SEQ ID NO: 2596270 - RNA, 14 nt, Human
ucaggaacagaagg

SEQ ID NO: 2596271 - RNA, 16 nt, Human
ucaggaacagaaggau

SEQ ID NO: 2596272 - RNA, 16 nt, Human
accgcgacuaauuuca

SEQ ID NO: 2596273 - RNA, 17 nt, Human
accgcgacuaauuucaa

SEQ ID NO: 2596274 - RNA, 18 nt, Human
ucaggaacagcuauggga

SEQ ID NO: 2596275 - RNA, 20 nt, Human
accgcgacuaauuucaaaau

SEQ ID NO: 2596276 - RNA, 15 nt, Human
accgcgucuggugac

SEQ ID NO: 2596277 - RNA, 19 nt, Human
accgcguuguaaaauauag

SEQ ID NO: 2596278 - RNA, 18 nt, Human
accgcguuguaaaauaua

SEQ ID NO: 2596279 - RNA, 15 nt, Human
accgcguuguaaaau

SEQ ID NO: 2596280 - RNA, 13 nt, Human
accgcguuguaaa

SEQ ID NO: 2596281 - RNA, 13 nt, Human
accgcuccccagc

SEQ ID NO: 2596282 - RNA, 15 nt, Human
accuaaaaaagauau

SEQ ID NO: 2596283 - RNA, 14 nt, Human
accgcuccccagcc

SEQ ID NO: 2596284 - RNA, 15 nt, Human
accuaaacagauaua

SEQ ID NO: 2596285 - RNA, 22 nt, Human
accuaaaauuugcccucccauc

SEQ ID NO: 2596286 - RNA, 21 nt, Human
accuaaaauuugcccucccau

SEQ ID NO: 2596287 - RNA, 19 nt, Human
accuaaaauuugcccuccc

SEQ ID NO: 2596288 - RNA, 23 nt, Human
accuaaacauagaaauugccuga

SEQ ID NO: 2596289 - RNA, 19 nt, Human
accuaaaaaagauauauua

SEQ ID NO: 2596290 - RNA, 16 nt, Human
accuaaaaaagauaua

SEQ ID NO: 2596291 - RNA, 21 nt, Human
accuaaaagagauuucaagag

SEQ ID NO: 2596292 - RNA, 13 nt, Human
accuaaaagagau

SEQ ID NO: 2596293 - RNA, 21 nt, Human
accuaaaaggaaaucucaccc

SEQ ID NO: 2596294 - RNA, 22 nt, Human
accuaaaaggaaaucucacccc

SEQ ID NO: 2596295 - RNA, 15 nt, Human
accuaaccccuuucc

SEQ ID NO: 2596296 - RNA, 16 nt, Human
accuaaccccuuuccu

SEQ ID NO: 2596297 - RNA, 18 nt, Human
accuaacauuauuuauuc

SEQ ID NO: 2596298 - RNA, 15 nt, Human
accuaaauggccuca

SEQ ID NO: 2596299 - RNA, 22 nt, Human
ucauccuucuggaauaaggaga

SEQ ID NO: 2596300 - RNA, 14 nt, Human
ucaucuaggauuuu

SEQ ID NO: 2596301 - RNA, 18 nt, Human
ucaucuagguaaauuaca

SEQ ID NO: 2596302 - RNA, 13 nt, Human
ucaucuaguuuua

SEQ ID NO: 2596303 - RNA, 16 nt, Human
ucaugaauuaguuuua

SEQ ID NO: 2596304 - RNA, 16 nt, Human
ucaugaaucugcaaug

SEQ ID NO: 2596305 - RNA, 13 nt, Human
ucaugaagcccaa

SEQ ID NO: 2596306 - RNA, 18 nt, Human
ucaucuauuucugagaag

SEQ ID NO: 2596307 - RNA, 23 nt, Human
ucaucuauaaagaagaacuugca

SEQ ID NO: 2596308 - RNA, 13 nt, Human
ucaucuauaaaga

SEQ ID NO: 2596309 - RNA, 11 nt, Human
ucaucuauuuc

SEQ ID NO: 2596310 - RNA, 14 nt, Human
ucaucuauuucuga

SEQ ID NO: 2596311 - RNA, 15 nt, Human
ucaucuauuucugag

SEQ ID NO: 2596312 - RNA, 16 nt, Human
ucaucuauuucugaga

SEQ ID NO: 2596313 - RNA, 17 nt, Human
ucaucuauuucugagaa

SEQ ID NO: 2596314 - RNA, 19 nt, Human
ucauccuccucagaucuuc

SEQ ID NO: 2596315 - RNA, 13 nt, Human
ucauccuccucag

SEQ ID NO: 2596316 - RNA, 18 nt, Human
ucauccucauacccaccc

SEQ ID NO: 2596317 - RNA, 20 nt, Human
ucauccugacucugcccccu

SEQ ID NO: 2596318 - RNA, 19 nt, Human
ucauccugacucugccccc

SEQ ID NO: 2596319 - RNA, 17 nt, Human
ucauccugacucugccc

SEQ ID NO: 2596320 - RNA, 16 nt, Human
ucauccugacucugcc

SEQ ID NO: 2596321 - RNA, 14 nt, Human
ucauccuucuggaa

SEQ ID NO: 2596322 - RNA, 13 nt, Human
ucauccugcaggc

SEQ ID NO: 2596323 - RNA, 12 nt, Human
ucauccugcagg

SEQ ID NO: 2596324 - RNA, 14 nt, Human
ucauccgaggcagg

SEQ ID NO: 2596325 - RNA, 15 nt, Human
ucauccgaggcaggg

SEQ ID NO: 2596326 - RNA, 21 nt, Human
ucaucccgagcaccuccacau

SEQ ID NO: 2596327 - RNA, 23 nt, Human
ucaucccgagcaccuccacaucc

SEQ ID NO: 2596328 - RNA, 18 nt, Human
ucaucccuaaugcugcag

SEQ ID NO: 2596329 - RNA, 17 nt, Human
ucaucccuaaugcugca

SEQ ID NO: 2596330 - RNA, 21 nt, Human
ucaucccuaugggauucagug

SEQ ID NO: 2596331 - RNA, 15 nt, Human
ucauccuaagcuauu

SEQ ID NO: 2596332 - RNA, 19 nt, Human
ucauccggcagccuggaug

SEQ ID NO: 2596333 - RNA, 15 nt, Human
ucauccggcagccug

SEQ ID NO: 2596334 - RNA, 17 nt, Human
ucauccggcagccugga

SEQ ID NO: 2596335 - RNA, 14 nt, Human
ucaucccauguaca

SEQ ID NO: 2596336 - RNA, 23 nt, Human
accuccugccucgaacuggcugc

SEQ ID NO: 2596337 - RNA, 18 nt, Human
ucaucccauucugcguca

SEQ ID NO: 2596338 - RNA, 20 nt, Human
ucauccccaccugucuucaa

SEQ ID NO: 2596339 - RNA, 12 nt, Human
ucauccccaggg

SEQ ID NO: 2596340 - RNA, 20 nt, Human
ucauccccaggggucccagc

SEQ ID NO: 2596341 - RNA, 21 nt, Human
ucauccccaggggucccagcc

SEQ ID NO: 2596342 - RNA, 17 nt, Human
ucauccccucacuugcc

SEQ ID NO: 2596343 - RNA, 17 nt, Human
accucccugacccgucu

SEQ ID NO: 2596344 - RNA, 13 nt, Human
accucccugaccc

SEQ ID NO: 2596345 - RNA, 14 nt, Human
accucccugcaacc

SEQ ID NO: 2596346 - RNA, 13 nt, Human
accucccugccuc

SEQ ID NO: 2596347 - RNA, 14 nt, Human
accucccugccucc

SEQ ID NO: 2596348 - RNA, 12 nt, Human
accuccugccuc

SEQ ID NO: 2596349 - RNA, 13 nt, Human
accuccugccucg

SEQ ID NO: 2596350 - RNA, 10 nt, Human
accucccucc

SEQ ID NO: 2596351 - RNA, 16 nt, Human
accucaacugccuacu

SEQ ID NO: 2596352 - RNA, 22 nt, Human
accucaacccccauuucuauuu

SEQ ID NO: 2596353 - RNA, 15 nt, Human
accucccucccggca

SEQ ID NO: 2596354 - RNA, 22 nt, Human
accucaacugccuacuccaaaa

SEQ ID NO: 2596355 - RNA, 14 nt, Human
accucccugaacca

SEQ ID NO: 2596356 - RNA, 15 nt, Human
accucccugaaccau

SEQ ID NO: 2596357 - RNA, 20 nt, Human
accucccugaaccaucccug

SEQ ID NO: 2596358 - RNA, 21 nt, Human
accucaacccccauuucuauu

SEQ ID NO: 2596359 - RNA, 19 nt, Human
accucaacccccauuucua

SEQ ID NO: 2596360 - RNA, 16 nt, Human
accucaaccugugaug

SEQ ID NO: 2596361 - RNA, 16 nt, Human
accucaaccaaugcca

SEQ ID NO: 2596362 - RNA, 21 nt, Human
accugaggcccuucucuccag

SEQ ID NO: 2596363 - RNA, 20 nt, Human
accugaggcccuucucucca

SEQ ID NO: 2596364 - RNA, 16 nt, Human
accugaggcccuucuc

SEQ ID NO: 2596365 - RNA, 15 nt, Human
accugaggcccuucu

SEQ ID NO: 2596366 - RNA, 22 nt, Human
accugaggugggcccaggacca

SEQ ID NO: 2596367 - RNA, 21 nt, Human
accugaggugggcccaggacc

SEQ ID NO: 2596368 - RNA, 19 nt, Human
accugaggugggcccagga

SEQ ID NO: 2596369 - RNA, 18 nt, Human
accugaggugggcccagg

SEQ ID NO: 2596370 - RNA, 17 nt, Human
accugaggugggcccag

SEQ ID NO: 2596371 - RNA, 16 nt, Human
accugaggugggccca

SEQ ID NO: 2596372 - RNA, 14 nt, Human
accugaggugggcc

SEQ ID NO: 2596373 - RNA, 12 nt, Human
accugagguggg

SEQ ID NO: 2596374 - RNA, 24 nt, Human
accugaggugggcccaggaccagc

SEQ ID NO: 2596375 - RNA, 23 nt, Human
accugaggugggcccaggaccag

SEQ ID NO: 2596376 - RNA, 22 nt, Human
accugagucacccuaccugugc

SEQ ID NO: 2596377 - RNA, 23 nt, Human
accugagucacccuaccugugcc

SEQ ID NO: 2596378 - RNA, 21 nt, Human
accugagucguacagaaagcu

SEQ ID NO: 2596379 - RNA, 22 nt, Human
accugaggcccuucucuccagc

SEQ ID NO: 2596380 - RNA, 18 nt, Human
accugauugugucucuug

SEQ ID NO: 2596381 - RNA, 17 nt, Human
accugauugugucucuu

SEQ ID NO: 2596382 - RNA, 15 nt, Human
accugauugugucuc

SEQ ID NO: 2596383 - RNA, 14 nt, Human
accugaucaaugac

SEQ ID NO: 2596384 - RNA, 16 nt, Human
accugaucaaugacag

SEQ ID NO: 2596385 - RNA, 18 nt, Human
accugagucugcuauauu

SEQ ID NO: 2596386 - RNA, 21 nt, Human
accugauuuacaguuucaaaa

SEQ ID NO: 2596387 - RNA, 15 nt, Human
accugauuuacaguu

SEQ ID NO: 2596388 - RNA, 20 nt, Human
accugaucaaugacagagcc

SEQ ID NO: 2596389 - RNA, 17 nt, Human
accugaucaaugacaga

SEQ ID NO: 2596390 - RNA, 14 nt, Human
accugauugugucu

SEQ ID NO: 2596391 - RNA, 23 nt, Human
accugcacuggggagcccgucuc

SEQ ID NO: 2596392 - RNA, 22 nt, Human
accugcaccuccccccacugca

SEQ ID NO: 2596393 - RNA, 21 nt, Human
accugcaccuccccccacugc

SEQ ID NO: 2596394 - RNA, 15 nt, Human
accugcaggccaaga

SEQ ID NO: 2596395 - RNA, 19 nt, Human
accugcaggccaagagcag

SEQ ID NO: 2596396 - RNA, 21 nt, Human
accugcauccguaguucccug

SEQ ID NO: 2596397 - RNA, 22 nt, Human
accugcauccguaguucccuga

SEQ ID NO: 2596398 - RNA, 17 nt, Human
accugcagguugggcca

SEQ ID NO: 2596399 - RNA, 13 nt, Human
accugcagguugg

SEQ ID NO: 2596400 - RNA, 22 nt, Human
accugcagguugggccauacug

SEQ ID NO: 2596401 - RNA, 19 nt, Human
accugcauccguaguuccc

SEQ ID NO: 2596402 - RNA, 14 nt, Human
accugaggcccuuc

SEQ ID NO: 2596403 - RNA, 13 nt, Human
accugaggaagcg

SEQ ID NO: 2596404 - RNA, 15 nt, Human
accugagcuccccac

SEQ ID NO: 2596405 - RNA, 12 nt, Human
accugagcugcc

SEQ ID NO: 2596406 - RNA, 18 nt, Human
accugagcugccauccag

SEQ ID NO: 2596407 - RNA, 19 nt, Human
accugagcuagaagcugga

SEQ ID NO: 2596408 - RNA, 20 nt, Human
accugagcuagaagcuggag

SEQ ID NO: 2596409 - RNA, 14 nt, Human
accugagcucccca

SEQ ID NO: 2596410 - RNA, 23 nt, Human
accugagaccaguugggagcacu

SEQ ID NO: 2596411 - RNA, 23 nt, Human
accugacucugaaaucugaagac

SEQ ID NO: 2596412 - RNA, 22 nt, Human
accugacucugaaaucugaaga

SEQ ID NO: 2596413 - RNA, 20 nt, Human
accugaccgugggcggggcc

SEQ ID NO: 2596414 - RNA, 19 nt, Human
accugacguagcugcaaag

SEQ ID NO: 2596415 - RNA, 20 nt, Human
accugacuauugaaguugca

SEQ ID NO: 2596416 - RNA, 19 nt, Human
accugacucugaaaucuga

SEQ ID NO: 2596417 - RNA, 18 nt, Human
accugacucugaaaucug

SEQ ID NO: 2596418 - RNA, 17 nt, Human
accugacucugaaaucu

SEQ ID NO: 2596419 - RNA, 16 nt, Human
accugacucugaaauc

SEQ ID NO: 2596420 - RNA, 15 nt, Human
accugacucugaaau

SEQ ID NO: 2596421 - RNA, 14 nt, Human
accugacucugaaa

SEQ ID NO: 2596422 - RNA, 13 nt, Human
accugacucugaa

SEQ ID NO: 2596423 - RNA, 22 nt, Human
accugacucgucugacugugug

SEQ ID NO: 2596424 - RNA, 16 nt, Human
accugaccccugcuca

SEQ ID NO: 2596425 - RNA, 17 nt, Human
accugaccccugcucag

SEQ ID NO: 2596426 - RNA, 18 nt, Human
accugaccgugggcgggg

SEQ ID NO: 2596427 - RNA, 14 nt, Human
accugaccgugggc

SEQ ID NO: 2596428 - RNA, 23 nt, Human
accugaccccugcucaguaaagc

SEQ ID NO: 2596429 - RNA, 21 nt, Human
accugaaaaaaaguuuacaag

SEQ ID NO: 2596430 - RNA, 21 nt, Human
accugaaaacacugugcacau

SEQ ID NO: 2596431 - RNA, 12 nt, Human
accugaaaagua

SEQ ID NO: 2596432 - RNA, 13 nt, Human
accucuccaaggg

SEQ ID NO: 2596433 - RNA, 11 nt, Human
accucuccaag

SEQ ID NO: 2596434 - RNA, 10 nt, Human
accucuccaa

SEQ ID NO: 2596435 - RNA, 18 nt, Human
accucucaucaguguccu

SEQ ID NO: 2596436 - RNA, 22 nt, Human
accucuccaagggcuucugcac

SEQ ID NO: 2596437 - RNA, 20 nt, Human
accucuccaagggcuucugc

SEQ ID NO: 2596438 - RNA, 19 nt, Human
accucuccaucuucagcuu

SEQ ID NO: 2596439 - RNA, 15 nt, Human
accucuccaucuuca

SEQ ID NO: 2596440 - RNA, 22 nt, Human
accucguccucccccugccagu

SEQ ID NO: 2596441 - RNA, 11 nt, Human
accugaaaaca

SEQ ID NO: 2596442 - RNA, 18 nt, Human
accugaaaacacugugca

SEQ ID NO: 2596443 - RNA, 19 nt, Human
accugaaaacacugugcac

SEQ ID NO: 2596444 - RNA, 20 nt, Human
accugaaaacacugugcaca

SEQ ID NO: 2596445 - RNA, 19 nt, Human
accugaaaaaaaguuuaca

SEQ ID NO: 2596446 - RNA, 18 nt, Human
accugaaaaaaaguuuac

SEQ ID NO: 2596447 - RNA, 15 nt, Human
accugaaaaaaaguu

SEQ ID NO: 2596448 - RNA, 22 nt, Human
accucuuuauuuuuugauugaa

SEQ ID NO: 2596449 - RNA, 19 nt, Human
accucuuuauuuuuugauu

SEQ ID NO: 2596450 - RNA, 20 nt, Human
accucuccaucuucagcuuc

SEQ ID NO: 2596451 - RNA, 17 nt, Human
accucuccccuggaacu

SEQ ID NO: 2596452 - RNA, 23 nt, Human
accucuccaucuucagcuucuuc

SEQ ID NO: 2596453 - RNA, 13 nt, Human
accucucccaggg

SEQ ID NO: 2596454 - RNA, 15 nt, Human
ucauugaccugaggc

SEQ ID NO: 2596455 - RNA, 14 nt, Human
ucauugaccugagg

SEQ ID NO: 2596456 - RNA, 12 nt, Human
ucauugaccuga

SEQ ID NO: 2596457 - RNA, 22 nt, Human
ucauugaaaucuuuuugcuuug

SEQ ID NO: 2596458 - RNA, 17 nt, Human
ucauugccuuaacugga

SEQ ID NO: 2596459 - RNA, 23 nt, Human
ucauugccuuaacuggagcccca

SEQ ID NO: 2596460 - RNA, 20 nt, Human
ucauugccuuaacuggagcc

SEQ ID NO: 2596461 - RNA, 15 nt, Human
ucauugcugagccuc

SEQ ID NO: 2596462 - RNA, 16 nt, Human
ucauugcugagccucu

SEQ ID NO: 2596463 - RNA, 18 nt, Human
ucauugcugaaaauggua

SEQ ID NO: 2596464 - RNA, 17 nt, Human
ucauugcugaaaauggu

SEQ ID NO: 2596465 - RNA, 14 nt, Human
ucauugcugaaaau

SEQ ID NO: 2596466 - RNA, 19 nt, Human
ucauugauaugaaaaauau

SEQ ID NO: 2596467 - RNA, 17 nt, Human
ucauugaagucagaugu

SEQ ID NO: 2596468 - RNA, 14 nt, Human
ucauugaaguauuu

SEQ ID NO: 2596469 - RNA, 18 nt, Human
ucauugcccccagggcac

SEQ ID NO: 2596470 - RNA, 18 nt, Human
ucauugauugucagcuac

SEQ ID NO: 2596471 - RNA, 16 nt, Human
accuccugucucuggc

SEQ ID NO: 2596472 - RNA, 15 nt, Human
accuccugucucugg

SEQ ID NO: 2596473 - RNA, 17 nt, Human
accuccugucucuggcc

SEQ ID NO: 2596474 - RNA, 23 nt, Human
ucauugcugaaaaugguauuuuc

SEQ ID NO: 2596475 - RNA, 23 nt, Human
ucauugcugagccucugcucccc

SEQ ID NO: 2596476 - RNA, 17 nt, Human
ucauugcugagccucug

SEQ ID NO: 2596477 - RNA, 22 nt, Human
ucauugcugagccucugcuccc

SEQ ID NO: 2596478 - RNA, 13 nt, Human
accuccugggcua

SEQ ID NO: 2596479 - RNA, 19 nt, Human
accucggugccuuccucuu

SEQ ID NO: 2596480 - RNA, 12 nt, Human
accuccuucucu

SEQ ID NO: 2596481 - RNA, 21 nt, Human
accuccuuguaacaucaggga

SEQ ID NO: 2596482 - RNA, 23 nt, Human
accuccuucucugucucaugugu

SEQ ID NO: 2596483 - RNA, 14 nt, Human
accucguccucccc

SEQ ID NO: 2596484 - RNA, 15 nt, Human
accucguccuccccc

SEQ ID NO: 2596485 - RNA, 18 nt, Human
accucguccucccccugc

SEQ ID NO: 2596486 - RNA, 20 nt, Human
accucguccucccccugcca

SEQ ID NO: 2596487 - RNA, 21 nt, Human
accucguccucccccugccag

SEQ ID NO: 2596488 - RNA, 18 nt, Human
accucuaaaacaguccuu

SEQ ID NO: 2596489 - RNA, 17 nt, Human
ucauucuucucuagcug

SEQ ID NO: 2596490 - RNA, 13 nt, Human
ucauucuucucua

SEQ ID NO: 2596491 - RNA, 18 nt, Human
ucauucuuauuucaugaa

SEQ ID NO: 2596492 - RNA, 16 nt, Human
ucauucuuagcucuua

SEQ ID NO: 2596493 - RNA, 14 nt, Human
ucauucuuauuuca

SEQ ID NO: 2596494 - RNA, 18 nt, Human
ucauucucugucucaucc

SEQ ID NO: 2596495 - RNA, 19 nt, Human
ucauucucugucucaucca

SEQ ID NO: 2596496 - RNA, 18 nt, Human
ucauucugaaggagcccc

SEQ ID NO: 2596497 - RNA, 20 nt, Human
ucauuacuuuaccaccccca

SEQ ID NO: 2596498 - RNA, 14 nt, Human
ucauucucugucuc

SEQ ID NO: 2596499 - RNA, 15 nt, Human
ucauucucugucuca

SEQ ID NO: 2596500 - RNA, 16 nt, Human
ucauucucugucucau

SEQ ID NO: 2596501 - RNA, 21 nt, Human
ucauuaaugacacuugucccc

SEQ ID NO: 2596502 - RNA, 18 nt, Human
ucauuacuuuaccacccc

SEQ ID NO: 2596503 - RNA, 13 nt, Human
ucauugaaaucuu

SEQ ID NO: 2596504 - RNA, 12 nt, Human
ucauugaaaucu

SEQ ID NO: 2596505 - RNA, 12 nt, Human
ucauucuucugu

SEQ ID NO: 2596506 - RNA, 18 nt, Human
ucauucuugaaagcugug

SEQ ID NO: 2596507 - RNA, 17 nt, Human
ucauucuugaaagcugu

SEQ ID NO: 2596508 - RNA, 13 nt, Human
ucaugauccaacu

SEQ ID NO: 2596509 - RNA, 16 nt, Human
ucaugauccaacuaau

SEQ ID NO: 2596510 - RNA, 21 nt, Human
ucaugaauuaguuuuauaugc

SEQ ID NO: 2596511 - RNA, 16 nt, Human
ucaugaucuugugaca

SEQ ID NO: 2596512 - RNA, 17 nt, Human
ucaugaucuugugacau

SEQ ID NO: 2596513 - RNA, 18 nt, Human
ucaugaucuugugacaua

SEQ ID NO: 2596514 - RNA, 13 nt, Human
ucaugaucucccu

SEQ ID NO: 2596515 - RNA, 14 nt, Human
ucaugaucucccug

SEQ ID NO: 2596516 - RNA, 15 nt, Human
ucaugaucucccugc

SEQ ID NO: 2596517 - RNA, 16 nt, Human
ucaugaucucccugcc

SEQ ID NO: 2596518 - RNA, 17 nt, Human
ucaugaucucccugccg

SEQ ID NO: 2596519 - RNA, 18 nt, Human
ucaugaucucccugccgc

SEQ ID NO: 2596520 - RNA, 19 nt, Human
ucaugaucucccugccgcc

SEQ ID NO: 2596521 - RNA, 22 nt, Human
ucaugaucucccugccgccuca

SEQ ID NO: 2596522 - RNA, 13 nt, Human
ucaugauuagcaa

SEQ ID NO: 2596523 - RNA, 14 nt, Human
ucauuaaugacacu

SEQ ID NO: 2596524 - RNA, 13 nt, Human
ucauuaaugacac

SEQ ID NO: 2596525 - RNA, 23 nt, Human
ucauuaagguauuauuuuuucca

SEQ ID NO: 2596526 - RNA, 14 nt, Human
ucaugauuagcaag

SEQ ID NO: 2596527 - RNA, 15 nt, Human
ucauuaaugacacuu

SEQ ID NO: 2596528 - RNA, 19 nt, Human
ucauuaaugacacuugucc

SEQ ID NO: 2596529 - RNA, 22 nt, Human
ucauuaaugacacuugucccca

SEQ ID NO: 2596530 - RNA, 13 nt, Human
ucauuaauucuau

SEQ ID NO: 2596531 - RNA, 14 nt, Human
ucauuaauucuaua

SEQ ID NO: 2596532 - RNA, 20 nt, Human
ucauuaccuuuuuugauaaa

SEQ ID NO: 2596533 - RNA, 13 nt, Human
ucauuaccacagg

SEQ ID NO: 2596534 - RNA, 21 nt, Human
acgguggucacuggaacucag

SEQ ID NO: 2596535 - RNA, 21 nt, Human
acggugggccuugcuggggac

SEQ ID NO: 2596536 - RNA, 23 nt, Human
acgggcuuguugcuguugauguu

SEQ ID NO: 2596537 - RNA, 16 nt, Human
acgguucaccagccuc

SEQ ID NO: 2596538 - RNA, 19 nt, Human
acgguucaccagccucucu

SEQ ID NO: 2596539 - RNA, 18 nt, Human
acgggcaugggcacuccc

SEQ ID NO: 2596540 - RNA, 16 nt, Human
acgggcaguagcugug

SEQ ID NO: 2596541 - RNA, 14 nt, Human
acgggcugcccugc

SEQ ID NO: 2596542 - RNA, 20 nt, Human
acggugggccuugcugggga

SEQ ID NO: 2596543 - RNA, 15 nt, Human
acgggacugacgcaa

SEQ ID NO: 2596544 - RNA, 18 nt, Human
ucccacccccacccccag

SEQ ID NO: 2596545 - RNA, 16 nt, Human
acgggacugacgcaac

SEQ ID NO: 2596546 - RNA, 20 nt, Human
acgggaggguaaggcugugg

SEQ ID NO: 2596547 - RNA, 22 nt, Human
ucccaccccauuuucugugggc

SEQ ID NO: 2596548 - RNA, 20 nt, Human
ucccaccccauuuucugugg

SEQ ID NO: 2596549 - RNA, 16 nt, Human
ucccaccccacccccu

SEQ ID NO: 2596550 - RNA, 18 nt, Human
ucccaccccacccccuuc

SEQ ID NO: 2596551 - RNA, 20 nt, Human
ucccaccccacccccuucag

SEQ ID NO: 2596552 - RNA, 22 nt, Human
ucccaccccacccccuucagug

SEQ ID NO: 2596553 - RNA, 13 nt, Human
ucccacagcgcug

SEQ ID NO: 2596554 - RNA, 12 nt, Human
ucccaccccacc

SEQ ID NO: 2596555 - RNA, 13 nt, Human
ucccaccccaccc

SEQ ID NO: 2596556 - RNA, 16 nt, Human
ucccacaaaggagagc

SEQ ID NO: 2596557 - RNA, 22 nt, Human
ucccaauagcaacguagcuucu

SEQ ID NO: 2596558 - RNA, 23 nt, Human
ucccaaguuuuaggacaaacagc

SEQ ID NO: 2596559 - RNA, 17 nt, Human
ucccaauaggcagacug

SEQ ID NO: 2596560 - RNA, 15 nt, Human
ucccaagucuacaga

SEQ ID NO: 2596561 - RNA, 14 nt, Human
ucccaagucuacag

SEQ ID NO: 2596562 - RNA, 18 nt, Human
ucccaaguuuuaggacaa

SEQ ID NO: 2596563 - RNA, 18 nt, Human
ucccaaguggugccuaaa

SEQ ID NO: 2596564 - RNA, 16 nt, Human
ucccaaguggugccua

SEQ ID NO: 2596565 - RNA, 12 nt, Human
ucccaaguggug

SEQ ID NO: 2596566 - RNA, 17 nt, Human
ucccaagugccagucuu

SEQ ID NO: 2596567 - RNA, 20 nt, Human
ucccaccccacacacgccag

SEQ ID NO: 2596568 - RNA, 15 nt, Human
ucccaccccacacac

SEQ ID NO: 2596569 - RNA, 14 nt, Human
ucccacaaguggug

SEQ ID NO: 2596570 - RNA, 23 nt, Human
ucccacaauauaaaacuguacuu

SEQ ID NO: 2596571 - RNA, 16 nt, Human
ucccacaagugguggu

SEQ ID NO: 2596572 - RNA, 23 nt, Human
ucccacaaucuuaaggggcagcu

SEQ ID NO: 2596573 - RNA, 22 nt, Human
ucccacaaucuuaaggggcagc

SEQ ID NO: 2596574 - RNA, 13 nt, Human
ucccacacccugg

SEQ ID NO: 2596575 - RNA, 16 nt, Human
ucccacaccuccacag

SEQ ID NO: 2596576 - RNA, 15 nt, Human
ucccacaccuccaca

SEQ ID NO: 2596577 - RNA, 18 nt, Human
ucccacaccguguaaacc

SEQ ID NO: 2596578 - RNA, 18 nt, Human
ucccacaccuccacaguu

SEQ ID NO: 2596579 - RNA, 17 nt, Human
ucccacaccuccacagu

SEQ ID NO: 2596580 - RNA, 18 nt, Human
ucccacacuggugacugc

SEQ ID NO: 2596581 - RNA, 22 nt, Human
ucccacacugcuaggugggcca

SEQ ID NO: 2596582 - RNA, 19 nt, Human
acgugggcaaacaggcagu

SEQ ID NO: 2596583 - RNA, 15 nt, Human
acgugggcggcagag

SEQ ID NO: 2596584 - RNA, 20 nt, Human
acgugggcggcagagaggac

SEQ ID NO: 2596585 - RNA, 20 nt, Human
acguggggcagcacagagag

SEQ ID NO: 2596586 - RNA, 19 nt, Human
acguggggcagcacagaga

SEQ ID NO: 2596587 - RNA, 15 nt, Human
acguggggcagcaca

SEQ ID NO: 2596588 - RNA, 14 nt, Human
acguggggcagcac

SEQ ID NO: 2596589 - RNA, 22 nt, Human
acgugggucuucagggggccag

SEQ ID NO: 2596590 - RNA, 14 nt, Human
acguguagcuauau

SEQ ID NO: 2596591 - RNA, 18 nt, Human
acguguacuacaauuuaa

SEQ ID NO: 2596592 - RNA, 15 nt, Human
acgugugauuuuucu

SEQ ID NO: 2596593 - RNA, 12 nt, Human
acgugugauuuu

SEQ ID NO: 2596594 - RNA, 11 nt, Human
acgugugugac

SEQ ID NO: 2596595 - RNA, 16 nt, Human
acgugugugacucaga

SEQ ID NO: 2596596 - RNA, 16 nt, Human
acguucaccccuccac

SEQ ID NO: 2596597 - RNA, 14 nt, Human
acguucaccccucc

SEQ ID NO: 2596598 - RNA, 21 nt, Human
acguuccuauugucauuaaag

SEQ ID NO: 2596599 - RNA, 16 nt, Human
acguuccuuacugcag

SEQ ID NO: 2596600 - RNA, 18 nt, Human
acguuccuuacugcagaa

SEQ ID NO: 2596601 - RNA, 19 nt, Human
acguuccuuacugcagaau

SEQ ID NO: 2596602 - RNA, 20 nt, Human
acguuccuuacugcagaaua

SEQ ID NO: 2596603 - RNA, 14 nt, Human
acguucggggcaug

SEQ ID NO: 2596604 - RNA, 14 nt, Human
acguuccagccggc

SEQ ID NO: 2596605 - RNA, 12 nt, Human
acguuccagccg

SEQ ID NO: 2596606 - RNA, 11 nt, Human
acguuccagcc

SEQ ID NO: 2596607 - RNA, 20 nt, Human
acguuccuauugucauuaaa

SEQ ID NO: 2596608 - RNA, 18 nt, Human
acguuccuauugucauua

SEQ ID NO: 2596609 - RNA, 16 nt, Human
acguuccuauugucau

SEQ ID NO: 2596610 - RNA, 22 nt, Human
acguauaaaagccuguuuaaga

SEQ ID NO: 2596611 - RNA, 16 nt, Human
acguacuuagcagcua

SEQ ID NO: 2596612 - RNA, 17 nt, Human
acgguuugaagccugga

SEQ ID NO: 2596613 - RNA, 20 nt, Human
acguacguaucagcggcccc

SEQ ID NO: 2596614 - RNA, 15 nt, Human
acgguuuuacugcag

SEQ ID NO: 2596615 - RNA, 17 nt, Human
acgguuuuacugcagcu

SEQ ID NO: 2596616 - RNA, 23 nt, Human
acguggcugcuucaaggauccug

SEQ ID NO: 2596617 - RNA, 16 nt, Human
acgugggcaaacaggc

SEQ ID NO: 2596618 - RNA, 16 nt, Human
acgugggagacaagaa

SEQ ID NO: 2596619 - RNA, 11 nt, Human
acgugggagac

SEQ ID NO: 2596620 - RNA, 18 nt, Human
acguggcuuuuagacaga

SEQ ID NO: 2596621 - RNA, 14 nt, Human
acguaugcauguga

SEQ ID NO: 2596622 - RNA, 13 nt, Human
acguaugcaugug

SEQ ID NO: 2596623 - RNA, 24 nt, Human
acguagcuucuaccaugaacagaa

SEQ ID NO: 2596624 - RNA, 16 nt, Human
acguagcugcaaagga

SEQ ID NO: 2596625 - RNA, 20 nt, Human
acguagcugcaaaggacaga

SEQ ID NO: 2596626 - RNA, 17 nt, Human
acguagcugaggccgga

SEQ ID NO: 2596627 - RNA, 18 nt, Human
acguacuuagcagcuauc

SEQ ID NO: 2596628 - RNA, 16 nt, Human
acguauugguccagcu

SEQ ID NO: 2596629 - RNA, 20 nt, Human
acguauguuuuuguguauuu

SEQ ID NO: 2596630 - RNA, 16 nt, Human
ucccaaagcagugcau

SEQ ID NO: 2596631 - RNA, 15 nt, Human
ucccaaacgccuccc

SEQ ID NO: 2596632 - RNA, 21 nt, Human
ucccaaacgccuccccugccc

SEQ ID NO: 2596633 - RNA, 18 nt, Human
ucccaaacccuucagugc

SEQ ID NO: 2596634 - RNA, 22 nt, Human
ucccaaaauuguuuugagcuuu

SEQ ID NO: 2596635 - RNA, 15 nt, Human
ucccaaaauuguuuu

SEQ ID NO: 2596636 - RNA, 14 nt, Human
ucccaaaauuguuu

SEQ ID NO: 2596637 - RNA, 14 nt, Human
uccauuuaguucuu

SEQ ID NO: 2596638 - RNA, 20 nt, Human
uccauuuaguucuuuguuau

SEQ ID NO: 2596639 - RNA, 20 nt, Human
uccauuucgccccucauuua

SEQ ID NO: 2596640 - RNA, 21 nt, Human
uccauuucaucuauuucugag

SEQ ID NO: 2596641 - RNA, 23 nt, Human
uccauuucaucuauuucugagaa

SEQ ID NO: 2596642 - RNA, 20 nt, Human
ucccaaaagcccauucauuc

SEQ ID NO: 2596643 - RNA, 23 nt, Human
uccauuuuuucaagguaauuucu

SEQ ID NO: 2596644 - RNA, 17 nt, Human
uccauuucucauguuuu

SEQ ID NO: 2596645 - RNA, 14 nt, Human
uccauuucucaugu

SEQ ID NO: 2596646 - RNA, 14 nt, Human
uccauuugaaagaa

SEQ ID NO: 2596647 - RNA, 18 nt, Human
ucccaaagcagugcaugc

SEQ ID NO: 2596648 - RNA, 17 nt, Human
ucccaaagcagugcaug

SEQ ID NO: 2596649 - RNA, 22 nt, Human
ucccaaagccuugugucuacag

SEQ ID NO: 2596650 - RNA, 19 nt, Human
ucccaaagccagaaccaga

SEQ ID NO: 2596651 - RNA, 22 nt, Human
ucccaaaggacuccacccaucc

SEQ ID NO: 2596652 - RNA, 16 nt, Human
ucccaaaggacuccac

SEQ ID NO: 2596653 - RNA, 21 nt, Human
ucccaaagcagugcaugcugu

SEQ ID NO: 2596654 - RNA, 20 nt, Human
ucccaaguagcugggauuac

SEQ ID NO: 2596655 - RNA, 21 nt, Human
ucccaaguagcugggauuaca

SEQ ID NO: 2596656 - RNA, 14 nt, Human
ucccaaagugcugg

SEQ ID NO: 2596657 - RNA, 13 nt, Human
ucccaaagugcug

SEQ ID NO: 2596658 - RNA, 20 nt, Human
uccauccugaggcuccacuu

SEQ ID NO: 2596659 - RNA, 21 nt, Human
uccauccugaggcuccacuug

SEQ ID NO: 2596660 - RNA, 23 nt, Human
acgccagauucuuuccugaggcu

SEQ ID NO: 2596661 - RNA, 22 nt, Human
acgccagauucuuuccugaggc

SEQ ID NO: 2596662 - RNA, 16 nt, Human
uccaucuaaacugccc

SEQ ID NO: 2596663 - RNA, 20 nt, Human
uccauccuugagucaaaaaa

SEQ ID NO: 2596664 - RNA, 17 nt, Human
uccauccuuucugccuc

SEQ ID NO: 2596665 - RNA, 19 nt, Human
uccauccugaggcuccacu

SEQ ID NO: 2596666 - RNA, 20 nt, Human
uccaucuccaagaaugcuga

SEQ ID NO: 2596667 - RNA, 18 nt, Human
uccaucuccaagaaugcu

SEQ ID NO: 2596668 - RNA, 16 nt, Human
uccaucuccaagaaug

SEQ ID NO: 2596669 - RNA, 21 nt, Human
uccaucuaaauaccugcccug

SEQ ID NO: 2596670 - RNA, 18 nt, Human
uccaucuaaacugccccc

SEQ ID NO: 2596671 - RNA, 21 nt, Human
uccaucuccaagaaugcugaa

SEQ ID NO: 2596672 - RNA, 14 nt, Human
uccaucucgccacc

SEQ ID NO: 2596673 - RNA, 23 nt, Human
uccaucucgccaccccuccuucc

SEQ ID NO: 2596674 - RNA, 16 nt, Human
uccaucucucuggccc

SEQ ID NO: 2596675 - RNA, 16 nt, Human
uccaucucgccacccc

SEQ ID NO: 2596676 - RNA, 18 nt, Human
uccauugacauguacaga

SEQ ID NO: 2596677 - RNA, 17 nt, Human
uccauugacauguacag

SEQ ID NO: 2596678 - RNA, 16 nt, Human
uccauugacauguaca

SEQ ID NO: 2596679 - RNA, 15 nt, Human
uccauugacauguac

SEQ ID NO: 2596680 - RNA, 14 nt, Human
uccauugacaugua

SEQ ID NO: 2596681 - RNA, 19 nt, Human
uccauucuuucugauaacu

SEQ ID NO: 2596682 - RNA, 13 nt, Human
uccauucuggaag

SEQ ID NO: 2596683 - RNA, 14 nt, Human
uccauucuggaagu

SEQ ID NO: 2596684 - RNA, 12 nt, Human
uccauucuuucu

SEQ ID NO: 2596685 - RNA, 14 nt, Human
uccauucuuucuga

SEQ ID NO: 2596686 - RNA, 18 nt, Human
uccauucuuucugauaac

SEQ ID NO: 2596687 - RNA, 16 nt, Human
uccauucucccaggua

SEQ ID NO: 2596688 - RNA, 12 nt, Human
uccauucuggaa

SEQ ID NO: 2596689 - RNA, 15 nt, Human
uccauucucccaggu

SEQ ID NO: 2596690 - RNA, 14 nt, Human
uccauucucccagg

SEQ ID NO: 2596691 - RNA, 21 nt, Human
uccaugaagauguagaggaga

SEQ ID NO: 2596692 - RNA, 21 nt, Human
uccaugaagaccacauccaca

SEQ ID NO: 2596693 - RNA, 20 nt, Human
uccaugaagaccacauccac

SEQ ID NO: 2596694 - RNA, 12 nt, Human
uccauuccucag

SEQ ID NO: 2596695 - RNA, 23 nt, Human
uccaugaagaccacauccacaca

SEQ ID NO: 2596696 - RNA, 13 nt, Human
uccauuccucagg

SEQ ID NO: 2596697 - RNA, 14 nt, Human
uccauuccucaggg

SEQ ID NO: 2596698 - RNA, 15 nt, Human
uccauuccucaggga

SEQ ID NO: 2596699 - RNA, 13 nt, Human
uccaugaagaugu

SEQ ID NO: 2596700 - RNA, 15 nt, Human
uccaugaaaaugcaa

SEQ ID NO: 2596701 - RNA, 17 nt, Human
uccaucucucuggcccu

SEQ ID NO: 2596702 - RNA, 16 nt, Human
uccaugaaaaugcaac

SEQ ID NO: 2596703 - RNA, 23 nt, Human
acuacccacguucucacacccac

SEQ ID NO: 2596704 - RNA, 21 nt, Human
acuacccacguucucacaccc

SEQ ID NO: 2596705 - RNA, 18 nt, Human
acuacccuauucucucuu

SEQ ID NO: 2596706 - RNA, 15 nt, Human
acuaccuccucaggg

SEQ ID NO: 2596707 - RNA, 14 nt, Human
acuaccuccucagg

SEQ ID NO: 2596708 - RNA, 15 nt, Human
acuacauucuguuaa

SEQ ID NO: 2596709 - RNA, 21 nt, Human
acuaccaagaggcccugucug

SEQ ID NO: 2596710 - RNA, 21 nt, Human
ucccccaacccccaccccaca

SEQ ID NO: 2596711 - RNA, 19 nt, Human
uccccauuucccaucugca

SEQ ID NO: 2596712 - RNA, 18 nt, Human
uccccauuucccaucugc

SEQ ID NO: 2596713 - RNA, 17 nt, Human
uccccauuucccaucug

SEQ ID NO: 2596714 - RNA, 16 nt, Human
uccccauuucccaucu

SEQ ID NO: 2596715 - RNA, 15 nt, Human
uccccauuucccauc

SEQ ID NO: 2596716 - RNA, 18 nt, Human
uccccauugccuccuccu

SEQ ID NO: 2596717 - RNA, 19 nt, Human
uccccauuuagguuucuga

SEQ ID NO: 2596718 - RNA, 17 nt, Human
uccccauucuuccuagu

SEQ ID NO: 2596719 - RNA, 22 nt, Human
uccccauucuuccuaguuuucu

SEQ ID NO: 2596720 - RNA, 14 nt, Human
uccccauucuuccu

SEQ ID NO: 2596721 - RNA, 24 nt, Human
uccccauuagcuuucaauuccgua

SEQ ID NO: 2596722 - RNA, 15 nt, Human
ucccccaaccccagc

SEQ ID NO: 2596723 - RNA, 12 nt, Human
ucccccaacaga

SEQ ID NO: 2596724 - RNA, 20 nt, Human
uccccauuucccaucugcac

SEQ ID NO: 2596725 - RNA, 14 nt, Human
ucccccaaccccca

SEQ ID NO: 2596726 - RNA, 15 nt, Human
ucccccaacccccac

SEQ ID NO: 2596727 - RNA, 16 nt, Human
ucccccaacccccacc

SEQ ID NO: 2596728 - RNA, 17 nt, Human
ucccccaacccccaccc

SEQ ID NO: 2596729 - RNA, 19 nt, Human
ucccccaacccccacccca

SEQ ID NO: 2596730 - RNA, 20 nt, Human
ucccccaacccccaccccac

SEQ ID NO: 2596731 - RNA, 21 nt, Human
uccccaccgcagacaggacca

SEQ ID NO: 2596732 - RNA, 18 nt, Human
uccccaccgcagacagga

SEQ ID NO: 2596733 - RNA, 17 nt, Human
uccccaccgcagacagg

SEQ ID NO: 2596734 - RNA, 22 nt, Human
uccccaccccugcccccagccc

SEQ ID NO: 2596735 - RNA, 18 nt, Human
uccccaccccugccccca

SEQ ID NO: 2596736 - RNA, 16 nt, Human
uccccaccccugcccc

SEQ ID NO: 2596737 - RNA, 15 nt, Human
uccccaccccugccc

SEQ ID NO: 2596738 - RNA, 16 nt, Human
uccccaugcagacaug

SEQ ID NO: 2596739 - RNA, 14 nt, Human
uccccaucuucuaa

SEQ ID NO: 2596740 - RNA, 13 nt, Human
uccccauggagcc

SEQ ID NO: 2596741 - RNA, 19 nt, Human
uccccaucuucuaaaccca

SEQ ID NO: 2596742 - RNA, 22 nt, Human
uccccaccgcagacaggaccag

SEQ ID NO: 2596743 - RNA, 17 nt, Human
uccccaugucucgacuc

SEQ ID NO: 2596744 - RNA, 19 nt, Human
uccccauuagagucagccu

SEQ ID NO: 2596745 - RNA, 21 nt, Human
uccccauuagagucagccuuc

SEQ ID NO: 2596746 - RNA, 15 nt, Human
uccccauggagccag

SEQ ID NO: 2596747 - RNA, 16 nt, Human
uccccauggagccagc

SEQ ID NO: 2596748 - RNA, 11 nt, Human
uccccauggga

SEQ ID NO: 2596749 - RNA, 23 nt, Human
uccccaugggaagacgaggcccu

SEQ ID NO: 2596750 - RNA, 14 nt, Human
ucccagucauuuaa

SEQ ID NO: 2596751 - RNA, 22 nt, Human
ucccagucauuuaauaaaugug

SEQ ID NO: 2596752 - RNA, 17 nt, Human
ucccaguaccuccuguc

SEQ ID NO: 2596753 - RNA, 23 nt, Human
ucccaguaccuccugucucuggc

SEQ ID NO: 2596754 - RNA, 18 nt, Human
ucccagcugccauguuuc

SEQ ID NO: 2596755 - RNA, 24 nt, Human
ucccagcugacaguccucuccacc

SEQ ID NO: 2596756 - RNA, 15 nt, Human
ucccaucacccgcua

SEQ ID NO: 2596757 - RNA, 16 nt, Human
ucccauaugccugggc

SEQ ID NO: 2596758 - RNA, 14 nt, Human
ucccaucaaaacuc

SEQ ID NO: 2596759 - RNA, 22 nt, Human
ucccauaugccugggcagaagg

SEQ ID NO: 2596760 - RNA, 18 nt, Human
ucccagucuacccagaga

SEQ ID NO: 2596761 - RNA, 17 nt, Human
ucccagucuacccagag

SEQ ID NO: 2596762 - RNA, 15 nt, Human
ucccagucuacccag

SEQ ID NO: 2596763 - RNA, 22 nt, Human
ucccagucaccuuguggcaagc

SEQ ID NO: 2596764 - RNA, 20 nt, Human
ucccaguccaaauguccucc

SEQ ID NO: 2596765 - RNA, 18 nt, Human
ucccauccagugucucac

SEQ ID NO: 2596766 - RNA, 15 nt, Human
ucccauccaggcagu

SEQ ID NO: 2596767 - RNA, 14 nt, Human
ucccauccagggcc

SEQ ID NO: 2596768 - RNA, 14 nt, Human
ucccauccaggcag

SEQ ID NO: 2596769 - RNA, 13 nt, Human
ucccauccaggca

SEQ ID NO: 2596770 - RNA, 13 nt, Human
ucccauccagggc

SEQ ID NO: 2596771 - RNA, 22 nt, Human
ucccaucacuggagcaccaggc

SEQ ID NO: 2596772 - RNA, 12 nt, Human
ucccauccaggc

SEQ ID NO: 2596773 - RNA, 14 nt, Human
ucccaucacuggag

SEQ ID NO: 2596774 - RNA, 15 nt, Human
ucccaucccccugcc

SEQ ID NO: 2596775 - RNA, 14 nt, Human
ucccaucccccugc

SEQ ID NO: 2596776 - RNA, 13 nt, Human
ucccaucccccug

SEQ ID NO: 2596777 - RNA, 22 nt, Human
ucccaucccagcugaaauacug

SEQ ID NO: 2596778 - RNA, 18 nt, Human
ucccaucccacugcuccc

SEQ ID NO: 2596779 - RNA, 16 nt, Human
ucccaucccagcugaa

SEQ ID NO: 2596780 - RNA, 19 nt, Human
ucccaucccccugcccucg

SEQ ID NO: 2596781 - RNA, 18 nt, Human
ucccaucccccugcccuc

SEQ ID NO: 2596782 - RNA, 17 nt, Human
ucccaucccccugcccu

SEQ ID NO: 2596783 - RNA, 16 nt, Human
ucccaucccccugccc

SEQ ID NO: 2596784 - RNA, 15 nt, Human
ucccauccccuggac

SEQ ID NO: 2596785 - RNA, 13 nt, Human
ucccauccccugg

SEQ ID NO: 2596786 - RNA, 14 nt, Human
uccccaccccugcc

SEQ ID NO: 2596787 - RNA, 13 nt, Human
uccccaccccugc

SEQ ID NO: 2596788 - RNA, 18 nt, Human
uccccacaggagcccugc

SEQ ID NO: 2596789 - RNA, 15 nt, Human
uccccaccaccccag

SEQ ID NO: 2596790 - RNA, 14 nt, Human
ucccauccuacccu

SEQ ID NO: 2596791 - RNA, 20 nt, Human
ucccauccuacccucgggcc

SEQ ID NO: 2596792 - RNA, 18 nt, Human
ucccauccuacccucggg

SEQ ID NO: 2596793 - RNA, 21 nt, Human
ucccagcagcccuaaggaucu

SEQ ID NO: 2596794 - RNA, 18 nt, Human
ucccagcagcccuaagga

SEQ ID NO: 2596795 - RNA, 13 nt, Human
ucccagcagcccu

SEQ ID NO: 2596796 - RNA, 20 nt, Human
ucccagcaugcugagauuac

SEQ ID NO: 2596797 - RNA, 18 nt, Human
ucccagcagggccacucc

SEQ ID NO: 2596798 - RNA, 12 nt, Human
ucccagccaccc

SEQ ID NO: 2596799 - RNA, 13 nt, Human
ucccagccacccc

SEQ ID NO: 2596800 - RNA, 14 nt, Human
ucccagccaccccg

SEQ ID NO: 2596801 - RNA, 20 nt, Human
ucccagccaccccgggcucu

SEQ ID NO: 2596802 - RNA, 20 nt, Human
ucccagccacucgggaggcu

SEQ ID NO: 2596803 - RNA, 16 nt, Human
ucccagccacucggga

SEQ ID NO: 2596804 - RNA, 24 nt, Human
ucccagccaccccgggcucucugc

SEQ ID NO: 2596805 - RNA, 17 nt, Human
ucccagcugugcucugg

SEQ ID NO: 2596806 - RNA, 22 nt, Human
ucccagcugacaguccucucca

SEQ ID NO: 2596807 - RNA, 20 nt, Human
ucccagcugacaguccucuc

SEQ ID NO: 2596808 - RNA, 18 nt, Human
ucccagcugacaguccuc

SEQ ID NO: 2596809 - RNA, 17 nt, Human
ucccagcugacaguccu

SEQ ID NO: 2596810 - RNA, 22 nt, Human
ucccagcucucccucuggcccu

SEQ ID NO: 2596811 - RNA, 23 nt, Human
ucccagcucucccucuggcccug

SEQ ID NO: 2596812 - RNA, 16 nt, Human
ucccagcugacagucc

SEQ ID NO: 2596813 - RNA, 17 nt, Human
ucccagcugaaauacug

SEQ ID NO: 2596814 - RNA, 22 nt, Human
ucccagccacucgggaggcuga

SEQ ID NO: 2596815 - RNA, 12 nt, Human
ucccagccccaa

SEQ ID NO: 2596816 - RNA, 15 nt, Human
ucccagcccaaagcu

SEQ ID NO: 2596817 - RNA, 14 nt, Human
ucccagcucucccu

SEQ ID NO: 2596818 - RNA, 16 nt, Human
ucccagcucucccucu

SEQ ID NO: 2596819 - RNA, 18 nt, Human
ucccagcucucccucugg

SEQ ID NO: 2596820 - RNA, 19 nt, Human
ucccagcucucccucuggc

SEQ ID NO: 2596821 - RNA, 21 nt, Human
ucccagcucucccucuggccc

SEQ ID NO: 2596822 - RNA, 15 nt, Human
acuacaguuuguuag

SEQ ID NO: 2596823 - RNA, 11 nt, Human
acuacauucug

SEQ ID NO: 2596824 - RNA, 12 nt, Human
acuacauucugu

SEQ ID NO: 2596825 - RNA, 13 nt, Human
acuacauucuguu

SEQ ID NO: 2596826 - RNA, 23 nt, Human
ucccagauuggcucacacugaga

SEQ ID NO: 2596827 - RNA, 22 nt, Human
ucccagauuggcucacacugag

SEQ ID NO: 2596828 - RNA, 14 nt, Human
acuacauucuguua

SEQ ID NO: 2596829 - RNA, 19 nt, Human
ucccagcacuuugggaggc

SEQ ID NO: 2596830 - RNA, 21 nt, Human
ucccagcacuuugggaggcca

SEQ ID NO: 2596831 - RNA, 22 nt, Human
ucccagcacuuugggaggccua

SEQ ID NO: 2596832 - RNA, 23 nt, Human
ucccagcacuuugggaggccaag

SEQ ID NO: 2596833 - RNA, 21 nt, Human
ucccagcacuuugggaggccu

SEQ ID NO: 2596834 - RNA, 18 nt, Human
ucccagcacuuugggagg

SEQ ID NO: 2596835 - RNA, 16 nt, Human
ucccagcacuuuggga

SEQ ID NO: 2596836 - RNA, 13 nt, Human
ucccagcacuuug

SEQ ID NO: 2596837 - RNA, 23 nt, Human
ucccagcacaugaaaccuuauuu

SEQ ID NO: 2596838 - RNA, 23 nt, Human
acuacaaagcuucuaucccagga

SEQ ID NO: 2596839 - RNA, 22 nt, Human
acuacaaacaaaauuucuauua

SEQ ID NO: 2596840 - RNA, 11 nt, Human
acuacaaauca

SEQ ID NO: 2596841 - RNA, 13 nt, Human
acuacaaaucaag

SEQ ID NO: 2596842 - RNA, 19 nt, Human
acuacaaaucaaguauuug

SEQ ID NO: 2596843 - RNA, 20 nt, Human
acuacaaacaaaauuucuau

SEQ ID NO: 2596844 - RNA, 21 nt, Human
acuacaaacaaaauuucuauu

SEQ ID NO: 2596845 - RNA, 12 nt, Human
acuaaccacgcu

SEQ ID NO: 2596846 - RNA, 17 nt, Human
acuaacauauaauguug

SEQ ID NO: 2596847 - RNA, 15 nt, Human
acuaacauauaaugu

SEQ ID NO: 2596848 - RNA, 17 nt, Human
acuaacaggauauuuaa

SEQ ID NO: 2596849 - RNA, 17 nt, Human
acuaacagauaagcaag

SEQ ID NO: 2596850 - RNA, 15 nt, Human
acguugcugugggaa

SEQ ID NO: 2596851 - RNA, 14 nt, Human
acguugcuguggga

SEQ ID NO: 2596852 - RNA, 12 nt, Human
acguugcugugg

SEQ ID NO: 2596853 - RNA, 11 nt, Human
acguugcugug

SEQ ID NO: 2596854 - RNA, 17 nt, Human
acguucucacacccacc

SEQ ID NO: 2596855 - RNA, 13 nt, Human
acguugcucccca

SEQ ID NO: 2596856 - RNA, 16 nt, Human
acguugagccccugga

SEQ ID NO: 2596857 - RNA, 15 nt, Human
acguucucacaccca

SEQ ID NO: 2596858 - RNA, 21 nt, Human
acguuccuuacugcagaauag

SEQ ID NO: 2596859 - RNA, 13 nt, Human
acuacaguuuguu

SEQ ID NO: 2596860 - RNA, 14 nt, Human
acuacaguuuguua

SEQ ID NO: 2596861 - RNA, 17 nt, Human
acuacaguccucccauc

SEQ ID NO: 2596862 - RNA, 15 nt, Human
acuacaggcacccac

SEQ ID NO: 2596863 - RNA, 20 nt, Human
acuacacagucugcaagauu

SEQ ID NO: 2596864 - RNA, 11 nt, Human
acuacaggcac

SEQ ID NO: 2596865 - RNA, 19 nt, Human
acuacaaccaagcucucug

SEQ ID NO: 2596866 - RNA, 17 nt, Human
acuacaauuuaaagcaa

SEQ ID NO: 2596867 - RNA, 22 nt, Human
acuacaauuuaaagcaaaggag

SEQ ID NO: 2596868 - RNA, 16 nt, Human
ucccugaaggccccgc

SEQ ID NO: 2596869 - RNA, 22 nt, Human
ucccugacucauucugaaggag

SEQ ID NO: 2596870 - RNA, 22 nt, Human
ucccucccggcaugggaaagcc

SEQ ID NO: 2596871 - RNA, 16 nt, Human
ucccugacucucugug

SEQ ID NO: 2596872 - RNA, 11 nt, Human
ucccugagcag

SEQ ID NO: 2596873 - RNA, 14 nt, Human
ucccugacugggag

SEQ ID NO: 2596874 - RNA, 20 nt, Human
ucccugacucucugugaccu

SEQ ID NO: 2596875 - RNA, 17 nt, Human
ucccugacucucuguga

SEQ ID NO: 2596876 - RNA, 18 nt, Human
ucccugacucucugugac

SEQ ID NO: 2596877 - RNA, 11 nt, Human
ucccugaggca

SEQ ID NO: 2596878 - RNA, 15 nt, Human
ucccugacugggagu

SEQ ID NO: 2596879 - RNA, 20 nt, Human
ucccugaggcagguccccag

SEQ ID NO: 2596880 - RNA, 21 nt, Human
ucccugaggcagguccccaga

SEQ ID NO: 2596881 - RNA, 22 nt, Human
ucccugaggcagguccccagac

SEQ ID NO: 2596882 - RNA, 14 nt, Human
ucccugagucacca

SEQ ID NO: 2596883 - RNA, 15 nt, Human
ucccugagucaccag

SEQ ID NO: 2596884 - RNA, 16 nt, Human
ucccugagucaccagg

SEQ ID NO: 2596885 - RNA, 16 nt, Human
ucccugcaaccaacua

SEQ ID NO: 2596886 - RNA, 15 nt, Human
ucccugcaaccaacu

SEQ ID NO: 2596887 - RNA, 21 nt, Human
ucccugauaacaaccuggaga

SEQ ID NO: 2596888 - RNA, 19 nt, Human
ucccugauaacaaccugga

SEQ ID NO: 2596889 - RNA, 17 nt, Human
ucccugagucaccagga

SEQ ID NO: 2596890 - RNA, 21 nt, Human
ucccugagucaccaggaaugu

SEQ ID NO: 2596891 - RNA, 13 nt, Human
acucaccugcugg

SEQ ID NO: 2596892 - RNA, 16 nt, Human
acucaccugcuggccc

SEQ ID NO: 2596893 - RNA, 17 nt, Human
acucaccugcuggcccc

SEQ ID NO: 2596894 - RNA, 18 nt, Human
acucaccugcuggccccu

SEQ ID NO: 2596895 - RNA, 19 nt, Human
acucaccugcuggccccuc

SEQ ID NO: 2596896 - RNA, 12 nt, Human
acucaccugggg

SEQ ID NO: 2596897 - RNA, 20 nt, Human
acucaccugcuggccccuca

SEQ ID NO: 2596898 - RNA, 20 nt, Human
acucaccuggggcugcuggc

SEQ ID NO: 2596899 - RNA, 19 nt, Human
acucaccuggggcugcugg

SEQ ID NO: 2596900 - RNA, 18 nt, Human
acucaccuggggcugcug

SEQ ID NO: 2596901 - RNA, 14 nt, Human
acucaccuggggcu

SEQ ID NO: 2596902 - RNA, 15 nt, Human
acucaccuguuacuu

SEQ ID NO: 2596903 - RNA, 23 nt, Human
acucaccuggggcugcuggccug

SEQ ID NO: 2596904 - RNA, 23 nt, Human
acucacgauaaauaaucggccca

SEQ ID NO: 2596905 - RNA, 21 nt, Human
acucacuccugagaccccugg

SEQ ID NO: 2596906 - RNA, 20 nt, Human
acucacuccugagaccccug

SEQ ID NO: 2596907 - RNA, 22 nt, Human
acucacuccugagaccccuggc

SEQ ID NO: 2596908 - RNA, 22 nt, Human
acucacugcucaagaagacaug

SEQ ID NO: 2596909 - RNA, 15 nt, Human
acucacugcucaaga

SEQ ID NO: 2596910 - RNA, 22 nt, Human
acucacuggggccuacagcuuu

SEQ ID NO: 2596911 - RNA, 17 nt, Human
acucacuaggcccccac

SEQ ID NO: 2596912 - RNA, 15 nt, Human
acucacuaggccccc

SEQ ID NO: 2596913 - RNA, 14 nt, Human
acucacuaggcccc

SEQ ID NO: 2596914 - RNA, 22 nt, Human
acucacuaggcccccacuugcc

SEQ ID NO: 2596915 - RNA, 21 nt, Human
acucacuaggcccccacuugc

SEQ ID NO: 2596916 - RNA, 16 nt, Human
acucacuccugagacc

SEQ ID NO: 2596917 - RNA, 14 nt, Human
acucacuccugaga

SEQ ID NO: 2596918 - RNA, 13 nt, Human
acucacuccugag

SEQ ID NO: 2596919 - RNA, 15 nt, Human
ucccugaaggccccg

SEQ ID NO: 2596920 - RNA, 11 nt, Human
ucccugaaggc

SEQ ID NO: 2596921 - RNA, 20 nt, Human
ucccucccggcaugggaaag

SEQ ID NO: 2596922 - RNA, 20 nt, Human
ucccugaaggaaccaaagcg

SEQ ID NO: 2596923 - RNA, 21 nt, Human
ucccucuuucccucccuuccu

SEQ ID NO: 2596924 - RNA, 18 nt, Human
ucccucuuucccucccuu

SEQ ID NO: 2596925 - RNA, 20 nt, Human
ucccucuuucccucccuucc

SEQ ID NO: 2596926 - RNA, 14 nt, Human
ucccucuuucccuc

SEQ ID NO: 2596927 - RNA, 13 nt, Human
ucccggcugcccu

SEQ ID NO: 2596928 - RNA, 14 nt, Human
ucccggcugcccuu

SEQ ID NO: 2596929 - RNA, 15 nt, Human
ucccggcugcccuuu

SEQ ID NO: 2596930 - RNA, 18 nt, Human
ucccggcugcccuuucug

SEQ ID NO: 2596931 - RNA, 22 nt, Human
ucccggcugcccuuucugggca

SEQ ID NO: 2596932 - RNA, 21 nt, Human
ucccucccaccucugugaccu

SEQ ID NO: 2596933 - RNA, 19 nt, Human
ucccucccaccucugugac

SEQ ID NO: 2596934 - RNA, 16 nt, Human
ucccucccaccucugu

SEQ ID NO: 2596935 - RNA, 15 nt, Human
ucccucccaccucug

SEQ ID NO: 2596936 - RNA, 14 nt, Human
ucccucccaccucu

SEQ ID NO: 2596937 - RNA, 13 nt, Human
ucccucccaccuc

SEQ ID NO: 2596938 - RNA, 23 nt, Human
ucccuccacuccuuccugccacc

SEQ ID NO: 2596939 - RNA, 20 nt, Human
ucccuccacguucaccccuc

SEQ ID NO: 2596940 - RNA, 19 nt, Human
ucccuccacguucaccccu

SEQ ID NO: 2596941 - RNA, 18 nt, Human
ucccuccacguucacccc

SEQ ID NO: 2596942 - RNA, 11 nt, Human
uccccucccau

SEQ ID NO: 2596943 - RNA, 14 nt, Human
uccccucacagccu

SEQ ID NO: 2596944 - RNA, 21 nt, Human
uccccucaaagucugcaacuu

SEQ ID NO: 2596945 - RNA, 18 nt, Human
uccccucaaagucugcaa

SEQ ID NO: 2596946 - RNA, 17 nt, Human
uccccucaaagucugca

SEQ ID NO: 2596947 - RNA, 13 nt, Human
uccccucacagcc

SEQ ID NO: 2596948 - RNA, 14 nt, Human
uccccuccccugcu

SEQ ID NO: 2596949 - RNA, 13 nt, Human
uccccuccccugc

SEQ ID NO: 2596950 - RNA, 18 nt, Human
uccccuccccggcccuac

SEQ ID NO: 2596951 - RNA, 17 nt, Human
uccccucccaucuggga

SEQ ID NO: 2596952 - RNA, 15 nt, Human
uccccucccaucugg

SEQ ID NO: 2596953 - RNA, 14 nt, Human
uccccucccaucug

SEQ ID NO: 2596954 - RNA, 16 nt, Human
uccccuccccugcugc

SEQ ID NO: 2596955 - RNA, 15 nt, Human
uccccuccccugcug

SEQ ID NO: 2596956 - RNA, 17 nt, Human
uccccuccccugcugca

SEQ ID NO: 2596957 - RNA, 14 nt, Human
uccccucccuccuc

SEQ ID NO: 2596958 - RNA, 12 nt, Human
uccccucccugg

SEQ ID NO: 2596959 - RNA, 16 nt, Human
uccccucccuccucug

SEQ ID NO: 2596960 - RNA, 13 nt, Human
uccccucccuggc

SEQ ID NO: 2596961 - RNA, 14 nt, Human
uccccucaaagucu

SEQ ID NO: 2596962 - RNA, 19 nt, Human
uccccuauggggauggucc

SEQ ID NO: 2596963 - RNA, 18 nt, Human
uccccuauccacccagcc

SEQ ID NO: 2596964 - RNA, 20 nt, Human
uccccuauccacccagccca

SEQ ID NO: 2596965 - RNA, 21 nt, Human
uccccuauccacccagcccau

SEQ ID NO: 2596966 - RNA, 21 nt, Human
uccccuaguaagugccuucca

SEQ ID NO: 2596967 - RNA, 20 nt, Human
uccccuaguaagugccuucc

SEQ ID NO: 2596968 - RNA, 18 nt, Human
uccccuaguaagugccuu

SEQ ID NO: 2596969 - RNA, 22 nt, Human
uccccuaguaagugccuuccau

SEQ ID NO: 2596970 - RNA, 15 nt, Human
uccccuauccaccca

SEQ ID NO: 2596971 - RNA, 16 nt, Human
uccccuauccacccag

SEQ ID NO: 2596972 - RNA, 17 nt, Human
uccccuauccacccagc

SEQ ID NO: 2596973 - RNA, 21 nt, Human
acucacccaugugccaaggug

SEQ ID NO: 2596974 - RNA, 18 nt, Human
acucacccaugugccaag

SEQ ID NO: 2596975 - RNA, 20 nt, Human
uccccuaagcagaccacuga

SEQ ID NO: 2596976 - RNA, 14 nt, Human
acucaccaucugug

SEQ ID NO: 2596977 - RNA, 15 nt, Human
acucaccauguaaaa

SEQ ID NO: 2596978 - RNA, 17 nt, Human
acucacccaugugccaa

SEQ ID NO: 2596979 - RNA, 12 nt, Human
acucacccaagc

SEQ ID NO: 2596980 - RNA, 23 nt, Human
uccccuacccccuccucucugcc

SEQ ID NO: 2596981 - RNA, 17 nt, Human
uccccuaguaagugccu

SEQ ID NO: 2596982 - RNA, 17 nt, Human
uccccuaccacugucuu

SEQ ID NO: 2596983 - RNA, 13 nt, Human
uccccuaaugccu

SEQ ID NO: 2596984 - RNA, 21 nt, Human
acuacuagggaaaugccuuug

SEQ ID NO: 2596985 - RNA, 14 nt, Human
acuacuagggaaau

SEQ ID NO: 2596986 - RNA, 19 nt, Human
acuaccuccucagggaugg

SEQ ID NO: 2596987 - RNA, 17 nt, Human
acuaccuccucagggau

SEQ ID NO: 2596988 - RNA, 17 nt, Human
acuacucccccaggugg

SEQ ID NO: 2596989 - RNA, 15 nt, Human
acucaccaucugugc

SEQ ID NO: 2596990 - RNA, 13 nt, Human
acucaccaucugu

SEQ ID NO: 2596991 - RNA, 23 nt, Human
acucaccaguguccccuccacug

SEQ ID NO: 2596992 - RNA, 19 nt, Human
acucaccaguguccccucc

SEQ ID NO: 2596993 - RNA, 17 nt, Human
acucaccaguguccccu

SEQ ID NO: 2596994 - RNA, 12 nt, Human
acucaccccagc

SEQ ID NO: 2596995 - RNA, 21 nt, Human
acucacauuuauucugcucac

SEQ ID NO: 2596996 - RNA, 21 nt, Human
acuacuccucugcagugccuu

SEQ ID NO: 2596997 - RNA, 19 nt, Human
acuacuccucugcagugcc

SEQ ID NO: 2596998 - RNA, 14 nt, Human
acuacuccucugca

SEQ ID NO: 2596999 - RNA, 20 nt, Human
acuacuccggagacaggguu

SEQ ID NO: 2597000 - RNA, 15 nt, Human
acuacucagggaaug

SEQ ID NO: 2597001 - RNA, 17 nt, Human
acuacucagggaaugaa

SEQ ID NO: 2597002 - RNA, 17 nt, Human
uccccucggagaagagc

SEQ ID NO: 2597003 - RNA, 18 nt, Human
uccccuccuugggcacuu

SEQ ID NO: 2597004 - RNA, 14 nt, Human
uccccuccuugggc

SEQ ID NO: 2597005 - RNA, 12 nt, Human
uccccuccuugg

SEQ ID NO: 2597006 - RNA, 23 nt, Human
uccccuccuugccuccuguguaa

SEQ ID NO: 2597007 - RNA, 17 nt, Human
uccccucuauuuagcau

SEQ ID NO: 2597008 - RNA, 16 nt, Human
uccccucggagaagag

SEQ ID NO: 2597009 - RNA, 15 nt, Human
uccccucccuggcuc

SEQ ID NO: 2597010 - RNA, 16 nt, Human
uccccucccuggcucc

SEQ ID NO: 2597011 - RNA, 19 nt, Human
uccccucccuggcucccau

SEQ ID NO: 2597012 - RNA, 21 nt, Human
uccccuccuugccuccugugu

SEQ ID NO: 2597013 - RNA, 22 nt, Human
uccccuccuugccuccugugua

SEQ ID NO: 2597014 - RNA, 15 nt, Human
uccccucuccuuccu

SEQ ID NO: 2597015 - RNA, 17 nt, Human
uccccuugcccagggcu

SEQ ID NO: 2597016 - RNA, 20 nt, Human
uccccuugcccagggcucag

SEQ ID NO: 2597017 - RNA, 22 nt, Human
uccccuugcccagggcucagcc

SEQ ID NO: 2597018 - RNA, 18 nt, Human
uccccuugcccuugcccu

SEQ ID NO: 2597019 - RNA, 14 nt, Human
uccccuugcccuug

SEQ ID NO: 2597020 - RNA, 24 nt, Human
uccccuugcccagggcucagccug

SEQ ID NO: 2597021 - RNA, 23 nt, Human
uccccuugcccuugcccugaccu

SEQ ID NO: 2597022 - RNA, 21 nt, Human
uccccuugcccuugcccugac

SEQ ID NO: 2597023 - RNA, 20 nt, Human
uccccuugcccuugcccuga

SEQ ID NO: 2597024 - RNA, 19 nt, Human
uccccuugcccuugcccug

SEQ ID NO: 2597025 - RNA, 14 nt, Human
uccccuugggcggc

SEQ ID NO: 2597026 - RNA, 22 nt, Human
uccccuugggcggcugagagcc

SEQ ID NO: 2597027 - RNA, 17 nt, Human
uccccuugggcggcuga

SEQ ID NO: 2597028 - RNA, 17 nt, Human
ucccgaguagcugggac

SEQ ID NO: 2597029 - RNA, 16 nt, Human
ucccgaguagcuggga

SEQ ID NO: 2597030 - RNA, 20 nt, Human
ucccgaguagcugagauuau

SEQ ID NO: 2597031 - RNA, 23 nt, Human
ucccggcaugggaaagccaccuc

SEQ ID NO: 2597032 - RNA, 18 nt, Human
ucccgaguagcugggacu

SEQ ID NO: 2597033 - RNA, 22 nt, Human
ucccgagcaccuccacauccuc

SEQ ID NO: 2597034 - RNA, 20 nt, Human
ucccgagcaaagucuaaagu

SEQ ID NO: 2597035 - RNA, 19 nt, Human
ucccgagcaaagucuaaag

SEQ ID NO: 2597036 - RNA, 17 nt, Human
uccccuuuuauugcugc

SEQ ID NO: 2597037 - RNA, 15 nt, Human
ucccgaguagcuggg

SEQ ID NO: 2597038 - RNA, 20 nt, Human
ucccgaauagcugggacuac

SEQ ID NO: 2597039 - RNA, 21 nt, Human
uccccuuuguauuccuuaaau

SEQ ID NO: 2597040 - RNA, 15 nt, Human
acuccugacagucuu

SEQ ID NO: 2597041 - RNA, 21 nt, Human
acuccugacagucuugugcuu

SEQ ID NO: 2597042 - RNA, 19 nt, Human
acuccugacagucuugugc

SEQ ID NO: 2597043 - RNA, 17 nt, Human
acuccugcaggcagcca

SEQ ID NO: 2597044 - RNA, 19 nt, Human
acuccugcaggcagccagg

SEQ ID NO: 2597045 - RNA, 18 nt, Human
acuccugcaggcagccag

SEQ ID NO: 2597046 - RNA, 18 nt, Human
acuccucgguacucccau

SEQ ID NO: 2597047 - RNA, 23 nt, Human
acuccucggccuggcuccuaccc

SEQ ID NO: 2597048 - RNA, 19 nt, Human
acuccucggccuggcuccu

SEQ ID NO: 2597049 - RNA, 17 nt, Human
acuccucggccuggcuc

SEQ ID NO: 2597050 - RNA, 22 nt, Human
acuccuccuccaaaggcccccu

SEQ ID NO: 2597051 - RNA, 21 nt, Human
acuccuccuccaaaggccccc

SEQ ID NO: 2597052 - RNA, 16 nt, Human
acuccucggccuggcu

SEQ ID NO: 2597053 - RNA, 23 nt, Human
acuccucuaagccacucuuccaa

SEQ ID NO: 2597054 - RNA, 21 nt, Human
acuccucuaagccacucuucc

SEQ ID NO: 2597055 - RNA, 14 nt, Human
acuccucugacuca

SEQ ID NO: 2597056 - RNA, 17 nt, Human
acuccucugcagugccu

SEQ ID NO: 2597057 - RNA, 12 nt, Human
acuccucugcag

SEQ ID NO: 2597058 - RNA, 20 nt, Human
acuccucugacucagggcuc

SEQ ID NO: 2597059 - RNA, 20 nt, Human
acuccucugcagugccuugg

SEQ ID NO: 2597060 - RNA, 13 nt, Human
acuccucugucca

SEQ ID NO: 2597061 - RNA, 16 nt, Human
acuccucuuauuugcu

SEQ ID NO: 2597062 - RNA, 14 nt, Human
acuccucuuauuug

SEQ ID NO: 2597063 - RNA, 14 nt, Human
acuccucuguccag

SEQ ID NO: 2597064 - RNA, 23 nt, Human
acuccagaauuucccaaagcagu

SEQ ID NO: 2597065 - RNA, 13 nt, Human
acuccagccugag

SEQ ID NO: 2597066 - RNA, 14 nt, Human
acuccagccugagc

SEQ ID NO: 2597067 - RNA, 12 nt, Human
acuccagccugg

SEQ ID NO: 2597068 - RNA, 15 nt, Human
acuccagccugagca

SEQ ID NO: 2597069 - RNA, 19 nt, Human
acuccagccugagcaacag

SEQ ID NO: 2597070 - RNA, 20 nt, Human
acuccagccugagcaacaga

SEQ ID NO: 2597071 - RNA, 19 nt, Human
acuccagccuggcgacaga

SEQ ID NO: 2597072 - RNA, 15 nt, Human
acuccuccuagccac

SEQ ID NO: 2597073 - RNA, 16 nt, Human
acuccuccuagccacc

SEQ ID NO: 2597074 - RNA, 23 nt, Human
acuccuccuccaaaggcccccua

SEQ ID NO: 2597075 - RNA, 18 nt, Human
acuccuccuagccaccca

SEQ ID NO: 2597076 - RNA, 13 nt, Human
acuccagccuggg

SEQ ID NO: 2597077 - RNA, 14 nt, Human
acuccuccuagcca

SEQ ID NO: 2597078 - RNA, 13 nt, Human
acuccuccuagcc

SEQ ID NO: 2597079 - RNA, 14 nt, Human
acuccagccugggc

SEQ ID NO: 2597080 - RNA, 17 nt, Human
acuccagaauuucccaa

SEQ ID NO: 2597081 - RNA, 15 nt, Human
acuccagaauuuccc

SEQ ID NO: 2597082 - RNA, 21 nt, Human
acuccaaagaaauguaaggga

SEQ ID NO: 2597083 - RNA, 15 nt, Human
acuccaaagaaaugu

SEQ ID NO: 2597084 - RNA, 18 nt, Human
acuccaaagaaauguaag

SEQ ID NO: 2597085 - RNA, 14 nt, Human
acuccaaagaaaug

SEQ ID NO: 2597086 - RNA, 15 nt, Human
acucauugaccugag

SEQ ID NO: 2597087 - RNA, 13 nt, Human
acucauucaaaag

SEQ ID NO: 2597088 - RNA, 21 nt, Human
acucauucaaaaguugaaauu

SEQ ID NO: 2597089 - RNA, 15 nt, Human
acucauucugaagga

SEQ ID NO: 2597090 - RNA, 19 nt, Human
acucauucugaaggagccc

SEQ ID NO: 2597091 - RNA, 13 nt, Human
acucauuccugua

SEQ ID NO: 2597092 - RNA, 23 nt, Human
acucauucagggauagcacugag

SEQ ID NO: 2597093 - RNA, 14 nt, Human
acucauugaccuga

SEQ ID NO: 2597094 - RNA, 15 nt, Human
acucauucuucugua

SEQ ID NO: 2597095 - RNA, 15 nt, Human
acucacuuucuagau

SEQ ID NO: 2597096 - RNA, 14 nt, Human
acucagaaacauca

SEQ ID NO: 2597097 - RNA, 15 nt, Human
acucagaaacaucag

SEQ ID NO: 2597098 - RNA, 12 nt, Human
acucauguguau

SEQ ID NO: 2597099 - RNA, 11 nt, Human
acucaugugua

SEQ ID NO: 2597100 - RNA, 10 nt, Human
acucaugugu

SEQ ID NO: 2597101 - RNA, 21 nt, Human
acucauguguaugggcaaaaa

SEQ ID NO: 2597102 - RNA, 13 nt, Human
acucauguguaug

SEQ ID NO: 2597103 - RNA, 22 nt, Human
uccggcuccugugcuuucccug

SEQ ID NO: 2597104 - RNA, 17 nt, Human
uccggcuccugugcuuu

SEQ ID NO: 2597105 - RNA, 16 nt, Human
uccggcuccugugcuu

SEQ ID NO: 2597106 - RNA, 14 nt, Human
uccggcuccugugc

SEQ ID NO: 2597107 - RNA, 21 nt, Human
uccgggaccuggugcugccuc

SEQ ID NO: 2597108 - RNA, 23 nt, Human
uccgggagggugcggcugugcag

SEQ ID NO: 2597109 - RNA, 16 nt, Human
uccggggagcgcccgc

SEQ ID NO: 2597110 - RNA, 16 nt, Human
ucccuuuuugaagugu

SEQ ID NO: 2597111 - RNA, 15 nt, Human
ucccuuuuugaagug

SEQ ID NO: 2597112 - RNA, 21 nt, Human
ucccuuuuuccuuguccccac

SEQ ID NO: 2597113 - RNA, 17 nt, Human
ucccuuuuuccuugucc

SEQ ID NO: 2597114 - RNA, 16 nt, Human
ucccuuuuuccuuguc

SEQ ID NO: 2597115 - RNA, 15 nt, Human
ucccuuuuuccuugu

SEQ ID NO: 2597116 - RNA, 14 nt, Human
ucccuuuuuccuug

SEQ ID NO: 2597117 - RNA, 23 nt, Human
ucccuuuugcggaugggaggggu

SEQ ID NO: 2597118 - RNA, 15 nt, Human
ucccuuuugcaucau

SEQ ID NO: 2597119 - RNA, 20 nt, Human
ucccuuuuuauaucccauuu

SEQ ID NO: 2597120 - RNA, 19 nt, Human
ucccuuucugcuuguguua

SEQ ID NO: 2597121 - RNA, 23 nt, Human
ucccuuucuccccugcccccagg

SEQ ID NO: 2597122 - RNA, 13 nt, Human
ucccuuucuuggc

SEQ ID NO: 2597123 - RNA, 13 nt, Human
ucccuuuuacaua

SEQ ID NO: 2597124 - RNA, 16 nt, Human
ucccuuucuuggccag

SEQ ID NO: 2597125 - RNA, 17 nt, Human
ucccuuucuuggccagu

SEQ ID NO: 2597126 - RNA, 17 nt, Human
ucccuuuuacauacugc

SEQ ID NO: 2597127 - RNA, 19 nt, Human
ucccuuuuacauacugcug

SEQ ID NO: 2597128 - RNA, 12 nt, Human
ucccuuuuccuu

SEQ ID NO: 2597129 - RNA, 20 nt, Human
ucccuuuuacauacugcugu

SEQ ID NO: 2597130 - RNA, 22 nt, Human
uccggguuugagauggacacac

SEQ ID NO: 2597131 - RNA, 22 nt, Human
uccgggggcagcucuggagggg

SEQ ID NO: 2597132 - RNA, 17 nt, Human
uccggucccugucccag

SEQ ID NO: 2597133 - RNA, 19 nt, Human
uccuaaauauauuuuaaga

SEQ ID NO: 2597134 - RNA, 20 nt, Human
uccggguuugagauggacac

SEQ ID NO: 2597135 - RNA, 15 nt, Human
uccuaaaugcaguga

SEQ ID NO: 2597136 - RNA, 19 nt, Human
uccuaaaugcagugaauug

SEQ ID NO: 2597137 - RNA, 22 nt, Human
uccuaagaaagaggagugcuug

SEQ ID NO: 2597138 - RNA, 20 nt, Human
uccuaagaaagaggagugcu

SEQ ID NO: 2597139 - RNA, 13 nt, Human
uccuaagaaagag

SEQ ID NO: 2597140 - RNA, 16 nt, Human
uccuaagagugcuggg

SEQ ID NO: 2597141 - RNA, 16 nt, Human
uccuaacacagcaugu

SEQ ID NO: 2597142 - RNA, 14 nt, Human
uccuacuuccccuu

SEQ ID NO: 2597143 - RNA, 16 nt, Human
uccuagaaauucccca

SEQ ID NO: 2597144 - RNA, 23 nt, Human
ucccuguuuucugagcccgggcu

SEQ ID NO: 2597145 - RNA, 22 nt, Human
ucccuguuuucugagcccgggc

SEQ ID NO: 2597146 - RNA, 15 nt, Human
ucccuuaaacaaaaa

SEQ ID NO: 2597147 - RNA, 18 nt, Human
ucccuuaaaauagaaaua

SEQ ID NO: 2597148 - RNA, 22 nt, Human
ucccuuaaacaaaaauuaaaau

SEQ ID NO: 2597149 - RNA, 20 nt, Human
ucccuguuugaagccugccc

SEQ ID NO: 2597150 - RNA, 20 nt, Human
ucccugugcugacggaagcc

SEQ ID NO: 2597151 - RNA, 21 nt, Human
ucccuguuuucugagcccggg

SEQ ID NO: 2597152 - RNA, 19 nt, Human
ucccuguuuucugagcccg

SEQ ID NO: 2597153 - RNA, 18 nt, Human
ucccuguuuucugagccc

SEQ ID NO: 2597154 - RNA, 15 nt, Human
ucccuguuuucugag

SEQ ID NO: 2597155 - RNA, 11 nt, Human
ucccuguuuuc

SEQ ID NO: 2597156 - RNA, 17 nt, Human
ucccuuacgugaguccu

SEQ ID NO: 2597157 - RNA, 14 nt, Human
ucccuuuccuucca

SEQ ID NO: 2597158 - RNA, 17 nt, Human
ucccuuuccuuccaucc

SEQ ID NO: 2597159 - RNA, 18 nt, Human
ucccuuucuccccugccc

SEQ ID NO: 2597160 - RNA, 17 nt, Human
ucccuuucuccccugcc

SEQ ID NO: 2597161 - RNA, 16 nt, Human
ucccuuucuccccugc

SEQ ID NO: 2597162 - RNA, 15 nt, Human
ucccuuucuccccug

SEQ ID NO: 2597163 - RNA, 14 nt, Human
ucccuuucuccccu

SEQ ID NO: 2597164 - RNA, 23 nt, Human
ucccuuuccuuccaucccuaccc

SEQ ID NO: 2597165 - RNA, 18 nt, Human
ucccuuuccuuccauccc

SEQ ID NO: 2597166 - RNA, 19 nt, Human
ucccuuuccuuccaucccu

SEQ ID NO: 2597167 - RNA, 15 nt, Human
ucccugguggcagcu

SEQ ID NO: 2597168 - RNA, 12 nt, Human
ucccugucccag

SEQ ID NO: 2597169 - RNA, 14 nt, Human
ucccugucccucua

SEQ ID NO: 2597170 - RNA, 22 nt, Human
ucccugucaccaagcucacagu

SEQ ID NO: 2597171 - RNA, 12 nt, Human
ucccuguccucc

SEQ ID NO: 2597172 - RNA, 14 nt, Human
ucccuguccuccuc

SEQ ID NO: 2597173 - RNA, 16 nt, Human
ucccugucggccuggu

SEQ ID NO: 2597174 - RNA, 20 nt, Human
ucccugugccuaacaccagc

SEQ ID NO: 2597175 - RNA, 15 nt, Human
ucccuguccuccucg

SEQ ID NO: 2597176 - RNA, 21 nt, Human
ucccugggggaagcccuggau

SEQ ID NO: 2597177 - RNA, 13 nt, Human
ucccuggucccuu

SEQ ID NO: 2597178 - RNA, 21 nt, Human
ucccugguaauaaguacugug

SEQ ID NO: 2597179 - RNA, 14 nt, Human
ucccuggucccuug

SEQ ID NO: 2597180 - RNA, 19 nt, Human
ucccuggucccuuggagac

SEQ ID NO: 2597181 - RNA, 21 nt, Human
acuccugcaggcagccaggcc

SEQ ID NO: 2597182 - RNA, 18 nt, Human
ucccugggggaagcccug

SEQ ID NO: 2597183 - RNA, 20 nt, Human
ucccuggggcuagggggagc

SEQ ID NO: 2597184 - RNA, 19 nt, Human
ucccugggggaagcccugg

SEQ ID NO: 2597185 - RNA, 20 nt, Human
ucccugggggaagcccugga

SEQ ID NO: 2597186 - RNA, 14 nt, Human
ucccuggggugggg

SEQ ID NO: 2597187 - RNA, 14 nt, Human
uccuuguguuacua

SEQ ID NO: 2597188 - RNA, 23 nt, Human
uccuuguguuacuaaguuuuuau

SEQ ID NO: 2597189 - RNA, 14 nt, Human
uccuuguuucaaac

SEQ ID NO: 2597190 - RNA, 13 nt, Human
uccuuguuucaaa

SEQ ID NO: 2597191 - RNA, 22 nt, Human
uccuugugguuuaugucaucau

SEQ ID NO: 2597192 - RNA, 19 nt, Human
uccuugugguuuaugucau

SEQ ID NO: 2597193 - RNA, 14 nt, Human
uccuuguuccuaga

SEQ ID NO: 2597194 - RNA, 22 nt, Human
uccuuuaaaaaaauuuaagugc

SEQ ID NO: 2597195 - RNA, 16 nt, Human
uccuuuaaaaaaauuu

SEQ ID NO: 2597196 - RNA, 22 nt, Human
uccuuguuucaaacacaaaugc

SEQ ID NO: 2597197 - RNA, 17 nt, Human
uccuuuaaauccuucca

SEQ ID NO: 2597198 - RNA, 19 nt, Human
uccuuuagcgcccaguugg

SEQ ID NO: 2597199 - RNA, 15 nt, Human
uccuuuagcgcccag

SEQ ID NO: 2597200 - RNA, 22 nt, Human
uccuuuacacauucggcucccu

SEQ ID NO: 2597201 - RNA, 12 nt, Human
uccuuuacacau

SEQ ID NO: 2597202 - RNA, 21 nt, Human
uccuuuaaaaaaauuuaagug

SEQ ID NO: 2597203 - RNA, 21 nt, Human
uccuuuaauuuuuuacuauuu

SEQ ID NO: 2597204 - RNA, 22 nt, Human
uccuuguccccacacuccuaca

SEQ ID NO: 2597205 - RNA, 20 nt, Human
uccuuguccccacacuccua

SEQ ID NO: 2597206 - RNA, 19 nt, Human
uccuuguccccacacuccu

SEQ ID NO: 2597207 - RNA, 18 nt, Human
uccuuguccccacacucc

SEQ ID NO: 2597208 - RNA, 17 nt, Human
uccuuguccccacacuc

SEQ ID NO: 2597209 - RNA, 16 nt, Human
uccuuguccccacacu

SEQ ID NO: 2597210 - RNA, 14 nt, Human
uccuuguccccaca

SEQ ID NO: 2597211 - RNA, 13 nt, Human
uccuuguccccac

SEQ ID NO: 2597212 - RNA, 16 nt, Human
uccuuguccacccacc

SEQ ID NO: 2597213 - RNA, 15 nt, Human
uccuuguccacccac

SEQ ID NO: 2597214 - RNA, 13 nt, Human
uccuugucacugg

SEQ ID NO: 2597215 - RNA, 15 nt, Human
uccuuguauuuaaau

SEQ ID NO: 2597216 - RNA, 17 nt, Human
uccuugugguuuauguc

SEQ ID NO: 2597217 - RNA, 19 nt, Human
uccuuguggccugggccuc

SEQ ID NO: 2597218 - RNA, 18 nt, Human
uccuuguggccugggccu

SEQ ID NO: 2597219 - RNA, 12 nt, Human
uccuugugcaug

SEQ ID NO: 2597220 - RNA, 19 nt, Human
uccuuccuugcuguccuag

SEQ ID NO: 2597221 - RNA, 16 nt, Human
uccuucuaguuuccca

SEQ ID NO: 2597222 - RNA, 17 nt, Human
uccuucuaguuucccac

SEQ ID NO: 2597223 - RNA, 16 nt, Human
uccuuccuugaccagc

SEQ ID NO: 2597224 - RNA, 18 nt, Human
uccuucuaguuucccaca

SEQ ID NO: 2597225 - RNA, 12 nt, Human
uccuucucccuu

SEQ ID NO: 2597226 - RNA, 20 nt, Human
uccuucucucaccuccuaaa

SEQ ID NO: 2597227 - RNA, 15 nt, Human
uccuucugaaguguu

SEQ ID NO: 2597228 - RNA, 15 nt, Human
uccuucucugucuca

SEQ ID NO: 2597229 - RNA, 12 nt, Human
uccuucucuguc

SEQ ID NO: 2597230 - RNA, 13 nt, Human
uccuucuccuccu

SEQ ID NO: 2597231 - RNA, 21 nt, Human
uccuuggugugacccucugaa

SEQ ID NO: 2597232 - RNA, 17 nt, Human
uccuucugaccacagca

SEQ ID NO: 2597233 - RNA, 15 nt, Human
uccuucagugccuua

SEQ ID NO: 2597234 - RNA, 14 nt, Human
uccuucagugccuu

SEQ ID NO: 2597235 - RNA, 19 nt, Human
acuggccucgccuggccug

SEQ ID NO: 2597236 - RNA, 18 nt, Human
acuggccucgccuggccu

SEQ ID NO: 2597237 - RNA, 17 nt, Human
acuggccucgccuggcc

SEQ ID NO: 2597238 - RNA, 14 nt, Human
acuggccucugcug

SEQ ID NO: 2597239 - RNA, 23 nt, Human
acuggccggucugcaagucagag

SEQ ID NO: 2597240 - RNA, 16 nt, Human
acuggccucgccuggc

SEQ ID NO: 2597241 - RNA, 22 nt, Human
acuggccggucugcaagucaga

SEQ ID NO: 2597242 - RNA, 19 nt, Human
acuggccggagucagugcc

SEQ ID NO: 2597243 - RNA, 17 nt, Human
acuggccccugggucag

SEQ ID NO: 2597244 - RNA, 19 nt, Human
acuggccaccaggcuggcg

SEQ ID NO: 2597245 - RNA, 18 nt, Human
acuggccaccaggcuggc

SEQ ID NO: 2597246 - RNA, 17 nt, Human
acuggccaccaggcugg

SEQ ID NO: 2597247 - RNA, 16 nt, Human
acuggccaccaggcug

SEQ ID NO: 2597248 - RNA, 22 nt, Human
acuggccaccaggcuggcgcag

SEQ ID NO: 2597249 - RNA, 21 nt, Human
acuggccaccaggcuggcgca

SEQ ID NO: 2597250 - RNA, 23 nt, Human
acuggccaccaggcuggcgcagc

SEQ ID NO: 2597251 - RNA, 14 nt, Human
acuggccaucucca

SEQ ID NO: 2597252 - RNA, 13 nt, Human
acuggccaucucc

SEQ ID NO: 2597253 - RNA, 23 nt, Human
acuggccaguggcuggaucugug

SEQ ID NO: 2597254 - RNA, 13 nt, Human
acuggccccuggg

SEQ ID NO: 2597255 - RNA, 12 nt, Human
acuggccccugg

SEQ ID NO: 2597256 - RNA, 21 nt, Human
acuggccccuagaaucagccu

SEQ ID NO: 2597257 - RNA, 15 nt, Human
acuggccccuggguc

SEQ ID NO: 2597258 - RNA, 14 nt, Human
acuggccccugggu

SEQ ID NO: 2597259 - RNA, 18 nt, Human
uccuucccaaaggacucc

SEQ ID NO: 2597260 - RNA, 23 nt, Human
uccuucccaaaggacuccaccca

SEQ ID NO: 2597261 - RNA, 16 nt, Human
uccuuccuguucugaa

SEQ ID NO: 2597262 - RNA, 14 nt, Human
uccuuccuucccac

SEQ ID NO: 2597263 - RNA, 19 nt, Human
uccuuccuguucugaacug

SEQ ID NO: 2597264 - RNA, 15 nt, Human
uccuuccuucccacc

SEQ ID NO: 2597265 - RNA, 14 nt, Human
uccuuccuucccug

SEQ ID NO: 2597266 - RNA, 15 nt, Human
uccuuccuucccugg

SEQ ID NO: 2597267 - RNA, 16 nt, Human
uccuuccuucccuggc

SEQ ID NO: 2597268 - RNA, 21 nt, Human
uccuuccaguguccuuagaac

SEQ ID NO: 2597269 - RNA, 15 nt, Human
uccuuccaucaaaua

SEQ ID NO: 2597270 - RNA, 16 nt, Human
uccuuccaggccccca

SEQ ID NO: 2597271 - RNA, 21 nt, Human
uccuuccaggcccccaccacu

SEQ ID NO: 2597272 - RNA, 16 nt, Human
uccuuccaucccuacc

SEQ ID NO: 2597273 - RNA, 17 nt, Human
uccuuccaucccuaccc

SEQ ID NO: 2597274 - RNA, 13 nt, Human
uccuuccaugaaa

SEQ ID NO: 2597275 - RNA, 17 nt, Human
uccuucagugccuuaug

SEQ ID NO: 2597276 - RNA, 16 nt, Human
uccuucagugccuuau

SEQ ID NO: 2597277 - RNA, 17 nt, Human
uccuuccaccucccucc

SEQ ID NO: 2597278 - RNA, 13 nt, Human
uccuuccaggccc

SEQ ID NO: 2597279 - RNA, 14 nt, Human
uccuuccaccuccc

SEQ ID NO: 2597280 - RNA, 23 nt, Human
acuggccucgccuggccugaggu

SEQ ID NO: 2597281 - RNA, 22 nt, Human
acuggccucgccuggccugagg

SEQ ID NO: 2597282 - RNA, 12 nt, Human
uccuuccaccuc

SEQ ID NO: 2597283 - RNA, 14 nt, Human
ucgagaccagucug

SEQ ID NO: 2597284 - RNA, 15 nt, Human
ucgagcaugccugga

SEQ ID NO: 2597285 - RNA, 18 nt, Human
ucgagcaugccuggaugg

SEQ ID NO: 2597286 - RNA, 16 nt, Human
ucgagcaugccuggau

SEQ ID NO: 2597287 - RNA, 16 nt, Human
ucgcgacaaugcaaac

SEQ ID NO: 2597288 - RNA, 19 nt, Human
ucgcgacaaugcaaaccau

SEQ ID NO: 2597289 - RNA, 17 nt, Human
ucgaggaaccagagcca

SEQ ID NO: 2597290 - RNA, 17 nt, Human
acuggcugucaguauga

SEQ ID NO: 2597291 - RNA, 21 nt, Human
acuggcugucaguaugacauu

SEQ ID NO: 2597292 - RNA, 13 nt, Human
acuggcuuuggcu

SEQ ID NO: 2597293 - RNA, 15 nt, Human
acuggcuuuggcuuc

SEQ ID NO: 2597294 - RNA, 16 nt, Human
acuggcuuuggcuucu

SEQ ID NO: 2597295 - RNA, 18 nt, Human
acuggcuuuggcuucuug

SEQ ID NO: 2597296 - RNA, 12 nt, Human
acuggcugguga

SEQ ID NO: 2597297 - RNA, 19 nt, Human
acuggcuuuuauuaaugca

SEQ ID NO: 2597298 - RNA, 18 nt, Human
acuggcuuuuauuaaugc

SEQ ID NO: 2597299 - RNA, 14 nt, Human
acuggcuuuuauua

SEQ ID NO: 2597300 - RNA, 18 nt, Human
ucgcgugcccucgcugcu

SEQ ID NO: 2597301 - RNA, 16 nt, Human
ucgcgugcccucgcug

SEQ ID NO: 2597302 - RNA, 20 nt, Human
ucgcgugcccucgcugcuuc

SEQ ID NO: 2597303 - RNA, 18 nt, Human
ucgcuauugucaccaggg

SEQ ID NO: 2597304 - RNA, 18 nt, Human
ucgcucaaucaagaaaau

SEQ ID NO: 2597305 - RNA, 13 nt, Human
ucgcgcugccugu

SEQ ID NO: 2597306 - RNA, 12 nt, Human
ucgcgcugccug

SEQ ID NO: 2597307 - RNA, 14 nt, Human
ucgcgcucagcaug

SEQ ID NO: 2597308 - RNA, 16 nt, Human
ucgcgcugccugugug

SEQ ID NO: 2597309 - RNA, 15 nt, Human
ucgcgcugccugugu

SEQ ID NO: 2597310 - RNA, 20 nt, Human
ucgcggcggagcuggccccg

SEQ ID NO: 2597311 - RNA, 19 nt, Human
ucgcggcggagcuggcccc

SEQ ID NO: 2597312 - RNA, 18 nt, Human
ucgcggcggagcuggccc

SEQ ID NO: 2597313 - RNA, 16 nt, Human
ucgcggcggagcuggc

SEQ ID NO: 2597314 - RNA, 20 nt, Human
uccuuucuugguucauaaau

SEQ ID NO: 2597315 - RNA, 22 nt, Human
uccuuucuugguucauaaauga

SEQ ID NO: 2597316 - RNA, 15 nt, Human
uccuuucuuucuaac

SEQ ID NO: 2597317 - RNA, 18 nt, Human
uccuuucuccagccagca

SEQ ID NO: 2597318 - RNA, 17 nt, Human
uccuuucuccagccagc

SEQ ID NO: 2597319 - RNA, 17 nt, Human
uccuuucuuuuucuucu

SEQ ID NO: 2597320 - RNA, 16 nt, Human
uccuuucuuuuucuuc

SEQ ID NO: 2597321 - RNA, 14 nt, Human
uccuuucuuuuucu

SEQ ID NO: 2597322 - RNA, 18 nt, Human
ucgaagcucagcccaccc

SEQ ID NO: 2597323 - RNA, 19 nt, Human
ucgaagcucagcccacccc

SEQ ID NO: 2597324 - RNA, 11 nt, Human
uccuuucuauc

SEQ ID NO: 2597325 - RNA, 21 nt, Human
uccuuucuaucauuuuuguac

SEQ ID NO: 2597326 - RNA, 19 nt, Human
uccuuuacacucaggcuuu

SEQ ID NO: 2597327 - RNA, 13 nt, Human
uccuuucucaccg

SEQ ID NO: 2597328 - RNA, 15 nt, Human
uccuuucuauugaaa

SEQ ID NO: 2597329 - RNA, 14 nt, Human
uccuuucucagccg

SEQ ID NO: 2597330 - RNA, 16 nt, Human
uccuuucuccagccag

SEQ ID NO: 2597331 - RNA, 15 nt, Human
uccuuucucauccca

SEQ ID NO: 2597332 - RNA, 23 nt, Human
uccuuucucagccgcuucugacu

SEQ ID NO: 2597333 - RNA, 23 nt, Human
uccuuuagcgcccaguugggugg

SEQ ID NO: 2597334 - RNA, 22 nt, Human
uccuuuagcgcccaguugggug

SEQ ID NO: 2597335 - RNA, 19 nt, Human
ucgagaccagccuggccaa

SEQ ID NO: 2597336 - RNA, 18 nt, Human
ucgagaccagccuggcca

SEQ ID NO: 2597337 - RNA, 15 nt, Human
ucgagaccagccugg

SEQ ID NO: 2597338 - RNA, 14 nt, Human
ucgagaccagccug

SEQ ID NO: 2597339 - RNA, 16 nt, Human
ucgagaccagccuggc

SEQ ID NO: 2597340 - RNA, 17 nt, Human
ucgagaccagccuggcc

SEQ ID NO: 2597341 - RNA, 16 nt, Human
ucgagaacuuucauuu

SEQ ID NO: 2597342 - RNA, 15 nt, Human
ucgagaacuuucauu

SEQ ID NO: 2597343 - RNA, 19 nt, Human
ucgagaagcugcucuggaa

SEQ ID NO: 2597344 - RNA, 22 nt, Human
ucgagaacuuucauuuuuuucc

SEQ ID NO: 2597345 - RNA, 14 nt, Human
ucgagacacuugcc

SEQ ID NO: 2597346 - RNA, 16 nt, Human
ucgagacacagugaag

SEQ ID NO: 2597347 - RNA, 21 nt, Human
ucgagaagcugcucuggaauu

SEQ ID NO: 2597348 - RNA, 14 nt, Human
ucgagacagaaccu

SEQ ID NO: 2597349 - RNA, 18 nt, Human
ucgagaccaaccugacca

SEQ ID NO: 2597350 - RNA, 13 nt, Human
ucgagaccagccu

SEQ ID NO: 2597351 - RNA, 22 nt, Human
ucgaaucucugugccuucgucu

SEQ ID NO: 2597352 - RNA, 15 nt, Human
ucgaauuaauagcuu

SEQ ID NO: 2597353 - RNA, 17 nt, Human
ucgaaucucugugccuu

SEQ ID NO: 2597354 - RNA, 16 nt, Human
ucgaaucucugugccu

SEQ ID NO: 2597355 - RNA, 14 nt, Human
ucgaaucucugugc

SEQ ID NO: 2597356 - RNA, 20 nt, Human
ucgaaucuacuaauuccaca

SEQ ID NO: 2597357 - RNA, 14 nt, Human
ucgagaacuuucau

SEQ ID NO: 2597358 - RNA, 21 nt, Human
ucgaauuaauagcuuuuauug

SEQ ID NO: 2597359 - RNA, 16 nt, Human
ucgaauuaauagcuuu

SEQ ID NO: 2597360 - RNA, 14 nt, Human
ucgacuugcauuuu

SEQ ID NO: 2597361 - RNA, 22 nt, Human
acugccuucgcuucuugccucu

SEQ ID NO: 2597362 - RNA, 21 nt, Human
acugccuucgcuucuugccuc

SEQ ID NO: 2597363 - RNA, 17 nt, Human
acugccuucgcuucuug

SEQ ID NO: 2597364 - RNA, 16 nt, Human
acugccuucgcuucuu

SEQ ID NO: 2597365 - RNA, 15 nt, Human
acugccuucgcuucu

SEQ ID NO: 2597366 - RNA, 16 nt, Human
acugccuuaaaacuuu

SEQ ID NO: 2597367 - RNA, 15 nt, Human
acugccuuaaaacuu

SEQ ID NO: 2597368 - RNA, 14 nt, Human
acugccugggcucc

SEQ ID NO: 2597369 - RNA, 14 nt, Human
acugccuuaaaacu

SEQ ID NO: 2597370 - RNA, 20 nt, Human
acugccugauggaccuguca

SEQ ID NO: 2597371 - RNA, 17 nt, Human
acugccugauggaccug

SEQ ID NO: 2597372 - RNA, 23 nt, Human
acugccugcagaggucugugcug

SEQ ID NO: 2597373 - RNA, 22 nt, Human
acugccugcagaggucugugcu

SEQ ID NO: 2597374 - RNA, 9 nt, Human
acugccugc

SEQ ID NO: 2597375 - RNA, 24 nt, Human
acugccugcagaggucugugcuga

SEQ ID NO: 2597376 - RNA, 12 nt, Human
acugccugccca

SEQ ID NO: 2597377 - RNA, 13 nt, Human
acugccugcccac

SEQ ID NO: 2597378 - RNA, 14 nt, Human
acugccugcccacc

SEQ ID NO: 2597379 - RNA, 16 nt, Human
acugccugcccacccg

SEQ ID NO: 2597380 - RNA, 19 nt, Human
acugccugcccacccgugg

SEQ ID NO: 2597381 - RNA, 22 nt, Human
acugccugcccacccguggaga

SEQ ID NO: 2597382 - RNA, 23 nt, Human
acugccugcccacccguggagau

SEQ ID NO: 2597383 - RNA, 15 nt, Human
acugccucuuccucc

SEQ ID NO: 2597384 - RNA, 14 nt, Human
acugccucuuccuc

SEQ ID NO: 2597385 - RNA, 19 nt, Human
acugccucucccuggcccu

SEQ ID NO: 2597386 - RNA, 17 nt, Human
acugccucucccuggcc

SEQ ID NO: 2597387 - RNA, 18 nt, Human
acugccucucccuggccc

SEQ ID NO: 2597388 - RNA, 16 nt, Human
acugccucucccuggc

SEQ ID NO: 2597389 - RNA, 15 nt, Human
acugcauuauauuua

SEQ ID NO: 2597390 - RNA, 23 nt, Human
acugcauuaccgcguuguaaaau

SEQ ID NO: 2597391 - RNA, 16 nt, Human
acugcauuagaaauua

SEQ ID NO: 2597392 - RNA, 14 nt, Human
acugcauuauauuu

SEQ ID NO: 2597393 - RNA, 21 nt, Human
acugcauguaccauuugcaug

SEQ ID NO: 2597394 - RNA, 22 nt, Human
acugcauuaccgcguuguaaaa

SEQ ID NO: 2597395 - RNA, 21 nt, Human
acugcauuaccgcguuguaaa

SEQ ID NO: 2597396 - RNA, 20 nt, Human
acugcauuaccgcguuguaa

SEQ ID NO: 2597397 - RNA, 21 nt, Human
acugccuauuuuaauaaacac

SEQ ID NO: 2597398 - RNA, 16 nt, Human
acugccuauuuuaaua

SEQ ID NO: 2597399 - RNA, 16 nt, Human
acugccucagguuccu

SEQ ID NO: 2597400 - RNA, 15 nt, Human
acugccucagguucc

SEQ ID NO: 2597401 - RNA, 13 nt, Human
acugccucagguu

SEQ ID NO: 2597402 - RNA, 12 nt, Human
acugccucaggu

SEQ ID NO: 2597403 - RNA, 15 nt, Human
acugcauugagaacu

SEQ ID NO: 2597404 - RNA, 17 nt, Human
acugccucgaaacacag

SEQ ID NO: 2597405 - RNA, 19 nt, Human
acugccucgaaacacagaa

SEQ ID NO: 2597406 - RNA, 22 nt, Human
acugccucgggaaccucacucu

SEQ ID NO: 2597407 - RNA, 15 nt, Human
acugcauguuuguga

SEQ ID NO: 2597408 - RNA, 16 nt, Human
acugcauguuugugau

SEQ ID NO: 2597409 - RNA, 18 nt, Human
acugcaugcacuucuuac

SEQ ID NO: 2597410 - RNA, 13 nt, Human
acugcaugcugcu

SEQ ID NO: 2597411 - RNA, 16 nt, Human
acugcaugcugcugga

SEQ ID NO: 2597412 - RNA, 17 nt, Human
acugcaugcugcuggac

SEQ ID NO: 2597413 - RNA, 12 nt, Human
acugcaugcacu

SEQ ID NO: 2597414 - RNA, 14 nt, Human
acugcaugcacuuc

SEQ ID NO: 2597415 - RNA, 23 nt, Human
acugcauccuccgccucccgggu

SEQ ID NO: 2597416 - RNA, 22 nt, Human
acugcaucaagaugugacaugu

SEQ ID NO: 2597417 - RNA, 20 nt, Human
acugcaucaagaugugacau

SEQ ID NO: 2597418 - RNA, 20 nt, Human
acugcauacuuuuuaaaugu

SEQ ID NO: 2597419 - RNA, 23 nt, Human
acugcauacuuuuuaaauguaaa

SEQ ID NO: 2597420 - RNA, 17 nt, Human
acugcauccuccgccuc

SEQ ID NO: 2597421 - RNA, 20 nt, Human
acugcauccuccgccucccg

SEQ ID NO: 2597422 - RNA, 23 nt, Human
uccuagagaacgcagcccuagag

SEQ ID NO: 2597423 - RNA, 19 nt, Human
uccuagagaacgcagcccu

SEQ ID NO: 2597424 - RNA, 18 nt, Human
uccuagagaacgcagccc

SEQ ID NO: 2597425 - RNA, 17 nt, Human
uccuagagaacgcagcc

SEQ ID NO: 2597426 - RNA, 21 nt, Human
uccuagaaguuacugaaugca

SEQ ID NO: 2597427 - RNA, 20 nt, Human
uccuagaaguuacugaaugc

SEQ ID NO: 2597428 - RNA, 19 nt, Human
uccuagaaguuacugaaug

SEQ ID NO: 2597429 - RNA, 21 nt, Human
uccuagaaauuccccacccug

SEQ ID NO: 2597430 - RNA, 22 nt, Human
uccuagaaauuccccacccuga

SEQ ID NO: 2597431 - RNA, 13 nt, Human
acugcauacuuuu

SEQ ID NO: 2597432 - RNA, 16 nt, Human
acugcauacuuuuuaa

SEQ ID NO: 2597433 - RNA, 17 nt, Human
acugcauacuuuuuaaa

SEQ ID NO: 2597434 - RNA, 18 nt, Human
acugcauacuuuuuaaau

SEQ ID NO: 2597435 - RNA, 16 nt, Human
acugcauaugaaagga

SEQ ID NO: 2597436 - RNA, 19 nt, Human
uccuagagacagaagcagg

SEQ ID NO: 2597437 - RNA, 18 nt, Human
uccuagagacagaagcag

SEQ ID NO: 2597438 - RNA, 15 nt, Human
uccuagaggaccuga

SEQ ID NO: 2597439 - RNA, 14 nt, Human
uccuagaggaccug

SEQ ID NO: 2597440 - RNA, 17 nt, Human
uccuagagggaggggcc

SEQ ID NO: 2597441 - RNA, 20 nt, Human
uccuagagggaggggccuag

SEQ ID NO: 2597442 - RNA, 20 nt, Human
acugcauaccaaccugggca

SEQ ID NO: 2597443 - RNA, 22 nt, Human
acugcauaccaaccugggcaau

SEQ ID NO: 2597444 - RNA, 22 nt, Human
acugcucccugaagccagccuu

SEQ ID NO: 2597445 - RNA, 21 nt, Human
acugcucccugaagccagccu

SEQ ID NO: 2597446 - RNA, 20 nt, Human
acugcucccugaagccagcc

SEQ ID NO: 2597447 - RNA, 19 nt, Human
acugcucccugaagccagc

SEQ ID NO: 2597448 - RNA, 18 nt, Human
acugcucccugaagccag

SEQ ID NO: 2597449 - RNA, 17 nt, Human
acugcucccugaagcca

SEQ ID NO: 2597450 - RNA, 16 nt, Human
acugcucccugaagcc

SEQ ID NO: 2597451 - RNA, 15 nt, Human
acugcucccugaagc

SEQ ID NO: 2597452 - RNA, 23 nt, Human
acugcucccugaagccagccuuc

SEQ ID NO: 2597453 - RNA, 15 nt, Human
acugcuggcugccuu

SEQ ID NO: 2597454 - RNA, 14 nt, Human
acugcuggcugccu

SEQ ID NO: 2597455 - RNA, 20 nt, Human
acugcuggguggcccauccc

SEQ ID NO: 2597456 - RNA, 19 nt, Human
acugcuggguggcccaucc

SEQ ID NO: 2597457 - RNA, 18 nt, Human
acugcuggguggcccauc

SEQ ID NO: 2597458 - RNA, 17 nt, Human
acugcuggguggcccau

SEQ ID NO: 2597459 - RNA, 16 nt, Human
acugcuggguggccca

SEQ ID NO: 2597460 - RNA, 13 nt, Human
acugcuggguggc

SEQ ID NO: 2597461 - RNA, 12 nt, Human
acugcugggugg

SEQ ID NO: 2597462 - RNA, 13 nt, Human
acugcugggacug

SEQ ID NO: 2597463 - RNA, 18 nt, Human
acugcugggacuggccag

SEQ ID NO: 2597464 - RNA, 19 nt, Human
acugcugggacuggccagg

SEQ ID NO: 2597465 - RNA, 18 nt, Human
acugcuuaacuucacaua

SEQ ID NO: 2597466 - RNA, 21 nt, Human
acugcugugcugugcccaagu

SEQ ID NO: 2597467 - RNA, 22 nt, Human
acugcuguaaauaaaugcuuua

SEQ ID NO: 2597468 - RNA, 15 nt, Human
acugcuaaauaaaau

SEQ ID NO: 2597469 - RNA, 14 nt, Human
acugcuaaauaaaa

SEQ ID NO: 2597470 - RNA, 13 nt, Human
acugcuaaauaaa

SEQ ID NO: 2597471 - RNA, 23 nt, Human
acugccuucgcuucuugccucug

SEQ ID NO: 2597472 - RNA, 20 nt, Human
acugccuucucaacuccaaa

SEQ ID NO: 2597473 - RNA, 19 nt, Human
acugccuucucaacuccaa

SEQ ID NO: 2597474 - RNA, 13 nt, Human
acugccuucucaa

SEQ ID NO: 2597475 - RNA, 20 nt, Human
acugcuaaauaaaauuuguu

SEQ ID NO: 2597476 - RNA, 19 nt, Human
acugcuaaauaaaauuugu

SEQ ID NO: 2597477 - RNA, 17 nt, Human
acugcuaaauaaaauuu

SEQ ID NO: 2597478 - RNA, 16 nt, Human
acugcuaaauaaaauu

SEQ ID NO: 2597479 - RNA, 16 nt, Human
acugcuaagaauauuu

SEQ ID NO: 2597480 - RNA, 18 nt, Human
acugcuaagaauauuuga

SEQ ID NO: 2597481 - RNA, 21 nt, Human
acugcuccccagcccuggcuc

SEQ ID NO: 2597482 - RNA, 20 nt, Human
acugcuccccagcccuggcu

SEQ ID NO: 2597483 - RNA, 19 nt, Human
acugcuccccagcccuggc

SEQ ID NO: 2597484 - RNA, 13 nt, Human
acugcuacuguaa

SEQ ID NO: 2597485 - RNA, 19 nt, Human
acugcuaaguauuucccag

SEQ ID NO: 2597486 - RNA, 18 nt, Human
acugcuaaguauuuccca

SEQ ID NO: 2597487 - RNA, 17 nt, Human
acugcuaaguauuuccc

SEQ ID NO: 2597488 - RNA, 20 nt, Human
acugcuaaguauuucccagc

SEQ ID NO: 2597489 - RNA, 23 nt, Human
acugcuacaaauacucuuaggaa

SEQ ID NO: 2597490 - RNA, 19 nt, Human
acuggcacaguuuucugag

SEQ ID NO: 2597491 - RNA, 20 nt, Human
acuggcacaguuuucugaga

SEQ ID NO: 2597492 - RNA, 21 nt, Human
acuggcauugucccugugccu

SEQ ID NO: 2597493 - RNA, 17 nt, Human
acuggcauugucccugu

SEQ ID NO: 2597494 - RNA, 15 nt, Human
acuggccaccaggcu

SEQ ID NO: 2597495 - RNA, 14 nt, Human
acuggccaccaggc

SEQ ID NO: 2597496 - RNA, 16 nt, Human
acuggccacaguuguu

SEQ ID NO: 2597497 - RNA, 13 nt, Human
acuggcacaguuu

SEQ ID NO: 2597498 - RNA, 14 nt, Human
acuggaugaagauu

SEQ ID NO: 2597499 - RNA, 17 nt, Human
acuggaugcagaaacag

SEQ ID NO: 2597500 - RNA, 18 nt, Human
acuggaugcagaaacagu

SEQ ID NO: 2597501 - RNA, 15 nt, Human
acuggauuaaacuua

SEQ ID NO: 2597502 - RNA, 13 nt, Human
acuggaugaagau

SEQ ID NO: 2597503 - RNA, 22 nt, Human
acuggaugaaauaacuccuucu

SEQ ID NO: 2597504 - RNA, 11 nt, Human
acuggaugaaa

SEQ ID NO: 2597505 - RNA, 10 nt, Human
acuggaugaa

SEQ ID NO: 2597506 - RNA, 19 nt, Human
acuggaguucuaugcucuc

SEQ ID NO: 2597507 - RNA, 18 nt, Human
acuggauacugcccgggg

SEQ ID NO: 2597508 - RNA, 20 nt, Human
acugcuuaacuucacauauu

SEQ ID NO: 2597509 - RNA, 17 nt, Human
acugcuuccagugaggc

SEQ ID NO: 2597510 - RNA, 21 nt, Human
acugcuugugaaaggaaagag

SEQ ID NO: 2597511 - RNA, 16 nt, Human
acugcuuguguuuuua

SEQ ID NO: 2597512 - RNA, 15 nt, Human
acuggaguucuaugc

SEQ ID NO: 2597513 - RNA, 13 nt, Human
acuggaguucuau

SEQ ID NO: 2597514 - RNA, 17 nt, Human
acuggaguuacauuaau

SEQ ID NO: 2597515 - RNA, 16 nt, Human
acuggaguuacauuaa

SEQ ID NO: 2597516 - RNA, 15 nt, Human
acuggaguuacauua

SEQ ID NO: 2597517 - RNA, 14 nt, Human
acuggaguuacauu

SEQ ID NO: 2597518 - RNA, 17 nt, Human
acugcuuucuuucguuu

SEQ ID NO: 2597519 - RNA, 23 nt, Human
acugcuuucuuucguuuguuugu

SEQ ID NO: 2597520 - RNA, 19 nt, Human
acugcuucaugacauuccu

SEQ ID NO: 2597521 - RNA, 16 nt, Human
acugcuuguuuccuag

SEQ ID NO: 2597522 - RNA, 13 nt, Human
acugcuuguuucc

SEQ ID NO: 2597523 - RNA, 18 nt, Human
acugcuuguguuuuuaac

SEQ ID NO: 2597524 - RNA, 23 nt, Human
acugucccucaaaugacccaaag

SEQ ID NO: 2597525 - RNA, 15 nt, Human
acugugcuggagcca

SEQ ID NO: 2597526 - RNA, 18 nt, Human
acugucagccgggcccug

SEQ ID NO: 2597527 - RNA, 16 nt, Human
acugucccuugccuca

SEQ ID NO: 2597528 - RNA, 21 nt, Human
acugugcuggagccacuaacu

SEQ ID NO: 2597529 - RNA, 18 nt, Human
acugugcuggagccacua

SEQ ID NO: 2597530 - RNA, 22 nt, Human
acugugcuggagccacuaacua

SEQ ID NO: 2597531 - RNA, 22 nt, Human
acugugcuuucuauuguacaga

SEQ ID NO: 2597532 - RNA, 21 nt, Human
acugugcuuucuauuguacag

SEQ ID NO: 2597533 - RNA, 20 nt, Human
acugugcuuucuauuguaca

SEQ ID NO: 2597534 - RNA, 14 nt, Human
acugugcuuucuau

SEQ ID NO: 2597535 - RNA, 13 nt, Human
acugugcuuucua

SEQ ID NO: 2597536 - RNA, 12 nt, Human
acugugcuuucu

SEQ ID NO: 2597537 - RNA, 11 nt, Human
acugugcuuuc

SEQ ID NO: 2597538 - RNA, 14 nt, Human
acuguggaaaaaua

SEQ ID NO: 2597539 - RNA, 15 nt, Human
acuguggaaaaauau

SEQ ID NO: 2597540 - RNA, 17 nt, Human
acuguggaaaaauauuu

SEQ ID NO: 2597541 - RNA, 19 nt, Human
acuguggaaaaauauuuaa

SEQ ID NO: 2597542 - RNA, 18 nt, Human
acugucacuuugcucugg

SEQ ID NO: 2597543 - RNA, 15 nt, Human
acugucacuuugcuc

SEQ ID NO: 2597544 - RNA, 19 nt, Human
acugucacuuugcucuggg

SEQ ID NO: 2597545 - RNA, 16 nt, Human
acugucagccgggccc

SEQ ID NO: 2597546 - RNA, 20 nt, Human
acugucccucaaaugaccca

SEQ ID NO: 2597547 - RNA, 17 nt, Human
acuguccuacccacccu

SEQ ID NO: 2597548 - RNA, 23 nt, Human
acuguccuacccacccuccuuuc

SEQ ID NO: 2597549 - RNA, 18 nt, Human
acuguccuacccacccuc

SEQ ID NO: 2597550 - RNA, 18 nt, Human
acugggacaggggagaac

SEQ ID NO: 2597551 - RNA, 16 nt, Human
acugggagaaaugaaa

SEQ ID NO: 2597552 - RNA, 21 nt, Human
acuggcuuuuauuaaugcacu

SEQ ID NO: 2597553 - RNA, 20 nt, Human
acuggcuuuuauuaaugcac

SEQ ID NO: 2597554 - RNA, 23 nt, Human
acuggcuuuuauuaaugcacuuu

SEQ ID NO: 2597555 - RNA, 19 nt, Human
acugggaagauaggcucug

SEQ ID NO: 2597556 - RNA, 22 nt, Human
acugggaagauaggcucugcac

SEQ ID NO: 2597557 - RNA, 23 nt, Human
acugggaagauaggcucugcaca

SEQ ID NO: 2597558 - RNA, 16 nt, Human
acugggaagugacuua

SEQ ID NO: 2597559 - RNA, 15 nt, Human
acugucacuguuccu

SEQ ID NO: 2597560 - RNA, 24 nt, Human
acugucacucauugcugagccucu

SEQ ID NO: 2597561 - RNA, 21 nt, Human
acugggaccuuuagugguggc

SEQ ID NO: 2597562 - RNA, 23 nt, Human
acugucacucauugcugagccuc

SEQ ID NO: 2597563 - RNA, 21 nt, Human
acugucagcuccccucggaga

SEQ ID NO: 2597564 - RNA, 15 nt, Human
acugucacuguuucu

SEQ ID NO: 2597565 - RNA, 16 nt, Human
acugucacuguuucuc

SEQ ID NO: 2597566 - RNA, 20 nt, Human
acugucacuguuucucugcu

SEQ ID NO: 2597567 - RNA, 21 nt, Human
acugucacuguuucucugcug

SEQ ID NO: 2597568 - RNA, 18 nt, Human
acuguggaggaaggauug

SEQ ID NO: 2597569 - RNA, 17 nt, Human
acuguggaggaaggauu

SEQ ID NO: 2597570 - RNA, 16 nt, Human
acuguggaggaaggau

SEQ ID NO: 2597571 - RNA, 15 nt, Human
acuguggaggaagga

SEQ ID NO: 2597572 - RNA, 12 nt, Human
acuguggaggaa

SEQ ID NO: 2597573 - RNA, 18 nt, Human
acuguggguagacacaca

SEQ ID NO: 2597574 - RNA, 14 nt, Human
acugugguccuaug

SEQ ID NO: 2597575 - RNA, 12 nt, Human
acuguguacaua

SEQ ID NO: 2597576 - RNA, 16 nt, Human
acuguguacauaacug

SEQ ID NO: 2597577 - RNA, 18 nt, Human
acuguguacauaacugaa

SEQ ID NO: 2597578 - RNA, 21 nt, Human
acugugugcucaggagcccug

SEQ ID NO: 2597579 - RNA, 20 nt, Human
acugugugcucaggagcccu

SEQ ID NO: 2597580 - RNA, 19 nt, Human
acugugugcucaggagccc

SEQ ID NO: 2597581 - RNA, 15 nt, Human
acugugugcucagga

SEQ ID NO: 2597582 - RNA, 23 nt, Human
acuguguacaguaaauggcuuau

SEQ ID NO: 2597583 - RNA, 17 nt, Human
acuguguacauaacuga

SEQ ID NO: 2597584 - RNA, 12 nt, Human
acuguguauaga

SEQ ID NO: 2597585 - RNA, 15 nt, Human
acuguguauuccaag

SEQ ID NO: 2597586 - RNA, 16 nt, Human
acuguguauuccaaga

SEQ ID NO: 2597587 - RNA, 12 nt, Human
acugugugcuca

SEQ ID NO: 2597588 - RNA, 16 nt, Human
acuguguccuggugcu

SEQ ID NO: 2597589 - RNA, 14 nt, Human
acuguguccuggug

SEQ ID NO: 2597590 - RNA, 21 nt, Human
acuguguauuccaagacaugu

SEQ ID NO: 2597591 - RNA, 13 nt, Human
acuguguccuggu

SEQ ID NO: 2597592 - RNA, 22 nt, Human
ucggguuuuauuguuuaaaauc

SEQ ID NO: 2597593 - RNA, 21 nt, Human
ucgguaaguugaauggccugc

SEQ ID NO: 2597594 - RNA, 16 nt, Human
ucgggggcuggccuag

SEQ ID NO: 2597595 - RNA, 13 nt, Human
ucgggggcuggcc

SEQ ID NO: 2597596 - RNA, 12 nt, Human
ucgggcuccugu

SEQ ID NO: 2597597 - RNA, 16 nt, Human
ucggggggacagcucc

SEQ ID NO: 2597598 - RNA, 13 nt, Human
ucgggcccuuccc

SEQ ID NO: 2597599 - RNA, 12 nt, Human
ucgggcaugaca

SEQ ID NO: 2597600 - RNA, 11 nt, Human
ucgggcaugac

SEQ ID NO: 2597601 - RNA, 14 nt, Human
ucgggcccagcccc

SEQ ID NO: 2597602 - RNA, 12 nt, Human
ucgggcccagcc

SEQ ID NO: 2597603 - RNA, 11 nt, Human
ucgggcccagc

SEQ ID NO: 2597604 - RNA, 21 nt, Human
ucgggcccaccuggccaccug

SEQ ID NO: 2597605 - RNA, 17 nt, Human
ucgggcccaggccaucu

SEQ ID NO: 2597606 - RNA, 15 nt, Human
ucgggcccagccccc

SEQ ID NO: 2597607 - RNA, 18 nt, Human
ucgggcccaccuggccac

SEQ ID NO: 2597608 - RNA, 17 nt, Human
ucgggcccaccuggcca

SEQ ID NO: 2597609 - RNA, 14 nt, Human
ucgggcccaccugg

SEQ ID NO: 2597610 - RNA, 18 nt, Human
ucggcucacugcauccuc

SEQ ID NO: 2597611 - RNA, 10 nt, Human
acugugugug

SEQ ID NO: 2597612 - RNA, 19 nt, Human
acuguguggacugugaugc

SEQ ID NO: 2597613 - RNA, 21 nt, Human
acuguguccuggugcucucug

SEQ ID NO: 2597614 - RNA, 19 nt, Human
acugugugcagacucaaua

SEQ ID NO: 2597615 - RNA, 17 nt, Human
acuguguggacugugau

SEQ ID NO: 2597616 - RNA, 18 nt, Human
acuguguggacugugaug

SEQ ID NO: 2597617 - RNA, 14 nt, Human
ucggcuccugcugc

SEQ ID NO: 2597618 - RNA, 13 nt, Human
ucggcuccugcug

SEQ ID NO: 2597619 - RNA, 12 nt, Human
ucggcuccugcu

SEQ ID NO: 2597620 - RNA, 11 nt, Human
ucggcuccugc

SEQ ID NO: 2597621 - RNA, 14 nt, Human
ucggcucccuggag

SEQ ID NO: 2597622 - RNA, 12 nt, Human
ucggcucccugg

SEQ ID NO: 2597623 - RNA, 19 nt, Human
ucggcuccccauguguccu

SEQ ID NO: 2597624 - RNA, 18 nt, Human
ucggcuccugcugcacca

SEQ ID NO: 2597625 - RNA, 17 nt, Human
ucggcuccugcugcacc

SEQ ID NO: 2597626 - RNA, 16 nt, Human
ucggcuccugcugcac

SEQ ID NO: 2597627 - RNA, 15 nt, Human
ucggcuccugcugca

SEQ ID NO: 2597628 - RNA, 15 nt, Human
ucggcugaccaugcu

SEQ ID NO: 2597629 - RNA, 17 nt, Human
ucgggaggucgaggcag

SEQ ID NO: 2597630 - RNA, 16 nt, Human
ucggcugaccaugcuc

SEQ ID NO: 2597631 - RNA, 17 nt, Human
ucggcuuuucucagcug

SEQ ID NO: 2597632 - RNA, 14 nt, Human
ucgggaacaguguu

SEQ ID NO: 2597633 - RNA, 19 nt, Human
ucgggaggucgaggcagga

SEQ ID NO: 2597634 - RNA, 21 nt, Human
ucgggaggucgaggcaggagg

SEQ ID NO: 2597635 - RNA, 20 nt, Human
ucgguauccccccaucuugc

SEQ ID NO: 2597636 - RNA, 16 nt, Human
ucgguagguucagcca

SEQ ID NO: 2597637 - RNA, 13 nt, Human
ucgguacucccau

SEQ ID NO: 2597638 - RNA, 13 nt, Human
ucguaaaauuaag

SEQ ID NO: 2597639 - RNA, 22 nt, Human
ucgguggagacuaucagcccaa

SEQ ID NO: 2597640 - RNA, 16 nt, Human
ucguaaaauuaagaaa

SEQ ID NO: 2597641 - RNA, 23 nt, Human
ucgguuccacgucccccuggggc

SEQ ID NO: 2597642 - RNA, 15 nt, Human
ucgguuccacguccc

SEQ ID NO: 2597643 - RNA, 13 nt, Human
ucgguuucuccaa

SEQ ID NO: 2597644 - RNA, 19 nt, Human
ucguuucaaaaacacagug

SEQ ID NO: 2597645 - RNA, 19 nt, Human
ucgguuucuaacuuggagc

SEQ ID NO: 2597646 - RNA, 22 nt, Human
ucguuuucaaaauuguuacaaa

SEQ ID NO: 2597647 - RNA, 13 nt, Human
ucguuucuguaua

SEQ ID NO: 2597648 - RNA, 12 nt, Human
ucguuucuguau

SEQ ID NO: 2597649 - RNA, 21 nt, Human
ucguuucaaaaacacaguguu

SEQ ID NO: 2597650 - RNA, 17 nt, Human
ucguuugaaucacagua

SEQ ID NO: 2597651 - RNA, 20 nt, Human
ucuaaaacuaaauagcaugu

SEQ ID NO: 2597652 - RNA, 17 nt, Human
ucuaaaacuaaauagca

SEQ ID NO: 2597653 - RNA, 21 nt, Human
ucuaaaacuaaauagcaugua

SEQ ID NO: 2597654 - RNA, 15 nt, Human
ucuaaaacuaaauag

SEQ ID NO: 2597655 - RNA, 15 nt, Human
ucuaaaacaauaaaa

SEQ ID NO: 2597656 - RNA, 11 nt, Human
ucuaaaacaau

SEQ ID NO: 2597657 - RNA, 18 nt, Human
ucuaaaaaacagaggcca

SEQ ID NO: 2597658 - RNA, 14 nt, Human
ucuaaaaacaccaa

SEQ ID NO: 2597659 - RNA, 16 nt, Human
ucuaaaagguucaggg

SEQ ID NO: 2597660 - RNA, 17 nt, Human
ucuaaaagauccuuuuu

SEQ ID NO: 2597661 - RNA, 11 nt, Human
ucuaaaagaaa

SEQ ID NO: 2597662 - RNA, 23 nt, Human
ucuaaaagguucagggaaccguu

SEQ ID NO: 2597663 - RNA, 13 nt, Human
ucuaaaaugaguu

SEQ ID NO: 2597664 - RNA, 17 nt, Human
acuuaaauaaugugaaa

SEQ ID NO: 2597665 - RNA, 18 nt, Human
acuuaaauaaugugaaac

SEQ ID NO: 2597666 - RNA, 16 nt, Human
acuuaaauaaugugaa

SEQ ID NO: 2597667 - RNA, 15 nt, Human
acuuaaauaauguga

SEQ ID NO: 2597668 - RNA, 12 nt, Human
acuguuguauaa

SEQ ID NO: 2597669 - RNA, 17 nt, Human
acuuaauacuaccuuga

SEQ ID NO: 2597670 - RNA, 18 nt, Human
acuuaauacuaccuugaa

SEQ ID NO: 2597671 - RNA, 19 nt, Human
acuuaauacuaccuugaaa

SEQ ID NO: 2597672 - RNA, 21 nt, Human
acuuaauacuaccuugaaaau

SEQ ID NO: 2597673 - RNA, 17 nt, Human
acuuaauaauguguaca

SEQ ID NO: 2597674 - RNA, 13 nt, Human
acuuaauaaugug

SEQ ID NO: 2597675 - RNA, 20 nt, Human
acuguuguaacuaggcucag

SEQ ID NO: 2597676 - RNA, 15 nt, Human
acuuaaguuaaacau

SEQ ID NO: 2597677 - RNA, 17 nt, Human
acuuaagggagaaaaaa

SEQ ID NO: 2597678 - RNA, 19 nt, Human
acuuaaguugguccuuuac

SEQ ID NO: 2597679 - RNA, 13 nt, Human
acuuaauaaauuc

SEQ ID NO: 2597680 - RNA, 17 nt, Human
acuuaauaaauucagau

SEQ ID NO: 2597681 - RNA, 22 nt, Human
acuguugggguggguauaaaag

SEQ ID NO: 2597682 - RNA, 21 nt, Human
acuguugggguggguauaaaa

SEQ ID NO: 2597683 - RNA, 20 nt, Human
acuguugggguggguauaaa

SEQ ID NO: 2597684 - RNA, 21 nt, Human
acuguugcucaaaucuauuca

SEQ ID NO: 2597685 - RNA, 12 nt, Human
acuguugcucaa

SEQ ID NO: 2597686 - RNA, 21 nt, Human
acuguucucuucuugaacacu

SEQ ID NO: 2597687 - RNA, 18 nt, Human
acuguugggguggguaua

SEQ ID NO: 2597688 - RNA, 18 nt, Human
acuguugcccaggcuggc

SEQ ID NO: 2597689 - RNA, 17 nt, Human
acuguugcccaggcugg

SEQ ID NO: 2597690 - RNA, 14 nt, Human
acuguugcccaggc

SEQ ID NO: 2597691 - RNA, 13 nt, Human
acuguugcccagg

SEQ ID NO: 2597692 - RNA, 17 nt, Human
acuguucugugucuuuc

SEQ ID NO: 2597693 - RNA, 16 nt, Human
acuguucugugucuuu

SEQ ID NO: 2597694 - RNA, 15 nt, Human
acuguucugugucuu

SEQ ID NO: 2597695 - RNA, 13 nt, Human
acuguucuguguc

SEQ ID NO: 2597696 - RNA, 12 nt, Human
acuguugcccag

SEQ ID NO: 2597697 - RNA, 12 nt, Human
acuuagaggaaa

SEQ ID NO: 2597698 - RNA, 18 nt, Human
acuuagaauaaaauugua

SEQ ID NO: 2597699 - RNA, 17 nt, Human
acuuagaauaaaauugu

SEQ ID NO: 2597700 - RNA, 22 nt, Human
acuuagaauaaaauuguaaaau

SEQ ID NO: 2597701 - RNA, 16 nt, Human
acuuacuugcuuauuu

SEQ ID NO: 2597702 - RNA, 14 nt, Human
acuuacuugcuuau

SEQ ID NO: 2597703 - RNA, 15 nt, Human
acuuagaaagcaggg

SEQ ID NO: 2597704 - RNA, 16 nt, Human
acuuagaauaaaauug

SEQ ID NO: 2597705 - RNA, 15 nt, Human
acuuagaauaaaauu

SEQ ID NO: 2597706 - RNA, 19 nt, Human
acuuagaaagcaggggcua

SEQ ID NO: 2597707 - RNA, 16 nt, Human
acuuagaaagcagggg

SEQ ID NO: 2597708 - RNA, 16 nt, Human
acuuagaaauugcauu

SEQ ID NO: 2597709 - RNA, 17 nt, Human
acuuauaauuuuccuaa

SEQ ID NO: 2597710 - RNA, 20 nt, Human
acuuagugcggacaaguuuu

SEQ ID NO: 2597711 - RNA, 14 nt, Human
acuucagcucuguu

SEQ ID NO: 2597712 - RNA, 13 nt, Human
acuuaaucuaaau

SEQ ID NO: 2597713 - RNA, 14 nt, Human
acuuaauagaaaca

SEQ ID NO: 2597714 - RNA, 15 nt, Human
acuuaauagaaacau

SEQ ID NO: 2597715 - RNA, 18 nt, Human
acuuaaucaauuaauuuu

SEQ ID NO: 2597716 - RNA, 19 nt, Human
acuuaaucaauuaauuuuu

SEQ ID NO: 2597717 - RNA, 15 nt, Human
acuuaaucuaaaugg

SEQ ID NO: 2597718 - RNA, 16 nt, Human
acuuaaucuaaaugga

SEQ ID NO: 2597719 - RNA, 15 nt, Human
acuuaccuucaauaa

SEQ ID NO: 2597720 - RNA, 16 nt, Human
acuuaccuucaauaaa

SEQ ID NO: 2597721 - RNA, 19 nt, Human
acuuaccuaaacagauaua

SEQ ID NO: 2597722 - RNA, 17 nt, Human
acuuaccuagauuuaca

SEQ ID NO: 2597723 - RNA, 15 nt, Human
acuuacuugcuuauu

SEQ ID NO: 2597724 - RNA, 17 nt, Human
acuuaccuucaauaaag

SEQ ID NO: 2597725 - RNA, 19 nt, Human
acuuaccuucaauaaagua

SEQ ID NO: 2597726 - RNA, 20 nt, Human
acuuaccuucaauaaaguau

SEQ ID NO: 2597727 - RNA, 17 nt, Human
acuuacaugauucauuu

SEQ ID NO: 2597728 - RNA, 18 nt, Human
acuuacaugauucauuuu

SEQ ID NO: 2597729 - RNA, 19 nt, Human
acuuacaugauucauuuua

SEQ ID NO: 2597730 - RNA, 14 nt, Human
acuuacaugauuca

SEQ ID NO: 2597731 - RNA, 23 nt, Human
acuuacauuguucaauuagaaua

SEQ ID NO: 2597732 - RNA, 21 nt, Human
acuuaccgugagcgacaaaga

SEQ ID NO: 2597733 - RNA, 16 nt, Human
acuuaccauaugugcu

SEQ ID NO: 2597734 - RNA, 21 nt, Human
ucuaaguaaaaccacagcagu

SEQ ID NO: 2597735 - RNA, 22 nt, Human
ucuaaguaaaaccacagcaguu

SEQ ID NO: 2597736 - RNA, 21 nt, Human
ucuacagugguuuuauacuga

SEQ ID NO: 2597737 - RNA, 13 nt, Human
ucuacagugguuu

SEQ ID NO: 2597738 - RNA, 12 nt, Human
ucuacagugguu

SEQ ID NO: 2597739 - RNA, 23 nt, Human
ucuaaguaaaaccacagcaguug

SEQ ID NO: 2597740 - RNA, 20 nt, Human
ucuacauaaguaauucaaga

SEQ ID NO: 2597741 - RNA, 17 nt, Human
ucuacauaaguaauuca

SEQ ID NO: 2597742 - RNA, 16 nt, Human
ucuacauacuauggaa

SEQ ID NO: 2597743 - RNA, 14 nt, Human
ucuaaagcugccag

SEQ ID NO: 2597744 - RNA, 13 nt, Human
ucuaaagcugcca

SEQ ID NO: 2597745 - RNA, 20 nt, Human
ucuaaagccauuguaguccu

SEQ ID NO: 2597746 - RNA, 15 nt, Human
ucuaaagcugccagc

SEQ ID NO: 2597747 - RNA, 18 nt, Human
ucuaaagccuuaagucuu

SEQ ID NO: 2597748 - RNA, 16 nt, Human
ucuaaagcugccagcc

SEQ ID NO: 2597749 - RNA, 20 nt, Human
ucuaaggaugucacagggcc

SEQ ID NO: 2597750 - RNA, 23 nt, Human
ucuaaggaugucacagggccaac

SEQ ID NO: 2597751 - RNA, 19 nt, Human
ucuaaggaugucacagggc

SEQ ID NO: 2597752 - RNA, 18 nt, Human
ucuaagccuuuccauaag

SEQ ID NO: 2597753 - RNA, 16 nt, Human
acuguucccugaggug

SEQ ID NO: 2597754 - RNA, 19 nt, Human
acuguucccugagguggga

SEQ ID NO: 2597755 - RNA, 13 nt, Human
acuguuauuuaua

SEQ ID NO: 2597756 - RNA, 18 nt, Human
acuguucccucugcuccu

SEQ ID NO: 2597757 - RNA, 14 nt, Human
acuguucucugccc

SEQ ID NO: 2597758 - RNA, 22 nt, Human
acuguucccucugcuccuggag

SEQ ID NO: 2597759 - RNA, 20 nt, Human
acuguucccucugcuccugg

SEQ ID NO: 2597760 - RNA, 20 nt, Human
acuguucucugcccuccaag

SEQ ID NO: 2597761 - RNA, 15 nt, Human
acuguucucugcccu

SEQ ID NO: 2597762 - RNA, 21 nt, Human
acuguucucugcccuccaaga

SEQ ID NO: 2597763 - RNA, 18 nt, Human
acuguucucuucuugaac

SEQ ID NO: 2597764 - RNA, 22 nt, Human
ucuacagugguuuuauacugaa

SEQ ID NO: 2597765 - RNA, 23 nt, Human
ucuacagugguuuuauacugaag

SEQ ID NO: 2597766 - RNA, 22 nt, Human
ucuacauaaguaauucaagaaa

SEQ ID NO: 2597767 - RNA, 13 nt, Human
ucuaccagacugu

SEQ ID NO: 2597768 - RNA, 20 nt, Human
ucuaccaagcuauccuggcu

SEQ ID NO: 2597769 - RNA, 22 nt, Human
ucuaccagccucccuauuuuuu

SEQ ID NO: 2597770 - RNA, 17 nt, Human
ucuaccagacuguguau

SEQ ID NO: 2597771 - RNA, 16 nt, Human
ucuaccagacugugua

SEQ ID NO: 2597772 - RNA, 19 nt, Human
ucuaccaugaacagaaaac

SEQ ID NO: 2597773 - RNA, 14 nt, Human
ucuaccauuucaga

SEQ ID NO: 2597774 - RNA, 15 nt, Human
ucuaccauuucagag

SEQ ID NO: 2597775 - RNA, 18 nt, Human
ucuaccauuucagagagg

SEQ ID NO: 2597776 - RNA, 21 nt, Human
ucuaccagacuguguauucau

SEQ ID NO: 2597777 - RNA, 23 nt, Human
acuguuaccugaucaaugacaga

SEQ ID NO: 2597778 - RNA, 21 nt, Human
acuguuaccugaucaaugaca

SEQ ID NO: 2597779 - RNA, 22 nt, Human
ucuacccagagaagccccuucc

SEQ ID NO: 2597780 - RNA, 21 nt, Human
ucuacccaaaggauacuguaa

SEQ ID NO: 2597781 - RNA, 13 nt, Human
ucuacccaaagga

SEQ ID NO: 2597782 - RNA, 20 nt, Human
acuguuagaaaauggacacu

SEQ ID NO: 2597783 - RNA, 23 nt, Human
acuguuaugaaauaaagaaauug

SEQ ID NO: 2597784 - RNA, 19 nt, Human
acuguuaugaaauaaagaa

SEQ ID NO: 2597785 - RNA, 21 nt, Human
ucuccuccuuuucacaguucu

SEQ ID NO: 2597786 - RNA, 23 nt, Human
ucuccucccuuccuuuucccugc

SEQ ID NO: 2597787 - RNA, 14 nt, Human
ucuccuccugccca

SEQ ID NO: 2597788 - RNA, 16 nt, Human
ucuccuccugcccacc

SEQ ID NO: 2597789 - RNA, 16 nt, Human
ucuccucgcaagcugg

SEQ ID NO: 2597790 - RNA, 21 nt, Human
ucuccucggcccccuccaucg

SEQ ID NO: 2597791 - RNA, 14 nt, Human
ucuccucggccccc

SEQ ID NO: 2597792 - RNA, 16 nt, Human
ucuccucucagccccu

SEQ ID NO: 2597793 - RNA, 13 nt, Human
ucuccucuccccu

SEQ ID NO: 2597794 - RNA, 14 nt, Human
ucuccucccuuccu

SEQ ID NO: 2597795 - RNA, 13 nt, Human
ucuccucccuucc

SEQ ID NO: 2597796 - RNA, 18 nt, Human
ucuccuccccacccgccc

SEQ ID NO: 2597797 - RNA, 15 nt, Human
ucuccuccccacccg

SEQ ID NO: 2597798 - RNA, 12 nt, Human
ucuccuccccaa

SEQ ID NO: 2597799 - RNA, 12 nt, Human
ucuccucccagg

SEQ ID NO: 2597800 - RNA, 16 nt, Human
ucuccuccaugggaga

SEQ ID NO: 2597801 - RNA, 19 nt, Human
ucuccuauguguaagguga

SEQ ID NO: 2597802 - RNA, 20 nt, Human
ucuccuccaugggagaaaau

SEQ ID NO: 2597803 - RNA, 15 nt, Human
ucuccuauguguaag

SEQ ID NO: 2597804 - RNA, 14 nt, Human
ucuccuauguguaa

SEQ ID NO: 2597805 - RNA, 20 nt, Human
ucuccucaaguccccaagau

SEQ ID NO: 2597806 - RNA, 16 nt, Human
acuuguguuuugcaag

SEQ ID NO: 2597807 - RNA, 16 nt, Human
ucuccucuccccucua

SEQ ID NO: 2597808 - RNA, 23 nt, Human
acuugugugugggcugugagugu

SEQ ID NO: 2597809 - RNA, 15 nt, Human
acuuguuccagcucu

SEQ ID NO: 2597810 - RNA, 16 nt, Human
acuuguuccagcucuu

SEQ ID NO: 2597811 - RNA, 15 nt, Human
acuuuaaaauaaaau

SEQ ID NO: 2597812 - RNA, 17 nt, Human
acuuucuagccagagga

SEQ ID NO: 2597813 - RNA, 17 nt, Human
acuuucuauccucugua

SEQ ID NO: 2597814 - RNA, 13 nt, Human
acuuucucaguuu

SEQ ID NO: 2597815 - RNA, 16 nt, Human
acuuucuagccagagg

SEQ ID NO: 2597816 - RNA, 14 nt, Human
acuuugaccucugc

SEQ ID NO: 2597817 - RNA, 14 nt, Human
acuuucucaguuuu

SEQ ID NO: 2597818 - RNA, 17 nt, Human
acuuucucaguuuucau

SEQ ID NO: 2597819 - RNA, 20 nt, Human
acuuuaaaggaaaaaauguu

SEQ ID NO: 2597820 - RNA, 21 nt, Human
acuuuaaaggaaaaaauguug

SEQ ID NO: 2597821 - RNA, 12 nt, Human
acuuuaaaggaa

SEQ ID NO: 2597822 - RNA, 21 nt, Human
acuuguucaaaauauguucuu

SEQ ID NO: 2597823 - RNA, 17 nt, Human
acuuuaagacugagcac

SEQ ID NO: 2597824 - RNA, 15 nt, Human
acuuuaagcacuaca

SEQ ID NO: 2597825 - RNA, 14 nt, Human
acuuuaagcacuac

SEQ ID NO: 2597826 - RNA, 13 nt, Human
acuuuaagcacua

SEQ ID NO: 2597827 - RNA, 14 nt, Human
acuuuaagaggaca

SEQ ID NO: 2597828 - RNA, 15 nt, Human
acuuuaaguuucagg

SEQ ID NO: 2597829 - RNA, 23 nt, Human
acuuuaagcagcucuugcuaauc

SEQ ID NO: 2597830 - RNA, 19 nt, Human
acuuuaagcagcucuugcu

SEQ ID NO: 2597831 - RNA, 16 nt, Human
acuuuaagcacuacau

SEQ ID NO: 2597832 - RNA, 19 nt, Human
acuuuaauuaccaaccugu

SEQ ID NO: 2597833 - RNA, 18 nt, Human
acuuuaaguuucaggaua

SEQ ID NO: 2597834 - RNA, 23 nt, Human
ucuccuauccugguuuuuguagc

SEQ ID NO: 2597835 - RNA, 17 nt, Human
ucuccuagacugacccu

SEQ ID NO: 2597836 - RNA, 20 nt, Human
ucuccuagagacagaagcag

SEQ ID NO: 2597837 - RNA, 19 nt, Human
ucuccuagagacagaagca

SEQ ID NO: 2597838 - RNA, 23 nt, Human
ucuccuagacugacccugaucag

SEQ ID NO: 2597839 - RNA, 23 nt, Human
ucuccguuagcuccuguggcccc

SEQ ID NO: 2597840 - RNA, 22 nt, Human
ucuccguuagcuccuguggccc

SEQ ID NO: 2597841 - RNA, 21 nt, Human
ucuccguuagcuccuguggcc

SEQ ID NO: 2597842 - RNA, 20 nt, Human
ucuccguuagcuccuguggc

SEQ ID NO: 2597843 - RNA, 11 nt, Human
ucuccccacac

SEQ ID NO: 2597844 - RNA, 13 nt, Human
ucuccccacacua

SEQ ID NO: 2597845 - RNA, 20 nt, Human
ucucccauggagccccagcc

SEQ ID NO: 2597846 - RNA, 18 nt, Human
ucucccauggagccccag

SEQ ID NO: 2597847 - RNA, 15 nt, Human
ucucccauggagccc

SEQ ID NO: 2597848 - RNA, 22 nt, Human
ucucccaucccccugcccucgu

SEQ ID NO: 2597849 - RNA, 22 nt, Human
ucucccauggagccccagcccc

SEQ ID NO: 2597850 - RNA, 21 nt, Human
ucucccauggagccccagccc

SEQ ID NO: 2597851 - RNA, 22 nt, Human
ucucccauggcuuaaugcuucu

SEQ ID NO: 2597852 - RNA, 17 nt, Human
ucucccauugucccucu

SEQ ID NO: 2597853 - RNA, 18 nt, Human
ucucccauugucccucug

SEQ ID NO: 2597854 - RNA, 19 nt, Human
ucucccauugucccucugc

SEQ ID NO: 2597855 - RNA, 10 nt, Human
ucuccccaca

SEQ ID NO: 2597856 - RNA, 18 nt, Human
ucucccaucccccugccc

SEQ ID NO: 2597857 - RNA, 17 nt, Human
ucucccaucccccugcc

SEQ ID NO: 2597858 - RNA, 15 nt, Human
ucucccaucccccug

SEQ ID NO: 2597859 - RNA, 14 nt, Human
ucucccaucccccu

SEQ ID NO: 2597860 - RNA, 20 nt, Human
ucucccaucccccugcccuc

SEQ ID NO: 2597861 - RNA, 19 nt, Human
ucucccaucccccugcccu

SEQ ID NO: 2597862 - RNA, 13 nt, Human
ucucccauggagc

SEQ ID NO: 2597863 - RNA, 23 nt, Human
ucucccauccagugucucacagc

SEQ ID NO: 2597864 - RNA, 11 nt, Human
ucucccaggaa

SEQ ID NO: 2597865 - RNA, 17 nt, Human
ucucccagcucuagaca

SEQ ID NO: 2597866 - RNA, 13 nt, Human
ucucccauccccc

SEQ ID NO: 2597867 - RNA, 12 nt, Human
ucucccaucccc

SEQ ID NO: 2597868 - RNA, 11 nt, Human
ucucccauccc

SEQ ID NO: 2597869 - RNA, 19 nt, Human
ucuccauggcuuccuccuc

SEQ ID NO: 2597870 - RNA, 20 nt, Human
ucuccauggccaccuuuuca

SEQ ID NO: 2597871 - RNA, 20 nt, Human
ucuccauggcuuccuccucc

SEQ ID NO: 2597872 - RNA, 17 nt, Human
ucuccauggcuuccucc

SEQ ID NO: 2597873 - RNA, 16 nt, Human
ucuccauguuugaugu

SEQ ID NO: 2597874 - RNA, 15 nt, Human
ucuccauggcccugc

SEQ ID NO: 2597875 - RNA, 18 nt, Human
ucuccauggcccugcaaa

SEQ ID NO: 2597876 - RNA, 15 nt, Human
ucuccauggccaccu

SEQ ID NO: 2597877 - RNA, 18 nt, Human
ucuccaucuucagcuucu

SEQ ID NO: 2597878 - RNA, 14 nt, Human
ucuccauggcccug

SEQ ID NO: 2597879 - RNA, 14 nt, Human
ucuccaucuguuug

SEQ ID NO: 2597880 - RNA, 18 nt, Human
ucuccaucucucuggccc

SEQ ID NO: 2597881 - RNA, 17 nt, Human
ucuccaucuggcagggu

SEQ ID NO: 2597882 - RNA, 15 nt, Human
ucucccaccccugcc

SEQ ID NO: 2597883 - RNA, 16 nt, Human
ucucccacgugggaga

SEQ ID NO: 2597884 - RNA, 15 nt, Human
ucucccacgugggag

SEQ ID NO: 2597885 - RNA, 14 nt, Human
ucucccacguggga

SEQ ID NO: 2597886 - RNA, 14 nt, Human
ucucccaccuagca

SEQ ID NO: 2597887 - RNA, 16 nt, Human
ucucccagauaaugug

SEQ ID NO: 2597888 - RNA, 18 nt, Human
ucucccagauaaugugaa

SEQ ID NO: 2597889 - RNA, 21 nt, Human
ucucccagauaaugugaaaau

SEQ ID NO: 2597890 - RNA, 23 nt, Human
ucucccagauaaugugaaaaugg

SEQ ID NO: 2597891 - RNA, 19 nt, Human
ucucccacuagacaagucc

SEQ ID NO: 2597892 - RNA, 12 nt, Human
ucucagggccug

SEQ ID NO: 2597893 - RNA, 13 nt, Human
ucucagggccugg

SEQ ID NO: 2597894 - RNA, 12 nt, Human
ucucaggaaauc

SEQ ID NO: 2597895 - RNA, 14 nt, Human
ucucaggcucugcc

SEQ ID NO: 2597896 - RNA, 15 nt, Human
ucucaggcucugccc

SEQ ID NO: 2597897 - RNA, 17 nt, Human
ucucaggcucugcccug

SEQ ID NO: 2597898 - RNA, 18 nt, Human
ucucaggcuggugggagg

SEQ ID NO: 2597899 - RNA, 19 nt, Human
ucucaggcucugcccugcc

SEQ ID NO: 2597900 - RNA, 20 nt, Human
ucucaggcucugcccugccc

SEQ ID NO: 2597901 - RNA, 19 nt, Human
ucucagcucuucugacuua

SEQ ID NO: 2597902 - RNA, 22 nt, Human
ucucagcucccccuguccccuc

SEQ ID NO: 2597903 - RNA, 21 nt, Human
ucucagcucccccuguccccu

SEQ ID NO: 2597904 - RNA, 19 nt, Human
ucucagcucccccuguccc

SEQ ID NO: 2597905 - RNA, 18 nt, Human
ucucagcucccccugucc

SEQ ID NO: 2597906 - RNA, 17 nt, Human
ucucagcucccccuguc

SEQ ID NO: 2597907 - RNA, 22 nt, Human
ucucagcucccauuucuacucu

SEQ ID NO: 2597908 - RNA, 21 nt, Human
ucucagcuccagguggcucug

SEQ ID NO: 2597909 - RNA, 16 nt, Human
ucucagcuccaggugg

SEQ ID NO: 2597910 - RNA, 18 nt, Human
ucucagcucccauuucua

SEQ ID NO: 2597911 - RNA, 17 nt, Human
ucucagcucccauuucu

SEQ ID NO: 2597912 - RNA, 11 nt, Human
ucucagcuccc

SEQ ID NO: 2597913 - RNA, 15 nt, Human
acuuguggacacagc

SEQ ID NO: 2597914 - RNA, 12 nt, Human
ucucagccuccc

SEQ ID NO: 2597915 - RNA, 13 nt, Human
ucucagccuccca

SEQ ID NO: 2597916 - RNA, 19 nt, Human
ucucagggccuggucguuu

SEQ ID NO: 2597917 - RNA, 11 nt, Human
ucucagggcuc

SEQ ID NO: 2597918 - RNA, 19 nt, Human
ucucaggcuggugggaggg

SEQ ID NO: 2597919 - RNA, 14 nt, Human
ucucagggccuggu

SEQ ID NO: 2597920 - RNA, 15 nt, Human
ucucagggccugguc

SEQ ID NO: 2597921 - RNA, 16 nt, Human
ucucauuacuuuugaa

SEQ ID NO: 2597922 - RNA, 12 nt, Human
ucucagggcucc

SEQ ID NO: 2597923 - RNA, 16 nt, Human
ucucauuccagaggaa

SEQ ID NO: 2597924 - RNA, 17 nt, Human
ucucauuccaacaguga

SEQ ID NO: 2597925 - RNA, 19 nt, Human
ucucauuccaacagugagu

SEQ ID NO: 2597926 - RNA, 13 nt, Human
ucucauuccccag

SEQ ID NO: 2597927 - RNA, 19 nt, Human
ucucauuggacccuuccau

SEQ ID NO: 2597928 - RNA, 16 nt, Human
ucucauuccccaggug

SEQ ID NO: 2597929 - RNA, 15 nt, Human
ucucauugcuuacaa

SEQ ID NO: 2597930 - RNA, 14 nt, Human
ucucauuccccagg

SEQ ID NO: 2597931 - RNA, 17 nt, Human
ucuccaaaauaaaacuu

SEQ ID NO: 2597932 - RNA, 19 nt, Human
ucuccaaaauaaaacuuuu

SEQ ID NO: 2597933 - RNA, 22 nt, Human
ucuccaaacugaagcagccucu

SEQ ID NO: 2597934 - RNA, 13 nt, Human
ucuccaaaauaaa

SEQ ID NO: 2597935 - RNA, 22 nt, Human
ucuccaaaauaaaacuuuuuaa

SEQ ID NO: 2597936 - RNA, 20 nt, Human
ucuccaaccccccagcacug

SEQ ID NO: 2597937 - RNA, 19 nt, Human
ucuccaaccccccagcacu

SEQ ID NO: 2597938 - RNA, 18 nt, Human
ucuccaaccccccagcac

SEQ ID NO: 2597939 - RNA, 17 nt, Human
ucuccaaccccccagca

SEQ ID NO: 2597940 - RNA, 23 nt, Human
ucuccaaacugaagcagccucuc

SEQ ID NO: 2597941 - RNA, 12 nt, Human
ucuccaaaugag

SEQ ID NO: 2597942 - RNA, 24 nt, Human
ucuccaaaugagaucuaagccuuu

SEQ ID NO: 2597943 - RNA, 22 nt, Human
ucuccaaccccccagcacugag

SEQ ID NO: 2597944 - RNA, 21 nt, Human
ucuccaaccccccagcacuga

SEQ ID NO: 2597945 - RNA, 23 nt, Human
ucuccaaccccccagcacugagg

SEQ ID NO: 2597946 - RNA, 15 nt, Human
ucuccaaccuggaca

SEQ ID NO: 2597947 - RNA, 16 nt, Human
ucuccaucucucuggc

SEQ ID NO: 2597948 - RNA, 14 nt, Human
ucuccaucucucug

SEQ ID NO: 2597949 - RNA, 11 nt, Human
ucuccaucucu

SEQ ID NO: 2597950 - RNA, 22 nt, Human
ucuccauccuuucugccucuca

SEQ ID NO: 2597951 - RNA, 19 nt, Human
ucuccauccuuucugccuc

SEQ ID NO: 2597952 - RNA, 17 nt, Human
ucuccauccuuucugcc

SEQ ID NO: 2597953 - RNA, 19 nt, Human
ucuccauccacaugggagc

SEQ ID NO: 2597954 - RNA, 13 nt, Human
ucuccauccacau

SEQ ID NO: 2597955 - RNA, 17 nt, Human
ucuccaucagcuguaag

SEQ ID NO: 2597956 - RNA, 15 nt, Human
ucuccauauguuaca

SEQ ID NO: 2597957 - RNA, 13 nt, Human
ucuccaucagcug

SEQ ID NO: 2597958 - RNA, 17 nt, Human
ucuccagugguugcugu

SEQ ID NO: 2597959 - RNA, 18 nt, Human
ucuccagugguugcuguu

SEQ ID NO: 2597960 - RNA, 21 nt, Human
ucuccagggaguccccucccc

SEQ ID NO: 2597961 - RNA, 15 nt, Human
ucuccaguuuucagu

SEQ ID NO: 2597962 - RNA, 20 nt, Human
ucuccauaaccccacccuug

SEQ ID NO: 2597963 - RNA, 18 nt, Human
ucuccauaaccccacccu

SEQ ID NO: 2597964 - RNA, 17 nt, Human
ucuccauaaccccaccc

SEQ ID NO: 2597965 - RNA, 20 nt, Human
ucuccagugguugcuguuga

SEQ ID NO: 2597966 - RNA, 22 nt, Human
ucuccauaaccccacccuugcc

SEQ ID NO: 2597967 - RNA, 21 nt, Human
ucuccauaaccccacccuugc

SEQ ID NO: 2597968 - RNA, 23 nt, Human
ucuccauaaccccacccuugccc

SEQ ID NO: 2597969 - RNA, 14 nt, Human
ucuccauauguuac

SEQ ID NO: 2597970 - RNA, 17 nt, Human
ucuccaagaaugcugaa

SEQ ID NO: 2597971 - RNA, 16 nt, Human
ucuccaagaaugcuga

SEQ ID NO: 2597972 - RNA, 15 nt, Human
ucuccaagaaugcug

SEQ ID NO: 2597973 - RNA, 14 nt, Human
ucuccaagaaugcu

SEQ ID NO: 2597974 - RNA, 20 nt, Human
ucuccagggaguccccuccc

SEQ ID NO: 2597975 - RNA, 18 nt, Human
ucuccaagaaugcugaaa

SEQ ID NO: 2597976 - RNA, 16 nt, Human
ucuccaggcuguaucc

SEQ ID NO: 2597977 - RNA, 22 nt, Human
ucuccaggggcugcuuccuccu

SEQ ID NO: 2597978 - RNA, 20 nt, Human
ucuccaggggcugcuuccuc

SEQ ID NO: 2597979 - RNA, 18 nt, Human
ucuccaggggcugcuucc

SEQ ID NO: 2597980 - RNA, 17 nt, Human
ucuccaggggcugcuuc

SEQ ID NO: 2597981 - RNA, 23 nt, Human
ucuccaggggcugcuuccuccug

SEQ ID NO: 2597982 - RNA, 19 nt, Human
ucuccaguauccacuuugc

SEQ ID NO: 2597983 - RNA, 19 nt, Human
ucuccaggucucacgggca

SEQ ID NO: 2597984 - RNA, 21 nt, Human
acuugaacccauauuuguaca

SEQ ID NO: 2597985 - RNA, 19 nt, Human
acuugaacccgggaggcag

SEQ ID NO: 2597986 - RNA, 20 nt, Human
acuugaacccgggaggcaga

SEQ ID NO: 2597987 - RNA, 16 nt, Human
acuucuccacccugcu

SEQ ID NO: 2597988 - RNA, 15 nt, Human
acuucuccacccugc

SEQ ID NO: 2597989 - RNA, 16 nt, Human
acuugaaucaaagcag

SEQ ID NO: 2597990 - RNA, 22 nt, Human
acuugaaguuguuacuaacuaa

SEQ ID NO: 2597991 - RNA, 20 nt, Human
acuugaaguuguuacuaacu

SEQ ID NO: 2597992 - RNA, 13 nt, Human
acuugaaguuguu

SEQ ID NO: 2597993 - RNA, 12 nt, Human
acuugaaguugu

SEQ ID NO: 2597994 - RNA, 11 nt, Human
acuugaaguug

SEQ ID NO: 2597995 - RNA, 21 nt, Human
acuugaagggccagagccagg

SEQ ID NO: 2597996 - RNA, 22 nt, Human
acuugaagggccagagccaggg

SEQ ID NO: 2597997 - RNA, 17 nt, Human
acuugaagggccagagc

SEQ ID NO: 2597998 - RNA, 18 nt, Human
acuugaagggccagagcc

SEQ ID NO: 2597999 - RNA, 19 nt, Human
acuugaagggccagagcca

SEQ ID NO: 2598000 - RNA, 20 nt, Human
acuugaagggccagagccag

SEQ ID NO: 2598001 - RNA, 15 nt, Human
acuugaagggccaga

SEQ ID NO: 2598002 - RNA, 14 nt, Human
acuugaagggccag

SEQ ID NO: 2598003 - RNA, 21 nt, Human
acuugaacccgggaggcagag

SEQ ID NO: 2598004 - RNA, 19 nt, Human
acuugagcccagagugaac

SEQ ID NO: 2598005 - RNA, 19 nt, Human
acuugaauccuagggccug

SEQ ID NO: 2598006 - RNA, 12 nt, Human
acuugagaggau

SEQ ID NO: 2598007 - RNA, 19 nt, Human
acuugagaggaugaaugua

SEQ ID NO: 2598008 - RNA, 16 nt, Human
acuugagaggaugaau

SEQ ID NO: 2598009 - RNA, 20 nt, Human
acuugagcaccgucauggcu

SEQ ID NO: 2598010 - RNA, 15 nt, Human
acuugagcuuuaaaa

SEQ ID NO: 2598011 - RNA, 20 nt, Human
acuuggcucgaaucucugug

SEQ ID NO: 2598012 - RNA, 19 nt, Human
acuuggcucgaaucucugu

SEQ ID NO: 2598013 - RNA, 18 nt, Human
acuuggcucgaaucucug

SEQ ID NO: 2598014 - RNA, 17 nt, Human
acuuggcuacacaggga

SEQ ID NO: 2598015 - RNA, 16 nt, Human
acuugucaauaaaauc

SEQ ID NO: 2598016 - RNA, 14 nt, Human
acuugucaauauuu

SEQ ID NO: 2598017 - RNA, 13 nt, Human
acuugucaauauu

SEQ ID NO: 2598018 - RNA, 21 nt, Human
acuuggcucgaaucucugugc

SEQ ID NO: 2598019 - RNA, 17 nt, Human
acuugucaauauuuaaa

SEQ ID NO: 2598020 - RNA, 16 nt, Human
acuugucaauauuuaa

SEQ ID NO: 2598021 - RNA, 20 nt, Human
acuugucaauauuuaaacau

SEQ ID NO: 2598022 - RNA, 13 nt, Human
acuugucauguga

SEQ ID NO: 2598023 - RNA, 18 nt, Human
acuuguggacacagcucu

SEQ ID NO: 2598024 - RNA, 17 nt, Human
acuuguggacacagcuc

SEQ ID NO: 2598025 - RNA, 18 nt, Human
acuugucccacuaucugg

SEQ ID NO: 2598026 - RNA, 17 nt, Human
acuuguccccaaauccg

SEQ ID NO: 2598027 - RNA, 22 nt, Human
acuuguccccaaauccgaaccu

SEQ ID NO: 2598028 - RNA, 16 nt, Human
acuuguggacacagcu

SEQ ID NO: 2598029 - RNA, 16 nt, Human
acuuggcaacagaagc

SEQ ID NO: 2598030 - RNA, 15 nt, Human
acuuggcaacagaag

SEQ ID NO: 2598031 - RNA, 18 nt, Human
acuuggcaucagcuggcg

SEQ ID NO: 2598032 - RNA, 19 nt, Human
acuuggccaagcagggagg

SEQ ID NO: 2598033 - RNA, 10 nt, Human
acuuggccaa

SEQ ID NO: 2598034 - RNA, 14 nt, Human
acuuggccucugga

SEQ ID NO: 2598035 - RNA, 20 nt, Human
acuuggaggguugguccucu

SEQ ID NO: 2598036 - RNA, 11 nt, Human
acuuggagccg

SEQ ID NO: 2598037 - RNA, 19 nt, Human
acuuggagccccagugcca

SEQ ID NO: 2598038 - RNA, 14 nt, Human
acuugcucuugaug

SEQ ID NO: 2598039 - RNA, 14 nt, Human
acuuggagccccag

SEQ ID NO: 2598040 - RNA, 17 nt, Human
acuugccucuuccuuga

SEQ ID NO: 2598041 - RNA, 13 nt, Human
acuugccucuucc

SEQ ID NO: 2598042 - RNA, 23 nt, Human
acuugagcuuuaaaaaucauugu

SEQ ID NO: 2598043 - RNA, 20 nt, Human
acuugccuucuucacccagc

SEQ ID NO: 2598044 - RNA, 23 nt, Human
acuugcucucuggccuuuuccua

SEQ ID NO: 2598045 - RNA, 14 nt, Human
ucuauuucuccucc

SEQ ID NO: 2598046 - RNA, 15 nt, Human
ucuauuucuccucca

SEQ ID NO: 2598047 - RNA, 16 nt, Human
ucuauuucuccuccau

SEQ ID NO: 2598048 - RNA, 20 nt, Human
ucuauuucuccuccauggga

SEQ ID NO: 2598049 - RNA, 11 nt, Human
ucuauuucuag

SEQ ID NO: 2598050 - RNA, 15 nt, Human
ucuauuuccuggaau

SEQ ID NO: 2598051 - RNA, 14 nt, Human
ucucacacccaccg

SEQ ID NO: 2598052 - RNA, 13 nt, Human
ucuauuucugcug

SEQ ID NO: 2598053 - RNA, 21 nt, Human
ucuauuucugcugaauuuuca

SEQ ID NO: 2598054 - RNA, 23 nt, Human
ucucacacaugagcaucaggcca

SEQ ID NO: 2598055 - RNA, 12 nt, Human
ucuauuucugcu

SEQ ID NO: 2598056 - RNA, 11 nt, Human
ucuauuucugc

SEQ ID NO: 2598057 - RNA, 20 nt, Human
ucuauuucugagaagguccu

SEQ ID NO: 2598058 - RNA, 17 nt, Human
ucuauuucuaugagaaa

SEQ ID NO: 2598059 - RNA, 12 nt, Human
ucuauuucugag

SEQ ID NO: 2598060 - RNA, 13 nt, Human
ucuauuucugaga

SEQ ID NO: 2598061 - RNA, 15 nt, Human
ucuauuucugagaag

SEQ ID NO: 2598062 - RNA, 22 nt, Human
acuuauaucaucagcauaccuu

SEQ ID NO: 2598063 - RNA, 17 nt, Human
acuuauaucaucagcau

SEQ ID NO: 2598064 - RNA, 13 nt, Human
acuucagcucugu

SEQ ID NO: 2598065 - RNA, 14 nt, Human
acuucaggcucuuc

SEQ ID NO: 2598066 - RNA, 11 nt, Human
acuucagcuga

SEQ ID NO: 2598067 - RNA, 16 nt, Human
acuucagcugacuuuu

SEQ ID NO: 2598068 - RNA, 13 nt, Human
ucucacuaaacuu

SEQ ID NO: 2598069 - RNA, 23 nt, Human
ucucacgggcaugggcacucccu

SEQ ID NO: 2598070 - RNA, 22 nt, Human
ucucacgggcaugggcacuccc

SEQ ID NO: 2598071 - RNA, 21 nt, Human
ucucacgggcaugggcacucc

SEQ ID NO: 2598072 - RNA, 17 nt, Human
ucucacuaaacuuuacc

SEQ ID NO: 2598073 - RNA, 15 nt, Human
ucucacuaaacuuua

SEQ ID NO: 2598074 - RNA, 11 nt, Human
ucucacuccuu

SEQ ID NO: 2598075 - RNA, 15 nt, Human
ucucaccuguacucu

SEQ ID NO: 2598076 - RNA, 20 nt, Human
ucucacgggcaguagcugug

SEQ ID NO: 2598077 - RNA, 21 nt, Human
ucucacacuggcguagaaguu

SEQ ID NO: 2598078 - RNA, 14 nt, Human
ucucacacuggcgu

SEQ ID NO: 2598079 - RNA, 23 nt, Human
ucucacacccaccguccgcccug

SEQ ID NO: 2598080 - RNA, 23 nt, Human
acuucuaaguaaaaccacagcag

SEQ ID NO: 2598081 - RNA, 15 nt, Human
acuucuaaaugaagu

SEQ ID NO: 2598082 - RNA, 16 nt, Human
acuucuaaaugaagug

SEQ ID NO: 2598083 - RNA, 23 nt, Human
acuucgugggaucugccccuccc

SEQ ID NO: 2598084 - RNA, 22 nt, Human
acuucgugggaucugccccucc

SEQ ID NO: 2598085 - RNA, 13 nt, Human
acuucgugggauc

SEQ ID NO: 2598086 - RNA, 20 nt, Human
acuucgucuucuaauuucaa

SEQ ID NO: 2598087 - RNA, 19 nt, Human
acuucgucuucuaauuuca

SEQ ID NO: 2598088 - RNA, 15 nt, Human
acuucgucuucuaau

SEQ ID NO: 2598089 - RNA, 18 nt, Human
acuucgucuucuaauuuc

SEQ ID NO: 2598090 - RNA, 15 nt, Human
acuucuaauauauuu

SEQ ID NO: 2598091 - RNA, 11 nt, Human
acuucuaauau

SEQ ID NO: 2598092 - RNA, 17 nt, Human
acuucuaaaugcauauc

SEQ ID NO: 2598093 - RNA, 22 nt, Human
acuucuaauauauuuuuauauu

SEQ ID NO: 2598094 - RNA, 22 nt, Human
acuucucaaaccuguuuaaaua

SEQ ID NO: 2598095 - RNA, 23 nt, Human
acuucuacuucugcccuugccaa

SEQ ID NO: 2598096 - RNA, 14 nt, Human
acuucuccacccug

SEQ ID NO: 2598097 - RNA, 18 nt, Human
acuuccuguccagcucca

SEQ ID NO: 2598098 - RNA, 22 nt, Human
acuuccuguccagcuccaaccu

SEQ ID NO: 2598099 - RNA, 14 nt, Human
acuuccuguccaga

SEQ ID NO: 2598100 - RNA, 12 nt, Human
ucucacucuguc

SEQ ID NO: 2598101 - RNA, 13 nt, Human
ucucacuccuuga

SEQ ID NO: 2598102 - RNA, 16 nt, Human
ucucacuauaccagua

SEQ ID NO: 2598103 - RNA, 22 nt, Human
acuuccuuacuaagcauagcaa

SEQ ID NO: 2598104 - RNA, 21 nt, Human
acuuccuguuugggccccucu

SEQ ID NO: 2598105 - RNA, 18 nt, Human
acuuccuguuugggcccc

SEQ ID NO: 2598106 - RNA, 14 nt, Human
acuuccuugagaca

SEQ ID NO: 2598107 - RNA, 22 nt, Human
acuuccuugagacacggagccc

SEQ ID NO: 2598108 - RNA, 15 nt, Human
acuuccugugacuuc

SEQ ID NO: 2598109 - RNA, 23 nt, Human
acuuccuguccagcuccaaccug

SEQ ID NO: 2598110 - RNA, 17 nt, Human
acuuccuguuugggccc

SEQ ID NO: 2598111 - RNA, 17 nt, Human
acuuccuguccagagag

SEQ ID NO: 2598112 - RNA, 22 nt, Human
acuucgggaggucgaggcagga

SEQ ID NO: 2598113 - RNA, 19 nt, Human
acuucgacucaggauccag

SEQ ID NO: 2598114 - RNA, 15 nt, Human
acuucgacucaggau

SEQ ID NO: 2598115 - RNA, 19 nt, Human
acuuccuugcucucccucu

SEQ ID NO: 2598116 - RNA, 16 nt, Human
acuuccuugcucuccc

SEQ ID NO: 2598117 - RNA, 18 nt, Human
ucugaagucacugcacag

SEQ ID NO: 2598118 - RNA, 16 nt, Human
ucugaagucacugcac

SEQ ID NO: 2598119 - RNA, 15 nt, Human
ucugaagucacugca

SEQ ID NO: 2598120 - RNA, 15 nt, Human
ucugacaacagacuu

SEQ ID NO: 2598121 - RNA, 16 nt, Human
ucugacaacagacuuc

SEQ ID NO: 2598122 - RNA, 15 nt, Human
ucugaccugcaggcc

SEQ ID NO: 2598123 - RNA, 16 nt, Human
ucugaccugcaggcca

SEQ ID NO: 2598124 - RNA, 17 nt, Human
ucugaccugcaggccaa

SEQ ID NO: 2598125 - RNA, 19 nt, Human
ucugaccugcaggccaaga

SEQ ID NO: 2598126 - RNA, 21 nt, Human
ucugaccugcaggccaagagc

SEQ ID NO: 2598127 - RNA, 14 nt, Human
agaaaugaaagcag

SEQ ID NO: 2598128 - RNA, 22 nt, Human
agaaaucccuguuuaauauuua

SEQ ID NO: 2598129 - RNA, 16 nt, Human
agaaaugaaaaaauau

SEQ ID NO: 2598130 - RNA, 23 nt, Human
agaaaugaaaaaauauauaucaa

SEQ ID NO: 2598131 - RNA, 18 nt, Human
agaaaugaaaaaauauau

SEQ ID NO: 2598132 - RNA, 12 nt, Human
ucugaagaagau

SEQ ID NO: 2598133 - RNA, 22 nt, Human
ucugaagaccucgagcagauga

SEQ ID NO: 2598134 - RNA, 22 nt, Human
ucugaagaguggguuucacaag

SEQ ID NO: 2598135 - RNA, 20 nt, Human
ucugaagcauguuucauguu

SEQ ID NO: 2598136 - RNA, 15 nt, Human
ucugaagcauguuuc

SEQ ID NO: 2598137 - RNA, 21 nt, Human
ucugaagcauguuucauguuu

SEQ ID NO: 2598138 - RNA, 14 nt, Human
ucugaagcauguuu

SEQ ID NO: 2598139 - RNA, 13 nt, Human
ucugaagcauguu

SEQ ID NO: 2598140 - RNA, 12 nt, Human
ucugaagcaugu

SEQ ID NO: 2598141 - RNA, 12 nt, Human
ucugaagcagau

SEQ ID NO: 2598142 - RNA, 17 nt, Human
ucugaagucacaucaca

SEQ ID NO: 2598143 - RNA, 20 nt, Human
ucugaagucacaucacagga

SEQ ID NO: 2598144 - RNA, 22 nt, Human
ucugaagucacaucacaggaca

SEQ ID NO: 2598145 - RNA, 23 nt, Human
ucugaagucacaucacaggacac

SEQ ID NO: 2598146 - RNA, 20 nt, Human
agaaagcugguaaacuauuu

SEQ ID NO: 2598147 - RNA, 19 nt, Human
agaaagcugguaaacuauu

SEQ ID NO: 2598148 - RNA, 16 nt, Human
agaaagcugguaaacu

SEQ ID NO: 2598149 - RNA, 13 nt, Human
agaaagcugccug

SEQ ID NO: 2598150 - RNA, 20 nt, Human
agaaagccuguuccccucac

SEQ ID NO: 2598151 - RNA, 19 nt, Human
agaaagccuguuccccuca

SEQ ID NO: 2598152 - RNA, 22 nt, Human
agaaagccuguuccccucacug

SEQ ID NO: 2598153 - RNA, 21 nt, Human
agaaagccugggugacauuug

SEQ ID NO: 2598154 - RNA, 20 nt, Human
agaaagccugggugacauuu

SEQ ID NO: 2598155 - RNA, 19 nt, Human
agaaagccugggugacauu

SEQ ID NO: 2598156 - RNA, 18 nt, Human
agaaagccugggugacau

SEQ ID NO: 2598157 - RNA, 22 nt, Human
agaaacuuuauucaaguaaaaa

SEQ ID NO: 2598158 - RNA, 14 nt, Human
agaaagaaaaucag

SEQ ID NO: 2598159 - RNA, 12 nt, Human
agaaacuuuauu

SEQ ID NO: 2598160 - RNA, 13 nt, Human
agaaacuucgccu

SEQ ID NO: 2598161 - RNA, 23 nt, Human
agaaacuugugaaguggaaaugu

SEQ ID NO: 2598162 - RNA, 19 nt, Human
agaaacuuccaaauccccu

SEQ ID NO: 2598163 - RNA, 13 nt, Human
agaaacuugugaa

SEQ ID NO: 2598164 - RNA, 12 nt, Human
agaaaucuaaaa

SEQ ID NO: 2598165 - RNA, 18 nt, Human
agaaaucaguaauauuua

SEQ ID NO: 2598166 - RNA, 17 nt, Human
agaaaucacagaaucau

SEQ ID NO: 2598167 - RNA, 21 nt, Human
agaaaucauuuggguuaauau

SEQ ID NO: 2598168 - RNA, 17 nt, Human
agaaaugaaaaaauaua

SEQ ID NO: 2598169 - RNA, 19 nt, Human
agaaaucccuguuuaauau

SEQ ID NO: 2598170 - RNA, 14 nt, Human
agaaauauaauuga

SEQ ID NO: 2598171 - RNA, 19 nt, Human
agaaauaucugaaaaugua

SEQ ID NO: 2598172 - RNA, 17 nt, Human
agaaaucaaagagagaa

SEQ ID NO: 2598173 - RNA, 20 nt, Human
agaaauaucugaaaauguau

SEQ ID NO: 2598174 - RNA, 19 nt, Human
ucugcacuccccugcuggg

SEQ ID NO: 2598175 - RNA, 18 nt, Human
ucugcacuccccugcugg

SEQ ID NO: 2598176 - RNA, 18 nt, Human
ucugauuacacaaaacaa

SEQ ID NO: 2598177 - RNA, 18 nt, Human
ucugauucccaagcucug

SEQ ID NO: 2598178 - RNA, 24 nt, Human
ucugaguuucauucuccugccugu

SEQ ID NO: 2598179 - RNA, 14 nt, Human
ucugauaacuagau

SEQ ID NO: 2598180 - RNA, 20 nt, Human
ucugauaacuagauggugcu

SEQ ID NO: 2598181 - RNA, 21 nt, Human
ucugauaacuagauggugcug

SEQ ID NO: 2598182 - RNA, 19 nt, Human
ucugauaagagaaucaaca

SEQ ID NO: 2598183 - RNA, 15 nt, Human
ucugauaaugaaaau

SEQ ID NO: 2598184 - RNA, 22 nt, Human
ucugauaacuagauggugcuga

SEQ ID NO: 2598185 - RNA, 23 nt, Human
ucugaugcaagcaagaaacacug

SEQ ID NO: 2598186 - RNA, 13 nt, Human
ucugauggcuucu

SEQ ID NO: 2598187 - RNA, 18 nt, Human
ucugauggcuucuccagg

SEQ ID NO: 2598188 - RNA, 15 nt, Human
ucugauggcuucucc

SEQ ID NO: 2598189 - RNA, 23 nt, Human
ucugagacucgcgacaaugcaaa

SEQ ID NO: 2598190 - RNA, 22 nt, Human
ucugagacucgcgacaaugcaa

SEQ ID NO: 2598191 - RNA, 23 nt, Human
ucugacuacugggcaaagagugu

SEQ ID NO: 2598192 - RNA, 22 nt, Human
ucugacuacugggcaaagagug

SEQ ID NO: 2598193 - RNA, 23 nt, Human
ucugacgugccuuuugcaccccu

SEQ ID NO: 2598194 - RNA, 20 nt, Human
ucugacgugccuuuugcacc

SEQ ID NO: 2598195 - RNA, 22 nt, Human
ucugagacucucuuaggagcag

SEQ ID NO: 2598196 - RNA, 22 nt, Human
ucugaguuucauucuccugccu

SEQ ID NO: 2598197 - RNA, 20 nt, Human
ucugaguuucauucuccugc

SEQ ID NO: 2598198 - RNA, 15 nt, Human
ucugaguuucauucu

SEQ ID NO: 2598199 - RNA, 17 nt, Human
ucugaguuccugcaugc

SEQ ID NO: 2598200 - RNA, 24 nt, Human
ucugaguguuuuuacuacaguugu

SEQ ID NO: 2598201 - RNA, 21 nt, Human
agaaauuaugugccagauuua

SEQ ID NO: 2598202 - RNA, 13 nt, Human
agaaauuaugugc

SEQ ID NO: 2598203 - RNA, 18 nt, Human
ucugcaggucccuaauaa

SEQ ID NO: 2598204 - RNA, 13 nt, Human
ucugcaggcagac

SEQ ID NO: 2598205 - RNA, 22 nt, Human
ucugcaggcaccuuaguggcuu

SEQ ID NO: 2598206 - RNA, 14 nt, Human
ucugcaggucccua

SEQ ID NO: 2598207 - RNA, 17 nt, Human
agaaauuuauaaacuuu

SEQ ID NO: 2598208 - RNA, 16 nt, Human
agaaauuuauaaacuu

SEQ ID NO: 2598209 - RNA, 22 nt, Human
agaaauuaugugccagauuuau

SEQ ID NO: 2598210 - RNA, 17 nt, Human
agaaauuauuuaauaaa

SEQ ID NO: 2598211 - RNA, 16 nt, Human
agaaauuauuuaauaa

SEQ ID NO: 2598212 - RNA, 14 nt, Human
agaaauuauuuaau

SEQ ID NO: 2598213 - RNA, 14 nt, Human
ucugcaggcagaca

SEQ ID NO: 2598214 - RNA, 13 nt, Human
agaaauuccugua

SEQ ID NO: 2598215 - RNA, 17 nt, Human
ucugcaggucccuaaua

SEQ ID NO: 2598216 - RNA, 16 nt, Human
ucugcaggucccuaau

SEQ ID NO: 2598217 - RNA, 15 nt, Human
ucugcaggucccuaa

SEQ ID NO: 2598218 - RNA, 20 nt, Human
ucugcagcugaccucuguug

SEQ ID NO: 2598219 - RNA, 14 nt, Human
ucugcagcugaccu

SEQ ID NO: 2598220 - RNA, 13 nt, Human
ucugcagcugacc

SEQ ID NO: 2598221 - RNA, 17 nt, Human
ucugcaggcaccuuagu

SEQ ID NO: 2598222 - RNA, 14 nt, Human
ucugcaggcaccuu

SEQ ID NO: 2598223 - RNA, 15 nt, Human
ucugcagcuguuuua

SEQ ID NO: 2598224 - RNA, 22 nt, Human
ucugcaggauugauuaugcaga

SEQ ID NO: 2598225 - RNA, 18 nt, Human
ucugcagcaauaaagcag

SEQ ID NO: 2598226 - RNA, 20 nt, Human
ucugcacuccccugcugggu

SEQ ID NO: 2598227 - RNA, 13 nt, Human
ucugauuccacuu

SEQ ID NO: 2598228 - RNA, 11 nt, Human
ucugauuccac

SEQ ID NO: 2598229 - RNA, 16 nt, Human
ucugcagcaugaccug

SEQ ID NO: 2598230 - RNA, 20 nt, Human
ucugcagcaugaccugugac

SEQ ID NO: 2598231 - RNA, 14 nt, Human
ucugcagccagccc

SEQ ID NO: 2598232 - RNA, 15 nt, Human
ucugcagccagccca

SEQ ID NO: 2598233 - RNA, 16 nt, Human
ucugcagccagcccag

SEQ ID NO: 2598234 - RNA, 23 nt, Human
ucugcagcccggcgccaccaucc

SEQ ID NO: 2598235 - RNA, 15 nt, Human
ucugcagcccaggga

SEQ ID NO: 2598236 - RNA, 13 nt, Human
ucugcagcccagg

SEQ ID NO: 2598237 - RNA, 18 nt, Human
ucugcagccagcccagcc

SEQ ID NO: 2598238 - RNA, 19 nt, Human
ucugcagccagcccagccc

SEQ ID NO: 2598239 - RNA, 23 nt, Human
ucucucaucucuuagcuccccuc

SEQ ID NO: 2598240 - RNA, 19 nt, Human
ucucucaucucuuagcucc

SEQ ID NO: 2598241 - RNA, 14 nt, Human
ucucucaucucuua

SEQ ID NO: 2598242 - RNA, 15 nt, Human
ucucucaugaaccuc

SEQ ID NO: 2598243 - RNA, 17 nt, Human
ucucucaugaaccucaa

SEQ ID NO: 2598244 - RNA, 12 nt, Human
ucucucaugaac

SEQ ID NO: 2598245 - RNA, 22 nt, Human
ucucucaucucuuagcuccccu

SEQ ID NO: 2598246 - RNA, 16 nt, Human
ucucucauugucugug

SEQ ID NO: 2598247 - RNA, 22 nt, Human
ucucucaugaaccucaagcugc

SEQ ID NO: 2598248 - RNA, 19 nt, Human
ucucuccagccccuggaug

SEQ ID NO: 2598249 - RNA, 18 nt, Human
ucucuccagccccuggau

SEQ ID NO: 2598250 - RNA, 16 nt, Human
ucucuccagccccugg

SEQ ID NO: 2598251 - RNA, 17 nt, Human
ucucuccagccccugga

SEQ ID NO: 2598252 - RNA, 15 nt, Human
acuuugaccucugca

SEQ ID NO: 2598253 - RNA, 16 nt, Human
acuuugaccucugcag

SEQ ID NO: 2598254 - RNA, 19 nt, Human
acuuucucuucauacuuuu

SEQ ID NO: 2598255 - RNA, 22 nt, Human
acuuucuauagcagauugugua

SEQ ID NO: 2598256 - RNA, 18 nt, Human
acuuucucaguuuucaua

SEQ ID NO: 2598257 - RNA, 16 nt, Human
ucucucaauaugcuua

SEQ ID NO: 2598258 - RNA, 18 nt, Human
acuuugaccucugcagca

SEQ ID NO: 2598259 - RNA, 15 nt, Human
ucucucacuccuuga

SEQ ID NO: 2598260 - RNA, 13 nt, Human
ucucucacuccuu

SEQ ID NO: 2598261 - RNA, 20 nt, Human
ucucucaauaugcuuacaaa

SEQ ID NO: 2598262 - RNA, 17 nt, Human
ucucugcccuccaagac

SEQ ID NO: 2598263 - RNA, 16 nt, Human
ucucugcccuccaaga

SEQ ID NO: 2598264 - RNA, 15 nt, Human
ucucugcccuccaag

SEQ ID NO: 2598265 - RNA, 11 nt, Human
ucucugcccuc

SEQ ID NO: 2598266 - RNA, 16 nt, Human
ucucuccuguaccucu

SEQ ID NO: 2598267 - RNA, 17 nt, Human
ucucuccuguaccucuu

SEQ ID NO: 2598268 - RNA, 11 nt, Human
ucucuccuccu

SEQ ID NO: 2598269 - RNA, 14 nt, Human
ucucuccuguaccu

SEQ ID NO: 2598270 - RNA, 21 nt, Human
ucucucccuccccugccauuu

SEQ ID NO: 2598271 - RNA, 20 nt, Human
ucucucccucccuuugaaau

SEQ ID NO: 2598272 - RNA, 13 nt, Human
ucucuccucccca

SEQ ID NO: 2598273 - RNA, 15 nt, Human
ucucuggaugccuga

SEQ ID NO: 2598274 - RNA, 22 nt, Human
ucucuggagugagcucuguuuc

SEQ ID NO: 2598275 - RNA, 22 nt, Human
ucucuggagccaaguccagauu

SEQ ID NO: 2598276 - RNA, 20 nt, Human
ucucuggagccaaguccaga

SEQ ID NO: 2598277 - RNA, 18 nt, Human
ucucuggagccaagucca

SEQ ID NO: 2598278 - RNA, 19 nt, Human
ucucuggaauuugaaacac

SEQ ID NO: 2598279 - RNA, 12 nt, Human
ucucuggccuuc

SEQ ID NO: 2598280 - RNA, 19 nt, Human
ucucuggccucccacccga

SEQ ID NO: 2598281 - RNA, 18 nt, Human
ucucuggccucccacccg

SEQ ID NO: 2598282 - RNA, 17 nt, Human
ucucuggccucccaccc

SEQ ID NO: 2598283 - RNA, 15 nt, Human
ucucuggccucccac

SEQ ID NO: 2598284 - RNA, 15 nt, Human
ucucuggccccaagg

SEQ ID NO: 2598285 - RNA, 14 nt, Human
ucucuggaugccug

SEQ ID NO: 2598286 - RNA, 11 nt, Human
ucucuggccuc

SEQ ID NO: 2598287 - RNA, 19 nt, Human
ucucuggcccuucuugccu

SEQ ID NO: 2598288 - RNA, 23 nt, Human
ucucugcucugcgugucaccugu

SEQ ID NO: 2598289 - RNA, 11 nt, Human
ucucugcugcc

SEQ ID NO: 2598290 - RNA, 13 nt, Human
ucucugcugaagg

SEQ ID NO: 2598291 - RNA, 13 nt, Human
ucucugcugccgc

SEQ ID NO: 2598292 - RNA, 12 nt, Human
ucucugcugccg

SEQ ID NO: 2598293 - RNA, 12 nt, Human
ucucugcuggcc

SEQ ID NO: 2598294 - RNA, 14 nt, Human
ucucugcuggccca

SEQ ID NO: 2598295 - RNA, 15 nt, Human
ucucugcuggcccag

SEQ ID NO: 2598296 - RNA, 16 nt, Human
ucucugcuggcccagc

SEQ ID NO: 2598297 - RNA, 19 nt, Human
ucucugcuggcccagccaa

SEQ ID NO: 2598298 - RNA, 15 nt, Human
ucucuggaauuugaa

SEQ ID NO: 2598299 - RNA, 11 nt, Human
ucucugcugua

SEQ ID NO: 2598300 - RNA, 18 nt, Human
ucucugcuugagucaggu

SEQ ID NO: 2598301 - RNA, 19 nt, Human
ucucugcuugagucagguu

SEQ ID NO: 2598302 - RNA, 22 nt, Human
ucucuggaaaggggggagcugg

SEQ ID NO: 2598303 - RNA, 16 nt, Human
ucucuugauucauaau

SEQ ID NO: 2598304 - RNA, 14 nt, Human
ucucuugauucaua

SEQ ID NO: 2598305 - RNA, 18 nt, Human
ucucuugagccugggagg

SEQ ID NO: 2598306 - RNA, 18 nt, Human
ucucuugaggccaggagu

SEQ ID NO: 2598307 - RNA, 21 nt, Human
ucucuggccuucggccuccau

SEQ ID NO: 2598308 - RNA, 22 nt, Human
ucucuggccuucggccuccauc

SEQ ID NO: 2598309 - RNA, 23 nt, Human
ucucuggccuucggccuccaucc

SEQ ID NO: 2598310 - RNA, 17 nt, Human
ucucuugagccugggag

SEQ ID NO: 2598311 - RNA, 16 nt, Human
ucucuugggaacugaa

SEQ ID NO: 2598312 - RNA, 23 nt, Human
ucucuugggaacugaacucacuu

SEQ ID NO: 2598313 - RNA, 15 nt, Human
ucucuugcacccgcc

SEQ ID NO: 2598314 - RNA, 14 nt, Human
ucucuugcacccgc

SEQ ID NO: 2598315 - RNA, 13 nt, Human
ucucuugcacccg

SEQ ID NO: 2598316 - RNA, 12 nt, Human
ucucuugcaccc

SEQ ID NO: 2598317 - RNA, 22 nt, Human
ucucuugcacccgccucucccg

SEQ ID NO: 2598318 - RNA, 17 nt, Human
ucucuugcacccgccuc

SEQ ID NO: 2598319 - RNA, 15 nt, Human
ucucuugaguuuguc

SEQ ID NO: 2598320 - RNA, 12 nt, Human
ucucuugauuuu

SEQ ID NO: 2598321 - RNA, 14 nt, Human
ucucuugaguuugu

SEQ ID NO: 2598322 - RNA, 13 nt, Human
ucucuugagggag

SEQ ID NO: 2598323 - RNA, 22 nt, Human
ucucuugagggagcuuagccaa

SEQ ID NO: 2598324 - RNA, 21 nt, Human
ucucuuuaaugucacaggcag

SEQ ID NO: 2598325 - RNA, 20 nt, Human
ucucuuuaaugucacaggca

SEQ ID NO: 2598326 - RNA, 13 nt, Human
agaaaaagaaaaa

SEQ ID NO: 2598327 - RNA, 16 nt, Human
ucucuuuaaucuucag

SEQ ID NO: 2598328 - RNA, 17 nt, Human
ucucuuuaaucuucagu

SEQ ID NO: 2598329 - RNA, 20 nt, Human
ucucuuuaaucuucaguuuu

SEQ ID NO: 2598330 - RNA, 10 nt, Human
agaaaagaaa

SEQ ID NO: 2598331 - RNA, 11 nt, Human
agaaaagaaaa

SEQ ID NO: 2598332 - RNA, 12 nt, Human
agaaaagaaaaa

SEQ ID NO: 2598333 - RNA, 13 nt, Human
agaaaagaaaaaa

SEQ ID NO: 2598334 - RNA, 9 nt, Human
agaaaagaa

SEQ ID NO: 2598335 - RNA, 20 nt, Human
agaaaaagcuccuguccucc

SEQ ID NO: 2598336 - RNA, 17 nt, Human
agaaaagaaaaaaaaag

SEQ ID NO: 2598337 - RNA, 18 nt, Human
agaaaagaaaaaaaaaga

SEQ ID NO: 2598338 - RNA, 17 nt, Human
agaaaagacaugaauau

SEQ ID NO: 2598339 - RNA, 17 nt, Human
agaaacacccucacacu

SEQ ID NO: 2598340 - RNA, 23 nt, Human
agaaacacgaacuuuagcugcau

SEQ ID NO: 2598341 - RNA, 19 nt, Human
agaaaacuuguauuaugug

SEQ ID NO: 2598342 - RNA, 21 nt, Human
agaaaacuuguauuaugugug

SEQ ID NO: 2598343 - RNA, 17 nt, Human
agaaaaaggaugcacag

SEQ ID NO: 2598344 - RNA, 20 nt, Human
agaaaaagcaauaaccucaa

SEQ ID NO: 2598345 - RNA, 21 nt, Human
agaaacguuuggaacaaucua

SEQ ID NO: 2598346 - RNA, 20 nt, Human
agaaacguuuggaacaaucu

SEQ ID NO: 2598347 - RNA, 23 nt, Human
agaaacucacccccaaggggcag

SEQ ID NO: 2598348 - RNA, 15 nt, Human
agaaacucaccccca

SEQ ID NO: 2598349 - RNA, 22 nt, Human
agaaacucacccccaaggggca

SEQ ID NO: 2598350 - RNA, 14 nt, Human
agaaacuuccaaau

SEQ ID NO: 2598351 - RNA, 16 nt, Human
agaaacgucuucuaaa

SEQ ID NO: 2598352 - RNA, 18 nt, Human
agaaacgucuucuaaacu

SEQ ID NO: 2598353 - RNA, 19 nt, Human
agaaacguuuggaacaauc

SEQ ID NO: 2598354 - RNA, 21 nt, Human
agaaacgucuucuaaacuucc

SEQ ID NO: 2598355 - RNA, 18 nt, Human
agaaaccuuuuuaaaaau

SEQ ID NO: 2598356 - RNA, 20 nt, Human
agaaaccuuauuguaccucu

SEQ ID NO: 2598357 - RNA, 15 nt, Human
agaaacgucuucuaa

SEQ ID NO: 2598358 - RNA, 12 nt, Human
agaaacagugag

SEQ ID NO: 2598359 - RNA, 13 nt, Human
agaaacagugagu

SEQ ID NO: 2598360 - RNA, 13 nt, Human
agaaacaguuaac

SEQ ID NO: 2598361 - RNA, 18 nt, Human
agaaaccuuauuguaccu

SEQ ID NO: 2598362 - RNA, 16 nt, Human
agaaaccuuauuguac

SEQ ID NO: 2598363 - RNA, 17 nt, Human
agaaaccuuaauaugug

SEQ ID NO: 2598364 - RNA, 20 nt, Human
agaaacaguuaacuuucaga

SEQ ID NO: 2598365 - RNA, 14 nt, Human
agaaacagagacag

SEQ ID NO: 2598366 - RNA, 19 nt, Human
agaaacagagacaggccca

SEQ ID NO: 2598367 - RNA, 15 nt, Human
agaaacagagacagg

SEQ ID NO: 2598368 - RNA, 16 nt, Human
agaaauuugauuucua

SEQ ID NO: 2598369 - RNA, 17 nt, Human
agaaccccuacaugaaa

SEQ ID NO: 2598370 - RNA, 19 nt, Human
agaaccccuacaugaaaca

SEQ ID NO: 2598371 - RNA, 20 nt, Human
agaacccugcguggggacag

SEQ ID NO: 2598372 - RNA, 20 nt, Human
agaacccuuggcuugcccac

SEQ ID NO: 2598373 - RNA, 22 nt, Human
agaaccccuggcuccaggccag

SEQ ID NO: 2598374 - RNA, 15 nt, Human
agaaugucaguaugu

SEQ ID NO: 2598375 - RNA, 16 nt, Human
agaaugucaguaugug

SEQ ID NO: 2598376 - RNA, 16 nt, Human
agaaccgagcaaagau

SEQ ID NO: 2598377 - RNA, 15 nt, Human
agaaccgagcaaaga

SEQ ID NO: 2598378 - RNA, 14 nt, Human
agaaccgagcaaag

SEQ ID NO: 2598379 - RNA, 13 nt, Human
agaaugucaguau

SEQ ID NO: 2598380 - RNA, 16 nt, Human
agaaauuuccagagaa

SEQ ID NO: 2598381 - RNA, 15 nt, Human
agaaauuugauuucu

SEQ ID NO: 2598382 - RNA, 23 nt, Human
agaaccccaggguccuguagccc

SEQ ID NO: 2598383 - RNA, 23 nt, Human
agaaauuuauuuccuaguucugu

SEQ ID NO: 2598384 - RNA, 15 nt, Human
agaaauuuauuuccu

SEQ ID NO: 2598385 - RNA, 13 nt, Human
agaaauuuauuuc

SEQ ID NO: 2598386 - RNA, 14 nt, Human
agaaauuuccagag

SEQ ID NO: 2598387 - RNA, 17 nt, Human
agaaugucaguaugugg

SEQ ID NO: 2598388 - RNA, 19 nt, Human
agaaugucaguauguggaa

SEQ ID NO: 2598389 - RNA, 21 nt, Human
agaauguguuuaaacuugguu

SEQ ID NO: 2598390 - RNA, 18 nt, Human
agaauguguuuucugaau

SEQ ID NO: 2598391 - RNA, 17 nt, Human
agaauguguuuucugaa

SEQ ID NO: 2598392 - RNA, 15 nt, Human
agaauguuguauuca

SEQ ID NO: 2598393 - RNA, 19 nt, Human
agaauguuguauucaguga

SEQ ID NO: 2598394 - RNA, 18 nt, Human
agaauguuuuacugugaa

SEQ ID NO: 2598395 - RNA, 18 nt, Human
agaauguuguauucagug

SEQ ID NO: 2598396 - RNA, 19 nt, Human
agaauuaguggcacuugcu

SEQ ID NO: 2598397 - RNA, 19 nt, Human
agaauguuuuacugugaaa

SEQ ID NO: 2598398 - RNA, 18 nt, Human
ucuggguagcuguaaggc

SEQ ID NO: 2598399 - RNA, 21 nt, Human
ucugggguucagccccuccuc

SEQ ID NO: 2598400 - RNA, 22 nt, Human
ucugggguucagccccuccucu

SEQ ID NO: 2598401 - RNA, 16 nt, Human
ucugggguucagcccc

SEQ ID NO: 2598402 - RNA, 17 nt, Human
ucugggguucagccccu

SEQ ID NO: 2598403 - RNA, 18 nt, Human
ucugggguucagccccuc

SEQ ID NO: 2598404 - RNA, 19 nt, Human
ucugggguucagccccucc

SEQ ID NO: 2598405 - RNA, 22 nt, Human
ucuggguuccuuccucugagcc

SEQ ID NO: 2598406 - RNA, 15 nt, Human
ucugggucagugguc

SEQ ID NO: 2598407 - RNA, 23 nt, Human
ucugggguucagccccuccucug

SEQ ID NO: 2598408 - RNA, 22 nt, Human
ucugguaauauugacuuguaua

SEQ ID NO: 2598409 - RNA, 21 nt, Human
ucugguaauauugacuuguau

SEQ ID NO: 2598410 - RNA, 15 nt, Human
ucugguacucuccua

SEQ ID NO: 2598411 - RNA, 23 nt, Human
ucuggguuccuuccucugagccu

SEQ ID NO: 2598412 - RNA, 21 nt, Human
ucugggcuuggggcuuccuaa

SEQ ID NO: 2598413 - RNA, 19 nt, Human
ucugggcuuggggcuuccu

SEQ ID NO: 2598414 - RNA, 22 nt, Human
ucuggggucuuuuuaugcauuu

SEQ ID NO: 2598415 - RNA, 17 nt, Human
ucugggguuaugauggc

SEQ ID NO: 2598416 - RNA, 19 nt, Human
ucugggcugucuauucuag

SEQ ID NO: 2598417 - RNA, 17 nt, Human
ucugggcugcuacccag

SEQ ID NO: 2598418 - RNA, 22 nt, Human
ucugggcugcuacccagaaauc

SEQ ID NO: 2598419 - RNA, 14 nt, Human
agaauucucuaguu

SEQ ID NO: 2598420 - RNA, 13 nt, Human
ucugggcuccaga

SEQ ID NO: 2598421 - RNA, 20 nt, Human
agaauucucagaaucucaaa

SEQ ID NO: 2598422 - RNA, 20 nt, Human
agaauuccuucagggugaug

SEQ ID NO: 2598423 - RNA, 18 nt, Human
agaauuccuucaggguga

SEQ ID NO: 2598424 - RNA, 12 nt, Human
agaauuccuuca

SEQ ID NO: 2598425 - RNA, 18 nt, Human
agaauucuagugcugcug

SEQ ID NO: 2598426 - RNA, 14 nt, Human
agaauucuagugcu

SEQ ID NO: 2598427 - RNA, 23 nt, Human
agaauucuagugcugcugaagau

SEQ ID NO: 2598428 - RNA, 20 nt, Human
agaauuccaaggaguuccau

SEQ ID NO: 2598429 - RNA, 20 nt, Human
agaauuauaauuaguuccuc

SEQ ID NO: 2598430 - RNA, 20 nt, Human
agaauuccaggguauggcca

SEQ ID NO: 2598431 - RNA, 22 nt, Human
agaauucccucucucugacucu

SEQ ID NO: 2598432 - RNA, 20 nt, Human
agaauucccucucucugacu

SEQ ID NO: 2598433 - RNA, 19 nt, Human
agaauucccucucucugac

SEQ ID NO: 2598434 - RNA, 22 nt, Human
ucuguggaaaguguaaagcauu

SEQ ID NO: 2598435 - RNA, 20 nt, Human
ucuguggaaaguguaaagca

SEQ ID NO: 2598436 - RNA, 16 nt, Human
ucuguggaaaguguaa

SEQ ID NO: 2598437 - RNA, 15 nt, Human
ucuguggaaagugua

SEQ ID NO: 2598438 - RNA, 14 nt, Human
ucuguggaaagugu

SEQ ID NO: 2598439 - RNA, 22 nt, Human
ucugugcuuugacucaccuguu

SEQ ID NO: 2598440 - RNA, 20 nt, Human
ucugugcuuugacucaccug

SEQ ID NO: 2598441 - RNA, 21 nt, Human
ucugugcuuuccagcucaccc

SEQ ID NO: 2598442 - RNA, 12 nt, Human
ucugugggcugc

SEQ ID NO: 2598443 - RNA, 23 nt, Human
ucugugggaugggaugguggagg

SEQ ID NO: 2598444 - RNA, 22 nt, Human
ucuguggaccacugcaugagcu

SEQ ID NO: 2598445 - RNA, 20 nt, Human
ucugugcccaugggcacugc

SEQ ID NO: 2598446 - RNA, 19 nt, Human
ucugugcccaugggcacug

SEQ ID NO: 2598447 - RNA, 16 nt, Human
ucugugcccaugggca

SEQ ID NO: 2598448 - RNA, 22 nt, Human
ucugugcccaugggcacugcug

SEQ ID NO: 2598449 - RNA, 21 nt, Human
ucugugcccaugggcacugcu

SEQ ID NO: 2598450 - RNA, 14 nt, Human
ucugugccccaugc

SEQ ID NO: 2598451 - RNA, 17 nt, Human
ucugugcuuuccagcuc

SEQ ID NO: 2598452 - RNA, 16 nt, Human
ucugugcuuuccagcu

SEQ ID NO: 2598453 - RNA, 14 nt, Human
ucugugcuuuccag

SEQ ID NO: 2598454 - RNA, 15 nt, Human
ucugugccccaugcc

SEQ ID NO: 2598455 - RNA, 12 nt, Human
ucugugcugugu

SEQ ID NO: 2598456 - RNA, 17 nt, Human
ucugugccccaugccug

SEQ ID NO: 2598457 - RNA, 16 nt, Human
ucugugaugauccuca

SEQ ID NO: 2598458 - RNA, 16 nt, Human
ucugugaccucaggca

SEQ ID NO: 2598459 - RNA, 15 nt, Human
ucugugaccucaggc

SEQ ID NO: 2598460 - RNA, 14 nt, Human
ucugugaccucagg

SEQ ID NO: 2598461 - RNA, 13 nt, Human
ucugugaccucag

SEQ ID NO: 2598462 - RNA, 19 nt, Human
ucugugaccaaugucuuga

SEQ ID NO: 2598463 - RNA, 19 nt, Human
ucugugcaugguggcacca

SEQ ID NO: 2598464 - RNA, 17 nt, Human
ucugugcaugguggcac

SEQ ID NO: 2598465 - RNA, 21 nt, Human
ucugugcacgcaguggccuuc

SEQ ID NO: 2598466 - RNA, 19 nt, Human
ucugugcacgcaguggccu

SEQ ID NO: 2598467 - RNA, 22 nt, Human
ucugugcaugguggcaccagcg

SEQ ID NO: 2598468 - RNA, 15 nt, Human
ucugugcccaugggc

SEQ ID NO: 2598469 - RNA, 20 nt, Human
ucugugggcugcacucugug

SEQ ID NO: 2598470 - RNA, 19 nt, Human
ucugugggcugcacucugu

SEQ ID NO: 2598471 - RNA, 16 nt, Human
ucugugggcugcacuc

SEQ ID NO: 2598472 - RNA, 15 nt, Human
ucugugggcugcacu

SEQ ID NO: 2598473 - RNA, 23 nt, Human
ucugugggcugcacucugugccc

SEQ ID NO: 2598474 - RNA, 21 nt, Human
ucugugggcugcacucugugc

SEQ ID NO: 2598475 - RNA, 19 nt, Human
ucugugggugacccagguc

SEQ ID NO: 2598476 - RNA, 17 nt, Human
ucuguucugcacacagc

SEQ ID NO: 2598477 - RNA, 18 nt, Human
ucuguucugcacacagca

SEQ ID NO: 2598478 - RNA, 22 nt, Human
ucuguucuguggaaaguguaaa

SEQ ID NO: 2598479 - RNA, 19 nt, Human
ucuguucuguggaaagugu

SEQ ID NO: 2598480 - RNA, 16 nt, Human
ucuguucuguggaaag

SEQ ID NO: 2598481 - RNA, 15 nt, Human
ucuguucuguggaaa

SEQ ID NO: 2598482 - RNA, 23 nt, Human
ucuguucuguggaaaguguaaag

SEQ ID NO: 2598483 - RNA, 14 nt, Human
ucuguucuguggaa

SEQ ID NO: 2598484 - RNA, 12 nt, Human
ucuguucugugg

SEQ ID NO: 2598485 - RNA, 21 nt, Human
ucugugggugacccagguccu

SEQ ID NO: 2598486 - RNA, 19 nt, Human
ucuguucugcacacagcac

SEQ ID NO: 2598487 - RNA, 16 nt, Human
ucuguuuagauaauac

SEQ ID NO: 2598488 - RNA, 19 nt, Human
ucuguuuagauaauacacc

SEQ ID NO: 2598489 - RNA, 23 nt, Human
ucuguuuagauaauacaccacua

SEQ ID NO: 2598490 - RNA, 14 nt, Human
ucuguucuugcuac

SEQ ID NO: 2598491 - RNA, 13 nt, Human
ucuguucuugaag

SEQ ID NO: 2598492 - RNA, 20 nt, Human
ucuguccccuucucucaucu

SEQ ID NO: 2598493 - RNA, 19 nt, Human
ucuguccccuucucucauc

SEQ ID NO: 2598494 - RNA, 15 nt, Human
ucuguccccuucucu

SEQ ID NO: 2598495 - RNA, 21 nt, Human
ucugucccacuuggcaucagc

SEQ ID NO: 2598496 - RNA, 17 nt, Human
ucugucccacuuggcau

SEQ ID NO: 2598497 - RNA, 13 nt, Human
ucugucccagguu

SEQ ID NO: 2598498 - RNA, 23 nt, Human
ucuguauuuccccaacauguaau

SEQ ID NO: 2598499 - RNA, 20 nt, Human
ucuguauuuccccaacaugu

SEQ ID NO: 2598500 - RNA, 23 nt, Human
ucuguauuuaugugugaggagcu

SEQ ID NO: 2598501 - RNA, 13 nt, Human
ucuguccagggcc

SEQ ID NO: 2598502 - RNA, 17 nt, Human
ucuguccagggcccuga

SEQ ID NO: 2598503 - RNA, 19 nt, Human
ucuguccagggcccugagc

SEQ ID NO: 2598504 - RNA, 20 nt, Human
ucuguccagggcccugagcu

SEQ ID NO: 2598505 - RNA, 22 nt, Human
ucuguccccuucucucaucucu

SEQ ID NO: 2598506 - RNA, 21 nt, Human
ucuguccccuucucucaucuc

SEQ ID NO: 2598507 - RNA, 19 nt, Human
ucugucccgggguccugug

SEQ ID NO: 2598508 - RNA, 20 nt, Human
ucugucccgggguccugugg

SEQ ID NO: 2598509 - RNA, 11 nt, Human
ucugugaauaa

SEQ ID NO: 2598510 - RNA, 12 nt, Human
ucugugaauaag

SEQ ID NO: 2598511 - RNA, 13 nt, Human
ucugugaauaagc

SEQ ID NO: 2598512 - RNA, 16 nt, Human
ucugugaccaaugucu

SEQ ID NO: 2598513 - RNA, 18 nt, Human
ucugugaccaaugucuug

SEQ ID NO: 2598514 - RNA, 16 nt, Human
ucugugaauaagccau

SEQ ID NO: 2598515 - RNA, 15 nt, Human
ucugugaauucagau

SEQ ID NO: 2598516 - RNA, 18 nt, Human
ucuguacgucugacaggc

SEQ ID NO: 2598517 - RNA, 16 nt, Human
ucugguagauagaaau

SEQ ID NO: 2598518 - RNA, 18 nt, Human
ucugguagauagaaauaa

SEQ ID NO: 2598519 - RNA, 20 nt, Human
ucugguagauuuuuaacgaa

SEQ ID NO: 2598520 - RNA, 15 nt, Human
ucugggggaguggaa

SEQ ID NO: 2598521 - RNA, 15 nt, Human
ucuguauuuaauuuu

SEQ ID NO: 2598522 - RNA, 20 nt, Human
ucuguaucaggacccagagg

SEQ ID NO: 2598523 - RNA, 18 nt, Human
ucuguaucggagacagug

SEQ ID NO: 2598524 - RNA, 19 nt, Human
ucuguaucggagacaguga

SEQ ID NO: 2598525 - RNA, 12 nt, Human
ucuguaucucuc

SEQ ID NO: 2598526 - RNA, 21 nt, Human
ucuguaucggagacagugauc

SEQ ID NO: 2598527 - RNA, 13 nt, Human
ucuguaucucucu

SEQ ID NO: 2598528 - RNA, 12 nt, Human
ucuguagaaaug

SEQ ID NO: 2598529 - RNA, 21 nt, Human
ucuguagaaaugguuguauua

SEQ ID NO: 2598530 - RNA, 17 nt, Human
ucuguagaaaugguugu

SEQ ID NO: 2598531 - RNA, 15 nt, Human
ucuguauauacaaua

SEQ ID NO: 2598532 - RNA, 15 nt, Human
ucuguauauacuuuu

SEQ ID NO: 2598533 - RNA, 15 nt, Human
ucuguauauuuuggg

SEQ ID NO: 2598534 - RNA, 16 nt, Human
ucuguauauuuuggga

SEQ ID NO: 2598535 - RNA, 17 nt, Human
agacacacugaagaagc

SEQ ID NO: 2598536 - RNA, 17 nt, Human
agacacaggcccggcuc

SEQ ID NO: 2598537 - RNA, 16 nt, Human
agacacacugaagaag

SEQ ID NO: 2598538 - RNA, 10 nt, Human
agacacacac

SEQ ID NO: 2598539 - RNA, 11 nt, Human
agacacacaca

SEQ ID NO: 2598540 - RNA, 17 nt, Human
agacacacgcacacaca

SEQ ID NO: 2598541 - RNA, 18 nt, Human
agacacacgcacacacac

SEQ ID NO: 2598542 - RNA, 22 nt, Human
agacacaggcccggcuccaggc

SEQ ID NO: 2598543 - RNA, 21 nt, Human
agacacaggcccggcuccagg

SEQ ID NO: 2598544 - RNA, 20 nt, Human
agacacaggcccggcuccag

SEQ ID NO: 2598545 - RNA, 19 nt, Human
agacacaggcccggcucca

SEQ ID NO: 2598546 - RNA, 20 nt, Human
agacacaacuauuuuuccaa

SEQ ID NO: 2598547 - RNA, 19 nt, Human
agacacaacuauuuuucca

SEQ ID NO: 2598548 - RNA, 13 nt, Human
agacacaagccuu

SEQ ID NO: 2598549 - RNA, 14 nt, Human
agacacaagccuuc

SEQ ID NO: 2598550 - RNA, 18 nt, Human
agaauucucuaguuugau

SEQ ID NO: 2598551 - RNA, 19 nt, Human
agaauucucuaguuugauu

SEQ ID NO: 2598552 - RNA, 17 nt, Human
agaauucucuuauccaa

SEQ ID NO: 2598553 - RNA, 13 nt, Human
agaauucugcuac

SEQ ID NO: 2598554 - RNA, 20 nt, Human
agaauucugcuaccucacug

SEQ ID NO: 2598555 - RNA, 22 nt, Human
agaauucugcuaccucacuggg

SEQ ID NO: 2598556 - RNA, 15 nt, Human
agacacagggacuug

SEQ ID NO: 2598557 - RNA, 22 nt, Human
agacaccuuggacauccuccuc

SEQ ID NO: 2598558 - RNA, 22 nt, Human
agacaccuugacagggcacacc

SEQ ID NO: 2598559 - RNA, 24 nt, Human
agacacauguccaagaagcccagg

SEQ ID NO: 2598560 - RNA, 19 nt, Human
agacaccuugacagggcac

SEQ ID NO: 2598561 - RNA, 22 nt, Human
agacacauguccaagaagccca

SEQ ID NO: 2598562 - RNA, 21 nt, Human
agacacauguccaagaagccc

SEQ ID NO: 2598563 - RNA, 23 nt, Human
agacacaggcccggcuccaggcu

SEQ ID NO: 2598564 - RNA, 18 nt, Human
agacacagaagaggcugg

SEQ ID NO: 2598565 - RNA, 13 nt, Human
agacacaggcccu

SEQ ID NO: 2598566 - RNA, 17 nt, Human
agacacagaagaggcug

SEQ ID NO: 2598567 - RNA, 20 nt, Human
agacagaagcaggcuggagg

SEQ ID NO: 2598568 - RNA, 19 nt, Human
agacagaagcaggcuggag

SEQ ID NO: 2598569 - RNA, 17 nt, Human
agacagaagcaggcugg

SEQ ID NO: 2598570 - RNA, 16 nt, Human
agacagaagcaggcug

SEQ ID NO: 2598571 - RNA, 15 nt, Human
agacagaagcaggcu

SEQ ID NO: 2598572 - RNA, 17 nt, Human
agacagaaccuuguuau

SEQ ID NO: 2598573 - RNA, 17 nt, Human
agacagaaccccuacau

SEQ ID NO: 2598574 - RNA, 18 nt, Human
agacagaaccuuguuauu

SEQ ID NO: 2598575 - RNA, 14 nt, Human
agacagcugccugg

SEQ ID NO: 2598576 - RNA, 13 nt, Human
agacagcugccug

SEQ ID NO: 2598577 - RNA, 16 nt, Human
agacacgcucuucuau

SEQ ID NO: 2598578 - RNA, 21 nt, Human
agacacggagcccagcccucc

SEQ ID NO: 2598579 - RNA, 12 nt, Human
agacagaaaaaa

SEQ ID NO: 2598580 - RNA, 15 nt, Human
agacacuugccuucu

SEQ ID NO: 2598581 - RNA, 15 nt, Human
ucuuacauguuuucu

SEQ ID NO: 2598582 - RNA, 19 nt, Human
ucuuacaggcacaaaauga

SEQ ID NO: 2598583 - RNA, 17 nt, Human
ucuuacaggcacaaaau

SEQ ID NO: 2598584 - RNA, 14 nt, Human
ucuuacauguuuuc

SEQ ID NO: 2598585 - RNA, 23 nt, Human
ucuuaccuguaugucuccaguau

SEQ ID NO: 2598586 - RNA, 21 nt, Human
ucuuaccuguaugucuccagu

SEQ ID NO: 2598587 - RNA, 14 nt, Human
ucuuacuaaacauu

SEQ ID NO: 2598588 - RNA, 18 nt, Human
ucuuacgauggcacccag

SEQ ID NO: 2598589 - RNA, 19 nt, Human
ucuuacgcccaacccuucc

SEQ ID NO: 2598590 - RNA, 24 nt, Human
ucuuacuaaacauuuuguuauugg

SEQ ID NO: 2598591 - RNA, 16 nt, Human
ucuuacuaaacauuuu

SEQ ID NO: 2598592 - RNA, 19 nt, Human
ucuuacugucuuuuuucua

SEQ ID NO: 2598593 - RNA, 22 nt, Human
ucuuacugcaaaugucaucaga

SEQ ID NO: 2598594 - RNA, 18 nt, Human
ucuuacuguaccuguucc

SEQ ID NO: 2598595 - RNA, 13 nt, Human
ucuuacugaaggu

SEQ ID NO: 2598596 - RNA, 15 nt, Human
ucuuacugcaaaugu

SEQ ID NO: 2598597 - RNA, 14 nt, Human
ucuuacugcaaaug

SEQ ID NO: 2598598 - RNA, 13 nt, Human
ucuuacugcaaau

SEQ ID NO: 2598599 - RNA, 23 nt, Human
ucuuacugaagguaaaauugaaa

SEQ ID NO: 2598600 - RNA, 22 nt, Human
ucuuauuagaacaggcaaguga

SEQ ID NO: 2598601 - RNA, 17 nt, Human
ucuuauuagggagaaaa

SEQ ID NO: 2598602 - RNA, 22 nt, Human
ucuuagauggauucuccacuca

SEQ ID NO: 2598603 - RNA, 13 nt, Human
ucuuagaaaugaa

SEQ ID NO: 2598604 - RNA, 18 nt, Human
ucuuagauggauucucca

SEQ ID NO: 2598605 - RNA, 18 nt, Human
ucuuauguaugugaaagu

SEQ ID NO: 2598606 - RNA, 23 nt, Human
ucuuacuuuccuuuccccagccc

SEQ ID NO: 2598607 - RNA, 22 nt, Human
ucuuacuuuccuuuccccagcc

SEQ ID NO: 2598608 - RNA, 22 nt, Human
ucuuagaugcaguucugaagaa

SEQ ID NO: 2598609 - RNA, 23 nt, Human
ucuuagaugcaguucugaagaag

SEQ ID NO: 2598610 - RNA, 12 nt, Human
ucuuagauguau

SEQ ID NO: 2598611 - RNA, 16 nt, Human
agacagcugccuggga

SEQ ID NO: 2598612 - RNA, 15 nt, Human
agacagcugccuggg

SEQ ID NO: 2598613 - RNA, 12 nt, Human
agacagucccug

SEQ ID NO: 2598614 - RNA, 22 nt, Human
agacaguaugagucaaugugca

SEQ ID NO: 2598615 - RNA, 17 nt, Human
agacagucaaggagugg

SEQ ID NO: 2598616 - RNA, 20 nt, Human
agacagucaaggaguggcuu

SEQ ID NO: 2598617 - RNA, 19 nt, Human
agacagucccugccaaugg

SEQ ID NO: 2598618 - RNA, 14 nt, Human
agacagucccugcc

SEQ ID NO: 2598619 - RNA, 13 nt, Human
agacagucccugc

SEQ ID NO: 2598620 - RNA, 15 nt, Human
agacagugaucucca

SEQ ID NO: 2598621 - RNA, 17 nt, Human
agacagugaucuccaua

SEQ ID NO: 2598622 - RNA, 18 nt, Human
agacagugaucuccauau

SEQ ID NO: 2598623 - RNA, 20 nt, Human
agacagugaucuccauaugu

SEQ ID NO: 2598624 - RNA, 21 nt, Human
agacagugaucuccauauguu

SEQ ID NO: 2598625 - RNA, 14 nt, Human
agacagugggaaau

SEQ ID NO: 2598626 - RNA, 13 nt, Human
agacagugggaaa

SEQ ID NO: 2598627 - RNA, 17 nt, Human
agacaguccagccugga

SEQ ID NO: 2598628 - RNA, 12 nt, Human
agacagugaucu

SEQ ID NO: 2598629 - RNA, 15 nt, Human
agacaguccagccug

SEQ ID NO: 2598630 - RNA, 17 nt, Human
agacagucaccccagga

SEQ ID NO: 2598631 - RNA, 14 nt, Human
agacaguuucuuag

SEQ ID NO: 2598632 - RNA, 13 nt, Human
agacaguuucuua

SEQ ID NO: 2598633 - RNA, 15 nt, Human
agacaguucaagaaa

SEQ ID NO: 2598634 - RNA, 20 nt, Human
ucuuaaucuuuucacaaaua

SEQ ID NO: 2598635 - RNA, 19 nt, Human
ucuuaaucuuuucacaaau

SEQ ID NO: 2598636 - RNA, 15 nt, Human
agacagugggaaaua

SEQ ID NO: 2598637 - RNA, 14 nt, Human
agacaguucaagaa

SEQ ID NO: 2598638 - RNA, 20 nt, Human
agacaguugggugagaacaa

SEQ ID NO: 2598639 - RNA, 20 nt, Human
ucuuaaugaaguuugaaugu

SEQ ID NO: 2598640 - RNA, 19 nt, Human
ucuuaaugaaguuugaaug

SEQ ID NO: 2598641 - RNA, 18 nt, Human
ucuuaaugaaguuugaau

SEQ ID NO: 2598642 - RNA, 17 nt, Human
ucuuaaugaaguuugaa

SEQ ID NO: 2598643 - RNA, 16 nt, Human
ucuuaaugaaguuuga

SEQ ID NO: 2598644 - RNA, 15 nt, Human
ucuuaaugaaguuug

SEQ ID NO: 2598645 - RNA, 22 nt, Human
ucuuaaucuuuucacaaauaaa

SEQ ID NO: 2598646 - RNA, 21 nt, Human
ucuuaaucuuuucacaaauaa

SEQ ID NO: 2598647 - RNA, 22 nt, Human
ucuuaaugaaguuugaauguua

SEQ ID NO: 2598648 - RNA, 21 nt, Human
ucuuaaugaaguuugaauguu

SEQ ID NO: 2598649 - RNA, 23 nt, Human
ucuuaaugaaguuugaauguuaa

SEQ ID NO: 2598650 - RNA, 20 nt, Human
ucuuaauuauuauuuguguu

SEQ ID NO: 2598651 - RNA, 19 nt, Human
ucuuaauuuugguuguauu

SEQ ID NO: 2598652 - RNA, 17 nt, Human
ucuuaauuuugguugua

SEQ ID NO: 2598653 - RNA, 23 nt, Human
ucuuaauuuaaucuuuuuuaugu

SEQ ID NO: 2598654 - RNA, 19 nt, Human
ucuuacaauaauucuauga

SEQ ID NO: 2598655 - RNA, 21 nt, Human
ucuuaauuuugguuguauucu

SEQ ID NO: 2598656 - RNA, 20 nt, Human
ucuuaauuuugguuguauuc

SEQ ID NO: 2598657 - RNA, 14 nt, Human
ucuuacaaacaugu

SEQ ID NO: 2598658 - RNA, 14 nt, Human
agacuuccuugaga

SEQ ID NO: 2598659 - RNA, 16 nt, Human
agacuuccuugagaca

SEQ ID NO: 2598660 - RNA, 15 nt, Human
agacuucccugaaug

SEQ ID NO: 2598661 - RNA, 19 nt, Human
agacuucccugaauguauu

SEQ ID NO: 2598662 - RNA, 21 nt, Human
agacuuccaaaccugacagau

SEQ ID NO: 2598663 - RNA, 19 nt, Human
agacuuaguauauuuucuu

SEQ ID NO: 2598664 - RNA, 22 nt, Human
agacuuaguauauuuucuuuuc

SEQ ID NO: 2598665 - RNA, 17 nt, Human
agacuuagggcaccagg

SEQ ID NO: 2598666 - RNA, 21 nt, Human
agacuuacuuuacucauuuuu

SEQ ID NO: 2598667 - RNA, 18 nt, Human
agacuuaguauauuuucu

SEQ ID NO: 2598668 - RNA, 20 nt, Human
agacuuccaaaccugacaga

SEQ ID NO: 2598669 - RNA, 19 nt, Human
agacuuccaaaccugacag

SEQ ID NO: 2598670 - RNA, 17 nt, Human
agacuucauuuuuccua

SEQ ID NO: 2598671 - RNA, 20 nt, Human
agacuuacuuuacucauuuu

SEQ ID NO: 2598672 - RNA, 19 nt, Human
agacuuacuuuacucauuu

SEQ ID NO: 2598673 - RNA, 16 nt, Human
agacuuagggcaccag

SEQ ID NO: 2598674 - RNA, 15 nt, Human
agacuuaccaggaag

SEQ ID NO: 2598675 - RNA, 23 nt, Human
agacuuaauagaaacauugaaga

SEQ ID NO: 2598676 - RNA, 20 nt, Human
agacuguaggaagaguagca

SEQ ID NO: 2598677 - RNA, 18 nt, Human
agacuguagccuggauau

SEQ ID NO: 2598678 - RNA, 17 nt, Human
agacuuaauagaaacau

SEQ ID NO: 2598679 - RNA, 23 nt, Human
agacuguuuuucagggagguggc

SEQ ID NO: 2598680 - RNA, 21 nt, Human
agacugucagcuuccaaacau

SEQ ID NO: 2598681 - RNA, 22 nt, Human
agacuguaggaagaguagcauu

SEQ ID NO: 2598682 - RNA, 14 nt, Human
agacuguacaaagu

SEQ ID NO: 2598683 - RNA, 15 nt, Human
agacuguacaaagua

SEQ ID NO: 2598684 - RNA, 16 nt, Human
agacuguacaaaguag

SEQ ID NO: 2598685 - RNA, 18 nt, Human
agacugguccugugugca

SEQ ID NO: 2598686 - RNA, 17 nt, Human
agacugguccugugugc

SEQ ID NO: 2598687 - RNA, 15 nt, Human
agacugguccugugu

SEQ ID NO: 2598688 - RNA, 15 nt, Human
agacuggguuucuag

SEQ ID NO: 2598689 - RNA, 20 nt, Human
agacucgcgacaaugcaaac

SEQ ID NO: 2598690 - RNA, 23 nt, Human
agacucgauucauauugaauaua

SEQ ID NO: 2598691 - RNA, 14 nt, Human
ucuuucuuagaaau

SEQ ID NO: 2598692 - RNA, 22 nt, Human
agacuugguguccuuucccucc

SEQ ID NO: 2598693 - RNA, 23 nt, Human
agacuugguguccuuucccucca

SEQ ID NO: 2598694 - RNA, 20 nt, Human
agacuucgacucaggaucca

SEQ ID NO: 2598695 - RNA, 16 nt, Human
agacuucgacucagga

SEQ ID NO: 2598696 - RNA, 19 nt, Human
agacuugguguccuuuccc

SEQ ID NO: 2598697 - RNA, 18 nt, Human
agacuuguaugaaagaug

SEQ ID NO: 2598698 - RNA, 19 nt, Human
agacuuuacaugacacagc

SEQ ID NO: 2598699 - RNA, 14 nt, Human
agacuuuaaagaau

SEQ ID NO: 2598700 - RNA, 20 nt, Human
agacuuuacaugacacagcu

SEQ ID NO: 2598701 - RNA, 12 nt, Human
agacuuucuguu

SEQ ID NO: 2598702 - RNA, 19 nt, Human
agacuuuucuuucagccaa

SEQ ID NO: 2598703 - RNA, 19 nt, Human
agacuuuuuuuaaauagua

SEQ ID NO: 2598704 - RNA, 21 nt, Human
agagaaaaaaaguuugccaga

SEQ ID NO: 2598705 - RNA, 22 nt, Human
agagaaaaaauauuuuccugcc

SEQ ID NO: 2598706 - RNA, 24 nt, Human
agagacagaaagcagaacagugau

SEQ ID NO: 2598707 - RNA, 20 nt, Human
agagacagaagcaggcugga

SEQ ID NO: 2598708 - RNA, 17 nt, Human
agagacagaagcaggcu

SEQ ID NO: 2598709 - RNA, 15 nt, Human
agagacagaagcagg

SEQ ID NO: 2598710 - RNA, 14 nt, Human
agagacagaagcag

SEQ ID NO: 2598711 - RNA, 20 nt, Human
agagacaaacaccucccagg

SEQ ID NO: 2598712 - RNA, 13 nt, Human
agagacagaagca

SEQ ID NO: 2598713 - RNA, 23 nt, Human
agagacagaagcaggcuggaggu

SEQ ID NO: 2598714 - RNA, 13 nt, Human
agagacagagagg

SEQ ID NO: 2598715 - RNA, 22 nt, Human
agagaauuucuaccauuucaga

SEQ ID NO: 2598716 - RNA, 23 nt, Human
agagaauuucuaccauuucagag

SEQ ID NO: 2598717 - RNA, 19 nt, Human
agagacaaacaccucccag

SEQ ID NO: 2598718 - RNA, 21 nt, Human
agagacaaacaccucccagga

SEQ ID NO: 2598719 - RNA, 17 nt, Human
agagaauggaaaacaga

SEQ ID NO: 2598720 - RNA, 16 nt, Human
agagaaugucugaucu

SEQ ID NO: 2598721 - RNA, 19 nt, Human
agagaauuguuugaacccg

SEQ ID NO: 2598722 - RNA, 13 nt, Human
agagaaaaacaaa

SEQ ID NO: 2598723 - RNA, 17 nt, Human
agagaauguagauauug

SEQ ID NO: 2598724 - RNA, 15 nt, Human
agagaaaaacaaauu

SEQ ID NO: 2598725 - RNA, 17 nt, Human
ucuuuauacaacagugc

SEQ ID NO: 2598726 - RNA, 14 nt, Human
ucuuuauacaacag

SEQ ID NO: 2598727 - RNA, 13 nt, Human
ucuuuauacaaca

SEQ ID NO: 2598728 - RNA, 20 nt, Human
ucuuuauaauucuacuuuga

SEQ ID NO: 2598729 - RNA, 16 nt, Human
ucuuuauacuguaauu

SEQ ID NO: 2598730 - RNA, 21 nt, Human
ucuuuauacaacagugcuaaa

SEQ ID NO: 2598731 - RNA, 20 nt, Human
ucuuuauacaacagugcuaa

SEQ ID NO: 2598732 - RNA, 13 nt, Human
ucuuucugcuuug

SEQ ID NO: 2598733 - RNA, 16 nt, Human
ucuuucuuagaaauuu

SEQ ID NO: 2598734 - RNA, 15 nt, Human
ucuuucuuagaaauu

SEQ ID NO: 2598735 - RNA, 19 nt, Human
ucuuucuggcuaugcauuu

SEQ ID NO: 2598736 - RNA, 14 nt, Human
ucuuucuuccucug

SEQ ID NO: 2598737 - RNA, 18 nt, Human
ucuuucuggcuaugcauu

SEQ ID NO: 2598738 - RNA, 13 nt, Human
ucuuucuggaguc

SEQ ID NO: 2598739 - RNA, 21 nt, Human
ucuuucugcagaaacagaaag

SEQ ID NO: 2598740 - RNA, 22 nt, Human
ucuuucugcagaaacagaaagg

SEQ ID NO: 2598741 - RNA, 19 nt, Human
agacucgcgacaaugcaaa

SEQ ID NO: 2598742 - RNA, 18 nt, Human
agacucgcgacaaugcaa

SEQ ID NO: 2598743 - RNA, 17 nt, Human
agacucgcgacaaugca

SEQ ID NO: 2598744 - RNA, 15 nt, Human
agacucgcgacaaug

SEQ ID NO: 2598745 - RNA, 16 nt, Human
ucuuucuuccucugcu

SEQ ID NO: 2598746 - RNA, 15 nt, Human
ucuuucuuccucugc

SEQ ID NO: 2598747 - RNA, 19 nt, Human
ucuuucuuagaaauuuauu

SEQ ID NO: 2598748 - RNA, 17 nt, Human
ucuuucuuccucugcug

SEQ ID NO: 2598749 - RNA, 15 nt, Human
agacuccugcccugu

SEQ ID NO: 2598750 - RNA, 14 nt, Human
agacuccugcccug

SEQ ID NO: 2598751 - RNA, 16 nt, Human
agacuccugcccuguu

SEQ ID NO: 2598752 - RNA, 20 nt, Human
agacuccuugagagaccagg

SEQ ID NO: 2598753 - RNA, 14 nt, Human
agacucgagaacuu

SEQ ID NO: 2598754 - RNA, 18 nt, Human
agacucgagaacuuucau

SEQ ID NO: 2598755 - RNA, 15 nt, Human
agacucgagaacuuu

SEQ ID NO: 2598756 - RNA, 19 nt, Human
agacucgagaacuuucauu

SEQ ID NO: 2598757 - RNA, 20 nt, Human
agacucgauucauauugaau

SEQ ID NO: 2598758 - RNA, 21 nt, Human
ucuugauaccccccucugucu

SEQ ID NO: 2598759 - RNA, 20 nt, Human
ucuugauaccccccucuguc

SEQ ID NO: 2598760 - RNA, 17 nt, Human
ucuugauaccccccucu

SEQ ID NO: 2598761 - RNA, 19 nt, Human
ucuugaucaacaucuuuuc

SEQ ID NO: 2598762 - RNA, 18 nt, Human
ucuugaucaacaucuuuu

SEQ ID NO: 2598763 - RNA, 22 nt, Human
ucuugauaccccccucugucuu

SEQ ID NO: 2598764 - RNA, 17 nt, Human
ucuugaucaacaucuuu

SEQ ID NO: 2598765 - RNA, 17 nt, Human
ucuuggucuucccaggc

SEQ ID NO: 2598766 - RNA, 15 nt, Human
ucuuggucuucccag

SEQ ID NO: 2598767 - RNA, 13 nt, Human
ucuugguuccagc

SEQ ID NO: 2598768 - RNA, 23 nt, Human
ucuugaucaacaucuuuucuugc

SEQ ID NO: 2598769 - RNA, 20 nt, Human
ucuugaucaacaucuuuucu

SEQ ID NO: 2598770 - RNA, 17 nt, Human
ucuugguuccagccugc

SEQ ID NO: 2598771 - RNA, 18 nt, Human
ucuugguuccagccugcc

SEQ ID NO: 2598772 - RNA, 21 nt, Human
ucuugguucauaaaugaauuu

SEQ ID NO: 2598773 - RNA, 18 nt, Human
ucuugguucauaaaugaa

SEQ ID NO: 2598774 - RNA, 19 nt, Human
ucuugguugaaaauaaaaa

SEQ ID NO: 2598775 - RNA, 19 nt, Human
ucuugguuccagccugcca

SEQ ID NO: 2598776 - RNA, 23 nt, Human
ucuugguugaaaauaaaaagauc

SEQ ID NO: 2598777 - RNA, 13 nt, Human
ucuugguugagga

SEQ ID NO: 2598778 - RNA, 14 nt, Human
ucuugguuuccaaa

SEQ ID NO: 2598779 - RNA, 17 nt, Human
ucuugguuggcuggccu

SEQ ID NO: 2598780 - RNA, 15 nt, Human
ucuugguugaggaaa

SEQ ID NO: 2598781 - RNA, 14 nt, Human
ucuugguuuguaaa

SEQ ID NO: 2598782 - RNA, 14 nt, Human
ucuuuaauuuuaca

SEQ ID NO: 2598783 - RNA, 22 nt, Human
ucuuuaaugucacaggcagguc

SEQ ID NO: 2598784 - RNA, 15 nt, Human
ucuuuaguuuuugug

SEQ ID NO: 2598785 - RNA, 16 nt, Human
ucuugguuuguaaauu

SEQ ID NO: 2598786 - RNA, 15 nt, Human
ucuugguuuccuucc

SEQ ID NO: 2598787 - RNA, 17 nt, Human
ucuuguaaauaaagccc

SEQ ID NO: 2598788 - RNA, 13 nt, Human
ucuuguaaauaaa

SEQ ID NO: 2598789 - RNA, 20 nt, Human
ucuuuaaugucacaggcagg

SEQ ID NO: 2598790 - RNA, 18 nt, Human
ucuuguaaauaaagcccu

SEQ ID NO: 2598791 - RNA, 20 nt, Human
ucuucugcccaauuggagga

SEQ ID NO: 2598792 - RNA, 18 nt, Human
ucuucugccggcccuggg

SEQ ID NO: 2598793 - RNA, 19 nt, Human
ucuucugccggcccugggg

SEQ ID NO: 2598794 - RNA, 22 nt, Human
ucuucugcuaugugacuugcau

SEQ ID NO: 2598795 - RNA, 16 nt, Human
ucuucugccuguuaua

SEQ ID NO: 2598796 - RNA, 15 nt, Human
ucuucugccuguuau

SEQ ID NO: 2598797 - RNA, 12 nt, Human
ucuucugccugu

SEQ ID NO: 2598798 - RNA, 11 nt, Human
ucuucugcucc

SEQ ID NO: 2598799 - RNA, 12 nt, Human
ucuucugcucca

SEQ ID NO: 2598800 - RNA, 22 nt, Human
ucuucugcuucagccucccgag

SEQ ID NO: 2598801 - RNA, 17 nt, Human
ucuucugggagggcagc

SEQ ID NO: 2598802 - RNA, 18 nt, Human
ucuucuggcucaaaaaga

SEQ ID NO: 2598803 - RNA, 21 nt, Human
ucuucuggcucaaaaagagaa

SEQ ID NO: 2598804 - RNA, 12 nt, Human
ucuucuggcuca

SEQ ID NO: 2598805 - RNA, 13 nt, Human
ucuucuggcucaa

SEQ ID NO: 2598806 - RNA, 17 nt, Human
ucuucuggagucuccag

SEQ ID NO: 2598807 - RNA, 19 nt, Human
ucuucuggagucuccagug

SEQ ID NO: 2598808 - RNA, 22 nt, Human
ucuucuguacgucugacaggca

SEQ ID NO: 2598809 - RNA, 21 nt, Human
ucuucuguacgucugacaggc

SEQ ID NO: 2598810 - RNA, 15 nt, Human
ucuuauuucauuucu

SEQ ID NO: 2598811 - RNA, 14 nt, Human
ucuuauuucaugaa

SEQ ID NO: 2598812 - RNA, 13 nt, Human
ucuuauuuauuau

SEQ ID NO: 2598813 - RNA, 15 nt, Human
ucuuauucucacucc

SEQ ID NO: 2598814 - RNA, 22 nt, Human
ucuuauugcaaaauagcauuug

SEQ ID NO: 2598815 - RNA, 17 nt, Human
ucuuauuuaaugaaaga

SEQ ID NO: 2598816 - RNA, 18 nt, Human
ucuuauucaguaaaaaac

SEQ ID NO: 2598817 - RNA, 17 nt, Human
ucuuauucaguaaaaaa

SEQ ID NO: 2598818 - RNA, 18 nt, Human
ucuuauuucaugaaaauu

SEQ ID NO: 2598819 - RNA, 16 nt, Human
ucuuauuucaugaaaa

SEQ ID NO: 2598820 - RNA, 11 nt, Human
ucuuauuugcu

SEQ ID NO: 2598821 - RNA, 16 nt, Human
ucuuauuucauuucuu

SEQ ID NO: 2598822 - RNA, 21 nt, Human
ucuucugacuuaagugugcaa

SEQ ID NO: 2598823 - RNA, 19 nt, Human
ucuucugagcuauuucauc

SEQ ID NO: 2598824 - RNA, 21 nt, Human
ucuucugagcuauuucaucua

SEQ ID NO: 2598825 - RNA, 17 nt, Human
ucuucugacgugccuuu

SEQ ID NO: 2598826 - RNA, 15 nt, Human
ucuucugacgugccu

SEQ ID NO: 2598827 - RNA, 14 nt, Human
ucuucugacgugcc

SEQ ID NO: 2598828 - RNA, 13 nt, Human
ucuucuucaccau

SEQ ID NO: 2598829 - RNA, 14 nt, Human
ucuucuucaccauu

SEQ ID NO: 2598830 - RNA, 12 nt, Human
ucuucuuaugca

SEQ ID NO: 2598831 - RNA, 15 nt, Human
ucuucuucaccauuu

SEQ ID NO: 2598832 - RNA, 14 nt, Human
ucuucuucagaaga

SEQ ID NO: 2598833 - RNA, 13 nt, Human
ucuucuucccucc

SEQ ID NO: 2598834 - RNA, 16 nt, Human
ucuucuucagaagaca

SEQ ID NO: 2598835 - RNA, 23 nt, Human
ucuucuguacgucugacaggcaa

SEQ ID NO: 2598836 - RNA, 15 nt, Human
ucuucuuacaugcau

SEQ ID NO: 2598837 - RNA, 20 nt, Human
ucuucuguacgucugacagg

SEQ ID NO: 2598838 - RNA, 23 nt, Human
agacauacuaaccagcagaaaug

SEQ ID NO: 2598839 - RNA, 13 nt, Human
ucuucuugaaauu

SEQ ID NO: 2598840 - RNA, 17 nt, Human
ucuucuugaaauuuuaa

SEQ ID NO: 2598841 - RNA, 19 nt, Human
ucuucuuccugaagcugag

SEQ ID NO: 2598842 - RNA, 22 nt, Human
ucuucuucccucccuaucuaac

SEQ ID NO: 2598843 - RNA, 14 nt, Human
ucuucuucuucaga

SEQ ID NO: 2598844 - RNA, 14 nt, Human
agacauacuugaag

SEQ ID NO: 2598845 - RNA, 16 nt, Human
agacauacuugaaggg

SEQ ID NO: 2598846 - RNA, 17 nt, Human
agacauacuugaagggc

SEQ ID NO: 2598847 - RNA, 19 nt, Human
agacauacuugaagggcca

SEQ ID NO: 2598848 - RNA, 13 nt, Human
agacauacuugaa

SEQ ID NO: 2598849 - RNA, 22 nt, Human
agacauacuccuuccaucaaau

SEQ ID NO: 2598850 - RNA, 23 nt, Human
ucuucuugaacacucaugcugaa

SEQ ID NO: 2598851 - RNA, 22 nt, Human
ucuucuugaacacucaugcuga

SEQ ID NO: 2598852 - RNA, 21 nt, Human
ucuucuugaacacucaugcug

SEQ ID NO: 2598853 - RNA, 15 nt, Human
ucuucuucuucagaa

SEQ ID NO: 2598854 - RNA, 23 nt, Human
agacauuucucuuacugcaaaug

SEQ ID NO: 2598855 - RNA, 21 nt, Human
agacauuugcuaugagcuggg

SEQ ID NO: 2598856 - RNA, 22 nt, Human
agacauuuguaaauguaaaacu

SEQ ID NO: 2598857 - RNA, 22 nt, Human
agacauggagacuccugcccug

SEQ ID NO: 2598858 - RNA, 16 nt, Human
agacauggcuugccac

SEQ ID NO: 2598859 - RNA, 23 nt, Human
agacauuuauacucuuuuuucau

SEQ ID NO: 2598860 - RNA, 21 nt, Human
agacauuuauacucuuuuuuc

SEQ ID NO: 2598861 - RNA, 17 nt, Human
agacauuuauacucuuu

SEQ ID NO: 2598862 - RNA, 15 nt, Human
agacauuuauacucu

SEQ ID NO: 2598863 - RNA, 22 nt, Human
agacauggcuugccacagcucu

SEQ ID NO: 2598864 - RNA, 12 nt, Human
agacauggggag

SEQ ID NO: 2598865 - RNA, 23 nt, Human
agacauuguuuugccaacauugc

SEQ ID NO: 2598866 - RNA, 14 nt, Human
agacauagaauuaa

SEQ ID NO: 2598867 - RNA, 20 nt, Human
agacauacuugaagggccag

SEQ ID NO: 2598868 - RNA, 21 nt, Human
agacauacuugaagggccaga

SEQ ID NO: 2598869 - RNA, 23 nt, Human
agacauacuugaagggccagagc

SEQ ID NO: 2598870 - RNA, 14 nt, Human
agacaugaauauga

SEQ ID NO: 2598871 - RNA, 20 nt, Human
agacaugagugcgugcucag

SEQ ID NO: 2598872 - RNA, 22 nt, Human
agacaugauuuccuugaaugug

SEQ ID NO: 2598873 - RNA, 15 nt, Human
agacaugauuuccuu

SEQ ID NO: 2598874 - RNA, 17 nt, Human
agacaugaauaugauua

SEQ ID NO: 2598875 - RNA, 17 nt, Human
agacaugaaugcacacu

SEQ ID NO: 2598876 - RNA, 19 nt, Human
agacauggagacuccugcc

SEQ ID NO: 2598877 - RNA, 18 nt, Human
agacauggagacuccugc

SEQ ID NO: 2598878 - RNA, 13 nt, Human
agacauggagacu

SEQ ID NO: 2598879 - RNA, 15 nt, Human
agacaugcugacuuu

SEQ ID NO: 2598880 - RNA, 23 nt, Human
agacaugccacaaggacuuccug

SEQ ID NO: 2598881 - RNA, 18 nt, Human
ucuugagccuugaacuuu

SEQ ID NO: 2598882 - RNA, 19 nt, Human
ucuugagccuugaacuuug

SEQ ID NO: 2598883 - RNA, 17 nt, Human
agacucaucuuacugua

SEQ ID NO: 2598884 - RNA, 16 nt, Human
agacucaucuuacugu

SEQ ID NO: 2598885 - RNA, 21 nt, Human
ucuugaguuugucgcucaugu

SEQ ID NO: 2598886 - RNA, 22 nt, Human
ucuugauaagaccaccaccuca

SEQ ID NO: 2598887 - RNA, 18 nt, Human
agacucaucuuacuguac

SEQ ID NO: 2598888 - RNA, 14 nt, Human
ucuugauaagacca

SEQ ID NO: 2598889 - RNA, 22 nt, Human
ucuugaguuugucgcucaugug

SEQ ID NO: 2598890 - RNA, 21 nt, Human
ucuugaguuuuguuuuaaaau

SEQ ID NO: 2598891 - RNA, 17 nt, Human
ucuugagccuugaacuu

SEQ ID NO: 2598892 - RNA, 15 nt, Human
agacucauucuucug

SEQ ID NO: 2598893 - RNA, 21 nt, Human
agacucaguggggaggggcug

SEQ ID NO: 2598894 - RNA, 15 nt, Human
agacucaccucugcc

SEQ ID NO: 2598895 - RNA, 12 nt, Human
agacucaguguu

SEQ ID NO: 2598896 - RNA, 13 nt, Human
agacucaguguuc

SEQ ID NO: 2598897 - RNA, 12 nt, Human
agacucaguuug

SEQ ID NO: 2598898 - RNA, 15 nt, Human
agacucaguuuguca

SEQ ID NO: 2598899 - RNA, 16 nt, Human
agacucaguuugucag

SEQ ID NO: 2598900 - RNA, 17 nt, Human
agacucaguuugucaga

SEQ ID NO: 2598901 - RNA, 21 nt, Human
agacucaguuugucagacuuu

SEQ ID NO: 2598902 - RNA, 22 nt, Human
agaccugccccuccucucugcc

SEQ ID NO: 2598903 - RNA, 23 nt, Human
agaccugccccuccucucugccc

SEQ ID NO: 2598904 - RNA, 16 nt, Human
agaccugccccuccuc

SEQ ID NO: 2598905 - RNA, 16 nt, Human
agaccucgagcagaug

SEQ ID NO: 2598906 - RNA, 13 nt, Human
agaccugccccuc

SEQ ID NO: 2598907 - RNA, 23 nt, Human
agacuauucaaacagucucagga

SEQ ID NO: 2598908 - RNA, 20 nt, Human
agaccugcugagggaccagc

SEQ ID NO: 2598909 - RNA, 22 nt, Human
agacucaagguucccagagaug

SEQ ID NO: 2598910 - RNA, 21 nt, Human
agacucaagguucccagagau

SEQ ID NO: 2598911 - RNA, 12 nt, Human
agacucaccucu

SEQ ID NO: 2598912 - RNA, 14 nt, Human
agacucaccucugc

SEQ ID NO: 2598913 - RNA, 22 nt, Human
agacucagguuguaguaaagaa

SEQ ID NO: 2598914 - RNA, 23 nt, Human
agacucagguuguaguaaagaaa

SEQ ID NO: 2598915 - RNA, 20 nt, Human
agacucacaaccugaaccua

SEQ ID NO: 2598916 - RNA, 17 nt, Human
agacuauuuaacuugag

SEQ ID NO: 2598917 - RNA, 20 nt, Human
agaccuggagccccugggug

SEQ ID NO: 2598918 - RNA, 19 nt, Human
agaccuggagccccugggu

SEQ ID NO: 2598919 - RNA, 16 nt, Human
agaccuggagccccug

SEQ ID NO: 2598920 - RNA, 13 nt, Human
agaccuggagccc

SEQ ID NO: 2598921 - RNA, 18 nt, Human
agacuauuuaacuugagg

SEQ ID NO: 2598922 - RNA, 13 nt, Human
agacucaaaugcu

SEQ ID NO: 2598923 - RNA, 16 nt, Human
agaccgagugaaccua

SEQ ID NO: 2598924 - RNA, 21 nt, Human
agaccgagcgcuuucuggaaa

SEQ ID NO: 2598925 - RNA, 20 nt, Human
agaccgaacuguuguauaaa

SEQ ID NO: 2598926 - RNA, 16 nt, Human
agacccuaccccacca

SEQ ID NO: 2598927 - RNA, 18 nt, Human
agacccuaccccaccacg

SEQ ID NO: 2598928 - RNA, 17 nt, Human
agaccgaacuguuguau

SEQ ID NO: 2598929 - RNA, 16 nt, Human
agaccguccucacccc

SEQ ID NO: 2598930 - RNA, 15 nt, Human
agaccguccucaccc

SEQ ID NO: 2598931 - RNA, 14 nt, Human
agaccguccucacc

SEQ ID NO: 2598932 - RNA, 13 nt, Human
agaccguccucac

SEQ ID NO: 2598933 - RNA, 19 nt, Human
agaccguccucaccccugu

SEQ ID NO: 2598934 - RNA, 18 nt, Human
agaccguccucaccccug

SEQ ID NO: 2598935 - RNA, 13 nt, Human
agaccaaaauaaa

SEQ ID NO: 2598936 - RNA, 14 nt, Human
agaccccuggcuuu

SEQ ID NO: 2598937 - RNA, 15 nt, Human
agaccccuggcuuuu

SEQ ID NO: 2598938 - RNA, 21 nt, Human
agaccccuggcuuuucacugc

SEQ ID NO: 2598939 - RNA, 19 nt, Human
agacccuaagccuccuuuu

SEQ ID NO: 2598940 - RNA, 15 nt, Human
agacccgaggaaacu

SEQ ID NO: 2598941 - RNA, 14 nt, Human
agacccggcugcgu

SEQ ID NO: 2598942 - RNA, 20 nt, Human
agaccguccucaccccuguc

SEQ ID NO: 2598943 - RNA, 14 nt, Human
agaccuagggagga

SEQ ID NO: 2598944 - RNA, 15 nt, Human
agaccuagggaggac

SEQ ID NO: 2598945 - RNA, 16 nt, Human
agaccuauuugacaua

SEQ ID NO: 2598946 - RNA, 11 nt, Human
agaccucagcc

SEQ ID NO: 2598947 - RNA, 19 nt, Human
agaccuauuccuccugggc

SEQ ID NO: 2598948 - RNA, 16 nt, Human
agaccuauuccuccug

SEQ ID NO: 2598949 - RNA, 19 nt, Human
agaccuagggaggaccuua

SEQ ID NO: 2598950 - RNA, 12 nt, Human
agaccucagcca

SEQ ID NO: 2598951 - RNA, 14 nt, Human
agaccucagccaug

SEQ ID NO: 2598952 - RNA, 12 nt, Human
agaccucagccu

SEQ ID NO: 2598953 - RNA, 13 nt, Human
agaccucagccug

SEQ ID NO: 2598954 - RNA, 14 nt, Human
agaccucagccugu

SEQ ID NO: 2598955 - RNA, 15 nt, Human
agaccucagccugug

SEQ ID NO: 2598956 - RNA, 16 nt, Human
agaccucagccugugc

SEQ ID NO: 2598957 - RNA, 17 nt, Human
agaccucagccugugcu

SEQ ID NO: 2598958 - RNA, 19 nt, Human
agaccucagccugugcugc

SEQ ID NO: 2598959 - RNA, 23 nt, Human
agaccuccccagccccuagccca

SEQ ID NO: 2598960 - RNA, 20 nt, Human
agaccuccccagccccuagc

SEQ ID NO: 2598961 - RNA, 17 nt, Human
agaccuccccagccccu

SEQ ID NO: 2598962 - RNA, 15 nt, Human
agaccuccccagccc

SEQ ID NO: 2598963 - RNA, 14 nt, Human
agaccuccccagcc

SEQ ID NO: 2598964 - RNA, 22 nt, Human
agaccucaucaggaugaaccca

SEQ ID NO: 2598965 - RNA, 19 nt, Human
agaccucaucaggaugaac

SEQ ID NO: 2598966 - RNA, 18 nt, Human
agaccucaucaggaugaa

SEQ ID NO: 2598967 - RNA, 13 nt, Human
agaccugaagaau

SEQ ID NO: 2598968 - RNA, 18 nt, Human
agaccucagugccuuccu

SEQ ID NO: 2598969 - RNA, 20 nt, Human
agaccucagugccuuccugu

SEQ ID NO: 2598970 - RNA, 17 nt, Human
agaccucaucaggauga

SEQ ID NO: 2598971 - RNA, 16 nt, Human
agaccucaucaggaug

SEQ ID NO: 2598972 - RNA, 15 nt, Human
agaccucaucaggau

SEQ ID NO: 2598973 - RNA, 18 nt, Human
agaccucagccaugagga

SEQ ID NO: 2598974 - RNA, 20 nt, Human
agaccucagccugugcugcc

SEQ ID NO: 2598975 - RNA, 16 nt, Human
agaucauccuuuccag

SEQ ID NO: 2598976 - RNA, 15 nt, Human
agaucauccuuucca

SEQ ID NO: 2598977 - RNA, 13 nt, Human
agaucauccuuuc

SEQ ID NO: 2598978 - RNA, 18 nt, Human
agaucauauacgugaaaa

SEQ ID NO: 2598979 - RNA, 21 nt, Human
agaucauccagaaguuccuca

SEQ ID NO: 2598980 - RNA, 16 nt, Human
agaucauauacgugaa

SEQ ID NO: 2598981 - RNA, 13 nt, Human
agauccaggacua

SEQ ID NO: 2598982 - RNA, 18 nt, Human
agaucauccuuuccagca

SEQ ID NO: 2598983 - RNA, 12 nt, Human
agaucaugaaga

SEQ ID NO: 2598984 - RNA, 18 nt, Human
agaucaguguaccauuug

SEQ ID NO: 2598985 - RNA, 21 nt, Human
agaucaguguaccauuugccu

SEQ ID NO: 2598986 - RNA, 13 nt, Human
ugaccaaugucuu

SEQ ID NO: 2598987 - RNA, 14 nt, Human
ugaccaaugucuug

SEQ ID NO: 2598988 - RNA, 15 nt, Human
agaucaguguaccau

SEQ ID NO: 2598989 - RNA, 13 nt, Human
agaucagccuggg

SEQ ID NO: 2598990 - RNA, 15 nt, Human
agaucagccugggca

SEQ ID NO: 2598991 - RNA, 20 nt, Human
ugacauuguggcacauucuu

SEQ ID NO: 2598992 - RNA, 17 nt, Human
ugacaguucugaagaau

SEQ ID NO: 2598993 - RNA, 22 nt, Human
ugacauuguagagcuucuggca

SEQ ID NO: 2598994 - RNA, 21 nt, Human
ugacauuguuggccaaagcca

SEQ ID NO: 2598995 - RNA, 20 nt, Human
ugacauuguuggccaaagcc

SEQ ID NO: 2598996 - RNA, 18 nt, Human
ugaccaaugauggucacc

SEQ ID NO: 2598997 - RNA, 21 nt, Human
ugaccaauauuguacaguuuu

SEQ ID NO: 2598998 - RNA, 19 nt, Human
ugaccaauauuguacaguu

SEQ ID NO: 2598999 - RNA, 15 nt, Human
ugacauuuauauauu

SEQ ID NO: 2599000 - RNA, 16 nt, Human
ugacauuuauauauug

SEQ ID NO: 2599001 - RNA, 23 nt, Human
ugaccaauauuauacuaagaaaa

SEQ ID NO: 2599002 - RNA, 18 nt, Human
ugaccaauauuguacagu

SEQ ID NO: 2599003 - RNA, 17 nt, Human
ugaccaauauuguacag

SEQ ID NO: 2599004 - RNA, 14 nt, Human
ugacaaaaauucaa

SEQ ID NO: 2599005 - RNA, 21 nt, Human
ugacacacagcucuguccugg

SEQ ID NO: 2599006 - RNA, 18 nt, Human
ugacacagaaaauguuga

SEQ ID NO: 2599007 - RNA, 19 nt, Human
ugacacagaaaauguugag

SEQ ID NO: 2599008 - RNA, 22 nt, Human
ugacagccucccacccccaucu

SEQ ID NO: 2599009 - RNA, 17 nt, Human
ugacagccucccacccc

SEQ ID NO: 2599010 - RNA, 19 nt, Human
ugacagccucccaccccca

SEQ ID NO: 2599011 - RNA, 20 nt, Human
ugacaggcaaugcuggcugu

SEQ ID NO: 2599012 - RNA, 23 nt, Human
ugacagcugcuccuagagggagg

SEQ ID NO: 2599013 - RNA, 16 nt, Human
ugacagcugucccugu

SEQ ID NO: 2599014 - RNA, 17 nt, Human
ugacagcugucccuguc

SEQ ID NO: 2599015 - RNA, 18 nt, Human
ugacagcugucccuguca

SEQ ID NO: 2599016 - RNA, 14 nt, Human
ugacaggcagcaga

SEQ ID NO: 2599017 - RNA, 13 nt, Human
ugacaggcagcag

SEQ ID NO: 2599018 - RNA, 20 nt, Human
ugacagcugucccugucacc

SEQ ID NO: 2599019 - RNA, 21 nt, Human
ugacagcugucccugucacca

SEQ ID NO: 2599020 - RNA, 12 nt, Human
ugacagcugcuc

SEQ ID NO: 2599021 - RNA, 13 nt, Human
ugacagcugcucc

SEQ ID NO: 2599022 - RNA, 14 nt, Human
ugacagcugcuccu

SEQ ID NO: 2599023 - RNA, 15 nt, Human
ugacagcugcuccua

SEQ ID NO: 2599024 - RNA, 18 nt, Human
ugacagcugcuccuagag

SEQ ID NO: 2599025 - RNA, 21 nt, Human
ugacagcugcuccuagaggga

SEQ ID NO: 2599026 - RNA, 22 nt, Human
ugacagcugcuccuagagggag

SEQ ID NO: 2599027 - RNA, 12 nt, Human
ugacagcugucc

SEQ ID NO: 2599028 - RNA, 14 nt, Human
ugacagcugucccu

SEQ ID NO: 2599029 - RNA, 21 nt, Human
ugacagggaagcuacagguua

SEQ ID NO: 2599030 - RNA, 20 nt, Human
ugacagggaagcuacagguu

SEQ ID NO: 2599031 - RNA, 19 nt, Human
ugacagggaagcuacaggu

SEQ ID NO: 2599032 - RNA, 17 nt, Human
ugacagggaagcuacag

SEQ ID NO: 2599033 - RNA, 16 nt, Human
ugacagggaagcuaca

SEQ ID NO: 2599034 - RNA, 14 nt, Human
ugacagggaagcua

SEQ ID NO: 2599035 - RNA, 13 nt, Human
ugacagggaagcu

SEQ ID NO: 2599036 - RNA, 12 nt, Human
ugacagggaagc

SEQ ID NO: 2599037 - RNA, 18 nt, Human
ugacaggcagccuggaca

SEQ ID NO: 2599038 - RNA, 19 nt, Human
ugacaggcagcagagacuu

SEQ ID NO: 2599039 - RNA, 16 nt, Human
ugacaggcagcagaga

SEQ ID NO: 2599040 - RNA, 15 nt, Human
ugacaggcagcagag

SEQ ID NO: 2599041 - RNA, 20 nt, Human
ugacaggcagccuggacaua

SEQ ID NO: 2599042 - RNA, 16 nt, Human
ugacagggcacaccgg

SEQ ID NO: 2599043 - RNA, 11 nt, Human
ugacagggcac

SEQ ID NO: 2599044 - RNA, 23 nt, Human
ugacagggaagcuacagguuaca

SEQ ID NO: 2599045 - RNA, 16 nt, Human
ugacaguguugaaaau

SEQ ID NO: 2599046 - RNA, 19 nt, Human
ugacaguguugaaaauguu

SEQ ID NO: 2599047 - RNA, 23 nt, Human
ugacaguuuuccauaaagaagau

SEQ ID NO: 2599048 - RNA, 16 nt, Human
ugacaguucugaagaa

SEQ ID NO: 2599049 - RNA, 20 nt, Human
ugacagggcacaccgggcac

SEQ ID NO: 2599050 - RNA, 21 nt, Human
ugacagugccugggaauguau

SEQ ID NO: 2599051 - RNA, 21 nt, Human
ugacaguggccgcccaaggcc

SEQ ID NO: 2599052 - RNA, 13 nt, Human
agaugcuggguug

SEQ ID NO: 2599053 - RNA, 18 nt, Human
agaugcuggguuggugca

SEQ ID NO: 2599054 - RNA, 19 nt, Human
agaugcuggcccagggccc

SEQ ID NO: 2599055 - RNA, 23 nt, Human
agaugcuggcccagggcccagag

SEQ ID NO: 2599056 - RNA, 20 nt, Human
agaugcuggcccagggccca

SEQ ID NO: 2599057 - RNA, 21 nt, Human
agaugcuggcccagggcccag

SEQ ID NO: 2599058 - RNA, 22 nt, Human
agaugcuggcccagggcccaga

SEQ ID NO: 2599059 - RNA, 14 nt, Human
agaugcuagaacuc

SEQ ID NO: 2599060 - RNA, 15 nt, Human
agaugcuagaacucc

SEQ ID NO: 2599061 - RNA, 19 nt, Human
agaugcaguucugaagaag

SEQ ID NO: 2599062 - RNA, 18 nt, Human
agaugcaguucugaagaa

SEQ ID NO: 2599063 - RNA, 15 nt, Human
agaugccugaagcca

SEQ ID NO: 2599064 - RNA, 17 nt, Human
agaugcagagagccauu

SEQ ID NO: 2599065 - RNA, 15 nt, Human
agaugcagagagcca

SEQ ID NO: 2599066 - RNA, 14 nt, Human
agaugcagagagcc

SEQ ID NO: 2599067 - RNA, 13 nt, Human
agaugcagagagc

SEQ ID NO: 2599068 - RNA, 12 nt, Human
agaugcagagag

SEQ ID NO: 2599069 - RNA, 17 nt, Human
agaugcaguucugaaga

SEQ ID NO: 2599070 - RNA, 15 nt, Human
agaugcaccagcccu

SEQ ID NO: 2599071 - RNA, 14 nt, Human
agaugcaccagccc

SEQ ID NO: 2599072 - RNA, 16 nt, Human
agauccagggacugaa

SEQ ID NO: 2599073 - RNA, 14 nt, Human
agaucauggcaucc

SEQ ID NO: 2599074 - RNA, 19 nt, Human
agauccagggacagaggcc

SEQ ID NO: 2599075 - RNA, 22 nt, Human
agauccagggacagaggcccca

SEQ ID NO: 2599076 - RNA, 23 nt, Human
agaugcaccaccaagccaaggga

SEQ ID NO: 2599077 - RNA, 21 nt, Human
agaugcaccaccaagccaagg

SEQ ID NO: 2599078 - RNA, 21 nt, Human
agaucccagaaggaccuccug

SEQ ID NO: 2599079 - RNA, 21 nt, Human
agaugugcacccaugggcucu

SEQ ID NO: 2599080 - RNA, 18 nt, Human
agaugugcaaaugcaagc

SEQ ID NO: 2599081 - RNA, 16 nt, Human
agaugugcaaaugcaa

SEQ ID NO: 2599082 - RNA, 20 nt, Human
agaugugauuuaauaguguu

SEQ ID NO: 2599083 - RNA, 12 nt, Human
agaugugauuua

SEQ ID NO: 2599084 - RNA, 23 nt, Human
agaugcuggguuggugcacagug

SEQ ID NO: 2599085 - RNA, 15 nt, Human
agaugcuucucacug

SEQ ID NO: 2599086 - RNA, 22 nt, Human
agauguggaaaagccaagaggc

SEQ ID NO: 2599087 - RNA, 17 nt, Human
agauguggaaaagccaa

SEQ ID NO: 2599088 - RNA, 15 nt, Human
agaugugcacccaug

SEQ ID NO: 2599089 - RNA, 13 nt, Human
agaugugcaccca

SEQ ID NO: 2599090 - RNA, 18 nt, Human
agauguucagucauuuuu

SEQ ID NO: 2599091 - RNA, 17 nt, Human
agauguucagucauuuu

SEQ ID NO: 2599092 - RNA, 17 nt, Human
agauguucuaagucuuu

SEQ ID NO: 2599093 - RNA, 21 nt, Human
agauguucagauugcuuugau

SEQ ID NO: 2599094 - RNA, 17 nt, Human
agauguuagaucagggg

SEQ ID NO: 2599095 - RNA, 12 nt, Human
agauguuaaaaa

SEQ ID NO: 2599096 - RNA, 21 nt, Human
agauguggccuuccauuuaua

SEQ ID NO: 2599097 - RNA, 13 nt, Human
ugacccacugcuu

SEQ ID NO: 2599098 - RNA, 12 nt, Human
ugacccacugcu

SEQ ID NO: 2599099 - RNA, 23 nt, Human
ugacccaccccugugcuccgugc

SEQ ID NO: 2599100 - RNA, 18 nt, Human
ugacccaccccugugcuc

SEQ ID NO: 2599101 - RNA, 17 nt, Human
ugacccaccccugugcu

SEQ ID NO: 2599102 - RNA, 16 nt, Human
ugacccaccccugugc

SEQ ID NO: 2599103 - RNA, 15 nt, Human
ugacccaccccugug

SEQ ID NO: 2599104 - RNA, 13 nt, Human
ugacccaccccug

SEQ ID NO: 2599105 - RNA, 12 nt, Human
ugacccaccccu

SEQ ID NO: 2599106 - RNA, 11 nt, Human
ugacccacccc

SEQ ID NO: 2599107 - RNA, 16 nt, Human
ugacccaaagaccaau

SEQ ID NO: 2599108 - RNA, 17 nt, Human
ugacccacaagaaauga

SEQ ID NO: 2599109 - RNA, 19 nt, Human
agauguucucuaucauuua

SEQ ID NO: 2599110 - RNA, 18 nt, Human
agauguucucuaucauuu

SEQ ID NO: 2599111 - RNA, 23 nt, Human
ugaccauucuccaccugccaggg

SEQ ID NO: 2599112 - RNA, 17 nt, Human
agauguucucuaucauu

SEQ ID NO: 2599113 - RNA, 15 nt, Human
agauguucucuauca

SEQ ID NO: 2599114 - RNA, 12 nt, Human
agauguucucua

SEQ ID NO: 2599115 - RNA, 20 nt, Human
agauguucuaagucuuucca

SEQ ID NO: 2599116 - RNA, 21 nt, Human
agauguucuaagucuuuccau

SEQ ID NO: 2599117 - RNA, 22 nt, Human
agauguucuaagucuuuccauu

SEQ ID NO: 2599118 - RNA, 22 nt, Human
agagucccacugccucagguuc

SEQ ID NO: 2599119 - RNA, 21 nt, Human
agagucccacugccucagguu

SEQ ID NO: 2599120 - RNA, 20 nt, Human
agagucccacugccucaggu

SEQ ID NO: 2599121 - RNA, 19 nt, Human
agagucccacugccucagg

SEQ ID NO: 2599122 - RNA, 21 nt, Human
agagucccagagcaggaggcc

SEQ ID NO: 2599123 - RNA, 18 nt, Human
agagucccacugccucag

SEQ ID NO: 2599124 - RNA, 15 nt, Human
agagucccacugccu

SEQ ID NO: 2599125 - RNA, 14 nt, Human
agagucccacugcc

SEQ ID NO: 2599126 - RNA, 13 nt, Human
agagucccacugc

SEQ ID NO: 2599127 - RNA, 14 nt, Human
agaguccaggcccc

SEQ ID NO: 2599128 - RNA, 15 nt, Human
agaguccaggcccca

SEQ ID NO: 2599129 - RNA, 16 nt, Human
agaguccaggccccaa

SEQ ID NO: 2599130 - RNA, 19 nt, Human
agagucaucuccaucagcu

SEQ ID NO: 2599131 - RNA, 21 nt, Human
agagucaucuccaucagcugu

SEQ ID NO: 2599132 - RNA, 18 nt, Human
agagucauauuuugauua

SEQ ID NO: 2599133 - RNA, 13 nt, Human
agagucaucucca

SEQ ID NO: 2599134 - RNA, 14 nt, Human
agagucaucuccau

SEQ ID NO: 2599135 - RNA, 18 nt, Human
agagucaucuccaucagc

SEQ ID NO: 2599136 - RNA, 13 nt, Human
agagucauauuuu

SEQ ID NO: 2599137 - RNA, 17 nt, Human
agagucauauuuugauu

SEQ ID NO: 2599138 - RNA, 15 nt, Human
agagucauauuuuga

SEQ ID NO: 2599139 - RNA, 18 nt, Human
agagucagccuucccccu

SEQ ID NO: 2599140 - RNA, 18 nt, Human
ugaauguggcuugagaaa

SEQ ID NO: 2599141 - RNA, 14 nt, Human
ugaauguguguggu

SEQ ID NO: 2599142 - RNA, 14 nt, Human
ugaaugugucacua

SEQ ID NO: 2599143 - RNA, 16 nt, Human
agagucagcagaacug

SEQ ID NO: 2599144 - RNA, 19 nt, Human
ugaaugguuccaugccuga

SEQ ID NO: 2599145 - RNA, 21 nt, Human
ugaaugguguuguaugccuuu

SEQ ID NO: 2599146 - RNA, 20 nt, Human
ugaaugguguuguaugccuu

SEQ ID NO: 2599147 - RNA, 18 nt, Human
ugaaugguguuguaugcc

SEQ ID NO: 2599148 - RNA, 22 nt, Human
ugaaugguuccaugccugaggg

SEQ ID NO: 2599149 - RNA, 21 nt, Human
ugaaugguuccaugccugagg

SEQ ID NO: 2599150 - RNA, 23 nt, Human
ugaaugguuccaugccugagggu

SEQ ID NO: 2599151 - RNA, 19 nt, Human
ugaaugucagugugacuga

SEQ ID NO: 2599152 - RNA, 15 nt, Human
ugaaugucuuuugaa

SEQ ID NO: 2599153 - RNA, 20 nt, Human
ugaaugucuaaggucacaca

SEQ ID NO: 2599154 - RNA, 23 nt, Human
ugaaugucuuuugaauauuccca

SEQ ID NO: 2599155 - RNA, 16 nt, Human
ugaaugucauucacaa

SEQ ID NO: 2599156 - RNA, 20 nt, Human
ugaaugguuuucaaaauaaa

SEQ ID NO: 2599157 - RNA, 15 nt, Human
ugaaugguguuguau

SEQ ID NO: 2599158 - RNA, 15 nt, Human
ugaaugguccagggu

SEQ ID NO: 2599159 - RNA, 14 nt, Human
ugaaugguccaggg

SEQ ID NO: 2599160 - RNA, 21 nt, Human
ugaauggucagcguugcaugu

SEQ ID NO: 2599161 - RNA, 20 nt, Human
ugaaugguauggaacucucu

SEQ ID NO: 2599162 - RNA, 13 nt, Human
ugaauggucagcg

SEQ ID NO: 2599163 - RNA, 17 nt, Human
ugaauggguccauuuug

SEQ ID NO: 2599164 - RNA, 17 nt, Human
ugaagcaccaagcucaa

SEQ ID NO: 2599165 - RNA, 20 nt, Human
ugaaugggcaaaacugaauu

SEQ ID NO: 2599166 - RNA, 19 nt, Human
ugaaugggcaaaacugaau

SEQ ID NO: 2599167 - RNA, 13 nt, Human
ugaaugguaugga

SEQ ID NO: 2599168 - RNA, 17 nt, Human
ugaaugggcaaaacuga

SEQ ID NO: 2599169 - RNA, 18 nt, Human
agagucuggugaagcuca

SEQ ID NO: 2599170 - RNA, 17 nt, Human
agagucugaacagcugu

SEQ ID NO: 2599171 - RNA, 16 nt, Human
agagucugaacagcug

SEQ ID NO: 2599172 - RNA, 13 nt, Human
agagucugaacag

SEQ ID NO: 2599173 - RNA, 12 nt, Human
agagucugaaca

SEQ ID NO: 2599174 - RNA, 12 nt, Human
agaguccuauuu

SEQ ID NO: 2599175 - RNA, 13 nt, Human
agaguccucacuc

SEQ ID NO: 2599176 - RNA, 20 nt, Human
agaguugauacuacaguuug

SEQ ID NO: 2599177 - RNA, 22 nt, Human
agaguugauacuacaguuuguu

SEQ ID NO: 2599178 - RNA, 17 nt, Human
agaguugauacuacagu

SEQ ID NO: 2599179 - RNA, 23 nt, Human
agagucuggugaagcucacuucu

SEQ ID NO: 2599180 - RNA, 12 nt, Human
agagucugucuc

SEQ ID NO: 2599181 - RNA, 21 nt, Human
agaguuguaaauauauaaaua

SEQ ID NO: 2599182 - RNA, 20 nt, Human
agaguuguaaauauauaaau

SEQ ID NO: 2599183 - RNA, 19 nt, Human
agaguuguaaauauauaaa

SEQ ID NO: 2599184 - RNA, 18 nt, Human
agaguuguaaauauauaa

SEQ ID NO: 2599185 - RNA, 17 nt, Human
agaguuguaaauauaua

SEQ ID NO: 2599186 - RNA, 16 nt, Human
agaguuguaaauauau

SEQ ID NO: 2599187 - RNA, 15 nt, Human
agaguuguaaauaua

SEQ ID NO: 2599188 - RNA, 13 nt, Human
agaguuguaaaua

SEQ ID NO: 2599189 - RNA, 12 nt, Human
agaguuguuaca

SEQ ID NO: 2599190 - RNA, 20 nt, Human
agaguugaugguuguacaua

SEQ ID NO: 2599191 - RNA, 16 nt, Human
agagugaaaauugucu

SEQ ID NO: 2599192 - RNA, 16 nt, Human
agaguugcugggagcu

SEQ ID NO: 2599193 - RNA, 17 nt, Human
agaguuuagcuggaaaa

SEQ ID NO: 2599194 - RNA, 16 nt, Human
agaguuuagcuggaaa

SEQ ID NO: 2599195 - RNA, 21 nt, Human
agaguuguuacauuuuuaagu

SEQ ID NO: 2599196 - RNA, 14 nt, Human
agaguuuaacacaa

SEQ ID NO: 2599197 - RNA, 19 nt, Human
agaguugugcacauggcuu

SEQ ID NO: 2599198 - RNA, 22 nt, Human
agaguuguaaauauauaaauau

SEQ ID NO: 2599199 - RNA, 18 nt, Human
agaucacgccacugcacu

SEQ ID NO: 2599200 - RNA, 17 nt, Human
agaucacgccacugcac

SEQ ID NO: 2599201 - RNA, 21 nt, Human
agaucaccagcccggccugcu

SEQ ID NO: 2599202 - RNA, 16 nt, Human
agaucaccagcccggc

SEQ ID NO: 2599203 - RNA, 15 nt, Human
agaucaccagcccgg

SEQ ID NO: 2599204 - RNA, 14 nt, Human
agaucaccagcccg

SEQ ID NO: 2599205 - RNA, 22 nt, Human
agaucacgccacugcacuccag

SEQ ID NO: 2599206 - RNA, 23 nt, Human
ugaauuucuucacuguugaaaau

SEQ ID NO: 2599207 - RNA, 21 nt, Human
ugaauuucuucacuguugaaa

SEQ ID NO: 2599208 - RNA, 15 nt, Human
ugaauuucuuuugcc

SEQ ID NO: 2599209 - RNA, 13 nt, Human
ugaauuucuaaaa

SEQ ID NO: 2599210 - RNA, 16 nt, Human
agaucacgcuccccgc

SEQ ID NO: 2599211 - RNA, 15 nt, Human
agaucacgcuccccg

SEQ ID NO: 2599212 - RNA, 20 nt, Human
ugaauuucuucacuguugaa

SEQ ID NO: 2599213 - RNA, 17 nt, Human
ugaauuuucccacugca

SEQ ID NO: 2599214 - RNA, 16 nt, Human
ugaauuuucccacugc

SEQ ID NO: 2599215 - RNA, 15 nt, Human
ugaauuuucccacug

SEQ ID NO: 2599216 - RNA, 14 nt, Human
ugaauuuucccacu

SEQ ID NO: 2599217 - RNA, 14 nt, Human
ugaauuuucugugu

SEQ ID NO: 2599218 - RNA, 13 nt, Human
ugaauuuucugug

SEQ ID NO: 2599219 - RNA, 20 nt, Human
ugaauuuucccacugcaccc

SEQ ID NO: 2599220 - RNA, 15 nt, Human
ugaauuuucuguguu

SEQ ID NO: 2599221 - RNA, 23 nt, Human
ugaauuuucuuuuuaauaaaaag

SEQ ID NO: 2599222 - RNA, 22 nt, Human
ugaauuuuucucuaacucagaa

SEQ ID NO: 2599223 - RNA, 19 nt, Human
ugaauuuucacaugaacau

SEQ ID NO: 2599224 - RNA, 18 nt, Human
ugaauuuucacaugaaca

SEQ ID NO: 2599225 - RNA, 17 nt, Human
ugaauuuucacaugaac

SEQ ID NO: 2599226 - RNA, 16 nt, Human
ugaauuuucacaugaa

SEQ ID NO: 2599227 - RNA, 15 nt, Human
ugaauuuucacauga

SEQ ID NO: 2599228 - RNA, 13 nt, Human
ugaauuuucacau

SEQ ID NO: 2599229 - RNA, 16 nt, Human
ugaauuuuuuuuuccu

SEQ ID NO: 2599230 - RNA, 19 nt, Human
ugaauuuuuuuuuccuagc

SEQ ID NO: 2599231 - RNA, 20 nt, Human
ugaauuuuuuuuuccuagcc

SEQ ID NO: 2599232 - RNA, 18 nt, Human
ugacaaaaauucaacuca

SEQ ID NO: 2599233 - RNA, 19 nt, Human
ugacaaaaaguuuccauau

SEQ ID NO: 2599234 - RNA, 20 nt, Human
ugacacacagcucuguccug

SEQ ID NO: 2599235 - RNA, 21 nt, Human
ugaauuuuuuucaucuucucu

SEQ ID NO: 2599236 - RNA, 23 nt, Human
ugaauuuuuuucaucuucucugg

SEQ ID NO: 2599237 - RNA, 23 nt, Human
agauacugcuacuguaauuuuau

SEQ ID NO: 2599238 - RNA, 19 nt, Human
agauacugcuacuguaauu

SEQ ID NO: 2599239 - RNA, 19 nt, Human
agauacuggaaguuuugca

SEQ ID NO: 2599240 - RNA, 20 nt, Human
agauacuggaaguuuugcau

SEQ ID NO: 2599241 - RNA, 21 nt, Human
agauacuggaaguuuugcauu

SEQ ID NO: 2599242 - RNA, 20 nt, Human
agauacgacuuuauuuucug

SEQ ID NO: 2599243 - RNA, 14 nt, Human
agauaaaucuagua

SEQ ID NO: 2599244 - RNA, 13 nt, Human
agauaaauuauaa

SEQ ID NO: 2599245 - RNA, 21 nt, Human
agauaacaagaucuuucagga

SEQ ID NO: 2599246 - RNA, 18 nt, Human
agauaacaagaucuuuca

SEQ ID NO: 2599247 - RNA, 19 nt, Human
agauacgacuuuauuuucu

SEQ ID NO: 2599248 - RNA, 17 nt, Human
agauaaagguucaugca

SEQ ID NO: 2599249 - RNA, 12 nt, Human
agauaaauauua

SEQ ID NO: 2599250 - RNA, 22 nt, Human
agaguuuaacacaaguccugug

SEQ ID NO: 2599251 - RNA, 18 nt, Human
agauaaagauuucuugag

SEQ ID NO: 2599252 - RNA, 12 nt, Human
agauaaaugugc

SEQ ID NO: 2599253 - RNA, 14 nt, Human
agauaaauauuaua

SEQ ID NO: 2599254 - RNA, 15 nt, Human
agaguuuaacacaag

SEQ ID NO: 2599255 - RNA, 16 nt, Human
agaucacgccacugca

SEQ ID NO: 2599256 - RNA, 15 nt, Human
agaucacgccacugc

SEQ ID NO: 2599257 - RNA, 14 nt, Human
agaucacgccacug

SEQ ID NO: 2599258 - RNA, 16 nt, Human
agaucaaggagaggag

SEQ ID NO: 2599259 - RNA, 18 nt, Human
agaucaagcugugagaca

SEQ ID NO: 2599260 - RNA, 14 nt, Human
agaucaagcuguga

SEQ ID NO: 2599261 - RNA, 12 nt, Human
agaucaagcugu

SEQ ID NO: 2599262 - RNA, 21 nt, Human
agaucaauuuguaauugcuua

SEQ ID NO: 2599263 - RNA, 14 nt, Human
agaucaauuuguaa

SEQ ID NO: 2599264 - RNA, 15 nt, Human
agaucaccagaauaa

SEQ ID NO: 2599265 - RNA, 12 nt, Human
agauauucaagu

SEQ ID NO: 2599266 - RNA, 22 nt, Human
agauauugucagaguucugcuc

SEQ ID NO: 2599267 - RNA, 18 nt, Human
agauauugugaaguacau

SEQ ID NO: 2599268 - RNA, 19 nt, Human
agauauugugaaguacaua

SEQ ID NO: 2599269 - RNA, 13 nt, Human
agauauuuauaua

SEQ ID NO: 2599270 - RNA, 23 nt, Human
agauauuuacaugaauugcauuu

SEQ ID NO: 2599271 - RNA, 21 nt, Human
agauauugugaaguacauauu

SEQ ID NO: 2599272 - RNA, 15 nt, Human
agauauuaccaguuu

SEQ ID NO: 2599273 - RNA, 17 nt, Human
agauauggcagcgaaag

SEQ ID NO: 2599274 - RNA, 17 nt, Human
agauaugggacauuuuu

SEQ ID NO: 2599275 - RNA, 18 nt, Human
agagcagaugcagagagc

SEQ ID NO: 2599276 - RNA, 15 nt, Human
agagcagaugcagag

SEQ ID NO: 2599277 - RNA, 14 nt, Human
agagcagaugcaga

SEQ ID NO: 2599278 - RNA, 20 nt, Human
agagcaggaggccccuggcc

SEQ ID NO: 2599279 - RNA, 15 nt, Human
agagcaggaggcccc

SEQ ID NO: 2599280 - RNA, 19 nt, Human
agagcagaugcagagagcc

SEQ ID NO: 2599281 - RNA, 23 nt, Human
agagcaggaggccccuggcccag

SEQ ID NO: 2599282 - RNA, 22 nt, Human
agagcaggaggccccuggccca

SEQ ID NO: 2599283 - RNA, 12 nt, Human
agagcaggcaca

SEQ ID NO: 2599284 - RNA, 13 nt, Human
agagcaggcacau

SEQ ID NO: 2599285 - RNA, 18 nt, Human
agagcaggcacauggagg

SEQ ID NO: 2599286 - RNA, 19 nt, Human
agagcaggcacauggagga

SEQ ID NO: 2599287 - RNA, 20 nt, Human
agagcaggcacauggaggag

SEQ ID NO: 2599288 - RNA, 13 nt, Human
agagcaggcuggc

SEQ ID NO: 2599289 - RNA, 19 nt, Human
agagcaggcguucagcuca

SEQ ID NO: 2599290 - RNA, 22 nt, Human
agagcaggcuggcagcucucca

SEQ ID NO: 2599291 - RNA, 17 nt, Human
agagcaggcuggcagcu

SEQ ID NO: 2599292 - RNA, 22 nt, Human
agagcagggauuaaccucugca

SEQ ID NO: 2599293 - RNA, 24 nt, Human
agagcagggauuaaccucugcacu

SEQ ID NO: 2599294 - RNA, 23 nt, Human
agagcaggcuggcagcucuccag

SEQ ID NO: 2599295 - RNA, 22 nt, Human
agagcagggguccuugguguga

SEQ ID NO: 2599296 - RNA, 18 nt, Human
agagcagagaccaucccu

SEQ ID NO: 2599297 - RNA, 17 nt, Human
agagcagagaccauccc

SEQ ID NO: 2599298 - RNA, 20 nt, Human
agagcagagaccaucccuga

SEQ ID NO: 2599299 - RNA, 23 nt, Human
agagcagaacggagccccaggcc

SEQ ID NO: 2599300 - RNA, 20 nt, Human
agagcagaacggagccccag

SEQ ID NO: 2599301 - RNA, 12 nt, Human
agagcagaugca

SEQ ID NO: 2599302 - RNA, 14 nt, Human
agagcagaggcagc

SEQ ID NO: 2599303 - RNA, 17 nt, Human
agagccagagaagugac

SEQ ID NO: 2599304 - RNA, 16 nt, Human
agagccagagaaguga

SEQ ID NO: 2599305 - RNA, 15 nt, Human
agagccagagaagug

SEQ ID NO: 2599306 - RNA, 13 nt, Human
agagccagagaag

SEQ ID NO: 2599307 - RNA, 10 nt, Human
agagccagag

SEQ ID NO: 2599308 - RNA, 16 nt, Human
agagccacccuguguu

SEQ ID NO: 2599309 - RNA, 22 nt, Human
agagccagaaccuggagggcua

SEQ ID NO: 2599310 - RNA, 11 nt, Human
agagccuugcg

SEQ ID NO: 2599311 - RNA, 21 nt, Human
agagccuugcggaagguucua

SEQ ID NO: 2599312 - RNA, 17 nt, Human
agagccuugguguccac

SEQ ID NO: 2599313 - RNA, 19 nt, Human
agagccuugguguccaccu

SEQ ID NO: 2599314 - RNA, 20 nt, Human
agagccuugguguccaccug

SEQ ID NO: 2599315 - RNA, 21 nt, Human
agagccuugguguccaccugg

SEQ ID NO: 2599316 - RNA, 16 nt, Human
agagcagugggccugg

SEQ ID NO: 2599317 - RNA, 22 nt, Human
agagcauuacgugagccaggua

SEQ ID NO: 2599318 - RNA, 21 nt, Human
agagcauuacgugagccaggu

SEQ ID NO: 2599319 - RNA, 20 nt, Human
agagcauuacgugagccagg

SEQ ID NO: 2599320 - RNA, 19 nt, Human
agagcauuacgugagccag

SEQ ID NO: 2599321 - RNA, 17 nt, Human
agagcauugcauggaca

SEQ ID NO: 2599322 - RNA, 19 nt, Human
agagcauugaauuggagag

SEQ ID NO: 2599323 - RNA, 18 nt, Human
agagcauugccauucccu

SEQ ID NO: 2599324 - RNA, 15 nt, Human
agagcauugccauuc

SEQ ID NO: 2599325 - RNA, 15 nt, Human
agagccaccaagagg

SEQ ID NO: 2599326 - RNA, 19 nt, Human
agagccaccaagagggacg

SEQ ID NO: 2599327 - RNA, 20 nt, Human
agagcauuuccaacaccaca

SEQ ID NO: 2599328 - RNA, 18 nt, Human
ucuuugggaauauuugaa

SEQ ID NO: 2599329 - RNA, 16 nt, Human
ucuuugggaauauuug

SEQ ID NO: 2599330 - RNA, 16 nt, Human
agagauuuaauuaauc

SEQ ID NO: 2599331 - RNA, 13 nt, Human
agagauuuaauua

SEQ ID NO: 2599332 - RNA, 12 nt, Human
agagauuucaag

SEQ ID NO: 2599333 - RNA, 18 nt, Human
agagcaaaauaauuuuaa

SEQ ID NO: 2599334 - RNA, 13 nt, Human
agagauuuuucau

SEQ ID NO: 2599335 - RNA, 21 nt, Human
ucuuuggacccugaggcccag

SEQ ID NO: 2599336 - RNA, 17 nt, Human
ucuuuggacccugaggc

SEQ ID NO: 2599337 - RNA, 14 nt, Human
ucuuuggcuccccu

SEQ ID NO: 2599338 - RNA, 22 nt, Human
ucuuuggcuccccuguaccuuu

SEQ ID NO: 2599339 - RNA, 15 nt, Human
ucuuugggaauauuu

SEQ ID NO: 2599340 - RNA, 13 nt, Human
agagacaggaaaa

SEQ ID NO: 2599341 - RNA, 21 nt, Human
agagacaggaaaauccucugg

SEQ ID NO: 2599342 - RNA, 12 nt, Human
agagcagagacc

SEQ ID NO: 2599343 - RNA, 22 nt, Human
agagcacuuaagagaauauuuu

SEQ ID NO: 2599344 - RNA, 21 nt, Human
agagcacuuaagagaauauuu

SEQ ID NO: 2599345 - RNA, 20 nt, Human
agagcacuuaagagaauauu

SEQ ID NO: 2599346 - RNA, 19 nt, Human
agagcacuuaagagaauau

SEQ ID NO: 2599347 - RNA, 19 nt, Human
agagcaccuaguccaguga

SEQ ID NO: 2599348 - RNA, 18 nt, Human
agagcaccuaguccagug

SEQ ID NO: 2599349 - RNA, 17 nt, Human
agagcaccccucucugc

SEQ ID NO: 2599350 - RNA, 16 nt, Human
agagcaccccucucug

SEQ ID NO: 2599351 - RNA, 20 nt, Human
agagcacuggguugcagggg

SEQ ID NO: 2599352 - RNA, 21 nt, Human
agagcacuggguugcagggga

SEQ ID NO: 2599353 - RNA, 15 nt, Human
agagcacuuaagaga

SEQ ID NO: 2599354 - RNA, 21 nt, Human
agagcaaugcccguaaugcuu

SEQ ID NO: 2599355 - RNA, 14 nt, Human
agagcaagucugca

SEQ ID NO: 2599356 - RNA, 16 nt, Human
agagcaagucugcagg

SEQ ID NO: 2599357 - RNA, 14 nt, Human
agagcaagucugga

SEQ ID NO: 2599358 - RNA, 16 nt, Human
agagcacagcccuccc

SEQ ID NO: 2599359 - RNA, 15 nt, Human
agagcacagcccucc

SEQ ID NO: 2599360 - RNA, 14 nt, Human
agagcacagcccuc

SEQ ID NO: 2599361 - RNA, 13 nt, Human
agagcacagcccu

SEQ ID NO: 2599362 - RNA, 11 nt, Human
agagcacagcc

SEQ ID NO: 2599363 - RNA, 20 nt, Human
agagcacacuuggcccaagu

SEQ ID NO: 2599364 - RNA, 14 nt, Human
agagcacacuguag

SEQ ID NO: 2599365 - RNA, 23 nt, Human
agagcaagauccugucuuuaagg

SEQ ID NO: 2599366 - RNA, 14 nt, Human
agagcaaaauugau

SEQ ID NO: 2599367 - RNA, 17 nt, Human
ugaaauaagccagacau

SEQ ID NO: 2599368 - RNA, 18 nt, Human
ugaaauaagccagacauc

SEQ ID NO: 2599369 - RNA, 20 nt, Human
ugaaauaagccagacaucaa

SEQ ID NO: 2599370 - RNA, 23 nt, Human
ugaaauaagccagacaucaacag

SEQ ID NO: 2599371 - RNA, 15 nt, Human
ugaaaguuaauccac

SEQ ID NO: 2599372 - RNA, 17 nt, Human
ugaaaguuugcacugua

SEQ ID NO: 2599373 - RNA, 18 nt, Human
ugaaaguuuucagaaccu

SEQ ID NO: 2599374 - RNA, 20 nt, Human
ugaaaguuuucagaaccucu

SEQ ID NO: 2599375 - RNA, 11 nt, Human
ugaaagugacu

SEQ ID NO: 2599376 - RNA, 18 nt, Human
agagcgccgugaguucuc

SEQ ID NO: 2599377 - RNA, 13 nt, Human
agagcgccccucc

SEQ ID NO: 2599378 - RNA, 17 nt, Human
agagcgagagucugucu

SEQ ID NO: 2599379 - RNA, 18 nt, Human
agagccuuuuucuaggcc

SEQ ID NO: 2599380 - RNA, 23 nt, Human
agagccuuuggaugaccagaaca

SEQ ID NO: 2599381 - RNA, 21 nt, Human
agagccuuuggaugaccagaa

SEQ ID NO: 2599382 - RNA, 22 nt, Human
agagccuugguguccaccuggc

SEQ ID NO: 2599383 - RNA, 23 nt, Human
agagccuugguguccaccuggcc

SEQ ID NO: 2599384 - RNA, 21 nt, Human
agagcgugcuccagccuggcu

SEQ ID NO: 2599385 - RNA, 23 nt, Human
agagcggucucaggcugguggga

SEQ ID NO: 2599386 - RNA, 14 nt, Human
agagcggucucagg

SEQ ID NO: 2599387 - RNA, 13 nt, Human
agagcgcgucugg

SEQ ID NO: 2599388 - RNA, 21 nt, Human
agagcgccgugaguucucagg

SEQ ID NO: 2599389 - RNA, 20 nt, Human
agagcgccgugaguucucag

SEQ ID NO: 2599390 - RNA, 22 nt, Human
agagcgccgugaguucucaggg

SEQ ID NO: 2599391 - RNA, 14 nt, Human
agagcgccugcccc

SEQ ID NO: 2599392 - RNA, 15 nt, Human
agagcgccugccccu

SEQ ID NO: 2599393 - RNA, 20 nt, Human
agagcgccugccccucccag

SEQ ID NO: 2599394 - RNA, 21 nt, Human
agagcgccugccccucccaga

SEQ ID NO: 2599395 - RNA, 23 nt, Human
agagcgccugccccucccagaac

SEQ ID NO: 2599396 - RNA, 18 nt, Human
agagcugccaccugccug

SEQ ID NO: 2599397 - RNA, 13 nt, Human
agagcugcccucc

SEQ ID NO: 2599398 - RNA, 21 nt, Human
agagcugcccuccuuguccac

SEQ ID NO: 2599399 - RNA, 20 nt, Human
agagcugcccuccuugucca

SEQ ID NO: 2599400 - RNA, 17 nt, Human
ugaaauuguacauauuu

SEQ ID NO: 2599401 - RNA, 14 nt, Human
ugaaauuguacaua

SEQ ID NO: 2599402 - RNA, 22 nt, Human
ugaaauugucuagcagagcagg

SEQ ID NO: 2599403 - RNA, 23 nt, Human
ugaaauuguacauauuuguggaa

SEQ ID NO: 2599404 - RNA, 18 nt, Human
ugaaauuguuuaaguguu

SEQ ID NO: 2599405 - RNA, 23 nt, Human
ugaaauuguuuaaguguuguaaa

SEQ ID NO: 2599406 - RNA, 21 nt, Human
ugaaauuuucuagacuuucug

SEQ ID NO: 2599407 - RNA, 17 nt, Human
ugaaauuuucuagacuu

SEQ ID NO: 2599408 - RNA, 20 nt, Human
ugaaauuuuccaaugucugc

SEQ ID NO: 2599409 - RNA, 19 nt, Human
ugaaauuuuccaaugucug

SEQ ID NO: 2599410 - RNA, 18 nt, Human
ugaaauuuuccaaugucu

SEQ ID NO: 2599411 - RNA, 16 nt, Human
ugaaauuuuauaugcu

SEQ ID NO: 2599412 - RNA, 18 nt, Human
ugaaauuuuauaugcuua

SEQ ID NO: 2599413 - RNA, 17 nt, Human
ugaaauuuuccaauguc

SEQ ID NO: 2599414 - RNA, 17 nt, Human
ugaaauuuuaaacuaua

SEQ ID NO: 2599415 - RNA, 22 nt, Human
ugaaauuuuauaugcuuacuga

SEQ ID NO: 2599416 - RNA, 19 nt, Human
ugaaauuuuaaaaauuguu

SEQ ID NO: 2599417 - RNA, 14 nt, Human
ugaaauuuuaaccu

SEQ ID NO: 2599418 - RNA, 20 nt, Human
ugaaauuuuaaccuaugaua

SEQ ID NO: 2599419 - RNA, 22 nt, Human
ugaaauuuuaaccuaugauauu

SEQ ID NO: 2599420 - RNA, 19 nt, Human
ugaaauacacaaguaaaca

SEQ ID NO: 2599421 - RNA, 14 nt, Human
ugaaauaauaaauc

SEQ ID NO: 2599422 - RNA, 15 nt, Human
ugaaauaucuguauu

SEQ ID NO: 2599423 - RNA, 16 nt, Human
ugaaauauacacacag

SEQ ID NO: 2599424 - RNA, 17 nt, Human
ugaaauauacacacagc

SEQ ID NO: 2599425 - RNA, 19 nt, Human
ugaaauaguucaaagccaa

SEQ ID NO: 2599426 - RNA, 15 nt, Human
ugaaauauacacaca

SEQ ID NO: 2599427 - RNA, 15 nt, Human
ugaaauuguauuaca

SEQ ID NO: 2599428 - RNA, 18 nt, Human
ugaaauauuauguuaaaa

SEQ ID NO: 2599429 - RNA, 12 nt, Human
ugaaauaugcau

SEQ ID NO: 2599430 - RNA, 18 nt, Human
ugaaauaugcuggcugga

SEQ ID NO: 2599431 - RNA, 19 nt, Human
agaggcugaggccuggacu

SEQ ID NO: 2599432 - RNA, 18 nt, Human
agaggcugaggccuggac

SEQ ID NO: 2599433 - RNA, 17 nt, Human
agaggcugaggccugga

SEQ ID NO: 2599434 - RNA, 14 nt, Human
agaggcugaggccu

SEQ ID NO: 2599435 - RNA, 13 nt, Human
agaggcugaaaga

SEQ ID NO: 2599436 - RNA, 19 nt, Human
agaggcugaaagaggccaa

SEQ ID NO: 2599437 - RNA, 13 nt, Human
agaggcugaggac

SEQ ID NO: 2599438 - RNA, 17 nt, Human
agagguauuuaucuuua

SEQ ID NO: 2599439 - RNA, 16 nt, Human
agaggucaagcccagg

SEQ ID NO: 2599440 - RNA, 18 nt, Human
agaggucaagcccaggag

SEQ ID NO: 2599441 - RNA, 20 nt, Human
agaggucaagcccaggagga

SEQ ID NO: 2599442 - RNA, 13 nt, Human
agaggcugaggca

SEQ ID NO: 2599443 - RNA, 16 nt, Human
agagguagggcugcca

SEQ ID NO: 2599444 - RNA, 19 nt, Human
agagguccacaacacacag

SEQ ID NO: 2599445 - RNA, 14 nt, Human
agaggucugugcug

SEQ ID NO: 2599446 - RNA, 13 nt, Human
agaggucugugcu

SEQ ID NO: 2599447 - RNA, 22 nt, Human
agaggucucugccggcucuuuc

SEQ ID NO: 2599448 - RNA, 18 nt, Human
agaggucugugcugaggc

SEQ ID NO: 2599449 - RNA, 16 nt, Human
agaggucugugcugag

SEQ ID NO: 2599450 - RNA, 19 nt, Human
agaggucugugcugaggcc

SEQ ID NO: 2599451 - RNA, 12 nt, Human
agaggucuuuuu

SEQ ID NO: 2599452 - RNA, 15 nt, Human
agagguugcagugag

SEQ ID NO: 2599453 - RNA, 13 nt, Human
agagguuucagug

SEQ ID NO: 2599454 - RNA, 17 nt, Human
agagguucauuucaaau

SEQ ID NO: 2599455 - RNA, 17 nt, Human
agaguagaauugcauug

SEQ ID NO: 2599456 - RNA, 18 nt, Human
agaguagaauugcauuga

SEQ ID NO: 2599457 - RNA, 22 nt, Human
agaguagauggugaaauuuauu

SEQ ID NO: 2599458 - RNA, 21 nt, Human
agaguagauggugaaauuuau

SEQ ID NO: 2599459 - RNA, 13 nt, Human
agaguagacauuu

SEQ ID NO: 2599460 - RNA, 18 nt, Human
ugaagcaaagcaccagcu

SEQ ID NO: 2599461 - RNA, 17 nt, Human
ugaagcaaagcaccagc

SEQ ID NO: 2599462 - RNA, 22 nt, Human
agaguagcaaguucuagagaag

SEQ ID NO: 2599463 - RNA, 12 nt, Human
agaguagcaagu

SEQ ID NO: 2599464 - RNA, 23 nt, Human
agaguagcaaguucuagagaaga

SEQ ID NO: 2599465 - RNA, 15 nt, Human
ugaagcaaacacauu

SEQ ID NO: 2599466 - RNA, 18 nt, Human
ugaagcaaaucagaaacu

SEQ ID NO: 2599467 - RNA, 14 nt, Human
ugaagcaaaucaga

SEQ ID NO: 2599468 - RNA, 15 nt, Human
ugaagcaaaucagaa

SEQ ID NO: 2599469 - RNA, 16 nt, Human
agaguacagugagcca

SEQ ID NO: 2599470 - RNA, 19 nt, Human
agaguacagugagccaaga

SEQ ID NO: 2599471 - RNA, 15 nt, Human
agaguagaauugcau

SEQ ID NO: 2599472 - RNA, 16 nt, Human
agaguagaauugcauu

SEQ ID NO: 2599473 - RNA, 18 nt, Human
agaguaauggguuucaua

SEQ ID NO: 2599474 - RNA, 17 nt, Human
agaguaauggguuucau

SEQ ID NO: 2599475 - RNA, 14 nt, Human
agaguaauggguuu

SEQ ID NO: 2599476 - RNA, 22 nt, Human
agagguuugacuagaugaugga

SEQ ID NO: 2599477 - RNA, 18 nt, Human
agagguuuuaaagugauu

SEQ ID NO: 2599478 - RNA, 22 nt, Human
agaguaauccaagcaaauguga

SEQ ID NO: 2599479 - RNA, 19 nt, Human
agagguuuuaaagugauua

SEQ ID NO: 2599480 - RNA, 12 nt, Human
agagguuuuguu

SEQ ID NO: 2599481 - RNA, 13 nt, Human
agaggcagggucu

SEQ ID NO: 2599482 - RNA, 10 nt, Human
agaggcaggg

SEQ ID NO: 2599483 - RNA, 19 nt, Human
agaggccaugauucgccca

SEQ ID NO: 2599484 - RNA, 14 nt, Human
agaggccauggcag

SEQ ID NO: 2599485 - RNA, 13 nt, Human
agaggcagggagg

SEQ ID NO: 2599486 - RNA, 22 nt, Human
agaggcaggggcuugcuuugca

SEQ ID NO: 2599487 - RNA, 17 nt, Human
agaggcagggaggggac

SEQ ID NO: 2599488 - RNA, 15 nt, Human
agaggccauggcaga

SEQ ID NO: 2599489 - RNA, 16 nt, Human
agaggccauggcagaa

SEQ ID NO: 2599490 - RNA, 20 nt, Human
agaggccauggcagaauaau

SEQ ID NO: 2599491 - RNA, 23 nt, Human
agaggccauggcagaauaaucuu

SEQ ID NO: 2599492 - RNA, 17 nt, Human
agaggcuaugugagcac

SEQ ID NO: 2599493 - RNA, 19 nt, Human
agaggcuauuauuuucacu

SEQ ID NO: 2599494 - RNA, 22 nt, Human
agaggcucguugacuggcugug

SEQ ID NO: 2599495 - RNA, 22 nt, Human
agaggccauguuccaauaaaca

SEQ ID NO: 2599496 - RNA, 19 nt, Human
agaggccaugggccuccug

SEQ ID NO: 2599497 - RNA, 22 nt, Human
agagcuucuuccaggugcccag

SEQ ID NO: 2599498 - RNA, 23 nt, Human
agagcuucuuccaggugcccagc

SEQ ID NO: 2599499 - RNA, 14 nt, Human
agagcuuggacugg

SEQ ID NO: 2599500 - RNA, 13 nt, Human
agagcuuggacug

SEQ ID NO: 2599501 - RNA, 17 nt, Human
agagcuugaugccagua

SEQ ID NO: 2599502 - RNA, 22 nt, Human
agagcuuucuguccuuuuggca

SEQ ID NO: 2599503 - RNA, 23 nt, Human
agagcuuggacuggaugcauguu

SEQ ID NO: 2599504 - RNA, 23 nt, Human
agagcuuucuguccuuuuggcac

SEQ ID NO: 2599505 - RNA, 22 nt, Human
agagcuuucuucccgaacccca

SEQ ID NO: 2599506 - RNA, 23 nt, Human
agaggcagagagcggucucaggc

SEQ ID NO: 2599507 - RNA, 14 nt, Human
agaggcagagagcg

SEQ ID NO: 2599508 - RNA, 13 nt, Human
agaggcagagagc

SEQ ID NO: 2599509 - RNA, 12 nt, Human
agaggcagagag

SEQ ID NO: 2599510 - RNA, 22 nt, Human
agaggcagagaaagaagagaca

SEQ ID NO: 2599511 - RNA, 22 nt, Human
agaggaaaaguaaggugcaguu

SEQ ID NO: 2599512 - RNA, 21 nt, Human
agaggaaaaguaaggugcagu

SEQ ID NO: 2599513 - RNA, 19 nt, Human
agaggaaaaguaaggugca

SEQ ID NO: 2599514 - RNA, 18 nt, Human
agaggaaaaguaaggugc

SEQ ID NO: 2599515 - RNA, 16 nt, Human
agaggaaaaaaaugac

SEQ ID NO: 2599516 - RNA, 17 nt, Human
agaggaaaaaaaugacu

SEQ ID NO: 2599517 - RNA, 19 nt, Human
agaggcagccccauucugc

SEQ ID NO: 2599518 - RNA, 13 nt, Human
agaggcagcccca

SEQ ID NO: 2599519 - RNA, 24 nt, Human
agaggcagccccauucugccugcc

SEQ ID NO: 2599520 - RNA, 15 nt, Human
agaggcagagagcgg

SEQ ID NO: 2599521 - RNA, 15 nt, Human
agagcuucuuccagg

SEQ ID NO: 2599522 - RNA, 22 nt, Human
agagcuucuguugcugccucau

SEQ ID NO: 2599523 - RNA, 15 nt, Human
agagcuuaacagugu

SEQ ID NO: 2599524 - RNA, 21 nt, Human
agagcuuaaugauaauauugu

SEQ ID NO: 2599525 - RNA, 21 nt, Human
agagcuguucacagccagacu

SEQ ID NO: 2599526 - RNA, 20 nt, Human
agagcuguucccaaauuuuc

SEQ ID NO: 2599527 - RNA, 19 nt, Human
agagcuguuuauggccuca

SEQ ID NO: 2599528 - RNA, 20 nt, Human
agagcuguuuauggccucag

SEQ ID NO: 2599529 - RNA, 21 nt, Human
agagcuguuuauggccucagc

SEQ ID NO: 2599530 - RNA, 18 nt, Human
agagcuggcaaagguggc

SEQ ID NO: 2599531 - RNA, 15 nt, Human
agagcuggcaaaggu

SEQ ID NO: 2599532 - RNA, 19 nt, Human
agagcuggagccuggugcc

SEQ ID NO: 2599533 - RNA, 18 nt, Human
agagcuggagccuggugc

SEQ ID NO: 2599534 - RNA, 12 nt, Human
agagcuggagcc

SEQ ID NO: 2599535 - RNA, 17 nt, Human
agagcuggagccuggug

SEQ ID NO: 2599536 - RNA, 15 nt, Human
agagcuggagccugg

SEQ ID NO: 2599537 - RNA, 14 nt, Human
agagcugcgggcug

SEQ ID NO: 2599538 - RNA, 20 nt, Human
ugaagaaaggguguuuuucu

SEQ ID NO: 2599539 - RNA, 21 nt, Human
ugaagaaaccuucagauuugu

SEQ ID NO: 2599540 - RNA, 14 nt, Human
agagcugccucucg

SEQ ID NO: 2599541 - RNA, 22 nt, Human
agagcugcucuggaaaauguga

SEQ ID NO: 2599542 - RNA, 16 nt, Human
agagcugcucuggaaa

SEQ ID NO: 2599543 - RNA, 15 nt, Human
agagcugcucuggaa

SEQ ID NO: 2599544 - RNA, 14 nt, Human
agagcugcucugga

SEQ ID NO: 2599545 - RNA, 23 nt, Human
agagcugcucuggaaaaugugac

SEQ ID NO: 2599546 - RNA, 19 nt, Human
ugaacuuugaccucugcag

SEQ ID NO: 2599547 - RNA, 20 nt, Human
ugaacuuugaccucugcagc

SEQ ID NO: 2599548 - RNA, 11 nt, Human
ugaacuuugcu

SEQ ID NO: 2599549 - RNA, 15 nt, Human
ugaacuuugcugagc

SEQ ID NO: 2599550 - RNA, 22 nt, Human
ugaacuuugaccucugcagcaa

SEQ ID NO: 2599551 - RNA, 21 nt, Human
ugaagaaaaucacuuaggaaa

SEQ ID NO: 2599552 - RNA, 15 nt, Human
ugaagaaaaucacuu

SEQ ID NO: 2599553 - RNA, 13 nt, Human
ugaacuuuuugua

SEQ ID NO: 2599554 - RNA, 16 nt, Human
ugaacuuugcugagcc

SEQ ID NO: 2599555 - RNA, 21 nt, Human
ugaacuauggacggugcucca

SEQ ID NO: 2599556 - RNA, 15 nt, Human
ugaagaaaaaauaca

SEQ ID NO: 2599557 - RNA, 17 nt, Human
ugaagaaaaaauacauu

SEQ ID NO: 2599558 - RNA, 18 nt, Human
ugaagaaaaaauacauuu

SEQ ID NO: 2599559 - RNA, 17 nt, Human
ugaagaaaacuccuuua

SEQ ID NO: 2599560 - RNA, 19 nt, Human
ugaagaaaaaauacauuuu

SEQ ID NO: 2599561 - RNA, 15 nt, Human
ugaagaaaagugggc

SEQ ID NO: 2599562 - RNA, 18 nt, Human
ugaagaaaagugggccag

SEQ ID NO: 2599563 - RNA, 19 nt, Human
ugaacaaauuuacagagac

SEQ ID NO: 2599564 - RNA, 20 nt, Human
ugaacaaauuuacagagaca

SEQ ID NO: 2599565 - RNA, 18 nt, Human
ugaacaaauuuacagaga

SEQ ID NO: 2599566 - RNA, 15 nt, Human
ugaaauuuuuauuaa

SEQ ID NO: 2599567 - RNA, 19 nt, Human
ugaaauuuucuagacuuuc

SEQ ID NO: 2599568 - RNA, 18 nt, Human
ugaaauuuucuagacuuu

SEQ ID NO: 2599569 - RNA, 20 nt, Human
ugaaauuuucuagacuuucu

SEQ ID NO: 2599570 - RNA, 14 nt, Human
ugaaccuaccuuca

SEQ ID NO: 2599571 - RNA, 16 nt, Human
ugaaccgcugaauaug

SEQ ID NO: 2599572 - RNA, 22 nt, Human
ugaaccgaugagaaauaaaguu

SEQ ID NO: 2599573 - RNA, 20 nt, Human
ugaaccuaccuucauuucag

SEQ ID NO: 2599574 - RNA, 15 nt, Human
ugaaccugaugcuga

SEQ ID NO: 2599575 - RNA, 12 nt, Human
ugaaccuggagg

SEQ ID NO: 2599576 - RNA, 22 nt, Human
ugaaccuaggagugccccauuc

SEQ ID NO: 2599577 - RNA, 21 nt, Human
ugaaccuaggagugccccauu

SEQ ID NO: 2599578 - RNA, 18 nt, Human
ugaacucaaacugaggaa

SEQ ID NO: 2599579 - RNA, 17 nt, Human
ugaacucaacuuugaca

SEQ ID NO: 2599580 - RNA, 12 nt, Human
ugaacuccuggc

SEQ ID NO: 2599581 - RNA, 15 nt, Human
ugaacuccuggccuc

SEQ ID NO: 2599582 - RNA, 14 nt, Human
ugaacuccuggccu

SEQ ID NO: 2599583 - RNA, 23 nt, Human
ugaacuauuccccagcagggucu

SEQ ID NO: 2599584 - RNA, 14 nt, Human
ugaacucaaacuga

SEQ ID NO: 2599585 - RNA, 16 nt, Human
ugaacucaaacugagg

SEQ ID NO: 2599586 - RNA, 17 nt, Human
ugaacucaaacugagga

SEQ ID NO: 2599587 - RNA, 23 nt, Human
ugaacuaggguggugcauuuuug

SEQ ID NO: 2599588 - RNA, 21 nt, Human
ugaacuaggauuguaguccca

SEQ ID NO: 2599589 - RNA, 17 nt, Human
ugaaccugaugcugacu

SEQ ID NO: 2599590 - RNA, 23 nt, Human
ugaacuagaguuuagcuggaaaa

SEQ ID NO: 2599591 - RNA, 16 nt, Human
agcauuugucaacaaa

SEQ ID NO: 2599592 - RNA, 14 nt, Human
agcauuuauaaauu

SEQ ID NO: 2599593 - RNA, 20 nt, Human
agcauuuaguccaaugucuu

SEQ ID NO: 2599594 - RNA, 17 nt, Human
agcauuugaaugcauuu

SEQ ID NO: 2599595 - RNA, 16 nt, Human
agcauuugaaugcauu

SEQ ID NO: 2599596 - RNA, 13 nt, Human
agcauuuauguuu

SEQ ID NO: 2599597 - RNA, 21 nt, Human
agcauuuaguccaaugucuuu

SEQ ID NO: 2599598 - RNA, 17 nt, Human
agcauuguuugcuuauu

SEQ ID NO: 2599599 - RNA, 15 nt, Human
agcauuuacuuugaa

SEQ ID NO: 2599600 - RNA, 17 nt, Human
agcauuuacuuugaauu

SEQ ID NO: 2599601 - RNA, 20 nt, Human
agcauuuaauguagccaugg

SEQ ID NO: 2599602 - RNA, 14 nt, Human
agcauuuuauaaau

SEQ ID NO: 2599603 - RNA, 15 nt, Human
agcauuuuauaaauc

SEQ ID NO: 2599604 - RNA, 13 nt, Human
agcauuuuauaaa

SEQ ID NO: 2599605 - RNA, 23 nt, Human
agcauuuuagcaauuuauacaau

SEQ ID NO: 2599606 - RNA, 20 nt, Human
agcauuuuauaaaucgcuuu

SEQ ID NO: 2599607 - RNA, 12 nt, Human
agcauuuuccuc

SEQ ID NO: 2599608 - RNA, 22 nt, Human
agcauuuugcuaaaugugaaug

SEQ ID NO: 2599609 - RNA, 15 nt, Human
agcauuuuguauuug

SEQ ID NO: 2599610 - RNA, 15 nt, Human
agcauuuugcuaaau

SEQ ID NO: 2599611 - RNA, 18 nt, Human
agccaaacauccuacaag

SEQ ID NO: 2599612 - RNA, 18 nt, Human
agccaaacccaugaggca

SEQ ID NO: 2599613 - RNA, 19 nt, Human
agccaaacccaugaggcaa

SEQ ID NO: 2599614 - RNA, 14 nt, Human
agccaaacccuguc

SEQ ID NO: 2599615 - RNA, 15 nt, Human
agccaaacccugucu

SEQ ID NO: 2599616 - RNA, 22 nt, Human
agccaaaauguaggcuuaguuu

SEQ ID NO: 2599617 - RNA, 17 nt, Human
agccaaaauguaggcuu

SEQ ID NO: 2599618 - RNA, 18 nt, Human
agcauuuuugauuuaugc

SEQ ID NO: 2599619 - RNA, 16 nt, Human
agcauuuuugauuuau

SEQ ID NO: 2599620 - RNA, 12 nt, Human
agcauucugucu

SEQ ID NO: 2599621 - RNA, 22 nt, Human
agcauucucacuccuaccuggu

SEQ ID NO: 2599622 - RNA, 22 nt, Human
agcauuuagauguauagguuga

SEQ ID NO: 2599623 - RNA, 17 nt, Human
agcauuuaauguagcca

SEQ ID NO: 2599624 - RNA, 21 nt, Human
agcauuguuugcuuauuguuc

SEQ ID NO: 2599625 - RNA, 22 nt, Human
agcauuguuugcuuauuguucc

SEQ ID NO: 2599626 - RNA, 23 nt, Human
agcauuguuugcuuauuguucca

SEQ ID NO: 2599627 - RNA, 20 nt, Human
agcauuccagccccucuggu

SEQ ID NO: 2599628 - RNA, 19 nt, Human
agcauuccagccccucugg

SEQ ID NO: 2599629 - RNA, 19 nt, Human
agcauuccaacaaaggguu

SEQ ID NO: 2599630 - RNA, 17 nt, Human
agcauuccaacaaaggg

SEQ ID NO: 2599631 - RNA, 16 nt, Human
agcauuccagccccuc

SEQ ID NO: 2599632 - RNA, 18 nt, Human
agcauuccuucuuugaua

SEQ ID NO: 2599633 - RNA, 17 nt, Human
agcauuccuucuuugau

SEQ ID NO: 2599634 - RNA, 16 nt, Human
agcauuccuucuuuga

SEQ ID NO: 2599635 - RNA, 15 nt, Human
agcauuccuucuuug

SEQ ID NO: 2599636 - RNA, 23 nt, Human
agcauuccuucuuugauaauguu

SEQ ID NO: 2599637 - RNA, 22 nt, Human
agcauuccuucuuugauaaugu

SEQ ID NO: 2599638 - RNA, 21 nt, Human
agcauuccuucuuugauaaug

SEQ ID NO: 2599639 - RNA, 19 nt, Human
agcauuccuucuuugauaa

SEQ ID NO: 2599640 - RNA, 24 nt, Human
agcauuccuucuuugauaauguua

SEQ ID NO: 2599641 - RNA, 14 nt, Human
agcauuccuuuuga

SEQ ID NO: 2599642 - RNA, 19 nt, Human
agcauucgagacagaaccu

SEQ ID NO: 2599643 - RNA, 20 nt, Human
agcauucucacuccuaccug

SEQ ID NO: 2599644 - RNA, 18 nt, Human
agcauucucacuccuacc

SEQ ID NO: 2599645 - RNA, 15 nt, Human
agcauuccaacaaag

SEQ ID NO: 2599646 - RNA, 14 nt, Human
agcauuccaacaaa

SEQ ID NO: 2599647 - RNA, 13 nt, Human
agcauuccaacaa

SEQ ID NO: 2599648 - RNA, 17 nt, Human
agcauucagagagcagc

SEQ ID NO: 2599649 - RNA, 16 nt, Human
agcauucagagagcag

SEQ ID NO: 2599650 - RNA, 15 nt, Human
agcauucagagagca

SEQ ID NO: 2599651 - RNA, 14 nt, Human
agcauucagagagc

SEQ ID NO: 2599652 - RNA, 18 nt, Human
agcauucacaacuuguuu

SEQ ID NO: 2599653 - RNA, 22 nt, Human
agcauucaauuuauucaagaaa

SEQ ID NO: 2599654 - RNA, 23 nt, Human
agcauucaauuuauucaagaaaa

SEQ ID NO: 2599655 - RNA, 20 nt, Human
agcauuacgugagccaggua

SEQ ID NO: 2599656 - RNA, 19 nt, Human
agcauuacgugagccaggu

SEQ ID NO: 2599657 - RNA, 18 nt, Human
agcauuacgugagccagg

SEQ ID NO: 2599658 - RNA, 17 nt, Human
agcauuacgugagccag

SEQ ID NO: 2599659 - RNA, 17 nt, Human
agcauuagauuucucau

SEQ ID NO: 2599660 - RNA, 19 nt, Human
agcauuaugauguggguca

SEQ ID NO: 2599661 - RNA, 17 nt, Human
agcauuacaaauugcuu

SEQ ID NO: 2599662 - RNA, 15 nt, Human
agcauguacaguguu

SEQ ID NO: 2599663 - RNA, 14 nt, Human
agcauguacagugu

SEQ ID NO: 2599664 - RNA, 12 nt, Human
agcauguacagu

SEQ ID NO: 2599665 - RNA, 19 nt, Human
agcaugggccuggccaccu

SEQ ID NO: 2599666 - RNA, 13 nt, Human
agcauguaauggu

SEQ ID NO: 2599667 - RNA, 19 nt, Human
agcauggcugccaauggga

SEQ ID NO: 2599668 - RNA, 16 nt, Human
agcauggcugugagga

SEQ ID NO: 2599669 - RNA, 13 nt, Human
agcauggcuguga

SEQ ID NO: 2599670 - RNA, 23 nt, Human
agcauccugccuuagagccaggc

SEQ ID NO: 2599671 - RNA, 22 nt, Human
agcauccugccuuagagccagg

SEQ ID NO: 2599672 - RNA, 14 nt, Human
agcaugggccuggc

SEQ ID NO: 2599673 - RNA, 17 nt, Human
agcauggcugugaggau

SEQ ID NO: 2599674 - RNA, 21 nt, Human
agcauauucaggaagcucagg

SEQ ID NO: 2599675 - RNA, 20 nt, Human
agcaucacaugaacuuguaa

SEQ ID NO: 2599676 - RNA, 19 nt, Human
agcauauucaggaagcuca

SEQ ID NO: 2599677 - RNA, 17 nt, Human
agcauauucaggaagcu

SEQ ID NO: 2599678 - RNA, 14 nt, Human
ugaucacggcucac

SEQ ID NO: 2599679 - RNA, 13 nt, Human
ugaucacggcuca

SEQ ID NO: 2599680 - RNA, 15 nt, Human
ugaucacggcucacu

SEQ ID NO: 2599681 - RNA, 14 nt, Human
ugaucaccugcccu

SEQ ID NO: 2599682 - RNA, 18 nt, Human
ugaucacggcucacugca

SEQ ID NO: 2599683 - RNA, 16 nt, Human
ugauacauccaaagca

SEQ ID NO: 2599684 - RNA, 17 nt, Human
ugauacaagauuagaag

SEQ ID NO: 2599685 - RNA, 16 nt, Human
ugauacaagauuagaa

SEQ ID NO: 2599686 - RNA, 20 nt, Human
ugauacaaauugcagacugu

SEQ ID NO: 2599687 - RNA, 22 nt, Human
ugauacauccaaagcagacagc

SEQ ID NO: 2599688 - RNA, 13 nt, Human
ugauacccagagc

SEQ ID NO: 2599689 - RNA, 14 nt, Human
ugauaccagcugga

SEQ ID NO: 2599690 - RNA, 15 nt, Human
ugauaccccccucug

SEQ ID NO: 2599691 - RNA, 18 nt, Human
ugauacccauagcuucca

SEQ ID NO: 2599692 - RNA, 21 nt, Human
ugauacccauagcuuccauga

SEQ ID NO: 2599693 - RNA, 15 nt, Human
ugaucacacucuggg

SEQ ID NO: 2599694 - RNA, 13 nt, Human
ugaucacacucug

SEQ ID NO: 2599695 - RNA, 12 nt, Human
ugaucacacucu

SEQ ID NO: 2599696 - RNA, 14 nt, Human
ugaucaauuaaaug

SEQ ID NO: 2599697 - RNA, 15 nt, Human
ugaucaauuaaaugu

SEQ ID NO: 2599698 - RNA, 16 nt, Human
ugaucaauuaaaugua

SEQ ID NO: 2599699 - RNA, 17 nt, Human
ugaucaauuaaauguag

SEQ ID NO: 2599700 - RNA, 19 nt, Human
ugauaccccccucugucuu

SEQ ID NO: 2599701 - RNA, 18 nt, Human
ugauaccccccucugucu

SEQ ID NO: 2599702 - RNA, 17 nt, Human
ugauaccccccucuguc

SEQ ID NO: 2599703 - RNA, 19 nt, Human
ugaucaaugacagagccuu

SEQ ID NO: 2599704 - RNA, 18 nt, Human
ugaucaaugacagagccu

SEQ ID NO: 2599705 - RNA, 14 nt, Human
ugaucaaugacaga

SEQ ID NO: 2599706 - RNA, 19 nt, Human
ugauaccgaauugugacuc

SEQ ID NO: 2599707 - RNA, 19 nt, Human
ugaucaauaaaaugugauu

SEQ ID NO: 2599708 - RNA, 21 nt, Human
ugaucaauaaaaugugauuuu

SEQ ID NO: 2599709 - RNA, 13 nt, Human
agcauggcugcca

SEQ ID NO: 2599710 - RNA, 23 nt, Human
agcaucccuugaccaggccuggg

SEQ ID NO: 2599711 - RNA, 22 nt, Human
agcaucccuugaccaggccugg

SEQ ID NO: 2599712 - RNA, 21 nt, Human
agcaucccuugaccaggccug

SEQ ID NO: 2599713 - RNA, 21 nt, Human
agcauccugccuuagagccag

SEQ ID NO: 2599714 - RNA, 22 nt, Human
agcaucccaggaucgcaagagc

SEQ ID NO: 2599715 - RNA, 20 nt, Human
agcauccaccuccuucucug

SEQ ID NO: 2599716 - RNA, 18 nt, Human
agcauccaccuccuucuc

SEQ ID NO: 2599717 - RNA, 17 nt, Human
agcauccaccuccuucu

SEQ ID NO: 2599718 - RNA, 16 nt, Human
agcauccaccuccuuc

SEQ ID NO: 2599719 - RNA, 15 nt, Human
agcauccaccuccuu

SEQ ID NO: 2599720 - RNA, 22 nt, Human
agcaucauuuugcauucaaauu

SEQ ID NO: 2599721 - RNA, 20 nt, Human
agcaucccugaggagccagg

SEQ ID NO: 2599722 - RNA, 24 nt, Human
agcauccauguguggacucaaguc

SEQ ID NO: 2599723 - RNA, 20 nt, Human
agcaucauuuugcauucaaa

SEQ ID NO: 2599724 - RNA, 19 nt, Human
agcaucauuuugcauucaa

SEQ ID NO: 2599725 - RNA, 18 nt, Human
agcaucauuuugcauuca

SEQ ID NO: 2599726 - RNA, 16 nt, Human
agcaucauuuugcauu

SEQ ID NO: 2599727 - RNA, 21 nt, Human
agcaucauuauuugcagagac

SEQ ID NO: 2599728 - RNA, 21 nt, Human
agcaucaggccaggcccucug

SEQ ID NO: 2599729 - RNA, 22 nt, Human
agcaucaggccaggcccucugc

SEQ ID NO: 2599730 - RNA, 23 nt, Human
agcaucaggccaggcccucugcc

SEQ ID NO: 2599731 - RNA, 22 nt, Human
agcaucaggguuaagaagacuu

SEQ ID NO: 2599732 - RNA, 16 nt, Human
agcauauucaggaagc

SEQ ID NO: 2599733 - RNA, 14 nt, Human
ugaucacagcagcu

SEQ ID NO: 2599734 - RNA, 13 nt, Human
agcaucaccucag

SEQ ID NO: 2599735 - RNA, 14 nt, Human
agcaucaccucagg

SEQ ID NO: 2599736 - RNA, 15 nt, Human
agcaucaccucaggc

SEQ ID NO: 2599737 - RNA, 16 nt, Human
agcaucaccucaggcc

SEQ ID NO: 2599738 - RNA, 19 nt, Human
agcaucaccucaggccagg

SEQ ID NO: 2599739 - RNA, 20 nt, Human
agcaucaccucaggccaggu

SEQ ID NO: 2599740 - RNA, 17 nt, Human
agcaucacuugggauua

SEQ ID NO: 2599741 - RNA, 23 nt, Human
ugauccagaaagaaaacuuguau

SEQ ID NO: 2599742 - RNA, 15 nt, Human
ugauccagagcacag

SEQ ID NO: 2599743 - RNA, 19 nt, Human
ugaucccaagugccagucu

SEQ ID NO: 2599744 - RNA, 13 nt, Human
ugauccagaaaga

SEQ ID NO: 2599745 - RNA, 18 nt, Human
ugauccacucgccuucau

SEQ ID NO: 2599746 - RNA, 14 nt, Human
ugauccacucgccu

SEQ ID NO: 2599747 - RNA, 18 nt, Human
agccaccccagaaauggu

SEQ ID NO: 2599748 - RNA, 14 nt, Human
agccaccccgggcu

SEQ ID NO: 2599749 - RNA, 20 nt, Human
agccaccccagaaaugguga

SEQ ID NO: 2599750 - RNA, 19 nt, Human
agccaccccgggcucucug

SEQ ID NO: 2599751 - RNA, 20 nt, Human
agccaccccgggcucucugc

SEQ ID NO: 2599752 - RNA, 21 nt, Human
agccaccccgggcucucugcu

SEQ ID NO: 2599753 - RNA, 23 nt, Human
agccaccccgggcucucugcugu

SEQ ID NO: 2599754 - RNA, 20 nt, Human
ugauccucccaccucagccu

SEQ ID NO: 2599755 - RNA, 19 nt, Human
ugauccucccaccucagcc

SEQ ID NO: 2599756 - RNA, 13 nt, Human
ugaucuaggaaga

SEQ ID NO: 2599757 - RNA, 15 nt, Human
ugaucgugcuaaauu

SEQ ID NO: 2599758 - RNA, 22 nt, Human
ugaucgugcuaaauuuucagua

SEQ ID NO: 2599759 - RNA, 20 nt, Human
ugaucccuguguugucucua

SEQ ID NO: 2599760 - RNA, 21 nt, Human
ugaucccuguuacccagagaa

SEQ ID NO: 2599761 - RNA, 22 nt, Human
ugauccguuccauugcaagcuu

SEQ ID NO: 2599762 - RNA, 18 nt, Human
ugauccucccaccucagc

SEQ ID NO: 2599763 - RNA, 19 nt, Human
ugaucccuguguugucucu

SEQ ID NO: 2599764 - RNA, 18 nt, Human
ugauccccaagugugaac

SEQ ID NO: 2599765 - RNA, 12 nt, Human
ugaucccagcac

SEQ ID NO: 2599766 - RNA, 13 nt, Human
ugaucccagcacu

SEQ ID NO: 2599767 - RNA, 17 nt, Human
agccaauuauguuaaac

SEQ ID NO: 2599768 - RNA, 16 nt, Human
agccaauuauguuaaa

SEQ ID NO: 2599769 - RNA, 20 nt, Human
agccaauuauguuaaacuag

SEQ ID NO: 2599770 - RNA, 16 nt, Human
agccaauucagacagg

SEQ ID NO: 2599771 - RNA, 15 nt, Human
agccaauuuuucugc

SEQ ID NO: 2599772 - RNA, 14 nt, Human
agccaauuuuucug

SEQ ID NO: 2599773 - RNA, 13 nt, Human
agccaauuuuucu

SEQ ID NO: 2599774 - RNA, 17 nt, Human
agccaauucagacaggc

SEQ ID NO: 2599775 - RNA, 18 nt, Human
agccaauucagacaggca

SEQ ID NO: 2599776 - RNA, 13 nt, Human
agccaaugcuguc

SEQ ID NO: 2599777 - RNA, 22 nt, Human
agccaauccccuccuugggcac

SEQ ID NO: 2599778 - RNA, 13 nt, Human
agccaaugcuuac

SEQ ID NO: 2599779 - RNA, 15 nt, Human
agccaauuauguuaa

SEQ ID NO: 2599780 - RNA, 21 nt, Human
agccaauccccuccuugggca

SEQ ID NO: 2599781 - RNA, 19 nt, Human
agccaaacccuugucagug

SEQ ID NO: 2599782 - RNA, 13 nt, Human
agccaaacccuug

SEQ ID NO: 2599783 - RNA, 16 nt, Human
agccaaacccugucug

SEQ ID NO: 2599784 - RNA, 14 nt, Human
agccacacacacag

SEQ ID NO: 2599785 - RNA, 15 nt, Human
agccacacacacaga

SEQ ID NO: 2599786 - RNA, 16 nt, Human
agccacacacacagaa

SEQ ID NO: 2599787 - RNA, 17 nt, Human
agccacacacacagaaa

SEQ ID NO: 2599788 - RNA, 18 nt, Human
agccacacacacagaaaa

SEQ ID NO: 2599789 - RNA, 19 nt, Human
agccacacacacagaaaau

SEQ ID NO: 2599790 - RNA, 20 nt, Human
agccacacacacagaaaaua

SEQ ID NO: 2599791 - RNA, 21 nt, Human
agccacacacacagaaaauau

SEQ ID NO: 2599792 - RNA, 17 nt, Human
agccacacaaacguuua

SEQ ID NO: 2599793 - RNA, 19 nt, Human
agccacaaaauaaauguug

SEQ ID NO: 2599794 - RNA, 10 nt, Human
agccacacac

SEQ ID NO: 2599795 - RNA, 12 nt, Human
agccacacacac

SEQ ID NO: 2599796 - RNA, 13 nt, Human
agccacacacaca

SEQ ID NO: 2599797 - RNA, 23 nt, Human
agccaauuuuucugcacugagca

SEQ ID NO: 2599798 - RNA, 20 nt, Human
agccaauuuuucugcacuga

SEQ ID NO: 2599799 - RNA, 17 nt, Human
agccaauuuuucugcac

SEQ ID NO: 2599800 - RNA, 16 nt, Human
agccaauuuuucugca

SEQ ID NO: 2599801 - RNA, 19 nt, Human
agccacaagaaauuugauu

SEQ ID NO: 2599802 - RNA, 20 nt, Human
agccacagaagccaggagca

SEQ ID NO: 2599803 - RNA, 19 nt, Human
agccacagaagccaggagc

SEQ ID NO: 2599804 - RNA, 18 nt, Human
agccacagaagccaggag

SEQ ID NO: 2599805 - RNA, 17 nt, Human
agccacagaagccagga

SEQ ID NO: 2599806 - RNA, 12 nt, Human
agccacagaagc

SEQ ID NO: 2599807 - RNA, 10 nt, Human
agccacagaa

SEQ ID NO: 2599808 - RNA, 23 nt, Human
agccacagaagccaggagcaaau

SEQ ID NO: 2599809 - RNA, 13 nt, Human
agccacaggccug

SEQ ID NO: 2599810 - RNA, 13 nt, Human
agccacagcuggu

SEQ ID NO: 2599811 - RNA, 22 nt, Human
agccacacacacagaaaauaua

SEQ ID NO: 2599812 - RNA, 23 nt, Human
agccacacacacagaaaauauac

SEQ ID NO: 2599813 - RNA, 21 nt, Human
agccacacugugggacucuuc

SEQ ID NO: 2599814 - RNA, 21 nt, Human
agccacacucugggcuccaga

SEQ ID NO: 2599815 - RNA, 13 nt, Human
agccaccacgccc

SEQ ID NO: 2599816 - RNA, 17 nt, Human
agccaccacguccagcu

SEQ ID NO: 2599817 - RNA, 16 nt, Human
agccaccaucuuugca

SEQ ID NO: 2599818 - RNA, 13 nt, Human
agccaccaucuuu

SEQ ID NO: 2599819 - RNA, 17 nt, Human
agccaccaucuuugcag

SEQ ID NO: 2599820 - RNA, 23 nt, Human
agccaccaugcccagcucagagg

SEQ ID NO: 2599821 - RNA, 21 nt, Human
agccacaggccugagauuuca

SEQ ID NO: 2599822 - RNA, 17 nt, Human
agccacaggccugagau

SEQ ID NO: 2599823 - RNA, 16 nt, Human
agccacaggccugaga

SEQ ID NO: 2599824 - RNA, 14 nt, Human
agccacaggccuga

SEQ ID NO: 2599825 - RNA, 23 nt, Human
agccacaggccugagauuucauc

SEQ ID NO: 2599826 - RNA, 22 nt, Human
agccacaggccugagauuucau

SEQ ID NO: 2599827 - RNA, 22 nt, Human
agccacagaagccaggagcaaa

SEQ ID NO: 2599828 - RNA, 15 nt, Human
ugauuaaguaaugau

SEQ ID NO: 2599829 - RNA, 16 nt, Human
ugauuaaguaaugaua

SEQ ID NO: 2599830 - RNA, 16 nt, Human
agccacggccaggcca

SEQ ID NO: 2599831 - RNA, 13 nt, Human
ugauuaaauucuu

SEQ ID NO: 2599832 - RNA, 16 nt, Human
ugauuaaauucuugca

SEQ ID NO: 2599833 - RNA, 17 nt, Human
ugauuaaauucuugcaa

SEQ ID NO: 2599834 - RNA, 20 nt, Human
ugauuaaccacuucagcuga

SEQ ID NO: 2599835 - RNA, 17 nt, Human
ugauguuuuccaugagu

SEQ ID NO: 2599836 - RNA, 21 nt, Human
ugauguuuuaaggaugcuugu

SEQ ID NO: 2599837 - RNA, 19 nt, Human
ugauguuuuccaugagucc

SEQ ID NO: 2599838 - RNA, 23 nt, Human
ugauguuuuccaugaguccccug

SEQ ID NO: 2599839 - RNA, 19 nt, Human
ugauggguuaguggaugga

SEQ ID NO: 2599840 - RNA, 23 nt, Human
ugauggguuaguggauggaaggg

SEQ ID NO: 2599841 - RNA, 15 nt, Human
ugaugggggaggggg

SEQ ID NO: 2599842 - RNA, 14 nt, Human
ugauggggaaggag

SEQ ID NO: 2599843 - RNA, 21 nt, Human
ugauggucagcucccuucucu

SEQ ID NO: 2599844 - RNA, 16 nt, Human
ugauggucagcucccu

SEQ ID NO: 2599845 - RNA, 15 nt, Human
ugauggucagcuccc

SEQ ID NO: 2599846 - RNA, 22 nt, Human
ugauggggcccugccuccuuug

SEQ ID NO: 2599847 - RNA, 15 nt, Human
ugaugggucaguugu

SEQ ID NO: 2599848 - RNA, 17 nt, Human
ugauggggaaggaggcu

SEQ ID NO: 2599849 - RNA, 20 nt, Human
ugaugaucuuugcagacagg

SEQ ID NO: 2599850 - RNA, 19 nt, Human
ugaugaucuuugcagacag

SEQ ID NO: 2599851 - RNA, 15 nt, Human
ugaugaaaauauuua

SEQ ID NO: 2599852 - RNA, 23 nt, Human
ugaugaaaugaggucagagccug

SEQ ID NO: 2599853 - RNA, 15 nt, Human
ugaucuaggaagacu

SEQ ID NO: 2599854 - RNA, 14 nt, Human
ugaucuaggaagac

SEQ ID NO: 2599855 - RNA, 17 nt, Human
ugaucuagagccaguua

SEQ ID NO: 2599856 - RNA, 18 nt, Human
ugaugaaaauauuuaaag

SEQ ID NO: 2599857 - RNA, 22 nt, Human
ugaugaaaugaggucagagccu

SEQ ID NO: 2599858 - RNA, 13 nt, Human
ugauggggcccug

SEQ ID NO: 2599859 - RNA, 22 nt, Human
ugaugggcaacccccagccugc

SEQ ID NO: 2599860 - RNA, 21 nt, Human
ugaugggcaacccccagccug

SEQ ID NO: 2599861 - RNA, 15 nt, Human
ugauggcuucuccag

SEQ ID NO: 2599862 - RNA, 13 nt, Human
ugauggcuucucc

SEQ ID NO: 2599863 - RNA, 18 nt, Human
ugauggcaacagaucugg

SEQ ID NO: 2599864 - RNA, 19 nt, Human
ugauggcaacagaucugga

SEQ ID NO: 2599865 - RNA, 16 nt, Human
ugauggcaacagaucu

SEQ ID NO: 2599866 - RNA, 21 nt, Human
ugaugaucuuugcagacaggc

SEQ ID NO: 2599867 - RNA, 15 nt, Human
ugauggcaauuuugu

SEQ ID NO: 2599868 - RNA, 23 nt, Human
ugauggcaacagaucuggaaccu

SEQ ID NO: 2599869 - RNA, 17 nt, Human
ugauggcaauuuuguaa

SEQ ID NO: 2599870 - RNA, 22 nt, Human
ugauggcaccacugcacuccag

SEQ ID NO: 2599871 - RNA, 20 nt, Human
ugauggcaggauggccuggc

SEQ ID NO: 2599872 - RNA, 22 nt, Human
ugauggcacuuagcuaucagaa

SEQ ID NO: 2599873 - RNA, 16 nt, Human
agcaggcuacugucag

SEQ ID NO: 2599874 - RNA, 17 nt, Human
agcaggcuacugucagc

SEQ ID NO: 2599875 - RNA, 19 nt, Human
agcaggcuacugucagcuc

SEQ ID NO: 2599876 - RNA, 20 nt, Human
agcaggcuacugucagcucc

SEQ ID NO: 2599877 - RNA, 14 nt, Human
agcaggcuacuguc

SEQ ID NO: 2599878 - RNA, 13 nt, Human
agcaggccuugcg

SEQ ID NO: 2599879 - RNA, 12 nt, Human
agcaggccuugc

SEQ ID NO: 2599880 - RNA, 21 nt, Human
agcaggcguucagcucacugu

SEQ ID NO: 2599881 - RNA, 21 nt, Human
agcaggccuugcgcuguugcg

SEQ ID NO: 2599882 - RNA, 16 nt, Human
agcaggaggaggugcc

SEQ ID NO: 2599883 - RNA, 23 nt, Human
agcaggagauugagaaggagaga

SEQ ID NO: 2599884 - RNA, 21 nt, Human
agcaggagauugagaaggaga

SEQ ID NO: 2599885 - RNA, 20 nt, Human
agcaggagauugagaaggag

SEQ ID NO: 2599886 - RNA, 14 nt, Human
agcaggaggccagg

SEQ ID NO: 2599887 - RNA, 15 nt, Human
agcaggaggccaggc

SEQ ID NO: 2599888 - RNA, 23 nt, Human
agcaggaggccccuggcccagcg

SEQ ID NO: 2599889 - RNA, 20 nt, Human
agcaggaggccccuggccca

SEQ ID NO: 2599890 - RNA, 16 nt, Human
agcaggaggccccugg

SEQ ID NO: 2599891 - RNA, 15 nt, Human
agcaggaggccccug

SEQ ID NO: 2599892 - RNA, 20 nt, Human
agcaggcacuugauuccuug

SEQ ID NO: 2599893 - RNA, 16 nt, Human
agcaggcacauggagg

SEQ ID NO: 2599894 - RNA, 21 nt, Human
agcaggauaguugcuccgccu

SEQ ID NO: 2599895 - RNA, 14 nt, Human
agcaggcacaugga

SEQ ID NO: 2599896 - RNA, 19 nt, Human
agcaggcacauggaggagc

SEQ ID NO: 2599897 - RNA, 22 nt, Human
agcaggauaguugcuccgccuc

SEQ ID NO: 2599898 - RNA, 19 nt, Human
agcaggagauugagaagga

SEQ ID NO: 2599899 - RNA, 18 nt, Human
agcaggagauugagaagg

SEQ ID NO: 2599900 - RNA, 15 nt, Human
agcaggagauugaga

SEQ ID NO: 2599901 - RNA, 23 nt, Human
agcaggagaggagagccagagaa

SEQ ID NO: 2599902 - RNA, 22 nt, Human
agcaggagaggagagccagaga

SEQ ID NO: 2599903 - RNA, 21 nt, Human
agcaggagaggagagccagag

SEQ ID NO: 2599904 - RNA, 20 nt, Human
agcaggagaggagagccaga

SEQ ID NO: 2599905 - RNA, 19 nt, Human
agcaggagaggagagccag

SEQ ID NO: 2599906 - RNA, 17 nt, Human
agcaggagaggagagcc

SEQ ID NO: 2599907 - RNA, 16 nt, Human
agcaggagaggagagc

SEQ ID NO: 2599908 - RNA, 14 nt, Human
agcaggagaggaga

SEQ ID NO: 2599909 - RNA, 22 nt, Human
agcaggaccucugaaacccugg

SEQ ID NO: 2599910 - RNA, 23 nt, Human
agcaggacugaauuguccccagu

SEQ ID NO: 2599911 - RNA, 13 nt, Human
agcaggaccucug

SEQ ID NO: 2599912 - RNA, 15 nt, Human
agcaggaagcucaga

SEQ ID NO: 2599913 - RNA, 16 nt, Human
agcagcagggagggcu

SEQ ID NO: 2599914 - RNA, 19 nt, Human
agcagcagccuuuaaugca

SEQ ID NO: 2599915 - RNA, 18 nt, Human
agcagcagugaaaacaag

SEQ ID NO: 2599916 - RNA, 16 nt, Human
agcagcagugaaaaca

SEQ ID NO: 2599917 - RNA, 23 nt, Human
agcagcagugaaaacaagugcug

SEQ ID NO: 2599918 - RNA, 18 nt, Human
agcagcaucugcuaauaa

SEQ ID NO: 2599919 - RNA, 13 nt, Human
agcaggacaugga

SEQ ID NO: 2599920 - RNA, 20 nt, Human
agcagccaagggaugaaaga

SEQ ID NO: 2599921 - RNA, 22 nt, Human
agcaggaagcauucagagagca

SEQ ID NO: 2599922 - RNA, 12 nt, Human
agcaggaagcuc

SEQ ID NO: 2599923 - RNA, 14 nt, Human
agcaggaagcucag

SEQ ID NO: 2599924 - RNA, 11 nt, Human
agcagccacau

SEQ ID NO: 2599925 - RNA, 15 nt, Human
agcagccacauuccu

SEQ ID NO: 2599926 - RNA, 20 nt, Human
agcagccaagcuccuuggga

SEQ ID NO: 2599927 - RNA, 21 nt, Human
agcagccaagcuccuugggag

SEQ ID NO: 2599928 - RNA, 22 nt, Human
agcagccaagcuccuugggagg

SEQ ID NO: 2599929 - RNA, 20 nt, Human
ugacccaugcugcccuguga

SEQ ID NO: 2599930 - RNA, 14 nt, Human
ugacccaggccgca

SEQ ID NO: 2599931 - RNA, 13 nt, Human
ugacccaggccgc

SEQ ID NO: 2599932 - RNA, 19 nt, Human
agcagcaccguucugugca

SEQ ID NO: 2599933 - RNA, 12 nt, Human
ugacccaggccg

SEQ ID NO: 2599934 - RNA, 20 nt, Human
ugacccagcacugcccaaag

SEQ ID NO: 2599935 - RNA, 23 nt, Human
ugacccagccccuugagaaaccu

SEQ ID NO: 2599936 - RNA, 15 nt, Human
ugacccaggccgcag

SEQ ID NO: 2599937 - RNA, 20 nt, Human
agcagcaccguucugugcac

SEQ ID NO: 2599938 - RNA, 19 nt, Human
ugacccaugcugcccugug

SEQ ID NO: 2599939 - RNA, 18 nt, Human
ugacccaugcugcccugu

SEQ ID NO: 2599940 - RNA, 17 nt, Human
ugacccaugcugcccug

SEQ ID NO: 2599941 - RNA, 21 nt, Human
ugacccagccccuugagaaac

SEQ ID NO: 2599942 - RNA, 19 nt, Human
ugacccagccccuugagaa

SEQ ID NO: 2599943 - RNA, 18 nt, Human
ugacccagccccuugaga

SEQ ID NO: 2599944 - RNA, 15 nt, Human
agcagggcucagcgg

SEQ ID NO: 2599945 - RNA, 14 nt, Human
agcagggcucagcg

SEQ ID NO: 2599946 - RNA, 21 nt, Human
agcagggauuaaccucugcac

SEQ ID NO: 2599947 - RNA, 20 nt, Human
agcagggauuaaccucugca

SEQ ID NO: 2599948 - RNA, 22 nt, Human
agcagggauuaaccucugcacu

SEQ ID NO: 2599949 - RNA, 24 nt, Human
agcagggaugcccuggagguggcu

SEQ ID NO: 2599950 - RNA, 13 nt, Human
agcagggcucagc

SEQ ID NO: 2599951 - RNA, 19 nt, Human
agcagggcauggcugggaa

SEQ ID NO: 2599952 - RNA, 19 nt, Human
agcagggauuaaccucugc

SEQ ID NO: 2599953 - RNA, 17 nt, Human
agcagggaugcccugga

SEQ ID NO: 2599954 - RNA, 22 nt, Human
agcagggaugcccuggaggugg

SEQ ID NO: 2599955 - RNA, 11 nt, Human
agcagggagga

SEQ ID NO: 2599956 - RNA, 21 nt, Human
agcagggaaaaugcagcaggg

SEQ ID NO: 2599957 - RNA, 22 nt, Human
agcaggcuggcagcucuccagu

SEQ ID NO: 2599958 - RNA, 20 nt, Human
agcaggcuggcagcucucca

SEQ ID NO: 2599959 - RNA, 24 nt, Human
agcaggcuggcagcucuccaguca

SEQ ID NO: 2599960 - RNA, 20 nt, Human
agcagggaaaauauauaucu

SEQ ID NO: 2599961 - RNA, 20 nt, Human
agcagggagggcuucugcca

SEQ ID NO: 2599962 - RNA, 16 nt, Human
agcaggggcguggagg

SEQ ID NO: 2599963 - RNA, 16 nt, Human
agcagggcugcuguga

SEQ ID NO: 2599964 - RNA, 23 nt, Human
agcagggcucugccccagaggcc

SEQ ID NO: 2599965 - RNA, 16 nt, Human
agcagggcucugcccc

SEQ ID NO: 2599966 - RNA, 23 nt, Human
agcagggcuacccugagcugagg

SEQ ID NO: 2599967 - RNA, 22 nt, Human
agcagggcucagcggggacagc

SEQ ID NO: 2599968 - RNA, 23 nt, Human
agcagggucuuuucaucugggaa

SEQ ID NO: 2599969 - RNA, 22 nt, Human
agcagggucuuuucaucuggga

SEQ ID NO: 2599970 - RNA, 20 nt, Human
agcagggucuuuucaucugg

SEQ ID NO: 2599971 - RNA, 19 nt, Human
agcagggucuuuucaucug

SEQ ID NO: 2599972 - RNA, 18 nt, Human
agcagggucuuuucaucu

SEQ ID NO: 2599973 - RNA, 16 nt, Human
agcagggucuuuucau

SEQ ID NO: 2599974 - RNA, 17 nt, Human
agcagggucugggcagg

SEQ ID NO: 2599975 - RNA, 16 nt, Human
agcagggucugggcag

SEQ ID NO: 2599976 - RNA, 21 nt, Human
agcaggggcuacaagagggaa

SEQ ID NO: 2599977 - RNA, 20 nt, Human
agcaggggcuacaagaggga

SEQ ID NO: 2599978 - RNA, 19 nt, Human
agcaggggcuacaagaggg

SEQ ID NO: 2599979 - RNA, 16 nt, Human
agcaggggcuacaaga

SEQ ID NO: 2599980 - RNA, 22 nt, Human
agcagggguccuuggugugacc

SEQ ID NO: 2599981 - RNA, 18 nt, Human
agcaggguagucugguuu

SEQ ID NO: 2599982 - RNA, 21 nt, Human
agcaggguagucugguuucua

SEQ ID NO: 2599983 - RNA, 21 nt, Human
agcagguccccagcuuuggcu

SEQ ID NO: 2599984 - RNA, 20 nt, Human
agcagguccccagcuuuggc

SEQ ID NO: 2599985 - RNA, 17 nt, Human
agcaggguguugggaua

SEQ ID NO: 2599986 - RNA, 15 nt, Human
agcagggugcugugg

SEQ ID NO: 2599987 - RNA, 14 nt, Human
agcagguaccacug

SEQ ID NO: 2599988 - RNA, 20 nt, Human
agcaggugcugcuacccucc

SEQ ID NO: 2599989 - RNA, 18 nt, Human
agcaggugcugcuacccu

SEQ ID NO: 2599990 - RNA, 17 nt, Human
agcaggugcugcuaccc

SEQ ID NO: 2599991 - RNA, 16 nt, Human
agcaggugcugcuacc

SEQ ID NO: 2599992 - RNA, 15 nt, Human
agcaggugcugcuac

SEQ ID NO: 2599993 - RNA, 13 nt, Human
agcaggugcugac

SEQ ID NO: 2599994 - RNA, 19 nt, Human
agcagguggcaucucuaau

SEQ ID NO: 2599995 - RNA, 16 nt, Human
agcagguggcaucucu

SEQ ID NO: 2599996 - RNA, 17 nt, Human
agcaggugggaaauggu

SEQ ID NO: 2599997 - RNA, 13 nt, Human
agcagguggggag

SEQ ID NO: 2599998 - RNA, 18 nt, Human
agcaggugguccugagac

SEQ ID NO: 2599999 - RNA, 17 nt, Human
agcaggugguccugaga

SEQ ID NO: 2600000 - RNA, 13 nt, Human
agcaggugguccu

SEQ ID NO: 2600001 - RNA, 14 nt, Human
agcagguggggagg

SEQ ID NO: 2600002 - RNA, 19 nt, Human
agcaggcucucaggccagc

SEQ ID NO: 2600003 - RNA, 18 nt, Human
agcaggcucucaggccag

SEQ ID NO: 2600004 - RNA, 17 nt, Human
agcaggcucucaggcca

SEQ ID NO: 2600005 - RNA, 16 nt, Human
agcaggcucucaggcc

SEQ ID NO: 2600006 - RNA, 15 nt, Human
agcaggcucucaggc

SEQ ID NO: 2600007 - RNA, 14 nt, Human
agcaggcucucagg

SEQ ID NO: 2600008 - RNA, 13 nt, Human
agcaggcucucag

SEQ ID NO: 2600009 - RNA, 17 nt, Human
agcaggcucgggcuccc

SEQ ID NO: 2600010 - RNA, 22 nt, Human
agcaggcuacacugacacuggu

SEQ ID NO: 2600011 - RNA, 16 nt, Human
agcaggcuacacugac

SEQ ID NO: 2600012 - RNA, 23 nt, Human
agcaggcucucaggccagcugcu

SEQ ID NO: 2600013 - RNA, 22 nt, Human
agcaggcucucaggccagcugc

SEQ ID NO: 2600014 - RNA, 21 nt, Human
agcaggcucucaggccagcug

SEQ ID NO: 2600015 - RNA, 15 nt, Human
agcagggaaacagcu

SEQ ID NO: 2600016 - RNA, 14 nt, Human
agcagggaaacagc

SEQ ID NO: 2600017 - RNA, 17 nt, Human
agcaggcuggcagcucu

SEQ ID NO: 2600018 - RNA, 16 nt, Human
agcaggcuggcagcuc

SEQ ID NO: 2600019 - RNA, 14 nt, Human
agcaggcuggcagc

SEQ ID NO: 2600020 - RNA, 13 nt, Human
agcaggcuggcag

SEQ ID NO: 2600021 - RNA, 15 nt, Human
agcaggcugugaguu

SEQ ID NO: 2600022 - RNA, 13 nt, Human
agcagggaaacag

SEQ ID NO: 2600023 - RNA, 16 nt, Human
ugaguacguugugcau

SEQ ID NO: 2600024 - RNA, 17 nt, Human
ugaguacguugugcauu

SEQ ID NO: 2600025 - RNA, 18 nt, Human
ugaguacguugugcauuu

SEQ ID NO: 2600026 - RNA, 19 nt, Human
ugaguacguugugcauuug

SEQ ID NO: 2600027 - RNA, 15 nt, Human
agcauaucugccuuu

SEQ ID NO: 2600028 - RNA, 14 nt, Human
ugaguaagagcugg

SEQ ID NO: 2600029 - RNA, 16 nt, Human
ugaguaagagcuggug

SEQ ID NO: 2600030 - RNA, 17 nt, Human
ugaguaagagcuggugu

SEQ ID NO: 2600031 - RNA, 18 nt, Human
ugaguaagagcugguguc

SEQ ID NO: 2600032 - RNA, 21 nt, Human
ugaguaagagcuggugucuga

SEQ ID NO: 2600033 - RNA, 23 nt, Human
ugaguaagagcuggugucugauu

SEQ ID NO: 2600034 - RNA, 13 nt, Human
agcauaucugccu

SEQ ID NO: 2600035 - RNA, 19 nt, Human
agcauaccaacacgagcag

SEQ ID NO: 2600036 - RNA, 22 nt, Human
agcauaccaacacgagcaggcu

SEQ ID NO: 2600037 - RNA, 16 nt, Human
agcauagaaggcaggu

SEQ ID NO: 2600038 - RNA, 13 nt, Human
agcaguuuucaag

SEQ ID NO: 2600039 - RNA, 17 nt, Human
agcaguuuucaagucaa

SEQ ID NO: 2600040 - RNA, 18 nt, Human
agcaguuuucaagucaaa

SEQ ID NO: 2600041 - RNA, 21 nt, Human
agcaguuuucaagucaaauua

SEQ ID NO: 2600042 - RNA, 22 nt, Human
agcaguuuucaagucaaauuaa

SEQ ID NO: 2600043 - RNA, 23 nt, Human
agcauaaaaauuagccaagugug

SEQ ID NO: 2600044 - RNA, 13 nt, Human
agcauaccaacac

SEQ ID NO: 2600045 - RNA, 13 nt, Human
agcauacauuuau

SEQ ID NO: 2600046 - RNA, 14 nt, Human
agcauacauuuaua

SEQ ID NO: 2600047 - RNA, 20 nt, Human
agcauacauuuauaauguuu

SEQ ID NO: 2600048 - RNA, 12 nt, Human
agcauacaacuu

SEQ ID NO: 2600049 - RNA, 14 nt, Human
agcagucgugccug

SEQ ID NO: 2600050 - RNA, 17 nt, Human
agcagucgugccugugu

SEQ ID NO: 2600051 - RNA, 16 nt, Human
agcagucgugccugug

SEQ ID NO: 2600052 - RNA, 19 nt, Human
agcagucaggaaagagaac

SEQ ID NO: 2600053 - RNA, 19 nt, Human
agcaguccugccucagccu

SEQ ID NO: 2600054 - RNA, 22 nt, Human
agcaguccugccucagccuccg

SEQ ID NO: 2600055 - RNA, 18 nt, Human
agcaguuucuguccugcu

SEQ ID NO: 2600056 - RNA, 20 nt, Human
agcaguuucuguccugcugg

SEQ ID NO: 2600057 - RNA, 19 nt, Human
agcaguuucuguccugcug

SEQ ID NO: 2600058 - RNA, 14 nt, Human
agcaguuugcuuug

SEQ ID NO: 2600059 - RNA, 19 nt, Human
agcauaaaaauuagccaag

SEQ ID NO: 2600060 - RNA, 18 nt, Human
agcagucaggaaagagaa

SEQ ID NO: 2600061 - RNA, 17 nt, Human
agcagucaggaaagaga

SEQ ID NO: 2600062 - RNA, 16 nt, Human
agcaguaucaugaagc

SEQ ID NO: 2600063 - RNA, 21 nt, Human
agcaguagaaauaauaugcau

SEQ ID NO: 2600064 - RNA, 22 nt, Human
agcaguagaaauaauaugcauu

SEQ ID NO: 2600065 - RNA, 17 nt, Human
agcagguucccaagcuc

SEQ ID NO: 2600066 - RNA, 18 nt, Human
agcagguucccaagcuca

SEQ ID NO: 2600067 - RNA, 16 nt, Human
agcagguucccaagcu

SEQ ID NO: 2600068 - RNA, 21 nt, Human
agcaggugguccugagaccug

SEQ ID NO: 2600069 - RNA, 20 nt, Human
agcaggugguccugagaccu

SEQ ID NO: 2600070 - RNA, 23 nt, Human
agcagguucccaagcucagaggc

SEQ ID NO: 2600071 - RNA, 20 nt, Human
agcagguugaggggcuccug

SEQ ID NO: 2600072 - RNA, 21 nt, Human
agcagguugaggggcuccugg

SEQ ID NO: 2600073 - RNA, 22 nt, Human
agcagguugaggggcuccugga

SEQ ID NO: 2600074 - RNA, 17 nt, Human
agcagguuuuucuccuc

SEQ ID NO: 2600075 - RNA, 17 nt, Human
agcaguaacugacaacu

SEQ ID NO: 2600076 - RNA, 16 nt, Human
ugauaaguaaaugcua

SEQ ID NO: 2600077 - RNA, 22 nt, Human
ugaguucuacauaaguaauuca

SEQ ID NO: 2600078 - RNA, 20 nt, Human
ugaguucuacauaaguaauu

SEQ ID NO: 2600079 - RNA, 15 nt, Human
ugaguucuacauaag

SEQ ID NO: 2600080 - RNA, 14 nt, Human
ugauacaaugcugu

SEQ ID NO: 2600081 - RNA, 15 nt, Human
ugauacaaugcugug

SEQ ID NO: 2600082 - RNA, 19 nt, Human
ugauaauauuguggugcca

SEQ ID NO: 2600083 - RNA, 15 nt, Human
ugaguguggaagccg

SEQ ID NO: 2600084 - RNA, 12 nt, Human
ugaguguggaag

SEQ ID NO: 2600085 - RNA, 14 nt, Human
ugaguguggcuccc

SEQ ID NO: 2600086 - RNA, 16 nt, Human
ugaguguggcuccccu

SEQ ID NO: 2600087 - RNA, 17 nt, Human
ugaguguggcuccccuc

SEQ ID NO: 2600088 - RNA, 18 nt, Human
ugaguguggcuccccucu

SEQ ID NO: 2600089 - RNA, 17 nt, Human
ugaguguguccaagugu

SEQ ID NO: 2600090 - RNA, 21 nt, Human
ugagugggggaucacagccuc

SEQ ID NO: 2600091 - RNA, 18 nt, Human
ugaguuccuagccaccgc

SEQ ID NO: 2600092 - RNA, 14 nt, Human
ugaguuccuagcca

SEQ ID NO: 2600093 - RNA, 24 nt, Human
ugaguuacuugcugcccugugcuc

SEQ ID NO: 2600094 - RNA, 15 nt, Human
ugaguuacuuccuau

SEQ ID NO: 2600095 - RNA, 18 nt, Human
ugaguucauacccuguua

SEQ ID NO: 2600096 - RNA, 16 nt, Human
ugaguuacagccuguu

SEQ ID NO: 2600097 - RNA, 22 nt, Human
ugaguguuuuuacuacaguugu

SEQ ID NO: 2600098 - RNA, 14 nt, Human
ugaguacuacaguc

SEQ ID NO: 2600099 - RNA, 15 nt, Human
ugaguacagcagaaa

SEQ ID NO: 2600100 - RNA, 20 nt, Human
ugaguacguugugcauuugg

SEQ ID NO: 2600101 - RNA, 18 nt, Human
ugagucaccaagcccagu

SEQ ID NO: 2600102 - RNA, 22 nt, Human
ugagucacccuaccugugccug

SEQ ID NO: 2600103 - RNA, 13 nt, Human
ugagucaccagga

SEQ ID NO: 2600104 - RNA, 20 nt, Human
ugagucacccuaccugugcc

SEQ ID NO: 2600105 - RNA, 16 nt, Human
ugagucacccaugaag

SEQ ID NO: 2600106 - RNA, 16 nt, Human
ugagugagccuggcuc

SEQ ID NO: 2600107 - RNA, 14 nt, Human
ugagugagccuggc

SEQ ID NO: 2600108 - RNA, 21 nt, Human
ugagucaugaucucccugccg

SEQ ID NO: 2600109 - RNA, 20 nt, Human
ugagucagguuugaguagag

SEQ ID NO: 2600110 - RNA, 20 nt, Human
ugagucaugaucucccugcc

SEQ ID NO: 2600111 - RNA, 22 nt, Human
ugagucaugaucucccugccgc

SEQ ID NO: 2600112 - RNA, 20 nt, Human
ugagugauuauuuguuauuu

SEQ ID NO: 2600113 - RNA, 14 nt, Human
ugagugauagagcu

SEQ ID NO: 2600114 - RNA, 22 nt, Human
ugagugaggguuucugagcugc

SEQ ID NO: 2600115 - RNA, 19 nt, Human
ugagugagccuggcucuug

SEQ ID NO: 2600116 - RNA, 17 nt, Human
ugagugagccuggcucu

SEQ ID NO: 2600117 - RNA, 15 nt, Human
ugagugauccuccaa

SEQ ID NO: 2600118 - RNA, 20 nt, Human
ugagugaugcggcagauuga

SEQ ID NO: 2600119 - RNA, 20 nt, Human
ugagugauccuccaacuuca

SEQ ID NO: 2600120 - RNA, 14 nt, Human
ugagugccuuacac

SEQ ID NO: 2600121 - RNA, 13 nt, Human
ugagugccuuaca

SEQ ID NO: 2600122 - RNA, 17 nt, Human
ugagugcagcucuggag

SEQ ID NO: 2600123 - RNA, 19 nt, Human
ugagugcagccguuugaga

SEQ ID NO: 2600124 - RNA, 14 nt, Human
ugagugauuauuug

SEQ ID NO: 2600125 - RNA, 16 nt, Human
ugagugccuuacacaa

SEQ ID NO: 2600126 - RNA, 15 nt, Human
ugagugcaguccuga

SEQ ID NO: 2600127 - RNA, 14 nt, Human
ugagugccuggcca

SEQ ID NO: 2600128 - RNA, 12 nt, Human
ugagugccuggc

SEQ ID NO: 2600129 - RNA, 18 nt, Human
ugaguggaugauguuucg

SEQ ID NO: 2600130 - RNA, 21 nt, Human
ugaguggcaggggacaggagu

SEQ ID NO: 2600131 - RNA, 13 nt, Human
ugaguggcagggg

SEQ ID NO: 2600132 - RNA, 15 nt, Human
ugaguggcauggcca

SEQ ID NO: 2600133 - RNA, 22 nt, Human
agccucuagggaccccuccucc

SEQ ID NO: 2600134 - RNA, 21 nt, Human
agccucuagggaccccuccuc

SEQ ID NO: 2600135 - RNA, 20 nt, Human
agccucuagggaccccuccu

SEQ ID NO: 2600136 - RNA, 16 nt, Human
agccucgucuucauua

SEQ ID NO: 2600137 - RNA, 18 nt, Human
agccucuagggaccccuc

SEQ ID NO: 2600138 - RNA, 16 nt, Human
agccucuccccagguc

SEQ ID NO: 2600139 - RNA, 23 nt, Human
agccucuccaggaaugccuccuc

SEQ ID NO: 2600140 - RNA, 18 nt, Human
agccucucaccuguacuc

SEQ ID NO: 2600141 - RNA, 12 nt, Human
agccucuccagg

SEQ ID NO: 2600142 - RNA, 22 nt, Human
agccucuccccagguccagcuc

SEQ ID NO: 2600143 - RNA, 18 nt, Human
agccucuccccaggucca

SEQ ID NO: 2600144 - RNA, 23 nt, Human
agccucuccccagguccagcucu

SEQ ID NO: 2600145 - RNA, 13 nt, Human
agccucuccccug

SEQ ID NO: 2600146 - RNA, 14 nt, Human
agccucuccaggaa

SEQ ID NO: 2600147 - RNA, 20 nt, Human
agccucgccgucugugaauu

SEQ ID NO: 2600148 - RNA, 17 nt, Human
agccucgacacagagug

SEQ ID NO: 2600149 - RNA, 18 nt, Human
agccucgacacagagugg

SEQ ID NO: 2600150 - RNA, 18 nt, Human
agccuccugcccaguccc

SEQ ID NO: 2600151 - RNA, 21 nt, Human
agccuccuguguagcugggau

SEQ ID NO: 2600152 - RNA, 21 nt, Human
ugcagacaggcaagcaccucc

SEQ ID NO: 2600153 - RNA, 13 nt, Human
ugcagacaggcaa

SEQ ID NO: 2600154 - RNA, 12 nt, Human
ugcagacaggca

SEQ ID NO: 2600155 - RNA, 18 nt, Human
agccuccugcccuuaccu

SEQ ID NO: 2600156 - RNA, 14 nt, Human
agccuccugcccuu

SEQ ID NO: 2600157 - RNA, 13 nt, Human
agccuccugcccu

SEQ ID NO: 2600158 - RNA, 16 nt, Human
agccuccugcccaguc

SEQ ID NO: 2600159 - RNA, 15 nt, Human
agccuccugcccagu

SEQ ID NO: 2600160 - RNA, 14 nt, Human
agccuccugcccag

SEQ ID NO: 2600161 - RNA, 13 nt, Human
agccuccugccca

SEQ ID NO: 2600162 - RNA, 11 nt, Human
agccuccugcc

SEQ ID NO: 2600163 - RNA, 20 nt, Human
agccuccugaguagcuggga

SEQ ID NO: 2600164 - RNA, 19 nt, Human
agccuccugaguagcugga

SEQ ID NO: 2600165 - RNA, 21 nt, Human
ugcagccucacaguccuuacc

SEQ ID NO: 2600166 - RNA, 21 nt, Human
agccucuuucugucccuucug

SEQ ID NO: 2600167 - RNA, 17 nt, Human
ugcagccucacaguccu

SEQ ID NO: 2600168 - RNA, 18 nt, Human
ugcagccucacaguccuu

SEQ ID NO: 2600169 - RNA, 15 nt, Human
agccucuuucugucc

SEQ ID NO: 2600170 - RNA, 18 nt, Human
agccucuuucugucccuu

SEQ ID NO: 2600171 - RNA, 11 nt, Human
agccucugugu

SEQ ID NO: 2600172 - RNA, 21 nt, Human
agccucugucacugcaggcac

SEQ ID NO: 2600173 - RNA, 22 nt, Human
agccucugucacugcaggcacu

SEQ ID NO: 2600174 - RNA, 14 nt, Human
agccucugucacug

SEQ ID NO: 2600175 - RNA, 22 nt, Human
agccucugggucagugguccac

SEQ ID NO: 2600176 - RNA, 23 nt, Human
agccucugggucagugguccaca

SEQ ID NO: 2600177 - RNA, 20 nt, Human
agccucuccggcagaaggga

SEQ ID NO: 2600178 - RNA, 23 nt, Human
agccucugugucacuggcugccu

SEQ ID NO: 2600179 - RNA, 20 nt, Human
agccucugugucacuggcug

SEQ ID NO: 2600180 - RNA, 19 nt, Human
agccucugugucacuggcu

SEQ ID NO: 2600181 - RNA, 18 nt, Human
agccucugugucacuggc

SEQ ID NO: 2600182 - RNA, 15 nt, Human
agccucugugucacu

SEQ ID NO: 2600183 - RNA, 14 nt, Human
agccucugugucac

SEQ ID NO: 2600184 - RNA, 13 nt, Human
agccucuguguca

SEQ ID NO: 2600185 - RNA, 21 nt, Human
agccucugugucacuggcugc

SEQ ID NO: 2600186 - RNA, 20 nt, Human
agccucuuaaagcugccugu

SEQ ID NO: 2600187 - RNA, 22 nt, Human
agccucuuaaagcugccuguag

SEQ ID NO: 2600188 - RNA, 23 nt, Human
agccucuuaaagcugccuguagu

SEQ ID NO: 2600189 - RNA, 19 nt, Human
ugcaggggcucuggagaga

SEQ ID NO: 2600190 - RNA, 18 nt, Human
ugcaggggcucuggagag

SEQ ID NO: 2600191 - RNA, 14 nt, Human
ugcaggggcucugg

SEQ ID NO: 2600192 - RNA, 22 nt, Human
ugcaggggauugaagcccucca

SEQ ID NO: 2600193 - RNA, 21 nt, Human
ugcaggggcucuggagagaaa

SEQ ID NO: 2600194 - RNA, 19 nt, Human
ugcagggggugugucugcu

SEQ ID NO: 2600195 - RNA, 17 nt, Human
ugcaggguggugcuggg

SEQ ID NO: 2600196 - RNA, 22 nt, Human
ugcagggggugugucugcucag

SEQ ID NO: 2600197 - RNA, 21 nt, Human
ugcaggggauugaagcccucc

SEQ ID NO: 2600198 - RNA, 20 nt, Human
ugcaggggauugaagcccuc

SEQ ID NO: 2600199 - RNA, 13 nt, Human
ugcaggggcucug

SEQ ID NO: 2600200 - RNA, 22 nt, Human
ugcaggucccuaauaaagcugu

SEQ ID NO: 2600201 - RNA, 19 nt, Human
ugcaggguggugcugggac

SEQ ID NO: 2600202 - RNA, 18 nt, Human
ugcaggguggugcuggga

SEQ ID NO: 2600203 - RNA, 20 nt, Human
ugcaggguggugcugggacu

SEQ ID NO: 2600204 - RNA, 14 nt, Human
ugcaggugcugcug

SEQ ID NO: 2600205 - RNA, 23 nt, Human
ugcaggugagcccauggcccucc

SEQ ID NO: 2600206 - RNA, 16 nt, Human
ugcaggugcugcugcg

SEQ ID NO: 2600207 - RNA, 13 nt, Human
ugcagguggggag

SEQ ID NO: 2600208 - RNA, 15 nt, Human
ugcaggucucaaccc

SEQ ID NO: 2600209 - RNA, 13 nt, Human
ugcaggugcacca

SEQ ID NO: 2600210 - RNA, 19 nt, Human
ugcaggugagcccauggcc

SEQ ID NO: 2600211 - RNA, 22 nt, Human
ugcaugccaaauuguaguucuu

SEQ ID NO: 2600212 - RNA, 22 nt, Human
ugcaugcagccacugugcugaa

SEQ ID NO: 2600213 - RNA, 22 nt, Human
ugcaugcacuguucccccugug

SEQ ID NO: 2600214 - RNA, 18 nt, Human
ugcaugcagccacugugc

SEQ ID NO: 2600215 - RNA, 14 nt, Human
ugcaugauuuugua

SEQ ID NO: 2600216 - RNA, 19 nt, Human
ugcaugcacuguucccccu

SEQ ID NO: 2600217 - RNA, 18 nt, Human
ugcaugauuuuguaaccc

SEQ ID NO: 2600218 - RNA, 18 nt, Human
ugcaugcugucccuuacg

SEQ ID NO: 2600219 - RNA, 21 nt, Human
ugcaugcggcccagcccggcu

SEQ ID NO: 2600220 - RNA, 18 nt, Human
ugcaugcggcccagcccg

SEQ ID NO: 2600221 - RNA, 16 nt, Human
ugcaugcggcccagcc

SEQ ID NO: 2600222 - RNA, 15 nt, Human
ugcaugcggcccagc

SEQ ID NO: 2600223 - RNA, 13 nt, Human
ugcaugcggccca

SEQ ID NO: 2600224 - RNA, 14 nt, Human
ugcaugccuggucu

SEQ ID NO: 2600225 - RNA, 21 nt, Human
ugcaugcugucccuuacguga

SEQ ID NO: 2600226 - RNA, 19 nt, Human
ugcaugcugucccuuacgu

SEQ ID NO: 2600227 - RNA, 11 nt, Human
ugcauggaaau

SEQ ID NO: 2600228 - RNA, 19 nt, Human
ugcauggaaaccugaaaaa

SEQ ID NO: 2600229 - RNA, 15 nt, Human
ugcauggaaaccuga

SEQ ID NO: 2600230 - RNA, 17 nt, Human
ugcaugcugcuggacag

SEQ ID NO: 2600231 - RNA, 16 nt, Human
ugcaugcucucugcag

SEQ ID NO: 2600232 - RNA, 17 nt, Human
ugcaugcucucugcagc

SEQ ID NO: 2600233 - RNA, 18 nt, Human
ugcaugcucucugcagcc

SEQ ID NO: 2600234 - RNA, 19 nt, Human
ugcaugcucucugcagcca

SEQ ID NO: 2600235 - RNA, 20 nt, Human
ugcaucuuggggacaucucu

SEQ ID NO: 2600236 - RNA, 22 nt, Human
ugcaucuuacugaagguaaaau

SEQ ID NO: 2600237 - RNA, 19 nt, Human
ugcaucuguccucaugugu

SEQ ID NO: 2600238 - RNA, 14 nt, Human
ugcaucuguccuca

SEQ ID NO: 2600239 - RNA, 14 nt, Human
ugcaucuuacugaa

SEQ ID NO: 2600240 - RNA, 17 nt, Human
ugcaucuuacugaaggu

SEQ ID NO: 2600241 - RNA, 18 nt, Human
ugcaucuuacugaaggua

SEQ ID NO: 2600242 - RNA, 11 nt, Human
ugcaugaaaau

SEQ ID NO: 2600243 - RNA, 18 nt, Human
ugcaugaagguuucugaa

SEQ ID NO: 2600244 - RNA, 13 nt, Human
ugcaugaagguuu

SEQ ID NO: 2600245 - RNA, 21 nt, Human
ugcaugaagguuucugaaaau

SEQ ID NO: 2600246 - RNA, 19 nt, Human
ugcaugaagguuucugaaa

SEQ ID NO: 2600247 - RNA, 13 nt, Human
ugcaucuguccuc

SEQ ID NO: 2600248 - RNA, 14 nt, Human
ugcaucucagccca

SEQ ID NO: 2600249 - RNA, 13 nt, Human
ugcaucucagccc

SEQ ID NO: 2600250 - RNA, 19 nt, Human
ugcaucuacucccaaguau

SEQ ID NO: 2600251 - RNA, 21 nt, Human
ugcaucucacuggaugcaaag

SEQ ID NO: 2600252 - RNA, 18 nt, Human
ugcaucuagauuauggag

SEQ ID NO: 2600253 - RNA, 21 nt, Human
ugcaucuagaggcuuccuuca

SEQ ID NO: 2600254 - RNA, 19 nt, Human
ugcauagagguaccagcaa

SEQ ID NO: 2600255 - RNA, 14 nt, Human
ugcaucuacuccca

SEQ ID NO: 2600256 - RNA, 17 nt, Human
ugcaucguuucaucuuc

SEQ ID NO: 2600257 - RNA, 19 nt, Human
ugcauagagccacguaugu

SEQ ID NO: 2600258 - RNA, 21 nt, Human
ugcaguagucucugugcuuug

SEQ ID NO: 2600259 - RNA, 16 nt, Human
ugcaguaucaugcccu

SEQ ID NO: 2600260 - RNA, 21 nt, Human
ugcaguaucaugcccugugca

SEQ ID NO: 2600261 - RNA, 16 nt, Human
ugcaguaugaaaauaa

SEQ ID NO: 2600262 - RNA, 17 nt, Human
ugcaguauugagcacug

SEQ ID NO: 2600263 - RNA, 15 nt, Human
ugcaguaugaaaaua

SEQ ID NO: 2600264 - RNA, 18 nt, Human
ugcaguagucucugugcu

SEQ ID NO: 2600265 - RNA, 15 nt, Human
ugcaguagucucugu

SEQ ID NO: 2600266 - RNA, 20 nt, Human
ugcaguagauuuucuuuaaa

SEQ ID NO: 2600267 - RNA, 19 nt, Human
ugcaguagauuuucuuuaa

SEQ ID NO: 2600268 - RNA, 16 nt, Human
ugcagguuuguuacau

SEQ ID NO: 2600269 - RNA, 16 nt, Human
ugcaguagauuuucuu

SEQ ID NO: 2600270 - RNA, 15 nt, Human
ugcagguuuguuaca

SEQ ID NO: 2600271 - RNA, 23 nt, Human
ugcagguugggccauacuggccu

SEQ ID NO: 2600272 - RNA, 20 nt, Human
ugcagguucuucuuccugaa

SEQ ID NO: 2600273 - RNA, 18 nt, Human
ugcauaccacuuuuguuc

SEQ ID NO: 2600274 - RNA, 20 nt, Human
ugcauaccacuuuuguucuu

SEQ ID NO: 2600275 - RNA, 16 nt, Human
ugcauaccacuuuugu

SEQ ID NO: 2600276 - RNA, 19 nt, Human
ugcagucacguggaggagc

SEQ ID NO: 2600277 - RNA, 21 nt, Human
ugcagucacguggaggagcag

SEQ ID NO: 2600278 - RNA, 15 nt, Human
ugcagucacuggagg

SEQ ID NO: 2600279 - RNA, 14 nt, Human
ugcagucacuggag

SEQ ID NO: 2600280 - RNA, 21 nt, Human
ugcagucagucaugauggcac

SEQ ID NO: 2600281 - RNA, 18 nt, Human
ugcauacuucaaaaguau

SEQ ID NO: 2600282 - RNA, 17 nt, Human
ugcauacuucaaaagua

SEQ ID NO: 2600283 - RNA, 16 nt, Human
ugcauacuucaaaagu

SEQ ID NO: 2600284 - RNA, 15 nt, Human
ugcauacuucaaaag

SEQ ID NO: 2600285 - RNA, 14 nt, Human
ugcauacuucaaaa

SEQ ID NO: 2600286 - RNA, 19 nt, Human
ugcauacucauuaggaugg

SEQ ID NO: 2600287 - RNA, 13 nt, Human
ugcauacucauua

SEQ ID NO: 2600288 - RNA, 14 nt, Human
ugcauaccacuuuu

SEQ ID NO: 2600289 - RNA, 17 nt, Human
ugcagucacuggagguu

SEQ ID NO: 2600290 - RNA, 13 nt, Human
ugcagucaucuug

SEQ ID NO: 2600291 - RNA, 21 nt, Human
ugcauacuucaaaaguauuuu

SEQ ID NO: 2600292 - RNA, 18 nt, Human
ugcauacuuuuuaaaugu

SEQ ID NO: 2600293 - RNA, 19 nt, Human
ugcauacuuuuuaaaugua

SEQ ID NO: 2600294 - RNA, 22 nt, Human
ugcauacuuuuuaaauguaaag

SEQ ID NO: 2600295 - RNA, 17 nt, Human
ugcauagaauaaaauuu

SEQ ID NO: 2600296 - RNA, 20 nt, Human
ugcauagauucccugagcag

SEQ ID NO: 2600297 - RNA, 23 nt, Human
ugcauacuuuuuaaauguaaaga

SEQ ID NO: 2600298 - RNA, 19 nt, Human
ugcauacuucaaaaguauu

SEQ ID NO: 2600299 - RNA, 17 nt, Human
ugcauagagccacguau

SEQ ID NO: 2600300 - RNA, 13 nt, Human
ugccauaauuacu

SEQ ID NO: 2600301 - RNA, 16 nt, Human
ugccauaaaacauuaa

SEQ ID NO: 2600302 - RNA, 14 nt, Human
ugccauaaaacauu

SEQ ID NO: 2600303 - RNA, 13 nt, Human
ugccauaaaacau

SEQ ID NO: 2600304 - RNA, 12 nt, Human
ugccauaaaaca

SEQ ID NO: 2600305 - RNA, 23 nt, Human
ugccaguuuaaucauugccuggu

SEQ ID NO: 2600306 - RNA, 19 nt, Human
ugccaguuuuguuuccuuu

SEQ ID NO: 2600307 - RNA, 17 nt, Human
ugccaguuauggcuaua

SEQ ID NO: 2600308 - RNA, 23 nt, Human
ugccagccuuccucugcagcuga

SEQ ID NO: 2600309 - RNA, 18 nt, Human
ugccagccuuccucugca

SEQ ID NO: 2600310 - RNA, 17 nt, Human
ugccagccuuccucugc

SEQ ID NO: 2600311 - RNA, 13 nt, Human
ugccagcuauuuu

SEQ ID NO: 2600312 - RNA, 21 nt, Human
ugccagccuuccucugcagcu

SEQ ID NO: 2600313 - RNA, 19 nt, Human
ugccagcuacuuccuccuc

SEQ ID NO: 2600314 - RNA, 17 nt, Human
ugccagcucagucccau

SEQ ID NO: 2600315 - RNA, 15 nt, Human
ugccagugccuuacc

SEQ ID NO: 2600316 - RNA, 20 nt, Human
ugccagugccuuaccuccug

SEQ ID NO: 2600317 - RNA, 21 nt, Human
ugccagugccuuaccuccugc

SEQ ID NO: 2600318 - RNA, 22 nt, Human
ugccagugccuuaccuccugcc

SEQ ID NO: 2600319 - RNA, 23 nt, Human
ugccagugccuuaccuccugccc

SEQ ID NO: 2600320 - RNA, 16 nt, Human
ugccagccuggcuucu

SEQ ID NO: 2600321 - RNA, 17 nt, Human
ugccagccuggcuucug

SEQ ID NO: 2600322 - RNA, 18 nt, Human
ugccagccuggcuucugg

SEQ ID NO: 2600323 - RNA, 20 nt, Human
ugccagccuggcuucuggag

SEQ ID NO: 2600324 - RNA, 21 nt, Human
ugccagccuggcuucuggagc

SEQ ID NO: 2600325 - RNA, 22 nt, Human
ugccagccuggcuucuggagcc

SEQ ID NO: 2600326 - RNA, 14 nt, Human
ugccagccuuccuc

SEQ ID NO: 2600327 - RNA, 12 nt, Human
ugccagccuucc

SEQ ID NO: 2600328 - RNA, 23 nt, Human
ugccagccuggcuucuggagccc

SEQ ID NO: 2600329 - RNA, 17 nt, Human
ugccagccgagauagcc

SEQ ID NO: 2600330 - RNA, 23 nt, Human
ugccagccagcagccagcucuca

SEQ ID NO: 2600331 - RNA, 22 nt, Human
ugccagccgagauagccaaggc

SEQ ID NO: 2600332 - RNA, 21 nt, Human
ugccagccgugaugcucaggc

SEQ ID NO: 2600333 - RNA, 20 nt, Human
ugccagccgugaugcucagg

SEQ ID NO: 2600334 - RNA, 19 nt, Human
ugccagccgugaugcucag

SEQ ID NO: 2600335 - RNA, 12 nt, Human
ugccagccuggc

SEQ ID NO: 2600336 - RNA, 15 nt, Human
ugccagccuggcuuc

SEQ ID NO: 2600337 - RNA, 13 nt, Human
ugccacaggacac

SEQ ID NO: 2600338 - RNA, 14 nt, Human
ugccacaggacaca

SEQ ID NO: 2600339 - RNA, 18 nt, Human
ugccacaggacacaguca

SEQ ID NO: 2600340 - RNA, 13 nt, Human
ugccacaggccuc

SEQ ID NO: 2600341 - RNA, 12 nt, Human
ugccacaggccu

SEQ ID NO: 2600342 - RNA, 11 nt, Human
ugccacaggcc

SEQ ID NO: 2600343 - RNA, 20 nt, Human
ugccacaggacacagucaga

SEQ ID NO: 2600344 - RNA, 14 nt, Human
ugccacaggccucc

SEQ ID NO: 2600345 - RNA, 15 nt, Human
ugccagccagcagcc

SEQ ID NO: 2600346 - RNA, 16 nt, Human
ugccagccagcagcca

SEQ ID NO: 2600347 - RNA, 17 nt, Human
ugccagccagcagccag

SEQ ID NO: 2600348 - RNA, 22 nt, Human
ugccagccagcagccagcucuc

SEQ ID NO: 2600349 - RNA, 13 nt, Human
ugccacagccucc

SEQ ID NO: 2600350 - RNA, 17 nt, Human
ugccacagccuccccug

SEQ ID NO: 2600351 - RNA, 21 nt, Human
ugccacagccuccccugccag

SEQ ID NO: 2600352 - RNA, 12 nt, Human
ugccacaggaca

SEQ ID NO: 2600353 - RNA, 22 nt, Human
ugccacagccuccccugccagg

SEQ ID NO: 2600354 - RNA, 12 nt, Human
ugccacagcucu

SEQ ID NO: 2600355 - RNA, 14 nt, Human
ugccaaugggagcu

SEQ ID NO: 2600356 - RNA, 13 nt, Human
ugccaauggacua

SEQ ID NO: 2600357 - RNA, 16 nt, Human
ugccacagagcgggga

SEQ ID NO: 2600358 - RNA, 14 nt, Human
ugccacagagcggg

SEQ ID NO: 2600359 - RNA, 19 nt, Human
ugccaauggaaccuccuuu

SEQ ID NO: 2600360 - RNA, 15 nt, Human
ugccacagagcgggg

SEQ ID NO: 2600361 - RNA, 18 nt, Human
ugccaauggaaccuccuu

SEQ ID NO: 2600362 - RNA, 14 nt, Human
ugccaauggaaccu

SEQ ID NO: 2600363 - RNA, 20 nt, Human
ugccaaugaggucugaaaug

SEQ ID NO: 2600364 - RNA, 21 nt, Human
ugccaauauuaaaucugcugg

SEQ ID NO: 2600365 - RNA, 22 nt, Human
ugccaaggccagaguggccugg

SEQ ID NO: 2600366 - RNA, 19 nt, Human
ugccaauauuaaaucugcu

SEQ ID NO: 2600367 - RNA, 21 nt, Human
ugccaaugaggucugaaaugg

SEQ ID NO: 2600368 - RNA, 16 nt, Human
ugccaaggccagagug

SEQ ID NO: 2600369 - RNA, 20 nt, Human
ugccaaggccagaguggccu

SEQ ID NO: 2600370 - RNA, 21 nt, Human
ugccaaggccagaguggccug

SEQ ID NO: 2600371 - RNA, 23 nt, Human
ugccaagcuccaagccccaucuu

SEQ ID NO: 2600372 - RNA, 16 nt, Human
ugccaagcuccaagcc

SEQ ID NO: 2600373 - RNA, 15 nt, Human
ugccaagcuccaagc

SEQ ID NO: 2600374 - RNA, 22 nt, Human
ugccaagcucaggaccaggcaa

SEQ ID NO: 2600375 - RNA, 18 nt, Human
ugccaagcucaggaccag

SEQ ID NO: 2600376 - RNA, 13 nt, Human
ugccaagcuccaa

SEQ ID NO: 2600377 - RNA, 15 nt, Human
ugccaagcucaggac

SEQ ID NO: 2600378 - RNA, 22 nt, Human
ugccaagcauuuaauguagcca

SEQ ID NO: 2600379 - RNA, 14 nt, Human
ugccaagcucagga

SEQ ID NO: 2600380 - RNA, 17 nt, Human
ugcauuuaaaacagaca

SEQ ID NO: 2600381 - RNA, 19 nt, Human
ugcauuuaaaacagacacu

SEQ ID NO: 2600382 - RNA, 15 nt, Human
ugcauuuaaaacaga

SEQ ID NO: 2600383 - RNA, 13 nt, Human
ugcauugugcuuc

SEQ ID NO: 2600384 - RNA, 15 nt, Human
ugcauugugcuucuu

SEQ ID NO: 2600385 - RNA, 12 nt, Human
ugcauugugcuu

SEQ ID NO: 2600386 - RNA, 16 nt, Human
ugcauuuaaaagauac

SEQ ID NO: 2600387 - RNA, 20 nt, Human
ugcauuuaaaacagacacug

SEQ ID NO: 2600388 - RNA, 22 nt, Human
ugcauuuaaaacagacacuggc

SEQ ID NO: 2600389 - RNA, 17 nt, Human
ugccaagcacugugcuc

SEQ ID NO: 2600390 - RNA, 15 nt, Human
ugccaagcacugugc

SEQ ID NO: 2600391 - RNA, 14 nt, Human
ugccaagcacugug

SEQ ID NO: 2600392 - RNA, 19 nt, Human
ugccaagcacagugccugc

SEQ ID NO: 2600393 - RNA, 15 nt, Human
agcgcccuuccucuc

SEQ ID NO: 2600394 - RNA, 14 nt, Human
agcgcccuuccucu

SEQ ID NO: 2600395 - RNA, 13 nt, Human
agcgcccuuccuc

SEQ ID NO: 2600396 - RNA, 12 nt, Human
agcgcccuuccu

SEQ ID NO: 2600397 - RNA, 23 nt, Human
agcgccgugaguucucagggcuc

SEQ ID NO: 2600398 - RNA, 22 nt, Human
agcgccgugaguucucagggcu

SEQ ID NO: 2600399 - RNA, 21 nt, Human
agcgccgugaguucucagggc

SEQ ID NO: 2600400 - RNA, 20 nt, Human
agcgccgugaguucucaggg

SEQ ID NO: 2600401 - RNA, 19 nt, Human
agcgccgugaguucucagg

SEQ ID NO: 2600402 - RNA, 17 nt, Human
agcgccgugaguucuca

SEQ ID NO: 2600403 - RNA, 17 nt, Human
agcgcccuuccucucca

SEQ ID NO: 2600404 - RNA, 16 nt, Human
agcgcccuuccucucc

SEQ ID NO: 2600405 - RNA, 20 nt, Human
ugcauuggaagaccccaccc

SEQ ID NO: 2600406 - RNA, 24 nt, Human
agcgccgugaguucucagggcucc

SEQ ID NO: 2600407 - RNA, 21 nt, Human
agcgccuaguggggucucccu

SEQ ID NO: 2600408 - RNA, 18 nt, Human
ugcauuguaucgauguua

SEQ ID NO: 2600409 - RNA, 19 nt, Human
ugcauuggaagaccccacc

SEQ ID NO: 2600410 - RNA, 13 nt, Human
agccuugaacuuu

SEQ ID NO: 2600411 - RNA, 23 nt, Human
agccuugaacuuugaccucugca

SEQ ID NO: 2600412 - RNA, 15 nt, Human
agccuucuuugcuug

SEQ ID NO: 2600413 - RNA, 22 nt, Human
agccuucuuccaucccaggaca

SEQ ID NO: 2600414 - RNA, 20 nt, Human
agccuucuuccaucccagga

SEQ ID NO: 2600415 - RNA, 18 nt, Human
agccuucuuccaucccag

SEQ ID NO: 2600416 - RNA, 23 nt, Human
agccuucuuugcuugccucucug

SEQ ID NO: 2600417 - RNA, 19 nt, Human
agccuucuuugcuugccuc

SEQ ID NO: 2600418 - RNA, 15 nt, Human
agccuucucuguuca

SEQ ID NO: 2600419 - RNA, 19 nt, Human
agccuucucuguucauuuc

SEQ ID NO: 2600420 - RNA, 20 nt, Human
agccuucucuguucauuucc

SEQ ID NO: 2600421 - RNA, 21 nt, Human
agccuucucuguucauuuccu

SEQ ID NO: 2600422 - RNA, 22 nt, Human
agccuucucuguucauuuccuc

SEQ ID NO: 2600423 - RNA, 23 nt, Human
agccuucucuguucauuuccuca

SEQ ID NO: 2600424 - RNA, 15 nt, Human
agccuucuguaggaa

SEQ ID NO: 2600425 - RNA, 20 nt, Human
agccuucugaggacauucca

SEQ ID NO: 2600426 - RNA, 12 nt, Human
agccugugccuc

SEQ ID NO: 2600427 - RNA, 15 nt, Human
agccuguuuaagaga

SEQ ID NO: 2600428 - RNA, 18 nt, Human
agccuuaaucagguccuc

SEQ ID NO: 2600429 - RNA, 18 nt, Human
agccuguuuuguuggaag

SEQ ID NO: 2600430 - RNA, 20 nt, Human
agccuguuuuaaguucugga

SEQ ID NO: 2600431 - RNA, 14 nt, Human
agccuucucuguuc

SEQ ID NO: 2600432 - RNA, 20 nt, Human
agccuuagaagucacacagu

SEQ ID NO: 2600433 - RNA, 16 nt, Human
agcgcccgcugggcug

SEQ ID NO: 2600434 - RNA, 15 nt, Human
agcgcccgcugggcu

SEQ ID NO: 2600435 - RNA, 14 nt, Human
agcgcccgcugggc

SEQ ID NO: 2600436 - RNA, 16 nt, Human
agcgccccucccuagu

SEQ ID NO: 2600437 - RNA, 19 nt, Human
agcgcccgcugggcugagc

SEQ ID NO: 2600438 - RNA, 15 nt, Human
agcgccccucccuag

SEQ ID NO: 2600439 - RNA, 11 nt, Human
agcgccccucc

SEQ ID NO: 2600440 - RNA, 16 nt, Human
agccuuggggauucuu

SEQ ID NO: 2600441 - RNA, 23 nt, Human
agccuuggggauucuuccaucug

SEQ ID NO: 2600442 - RNA, 16 nt, Human
agccuugggaccccug

SEQ ID NO: 2600443 - RNA, 16 nt, Human
agccuuggcaucuaga

SEQ ID NO: 2600444 - RNA, 23 nt, Human
agccuugggaacaugcgugugac

SEQ ID NO: 2600445 - RNA, 19 nt, Human
agccuuggauaaugcuguu

SEQ ID NO: 2600446 - RNA, 20 nt, Human
agccuuggauaaugcuguug

SEQ ID NO: 2600447 - RNA, 22 nt, Human
agccuuggauaaugcuguugcc

SEQ ID NO: 2600448 - RNA, 23 nt, Human
agccuuggauaaugcuguugccu

SEQ ID NO: 2600449 - RNA, 16 nt, Human
agccuuggauguauau

SEQ ID NO: 2600450 - RNA, 19 nt, Human
agccuugaccauucuccac

SEQ ID NO: 2600451 - RNA, 18 nt, Human
agccuugaccauucucca

SEQ ID NO: 2600452 - RNA, 21 nt, Human
agccuugaccauucuccaccu

SEQ ID NO: 2600453 - RNA, 19 nt, Human
agccuugcggaagguucua

SEQ ID NO: 2600454 - RNA, 22 nt, Human
agccugaguagaaaggccuuua

SEQ ID NO: 2600455 - RNA, 17 nt, Human
agccugaguagaaaggc

SEQ ID NO: 2600456 - RNA, 16 nt, Human
agccugagucaccugc

SEQ ID NO: 2600457 - RNA, 23 nt, Human
agccugaguagaaaggccuuuaa

SEQ ID NO: 2600458 - RNA, 19 nt, Human
agccugagucaccugcaga

SEQ ID NO: 2600459 - RNA, 13 nt, Human
agccugaguagaa

SEQ ID NO: 2600460 - RNA, 17 nt, Human
agccugaggcugagacu

SEQ ID NO: 2600461 - RNA, 19 nt, Human
ugcauggcuccagaaaugu

SEQ ID NO: 2600462 - RNA, 18 nt, Human
ugcauggcuccagaaaug

SEQ ID NO: 2600463 - RNA, 11 nt, Human
agccugaggcu

SEQ ID NO: 2600464 - RNA, 16 nt, Human
ugcauggcuccagaaa

SEQ ID NO: 2600465 - RNA, 20 nt, Human
ugcauggcacuugcaucugu

SEQ ID NO: 2600466 - RNA, 19 nt, Human
ugcauggaaauucccuuca

SEQ ID NO: 2600467 - RNA, 23 nt, Human
ugcauggaaauucccuucaucug

SEQ ID NO: 2600468 - RNA, 23 nt, Human
ugcauggacaccccuuauccagg

SEQ ID NO: 2600469 - RNA, 19 nt, Human
ugcauggaauuuguaaguu

SEQ ID NO: 2600470 - RNA, 19 nt, Human
ugcauggcacuugcaucug

SEQ ID NO: 2600471 - RNA, 13 nt, Human
ugcauggagcagg

SEQ ID NO: 2600472 - RNA, 21 nt, Human
agccugugcauguaugucuug

SEQ ID NO: 2600473 - RNA, 17 nt, Human
agccugugccucuggga

SEQ ID NO: 2600474 - RNA, 18 nt, Human
agccugugccucugggac

SEQ ID NO: 2600475 - RNA, 19 nt, Human
agccugugccucugggacu

SEQ ID NO: 2600476 - RNA, 16 nt, Human
agccugucucuuccau

SEQ ID NO: 2600477 - RNA, 15 nt, Human
agccugucucuucca

SEQ ID NO: 2600478 - RNA, 14 nt, Human
agccugucucuucc

SEQ ID NO: 2600479 - RNA, 18 nt, Human
agccuguccugggcuggu

SEQ ID NO: 2600480 - RNA, 17 nt, Human
agccuguccugggcugg

SEQ ID NO: 2600481 - RNA, 14 nt, Human
agccuguccugggc

SEQ ID NO: 2600482 - RNA, 11 nt, Human
agccuguccug

SEQ ID NO: 2600483 - RNA, 19 nt, Human
agccugucccauggacacu

SEQ ID NO: 2600484 - RNA, 16 nt, Human
agccuguaaucccagc

SEQ ID NO: 2600485 - RNA, 17 nt, Human
agccuguaaucccagcu

SEQ ID NO: 2600486 - RNA, 16 nt, Human
agccuguaucuugggg

SEQ ID NO: 2600487 - RNA, 18 nt, Human
agccuguaaucccagcua

SEQ ID NO: 2600488 - RNA, 15 nt, Human
agccuguaaucccag

SEQ ID NO: 2600489 - RNA, 20 nt, Human
ugcaaaguaucccuacugua

SEQ ID NO: 2600490 - RNA, 14 nt, Human
ugcaaaggcuggga

SEQ ID NO: 2600491 - RNA, 20 nt, Human
ugcaaagucaugcaaaggcu

SEQ ID NO: 2600492 - RNA, 21 nt, Human
ugcaaagucaugcaaaggcug

SEQ ID NO: 2600493 - RNA, 23 nt, Human
ugcaaagucaugcaaaggcuggg

SEQ ID NO: 2600494 - RNA, 22 nt, Human
ugcaaagucaugcaaaggcugg

SEQ ID NO: 2600495 - RNA, 23 nt, Human
ugcaaaguucccuacuuccugug

SEQ ID NO: 2600496 - RNA, 14 nt, Human
ugcaaagcccagcu

SEQ ID NO: 2600497 - RNA, 15 nt, Human
ugcaaagcccagcuu

SEQ ID NO: 2600498 - RNA, 17 nt, Human
ugcaaagcccagcuuga

SEQ ID NO: 2600499 - RNA, 13 nt, Human
ugcaaaggaaaua

SEQ ID NO: 2600500 - RNA, 16 nt, Human
ugcaaaggaaauacca

SEQ ID NO: 2600501 - RNA, 21 nt, Human
ugcaaaggguaucaggugcug

SEQ ID NO: 2600502 - RNA, 13 nt, Human
ugcaaaggcuggg

SEQ ID NO: 2600503 - RNA, 12 nt, Human
ugcaaaggcugg

SEQ ID NO: 2600504 - RNA, 15 nt, Human
ugcaaaggacagauc

SEQ ID NO: 2600505 - RNA, 12 nt, Human
ugcaaaggacug

SEQ ID NO: 2600506 - RNA, 13 nt, Human
ugcaaaggacaga

SEQ ID NO: 2600507 - RNA, 12 nt, Human
ugcaaagauuug

SEQ ID NO: 2600508 - RNA, 20 nt, Human
ugcaaagcacugacuucuaa

SEQ ID NO: 2600509 - RNA, 22 nt, Human
ugcaaagcacugacuucuaagu

SEQ ID NO: 2600510 - RNA, 18 nt, Human
ugcaaagcacugacuucu

SEQ ID NO: 2600511 - RNA, 23 nt, Human
ugcaaagaucuguccucagccuu

SEQ ID NO: 2600512 - RNA, 12 nt, Human
ugcaaagaucug

SEQ ID NO: 2600513 - RNA, 20 nt, Human
ugcaaaccaucauugaaauc

SEQ ID NO: 2600514 - RNA, 18 nt, Human
ugcaaaccaucauugaaa

SEQ ID NO: 2600515 - RNA, 17 nt, Human
ugcaaacuuuauuuuca

SEQ ID NO: 2600516 - RNA, 12 nt, Human
ugcaaacuuuau

SEQ ID NO: 2600517 - RNA, 12 nt, Human
ugcaaagaaaau

SEQ ID NO: 2600518 - RNA, 16 nt, Human
ugcaaagaaaaucaga

SEQ ID NO: 2600519 - RNA, 13 nt, Human
ugcaaagaggcaa

SEQ ID NO: 2600520 - RNA, 15 nt, Human
ugcaaagaggcaaga

SEQ ID NO: 2600521 - RNA, 19 nt, Human
ugcaaagaggcaagaggcu

SEQ ID NO: 2600522 - RNA, 19 nt, Human
ugauuucacaacagaucaa

SEQ ID NO: 2600523 - RNA, 16 nt, Human
ugauuucacaacagau

SEQ ID NO: 2600524 - RNA, 13 nt, Human
ugauuucauucaa

SEQ ID NO: 2600525 - RNA, 13 nt, Human
ugauuucauuuca

SEQ ID NO: 2600526 - RNA, 17 nt, Human
ugauuucauuucaacug

SEQ ID NO: 2600527 - RNA, 14 nt, Human
ugauuuccaaagag

SEQ ID NO: 2600528 - RNA, 22 nt, Human
ugauuuaugcauggaaaccuga

SEQ ID NO: 2600529 - RNA, 13 nt, Human
ugauuuaugcaug

SEQ ID NO: 2600530 - RNA, 22 nt, Human
ugauuuauaguuuguacaugca

SEQ ID NO: 2600531 - RNA, 16 nt, Human
ugauuuauaguuugua

SEQ ID NO: 2600532 - RNA, 18 nt, Human
agccacggccaggccaga

SEQ ID NO: 2600533 - RNA, 17 nt, Human
agccacggccaggccag

SEQ ID NO: 2600534 - RNA, 13 nt, Human
ugcaaaccaucau

SEQ ID NO: 2600535 - RNA, 12 nt, Human
ugcaaaccauca

SEQ ID NO: 2600536 - RNA, 13 nt, Human
ugauuugcauuga

SEQ ID NO: 2600537 - RNA, 14 nt, Human
ugauuugcauugaa

SEQ ID NO: 2600538 - RNA, 18 nt, Human
ugauuugcauugaacaca

SEQ ID NO: 2600539 - RNA, 15 nt, Human
ugauuugcauugaac

SEQ ID NO: 2600540 - RNA, 12 nt, Human
ugauuuggaaaa

SEQ ID NO: 2600541 - RNA, 20 nt, Human
ugauuugacuguuuuuaccc

SEQ ID NO: 2600542 - RNA, 18 nt, Human
ugauuugacuguuuuuac

SEQ ID NO: 2600543 - RNA, 14 nt, Human
ugauuugacuguuu

SEQ ID NO: 2600544 - RNA, 23 nt, Human
ugauuucccguggccccagccug

SEQ ID NO: 2600545 - RNA, 12 nt, Human
ugauuugcauug

SEQ ID NO: 2600546 - RNA, 23 nt, Human
ugauuugacuguuuuuacccaua

SEQ ID NO: 2600547 - RNA, 22 nt, Human
ugauuucccguggccccagccu

SEQ ID NO: 2600548 - RNA, 21 nt, Human
ugauuucccguggccccagcc

SEQ ID NO: 2600549 - RNA, 20 nt, Human
ugauuucccguggccccagc

SEQ ID NO: 2600550 - RNA, 19 nt, Human
ugauuucccguggccccag

SEQ ID NO: 2600551 - RNA, 19 nt, Human
ugauuugaagaacauguga

SEQ ID NO: 2600552 - RNA, 21 nt, Human
ugauuuccccuccaagguaug

SEQ ID NO: 2600553 - RNA, 18 nt, Human
ugauuuccaaagagaaaa

SEQ ID NO: 2600554 - RNA, 18 nt, Human
ugauuucccguggcccca

SEQ ID NO: 2600555 - RNA, 17 nt, Human
ugauuucccguggcccc

SEQ ID NO: 2600556 - RNA, 12 nt, Human
agcccaggccuc

SEQ ID NO: 2600557 - RNA, 13 nt, Human
agcccaggccccu

SEQ ID NO: 2600558 - RNA, 22 nt, Human
ugcaaucguaauguacagaugg

SEQ ID NO: 2600559 - RNA, 22 nt, Human
ugcaauauuuccucaugugauc

SEQ ID NO: 2600560 - RNA, 19 nt, Human
ugcaauccugucuuucuga

SEQ ID NO: 2600561 - RNA, 19 nt, Human
ugcaauauuuccucaugug

SEQ ID NO: 2600562 - RNA, 16 nt, Human
ugcaauauuuccucau

SEQ ID NO: 2600563 - RNA, 21 nt, Human
ugcaauauuaaugccuuuaaa

SEQ ID NO: 2600564 - RNA, 18 nt, Human
ugcaauauuaaugccuuu

SEQ ID NO: 2600565 - RNA, 14 nt, Human
ugcaauauguauua

SEQ ID NO: 2600566 - RNA, 23 nt, Human
ugcaauauaucuaaauugaauaa

SEQ ID NO: 2600567 - RNA, 22 nt, Human
ugcaauauaucuaaauugaaua

SEQ ID NO: 2600568 - RNA, 21 nt, Human
ugcaauauaucuaaauugaau

SEQ ID NO: 2600569 - RNA, 18 nt, Human
ugcaagugugugcaugug

SEQ ID NO: 2600570 - RNA, 23 nt, Human
ugcaagugugugcaugugugcga

SEQ ID NO: 2600571 - RNA, 13 nt, Human
ugcaagugugugc

SEQ ID NO: 2600572 - RNA, 14 nt, Human
ugcaagugugugca

SEQ ID NO: 2600573 - RNA, 21 nt, Human
ugcaagugugugcacaugugu

SEQ ID NO: 2600574 - RNA, 23 nt, Human
ugcaagugugugcacaugugugc

SEQ ID NO: 2600575 - RNA, 15 nt, Human
ugcaaggucauuuuu

SEQ ID NO: 2600576 - RNA, 20 nt, Human
ugcaagggcuccccacugcc

SEQ ID NO: 2600577 - RNA, 18 nt, Human
ugcaaggggaaaaucuca

SEQ ID NO: 2600578 - RNA, 15 nt, Human
ugcaagguggcucca

SEQ ID NO: 2600579 - RNA, 16 nt, Human
ugcaaggucuuugguu

SEQ ID NO: 2600580 - RNA, 23 nt, Human
ugcaagguuuaggcugguggccc

SEQ ID NO: 2600581 - RNA, 15 nt, Human
ugcaaguacugcugu

SEQ ID NO: 2600582 - RNA, 19 nt, Human
ugcaaguacugcuguaaau

SEQ ID NO: 2600583 - RNA, 19 nt, Human
ugcaaguguguaugugcgu

SEQ ID NO: 2600584 - RNA, 22 nt, Human
ugcaaguguguaugugcgugug

SEQ ID NO: 2600585 - RNA, 18 nt, Human
ugcaagugucugugugca

SEQ ID NO: 2600586 - RNA, 11 nt, Human
ugcaagggaaa

SEQ ID NO: 2600587 - RNA, 14 nt, Human
ugcaaggccuuucu

SEQ ID NO: 2600588 - RNA, 16 nt, Human
ugcaagggacugugug

SEQ ID NO: 2600589 - RNA, 21 nt, Human
ugcaagggcagaacacuaacc

SEQ ID NO: 2600590 - RNA, 20 nt, Human
ugcaagggcagaacacuaac

SEQ ID NO: 2600591 - RNA, 21 nt, Human
ugcaagggacuguguguugcc

SEQ ID NO: 2600592 - RNA, 16 nt, Human
ugcaagggcuccccac

SEQ ID NO: 2600593 - RNA, 15 nt, Human
ugcaagggcucccca

SEQ ID NO: 2600594 - RNA, 22 nt, Human
ugcaagggcagaacacuaaccu

SEQ ID NO: 2600595 - RNA, 23 nt, Human
ugcaaggccgcuguucacccaca

SEQ ID NO: 2600596 - RNA, 24 nt, Human
ugcaaggccgcuguucacccacag

SEQ ID NO: 2600597 - RNA, 17 nt, Human
ugcaaggaccaggacuc

SEQ ID NO: 2600598 - RNA, 13 nt, Human
ugcaaggcaaaga

SEQ ID NO: 2600599 - RNA, 21 nt, Human
ugcaagccagauuuuccugaa

SEQ ID NO: 2600600 - RNA, 15 nt, Human
ugcaagccagauuuu

SEQ ID NO: 2600601 - RNA, 18 nt, Human
ugcaagauucugaaacau

SEQ ID NO: 2600602 - RNA, 23 nt, Human
ugcaagagccuugguguccaccu

SEQ ID NO: 2600603 - RNA, 15 nt, Human
ugcaacaggcacuca

SEQ ID NO: 2600604 - RNA, 24 nt, Human
ugcaacagcacuggcucucuccag

SEQ ID NO: 2600605 - RNA, 19 nt, Human
ugcaagagacucuggccuc

SEQ ID NO: 2600606 - RNA, 14 nt, Human
ugcaagagccuugg

SEQ ID NO: 2600607 - RNA, 19 nt, Human
ugcaaggaaggaaagaaag

SEQ ID NO: 2600608 - RNA, 13 nt, Human
ugcaaggaccagg

SEQ ID NO: 2600609 - RNA, 14 nt, Human
ugcaaggaccagga

SEQ ID NO: 2600610 - RNA, 15 nt, Human
ugcaaggaccaggac

SEQ ID NO: 2600611 - RNA, 15 nt, Human
ugcaaggaaggaaag

SEQ ID NO: 2600612 - RNA, 16 nt, Human
ugcaaggaaggaaaga

SEQ ID NO: 2600613 - RNA, 12 nt, Human
ugcaaggaagga

SEQ ID NO: 2600614 - RNA, 20 nt, Human
ugcaaggaagccacagcugg

SEQ ID NO: 2600615 - RNA, 14 nt, Human
ugcaagccugcguu

SEQ ID NO: 2600616 - RNA, 12 nt, Human
ugcaagccugcg

SEQ ID NO: 2600617 - RNA, 19 nt, Human
ugcaaggaagccacagcug

SEQ ID NO: 2600618 - RNA, 17 nt, Human
ugcaagcagggcucugc

SEQ ID NO: 2600619 - RNA, 16 nt, Human
ugcaagcagggcucug

SEQ ID NO: 2600620 - RNA, 20 nt, Human
ugcaagcagggcucugcccc

SEQ ID NO: 2600621 - RNA, 23 nt, Human
ugcaagccccugcuccagaagau

SEQ ID NO: 2600622 - RNA, 17 nt, Human
ugcaaauccuaugugau

SEQ ID NO: 2600623 - RNA, 18 nt, Human
ugcaaauccuaugugauu

SEQ ID NO: 2600624 - RNA, 21 nt, Human
ugcaaauccuaugugauuuua

SEQ ID NO: 2600625 - RNA, 19 nt, Human
ugcaaauccuaugugauuu

SEQ ID NO: 2600626 - RNA, 14 nt, Human
ugcaaaucuugaaa

SEQ ID NO: 2600627 - RNA, 21 nt, Human
ugcaaaugcuaugagaugcau

SEQ ID NO: 2600628 - RNA, 15 nt, Human
ugcaaaugcuguauu

SEQ ID NO: 2600629 - RNA, 14 nt, Human
ugcaaauuaacagu

SEQ ID NO: 2600630 - RNA, 18 nt, Human
ugcaaaugucaucagaac

SEQ ID NO: 2600631 - RNA, 22 nt, Human
ugcaaaugucagauacaaugua

SEQ ID NO: 2600632 - RNA, 18 nt, Human
ugcaaauauuuuuuugua

SEQ ID NO: 2600633 - RNA, 10 nt, Human
ugcaaauccu

SEQ ID NO: 2600634 - RNA, 21 nt, Human
ugcaaauauuuuuuuguagau

SEQ ID NO: 2600635 - RNA, 12 nt, Human
ugcaaauccuau

SEQ ID NO: 2600636 - RNA, 14 nt, Human
ugcaaauccuaugu

SEQ ID NO: 2600637 - RNA, 15 nt, Human
ugcaaauccuaugug

SEQ ID NO: 2600638 - RNA, 13 nt, Human
ugcaacaggcugg

SEQ ID NO: 2600639 - RNA, 17 nt, Human
ugcaacagcacuggcuc

SEQ ID NO: 2600640 - RNA, 14 nt, Human
ugcaacagcacugg

SEQ ID NO: 2600641 - RNA, 13 nt, Human
ugcaacagcacug

SEQ ID NO: 2600642 - RNA, 15 nt, Human
ugcaacacacagaca

SEQ ID NO: 2600643 - RNA, 13 nt, Human
ugcaacaaaauuc

SEQ ID NO: 2600644 - RNA, 12 nt, Human
ugcaacacacag

SEQ ID NO: 2600645 - RNA, 13 nt, Human
ugcaacacacaga

SEQ ID NO: 2600646 - RNA, 14 nt, Human
ugcaacacacagac

SEQ ID NO: 2600647 - RNA, 15 nt, Human
ugcaacaacauguau

SEQ ID NO: 2600648 - RNA, 13 nt, Human
ugcaacaacaugu

SEQ ID NO: 2600649 - RNA, 18 nt, Human
agccccggcccugggcuc

SEQ ID NO: 2600650 - RNA, 16 nt, Human
agccccggcccugggc

SEQ ID NO: 2600651 - RNA, 14 nt, Human
agccccggcccugg

SEQ ID NO: 2600652 - RNA, 22 nt, Human
agccccgcagaccuccccagcc

SEQ ID NO: 2600653 - RNA, 24 nt, Human
agccccggggugaguccauucucc

SEQ ID NO: 2600654 - RNA, 21 nt, Human
agccccggcccugggcucgga

SEQ ID NO: 2600655 - RNA, 18 nt, Human
agccccucccaccacagc

SEQ ID NO: 2600656 - RNA, 18 nt, Human
agccccgugggguuccuc

SEQ ID NO: 2600657 - RNA, 12 nt, Human
agccccuccucu

SEQ ID NO: 2600658 - RNA, 13 nt, Human
agccccuccucug

SEQ ID NO: 2600659 - RNA, 14 nt, Human
agccccuccucugc

SEQ ID NO: 2600660 - RNA, 15 nt, Human
agccccuccucugcc

SEQ ID NO: 2600661 - RNA, 16 nt, Human
agccccuccucugcca

SEQ ID NO: 2600662 - RNA, 17 nt, Human
agccccuccucugccac

SEQ ID NO: 2600663 - RNA, 18 nt, Human
agccccuccucugccacc

SEQ ID NO: 2600664 - RNA, 23 nt, Human
agccccucccaccacagcaggug

SEQ ID NO: 2600665 - RNA, 11 nt, Human
agccccuccuc

SEQ ID NO: 2600666 - RNA, 18 nt, Human
agccccuguauggcacug

SEQ ID NO: 2600667 - RNA, 14 nt, Human
agccccugguccug

SEQ ID NO: 2600668 - RNA, 12 nt, Human
agccccugggug

SEQ ID NO: 2600669 - RNA, 20 nt, Human
agccccugucuagagaggga

SEQ ID NO: 2600670 - RNA, 21 nt, Human
agccccugucuagagagggag

SEQ ID NO: 2600671 - RNA, 15 nt, Human
agccccuguggagac

SEQ ID NO: 2600672 - RNA, 14 nt, Human
agccccuguggaga

SEQ ID NO: 2600673 - RNA, 22 nt, Human
agccccugucuagagagggagg

SEQ ID NO: 2600674 - RNA, 23 nt, Human
agccccugucuagagagggaggc

SEQ ID NO: 2600675 - RNA, 16 nt, Human
agccccucuggucgcu

SEQ ID NO: 2600676 - RNA, 13 nt, Human
agccccucugguc

SEQ ID NO: 2600677 - RNA, 12 nt, Human
agccccucuggu

SEQ ID NO: 2600678 - RNA, 23 nt, Human
agccccuccucugccaccucccc

SEQ ID NO: 2600679 - RNA, 19 nt, Human
agccccuccucugccaccu

SEQ ID NO: 2600680 - RNA, 20 nt, Human
agccccuccucugccaccuc

SEQ ID NO: 2600681 - RNA, 21 nt, Human
agccccuccucugccaccucc

SEQ ID NO: 2600682 - RNA, 22 nt, Human
agccccuccucugccaccuccc

SEQ ID NO: 2600683 - RNA, 21 nt, Human
agcccccuuugggcccaggga

SEQ ID NO: 2600684 - RNA, 20 nt, Human
agcccccuuugggcccaggg

SEQ ID NO: 2600685 - RNA, 19 nt, Human
agcccccuuugggcccagg

SEQ ID NO: 2600686 - RNA, 18 nt, Human
agcccccuuugggcccag

SEQ ID NO: 2600687 - RNA, 16 nt, Human
agcccccuugacaccg

SEQ ID NO: 2600688 - RNA, 14 nt, Human
agccccgaggccuu

SEQ ID NO: 2600689 - RNA, 23 nt, Human
agccccgcagaccuccccagccc

SEQ ID NO: 2600690 - RNA, 16 nt, Human
agccccgccuccaggc

SEQ ID NO: 2600691 - RNA, 19 nt, Human
agccccgcagaccucccca

SEQ ID NO: 2600692 - RNA, 15 nt, Human
agccccgcgccuccu

SEQ ID NO: 2600693 - RNA, 18 nt, Human
agccccgcgccuccuucc

SEQ ID NO: 2600694 - RNA, 19 nt, Human
agcccaggccuccuacagc

SEQ ID NO: 2600695 - RNA, 14 nt, Human
agcccaggccuccu

SEQ ID NO: 2600696 - RNA, 15 nt, Human
agcccccuggccucu

SEQ ID NO: 2600697 - RNA, 22 nt, Human
agcccaggccgggguggagcau

SEQ ID NO: 2600698 - RNA, 16 nt, Human
agcccccuggccucug

SEQ ID NO: 2600699 - RNA, 17 nt, Human
agcccccuggccucugu

SEQ ID NO: 2600700 - RNA, 19 nt, Human
agcccccuggccucugugc

SEQ ID NO: 2600701 - RNA, 15 nt, Human
agcccgggcucugcc

SEQ ID NO: 2600702 - RNA, 14 nt, Human
agcccgggcucugc

SEQ ID NO: 2600703 - RNA, 13 nt, Human
agcccgggcucug

SEQ ID NO: 2600704 - RNA, 19 nt, Human
agccccuucugacccaugc

SEQ ID NO: 2600705 - RNA, 16 nt, Human
agccccuucugaccca

SEQ ID NO: 2600706 - RNA, 15 nt, Human
agccccuucugaccc

SEQ ID NO: 2600707 - RNA, 23 nt, Human
agccccuuccuugcucugcaccc

SEQ ID NO: 2600708 - RNA, 17 nt, Human
agccccuuccuugcucu

SEQ ID NO: 2600709 - RNA, 17 nt, Human
agccccuuccccauggg

SEQ ID NO: 2600710 - RNA, 15 nt, Human
agccccuuccccaug

SEQ ID NO: 2600711 - RNA, 13 nt, Human
agccccuucccca

SEQ ID NO: 2600712 - RNA, 18 nt, Human
agccccuguggagacugg

SEQ ID NO: 2600713 - RNA, 14 nt, Human
agccccuuagcccc

SEQ ID NO: 2600714 - RNA, 14 nt, Human
agccccuucugacc

SEQ ID NO: 2600715 - RNA, 19 nt, Human
agcccugcagagggcacag

SEQ ID NO: 2600716 - RNA, 16 nt, Human
agcccugcagagggca

SEQ ID NO: 2600717 - RNA, 15 nt, Human
agcccugcagagggc

SEQ ID NO: 2600718 - RNA, 14 nt, Human
agcccugcagaggg

SEQ ID NO: 2600719 - RNA, 19 nt, Human
agccccuucucagaaucua

SEQ ID NO: 2600720 - RNA, 18 nt, Human
agccccuucucagaaucu

SEQ ID NO: 2600721 - RNA, 16 nt, Human
agccccuucucagaau

SEQ ID NO: 2600722 - RNA, 15 nt, Human
agccccuucucagaa

SEQ ID NO: 2600723 - RNA, 18 nt, Human
agcccugaguuccuagcc

SEQ ID NO: 2600724 - RNA, 16 nt, Human
agcccgggcucugccu

SEQ ID NO: 2600725 - RNA, 20 nt, Human
agcccugaguuccuagccac

SEQ ID NO: 2600726 - RNA, 23 nt, Human
agcccugaguuccuagccaccgc

SEQ ID NO: 2600727 - RNA, 14 nt, Human
agcccugaguuccu

SEQ ID NO: 2600728 - RNA, 21 nt, Human
ugcagaauacaguaagcugcu

SEQ ID NO: 2600729 - RNA, 23 nt, Human
ugcagaaggaagggcauccuucu

SEQ ID NO: 2600730 - RNA, 22 nt, Human
ugcagaaggaaaaauguguaau

SEQ ID NO: 2600731 - RNA, 21 nt, Human
ugcagaaggaaaaauguguaa

SEQ ID NO: 2600732 - RNA, 20 nt, Human
ugcagaaggaaaaaugugua

SEQ ID NO: 2600733 - RNA, 15 nt, Human
ugcagaaggccaaga

SEQ ID NO: 2600734 - RNA, 13 nt, Human
ugcagaaggccaa

SEQ ID NO: 2600735 - RNA, 22 nt, Human
ugcagaagacaguauggcagcu

SEQ ID NO: 2600736 - RNA, 19 nt, Human
ugcagaaggaaaaaugugu

SEQ ID NO: 2600737 - RNA, 16 nt, Human
ugcagaaggaaaaaug

SEQ ID NO: 2600738 - RNA, 15 nt, Human
ugcagaaggaaaaau

SEQ ID NO: 2600739 - RNA, 20 nt, Human
ugcacuccagccugggcaac

SEQ ID NO: 2600740 - RNA, 18 nt, Human
ugcacuccagccugggcg

SEQ ID NO: 2600741 - RNA, 16 nt, Human
ugcacuccagccuggg

SEQ ID NO: 2600742 - RNA, 12 nt, Human
ugcacuccagcc

SEQ ID NO: 2600743 - RNA, 13 nt, Human
ugcacuccagccu

SEQ ID NO: 2600744 - RNA, 17 nt, Human
ugcacuccagccugggc

SEQ ID NO: 2600745 - RNA, 18 nt, Human
ugcacuccagccugggca

SEQ ID NO: 2600746 - RNA, 14 nt, Human
ugcacccucuaucc

SEQ ID NO: 2600747 - RNA, 17 nt, Human
ugcacuccagccugagc

SEQ ID NO: 2600748 - RNA, 15 nt, Human
ugcacuccagccugg

SEQ ID NO: 2600749 - RNA, 15 nt, Human
ugcaccggcuggccu

SEQ ID NO: 2600750 - RNA, 14 nt, Human
ugcaccggcuggcc

SEQ ID NO: 2600751 - RNA, 14 nt, Human
ugcaccccucccau

SEQ ID NO: 2600752 - RNA, 13 nt, Human
ugcaccccuccca

SEQ ID NO: 2600753 - RNA, 12 nt, Human
ugcaccccuccc

SEQ ID NO: 2600754 - RNA, 19 nt, Human
ugcacccccuccugcugca

SEQ ID NO: 2600755 - RNA, 18 nt, Human
ugcacccccuccugcugc

SEQ ID NO: 2600756 - RNA, 17 nt, Human
ugcacccccuccugcug

SEQ ID NO: 2600757 - RNA, 16 nt, Human
ugcacccccuccugcu

SEQ ID NO: 2600758 - RNA, 15 nt, Human
ugcacccccuccugc

SEQ ID NO: 2600759 - RNA, 15 nt, Human
ugcaccccucccauu

SEQ ID NO: 2600760 - RNA, 15 nt, Human
ugcacccuggggccu

SEQ ID NO: 2600761 - RNA, 15 nt, Human
ugcacuccagccuga

SEQ ID NO: 2600762 - RNA, 14 nt, Human
ugcacuccagccug

SEQ ID NO: 2600763 - RNA, 16 nt, Human
ugcaccggcuggccug

SEQ ID NO: 2600764 - RNA, 22 nt, Human
ugcacccuggggccuggaccug

SEQ ID NO: 2600765 - RNA, 14 nt, Human
ugcacucagcucuu

SEQ ID NO: 2600766 - RNA, 19 nt, Human
ugcaccccaaagcuuuccu

SEQ ID NO: 2600767 - RNA, 18 nt, Human
ugcaccccaaagcuuucc

SEQ ID NO: 2600768 - RNA, 15 nt, Human
ugcaccaucccuuuu

SEQ ID NO: 2600769 - RNA, 23 nt, Human
ugcaccaggguugaccccagagg

SEQ ID NO: 2600770 - RNA, 16 nt, Human
ugcaccaacccagccg

SEQ ID NO: 2600771 - RNA, 23 nt, Human
ugcaccccaaagcuuuccugccc

SEQ ID NO: 2600772 - RNA, 22 nt, Human
ugcaccccaaagcuuuccugcc

SEQ ID NO: 2600773 - RNA, 21 nt, Human
ugcaccccaaagcuuuccugc

SEQ ID NO: 2600774 - RNA, 20 nt, Human
ugcaccccaaagcuuuccug

SEQ ID NO: 2600775 - RNA, 14 nt, Human
ugcaccccaugcug

SEQ ID NO: 2600776 - RNA, 16 nt, Human
ugcaccccaugcuguu

SEQ ID NO: 2600777 - RNA, 14 nt, Human
ugcaccccccuggg

SEQ ID NO: 2600778 - RNA, 14 nt, Human
ugcacccccuccug

SEQ ID NO: 2600779 - RNA, 12 nt, Human
ugcacccccucc

SEQ ID NO: 2600780 - RNA, 15 nt, Human
ugcaccccccugggc

SEQ ID NO: 2600781 - RNA, 16 nt, Human
ugcaccccccugggcu

SEQ ID NO: 2600782 - RNA, 13 nt, Human
ugcaccagcccuu

SEQ ID NO: 2600783 - RNA, 21 nt, Human
ugcaccacugcacuccagccu

SEQ ID NO: 2600784 - RNA, 15 nt, Human
ugcaccaacccagcc

SEQ ID NO: 2600785 - RNA, 15 nt, Human
ugcaccacugcacuc

SEQ ID NO: 2600786 - RNA, 19 nt, Human
ugcacaugugugcgugugc

SEQ ID NO: 2600787 - RNA, 20 nt, Human
agcccugggaggcucuggag

SEQ ID NO: 2600788 - RNA, 18 nt, Human
agcccugggaggcucugg

SEQ ID NO: 2600789 - RNA, 17 nt, Human
agcccugggaggcucug

SEQ ID NO: 2600790 - RNA, 20 nt, Human
agcccugcagugugguagcg

SEQ ID NO: 2600791 - RNA, 18 nt, Human
ugcacauguuuccucuag

SEQ ID NO: 2600792 - RNA, 17 nt, Human
ugcacauguuuccucua

SEQ ID NO: 2600793 - RNA, 16 nt, Human
ugcacauguuuccucu

SEQ ID NO: 2600794 - RNA, 14 nt, Human
ugcacauguuuccu

SEQ ID NO: 2600795 - RNA, 13 nt, Human
ugcacauguuucc

SEQ ID NO: 2600796 - RNA, 23 nt, Human
ugcacaugucuuguacaugugua

SEQ ID NO: 2600797 - RNA, 21 nt, Human
agcccugggccccaccaccua

SEQ ID NO: 2600798 - RNA, 13 nt, Human
ugcacaugugugc

SEQ ID NO: 2600799 - RNA, 22 nt, Human
ugcacaugucuuguacaugugu

SEQ ID NO: 2600800 - RNA, 17 nt, Human
agcccugggccccacca

SEQ ID NO: 2600801 - RNA, 19 nt, Human
agcccugggccccaccacc

SEQ ID NO: 2600802 - RNA, 23 nt, Human
agcccugggccccaccaccuagg

SEQ ID NO: 2600803 - RNA, 16 nt, Human
agcccugggccccacc

SEQ ID NO: 2600804 - RNA, 18 nt, Human
agcccugggaucacugug

SEQ ID NO: 2600805 - RNA, 16 nt, Human
agcccugggaucacug

SEQ ID NO: 2600806 - RNA, 16 nt, Human
aggacgcucucuggcc

SEQ ID NO: 2600807 - RNA, 17 nt, Human
aggacgcucucuggccu

SEQ ID NO: 2600808 - RNA, 19 nt, Human
aggacgcucucuggccuuc

SEQ ID NO: 2600809 - RNA, 20 nt, Human
aggacgcucucuggccuucg

SEQ ID NO: 2600810 - RNA, 14 nt, Human
aggacgccacccag

SEQ ID NO: 2600811 - RNA, 22 nt, Human
aggaccuuuccaccacagccag

SEQ ID NO: 2600812 - RNA, 20 nt, Human
aggacgaacauccaaccuuc

SEQ ID NO: 2600813 - RNA, 20 nt, Human
aggaccuucgggcugugccc

SEQ ID NO: 2600814 - RNA, 21 nt, Human
aggaccuuuccaccacagcca

SEQ ID NO: 2600815 - RNA, 13 nt, Human
aggacgcucucug

SEQ ID NO: 2600816 - RNA, 14 nt, Human
aggacgcucucugg

SEQ ID NO: 2600817 - RNA, 23 nt, Human
aggacaaucaguccccucccauc

SEQ ID NO: 2600818 - RNA, 22 nt, Human
aggacaaucaguccccucccau

SEQ ID NO: 2600819 - RNA, 21 nt, Human
aggacaaucaguccccuccca

SEQ ID NO: 2600820 - RNA, 20 nt, Human
aggacaaucaguccccuccc

SEQ ID NO: 2600821 - RNA, 19 nt, Human
aggacaaucaguccccucc

SEQ ID NO: 2600822 - RNA, 18 nt, Human
aggacaaucaguccccuc

SEQ ID NO: 2600823 - RNA, 17 nt, Human
aggacaaucaguccccu

SEQ ID NO: 2600824 - RNA, 14 nt, Human
aggacaaggcuaga

SEQ ID NO: 2600825 - RNA, 17 nt, Human
aggacaacgaggaagcc

SEQ ID NO: 2600826 - RNA, 18 nt, Human
aggacaacgaggaagccc

SEQ ID NO: 2600827 - RNA, 14 nt, Human
aggacaacgaggaa

SEQ ID NO: 2600828 - RNA, 20 nt, Human
aggaauuccccaaagaaugu

SEQ ID NO: 2600829 - RNA, 23 nt, Human
aggaauucccagcccaaagcugu

SEQ ID NO: 2600830 - RNA, 22 nt, Human
aggaauucuaggcaucccaggg

SEQ ID NO: 2600831 - RNA, 16 nt, Human
aggacaacgaggaagc

SEQ ID NO: 2600832 - RNA, 16 nt, Human
aggacaauuucaaaaa

SEQ ID NO: 2600833 - RNA, 15 nt, Human
aggacaauuucaaaa

SEQ ID NO: 2600834 - RNA, 14 nt, Human
aggacaauuucaaa

SEQ ID NO: 2600835 - RNA, 18 nt, Human
aggacaauucaugaacuu

SEQ ID NO: 2600836 - RNA, 23 nt, Human
aggacacacuaaucgaacuauga

SEQ ID NO: 2600837 - RNA, 13 nt, Human
aggacacacuaau

SEQ ID NO: 2600838 - RNA, 23 nt, Human
aggacacagaugaaacacaaaca

SEQ ID NO: 2600839 - RNA, 13 nt, Human
aggacacagucag

SEQ ID NO: 2600840 - RNA, 18 nt, Human
aggaccuucgggcugugc

SEQ ID NO: 2600841 - RNA, 19 nt, Human
aggaccuucgggcugugcc

SEQ ID NO: 2600842 - RNA, 15 nt, Human
aggaccuuaucugug

SEQ ID NO: 2600843 - RNA, 16 nt, Human
aggaccuuaucugugc

SEQ ID NO: 2600844 - RNA, 21 nt, Human
aggaccuguggccaaguucuu

SEQ ID NO: 2600845 - RNA, 17 nt, Human
aggacuccuuaaauuug

SEQ ID NO: 2600846 - RNA, 20 nt, Human
aggacuccccaggccaggcc

SEQ ID NO: 2600847 - RNA, 23 nt, Human
aggacucccuccucaccucugga

SEQ ID NO: 2600848 - RNA, 18 nt, Human
aggacucccuccucaccu

SEQ ID NO: 2600849 - RNA, 19 nt, Human
aggacucccuccucaccuc

SEQ ID NO: 2600850 - RNA, 12 nt, Human
aggacucucagg

SEQ ID NO: 2600851 - RNA, 13 nt, Human
aggacucugaggc

SEQ ID NO: 2600852 - RNA, 14 nt, Human
aggacucugaggcu

SEQ ID NO: 2600853 - RNA, 17 nt, Human
aggacucugaggcucuu

SEQ ID NO: 2600854 - RNA, 15 nt, Human
aggacucugcccaga

SEQ ID NO: 2600855 - RNA, 18 nt, Human
aggacucugcccagacca

SEQ ID NO: 2600856 - RNA, 13 nt, Human
aggacuccccagg

SEQ ID NO: 2600857 - RNA, 20 nt, Human
aggacucagcuccccagagu

SEQ ID NO: 2600858 - RNA, 19 nt, Human
aggacucagcuccccagag

SEQ ID NO: 2600859 - RNA, 18 nt, Human
aggacucagcuccccaga

SEQ ID NO: 2600860 - RNA, 17 nt, Human
aggacucagcuccccag

SEQ ID NO: 2600861 - RNA, 17 nt, Human
aggacuccacccauccu

SEQ ID NO: 2600862 - RNA, 19 nt, Human
aggacuccccaggccaggc

SEQ ID NO: 2600863 - RNA, 18 nt, Human
aggacuccccaggccagg

SEQ ID NO: 2600864 - RNA, 17 nt, Human
aggacuccccaggccag

SEQ ID NO: 2600865 - RNA, 16 nt, Human
aggacuccccaggcca

SEQ ID NO: 2600866 - RNA, 12 nt, Human
aggacucccucc

SEQ ID NO: 2600867 - RNA, 13 nt, Human
aggacucccuccu

SEQ ID NO: 2600868 - RNA, 14 nt, Human
aggacucccuccuc

SEQ ID NO: 2600869 - RNA, 15 nt, Human
aggacucccuccuca

SEQ ID NO: 2600870 - RNA, 16 nt, Human
aggacucccuccucac

SEQ ID NO: 2600871 - RNA, 17 nt, Human
aggacucccuccucacc

SEQ ID NO: 2600872 - RNA, 14 nt, Human
aggacucagcuccc

SEQ ID NO: 2600873 - RNA, 13 nt, Human
aggacucagcucc

SEQ ID NO: 2600874 - RNA, 18 nt, Human
aggacucagaagccucug

SEQ ID NO: 2600875 - RNA, 20 nt, Human
aggacuauagcccagguccu

SEQ ID NO: 2600876 - RNA, 19 nt, Human
aggacuauagcccaggucc

SEQ ID NO: 2600877 - RNA, 20 nt, Human
aggacuauauuugggccugc

SEQ ID NO: 2600878 - RNA, 18 nt, Human
aggacuauagcccagguc

SEQ ID NO: 2600879 - RNA, 16 nt, Human
aggacuauagcccagg

SEQ ID NO: 2600880 - RNA, 22 nt, Human
aggacuagaaccuggagggcug

SEQ ID NO: 2600881 - RNA, 18 nt, Human
aggacuagaaccuggagg

SEQ ID NO: 2600882 - RNA, 19 nt, Human
aggacuaggguccugggga

SEQ ID NO: 2600883 - RNA, 16 nt, Human
aggacuaggguccugg

SEQ ID NO: 2600884 - RNA, 18 nt, Human
aggacuaggguccugggg

SEQ ID NO: 2600885 - RNA, 17 nt, Human
aggacuagaaccuggag

SEQ ID NO: 2600886 - RNA, 20 nt, Human
aggacuacguuaagggaagg

SEQ ID NO: 2600887 - RNA, 19 nt, Human
aggacuacguuaagggaag

SEQ ID NO: 2600888 - RNA, 15 nt, Human
aggacuaggguccug

SEQ ID NO: 2600889 - RNA, 16 nt, Human
aggacggugcaaccca

SEQ ID NO: 2600890 - RNA, 22 nt, Human
aggacggggccggccagguggg

SEQ ID NO: 2600891 - RNA, 21 nt, Human
aggacggggccggccaggugg

SEQ ID NO: 2600892 - RNA, 20 nt, Human
aggacggggccggccaggug

SEQ ID NO: 2600893 - RNA, 19 nt, Human
aggacggggccggccaggu

SEQ ID NO: 2600894 - RNA, 16 nt, Human
aggacggggccggcca

SEQ ID NO: 2600895 - RNA, 15 nt, Human
aggacggggccggcc

SEQ ID NO: 2600896 - RNA, 13 nt, Human
aggacggccggcu

SEQ ID NO: 2600897 - RNA, 15 nt, Human
aggacgccacccagc

SEQ ID NO: 2600898 - RNA, 15 nt, Human
aggacgcuucugaau

SEQ ID NO: 2600899 - RNA, 14 nt, Human
aggacgcuucugaa

SEQ ID NO: 2600900 - RNA, 13 nt, Human
aggacgcuucuga

SEQ ID NO: 2600901 - RNA, 20 nt, Human
aggacgugggcggcagagag

SEQ ID NO: 2600902 - RNA, 14 nt, Human
aggacgugggcggc

SEQ ID NO: 2600903 - RNA, 19 nt, Human
aggacuuuucuuuguggcu

SEQ ID NO: 2600904 - RNA, 17 nt, Human
aggacuuuucuuugugg

SEQ ID NO: 2600905 - RNA, 18 nt, Human
aggagaaacuggaacucu

SEQ ID NO: 2600906 - RNA, 19 nt, Human
aggagaaacuggaacucuc

SEQ ID NO: 2600907 - RNA, 17 nt, Human
aggagaaacuggaacuc

SEQ ID NO: 2600908 - RNA, 22 nt, Human
aggacuuuucuuuguggcuucc

SEQ ID NO: 2600909 - RNA, 23 nt, Human
aggacugcacagcguccugucca

SEQ ID NO: 2600910 - RNA, 21 nt, Human
aggacugcacagcguccuguc

SEQ ID NO: 2600911 - RNA, 18 nt, Human
aggacucugccuccucuu

SEQ ID NO: 2600912 - RNA, 17 nt, Human
aggacucugccuccucu

SEQ ID NO: 2600913 - RNA, 16 nt, Human
aggacucugccuccuc

SEQ ID NO: 2600914 - RNA, 14 nt, Human
aggacucugccucc

SEQ ID NO: 2600915 - RNA, 13 nt, Human
aggacucugccuc

SEQ ID NO: 2600916 - RNA, 12 nt, Human
aggacucugccu

SEQ ID NO: 2600917 - RNA, 21 nt, Human
aggacuuccuguccagcucca

SEQ ID NO: 2600918 - RNA, 17 nt, Human
aggacuguauuugugac

SEQ ID NO: 2600919 - RNA, 22 nt, Human
aggacuuccuguccagcuccaa

SEQ ID NO: 2600920 - RNA, 16 nt, Human
aggacuguauuuguga

SEQ ID NO: 2600921 - RNA, 15 nt, Human
aggacuguauuugug

SEQ ID NO: 2600922 - RNA, 15 nt, Human
aggacugggccacuu

SEQ ID NO: 2600923 - RNA, 12 nt, Human
aggacugggcca

SEQ ID NO: 2600924 - RNA, 11 nt, Human
aggacugggcc

SEQ ID NO: 2600925 - RNA, 22 nt, Human
aggacugccgaccgaggcugga

SEQ ID NO: 2600926 - RNA, 18 nt, Human
aggacugccccgugcaga

SEQ ID NO: 2600927 - RNA, 21 nt, Human
aggacugccccgugcagacug

SEQ ID NO: 2600928 - RNA, 13 nt, Human
aggacugccgacc

SEQ ID NO: 2600929 - RNA, 17 nt, Human
aggacugccgaccgagg

SEQ ID NO: 2600930 - RNA, 21 nt, Human
aggacugccgaccgaggcugg

SEQ ID NO: 2600931 - RNA, 14 nt, Human
aggagccccagcua

SEQ ID NO: 2600932 - RNA, 15 nt, Human
aggagccccauuccu

SEQ ID NO: 2600933 - RNA, 16 nt, Human
aggagccccauuccug

SEQ ID NO: 2600934 - RNA, 18 nt, Human
aggagccccauuccuggg

SEQ ID NO: 2600935 - RNA, 19 nt, Human
aggagccccauuccuggga

SEQ ID NO: 2600936 - RNA, 21 nt, Human
aggagccccauuccugggaaa

SEQ ID NO: 2600937 - RNA, 22 nt, Human
aggagcaaauguuucugcagua

SEQ ID NO: 2600938 - RNA, 21 nt, Human
aggagcccuuaucugugcuca

SEQ ID NO: 2600939 - RNA, 23 nt, Human
aggagcccugggaggcucuggag

SEQ ID NO: 2600940 - RNA, 17 nt, Human
aggagccccgaggccuu

SEQ ID NO: 2600941 - RNA, 16 nt, Human
aggagccuccugcccu

SEQ ID NO: 2600942 - RNA, 17 nt, Human
aggagaguagaacagau

SEQ ID NO: 2600943 - RNA, 17 nt, Human
aggagagucccagagca

SEQ ID NO: 2600944 - RNA, 20 nt, Human
aggagagucccagagcagga

SEQ ID NO: 2600945 - RNA, 16 nt, Human
aggagaaaugcaucca

SEQ ID NO: 2600946 - RNA, 16 nt, Human
aggacuugaaagcauc

SEQ ID NO: 2600947 - RNA, 19 nt, Human
aggacuugaaagcauccau

SEQ ID NO: 2600948 - RNA, 21 nt, Human
aggacuugaaagcauccaugu

SEQ ID NO: 2600949 - RNA, 12 nt, Human
aggagaaaugca

SEQ ID NO: 2600950 - RNA, 20 nt, Human
aggagauaucugagggagga

SEQ ID NO: 2600951 - RNA, 16 nt, Human
aggagaugcuccuugg

SEQ ID NO: 2600952 - RNA, 23 nt, Human
aggagauaucugagggaggaggc

SEQ ID NO: 2600953 - RNA, 19 nt, Human
aggagauaucugagggagg

SEQ ID NO: 2600954 - RNA, 18 nt, Human
aggagauaucugagggag

SEQ ID NO: 2600955 - RNA, 14 nt, Human
aggagauaucugag

SEQ ID NO: 2600956 - RNA, 21 nt, Human
aggagauaaaucuaguauaca

SEQ ID NO: 2600957 - RNA, 24 nt, Human
aggagagucccagagcaggaggcc

SEQ ID NO: 2600958 - RNA, 21 nt, Human
aggagagucccagagcaggag

SEQ ID NO: 2600959 - RNA, 12 nt, Human
aggagauaaauc

SEQ ID NO: 2600960 - RNA, 13 nt, Human
aggagcagccaca

SEQ ID NO: 2600961 - RNA, 12 nt, Human
aggagcagccac

SEQ ID NO: 2600962 - RNA, 17 nt, Human
aggagaugcuccuuggg

SEQ ID NO: 2600963 - RNA, 18 nt, Human
aggagaugcuccuugggc

SEQ ID NO: 2600964 - RNA, 22 nt, Human
aggagaugcuccuugggcccuu

SEQ ID NO: 2600965 - RNA, 20 nt, Human
aggagauggaaguugcagug

SEQ ID NO: 2600966 - RNA, 22 nt, Human
aggagcaaaggcugagaacacu

SEQ ID NO: 2600967 - RNA, 19 nt, Human
aggagcaaauguuucugca

SEQ ID NO: 2600968 - RNA, 18 nt, Human
aggagcaaauguuucugc

SEQ ID NO: 2600969 - RNA, 17 nt, Human
aggagcaaauguuucug

SEQ ID NO: 2600970 - RNA, 22 nt, Human
aggagcacaggcagcuggauga

SEQ ID NO: 2600971 - RNA, 15 nt, Human
aggagcacaggcagc

SEQ ID NO: 2600972 - RNA, 19 nt, Human
uggaagcauauuguuauua

SEQ ID NO: 2600973 - RNA, 22 nt, Human
uggaagcauguaggagaaucca

SEQ ID NO: 2600974 - RNA, 12 nt, Human
uggaagcccucc

SEQ ID NO: 2600975 - RNA, 13 nt, Human
uggaagcccuccu

SEQ ID NO: 2600976 - RNA, 15 nt, Human
uggaagcccuccuuc

SEQ ID NO: 2600977 - RNA, 16 nt, Human
uggaagcccuccuucc

SEQ ID NO: 2600978 - RNA, 17 nt, Human
uggaagcccuccuucca

SEQ ID NO: 2600979 - RNA, 16 nt, Human
uggaagccagcuuucc

SEQ ID NO: 2600980 - RNA, 18 nt, Human
uggaagccagcuuucccu

SEQ ID NO: 2600981 - RNA, 15 nt, Human
uggaagccagcuuuc

SEQ ID NO: 2600982 - RNA, 17 nt, Human
uggaagcauguaggaga

SEQ ID NO: 2600983 - RNA, 19 nt, Human
uggaagcauguaggagaau

SEQ ID NO: 2600984 - RNA, 22 nt, Human
aggaggacaauucaugaacuuc

SEQ ID NO: 2600985 - RNA, 14 nt, Human
aggaggacaauuca

SEQ ID NO: 2600986 - RNA, 13 nt, Human
aggaggacaauuc

SEQ ID NO: 2600987 - RNA, 23 nt, Human
aggaggaaucaugucaggccugu

SEQ ID NO: 2600988 - RNA, 22 nt, Human
aggaggaaucaugucaggccug

SEQ ID NO: 2600989 - RNA, 17 nt, Human
aggaggaaggcaagagg

SEQ ID NO: 2600990 - RNA, 17 nt, Human
uggaagccggagggugu

SEQ ID NO: 2600991 - RNA, 14 nt, Human
aggaggaaggcaag

SEQ ID NO: 2600992 - RNA, 19 nt, Human
uggaagcccuccuuccacg

SEQ ID NO: 2600993 - RNA, 13 nt, Human
aggaggcuccaga

SEQ ID NO: 2600994 - RNA, 16 nt, Human
aggaggcuccagaggg

SEQ ID NO: 2600995 - RNA, 23 nt, Human
aggaggcgcacuuuccuccuggc

SEQ ID NO: 2600996 - RNA, 15 nt, Human
aggaggagcaggggc

SEQ ID NO: 2600997 - RNA, 17 nt, Human
aggaggcuccagagggc

SEQ ID NO: 2600998 - RNA, 18 nt, Human
aggaggcuccagagggca

SEQ ID NO: 2600999 - RNA, 19 nt, Human
aggaggcuccagagggcac

SEQ ID NO: 2601000 - RNA, 16 nt, Human
aggaggcugaggcaga

SEQ ID NO: 2601001 - RNA, 17 nt, Human
aggaggcugaggcagaa

SEQ ID NO: 2601002 - RNA, 17 nt, Human
aggaggcugaggcagga

SEQ ID NO: 2601003 - RNA, 19 nt, Human
aggaggcugaggcaggagg

SEQ ID NO: 2601004 - RNA, 13 nt, Human
aggaggcugaggg

SEQ ID NO: 2601005 - RNA, 20 nt, Human
aggauagaugcuggcccagg

SEQ ID NO: 2601006 - RNA, 21 nt, Human
aggauagaugcuggcccaggg

SEQ ID NO: 2601007 - RNA, 14 nt, Human
aggauagcauuuuu

SEQ ID NO: 2601008 - RNA, 22 nt, Human
aggauagaugcuggcccagggc

SEQ ID NO: 2601009 - RNA, 21 nt, Human
aggauaggaguucacuucauc

SEQ ID NO: 2601010 - RNA, 16 nt, Human
aggauaggaguucacu

SEQ ID NO: 2601011 - RNA, 18 nt, Human
aggauauauuuucacuuu

SEQ ID NO: 2601012 - RNA, 14 nt, Human
aggauauauuuuca

SEQ ID NO: 2601013 - RNA, 18 nt, Human
aggauagaugcuggccca

SEQ ID NO: 2601014 - RNA, 19 nt, Human
aggauagaugcuggcccag

SEQ ID NO: 2601015 - RNA, 15 nt, Human
aggauagaugcuggc

SEQ ID NO: 2601016 - RNA, 14 nt, Human
aggauagaugcugg

SEQ ID NO: 2601017 - RNA, 13 nt, Human
aggaggcuggcag

SEQ ID NO: 2601018 - RNA, 14 nt, Human
aggaggcuggcugg

SEQ ID NO: 2601019 - RNA, 13 nt, Human
aggaggcuggcug

SEQ ID NO: 2601020 - RNA, 16 nt, Human
aggaggcuggcaggua

SEQ ID NO: 2601021 - RNA, 23 nt, Human
aggaugaucuaggaagacuuugg

SEQ ID NO: 2601022 - RNA, 22 nt, Human
aggaugaucuaggaagacuuug

SEQ ID NO: 2601023 - RNA, 22 nt, Human
aggaugcacagaguuguuacau

SEQ ID NO: 2601024 - RNA, 23 nt, Human
aggaugagagcccagagguaaca

SEQ ID NO: 2601025 - RNA, 19 nt, Human
aggaugagcucuacccagg

SEQ ID NO: 2601026 - RNA, 16 nt, Human
aggauucuuccucccu

SEQ ID NO: 2601027 - RNA, 17 nt, Human
aggauucuuccucccuc

SEQ ID NO: 2601028 - RNA, 19 nt, Human
aggauucuuccucccuccc

SEQ ID NO: 2601029 - RNA, 17 nt, Human
aggauugauuaugcaga

SEQ ID NO: 2601030 - RNA, 22 nt, Human
aggauugaagagcauugcaugg

SEQ ID NO: 2601031 - RNA, 14 nt, Human
aggauugaagagca

SEQ ID NO: 2601032 - RNA, 13 nt, Human
aggauugaagagc

SEQ ID NO: 2601033 - RNA, 18 nt, Human
aggaugcagagucagcag

SEQ ID NO: 2601034 - RNA, 16 nt, Human
aggaugauuuuggccu

SEQ ID NO: 2601035 - RNA, 18 nt, Human
aggaucaugguguaauaa

SEQ ID NO: 2601036 - RNA, 17 nt, Human
aggaucaugguguaaua

SEQ ID NO: 2601037 - RNA, 20 nt, Human
aggaucauuuguuggaauga

SEQ ID NO: 2601038 - RNA, 15 nt, Human
aggaucaugguguaa

SEQ ID NO: 2601039 - RNA, 15 nt, Human
aggauaucuucucca

SEQ ID NO: 2601040 - RNA, 21 nt, Human
aggauauauuuucacuuugug

SEQ ID NO: 2601041 - RNA, 13 nt, Human
aggaucagucuga

SEQ ID NO: 2601042 - RNA, 20 nt, Human
aggaugagagcccagaggua

SEQ ID NO: 2601043 - RNA, 19 nt, Human
aggaugagagcccagaggu

SEQ ID NO: 2601044 - RNA, 18 nt, Human
aggaugagagcccagagg

SEQ ID NO: 2601045 - RNA, 17 nt, Human
aggaugagagcccagag

SEQ ID NO: 2601046 - RNA, 16 nt, Human
aggaugagagcccaga

SEQ ID NO: 2601047 - RNA, 15 nt, Human
aggaugagagcccag

SEQ ID NO: 2601048 - RNA, 14 nt, Human
aggaugagagccca

SEQ ID NO: 2601049 - RNA, 13 nt, Human
aggaugagagccc

SEQ ID NO: 2601050 - RNA, 20 nt, Human
aggaugaauguaugugcacu

SEQ ID NO: 2601051 - RNA, 18 nt, Human
aggaugaauguaugugca

SEQ ID NO: 2601052 - RNA, 12 nt, Human
aggaugaaugua

SEQ ID NO: 2601053 - RNA, 22 nt, Human
aggaucaugguguaauaagaca

SEQ ID NO: 2601054 - RNA, 23 nt, Human
aggaugacgguauuaugcuucuu

SEQ ID NO: 2601055 - RNA, 20 nt, Human
aggaugacgguauuaugcuu

SEQ ID NO: 2601056 - RNA, 20 nt, Human
aggaugaccuggauaacuua

SEQ ID NO: 2601057 - RNA, 19 nt, Human
aggaugaaugaggucccag

SEQ ID NO: 2601058 - RNA, 20 nt, Human
aggaugaaugaggucccagg

SEQ ID NO: 2601059 - RNA, 21 nt, Human
aggaugaaugaggucccaggc

SEQ ID NO: 2601060 - RNA, 22 nt, Human
aggaugaaugaggucccaggca

SEQ ID NO: 2601061 - RNA, 21 nt, Human
aggaucauuuguuggaaugaa

SEQ ID NO: 2601062 - RNA, 13 nt, Human
aggaucuuuugaa

SEQ ID NO: 2601063 - RNA, 18 nt, Human
aggaucuuuugaacccag

SEQ ID NO: 2601064 - RNA, 17 nt, Human
uggaagaccccacccaa

SEQ ID NO: 2601065 - RNA, 15 nt, Human
uggaagagggcugca

SEQ ID NO: 2601066 - RNA, 15 nt, Human
uggaagagccugcag

SEQ ID NO: 2601067 - RNA, 23 nt, Human
uggaagagccugcaggugcugcu

SEQ ID NO: 2601068 - RNA, 16 nt, Human
uggaagacagcucuua

SEQ ID NO: 2601069 - RNA, 15 nt, Human
uggaagacagcucuu

SEQ ID NO: 2601070 - RNA, 15 nt, Human
uggaagaccccaccc

SEQ ID NO: 2601071 - RNA, 13 nt, Human
uggaagaccccac

SEQ ID NO: 2601072 - RNA, 21 nt, Human
uggaaauuuguuauaaugaau

SEQ ID NO: 2601073 - RNA, 23 nt, Human
uggaaauuuguuauaaugaauga

SEQ ID NO: 2601074 - RNA, 13 nt, Human
ugcuuuuucugac

SEQ ID NO: 2601075 - RNA, 14 nt, Human
ugcuuuuucuaaug

SEQ ID NO: 2601076 - RNA, 13 nt, Human
ugcuuuuucuaau

SEQ ID NO: 2601077 - RNA, 12 nt, Human
ugcuuuuucuga

SEQ ID NO: 2601078 - RNA, 15 nt, Human
ugcuuuuucaccaga

SEQ ID NO: 2601079 - RNA, 18 nt, Human
ugcuuuuuauuucugcau

SEQ ID NO: 2601080 - RNA, 19 nt, Human
ugcuuuuuauuucugcaua

SEQ ID NO: 2601081 - RNA, 16 nt, Human
ugcuuuuuauggccug

SEQ ID NO: 2601082 - RNA, 15 nt, Human
ugcuuuuuauuucug

SEQ ID NO: 2601083 - RNA, 17 nt, Human
ugcuuuuuaaguguuaa

SEQ ID NO: 2601084 - RNA, 21 nt, Human
uggaaaguguaaagcauucca

SEQ ID NO: 2601085 - RNA, 18 nt, Human
uggaaaguguaaagcauu

SEQ ID NO: 2601086 - RNA, 17 nt, Human
uggaaaguguaaagcau

SEQ ID NO: 2601087 - RNA, 13 nt, Human
uggaaauaaaugu

SEQ ID NO: 2601088 - RNA, 15 nt, Human
uggaaauaaauguau

SEQ ID NO: 2601089 - RNA, 23 nt, Human
uggaaauaaauguaucauagaaa

SEQ ID NO: 2601090 - RNA, 21 nt, Human
ugcuuuuugagguggcacuuu

SEQ ID NO: 2601091 - RNA, 20 nt, Human
ugcuuuuugagguggcacuu

SEQ ID NO: 2601092 - RNA, 17 nt, Human
ugcuuuuugagguggca

SEQ ID NO: 2601093 - RNA, 14 nt, Human
uggaaagugaauuu

SEQ ID NO: 2601094 - RNA, 15 nt, Human
uggaaagugaauuug

SEQ ID NO: 2601095 - RNA, 16 nt, Human
uggaaagugaauuuga

SEQ ID NO: 2601096 - RNA, 16 nt, Human
uggaaaguguaaagca

SEQ ID NO: 2601097 - RNA, 15 nt, Human
uggaaaguguaaagc

SEQ ID NO: 2601098 - RNA, 14 nt, Human
uggaaaguguaaag

SEQ ID NO: 2601099 - RNA, 13 nt, Human
uggaaaguguaaa

SEQ ID NO: 2601100 - RNA, 17 nt, Human
uggaaagugaauuugaa

SEQ ID NO: 2601101 - RNA, 20 nt, Human
uggaaagugaauuugaauga

SEQ ID NO: 2601102 - RNA, 21 nt, Human
uggaaagugaauuugaaugaa

SEQ ID NO: 2601103 - RNA, 23 nt, Human
uggaaagugaauuugaaugaaaa

SEQ ID NO: 2601104 - RNA, 22 nt, Human
ugcuuuggaccuaaauggccuc

SEQ ID NO: 2601105 - RNA, 21 nt, Human
ugcuuuggaccuaaauggccu

SEQ ID NO: 2601106 - RNA, 23 nt, Human
ugcuuuggaccuaaauggccuca

SEQ ID NO: 2601107 - RNA, 15 nt, Human
ugcuuugggaagccg

SEQ ID NO: 2601108 - RNA, 15 nt, Human
ugcuuugggcugccc

SEQ ID NO: 2601109 - RNA, 14 nt, Human
ugcuuugggcugcc

SEQ ID NO: 2601110 - RNA, 16 nt, Human
ugcuugaggaaaacaa

SEQ ID NO: 2601111 - RNA, 13 nt, Human
ugcuuuggaaauc

SEQ ID NO: 2601112 - RNA, 18 nt, Human
ugcuuuggaccuaaaugg

SEQ ID NO: 2601113 - RNA, 13 nt, Human
ugcuugaggaaaa

SEQ ID NO: 2601114 - RNA, 12 nt, Human
ugcuugaggaaa

SEQ ID NO: 2601115 - RNA, 16 nt, Human
ugcuugagcccaggag

SEQ ID NO: 2601116 - RNA, 13 nt, Human
ugcuugagcccag

SEQ ID NO: 2601117 - RNA, 14 nt, Human
ugcuugagcccagg

SEQ ID NO: 2601118 - RNA, 15 nt, Human
ugcuugagcucagga

SEQ ID NO: 2601119 - RNA, 15 nt, Human
ugcuugacaacaucu

SEQ ID NO: 2601120 - RNA, 16 nt, Human
ugcuugacaacaucug

SEQ ID NO: 2601121 - RNA, 20 nt, Human
ugcuugacauaauuucacug

SEQ ID NO: 2601122 - RNA, 17 nt, Human
aggagccuccugcccuu

SEQ ID NO: 2601123 - RNA, 23 nt, Human
aggagcccuuaucugugcucagg

SEQ ID NO: 2601124 - RNA, 17 nt, Human
ugcuuuuaaaaaaaaau

SEQ ID NO: 2601125 - RNA, 18 nt, Human
ugcuuuuggucuguguga

SEQ ID NO: 2601126 - RNA, 20 nt, Human
ugcuuuugucuaugggacuc

SEQ ID NO: 2601127 - RNA, 23 nt, Human
ugcuuuuuaauauugauaugcuu

SEQ ID NO: 2601128 - RNA, 22 nt, Human
ugcuuugugauuuuuguaauuu

SEQ ID NO: 2601129 - RNA, 16 nt, Human
ugcuuugggcugcccu

SEQ ID NO: 2601130 - RNA, 17 nt, Human
ugcuuugugugauugaa

SEQ ID NO: 2601131 - RNA, 17 nt, Human
ugcuuugugauuuuugu

SEQ ID NO: 2601132 - RNA, 16 nt, Human
ugcuuugugugauuga

SEQ ID NO: 2601133 - RNA, 17 nt, Human
ugcuuuggcuuacuugu

SEQ ID NO: 2601134 - RNA, 14 nt, Human
uggaguugaaaauc

SEQ ID NO: 2601135 - RNA, 20 nt, Human
uggaguuacauuaauguuaa

SEQ ID NO: 2601136 - RNA, 18 nt, Human
uggaguuacauuaauguu

SEQ ID NO: 2601137 - RNA, 20 nt, Human
uggaguuccugaaccugaug

SEQ ID NO: 2601138 - RNA, 17 nt, Human
uggaguuacauuaaugu

SEQ ID NO: 2601139 - RNA, 20 nt, Human
uggaguuaacgggugaauaa

SEQ ID NO: 2601140 - RNA, 19 nt, Human
uggaguguguauuguuccc

SEQ ID NO: 2601141 - RNA, 19 nt, Human
uggaguguuccccuuccac

SEQ ID NO: 2601142 - RNA, 22 nt, Human
uggaguguuccccuuccacuga

SEQ ID NO: 2601143 - RNA, 17 nt, Human
uggaguggggcaguaga

SEQ ID NO: 2601144 - RNA, 15 nt, Human
uggaguguguauugu

SEQ ID NO: 2601145 - RNA, 20 nt, Human
uggaguguguauuguuccca

SEQ ID NO: 2601146 - RNA, 19 nt, Human
uggaguguaugacugcaca

SEQ ID NO: 2601147 - RNA, 17 nt, Human
uggaguguaugacugca

SEQ ID NO: 2601148 - RNA, 17 nt, Human
uggaguguggcugagga

SEQ ID NO: 2601149 - RNA, 16 nt, Human
uggaguggggcaguag

SEQ ID NO: 2601150 - RNA, 13 nt, Human
uggaguggggcag

SEQ ID NO: 2601151 - RNA, 14 nt, Human
uggaguguaugacu

SEQ ID NO: 2601152 - RNA, 13 nt, Human
uggaguggccacu

SEQ ID NO: 2601153 - RNA, 19 nt, Human
uggagugcagggaggagag

SEQ ID NO: 2601154 - RNA, 17 nt, Human
uggagugcagggaggag

SEQ ID NO: 2601155 - RNA, 15 nt, Human
uggagugcagggagg

SEQ ID NO: 2601156 - RNA, 20 nt, Human
uggaggugccagcaaagccc

SEQ ID NO: 2601157 - RNA, 19 nt, Human
uggaggugccagcaaagcc

SEQ ID NO: 2601158 - RNA, 17 nt, Human
uggaggugccagcaaag

SEQ ID NO: 2601159 - RNA, 22 nt, Human
uggaggucacauucaggaagau

SEQ ID NO: 2601160 - RNA, 17 nt, Human
uggaggugggagcagga

SEQ ID NO: 2601161 - RNA, 13 nt, Human
uggaggugggagc

SEQ ID NO: 2601162 - RNA, 12 nt, Human
uggaggugggag

SEQ ID NO: 2601163 - RNA, 20 nt, Human
uggaggucacauucaggaag

SEQ ID NO: 2601164 - RNA, 18 nt, Human
uggaggucacauucagga

SEQ ID NO: 2601165 - RNA, 20 nt, Human
uggaggucgguagguucagc

SEQ ID NO: 2601166 - RNA, 20 nt, Human
uggagguacgaaaagagggg

SEQ ID NO: 2601167 - RNA, 16 nt, Human
aggcauuugcugaaua

SEQ ID NO: 2601168 - RNA, 20 nt, Human
aggcauuugcugaauacaga

SEQ ID NO: 2601169 - RNA, 22 nt, Human
uggaggugucaggcugcuggcg

SEQ ID NO: 2601170 - RNA, 21 nt, Human
uggaggugucaggcugcuggc

SEQ ID NO: 2601171 - RNA, 20 nt, Human
uggaggugucaggcugcugg

SEQ ID NO: 2601172 - RNA, 18 nt, Human
uggaggugucaggcugcu

SEQ ID NO: 2601173 - RNA, 17 nt, Human
uggagguuaaggcugag

SEQ ID NO: 2601174 - RNA, 19 nt, Human
uggagguuaaggcugagga

SEQ ID NO: 2601175 - RNA, 19 nt, Human
uggagguggggccuggagc

SEQ ID NO: 2601176 - RNA, 20 nt, Human
uggaggugggagcaggagau

SEQ ID NO: 2601177 - RNA, 18 nt, Human
uggaggugggagcaggag

SEQ ID NO: 2601178 - RNA, 16 nt, Human
uggaggugucaggcug

SEQ ID NO: 2601179 - RNA, 17 nt, Human
uggaggugggguuggga

SEQ ID NO: 2601180 - RNA, 15 nt, Human
uggaggugggguugg

SEQ ID NO: 2601181 - RNA, 14 nt, Human
uggagguggggccu

SEQ ID NO: 2601182 - RNA, 14 nt, Human
uggagugcagugag

SEQ ID NO: 2601183 - RNA, 17 nt, Human
uggagugcaaugacaca

SEQ ID NO: 2601184 - RNA, 21 nt, Human
uggauugcacguggccucuug

SEQ ID NO: 2601185 - RNA, 17 nt, Human
uggauugcacguggccu

SEQ ID NO: 2601186 - RNA, 23 nt, Human
uggcacaucagcacgauuucugu

SEQ ID NO: 2601187 - RNA, 18 nt, Human
uggcacauuuaagagaca

SEQ ID NO: 2601188 - RNA, 23 nt, Human
uggcacauccuaugcaauauauc

SEQ ID NO: 2601189 - RNA, 19 nt, Human
uggcacauccuaugcaaua

SEQ ID NO: 2601190 - RNA, 18 nt, Human
uggcacauccuaugcaau

SEQ ID NO: 2601191 - RNA, 15 nt, Human
uggcacauccuaugc

SEQ ID NO: 2601192 - RNA, 21 nt, Human
uggcacauuuccccagaccug

SEQ ID NO: 2601193 - RNA, 18 nt, Human
uggcaccacugcacucca

SEQ ID NO: 2601194 - RNA, 19 nt, Human
uggcaccacugcacuccag

SEQ ID NO: 2601195 - RNA, 21 nt, Human
uggcaccacugcacuccagcc

SEQ ID NO: 2601196 - RNA, 17 nt, Human
uggauuccaaccccaac

SEQ ID NO: 2601197 - RNA, 12 nt, Human
uggauucucaga

SEQ ID NO: 2601198 - RNA, 13 nt, Human
uggauucucagau

SEQ ID NO: 2601199 - RNA, 14 nt, Human
uggauucucagaua

SEQ ID NO: 2601200 - RNA, 15 nt, Human
uggauucucagauau

SEQ ID NO: 2601201 - RNA, 16 nt, Human
uggauucucagauauu

SEQ ID NO: 2601202 - RNA, 16 nt, Human
uggauucugagagcug

SEQ ID NO: 2601203 - RNA, 17 nt, Human
uggauucugagagcugu

SEQ ID NO: 2601204 - RNA, 13 nt, Human
uggauugagggua

SEQ ID NO: 2601205 - RNA, 17 nt, Human
uggauucuuauguagca

SEQ ID NO: 2601206 - RNA, 19 nt, Human
uggauucucagauauuuau

SEQ ID NO: 2601207 - RNA, 15 nt, Human
uggaguucuugugcc

SEQ ID NO: 2601208 - RNA, 14 nt, Human
uggaguucuugugc

SEQ ID NO: 2601209 - RNA, 16 nt, Human
uggaguucuugugcca

SEQ ID NO: 2601210 - RNA, 15 nt, Human
uggaguugaucugga

SEQ ID NO: 2601211 - RNA, 17 nt, Human
uggaguugaucuggaac

SEQ ID NO: 2601212 - RNA, 19 nt, Human
uggaguugaucuggaaccc

SEQ ID NO: 2601213 - RNA, 23 nt, Human
uggaugccugguggcagcugcgg

SEQ ID NO: 2601214 - RNA, 21 nt, Human
uggaugccugguggcagcugc

SEQ ID NO: 2601215 - RNA, 23 nt, Human
uggauuauuuaauaacauuaccu

SEQ ID NO: 2601216 - RNA, 20 nt, Human
uggauuauuuaauaacauua

SEQ ID NO: 2601217 - RNA, 18 nt, Human
uggauuauuuaauaacau

SEQ ID NO: 2601218 - RNA, 17 nt, Human
uggauuauuuaauaaca

SEQ ID NO: 2601219 - RNA, 22 nt, Human
uggaguugaucuggaacccaga

SEQ ID NO: 2601220 - RNA, 23 nt, Human
uggaugcggaacccaaauuacgu

SEQ ID NO: 2601221 - RNA, 20 nt, Human
uggauucauuuccugcccuu

SEQ ID NO: 2601222 - RNA, 19 nt, Human
uggauucauuuccugcccu

SEQ ID NO: 2601223 - RNA, 18 nt, Human
uggauucauuuccugccc

SEQ ID NO: 2601224 - RNA, 17 nt, Human
uggauucauuuccugcc

SEQ ID NO: 2601225 - RNA, 15 nt, Human
uggauucauuuccug

SEQ ID NO: 2601226 - RNA, 13 nt, Human
uggauucauuucc

SEQ ID NO: 2601227 - RNA, 18 nt, Human
uggauucauuacagcuua

SEQ ID NO: 2601228 - RNA, 22 nt, Human
uggcagcucaccucucccuugg

SEQ ID NO: 2601229 - RNA, 21 nt, Human
uggcagcucaccucucccuug

SEQ ID NO: 2601230 - RNA, 23 nt, Human
uggcagcucaccucucccuugga

SEQ ID NO: 2601231 - RNA, 15 nt, Human
aggccaccuccccag

SEQ ID NO: 2601232 - RNA, 14 nt, Human
aggccaccucccca

SEQ ID NO: 2601233 - RNA, 13 nt, Human
uggcagcucagag

SEQ ID NO: 2601234 - RNA, 20 nt, Human
uggcacccggccccugcugg

SEQ ID NO: 2601235 - RNA, 19 nt, Human
uggcacccggccccugcug

SEQ ID NO: 2601236 - RNA, 14 nt, Human
uggcaccagacacc

SEQ ID NO: 2601237 - RNA, 16 nt, Human
uggcaccagacaccca

SEQ ID NO: 2601238 - RNA, 18 nt, Human
uggcacccggccccugcu

SEQ ID NO: 2601239 - RNA, 18 nt, Human
aggccaccucuccaaggg

SEQ ID NO: 2601240 - RNA, 17 nt, Human
aggccaccucuccaagg

SEQ ID NO: 2601241 - RNA, 16 nt, Human
aggccaccucuccaag

SEQ ID NO: 2601242 - RNA, 15 nt, Human
aggccaccucuccaa

SEQ ID NO: 2601243 - RNA, 14 nt, Human
aggccaccucucca

SEQ ID NO: 2601244 - RNA, 13 nt, Human
aggccaccucucc

SEQ ID NO: 2601245 - RNA, 12 nt, Human
aggccaccucuc

SEQ ID NO: 2601246 - RNA, 11 nt, Human
aggccaccucu

SEQ ID NO: 2601247 - RNA, 17 nt, Human
aggccaccuccccagca

SEQ ID NO: 2601248 - RNA, 16 nt, Human
aggccaccuccagaaa

SEQ ID NO: 2601249 - RNA, 23 nt, Human
aggccaccucuccaagggcuucu

SEQ ID NO: 2601250 - RNA, 19 nt, Human
aggccaccucuccaagggc

SEQ ID NO: 2601251 - RNA, 13 nt, Human
aggccaccugccc

SEQ ID NO: 2601252 - RNA, 13 nt, Human
aggccagccuggc

SEQ ID NO: 2601253 - RNA, 18 nt, Human
aggccaccugcccccuuc

SEQ ID NO: 2601254 - RNA, 14 nt, Human
aggccaccugcccc

SEQ ID NO: 2601255 - RNA, 15 nt, Human
aggccaccugccccc

SEQ ID NO: 2601256 - RNA, 16 nt, Human
aggccaccugcccccu

SEQ ID NO: 2601257 - RNA, 17 nt, Human
aggccaccugcccccuu

SEQ ID NO: 2601258 - RNA, 13 nt, Human
aggccagccuuga

SEQ ID NO: 2601259 - RNA, 15 nt, Human
aggccagccuugacc

SEQ ID NO: 2601260 - RNA, 13 nt, Human
aggccagcugccu

SEQ ID NO: 2601261 - RNA, 22 nt, Human
aggcccccagcccagggcuccu

SEQ ID NO: 2601262 - RNA, 19 nt, Human
aggcccccagcccagggcu

SEQ ID NO: 2601263 - RNA, 18 nt, Human
aggcccccagcccagggc

SEQ ID NO: 2601264 - RNA, 17 nt, Human
aggcccccagcccaggg

SEQ ID NO: 2601265 - RNA, 14 nt, Human
aggcccccagccca

SEQ ID NO: 2601266 - RNA, 20 nt, Human
aggcccccacuugccucuuc

SEQ ID NO: 2601267 - RNA, 18 nt, Human
aggcccccacuugccucu

SEQ ID NO: 2601268 - RNA, 17 nt, Human
aggcccccacuugccuc

SEQ ID NO: 2601269 - RNA, 14 nt, Human
aggccccaggaagc

SEQ ID NO: 2601270 - RNA, 15 nt, Human
aggccccaggaagcc

SEQ ID NO: 2601271 - RNA, 16 nt, Human
aggccccaggaagccg

SEQ ID NO: 2601272 - RNA, 13 nt, Human
aggcccccacuug

SEQ ID NO: 2601273 - RNA, 13 nt, Human
aggcccccaagcc

SEQ ID NO: 2601274 - RNA, 19 nt, Human
aggccagcugccccagcca

SEQ ID NO: 2601275 - RNA, 12 nt, Human
aggcccaagaga

SEQ ID NO: 2601276 - RNA, 20 nt, Human
aggcccaagagaugaagagu

SEQ ID NO: 2601277 - RNA, 13 nt, Human
aggcccagagggc

SEQ ID NO: 2601278 - RNA, 13 nt, Human
aggcccggccucu

SEQ ID NO: 2601279 - RNA, 14 nt, Human
aggcccggccucuc

SEQ ID NO: 2601280 - RNA, 23 nt, Human
aggccccgaggacccagacccag

SEQ ID NO: 2601281 - RNA, 21 nt, Human
aggccccgaggacccagaccc

SEQ ID NO: 2601282 - RNA, 19 nt, Human
aggcccgcaugcggcccag

SEQ ID NO: 2601283 - RNA, 17 nt, Human
aggcccggcuccaggcu

SEQ ID NO: 2601284 - RNA, 15 nt, Human
aggcccggccucuca

SEQ ID NO: 2601285 - RNA, 13 nt, Human
aggcccggcucca

SEQ ID NO: 2601286 - RNA, 23 nt, Human
aggcccccagcccagggcuccug

SEQ ID NO: 2601287 - RNA, 15 nt, Human
aggcccccaggugcc

SEQ ID NO: 2601288 - RNA, 14 nt, Human
aggccccgcccagg

SEQ ID NO: 2601289 - RNA, 20 nt, Human
aggccccgaggacccagacc

SEQ ID NO: 2601290 - RNA, 19 nt, Human
aggccccgaggacccagac

SEQ ID NO: 2601291 - RNA, 18 nt, Human
aggccccgaggacccaga

SEQ ID NO: 2601292 - RNA, 17 nt, Human
aggccccgaggacccag

SEQ ID NO: 2601293 - RNA, 21 nt, Human
uggagcucguggaacaguuac

SEQ ID NO: 2601294 - RNA, 17 nt, Human
uggagcucguggaacag

SEQ ID NO: 2601295 - RNA, 21 nt, Human
uggagcucgugggacagucac

SEQ ID NO: 2601296 - RNA, 17 nt, Human
aggcaagcaccuccugc

SEQ ID NO: 2601297 - RNA, 17 nt, Human
uggagccaauggagacu

SEQ ID NO: 2601298 - RNA, 15 nt, Human
uggagccaaguccag

SEQ ID NO: 2601299 - RNA, 17 nt, Human
uggagccaacugcugcu

SEQ ID NO: 2601300 - RNA, 17 nt, Human
uggagccaaggguucag

SEQ ID NO: 2601301 - RNA, 13 nt, Human
uggagccagcucc

SEQ ID NO: 2601302 - RNA, 16 nt, Human
uggagccacuaacuag

SEQ ID NO: 2601303 - RNA, 16 nt, Human
uggagccaaguccaga

SEQ ID NO: 2601304 - RNA, 18 nt, Human
uggagcaugggccuggcc

SEQ ID NO: 2601305 - RNA, 17 nt, Human
uggagcaugggccuggc

SEQ ID NO: 2601306 - RNA, 16 nt, Human
uggagcaucugacuca

SEQ ID NO: 2601307 - RNA, 15 nt, Human
uggagcaucugacuc

SEQ ID NO: 2601308 - RNA, 16 nt, Human
uggagccaacugcugc

SEQ ID NO: 2601309 - RNA, 17 nt, Human
uggagcauuggcugaga

SEQ ID NO: 2601310 - RNA, 18 nt, Human
uggagcaggacucuauuu

SEQ ID NO: 2601311 - RNA, 17 nt, Human
uggagcagaggggcuga

SEQ ID NO: 2601312 - RNA, 11 nt, Human
uggagcaucug

SEQ ID NO: 2601313 - RNA, 20 nt, Human
aggcaaggcaggugccucca

SEQ ID NO: 2601314 - RNA, 22 nt, Human
aggcaaggcaggugccuccagg

SEQ ID NO: 2601315 - RNA, 19 nt, Human
aggcaaggcaggugccucc

SEQ ID NO: 2601316 - RNA, 15 nt, Human
aggcaaggcaggugc

SEQ ID NO: 2601317 - RNA, 14 nt, Human
aggcaaggcaggug

SEQ ID NO: 2601318 - RNA, 13 nt, Human
aggcaaggcaggu

SEQ ID NO: 2601319 - RNA, 16 nt, Human
aggcaaggcugucaau

SEQ ID NO: 2601320 - RNA, 21 nt, Human
aggcacacacugugcuuucua

SEQ ID NO: 2601321 - RNA, 20 nt, Human
aggcacacacugugcuuucu

SEQ ID NO: 2601322 - RNA, 19 nt, Human
aggcacacacugugcuuuc

SEQ ID NO: 2601323 - RNA, 16 nt, Human
aggcacacacugugcu

SEQ ID NO: 2601324 - RNA, 14 nt, Human
aggcacacacugug

SEQ ID NO: 2601325 - RNA, 17 nt, Human
aggcaaggcugucaauu

SEQ ID NO: 2601326 - RNA, 19 nt, Human
aggcaagcaccuccugccu

SEQ ID NO: 2601327 - RNA, 18 nt, Human
aggcaagcaccuccugcc

SEQ ID NO: 2601328 - RNA, 12 nt, Human
aggcaagcccug

SEQ ID NO: 2601329 - RNA, 20 nt, Human
aggcaagcaccuccugccuc

SEQ ID NO: 2601330 - RNA, 17 nt, Human
aggauugcuacuguccu

SEQ ID NO: 2601331 - RNA, 15 nt, Human
aggauugcuacuguc

SEQ ID NO: 2601332 - RNA, 16 nt, Human
uggacuguucccugag

SEQ ID NO: 2601333 - RNA, 18 nt, Human
aggauugcuacuguccua

SEQ ID NO: 2601334 - RNA, 14 nt, Human
uggagaaaauggac

SEQ ID NO: 2601335 - RNA, 23 nt, Human
uggacuucacauaagcucagaau

SEQ ID NO: 2601336 - RNA, 18 nt, Human
uggacuucacauaagcuc

SEQ ID NO: 2601337 - RNA, 21 nt, Human
uggacuuagaaagcaggggcu

SEQ ID NO: 2601338 - RNA, 20 nt, Human
uggacuuagaaagcaggggc

SEQ ID NO: 2601339 - RNA, 20 nt, Human
uggacuguuuucucucggcu

SEQ ID NO: 2601340 - RNA, 17 nt, Human
uggacuguuuucucucg

SEQ ID NO: 2601341 - RNA, 17 nt, Human
uggacuguucccugagg

SEQ ID NO: 2601342 - RNA, 22 nt, Human
uggacuguuuucucucggcucc

SEQ ID NO: 2601343 - RNA, 18 nt, Human
uggacuuagaaagcaggg

SEQ ID NO: 2601344 - RNA, 16 nt, Human
uggacuuagaaagcag

SEQ ID NO: 2601345 - RNA, 15 nt, Human
uggacuuagaaagca

SEQ ID NO: 2601346 - RNA, 20 nt, Human
uggagcagagcaagucugca

SEQ ID NO: 2601347 - RNA, 12 nt, Human
uggagcagagca

SEQ ID NO: 2601348 - RNA, 17 nt, Human
uggagcagaccaccccg

SEQ ID NO: 2601349 - RNA, 13 nt, Human
uggagcagaccac

SEQ ID NO: 2601350 - RNA, 15 nt, Human
uggagcagaaucagu

SEQ ID NO: 2601351 - RNA, 22 nt, Human
uggagcagagcaagucugcagg

SEQ ID NO: 2601352 - RNA, 21 nt, Human
uggagcagagcaagucugcag

SEQ ID NO: 2601353 - RNA, 12 nt, Human
uggagcagaggg

SEQ ID NO: 2601354 - RNA, 13 nt, Human
uggagcagagggg

SEQ ID NO: 2601355 - RNA, 16 nt, Human
uggagcagaggggcug

SEQ ID NO: 2601356 - RNA, 14 nt, Human
uggagcagaaucag

SEQ ID NO: 2601357 - RNA, 17 nt, Human
uggagcaccaggcacga

SEQ ID NO: 2601358 - RNA, 21 nt, Human
uggagcaaagugagggccgag

SEQ ID NO: 2601359 - RNA, 19 nt, Human
uggagaaauuauuuaauaa

SEQ ID NO: 2601360 - RNA, 17 nt, Human
uggagaaauuauuuaau

SEQ ID NO: 2601361 - RNA, 15 nt, Human
uggagaaauuauuua

SEQ ID NO: 2601362 - RNA, 11 nt, Human
uggagaaauua

SEQ ID NO: 2601363 - RNA, 23 nt, Human
uggagaaauaaaaauaccucuuu

SEQ ID NO: 2601364 - RNA, 21 nt, Human
uggagaaauaaaaauaccucu

SEQ ID NO: 2601365 - RNA, 15 nt, Human
uggagaaaggaguga

SEQ ID NO: 2601366 - RNA, 22 nt, Human
uggacuucacauaagcucagaa

SEQ ID NO: 2601367 - RNA, 20 nt, Human
uggacuucuuuuacucauga

SEQ ID NO: 2601368 - RNA, 14 nt, Human
uggagaaacccugu

SEQ ID NO: 2601369 - RNA, 16 nt, Human
uggagaaacccugucu

SEQ ID NO: 2601370 - RNA, 18 nt, Human
uggagaaagcacugaccu

SEQ ID NO: 2601371 - RNA, 17 nt, Human
uggagaaagcacugacc

SEQ ID NO: 2601372 - RNA, 19 nt, Human
uggagaaagcacugaccug

SEQ ID NO: 2601373 - RNA, 17 nt, Human
uggagaaacccuugaaa

SEQ ID NO: 2601374 - RNA, 17 nt, Human
uggagaaacuguagucu

SEQ ID NO: 2601375 - RNA, 14 nt, Human
uggagaaagcacug

SEQ ID NO: 2601376 - RNA, 22 nt, Human
uggagaaacuguagucucagga

SEQ ID NO: 2601377 - RNA, 22 nt, Human
aggcagggcucucuuuccuucu

SEQ ID NO: 2601378 - RNA, 20 nt, Human
aggcagggguggggguggag

SEQ ID NO: 2601379 - RNA, 19 nt, Human
aggcaggggugggggugga

SEQ ID NO: 2601380 - RNA, 16 nt, Human
aggcaggggugggggu

SEQ ID NO: 2601381 - RNA, 15 nt, Human
aggcagggguggggg

SEQ ID NO: 2601382 - RNA, 23 nt, Human
aggcagggggaaggugggguccu

SEQ ID NO: 2601383 - RNA, 13 nt, Human
aggcaggggcgga

SEQ ID NO: 2601384 - RNA, 21 nt, Human
aggcaggccaaggccuucucc

SEQ ID NO: 2601385 - RNA, 22 nt, Human
aggcaggccaaggccuucuccu

SEQ ID NO: 2601386 - RNA, 22 nt, Human
aggcaggcauagaggcuucucc

SEQ ID NO: 2601387 - RNA, 22 nt, Human
aggcaggcuaaggcguggagcu

SEQ ID NO: 2601388 - RNA, 18 nt, Human
aggcaggcuaaggcgugg

SEQ ID NO: 2601389 - RNA, 23 nt, Human
aggcaggcuaaggcguggagcug

SEQ ID NO: 2601390 - RNA, 14 nt, Human
aggcaggcuuuguu

SEQ ID NO: 2601391 - RNA, 21 nt, Human
aggcagggccuugcccagaga

SEQ ID NO: 2601392 - RNA, 23 nt, Human
aggcagggccuugcccagagaug

SEQ ID NO: 2601393 - RNA, 22 nt, Human
aggcagggaaaggcucugaaag

SEQ ID NO: 2601394 - RNA, 22 nt, Human
aggcagggccuugcccagagau

SEQ ID NO: 2601395 - RNA, 18 nt, Human
aggcagcuggaugagacu

SEQ ID NO: 2601396 - RNA, 17 nt, Human
aggcagcugccugcucu

SEQ ID NO: 2601397 - RNA, 22 nt, Human
aggcagcuggaugagacuucca

SEQ ID NO: 2601398 - RNA, 12 nt, Human
aggcacagcaca

SEQ ID NO: 2601399 - RNA, 12 nt, Human
aggcacacuucu

SEQ ID NO: 2601400 - RNA, 15 nt, Human
aggcacacuucuucu

SEQ ID NO: 2601401 - RNA, 16 nt, Human
aggcacacuucuucuu

SEQ ID NO: 2601402 - RNA, 20 nt, Human
aggcacacuucuucuugguc

SEQ ID NO: 2601403 - RNA, 23 nt, Human
aggcacacagcugcagagacaga

SEQ ID NO: 2601404 - RNA, 18 nt, Human
aggcacacagcugcagag

SEQ ID NO: 2601405 - RNA, 23 nt, Human
aggcacacacugugcuuucuauu

SEQ ID NO: 2601406 - RNA, 14 nt, Human
aggcacacagcugc

SEQ ID NO: 2601407 - RNA, 19 nt, Human
aggcaggacaugcugaagc

SEQ ID NO: 2601408 - RNA, 14 nt, Human
aggcaggacaugcu

SEQ ID NO: 2601409 - RNA, 20 nt, Human
aggcaggaagggcaggaagg

SEQ ID NO: 2601410 - RNA, 16 nt, Human
aggcaggaagggcagg

SEQ ID NO: 2601411 - RNA, 17 nt, Human
aggcaggaagggcagga

SEQ ID NO: 2601412 - RNA, 15 nt, Human
aggcagcuugaaacu

SEQ ID NO: 2601413 - RNA, 23 nt, Human
aggcagcuuuaaccauuaaaacu

SEQ ID NO: 2601414 - RNA, 22 nt, Human
aggcagcuuuaaccauuaaaac

SEQ ID NO: 2601415 - RNA, 20 nt, Human
aggcagcuuuuucucuccca

SEQ ID NO: 2601416 - RNA, 15 nt, Human
aggcauagaggcuuc

SEQ ID NO: 2601417 - RNA, 22 nt, Human
aggcauaaagucagggguuccc

SEQ ID NO: 2601418 - RNA, 16 nt, Human
aggcauugccaagggc

SEQ ID NO: 2601419 - RNA, 18 nt, Human
aggcauugccaagggcuu

SEQ ID NO: 2601420 - RNA, 20 nt, Human
aggcauugccaagggcuuug

SEQ ID NO: 2601421 - RNA, 21 nt, Human
aggcauugccaagggcuuugu

SEQ ID NO: 2601422 - RNA, 13 nt, Human
aggcauugccaag

SEQ ID NO: 2601423 - RNA, 14 nt, Human
aggcauugccaagg

SEQ ID NO: 2601424 - RNA, 22 nt, Human
aggcauagaggcuucuccgcca

SEQ ID NO: 2601425 - RNA, 13 nt, Human
aggcauaggccug

SEQ ID NO: 2601426 - RNA, 14 nt, Human
aggcauaggccugg

SEQ ID NO: 2601427 - RNA, 15 nt, Human
aggcauaggccuggg

SEQ ID NO: 2601428 - RNA, 20 nt, Human
aggcauuuaggccaugggac

SEQ ID NO: 2601429 - RNA, 18 nt, Human
aggcauugugggaagggg

SEQ ID NO: 2601430 - RNA, 20 nt, Human
aggcauuucuaucacauauu

SEQ ID NO: 2601431 - RNA, 12 nt, Human
aggcauuuccua

SEQ ID NO: 2601432 - RNA, 14 nt, Human
aggcauuguuugag

SEQ ID NO: 2601433 - RNA, 15 nt, Human
aggcauaaagucagg

SEQ ID NO: 2601434 - RNA, 13 nt, Human
aggcaggugccug

SEQ ID NO: 2601435 - RNA, 21 nt, Human
aggcaggugccuccaggugug

SEQ ID NO: 2601436 - RNA, 15 nt, Human
aggcaggugccugga

SEQ ID NO: 2601437 - RNA, 20 nt, Human
aggcaggugccuccaggugu

SEQ ID NO: 2601438 - RNA, 18 nt, Human
aggcaggugccuccaggu

SEQ ID NO: 2601439 - RNA, 17 nt, Human
aggcaggugccuccagg

SEQ ID NO: 2601440 - RNA, 15 nt, Human
aggcaggugccucca

SEQ ID NO: 2601441 - RNA, 14 nt, Human
aggcaggugccucc

SEQ ID NO: 2601442 - RNA, 17 nt, Human
aggcaggugggauggau

SEQ ID NO: 2601443 - RNA, 12 nt, Human
aggcagggucuc

SEQ ID NO: 2601444 - RNA, 23 nt, Human
aggcagggguggggguggaggcu

SEQ ID NO: 2601445 - RNA, 22 nt, Human
aggcagggguggggguggaggc

SEQ ID NO: 2601446 - RNA, 14 nt, Human
aggcagggucagga

SEQ ID NO: 2601447 - RNA, 17 nt, Human
aggcagggucaggagag

SEQ ID NO: 2601448 - RNA, 19 nt, Human
aggcagggucaggagaggg

SEQ ID NO: 2601449 - RNA, 22 nt, Human
aggcaggucuugaacuccuggc

SEQ ID NO: 2601450 - RNA, 20 nt, Human
aggcagggucaggagagggg

SEQ ID NO: 2601451 - RNA, 23 nt, Human
aggcagggucaggagaggggcag

SEQ ID NO: 2601452 - RNA, 21 nt, Human
aggcagggucccauuucucac

SEQ ID NO: 2601453 - RNA, 16 nt, Human
agcuguuuacuaggga

SEQ ID NO: 2601454 - RNA, 22 nt, Human
agcuguuuacuagggaucccuc

SEQ ID NO: 2601455 - RNA, 12 nt, Human
agcuguuuaaga

SEQ ID NO: 2601456 - RNA, 20 nt, Human
agcuguuguacauuuaugau

SEQ ID NO: 2601457 - RNA, 18 nt, Human
agcuguuguacauuuaug

SEQ ID NO: 2601458 - RNA, 15 nt, Human
ugcuacccucccugc

SEQ ID NO: 2601459 - RNA, 14 nt, Human
ugcuacccucccug

SEQ ID NO: 2601460 - RNA, 23 nt, Human
agcuguuguacauuuaugauuua

SEQ ID NO: 2601461 - RNA, 22 nt, Human
agcuguuguacauuuaugauuu

SEQ ID NO: 2601462 - RNA, 23 nt, Human
ugcuacccaugacuuuauaugga

SEQ ID NO: 2601463 - RNA, 13 nt, Human
agcuuaacagugu

SEQ ID NO: 2601464 - RNA, 20 nt, Human
agcuuaaaggggcuagagug

SEQ ID NO: 2601465 - RNA, 19 nt, Human
agcuguuuauuuuauauua

SEQ ID NO: 2601466 - RNA, 16 nt, Human
agcuguuuaagauggg

SEQ ID NO: 2601467 - RNA, 19 nt, Human
agcuguuuauggccucagc

SEQ ID NO: 2601468 - RNA, 20 nt, Human
agcuguuuauggccucagcu

SEQ ID NO: 2601469 - RNA, 21 nt, Human
agcuguuuauggccucagcug

SEQ ID NO: 2601470 - RNA, 17 nt, Human
agcuguuuauggccuca

SEQ ID NO: 2601471 - RNA, 18 nt, Human
agcuguuuauggccucag

SEQ ID NO: 2601472 - RNA, 13 nt, Human
agcuguuuaugca

SEQ ID NO: 2601473 - RNA, 20 nt, Human
ugcuaauuuugaaaaacugc

SEQ ID NO: 2601474 - RNA, 19 nt, Human
ugcuaauuuugaaaaacug

SEQ ID NO: 2601475 - RNA, 18 nt, Human
ugcuaauuuugaaaaacu

SEQ ID NO: 2601476 - RNA, 16 nt, Human
ugcuaauuuugaaaaa

SEQ ID NO: 2601477 - RNA, 14 nt, Human
ugcuacaaaaacac

SEQ ID NO: 2601478 - RNA, 15 nt, Human
ugcuacaaaaacaca

SEQ ID NO: 2601479 - RNA, 11 nt, Human
ugcuacacacu

SEQ ID NO: 2601480 - RNA, 13 nt, Human
ugcuaccaaagca

SEQ ID NO: 2601481 - RNA, 14 nt, Human
ugcuacacaguaua

SEQ ID NO: 2601482 - RNA, 15 nt, Human
ugccuuuugcacccc

SEQ ID NO: 2601483 - RNA, 14 nt, Human
ugccuuuugcaccc

SEQ ID NO: 2601484 - RNA, 15 nt, Human
ugccuuuucuagccc

SEQ ID NO: 2601485 - RNA, 19 nt, Human
ugccuuuucccaacuccag

SEQ ID NO: 2601486 - RNA, 17 nt, Human
ugccuuuucccaacucc

SEQ ID NO: 2601487 - RNA, 21 nt, Human
ugccuuggggaauuuccucua

SEQ ID NO: 2601488 - RNA, 20 nt, Human
ugccuuggggaauuuccucu

SEQ ID NO: 2601489 - RNA, 16 nt, Human
ugccuuggugugcugu

SEQ ID NO: 2601490 - RNA, 22 nt, Human
ugccuuuugcaccccucccauu

SEQ ID NO: 2601491 - RNA, 20 nt, Human
ugccuuuugcaccccuccca

SEQ ID NO: 2601492 - RNA, 19 nt, Human
ugccuuuugcaccccuccc

SEQ ID NO: 2601493 - RNA, 18 nt, Human
ugccuuuugcaccccucc

SEQ ID NO: 2601494 - RNA, 17 nt, Human
ugccuuuugcaccccuc

SEQ ID NO: 2601495 - RNA, 21 nt, Human
ugccuuuugcaccccucccau

SEQ ID NO: 2601496 - RNA, 15 nt, Human
ugcgguagccagcac

SEQ ID NO: 2601497 - RNA, 16 nt, Human
ugcgguagccagcaca

SEQ ID NO: 2601498 - RNA, 17 nt, Human
ugcgguagccagcacac

SEQ ID NO: 2601499 - RNA, 15 nt, Human
ugcgguccacccagg

SEQ ID NO: 2601500 - RNA, 14 nt, Human
ugcgguccacccag

SEQ ID NO: 2601501 - RNA, 16 nt, Human
ugcuaagugugaacug

SEQ ID NO: 2601502 - RNA, 15 nt, Human
ugcuaagugugaacu

SEQ ID NO: 2601503 - RNA, 14 nt, Human
ugcuaagugugaac

SEQ ID NO: 2601504 - RNA, 13 nt, Human
ugcuaagugugaa

SEQ ID NO: 2601505 - RNA, 17 nt, Human
ugcgguauccgccccca

SEQ ID NO: 2601506 - RNA, 17 nt, Human
ugcggguuugaggauag

SEQ ID NO: 2601507 - RNA, 18 nt, Human
ugcgguagccagcacaca

SEQ ID NO: 2601508 - RNA, 18 nt, Human
ugcuaaguauuucccagc

SEQ ID NO: 2601509 - RNA, 17 nt, Human
ugcuaaguauuucccag

SEQ ID NO: 2601510 - RNA, 14 nt, Human
ugcuaaucaguguc

SEQ ID NO: 2601511 - RNA, 13 nt, Human
ugcuaaucagugu

SEQ ID NO: 2601512 - RNA, 23 nt, Human
ugcuaaucagggaggucauuuug

SEQ ID NO: 2601513 - RNA, 22 nt, Human
ugcuaaucagggaggucauuuu

SEQ ID NO: 2601514 - RNA, 19 nt, Human
ugcuaagugugaacuggac

SEQ ID NO: 2601515 - RNA, 17 nt, Human
ugcuaagugugaacugg

SEQ ID NO: 2601516 - RNA, 21 nt, Human
ugcuaauauaaguuucuuugc

SEQ ID NO: 2601517 - RNA, 12 nt, Human
ugcuaauaaaac

SEQ ID NO: 2601518 - RNA, 18 nt, Human
ugcuaauuuauccugaaa

SEQ ID NO: 2601519 - RNA, 20 nt, Human
ugcuaaucuucuuaugcaau

SEQ ID NO: 2601520 - RNA, 22 nt, Human
ugcuaaucuucuuaugcaauuu

SEQ ID NO: 2601521 - RNA, 13 nt, Human
ugcuaaucuucuu

SEQ ID NO: 2601522 - RNA, 17 nt, Human
ugcuaaucuucagggca

SEQ ID NO: 2601523 - RNA, 19 nt, Human
ugcuaaucagugucucaca

SEQ ID NO: 2601524 - RNA, 12 nt, Human
agcuuguguauc

SEQ ID NO: 2601525 - RNA, 20 nt, Human
agcuuguguauccauuauca

SEQ ID NO: 2601526 - RNA, 17 nt, Human
agcuuguucccugucuu

SEQ ID NO: 2601527 - RNA, 16 nt, Human
agcuuguuauuuauaa

SEQ ID NO: 2601528 - RNA, 18 nt, Human
agcuuguggagccccaca

SEQ ID NO: 2601529 - RNA, 17 nt, Human
agcuuguggagccccac

SEQ ID NO: 2601530 - RNA, 14 nt, Human
agcuuguggagccc

SEQ ID NO: 2601531 - RNA, 19 nt, Human
agcuugugcacaauucugu

SEQ ID NO: 2601532 - RNA, 23 nt, Human
agcuuguccaacccgaggcccgc

SEQ ID NO: 2601533 - RNA, 22 nt, Human
agcuuguauuuugugaagacug

SEQ ID NO: 2601534 - RNA, 22 nt, Human
agcuugucuaugguacaaaaau

SEQ ID NO: 2601535 - RNA, 19 nt, Human
agcuugcucuucaguggga

SEQ ID NO: 2601536 - RNA, 22 nt, Human
agcuugcucuucagugggagaa

SEQ ID NO: 2601537 - RNA, 16 nt, Human
agcuugcugcccuagg

SEQ ID NO: 2601538 - RNA, 21 nt, Human
agcuuguauaguguaaaauaa

SEQ ID NO: 2601539 - RNA, 18 nt, Human
agcuuguauaguguaaaa

SEQ ID NO: 2601540 - RNA, 12 nt, Human
agcuuguauuuu

SEQ ID NO: 2601541 - RNA, 20 nt, Human
agcuuguauaguguaaaaua

SEQ ID NO: 2601542 - RNA, 22 nt, Human
agcuuguccaacccgaggcccg

SEQ ID NO: 2601543 - RNA, 16 nt, Human
agcuugcccuguuaaa

SEQ ID NO: 2601544 - RNA, 18 nt, Human
agcuugcccuguuaaaag

SEQ ID NO: 2601545 - RNA, 19 nt, Human
agcuugcccuguuaaaaga

SEQ ID NO: 2601546 - RNA, 22 nt, Human
agcuugcgcauucucauggaga

SEQ ID NO: 2601547 - RNA, 21 nt, Human
agcuugcgcauucucauggag

SEQ ID NO: 2601548 - RNA, 23 nt, Human
agcuugcgcauucucauggagaa

SEQ ID NO: 2601549 - RNA, 23 nt, Human
agcuugcguuagaaugaggagga

SEQ ID NO: 2601550 - RNA, 17 nt, Human
agcuugcucacaucuug

SEQ ID NO: 2601551 - RNA, 15 nt, Human
agcuugcucacaucu

SEQ ID NO: 2601552 - RNA, 14 nt, Human
agcuugcucuucag

SEQ ID NO: 2601553 - RNA, 23 nt, Human
agcuugaccgugaggccagagac

SEQ ID NO: 2601554 - RNA, 16 nt, Human
agcuugaccugaggcu

SEQ ID NO: 2601555 - RNA, 14 nt, Human
agcuugaccugagg

SEQ ID NO: 2601556 - RNA, 22 nt, Human
agcuugaggguugggcuggugu

SEQ ID NO: 2601557 - RNA, 20 nt, Human
agcuugcccuggugccucac

SEQ ID NO: 2601558 - RNA, 18 nt, Human
agcuugccccggccccgg

SEQ ID NO: 2601559 - RNA, 14 nt, Human
agcuugccccggcc

SEQ ID NO: 2601560 - RNA, 18 nt, Human
agcuugauaaagggccaa

SEQ ID NO: 2601561 - RNA, 22 nt, Human
agcuugaccgugaggccagaga

SEQ ID NO: 2601562 - RNA, 20 nt, Human
agcuugaccgugaggccaga

SEQ ID NO: 2601563 - RNA, 17 nt, Human
agcuuacaagccagcug

SEQ ID NO: 2601564 - RNA, 15 nt, Human
agcuuacaagccagc

SEQ ID NO: 2601565 - RNA, 15 nt, Human
agcuuucaauuccgu

SEQ ID NO: 2601566 - RNA, 20 nt, Human
agcuuuccauguugcugcca

SEQ ID NO: 2601567 - RNA, 19 nt, Human
agcuuuccauguugcugcc

SEQ ID NO: 2601568 - RNA, 21 nt, Human
agcuuucccaaauaaacucua

SEQ ID NO: 2601569 - RNA, 17 nt, Human
agcuuuccauguugcug

SEQ ID NO: 2601570 - RNA, 16 nt, Human
agcuuuccauguugcu

SEQ ID NO: 2601571 - RNA, 22 nt, Human
agcuuucauguaaacugugcac

SEQ ID NO: 2601572 - RNA, 15 nt, Human
agcuuuccugcccca

SEQ ID NO: 2601573 - RNA, 14 nt, Human
agcuuuccugcccc

SEQ ID NO: 2601574 - RNA, 13 nt, Human
agcuuuccugccc

SEQ ID NO: 2601575 - RNA, 12 nt, Human
agcuuuccugcc

SEQ ID NO: 2601576 - RNA, 12 nt, Human
agcuuucccugc

SEQ ID NO: 2601577 - RNA, 16 nt, Human
agcuuucccugccucu

SEQ ID NO: 2601578 - RNA, 22 nt, Human
agcuuuccccaugucucgacuc

SEQ ID NO: 2601579 - RNA, 22 nt, Human
agcuuugcccaacaccagcccc

SEQ ID NO: 2601580 - RNA, 15 nt, Human
agcuuugcccaacac

SEQ ID NO: 2601581 - RNA, 20 nt, Human
agcuuugccagcugcugcug

SEQ ID NO: 2601582 - RNA, 19 nt, Human
agcuuugccagcugcugcu

SEQ ID NO: 2601583 - RNA, 17 nt, Human
agcuuugccagcugcug

SEQ ID NO: 2601584 - RNA, 16 nt, Human
agcuuugccagcugcu

SEQ ID NO: 2601585 - RNA, 22 nt, Human
agcuuugcauguuccacuaacc

SEQ ID NO: 2601586 - RNA, 18 nt, Human
agcuuugcauguuccacu

SEQ ID NO: 2601587 - RNA, 10 nt, Human
agcuuugcua

SEQ ID NO: 2601588 - RNA, 16 nt, Human
agcuuugcuaccaaag

SEQ ID NO: 2601589 - RNA, 21 nt, Human
agcuuugcuaccaaagcaccu

SEQ ID NO: 2601590 - RNA, 10 nt, Human
agcuuugcuc

SEQ ID NO: 2601591 - RNA, 22 nt, Human
agcuuuccugccccaggccuga

SEQ ID NO: 2601592 - RNA, 21 nt, Human
agcuuuccugccccaggccug

SEQ ID NO: 2601593 - RNA, 20 nt, Human
agcuuuccugccccaggccu

SEQ ID NO: 2601594 - RNA, 22 nt, Human
agcuuugagguggaagagggcu

SEQ ID NO: 2601595 - RNA, 15 nt, Human
agcuuugauuuuuac

SEQ ID NO: 2601596 - RNA, 20 nt, Human
agcuuuggcuaugagggccu

SEQ ID NO: 2601597 - RNA, 19 nt, Human
agcuuuggaccuaauccaa

SEQ ID NO: 2601598 - RNA, 18 nt, Human
agcuuuggaccuaaucca

SEQ ID NO: 2601599 - RNA, 16 nt, Human
agcuuuggaaacagga

SEQ ID NO: 2601600 - RNA, 18 nt, Human
agcuuugcucuuugguag

SEQ ID NO: 2601601 - RNA, 21 nt, Human
agcuuugcucuuugguagaaa

SEQ ID NO: 2601602 - RNA, 13 nt, Human
agcuuugcugcua

SEQ ID NO: 2601603 - RNA, 12 nt, Human
agcuuugcugcu

SEQ ID NO: 2601604 - RNA, 23 nt, Human
agcuuugcucuuugguagaaaag

SEQ ID NO: 2601605 - RNA, 13 nt, Human
agcuuugcugcug

SEQ ID NO: 2601606 - RNA, 22 nt, Human
agcuuugcugcugaaggcucau

SEQ ID NO: 2601607 - RNA, 20 nt, Human
agcuuugcuucucucucuaa

SEQ ID NO: 2601608 - RNA, 17 nt, Human
agcuuuggugcaauggc

SEQ ID NO: 2601609 - RNA, 21 nt, Human
agcuuuggcuaugagggccuu

SEQ ID NO: 2601610 - RNA, 13 nt, Human
aggaaaagaaaag

SEQ ID NO: 2601611 - RNA, 14 nt, Human
aggaaaagcugcug

SEQ ID NO: 2601612 - RNA, 15 nt, Human
aggaaaagccucugu

SEQ ID NO: 2601613 - RNA, 14 nt, Human
aggaaaagccucug

SEQ ID NO: 2601614 - RNA, 16 nt, Human
aggaaaagcaaauuga

SEQ ID NO: 2601615 - RNA, 19 nt, Human
aggaaaagccucuguguca

SEQ ID NO: 2601616 - RNA, 17 nt, Human
aggaaaagccucugugu

SEQ ID NO: 2601617 - RNA, 20 nt, Human
aggaaaagcggacaucagcu

SEQ ID NO: 2601618 - RNA, 18 nt, Human
ugcucuuagcugucugcu

SEQ ID NO: 2601619 - RNA, 14 nt, Human
ugcucuucaagaaa

SEQ ID NO: 2601620 - RNA, 22 nt, Human
ugcucugcgugucaccugugcu

SEQ ID NO: 2601621 - RNA, 23 nt, Human
ugcucugcgugucaccugugcuu

SEQ ID NO: 2601622 - RNA, 15 nt, Human
ugcucuuagcugucu

SEQ ID NO: 2601623 - RNA, 15 nt, Human
ugcucugcugacaga

SEQ ID NO: 2601624 - RNA, 14 nt, Human
ugcucugcugacag

SEQ ID NO: 2601625 - RNA, 15 nt, Human
ugcugagaaaacaug

SEQ ID NO: 2601626 - RNA, 14 nt, Human
ugcugagaagcuuu

SEQ ID NO: 2601627 - RNA, 14 nt, Human
ugcucuucuuuaga

SEQ ID NO: 2601628 - RNA, 23 nt, Human
ugcucuucuguggaccacugcau

SEQ ID NO: 2601629 - RNA, 20 nt, Human
ugcucuugaacuccugaccu

SEQ ID NO: 2601630 - RNA, 22 nt, Human
ugcucuugaacuccugaccuca

SEQ ID NO: 2601631 - RNA, 15 nt, Human
ugcucuugaacuccu

SEQ ID NO: 2601632 - RNA, 13 nt, Human
ugcucuucugugg

SEQ ID NO: 2601633 - RNA, 13 nt, Human
ugcucuucagugg

SEQ ID NO: 2601634 - RNA, 12 nt, Human
ugcucugcccuu

SEQ ID NO: 2601635 - RNA, 11 nt, Human
ugcucugcccu

SEQ ID NO: 2601636 - RNA, 20 nt, Human
ugcucugaggcuuccagaga

SEQ ID NO: 2601637 - RNA, 18 nt, Human
ugcucugaggcuuccaga

SEQ ID NO: 2601638 - RNA, 17 nt, Human
ugcucugaggcuuccag

SEQ ID NO: 2601639 - RNA, 16 nt, Human
ugcucugaggcuucca

SEQ ID NO: 2601640 - RNA, 13 nt, Human
ugcucucugccac

SEQ ID NO: 2601641 - RNA, 22 nt, Human
ugcucugaauuaguccuugcuu

SEQ ID NO: 2601642 - RNA, 17 nt, Human
ugcucucugcagccagc

SEQ ID NO: 2601643 - RNA, 20 nt, Human
ugcucucugcagccagccca

SEQ ID NO: 2601644 - RNA, 12 nt, Human
ugcucucugcca

SEQ ID NO: 2601645 - RNA, 21 nt, Human
ugcucucugcagccagcccag

SEQ ID NO: 2601646 - RNA, 22 nt, Human
ugcucucgcaccuuuccaaagu

SEQ ID NO: 2601647 - RNA, 13 nt, Human
ugcucucugcagc

SEQ ID NO: 2601648 - RNA, 14 nt, Human
ugcucucugcagcc

SEQ ID NO: 2601649 - RNA, 15 nt, Human
ugcucucugcagcca

SEQ ID NO: 2601650 - RNA, 19 nt, Human
ugcucucgcaccuuuccaa

SEQ ID NO: 2601651 - RNA, 12 nt, Human
ugcucuccuuuc

SEQ ID NO: 2601652 - RNA, 14 nt, Human
ugcuccaggcaggc

SEQ ID NO: 2601653 - RNA, 12 nt, Human
ugcuccaggcag

SEQ ID NO: 2601654 - RNA, 23 nt, Human
ugcuccagucaacaaacuauuuc

SEQ ID NO: 2601655 - RNA, 22 nt, Human
ugcuccaggcaggcuaaggcgu

SEQ ID NO: 2601656 - RNA, 20 nt, Human
ugcuccagcuguucagcugg

SEQ ID NO: 2601657 - RNA, 21 nt, Human
ugcuccagcuguucagcuggu

SEQ ID NO: 2601658 - RNA, 19 nt, Human
ugcuaugagcuggggaugu

SEQ ID NO: 2601659 - RNA, 20 nt, Human
ugcuaugagcuggggauguc

SEQ ID NO: 2601660 - RNA, 16 nt, Human
ugcuaugagcugggga

SEQ ID NO: 2601661 - RNA, 18 nt, Human
ugcuaucucccccagccc

SEQ ID NO: 2601662 - RNA, 16 nt, Human
ugcuauggauggcuuc

SEQ ID NO: 2601663 - RNA, 12 nt, Human
ugcuauggggag

SEQ ID NO: 2601664 - RNA, 18 nt, Human
ugcuauggggagaaaaga

SEQ ID NO: 2601665 - RNA, 19 nt, Human
ugcuauggggagaaaagac

SEQ ID NO: 2601666 - RNA, 22 nt, Human
ugcuaugagcuggggaugucuc

SEQ ID NO: 2601667 - RNA, 20 nt, Human
aggaaaccacagcugcugga

SEQ ID NO: 2601668 - RNA, 13 nt, Human
ugcuaugaaugau

SEQ ID NO: 2601669 - RNA, 18 nt, Human
ugcucaaaucuauucaga

SEQ ID NO: 2601670 - RNA, 19 nt, Human
ugcucaaaauuugaagaau

SEQ ID NO: 2601671 - RNA, 21 nt, Human
ugcucaaaauuugaagaauga

SEQ ID NO: 2601672 - RNA, 18 nt, Human
ugcucaaaauuugaagaa

SEQ ID NO: 2601673 - RNA, 14 nt, Human
ugcucaaaauuuga

SEQ ID NO: 2601674 - RNA, 21 nt, Human
ugcucaaaucuauucagacaa

SEQ ID NO: 2601675 - RNA, 19 nt, Human
ugcucaaaucuauucagac

SEQ ID NO: 2601676 - RNA, 14 nt, Human
ugcucaagaaacaa

SEQ ID NO: 2601677 - RNA, 15 nt, Human
ugcucaaaaaucugu

SEQ ID NO: 2601678 - RNA, 15 nt, Human
ugcucaaaaaaugag

SEQ ID NO: 2601679 - RNA, 17 nt, Human
ugcuaucucccccagcc

SEQ ID NO: 2601680 - RNA, 14 nt, Human
ugcuaucuccccca

SEQ ID NO: 2601681 - RNA, 17 nt, Human
aggaaaccacagcugcu

SEQ ID NO: 2601682 - RNA, 16 nt, Human
aggaaaccacagcugc

SEQ ID NO: 2601683 - RNA, 22 nt, Human
ugcuaucgcaccacuguguauu

SEQ ID NO: 2601684 - RNA, 13 nt, Human
ugcuaucuccccc

SEQ ID NO: 2601685 - RNA, 16 nt, Human
aggaaaagcugcugac

SEQ ID NO: 2601686 - RNA, 15 nt, Human
aggaaaaugaucuga

SEQ ID NO: 2601687 - RNA, 14 nt, Human
aggaaaaugaauaa

SEQ ID NO: 2601688 - RNA, 13 nt, Human
aggaaaauuucac

SEQ ID NO: 2601689 - RNA, 12 nt, Human
aggaaacaguua

SEQ ID NO: 2601690 - RNA, 21 nt, Human
aggaaacaaagcuuagcagga

SEQ ID NO: 2601691 - RNA, 14 nt, Human
aggaaacaacagcu

SEQ ID NO: 2601692 - RNA, 15 nt, Human
aggaaacaacagcuu

SEQ ID NO: 2601693 - RNA, 20 nt, Human
aggaaaucaaauaugcaaag

SEQ ID NO: 2601694 - RNA, 14 nt, Human
aggaaauaaaaccu

SEQ ID NO: 2601695 - RNA, 20 nt, Human
aggaaagucauuggcuuuau

SEQ ID NO: 2601696 - RNA, 19 nt, Human
aggaaagucauuggcuuua

SEQ ID NO: 2601697 - RNA, 17 nt, Human
aggaaagucauuggcuu

SEQ ID NO: 2601698 - RNA, 16 nt, Human
aggaaagucauuggcu

SEQ ID NO: 2601699 - RNA, 23 nt, Human
aggaaagucauuggcuuuauccu

SEQ ID NO: 2601700 - RNA, 22 nt, Human
aggaaagucauuggcuuuaucc

SEQ ID NO: 2601701 - RNA, 21 nt, Human
aggaaaucaaauaugcaaagc

SEQ ID NO: 2601702 - RNA, 22 nt, Human
aggaaaucaaauaugcaaagca

SEQ ID NO: 2601703 - RNA, 16 nt, Human
aggaaauaaaaccuuu

SEQ ID NO: 2601704 - RNA, 23 nt, Human
aggaagagcaggcacauggagga

SEQ ID NO: 2601705 - RNA, 21 nt, Human
aggaagaguagcauuucauuc

SEQ ID NO: 2601706 - RNA, 14 nt, Human
aggaagagggacag

SEQ ID NO: 2601707 - RNA, 16 nt, Human
ugcugaggccugggcc

SEQ ID NO: 2601708 - RNA, 15 nt, Human
ugcugaggccugggc

SEQ ID NO: 2601709 - RNA, 14 nt, Human
ugcugaggccuggg

SEQ ID NO: 2601710 - RNA, 13 nt, Human
ugcugaggccugg

SEQ ID NO: 2601711 - RNA, 16 nt, Human
ugcugaggcucugacc

SEQ ID NO: 2601712 - RNA, 17 nt, Human
ugcugaggccuccagcu

SEQ ID NO: 2601713 - RNA, 17 nt, Human
ugcugaggccugggccg

SEQ ID NO: 2601714 - RNA, 23 nt, Human
aggaaaggcuccaggagcagcca

SEQ ID NO: 2601715 - RNA, 13 nt, Human
aggaaagucauug

SEQ ID NO: 2601716 - RNA, 21 nt, Human
aggaaagggggucccaguggg

SEQ ID NO: 2601717 - RNA, 19 nt, Human
aggaaagggggucccagug

SEQ ID NO: 2601718 - RNA, 13 nt, Human
aggaaagggaagg

SEQ ID NO: 2601719 - RNA, 23 nt, Human
ugcugagccuguaaaauaaaagg

SEQ ID NO: 2601720 - RNA, 20 nt, Human
ugcugagccucugcucccca

SEQ ID NO: 2601721 - RNA, 16 nt, Human
ugcugagccucugcuc

SEQ ID NO: 2601722 - RNA, 17 nt, Human
ugcugagccucugcucc

SEQ ID NO: 2601723 - RNA, 12 nt, Human
ugcugagccucu

SEQ ID NO: 2601724 - RNA, 14 nt, Human
ugcugagccucugc

SEQ ID NO: 2601725 - RNA, 14 nt, Human
ugcugagagaaaua

SEQ ID NO: 2601726 - RNA, 17 nt, Human
ugcugagaagcuuuuga

SEQ ID NO: 2601727 - RNA, 23 nt, Human
ugcugagagaaauauggaacuua

SEQ ID NO: 2601728 - RNA, 15 nt, Human
ugcugagagacccaa

SEQ ID NO: 2601729 - RNA, 17 nt, Human
ugcugagagacccaagg

SEQ ID NO: 2601730 - RNA, 18 nt, Human
ugcugagagacccaagga

SEQ ID NO: 2601731 - RNA, 21 nt, Human
ugcugagagacccaaggagga

SEQ ID NO: 2601732 - RNA, 20 nt, Human
ugcugagauuacagguguga

SEQ ID NO: 2601733 - RNA, 22 nt, Human
ugcugagagacccaaggaggaa

SEQ ID NO: 2601734 - RNA, 21 nt, Human
aggaaggcucuucuccccaga

SEQ ID NO: 2601735 - RNA, 20 nt, Human
aggaaggcucuucuccccag

SEQ ID NO: 2601736 - RNA, 13 nt, Human
aggaaggcggggc

SEQ ID NO: 2601737 - RNA, 19 nt, Human
aggaaggcaggaagagagc

SEQ ID NO: 2601738 - RNA, 16 nt, Human
aggaauguguggccug

SEQ ID NO: 2601739 - RNA, 14 nt, Human
aggaauguuaaagu

SEQ ID NO: 2601740 - RNA, 20 nt, Human
aggaaugggggccucuucaa

SEQ ID NO: 2601741 - RNA, 13 nt, Human
aggaaugggcugu

SEQ ID NO: 2601742 - RNA, 21 nt, Human
aggaaugggggccucuucaaa

SEQ ID NO: 2601743 - RNA, 18 nt, Human
aggaauguagcugguuuc

SEQ ID NO: 2601744 - RNA, 17 nt, Human
aggaauuaaguuaucuu

SEQ ID NO: 2601745 - RNA, 22 nt, Human
aggaauucccagcccaaagcug

SEQ ID NO: 2601746 - RNA, 22 nt, Human
aggaauguuaaagucaguggga

SEQ ID NO: 2601747 - RNA, 23 nt, Human
aggaauuaaguuagggaauggca

SEQ ID NO: 2601748 - RNA, 13 nt, Human
aggaaggcaagag

SEQ ID NO: 2601749 - RNA, 18 nt, Human
aggaaggauuguaaaaaa

SEQ ID NO: 2601750 - RNA, 17 nt, Human
aggaaggauuguaaaaa

SEQ ID NO: 2601751 - RNA, 16 nt, Human
aggaaggauuguaaaa

SEQ ID NO: 2601752 - RNA, 17 nt, Human
aggaaggcaggaagaga

SEQ ID NO: 2601753 - RNA, 15 nt, Human
aggaaggcaggaaga

SEQ ID NO: 2601754 - RNA, 14 nt, Human
aggaaggcaagagg

SEQ ID NO: 2601755 - RNA, 15 nt, Human
aggaaggauuguaaa

SEQ ID NO: 2601756 - RNA, 14 nt, Human
aggaaggauuguaa

SEQ ID NO: 2601757 - RNA, 14 nt, Human
aggaaggaugagca

SEQ ID NO: 2601758 - RNA, 17 nt, Human
aggaaggaugagcauuu

SEQ ID NO: 2601759 - RNA, 18 nt, Human
aggaagccacagcuggug

SEQ ID NO: 2601760 - RNA, 15 nt, Human
aggaagcucagggcc

SEQ ID NO: 2601761 - RNA, 16 nt, Human
aggaagcucagggccu

SEQ ID NO: 2601762 - RNA, 16 nt, Human
aggaagccacagcugg

SEQ ID NO: 2601763 - RNA, 15 nt, Human
aggaagccacagcug

SEQ ID NO: 2601764 - RNA, 14 nt, Human
aggaagcucagggc

SEQ ID NO: 2601765 - RNA, 13 nt, Human
aggaagcucaggg

SEQ ID NO: 2601766 - RNA, 15 nt, Human
aggaagccaaagagu

SEQ ID NO: 2601767 - RNA, 13 nt, Human
aggaagccagcag

SEQ ID NO: 2601768 - RNA, 18 nt, Human
aggaagcagcuuucccca

SEQ ID NO: 2601769 - RNA, 19 nt, Human
aggaagcauucagagagca

SEQ ID NO: 2601770 - RNA, 18 nt, Human
aggaagcauucagagagc

SEQ ID NO: 2601771 - RNA, 22 nt, Human
aggaagaugggggcaagaagau

SEQ ID NO: 2601772 - RNA, 13 nt, Human
aggaagcaacgaa

SEQ ID NO: 2601773 - RNA, 23 nt, Human
aggaagcagaauaaagcaauuuu

SEQ ID NO: 2601774 - RNA, 22 nt, Human
aggaagcagaauaaagcaauuu

SEQ ID NO: 2601775 - RNA, 21 nt, Human
aggaagcagaauaaagcaauu

SEQ ID NO: 2601776 - RNA, 18 nt, Human
aggaagaugggggcaaga

SEQ ID NO: 2601777 - RNA, 17 nt, Human
aggaagaugaaagagga

SEQ ID NO: 2601778 - RNA, 15 nt, Human
aggaagaugaaagag

SEQ ID NO: 2601779 - RNA, 18 nt, Human
aggaagaucuuaaauuuu

SEQ ID NO: 2601780 - RNA, 20 nt, Human
aggaagaugggggcaagaag

SEQ ID NO: 2601781 - RNA, 19 nt, Human
aggaagaugggggcaagaa

SEQ ID NO: 2601782 - RNA, 16 nt, Human
aggaagcaaacuaagc

SEQ ID NO: 2601783 - RNA, 16 nt, Human
aggaagaucuuaaauu

SEQ ID NO: 2601784 - RNA, 23 nt, Human
agcucuguccugggagugagcug

SEQ ID NO: 2601785 - RNA, 14 nt, Human
agcugcaaaggaca

SEQ ID NO: 2601786 - RNA, 15 nt, Human
agcugcaaaggacag

SEQ ID NO: 2601787 - RNA, 16 nt, Human
agcugcaaaggacaga

SEQ ID NO: 2601788 - RNA, 19 nt, Human
agcugcaaaggacagaucc

SEQ ID NO: 2601789 - RNA, 13 nt, Human
agcugcaaaggac

SEQ ID NO: 2601790 - RNA, 20 nt, Human
agcugauuuuaacaauaacu

SEQ ID NO: 2601791 - RNA, 21 nt, Human
agcucuguccugggagugagc

SEQ ID NO: 2601792 - RNA, 16 nt, Human
agcucuguccugggag

SEQ ID NO: 2601793 - RNA, 24 nt, Human
agcugcacagggcagcugggccca

SEQ ID NO: 2601794 - RNA, 23 nt, Human
agcugcacagggcagcugggccc

SEQ ID NO: 2601795 - RNA, 22 nt, Human
agcugcacagggcagcugggcc

SEQ ID NO: 2601796 - RNA, 21 nt, Human
agcugcacagggcagcugggc

SEQ ID NO: 2601797 - RNA, 20 nt, Human
agcugcacagggcagcuggg

SEQ ID NO: 2601798 - RNA, 19 nt, Human
agcugcacagggcagcugg

SEQ ID NO: 2601799 - RNA, 15 nt, Human
agcugcacagggcag

SEQ ID NO: 2601800 - RNA, 17 nt, Human
agcugcacugaugcugc

SEQ ID NO: 2601801 - RNA, 19 nt, Human
agcugcacugaugcugccc

SEQ ID NO: 2601802 - RNA, 11 nt, Human
agcugcacuga

SEQ ID NO: 2601803 - RNA, 21 nt, Human
agcugcaagugacaucucuuu

SEQ ID NO: 2601804 - RNA, 19 nt, Human
agcugauuuuaacaauaac

SEQ ID NO: 2601805 - RNA, 15 nt, Human
agcugcaagugacau

SEQ ID NO: 2601806 - RNA, 18 nt, Human
agcugcaagugacaucuc

SEQ ID NO: 2601807 - RNA, 20 nt, Human
agcugccagccgagauagcc

SEQ ID NO: 2601808 - RNA, 14 nt, Human
agcugccagccgag

SEQ ID NO: 2601809 - RNA, 13 nt, Human
agcugcagagcca

SEQ ID NO: 2601810 - RNA, 19 nt, Human
agcugcagagacagagagg

SEQ ID NO: 2601811 - RNA, 18 nt, Human
agcugcagagacagagag

SEQ ID NO: 2601812 - RNA, 17 nt, Human
agcugcagagacagaga

SEQ ID NO: 2601813 - RNA, 20 nt, Human
agcugcacugaugcugcccc

SEQ ID NO: 2601814 - RNA, 22 nt, Human
agcugcacugaugcugccccuc

SEQ ID NO: 2601815 - RNA, 15 nt, Human
agcugcagagacaga

SEQ ID NO: 2601816 - RNA, 11 nt, Human
agcugcagaac

SEQ ID NO: 2601817 - RNA, 11 nt, Human
agcugcccucc

SEQ ID NO: 2601818 - RNA, 14 nt, Human
agcugccccuggcu

SEQ ID NO: 2601819 - RNA, 20 nt, Human
agcugccccggggaggggcg

SEQ ID NO: 2601820 - RNA, 18 nt, Human
agcugcccagaguugcug

SEQ ID NO: 2601821 - RNA, 14 nt, Human
agcugcccagaguu

SEQ ID NO: 2601822 - RNA, 15 nt, Human
agcugccccagccag

SEQ ID NO: 2601823 - RNA, 14 nt, Human
agcugccccagcca

SEQ ID NO: 2601824 - RNA, 16 nt, Human
agcugccccagccaga

SEQ ID NO: 2601825 - RNA, 17 nt, Human
agcugccauccagggau

SEQ ID NO: 2601826 - RNA, 16 nt, Human
agcugcagagccaccc

SEQ ID NO: 2601827 - RNA, 20 nt, Human
ugcccuguuaaaagaugaaa

SEQ ID NO: 2601828 - RNA, 19 nt, Human
ugcccuguucucuaccaag

SEQ ID NO: 2601829 - RNA, 17 nt, Human
ugcccuguucucuacca

SEQ ID NO: 2601830 - RNA, 22 nt, Human
agcugcccuccuuguccaccca

SEQ ID NO: 2601831 - RNA, 18 nt, Human
ugcccuuaccugccagga

SEQ ID NO: 2601832 - RNA, 22 nt, Human
ugccgaaugugcagguuuguua

SEQ ID NO: 2601833 - RNA, 20 nt, Human
ugcccuguuguguauagaug

SEQ ID NO: 2601834 - RNA, 19 nt, Human
ugcccuguuguguauagau

SEQ ID NO: 2601835 - RNA, 15 nt, Human
ugcccuuaaaucaua

SEQ ID NO: 2601836 - RNA, 20 nt, Human
ugcccuuacacuuacuguug

SEQ ID NO: 2601837 - RNA, 18 nt, Human
ugcccuuacacuuacugu

SEQ ID NO: 2601838 - RNA, 15 nt, Human
ugccgacagaaggaa

SEQ ID NO: 2601839 - RNA, 15 nt, Human
ugccgaccagagccc

SEQ ID NO: 2601840 - RNA, 21 nt, Human
ugccgaccagagccccacacg

SEQ ID NO: 2601841 - RNA, 22 nt, Human
ugccgaccagagccccacacgg

SEQ ID NO: 2601842 - RNA, 15 nt, Human
ugccgaccgaggcug

SEQ ID NO: 2601843 - RNA, 16 nt, Human
ugccgaccgaggcugg

SEQ ID NO: 2601844 - RNA, 22 nt, Human
ugccgaccgaggcuggagcugg

SEQ ID NO: 2601845 - RNA, 23 nt, Human
ugccgaccgaggcuggagcuggc

SEQ ID NO: 2601846 - RNA, 14 nt, Human
ugccgaccucgucc

SEQ ID NO: 2601847 - RNA, 15 nt, Human
ugccgaccucguccu

SEQ ID NO: 2601848 - RNA, 17 nt, Human
ugccgaccucguccucc

SEQ ID NO: 2601849 - RNA, 21 nt, Human
ugccgaccucguccucccccu

SEQ ID NO: 2601850 - RNA, 21 nt, Human
ugccgauauacucuagaugaa

SEQ ID NO: 2601851 - RNA, 15 nt, Human
ugccgacuccugggu

SEQ ID NO: 2601852 - RNA, 14 nt, Human
ugccgacuccuggg

SEQ ID NO: 2601853 - RNA, 22 nt, Human
ugccgaccucguccucccccug

SEQ ID NO: 2601854 - RNA, 17 nt, Human
ugccgcagagcuggccg

SEQ ID NO: 2601855 - RNA, 15 nt, Human
ugccgcagagcuggc

SEQ ID NO: 2601856 - RNA, 14 nt, Human
ugccgcagagcugg

SEQ ID NO: 2601857 - RNA, 13 nt, Human
ugccgcagagcug

SEQ ID NO: 2601858 - RNA, 17 nt, Human
ugccgcaauacaggaac

SEQ ID NO: 2601859 - RNA, 20 nt, Human
ugccgcaagucugcagcccg

SEQ ID NO: 2601860 - RNA, 22 nt, Human
ugccgcaauggccaugugggga

SEQ ID NO: 2601861 - RNA, 12 nt, Human
ugccgcacccca

SEQ ID NO: 2601862 - RNA, 13 nt, Human
ugccgcaccccag

SEQ ID NO: 2601863 - RNA, 15 nt, Human
ugccgcaccccagag

SEQ ID NO: 2601864 - RNA, 13 nt, Human
ugccucagccucc

SEQ ID NO: 2601865 - RNA, 12 nt, Human
ugccucagccuc

SEQ ID NO: 2601866 - RNA, 12 nt, Human
ugccgcagcccu

SEQ ID NO: 2601867 - RNA, 14 nt, Human
ugccgcagcccugc

SEQ ID NO: 2601868 - RNA, 18 nt, Human
ugccgcaccccagagugu

SEQ ID NO: 2601869 - RNA, 15 nt, Human
ugccucagcccugac

SEQ ID NO: 2601870 - RNA, 16 nt, Human
ugccucagcccugacc

SEQ ID NO: 2601871 - RNA, 12 nt, Human
agcucuggucca

SEQ ID NO: 2601872 - RNA, 17 nt, Human
agcucugguccauagag

SEQ ID NO: 2601873 - RNA, 14 nt, Human
agcucuguccuggg

SEQ ID NO: 2601874 - RNA, 15 nt, Human
agcucucugcaucua

SEQ ID NO: 2601875 - RNA, 19 nt, Human
agcucugaaaccaguguua

SEQ ID NO: 2601876 - RNA, 21 nt, Human
agcucugaagucacaucacag

SEQ ID NO: 2601877 - RNA, 23 nt, Human
agcucugaagucacaucacagga

SEQ ID NO: 2601878 - RNA, 23 nt, Human
agcucuggcugaacccugugcug

SEQ ID NO: 2601879 - RNA, 18 nt, Human
agcucugggagaggauuu

SEQ ID NO: 2601880 - RNA, 15 nt, Human
agcucugggagagga

SEQ ID NO: 2601881 - RNA, 12 nt, Human
agcucuggcuuc

SEQ ID NO: 2601882 - RNA, 20 nt, Human
agcucuggcuuccagaaaac

SEQ ID NO: 2601883 - RNA, 12 nt, Human
agcucgguggac

SEQ ID NO: 2601884 - RNA, 14 nt, Human
agcucgguggaccc

SEQ ID NO: 2601885 - RNA, 15 nt, Human
agcucgguggaccca

SEQ ID NO: 2601886 - RNA, 16 nt, Human
agcucgguggacccag

SEQ ID NO: 2601887 - RNA, 17 nt, Human
agcucgguggacccagg

SEQ ID NO: 2601888 - RNA, 18 nt, Human
agcucgguggacccaggg

SEQ ID NO: 2601889 - RNA, 19 nt, Human
agcucgguggacccaggga

SEQ ID NO: 2601890 - RNA, 18 nt, Human
agcucugaaaccaguguu

SEQ ID NO: 2601891 - RNA, 11 nt, Human
agcucucugca

SEQ ID NO: 2601892 - RNA, 20 nt, Human
agcucgguggacccagggau

SEQ ID NO: 2601893 - RNA, 21 nt, Human
agcuccuucuguccuacucug

SEQ ID NO: 2601894 - RNA, 16 nt, Human
agcuccuucuguccua

SEQ ID NO: 2601895 - RNA, 16 nt, Human
agcucccauuucuacu

SEQ ID NO: 2601896 - RNA, 22 nt, Human
agcuccuugggaggccccacug

SEQ ID NO: 2601897 - RNA, 20 nt, Human
agcuccuugggaggccccac

SEQ ID NO: 2601898 - RNA, 13 nt, Human
agcucccaggcau

SEQ ID NO: 2601899 - RNA, 12 nt, Human
agcucccaggaa

SEQ ID NO: 2601900 - RNA, 16 nt, Human
agcuccaucuccacuc

SEQ ID NO: 2601901 - RNA, 15 nt, Human
agcuccaucuccacu

SEQ ID NO: 2601902 - RNA, 13 nt, Human
agcuccaucucca

SEQ ID NO: 2601903 - RNA, 13 nt, Human
agcuccaguucga

SEQ ID NO: 2601904 - RNA, 15 nt, Human
agcuccuucuguccu

SEQ ID NO: 2601905 - RNA, 23 nt, Human
agcucccaggcauuccccaggag

SEQ ID NO: 2601906 - RNA, 14 nt, Human
agcucccaggaaca

SEQ ID NO: 2601907 - RNA, 13 nt, Human
agcucccaggaac

SEQ ID NO: 2601908 - RNA, 13 nt, Human
agcucccaggccg

SEQ ID NO: 2601909 - RNA, 21 nt, Human
agcucccaggccgagaagcca

SEQ ID NO: 2601910 - RNA, 14 nt, Human
agcucccaggccga

SEQ ID NO: 2601911 - RNA, 20 nt, Human
ugccauagaguuuaacacaa

SEQ ID NO: 2601912 - RNA, 15 nt, Human
ugccaagcacagugc

SEQ ID NO: 2601913 - RNA, 13 nt, Human
ugccaucaucucc

SEQ ID NO: 2601914 - RNA, 15 nt, Human
ugccaucaucuccug

SEQ ID NO: 2601915 - RNA, 16 nt, Human
ugccaucaucuccugc

SEQ ID NO: 2601916 - RNA, 16 nt, Human
ugccaucauguuuaca

SEQ ID NO: 2601917 - RNA, 23 nt, Human
ugccaucaucuccugccuuccuc

SEQ ID NO: 2601918 - RNA, 13 nt, Human
ugccauauuuuca

SEQ ID NO: 2601919 - RNA, 14 nt, Human
ugccauauuuucac

SEQ ID NO: 2601920 - RNA, 17 nt, Human
ugccauauuuucaccau

SEQ ID NO: 2601921 - RNA, 21 nt, Human
ugccauagaguuuaacacaag

SEQ ID NO: 2601922 - RNA, 16 nt, Human
ugccauagucacaugg

SEQ ID NO: 2601923 - RNA, 21 nt, Human
ugccauauugcacaugucuua

SEQ ID NO: 2601924 - RNA, 17 nt, Human
ugccauagucacauggc

SEQ ID NO: 2601925 - RNA, 20 nt, Human
ugccauauugcacaugucuu

SEQ ID NO: 2601926 - RNA, 18 nt, Human
ugccauacuuugucugaa

SEQ ID NO: 2601927 - RNA, 17 nt, Human
ugccauacuuugucuga

SEQ ID NO: 2601928 - RNA, 22 nt, Human
ugccauacuuugucugaaaaau

SEQ ID NO: 2601929 - RNA, 18 nt, Human
ugccauagaguuuaacac

SEQ ID NO: 2601930 - RNA, 13 nt, Human
ugccauagaguuu

SEQ ID NO: 2601931 - RNA, 23 nt, Human
ugccauaaaacauuaagaaaauc

SEQ ID NO: 2601932 - RNA, 21 nt, Human
ugccauaaaacauuaagaaaa

SEQ ID NO: 2601933 - RNA, 20 nt, Human
ugccauaaaacauuaagaaa

SEQ ID NO: 2601934 - RNA, 22 nt, Human
ugccauaaaacauuaagaaaau

SEQ ID NO: 2601935 - RNA, 15 nt, Human
ugccauacuuugucu

SEQ ID NO: 2601936 - RNA, 21 nt, Human
ugccuggauggggcugcaccg

SEQ ID NO: 2601937 - RNA, 20 nt, Human
ugccuggauggggcugcacc

SEQ ID NO: 2601938 - RNA, 17 nt, Human
ugccuggauggggcugc

SEQ ID NO: 2601939 - RNA, 16 nt, Human
ugccuggauggggcug

SEQ ID NO: 2601940 - RNA, 16 nt, Human
agcugccuguucagcu

SEQ ID NO: 2601941 - RNA, 14 nt, Human
agcugccuguucag

SEQ ID NO: 2601942 - RNA, 18 nt, Human
agcugccuguucagcucc

SEQ ID NO: 2601943 - RNA, 16 nt, Human
agcugcuugggcuuca

SEQ ID NO: 2601944 - RNA, 22 nt, Human
agcugcuucucccacuuggcca

SEQ ID NO: 2601945 - RNA, 12 nt, Human
agcugcuucucc

SEQ ID NO: 2601946 - RNA, 20 nt, Human
agcugcuugggcuucauccu

SEQ ID NO: 2601947 - RNA, 23 nt, Human
ugccugcuuuucacugcugcaag

SEQ ID NO: 2601948 - RNA, 21 nt, Human
ugccuggacauuugccuugcu

SEQ ID NO: 2601949 - RNA, 23 nt, Human
agcugcuggagacuccuaggcag

SEQ ID NO: 2601950 - RNA, 14 nt, Human
agcugcuggagacu

SEQ ID NO: 2601951 - RNA, 14 nt, Human
agcugcuggcuugc

SEQ ID NO: 2601952 - RNA, 17 nt, Human
agcugcuggcuugcagu

SEQ ID NO: 2601953 - RNA, 19 nt, Human
agcuggccgugggccuggg

SEQ ID NO: 2601954 - RNA, 18 nt, Human
agcuggcgucugucuuca

SEQ ID NO: 2601955 - RNA, 21 nt, Human
agcuggcgucaugcaaaguca

SEQ ID NO: 2601956 - RNA, 15 nt, Human
agcuggcgucugucu

SEQ ID NO: 2601957 - RNA, 17 nt, Human
agcuggccgugggccug

SEQ ID NO: 2601958 - RNA, 16 nt, Human
agcuggccgugggccu

SEQ ID NO: 2601959 - RNA, 22 nt, Human
agcuggccgcgccaaauaaugu

SEQ ID NO: 2601960 - RNA, 19 nt, Human
agcuggccgggagccugau

SEQ ID NO: 2601961 - RNA, 18 nt, Human
agcuggccgggagccuga

SEQ ID NO: 2601962 - RNA, 23 nt, Human
agcugcuucucccacuuggccaa

SEQ ID NO: 2601963 - RNA, 23 nt, Human
agcuggccgaggguccuggcucc

SEQ ID NO: 2601964 - RNA, 23 nt, Human
ugccugcccaggccccugccacc

SEQ ID NO: 2601965 - RNA, 22 nt, Human
ugccugcccaggccccugccac

SEQ ID NO: 2601966 - RNA, 20 nt, Human
ugccugcccaggccccugcc

SEQ ID NO: 2601967 - RNA, 11 nt, Human
ugccuccaggu

SEQ ID NO: 2601968 - RNA, 23 nt, Human
ugccuccagggcuggacugaggc

SEQ ID NO: 2601969 - RNA, 12 nt, Human
ugccucugccug

SEQ ID NO: 2601970 - RNA, 21 nt, Human
ugccugcuuuuuauggccugu

SEQ ID NO: 2601971 - RNA, 20 nt, Human
ugccugcuuuuuauggccug

SEQ ID NO: 2601972 - RNA, 22 nt, Human
ugccugcuuuuuauggccugug

SEQ ID NO: 2601973 - RNA, 22 nt, Human
ugccugcuuuucacugcugcaa

SEQ ID NO: 2601974 - RNA, 21 nt, Human
ugccuccagggcuggacugag

SEQ ID NO: 2601975 - RNA, 20 nt, Human
ugccuccagggcuggacuga

SEQ ID NO: 2601976 - RNA, 19 nt, Human
ugccuccagggcuggacug

SEQ ID NO: 2601977 - RNA, 18 nt, Human
ugccuccagggcuggacu

SEQ ID NO: 2601978 - RNA, 17 nt, Human
ugccucugccucugaca

SEQ ID NO: 2601979 - RNA, 20 nt, Human
ugccucugccucugacacac

SEQ ID NO: 2601980 - RNA, 18 nt, Human
ugccucugccucugacac

SEQ ID NO: 2601981 - RNA, 17 nt, Human
ugccuccagggcuggac

SEQ ID NO: 2601982 - RNA, 16 nt, Human
ugccuccagggcugga

SEQ ID NO: 2601983 - RNA, 15 nt, Human
ugccuccagggcugg

SEQ ID NO: 2601984 - RNA, 14 nt, Human
ugccuccagggcug

SEQ ID NO: 2601985 - RNA, 12 nt, Human
ugccuccagggc

SEQ ID NO: 2601986 - RNA, 19 nt, Human
ugccuccaggaaccacacc

SEQ ID NO: 2601987 - RNA, 20 nt, Human
ugccuccaggaaccacacca

SEQ ID NO: 2601988 - RNA, 20 nt, Human
ugccuccacucccacuuccc

SEQ ID NO: 2601989 - RNA, 19 nt, Human
ugccuccacucccacuucc

SEQ ID NO: 2601990 - RNA, 14 nt, Human
ugccuccaggaacc

SEQ ID NO: 2601991 - RNA, 17 nt, Human
ugccuccaggaaccaca

SEQ ID NO: 2601992 - RNA, 14 nt, Human
ugccucagccuccc

SEQ ID NO: 2601993 - RNA, 17 nt, Human
ugccuccacucccacuu

SEQ ID NO: 2601994 - RNA, 16 nt, Human
ugccuccacucccacu

SEQ ID NO: 2601995 - RNA, 15 nt, Human
ugccuccacucccac

SEQ ID NO: 2601996 - RNA, 14 nt, Human
ugccuccacuccca

SEQ ID NO: 2601997 - RNA, 13 nt, Human
ugccuccacuccc

SEQ ID NO: 2601998 - RNA, 20 nt, Human
ugccuccaccgcugccuaag

SEQ ID NO: 2601999 - RNA, 19 nt, Human
ugccucagcccugacccug

SEQ ID NO: 2602000 - RNA, 19 nt, Human
ugccuguguccaugcgcuc

SEQ ID NO: 2602001 - RNA, 15 nt, Human
ugccuguguccaugc

SEQ ID NO: 2602002 - RNA, 23 nt, Human
ugccuguggcgccgucuccaggg

SEQ ID NO: 2602003 - RNA, 22 nt, Human
ugccuguggcgccgucuccagg

SEQ ID NO: 2602004 - RNA, 21 nt, Human
ugccuguggcgccgucuccag

SEQ ID NO: 2602005 - RNA, 21 nt, Human
ugccuguggaaucuggaguga

SEQ ID NO: 2602006 - RNA, 19 nt, Human
ugccuguggaaucuggagu

SEQ ID NO: 2602007 - RNA, 11 nt, Human
ugccuguggcg

SEQ ID NO: 2602008 - RNA, 17 nt, Human
ugccuguucaguuacag

SEQ ID NO: 2602009 - RNA, 13 nt, Human
ugccuguucaguu

SEQ ID NO: 2602010 - RNA, 12 nt, Human
ugccuguucagu

SEQ ID NO: 2602011 - RNA, 21 nt, Human
ugccuguguccaugcgcucag

SEQ ID NO: 2602012 - RNA, 21 nt, Human
ugccuguucaguuacagaaag

SEQ ID NO: 2602013 - RNA, 20 nt, Human
ugccuguucaguuacagaaa

SEQ ID NO: 2602014 - RNA, 19 nt, Human
ugccuguucaguuacagaa

SEQ ID NO: 2602015 - RNA, 18 nt, Human
ugccuguucaguuacaga

SEQ ID NO: 2602016 - RNA, 14 nt, Human
ugccuguucccauu

SEQ ID NO: 2602017 - RNA, 14 nt, Human
agcuguucacagcc

SEQ ID NO: 2602018 - RNA, 19 nt, Human
agcuguuacugucuucagu

SEQ ID NO: 2602019 - RNA, 12 nt, Human
ugccugugccug

SEQ ID NO: 2602020 - RNA, 14 nt, Human
ugccuguggaacug

SEQ ID NO: 2602021 - RNA, 19 nt, Human
ugccugugccacccaccag

SEQ ID NO: 2602022 - RNA, 20 nt, Human
ugccugugccacccaccagg

SEQ ID NO: 2602023 - RNA, 19 nt, Human
agcuguuauuucuauuuuu

SEQ ID NO: 2602024 - RNA, 23 nt, Human
agcugugugaaauaccagugugg

SEQ ID NO: 2602025 - RNA, 14 nt, Human
ugccugugccaccc

SEQ ID NO: 2602026 - RNA, 17 nt, Human
ugccugugaggcagggg

SEQ ID NO: 2602027 - RNA, 16 nt, Human
ugccugugccacccac

SEQ ID NO: 2602028 - RNA, 21 nt, Human
ugccuuacccucauguucuua

SEQ ID NO: 2602029 - RNA, 23 nt, Human
ugccuuaauaagaaugguugccu

SEQ ID NO: 2602030 - RNA, 14 nt, Human
ugccuuaccuccug

SEQ ID NO: 2602031 - RNA, 15 nt, Human
ugccuuaccuccugc

SEQ ID NO: 2602032 - RNA, 16 nt, Human
ugccuuaccuccugcc

SEQ ID NO: 2602033 - RNA, 17 nt, Human
ugccuuaccuccugccc

SEQ ID NO: 2602034 - RNA, 16 nt, Human
ugccuuggggacaaga

SEQ ID NO: 2602035 - RNA, 16 nt, Human
ugccuugggcugcucc

SEQ ID NO: 2602036 - RNA, 17 nt, Human
ugccuugggcugcuccu

SEQ ID NO: 2602037 - RNA, 19 nt, Human
ugccuuggggaauuuccuc

SEQ ID NO: 2602038 - RNA, 18 nt, Human
ugccuuggggaauuuccu

SEQ ID NO: 2602039 - RNA, 19 nt, Human
ugccuugggcugcuccuca

SEQ ID NO: 2602040 - RNA, 17 nt, Human
ugccuguugggccagga

SEQ ID NO: 2602041 - RNA, 16 nt, Human
ugccuguugggccagg

SEQ ID NO: 2602042 - RNA, 20 nt, Human
ugccuuacccucauguucuu

SEQ ID NO: 2602043 - RNA, 22 nt, Human
ugccuguucaguuacagaaagu

SEQ ID NO: 2602044 - RNA, 17 nt, Human
ugccuuaaagucaguaa

SEQ ID NO: 2602045 - RNA, 16 nt, Human
ugccuuaacuggagcc

SEQ ID NO: 2602046 - RNA, 19 nt, Human
agcuguggacuuuguucac

SEQ ID NO: 2602047 - RNA, 22 nt, Human
agcugugccacccugggcucug

SEQ ID NO: 2602048 - RNA, 21 nt, Human
agcugugccacccugggcucu

SEQ ID NO: 2602049 - RNA, 18 nt, Human
agcugugcucuggacagg

SEQ ID NO: 2602050 - RNA, 17 nt, Human
agcugugcucuggacag

SEQ ID NO: 2602051 - RNA, 15 nt, Human
agcuguguccuugca

SEQ ID NO: 2602052 - RNA, 18 nt, Human
agcuguguccuugcaccu

SEQ ID NO: 2602053 - RNA, 20 nt, Human
agcuguguccuugcaccugc

SEQ ID NO: 2602054 - RNA, 21 nt, Human
agcuguggguacagagagguc

SEQ ID NO: 2602055 - RNA, 18 nt, Human
agcuguuacugucuucag

SEQ ID NO: 2602056 - RNA, 14 nt, Human
agcuguuacugucu

SEQ ID NO: 2602057 - RNA, 21 nt, Human
agcuguguccuugcaccugca

SEQ ID NO: 2602058 - RNA, 24 nt, Human
agcuguguccuugcaccugcaucc

SEQ ID NO: 2602059 - RNA, 13 nt, Human
agcugugugaaau

SEQ ID NO: 2602060 - RNA, 14 nt, Human
agcugugugaaaua

SEQ ID NO: 2602061 - RNA, 20 nt, Human
agcugggguggggaccucag

SEQ ID NO: 2602062 - RNA, 16 nt, Human
agcugggacuacaggu

SEQ ID NO: 2602063 - RNA, 23 nt, Human
agcugggacuacaggcacccacc

SEQ ID NO: 2602064 - RNA, 20 nt, Human
agcugggacuacaggcaccc

SEQ ID NO: 2602065 - RNA, 23 nt, Human
agcugggguggggaccucaggcc

SEQ ID NO: 2602066 - RNA, 22 nt, Human
agcugggguggggaccucaggc

SEQ ID NO: 2602067 - RNA, 20 nt, Human
agcugugccacccugggcuc

SEQ ID NO: 2602068 - RNA, 19 nt, Human
agcugugccacccugggcu

SEQ ID NO: 2602069 - RNA, 18 nt, Human
agcugugccacccugggc

SEQ ID NO: 2602070 - RNA, 13 nt, Human
agcugugccaccc

SEQ ID NO: 2602071 - RNA, 12 nt, Human
agcugugccacc

SEQ ID NO: 2602072 - RNA, 19 nt, Human
agcugugcagguggggaga

SEQ ID NO: 2602073 - RNA, 14 nt, Human
agcugggucaggca

SEQ ID NO: 2602074 - RNA, 20 nt, Human
agcuggguaaucgauggggg

SEQ ID NO: 2602075 - RNA, 20 nt, Human
agucacccuaccugugccug

SEQ ID NO: 2602076 - RNA, 17 nt, Human
agucaccucauggaauu

SEQ ID NO: 2602077 - RNA, 15 nt, Human
agucaccucauggaa

SEQ ID NO: 2602078 - RNA, 14 nt, Human
agucaccucaugga

SEQ ID NO: 2602079 - RNA, 19 nt, Human
agucacacgggggcagcug

SEQ ID NO: 2602080 - RNA, 19 nt, Human
agucacccuaccugugccu

SEQ ID NO: 2602081 - RNA, 16 nt, Human
agucacacgggggcag

SEQ ID NO: 2602082 - RNA, 19 nt, Human
agucaccccggccaccugc

SEQ ID NO: 2602083 - RNA, 23 nt, Human
agucacacagugagucgaggaca

SEQ ID NO: 2602084 - RNA, 15 nt, Human
agucacacagugagu

SEQ ID NO: 2602085 - RNA, 16 nt, Human
aguauuucuaugaaau

SEQ ID NO: 2602086 - RNA, 17 nt, Human
aguauuucuaugaaaua

SEQ ID NO: 2602087 - RNA, 18 nt, Human
aguauuucuaugaaauau

SEQ ID NO: 2602088 - RNA, 23 nt, Human
agucacacaguauuacuucugcu

SEQ ID NO: 2602089 - RNA, 15 nt, Human
aguauugaagcauuu

SEQ ID NO: 2602090 - RNA, 18 nt, Human
aguauugaagcauuuuau

SEQ ID NO: 2602091 - RNA, 20 nt, Human
aguauugaagcauuuuauaa

SEQ ID NO: 2602092 - RNA, 21 nt, Human
aguauugaagcauuuuauaaa

SEQ ID NO: 2602093 - RNA, 15 nt, Human
aguauucuugucaaa

SEQ ID NO: 2602094 - RNA, 14 nt, Human
aguauucuucucuu

SEQ ID NO: 2602095 - RNA, 12 nt, Human
aguauucuucuc

SEQ ID NO: 2602096 - RNA, 18 nt, Human
aguauucuugucaaaaaa

SEQ ID NO: 2602097 - RNA, 14 nt, Human
aguauugaagcauu

SEQ ID NO: 2602098 - RNA, 14 nt, Human
aguaugguggcugg

SEQ ID NO: 2602099 - RNA, 18 nt, Human
aguauuagaauaccacag

SEQ ID NO: 2602100 - RNA, 18 nt, Human
aguauuacuucugcuaca

SEQ ID NO: 2602101 - RNA, 17 nt, Human
aguaugguggcuggguu

SEQ ID NO: 2602102 - RNA, 15 nt, Human
aguauuacuucugcu

SEQ ID NO: 2602103 - RNA, 22 nt, Human
aguaguaccaaaugcuuuaaaa

SEQ ID NO: 2602104 - RNA, 18 nt, Human
aguaguaaaaauuaaaaa

SEQ ID NO: 2602105 - RNA, 14 nt, Human
aguaguaaaaauua

SEQ ID NO: 2602106 - RNA, 17 nt, Human
aguaguaccaaaugcuu

SEQ ID NO: 2602107 - RNA, 14 nt, Human
aguaguacuugaaa

SEQ ID NO: 2602108 - RNA, 21 nt, Human
aguaguaccaaaugcuuuaaa

SEQ ID NO: 2602109 - RNA, 19 nt, Human
aguaguaccaaaugcuuua

SEQ ID NO: 2602110 - RNA, 18 nt, Human
aguaguaccaaaugcuuu

SEQ ID NO: 2602111 - RNA, 16 nt, Human
aguaugguggcugggu

SEQ ID NO: 2602112 - RNA, 15 nt, Human
aguaugguggcuggg

SEQ ID NO: 2602113 - RNA, 15 nt, Human
ugucaauuacaggaa

SEQ ID NO: 2602114 - RNA, 14 nt, Human
ugucaauuacagga

SEQ ID NO: 2602115 - RNA, 17 nt, Human
ugucaaguugugcuugu

SEQ ID NO: 2602116 - RNA, 16 nt, Human
ugucaaguugugcuug

SEQ ID NO: 2602117 - RNA, 15 nt, Human
ugucaaguugugcuu

SEQ ID NO: 2602118 - RNA, 14 nt, Human
ugucaaguugugcu

SEQ ID NO: 2602119 - RNA, 19 nt, Human
ugucaagugggaucuguca

SEQ ID NO: 2602120 - RNA, 18 nt, Human
ugucaaguuccuuugggu

SEQ ID NO: 2602121 - RNA, 19 nt, Human
ugucaagucucugcuggcc

SEQ ID NO: 2602122 - RNA, 17 nt, Human
ugucaagucucugcugg

SEQ ID NO: 2602123 - RNA, 18 nt, Human
ugucaagucucugcuggc

SEQ ID NO: 2602124 - RNA, 17 nt, Human
ugucaauuacaggaagu

SEQ ID NO: 2602125 - RNA, 19 nt, Human
ugucaauuacaggaaguac

SEQ ID NO: 2602126 - RNA, 16 nt, Human
aguaguaauagagcaa

SEQ ID NO: 2602127 - RNA, 13 nt, Human
aguaguaaaaauu

SEQ ID NO: 2602128 - RNA, 23 nt, Human
aguagguuggaagcuagcucccc

SEQ ID NO: 2602129 - RNA, 20 nt, Human
aguagguuggaagcuagcuc

SEQ ID NO: 2602130 - RNA, 13 nt, Human
aguaggugcuuga

SEQ ID NO: 2602131 - RNA, 13 nt, Human
aguagggucaggc

SEQ ID NO: 2602132 - RNA, 15 nt, Human
uguaucacaaaucuu

SEQ ID NO: 2602133 - RNA, 18 nt, Human
uguaucacaaaucuuaac

SEQ ID NO: 2602134 - RNA, 23 nt, Human
uguauauuugugauagcacuuuc

SEQ ID NO: 2602135 - RNA, 17 nt, Human
uguaucaaugaguaaca

SEQ ID NO: 2602136 - RNA, 15 nt, Human
uguaguguuggagaa

SEQ ID NO: 2602137 - RNA, 22 nt, Human
uguauauuuuaagaaauaacag

SEQ ID NO: 2602138 - RNA, 22 nt, Human
uguauauuugugauagcacuuu

SEQ ID NO: 2602139 - RNA, 14 nt, Human
uguaguguuggaga

SEQ ID NO: 2602140 - RNA, 21 nt, Human
uguagugccucuuucauccac

SEQ ID NO: 2602141 - RNA, 17 nt, Human
uguaugugcgugugugc

SEQ ID NO: 2602142 - RNA, 20 nt, Human
uguaugugggggucugugug

SEQ ID NO: 2602143 - RNA, 19 nt, Human
uguaugugcacugucacuu

SEQ ID NO: 2602144 - RNA, 14 nt, Human
uguauguguguaug

SEQ ID NO: 2602145 - RNA, 17 nt, Human
uguaugugcacugucac

SEQ ID NO: 2602146 - RNA, 16 nt, Human
uguaugugcacuguca

SEQ ID NO: 2602147 - RNA, 11 nt, Human
uguaugugcac

SEQ ID NO: 2602148 - RNA, 21 nt, Human
uguaugucagacauccauguu

SEQ ID NO: 2602149 - RNA, 12 nt, Human
uguauguggggg

SEQ ID NO: 2602150 - RNA, 19 nt, Human
uguaugucuuggacacugu

SEQ ID NO: 2602151 - RNA, 14 nt, Human
uguaugucuuggac

SEQ ID NO: 2602152 - RNA, 18 nt, Human
uguaugucucgugguagg

SEQ ID NO: 2602153 - RNA, 15 nt, Human
uguauguauaauuca

SEQ ID NO: 2602154 - RNA, 13 nt, Human
uguauguauaauu

SEQ ID NO: 2602155 - RNA, 12 nt, Human
uguauguauaau

SEQ ID NO: 2602156 - RNA, 16 nt, Human
uguaucauagaaaugu

SEQ ID NO: 2602157 - RNA, 17 nt, Human
uguaucauagaaaugua

SEQ ID NO: 2602158 - RNA, 21 nt, Human
uguaucaucuggauaggagcc

SEQ ID NO: 2602159 - RNA, 17 nt, Human
uguaucauuugaacaac

SEQ ID NO: 2602160 - RNA, 15 nt, Human
uguaucauagaaaug

SEQ ID NO: 2602161 - RNA, 21 nt, Human
uguaucaggugcccaucccug

SEQ ID NO: 2602162 - RNA, 18 nt, Human
uguaucagaggccuauaa

SEQ ID NO: 2602163 - RNA, 21 nt, Human
uguaucaggaaauauauaugu

SEQ ID NO: 2602164 - RNA, 19 nt, Human
uguauucucuccuguaccu

SEQ ID NO: 2602165 - RNA, 20 nt, Human
uguauucucuccuguaccuc

SEQ ID NO: 2602166 - RNA, 22 nt, Human
uguauucuagcuaauguaauaa

SEQ ID NO: 2602167 - RNA, 22 nt, Human
uguauuuuuuuuucuaagagaa

SEQ ID NO: 2602168 - RNA, 21 nt, Human
uguauuuuuuuuucuaagaga

SEQ ID NO: 2602169 - RNA, 20 nt, Human
uguauuuuuuugcaagugaa

SEQ ID NO: 2602170 - RNA, 17 nt, Human
uguauuuuuuugcaagu

SEQ ID NO: 2602171 - RNA, 14 nt, Human
ugucaaaaaaaaaa

SEQ ID NO: 2602172 - RNA, 23 nt, Human
ugucaaaaaugucuuggguaggc

SEQ ID NO: 2602173 - RNA, 15 nt, Human
ugucaaaauaauuuu

SEQ ID NO: 2602174 - RNA, 16 nt, Human
ugucaaacaaagccag

SEQ ID NO: 2602175 - RNA, 17 nt, Human
ugucaaacaaagccaga

SEQ ID NO: 2602176 - RNA, 21 nt, Human
ugucaaacaaagccagaagcu

SEQ ID NO: 2602177 - RNA, 22 nt, Human
ugucaaacaaagccagaagcug

SEQ ID NO: 2602178 - RNA, 18 nt, Human
ugucaaggcugcuuagaa

SEQ ID NO: 2602179 - RNA, 19 nt, Human
ugucaaggcugcuuagaau

SEQ ID NO: 2602180 - RNA, 16 nt, Human
ugucaagucucugcug

SEQ ID NO: 2602181 - RNA, 22 nt, Human
uguauuacaaauccaaugaaau

SEQ ID NO: 2602182 - RNA, 21 nt, Human
uguauuaauauucauuguaua

SEQ ID NO: 2602183 - RNA, 21 nt, Human
uguauuccaagacaugucugu

SEQ ID NO: 2602184 - RNA, 20 nt, Human
uguauucuagcuaauguaau

SEQ ID NO: 2602185 - RNA, 17 nt, Human
uguauucccaguuacuu

SEQ ID NO: 2602186 - RNA, 13 nt, Human
uguauuacaaauc

SEQ ID NO: 2602187 - RNA, 19 nt, Human
uguauguuuugguaucugu

SEQ ID NO: 2602188 - RNA, 14 nt, Human
uguauguuugcaca

SEQ ID NO: 2602189 - RNA, 16 nt, Human
uguauguuugcacacu

SEQ ID NO: 2602190 - RNA, 11 nt, Human
uguauguuuug

SEQ ID NO: 2602191 - RNA, 22 nt, Human
uguauguuugcacacuugugug

SEQ ID NO: 2602192 - RNA, 16 nt, Human
uguauguuuacauauc

SEQ ID NO: 2602193 - RNA, 15 nt, Human
uguauguuuacauau

SEQ ID NO: 2602194 - RNA, 13 nt, Human
uguauguuuacau

SEQ ID NO: 2602195 - RNA, 11 nt, Human
uguauguuuac

SEQ ID NO: 2602196 - RNA, 19 nt, Human
agguuuuaaguuguuugca

SEQ ID NO: 2602197 - RNA, 14 nt, Human
agguuuuaaguugu

SEQ ID NO: 2602198 - RNA, 21 nt, Human
agguuuuaaagugauuaaacg

SEQ ID NO: 2602199 - RNA, 17 nt, Human
agguuuuaaagugauua

SEQ ID NO: 2602200 - RNA, 15 nt, Human
agguuuuaaagugau

SEQ ID NO: 2602201 - RNA, 16 nt, Human
uguagaggagaaacug

SEQ ID NO: 2602202 - RNA, 23 nt, Human
agguuuguuuagaagaagugugu

SEQ ID NO: 2602203 - RNA, 14 nt, Human
uguagagcuucugg

SEQ ID NO: 2602204 - RNA, 18 nt, Human
uguagagccagggucuca

SEQ ID NO: 2602205 - RNA, 16 nt, Human
uguagagccagggucu

SEQ ID NO: 2602206 - RNA, 14 nt, Human
uguacuuuguacaa

SEQ ID NO: 2602207 - RNA, 21 nt, Human
uguagaaaugguuguauuaga

SEQ ID NO: 2602208 - RNA, 13 nt, Human
uguagaaaugguu

SEQ ID NO: 2602209 - RNA, 23 nt, Human
uguagaaaauuuguuauuuugca

SEQ ID NO: 2602210 - RNA, 21 nt, Human
uguagaaaugaugauguggaa

SEQ ID NO: 2602211 - RNA, 23 nt, Human
uguagaaaagggaacugaacauu

SEQ ID NO: 2602212 - RNA, 22 nt, Human
agguuuacaauuuacaaagugu

SEQ ID NO: 2602213 - RNA, 18 nt, Human
agguuuacaauuuacaaa

SEQ ID NO: 2602214 - RNA, 23 nt, Human
agguuuacaauuuacaaagugug

SEQ ID NO: 2602215 - RNA, 18 nt, Human
agguuuaggcugguggcc

SEQ ID NO: 2602216 - RNA, 20 nt, Human
agguuuaggcugguggccca

SEQ ID NO: 2602217 - RNA, 21 nt, Human
agguuuaggcugguggcccag

SEQ ID NO: 2602218 - RNA, 19 nt, Human
uguacuugcucuugaugcc

SEQ ID NO: 2602219 - RNA, 23 nt, Human
uguacuugcucuugaugccuggc

SEQ ID NO: 2602220 - RNA, 22 nt, Human
uguacuugcucuugaugccugg

SEQ ID NO: 2602221 - RNA, 21 nt, Human
uguagaaaagggaacugaaca

SEQ ID NO: 2602222 - RNA, 20 nt, Human
uguagaaaagggaacugaac

SEQ ID NO: 2602223 - RNA, 19 nt, Human
uguagaaaagggaacugaa

SEQ ID NO: 2602224 - RNA, 18 nt, Human
uguagaaaagggaacuga

SEQ ID NO: 2602225 - RNA, 15 nt, Human
uguacuugucaaaga

SEQ ID NO: 2602226 - RNA, 22 nt, Human
uguacuuggaguauuggggucu

SEQ ID NO: 2602227 - RNA, 11 nt, Human
uguacuuugug

SEQ ID NO: 2602228 - RNA, 22 nt, Human
agguuuuucaauuaaacggauu

SEQ ID NO: 2602229 - RNA, 21 nt, Human
agguuuuucaauuaaacggau

SEQ ID NO: 2602230 - RNA, 20 nt, Human
agguuuuucaauuaaacgga

SEQ ID NO: 2602231 - RNA, 18 nt, Human
agguuuuucaauuaaacg

SEQ ID NO: 2602232 - RNA, 17 nt, Human
agguuuuucaauuaaac

SEQ ID NO: 2602233 - RNA, 16 nt, Human
agguuuuucaauuaaa

SEQ ID NO: 2602234 - RNA, 15 nt, Human
agguuuuucaauuaa

SEQ ID NO: 2602235 - RNA, 14 nt, Human
agguuuuucaauua

SEQ ID NO: 2602236 - RNA, 23 nt, Human
agguuuuucaauuaaacggauua

SEQ ID NO: 2602237 - RNA, 13 nt, Human
agguuuuucuuaa

SEQ ID NO: 2602238 - RNA, 20 nt, Human
agguuuuuggaauuaugucu

SEQ ID NO: 2602239 - RNA, 14 nt, Human
agguuuuauuuugu

SEQ ID NO: 2602240 - RNA, 13 nt, Human
agguuuuuauuag

SEQ ID NO: 2602241 - RNA, 14 nt, Human
agguuuuuaagccu

SEQ ID NO: 2602242 - RNA, 13 nt, Human
agguuuuucaauu

SEQ ID NO: 2602243 - RNA, 12 nt, Human
agguuuuucaau

SEQ ID NO: 2602244 - RNA, 15 nt, Human
agguuuuuauuagua

SEQ ID NO: 2602245 - RNA, 20 nt, Human
agguuuuuauuaguaccaua

SEQ ID NO: 2602246 - RNA, 17 nt, Human
agguuuuauaaggcuga

SEQ ID NO: 2602247 - RNA, 13 nt, Human
aguaaaauccaca

SEQ ID NO: 2602248 - RNA, 19 nt, Human
agguuuuuguuuguuuccu

SEQ ID NO: 2602249 - RNA, 14 nt, Human
aguaaaacuugcug

SEQ ID NO: 2602250 - RNA, 20 nt, Human
aguaaugauaacuggaaacu

SEQ ID NO: 2602251 - RNA, 18 nt, Human
aguaaugauaacuggaaa

SEQ ID NO: 2602252 - RNA, 17 nt, Human
aguaaugauaacuggaa

SEQ ID NO: 2602253 - RNA, 14 nt, Human
aguaauaugcacac

SEQ ID NO: 2602254 - RNA, 15 nt, Human
aguaauaugcacaca

SEQ ID NO: 2602255 - RNA, 14 nt, Human
aguaauagagcaaa

SEQ ID NO: 2602256 - RNA, 22 nt, Human
aguaccuccugucucuggccug

SEQ ID NO: 2602257 - RNA, 12 nt, Human
aguaccuccugu

SEQ ID NO: 2602258 - RNA, 17 nt, Human
aguagaagucuuagaug

SEQ ID NO: 2602259 - RNA, 21 nt, Human
aguagaagucuuagauguaua

SEQ ID NO: 2602260 - RNA, 19 nt, Human
aguagaagucuuagaugua

SEQ ID NO: 2602261 - RNA, 20 nt, Human
aguagaagucuuagauguau

SEQ ID NO: 2602262 - RNA, 19 nt, Human
aguacccucucagcuccag

SEQ ID NO: 2602263 - RNA, 18 nt, Human
aguacccucucagcucca

SEQ ID NO: 2602264 - RNA, 16 nt, Human
aguacccucucagcuc

SEQ ID NO: 2602265 - RNA, 19 nt, Human
aguacccguucacauuuuu

SEQ ID NO: 2602266 - RNA, 15 nt, Human
aguaccuauaaagua

SEQ ID NO: 2602267 - RNA, 15 nt, Human
aguaccuccugcccc

SEQ ID NO: 2602268 - RNA, 23 nt, Human
aguaccuauaaaguaaagcuaaa

SEQ ID NO: 2602269 - RNA, 21 nt, Human
aguaccuauaaaguaaagcua

SEQ ID NO: 2602270 - RNA, 16 nt, Human
aguacauuuggagaca

SEQ ID NO: 2602271 - RNA, 21 nt, Human
aguacccaaaagcucagccag

SEQ ID NO: 2602272 - RNA, 15 nt, Human
aguacccaaaagcuc

SEQ ID NO: 2602273 - RNA, 14 nt, Human
aguaccauuuauac

SEQ ID NO: 2602274 - RNA, 21 nt, Human
aguaccauuuauacaaauuag

SEQ ID NO: 2602275 - RNA, 22 nt, Human
aguacccaaaagcucagccagc

SEQ ID NO: 2602276 - RNA, 21 nt, Human
aguaauggguuucauauuucu

SEQ ID NO: 2602277 - RNA, 15 nt, Human
aguaauggguuucau

SEQ ID NO: 2602278 - RNA, 21 nt, Human
aguaaugcuacgugugauuuu

SEQ ID NO: 2602279 - RNA, 20 nt, Human
aguaaugcuacgugugauuu

SEQ ID NO: 2602280 - RNA, 19 nt, Human
aguaaugcuacgugugauu

SEQ ID NO: 2602281 - RNA, 18 nt, Human
aguaaugcuacgugugau

SEQ ID NO: 2602282 - RNA, 17 nt, Human
aguaaugcuacguguga

SEQ ID NO: 2602283 - RNA, 23 nt, Human
aguaauggguuucauauuucuua

SEQ ID NO: 2602284 - RNA, 22 nt, Human
aguaauggguuucauauuucuu

SEQ ID NO: 2602285 - RNA, 15 nt, Human
aguaauucaagaaaa

SEQ ID NO: 2602286 - RNA, 13 nt, Human
aguaauuaucggg

SEQ ID NO: 2602287 - RNA, 23 nt, Human
aguacagguaaggugagggaaua

SEQ ID NO: 2602288 - RNA, 22 nt, Human
aguaauuaucgggaacaguguu

SEQ ID NO: 2602289 - RNA, 20 nt, Human
aguaauuaucgggaacagug

SEQ ID NO: 2602290 - RNA, 21 nt, Human
aguacagguaaggugagggaa

SEQ ID NO: 2602291 - RNA, 18 nt, Human
aguacauauuaggaaaau

SEQ ID NO: 2602292 - RNA, 22 nt, Human
aguacauaaaggugguaugugu

SEQ ID NO: 2602293 - RNA, 17 nt, Human
aguacauauuaggaaaa

SEQ ID NO: 2602294 - RNA, 21 nt, Human
aguacauuuaauacagcagug

SEQ ID NO: 2602295 - RNA, 13 nt, Human
aguacauuuaaua

SEQ ID NO: 2602296 - RNA, 12 nt, Human
aguacauuuaau

SEQ ID NO: 2602297 - RNA, 14 nt, Human
aguacauguuaaac

SEQ ID NO: 2602298 - RNA, 20 nt, Human
uguaggcauaaagucagggg

SEQ ID NO: 2602299 - RNA, 17 nt, Human
uguaggcauaaagucag

SEQ ID NO: 2602300 - RNA, 16 nt, Human
uguaggcagacacagg

SEQ ID NO: 2602301 - RNA, 15 nt, Human
uguaggcagacacag

SEQ ID NO: 2602302 - RNA, 14 nt, Human
uguaggcagacaca

SEQ ID NO: 2602303 - RNA, 13 nt, Human
uguaggcagacac

SEQ ID NO: 2602304 - RNA, 17 nt, Human
uguaggcuuaguuugug

SEQ ID NO: 2602305 - RNA, 19 nt, Human
uguaguaauugacaugugc

SEQ ID NO: 2602306 - RNA, 18 nt, Human
uguaguaauugacaugug

SEQ ID NO: 2602307 - RNA, 13 nt, Human
uguagggagggcg

SEQ ID NO: 2602308 - RNA, 12 nt, Human
uguagggaacuc

SEQ ID NO: 2602309 - RNA, 23 nt, Human
uguaguaucaaauauuagaugug

SEQ ID NO: 2602310 - RNA, 21 nt, Human
uguaguaucaaauauuagaug

SEQ ID NO: 2602311 - RNA, 19 nt, Human
uguaguaucaaauauuaga

SEQ ID NO: 2602312 - RNA, 18 nt, Human
uguaguaucaaauauuag

SEQ ID NO: 2602313 - RNA, 18 nt, Human
uguaguagcccuuucugu

SEQ ID NO: 2602314 - RNA, 20 nt, Human
uguaggccaaauuuguagug

SEQ ID NO: 2602315 - RNA, 13 nt, Human
uguaguagucuca

SEQ ID NO: 2602316 - RNA, 14 nt, Human
uguaguaucaaaua

SEQ ID NO: 2602317 - RNA, 14 nt, Human
uguaguagucucau

SEQ ID NO: 2602318 - RNA, 15 nt, Human
uguaguauaaagaaa

SEQ ID NO: 2602319 - RNA, 12 nt, Human
uguaggcagaca

SEQ ID NO: 2602320 - RNA, 11 nt, Human
uguaggcagac

SEQ ID NO: 2602321 - RNA, 17 nt, Human
aguagccgagagccugc

SEQ ID NO: 2602322 - RNA, 18 nt, Human
aguagccgagagccugcu

SEQ ID NO: 2602323 - RNA, 22 nt, Human
aguagccuaacacacuccaaga

SEQ ID NO: 2602324 - RNA, 19 nt, Human
aguagccgagagccugcuc

SEQ ID NO: 2602325 - RNA, 19 nt, Human
aguagcccuuucugugugc

SEQ ID NO: 2602326 - RNA, 17 nt, Human
aguagcccuuucugugu

SEQ ID NO: 2602327 - RNA, 16 nt, Human
aguagcccuuucugug

SEQ ID NO: 2602328 - RNA, 22 nt, Human
aguagccaggguguggcccugc

SEQ ID NO: 2602329 - RNA, 21 nt, Human
aguagcccuuucugugugcac

SEQ ID NO: 2602330 - RNA, 20 nt, Human
aguagcccuuucugugugca

SEQ ID NO: 2602331 - RNA, 15 nt, Human
aguagccgagagccu

SEQ ID NO: 2602332 - RNA, 16 nt, Human
aguagccgagagccug

SEQ ID NO: 2602333 - RNA, 23 nt, Human
aguagccaggguguggcccugcc

SEQ ID NO: 2602334 - RNA, 15 nt, Human
aguagcccuuucugu

SEQ ID NO: 2602335 - RNA, 15 nt, Human
aguagcauuucauuc

SEQ ID NO: 2602336 - RNA, 14 nt, Human
aguagcauuucauu

SEQ ID NO: 2602337 - RNA, 13 nt, Human
aguagcauuucau

SEQ ID NO: 2602338 - RNA, 22 nt, Human
aguagacauuucucuuacugca

SEQ ID NO: 2602339 - RNA, 15 nt, Human
aguagaauugcauug

SEQ ID NO: 2602340 - RNA, 21 nt, Human
aguagaccuuguuacuucuga

SEQ ID NO: 2602341 - RNA, 20 nt, Human
aguagaccuuguuacuucug

SEQ ID NO: 2602342 - RNA, 14 nt, Human
aguagaauugcauu

SEQ ID NO: 2602343 - RNA, 11 nt, Human
aguagagacag

SEQ ID NO: 2602344 - RNA, 23 nt, Human
aguagaccuuguuacuucugagg

SEQ ID NO: 2602345 - RNA, 20 nt, Human
aguagcauguugagccaggc

SEQ ID NO: 2602346 - RNA, 15 nt, Human
aggugacagagugag

SEQ ID NO: 2602347 - RNA, 13 nt, Human
aggugacagagug

SEQ ID NO: 2602348 - RNA, 17 nt, Human
aggucuugaacuccugg

SEQ ID NO: 2602349 - RNA, 20 nt, Human
aggucuucaucgaaucuacu

SEQ ID NO: 2602350 - RNA, 21 nt, Human
aggucuucaucgaaucuacua

SEQ ID NO: 2602351 - RNA, 13 nt, Human
aggugaccccagg

SEQ ID NO: 2602352 - RNA, 20 nt, Human
aggugaccaaaauccccuuc

SEQ ID NO: 2602353 - RNA, 20 nt, Human
aggugacaugugaaaccuuu

SEQ ID NO: 2602354 - RNA, 16 nt, Human
aggugacaugugaaac

SEQ ID NO: 2602355 - RNA, 15 nt, Human
aggugacaugugaaa

SEQ ID NO: 2602356 - RNA, 14 nt, Human
aggugacaugugaa

SEQ ID NO: 2602357 - RNA, 22 nt, Human
aggugacagagugagacucugu

SEQ ID NO: 2602358 - RNA, 22 nt, Human
aggugagcaaccaguuggcuag

SEQ ID NO: 2602359 - RNA, 21 nt, Human
aggugagcaaccaguuggcua

SEQ ID NO: 2602360 - RNA, 20 nt, Human
aggugagcccauggcccucc

SEQ ID NO: 2602361 - RNA, 18 nt, Human
aggugagcacggccaaca

SEQ ID NO: 2602362 - RNA, 22 nt, Human
aggugagcacggccaacaaagc

SEQ ID NO: 2602363 - RNA, 13 nt, Human
aggugagggaagc

SEQ ID NO: 2602364 - RNA, 21 nt, Human
aggugagaagcagaggaagga

SEQ ID NO: 2602365 - RNA, 23 nt, Human
aggugagaagcagaggaaggaga

SEQ ID NO: 2602366 - RNA, 22 nt, Human
aggugacugggcccugccucug

SEQ ID NO: 2602367 - RNA, 20 nt, Human
aggugacugggcccugccuc

SEQ ID NO: 2602368 - RNA, 16 nt, Human
aggugagaagcagagg

SEQ ID NO: 2602369 - RNA, 19 nt, Human
aggugacccaaugauucag

SEQ ID NO: 2602370 - RNA, 22 nt, Human
aggugaccaaaauccccuucuc

SEQ ID NO: 2602371 - RNA, 19 nt, Human
aggugaccaaaucagugug

SEQ ID NO: 2602372 - RNA, 19 nt, Human
aggugacugggcccugccu

SEQ ID NO: 2602373 - RNA, 20 nt, Human
aggugaccuugcaacuucau

SEQ ID NO: 2602374 - RNA, 16 nt, Human
aggugaccuucuggga

SEQ ID NO: 2602375 - RNA, 22 nt, Human
agguccagcccuggcugaagga

SEQ ID NO: 2602376 - RNA, 21 nt, Human
agguccagcccuggcugaagg

SEQ ID NO: 2602377 - RNA, 20 nt, Human
agguccagcccuggcugaag

SEQ ID NO: 2602378 - RNA, 18 nt, Human
agguccagcccuggcuga

SEQ ID NO: 2602379 - RNA, 14 nt, Human
agguccagcucugg

SEQ ID NO: 2602380 - RNA, 13 nt, Human
agguccagcucug

SEQ ID NO: 2602381 - RNA, 17 nt, Human
agguccagcccuggcug

SEQ ID NO: 2602382 - RNA, 16 nt, Human
agguccagcccuggcu

SEQ ID NO: 2602383 - RNA, 22 nt, Human
agguccacggucuguucuugaa

SEQ ID NO: 2602384 - RNA, 21 nt, Human
agguccacggucuguucuuga

SEQ ID NO: 2602385 - RNA, 23 nt, Human
agguccagcccuggcugaaggac

SEQ ID NO: 2602386 - RNA, 16 nt, Human
aggucuucagccauca

SEQ ID NO: 2602387 - RNA, 17 nt, Human
agguccagcucuggagg

SEQ ID NO: 2602388 - RNA, 16 nt, Human
agguccagcucuggag

SEQ ID NO: 2602389 - RNA, 15 nt, Human
agguccagcucugga

SEQ ID NO: 2602390 - RNA, 16 nt, Human
aggucuugaacuccug

SEQ ID NO: 2602391 - RNA, 15 nt, Human
uggucacugcuguca

SEQ ID NO: 2602392 - RNA, 14 nt, Human
uggucacugcuguc

SEQ ID NO: 2602393 - RNA, 15 nt, Human
aggucagcaugucua

SEQ ID NO: 2602394 - RNA, 19 nt, Human
aggucagcgugcuuagccu

SEQ ID NO: 2602395 - RNA, 16 nt, Human
aggucagcaugucuau

SEQ ID NO: 2602396 - RNA, 16 nt, Human
aggucagcuugcugcc

SEQ ID NO: 2602397 - RNA, 18 nt, Human
aggucagcuugcugcccu

SEQ ID NO: 2602398 - RNA, 19 nt, Human
agguccacaacacacagau

SEQ ID NO: 2602399 - RNA, 15 nt, Human
aggucaggaguuccu

SEQ ID NO: 2602400 - RNA, 19 nt, Human
aggucaggaguuagaggcc

SEQ ID NO: 2602401 - RNA, 21 nt, Human
aggucaggaguuagaggccag

SEQ ID NO: 2602402 - RNA, 16 nt, Human
aggucaggaguuccua

SEQ ID NO: 2602403 - RNA, 18 nt, Human
aggucagagccugcaguu

SEQ ID NO: 2602404 - RNA, 17 nt, Human
aggucagagccugcagu

SEQ ID NO: 2602405 - RNA, 15 nt, Human
aggucagagccugca

SEQ ID NO: 2602406 - RNA, 14 nt, Human
aggucagagccugc

SEQ ID NO: 2602407 - RNA, 13 nt, Human
aggucagagccug

SEQ ID NO: 2602408 - RNA, 16 nt, Human
uggucagauuugaacu

SEQ ID NO: 2602409 - RNA, 15 nt, Human
uggucagauuugaac

SEQ ID NO: 2602410 - RNA, 13 nt, Human
uggucacugcugu

SEQ ID NO: 2602411 - RNA, 14 nt, Human
ugguagcucaggug

SEQ ID NO: 2602412 - RNA, 22 nt, Human
uggucacugccauggaggcaca

SEQ ID NO: 2602413 - RNA, 14 nt, Human
uggucacugccaug

SEQ ID NO: 2602414 - RNA, 13 nt, Human
uggucacugccau

SEQ ID NO: 2602415 - RNA, 17 nt, Human
uggugcuguggccaggg

SEQ ID NO: 2602416 - RNA, 13 nt, Human
uggugcuguggcc

SEQ ID NO: 2602417 - RNA, 12 nt, Human
uggugcuguggc

SEQ ID NO: 2602418 - RNA, 19 nt, Human
uggugcugggacugagcca

SEQ ID NO: 2602419 - RNA, 16 nt, Human
uggugcugggacugag

SEQ ID NO: 2602420 - RNA, 21 nt, Human
uggugcugggacugagccagu

SEQ ID NO: 2602421 - RNA, 22 nt, Human
uggugcuuacacaucucagacc

SEQ ID NO: 2602422 - RNA, 20 nt, Human
uggugcuguggccaggguga

SEQ ID NO: 2602423 - RNA, 18 nt, Human
ugguggaagaggggacag

SEQ ID NO: 2602424 - RNA, 21 nt, Human
ugguggagaggcccggccucu

SEQ ID NO: 2602425 - RNA, 16 nt, Human
ugguggacaguccugg

SEQ ID NO: 2602426 - RNA, 17 nt, Human
ugguggacaguccuggg

SEQ ID NO: 2602427 - RNA, 13 nt, Human
ugguggagggcca

SEQ ID NO: 2602428 - RNA, 18 nt, Human
ugguggacaguccuggga

SEQ ID NO: 2602429 - RNA, 16 nt, Human
ugguggcaagagcccc

SEQ ID NO: 2602430 - RNA, 19 nt, Human
ugguggaagaggggacagg

SEQ ID NO: 2602431 - RNA, 12 nt, Human
ugguggcagugg

SEQ ID NO: 2602432 - RNA, 15 nt, Human
ugguggcagcugcgg

SEQ ID NO: 2602433 - RNA, 13 nt, Human
ugguggcagcugc

SEQ ID NO: 2602434 - RNA, 14 nt, Human
ugguggcagcugcg

SEQ ID NO: 2602435 - RNA, 14 nt, Human
uggugugaacuaaa

SEQ ID NO: 2602436 - RNA, 22 nt, Human
uggugugaacuaaacuuucaca

SEQ ID NO: 2602437 - RNA, 12 nt, Human
uggugugaaggu

SEQ ID NO: 2602438 - RNA, 11 nt, Human
uggugugaagg

SEQ ID NO: 2602439 - RNA, 23 nt, Human
uggugugaacuaaacuuucacac

SEQ ID NO: 2602440 - RNA, 23 nt, Human
uggugugaccacugcagaagaca

SEQ ID NO: 2602441 - RNA, 20 nt, Human
uggugucuccaaccccccag

SEQ ID NO: 2602442 - RNA, 19 nt, Human
uggugucuccaacccccca

SEQ ID NO: 2602443 - RNA, 15 nt, Human
ugguggcacaggccc

SEQ ID NO: 2602444 - RNA, 11 nt, Human
uggugucucca

SEQ ID NO: 2602445 - RNA, 19 nt, Human
uggugucuggauucccagg

SEQ ID NO: 2602446 - RNA, 15 nt, Human
uggugugaaagucag

SEQ ID NO: 2602447 - RNA, 20 nt, Human
ugguuaggcauugugggaag

SEQ ID NO: 2602448 - RNA, 18 nt, Human
ugguuaggcauuguggga

SEQ ID NO: 2602449 - RNA, 13 nt, Human
ugguuagaaaugc

SEQ ID NO: 2602450 - RNA, 14 nt, Human
ugguuagaaaugca

SEQ ID NO: 2602451 - RNA, 13 nt, Human
ugguuagaaaagu

SEQ ID NO: 2602452 - RNA, 13 nt, Human
ugguuaaugccau

SEQ ID NO: 2602453 - RNA, 18 nt, Human
uggugcugccacacuuca

SEQ ID NO: 2602454 - RNA, 15 nt, Human
uggugcugagaagcu

SEQ ID NO: 2602455 - RNA, 19 nt, Human
uggugcugcugcugcugug

SEQ ID NO: 2602456 - RNA, 12 nt, Human
uggugcuggaua

SEQ ID NO: 2602457 - RNA, 17 nt, Human
uggugcuggauauuuuc

SEQ ID NO: 2602458 - RNA, 21 nt, Human
uggugcuggauauuuucaaau

SEQ ID NO: 2602459 - RNA, 15 nt, Human
uggugcugggacuga

SEQ ID NO: 2602460 - RNA, 14 nt, Human
uggugcugggacug

SEQ ID NO: 2602461 - RNA, 13 nt, Human
uggugcugggacu

SEQ ID NO: 2602462 - RNA, 18 nt, Human
uggugcuggauauuuuca

SEQ ID NO: 2602463 - RNA, 13 nt, Human
uggugcugaccuc

SEQ ID NO: 2602464 - RNA, 16 nt, Human
uggugcucucugccac

SEQ ID NO: 2602465 - RNA, 15 nt, Human
uggugcugaccucug

SEQ ID NO: 2602466 - RNA, 13 nt, Human
uggugcugagaag

SEQ ID NO: 2602467 - RNA, 13 nt, Human
uggugcugccaca

SEQ ID NO: 2602468 - RNA, 14 nt, Human
uggugcucaguugu

SEQ ID NO: 2602469 - RNA, 11 nt, Human
uggugcucagu

SEQ ID NO: 2602470 - RNA, 23 nt, Human
uggugcuauaggcuggagaagcu

SEQ ID NO: 2602471 - RNA, 22 nt, Human
uggugcuauaggcuggagaagc

SEQ ID NO: 2602472 - RNA, 17 nt, Human
uggugcucaguuguaga

SEQ ID NO: 2602473 - RNA, 15 nt, Human
uggugcucaguugua

SEQ ID NO: 2602474 - RNA, 21 nt, Human
uggugcucaguuguagaaugu

SEQ ID NO: 2602475 - RNA, 15 nt, Human
uggugcucucugcca

SEQ ID NO: 2602476 - RNA, 17 nt, Human
uggugcgaucuggguuc

SEQ ID NO: 2602477 - RNA, 18 nt, Human
uggugcuauaggcuggag

SEQ ID NO: 2602478 - RNA, 16 nt, Human
uggugcuacgccugca

SEQ ID NO: 2602479 - RNA, 16 nt, Human
uggugcgaucuggguu

SEQ ID NO: 2602480 - RNA, 11 nt, Human
uggugccuuca

SEQ ID NO: 2602481 - RNA, 21 nt, Human
uggugccugauucggcugucu

SEQ ID NO: 2602482 - RNA, 12 nt, Human
uggugccuucau

SEQ ID NO: 2602483 - RNA, 14 nt, Human
uggugccuucauuu

SEQ ID NO: 2602484 - RNA, 24 nt, Human
uggugccuggccuggcacacauca

SEQ ID NO: 2602485 - RNA, 23 nt, Human
uggugccuggccuggcacacauc

SEQ ID NO: 2602486 - RNA, 22 nt, Human
uggugccuggccuggcacacau

SEQ ID NO: 2602487 - RNA, 19 nt, Human
uggugccuggccuggcaca

SEQ ID NO: 2602488 - RNA, 18 nt, Human
uggugccuggccuggcac

SEQ ID NO: 2602489 - RNA, 17 nt, Human
uggugccuggccuggca

SEQ ID NO: 2602490 - RNA, 14 nt, Human
uggugccuggccug

SEQ ID NO: 2602491 - RNA, 13 nt, Human
uggugccuggccu

SEQ ID NO: 2602492 - RNA, 18 nt, Human
uggugccugagaggcagg

SEQ ID NO: 2602493 - RNA, 17 nt, Human
uggugccugagaggcag

SEQ ID NO: 2602494 - RNA, 15 nt, Human
uggugccugagaggc

SEQ ID NO: 2602495 - RNA, 14 nt, Human
uggugccugagagg

SEQ ID NO: 2602496 - RNA, 20 nt, Human
uggugccugagaggcaggca

SEQ ID NO: 2602497 - RNA, 19 nt, Human
uggugccugagaggcaggc

SEQ ID NO: 2602498 - RNA, 12 nt, Human
uggugccuggcc

SEQ ID NO: 2602499 - RNA, 22 nt, Human
uggugccuaaaguuuaaccaaa

SEQ ID NO: 2602500 - RNA, 13 nt, Human
uggugccugagag

SEQ ID NO: 2602501 - RNA, 10 nt, Human
uggugccuga

SEQ ID NO: 2602502 - RNA, 20 nt, Human
uggugcccuguucucuacca

SEQ ID NO: 2602503 - RNA, 19 nt, Human
aggugaguuugagcugccu

SEQ ID NO: 2602504 - RNA, 13 nt, Human
aggugagggaugu

SEQ ID NO: 2602505 - RNA, 21 nt, Human
aggugaguuugagcugccuuc

SEQ ID NO: 2602506 - RNA, 20 nt, Human
aggugaguuugagcugccuu

SEQ ID NO: 2602507 - RNA, 22 nt, Human
aggugaguuugagcugccuucc

SEQ ID NO: 2602508 - RNA, 18 nt, Human
aggugauauauuuaaaaa

SEQ ID NO: 2602509 - RNA, 18 nt, Human
aggugauauccauucuuu

SEQ ID NO: 2602510 - RNA, 19 nt, Human
aggugauauccauucuuuc

SEQ ID NO: 2602511 - RNA, 22 nt, Human
aggugauauccauucuuucuga

SEQ ID NO: 2602512 - RNA, 20 nt, Human
aggugcauauuuauaaaaau

SEQ ID NO: 2602513 - RNA, 21 nt, Human
aggugcaucuggggaacuaga

SEQ ID NO: 2602514 - RNA, 23 nt, Human
aggugcaucuggggaacuagagg

SEQ ID NO: 2602515 - RNA, 20 nt, Human
aggugauccacccaccucag

SEQ ID NO: 2602516 - RNA, 14 nt, Human
aggugauccaccca

SEQ ID NO: 2602517 - RNA, 18 nt, Human
aggugcccagaaugaggc

SEQ ID NO: 2602518 - RNA, 22 nt, Human
aggugcccagaaugaggcugcu

SEQ ID NO: 2602519 - RNA, 17 nt, Human
aggugcccaucccugga

SEQ ID NO: 2602520 - RNA, 17 nt, Human
aggugccccaaaaugca

SEQ ID NO: 2602521 - RNA, 15 nt, Human
aggugccagcaacug

SEQ ID NO: 2602522 - RNA, 14 nt, Human
aggugccagcaacu

SEQ ID NO: 2602523 - RNA, 20 nt, Human
aggugccagcaaagccccau

SEQ ID NO: 2602524 - RNA, 19 nt, Human
aggugccagcaaagcccca

SEQ ID NO: 2602525 - RNA, 18 nt, Human
aggugccagcaaagcccc

SEQ ID NO: 2602526 - RNA, 16 nt, Human
aggugccagcaaagcc

SEQ ID NO: 2602527 - RNA, 21 nt, Human
aggugccagcaacugaauaaa

SEQ ID NO: 2602528 - RNA, 20 nt, Human
aggugccagcaacugaauaa

SEQ ID NO: 2602529 - RNA, 19 nt, Human
aggugccagcaacugaaua

SEQ ID NO: 2602530 - RNA, 18 nt, Human
aggugccagcaacugaau

SEQ ID NO: 2602531 - RNA, 21 nt, Human
aggugcccagaauaaguuauu

SEQ ID NO: 2602532 - RNA, 17 nt, Human
aggugggauccuccagg

SEQ ID NO: 2602533 - RNA, 16 nt, Human
aggugggauccuccag

SEQ ID NO: 2602534 - RNA, 23 nt, Human
agguggggcagcuugaggguugg

SEQ ID NO: 2602535 - RNA, 18 nt, Human
aggugggauccuccaggu

SEQ ID NO: 2602536 - RNA, 16 nt, Human
agguggggcagcuuga

SEQ ID NO: 2602537 - RNA, 15 nt, Human
aggugggauccucca

SEQ ID NO: 2602538 - RNA, 18 nt, Human
aggugccugucccacccc

SEQ ID NO: 2602539 - RNA, 17 nt, Human
aggugccugucccaccc

SEQ ID NO: 2602540 - RNA, 18 nt, Human
aggugccuccaggugugc

SEQ ID NO: 2602541 - RNA, 11 nt, Human
aggugccugug

SEQ ID NO: 2602542 - RNA, 17 nt, Human
aggugccugugaggcag

SEQ ID NO: 2602543 - RNA, 23 nt, Human
aggugggauaucccuaugcugcc

SEQ ID NO: 2602544 - RNA, 18 nt, Human
aggugccucaagagaagg

SEQ ID NO: 2602545 - RNA, 16 nt, Human
aggugccuccaggugu

SEQ ID NO: 2602546 - RNA, 15 nt, Human
aggugccuccaggug

SEQ ID NO: 2602547 - RNA, 14 nt, Human
aggugccuccaggu

SEQ ID NO: 2602548 - RNA, 12 nt, Human
aggugccuccag

SEQ ID NO: 2602549 - RNA, 19 nt, Human
aggugcccuuggaggccag

SEQ ID NO: 2602550 - RNA, 20 nt, Human
aggugcccuuggaggccagc

SEQ ID NO: 2602551 - RNA, 21 nt, Human
aggugcccuuggaggccagcc

SEQ ID NO: 2602552 - RNA, 22 nt, Human
aggugcccuuggaggccagcca

SEQ ID NO: 2602553 - RNA, 19 nt, Human
aggugucuuccucccaagu

SEQ ID NO: 2602554 - RNA, 16 nt, Human
aggugucuuccuccca

SEQ ID NO: 2602555 - RNA, 20 nt, Human
agguguggagccgaggccua

SEQ ID NO: 2602556 - RNA, 18 nt, Human
aggugugggggcugcagc

SEQ ID NO: 2602557 - RNA, 17 nt, Human
aggugugggggcugcag

SEQ ID NO: 2602558 - RNA, 16 nt, Human
aggugugggggcugca

SEQ ID NO: 2602559 - RNA, 14 nt, Human
aggugugggggcug

SEQ ID NO: 2602560 - RNA, 20 nt, Human
aggugucuuccucccaagug

SEQ ID NO: 2602561 - RNA, 22 nt, Human
agguucuccguuagcuccugug

SEQ ID NO: 2602562 - RNA, 21 nt, Human
agguucuccguuagcuccugu

SEQ ID NO: 2602563 - RNA, 20 nt, Human
agguucuccguuagcuccug

SEQ ID NO: 2602564 - RNA, 19 nt, Human
agguucuccguuagcuccu

SEQ ID NO: 2602565 - RNA, 17 nt, Human
agguucuauuuggaauu

SEQ ID NO: 2602566 - RNA, 15 nt, Human
agguucuauuuggaa

SEQ ID NO: 2602567 - RNA, 22 nt, Human
agguucucuccuccccaaggag

SEQ ID NO: 2602568 - RNA, 17 nt, Human
agguucucuccucccca

SEQ ID NO: 2602569 - RNA, 14 nt, Human
agguucucuccucc

SEQ ID NO: 2602570 - RNA, 17 nt, Human
agguucuggugugaacu

SEQ ID NO: 2602571 - RNA, 17 nt, Human
agguucuuagugucacu

SEQ ID NO: 2602572 - RNA, 15 nt, Human
agguuuaacucagau

SEQ ID NO: 2602573 - RNA, 17 nt, Human
agguuuacaauuuacaa

SEQ ID NO: 2602574 - RNA, 16 nt, Human
agguuuacaauuuaca

SEQ ID NO: 2602575 - RNA, 23 nt, Human
agguuuaacucagaucacuacug

SEQ ID NO: 2602576 - RNA, 20 nt, Human
agguuuaacucagaucacua

SEQ ID NO: 2602577 - RNA, 19 nt, Human
agguuuaacucagaucacu

SEQ ID NO: 2602578 - RNA, 18 nt, Human
agguuuaacucagaucac

SEQ ID NO: 2602579 - RNA, 17 nt, Human
agguuuaacucagauca

SEQ ID NO: 2602580 - RNA, 14 nt, Human
agguuuaagcuguu

SEQ ID NO: 2602581 - RNA, 23 nt, Human
aggugggguauuuaccacagcag

SEQ ID NO: 2602582 - RNA, 21 nt, Human
agguggggcgggaaagccagu

SEQ ID NO: 2602583 - RNA, 19 nt, Human
agguggggucacucuggca

SEQ ID NO: 2602584 - RNA, 17 nt, Human
agguggggcgggaaagc

SEQ ID NO: 2602585 - RNA, 22 nt, Human
aggugggguauuuaccacagca

SEQ ID NO: 2602586 - RNA, 20 nt, Human
aggugugcucugaucaucca

SEQ ID NO: 2602587 - RNA, 15 nt, Human
aggugugcucugauc

SEQ ID NO: 2602588 - RNA, 17 nt, Human
aggugugaaccaccaca

SEQ ID NO: 2602589 - RNA, 17 nt, Human
aggugucugcacccagg

SEQ ID NO: 2602590 - RNA, 16 nt, Human
aggugucugcacccag

SEQ ID NO: 2602591 - RNA, 14 nt, Human
aggugucugcaccc

SEQ ID NO: 2602592 - RNA, 15 nt, Human
aggugucuuccuccc

SEQ ID NO: 2602593 - RNA, 21 nt, Human
aggugucugcacccaggggug

SEQ ID NO: 2602594 - RNA, 14 nt, Human
aggugucuuccucc

SEQ ID NO: 2602595 - RNA, 16 nt, Human
uguaaauaguauuuga

SEQ ID NO: 2602596 - RNA, 16 nt, Human
aggugauauauuuaaa

SEQ ID NO: 2602597 - RNA, 21 nt, Human
uguaaauacuguuuuuaacaa

SEQ ID NO: 2602598 - RNA, 16 nt, Human
uguaaauagcucaggu

SEQ ID NO: 2602599 - RNA, 15 nt, Human
uguaaauagcucagg

SEQ ID NO: 2602600 - RNA, 17 nt, Human
uguaaauaaaggaacca

SEQ ID NO: 2602601 - RNA, 18 nt, Human
uguaaauaaagcccuggg

SEQ ID NO: 2602602 - RNA, 19 nt, Human
uguaaauaaagaacuagca

SEQ ID NO: 2602603 - RNA, 14 nt, Human
uguaaauaaagccc

SEQ ID NO: 2602604 - RNA, 13 nt, Human
uguaaauaaagcc

SEQ ID NO: 2602605 - RNA, 17 nt, Human
uguaaaguuagucuacu

SEQ ID NO: 2602606 - RNA, 14 nt, Human
uguaaaguuagucu

SEQ ID NO: 2602607 - RNA, 12 nt, Human
uguaaaguuagu

SEQ ID NO: 2602608 - RNA, 22 nt, Human
uguaaaguguggucccaacagg

SEQ ID NO: 2602609 - RNA, 14 nt, Human
uguaaauaaaaaga

SEQ ID NO: 2602610 - RNA, 22 nt, Human
uguaaacuguguauuccaagac

SEQ ID NO: 2602611 - RNA, 13 nt, Human
uguaaacuuuuug

SEQ ID NO: 2602612 - RNA, 16 nt, Human
uguaaagaaagagaga

SEQ ID NO: 2602613 - RNA, 17 nt, Human
uguaaagaaagagagaa

SEQ ID NO: 2602614 - RNA, 18 nt, Human
uguaaagaaagagagaaa

SEQ ID NO: 2602615 - RNA, 19 nt, Human
uguaaagaaagagagaaaa

SEQ ID NO: 2602616 - RNA, 14 nt, Human
uguaaagaaagaga

SEQ ID NO: 2602617 - RNA, 15 nt, Human
uguaaagaaagagag

SEQ ID NO: 2602618 - RNA, 13 nt, Human
uguaaagaaagag

SEQ ID NO: 2602619 - RNA, 20 nt, Human
uguaaagaaagagagaaaau

SEQ ID NO: 2602620 - RNA, 21 nt, Human
uguaaagaaagagagaaaaua

SEQ ID NO: 2602621 - RNA, 16 nt, Human
uguaaaggagucaaaa

SEQ ID NO: 2602622 - RNA, 22 nt, Human
uguaaagaaagagagaaaauaa

SEQ ID NO: 2602623 - RNA, 16 nt, Human
uguaaaggaauuuaaa

SEQ ID NO: 2602624 - RNA, 19 nt, Human
uguaaaggagucaaaacua

SEQ ID NO: 2602625 - RNA, 21 nt, Human
uguaaaggagucaaaacuaca

SEQ ID NO: 2602626 - RNA, 19 nt, Human
uguaaaguaggaaaaauaa

SEQ ID NO: 2602627 - RNA, 13 nt, Human
uguaaaguguggu

SEQ ID NO: 2602628 - RNA, 12 nt, Human
uguaaagugugg

SEQ ID NO: 2602629 - RNA, 16 nt, Human
uguaaaguguaaaucc

SEQ ID NO: 2602630 - RNA, 17 nt, Human
uguaaaguguaaauccu

SEQ ID NO: 2602631 - RNA, 18 nt, Human
uguaaaguauguaaacag

SEQ ID NO: 2602632 - RNA, 23 nt, Human
ugguuuggggcgaggcagaggac

SEQ ID NO: 2602633 - RNA, 22 nt, Human
ugguuuggggcgaggcagagga

SEQ ID NO: 2602634 - RNA, 14 nt, Human
ugguuugcagauga

SEQ ID NO: 2602635 - RNA, 21 nt, Human
ugguuuuccccucccuggguu

SEQ ID NO: 2602636 - RNA, 20 nt, Human
ugguuuuccccucccugggu

SEQ ID NO: 2602637 - RNA, 19 nt, Human
uguaaacuguguauuccaa

SEQ ID NO: 2602638 - RNA, 18 nt, Human
ugguuuuccccucccugg

SEQ ID NO: 2602639 - RNA, 14 nt, Human
ugguuuuccccucc

SEQ ID NO: 2602640 - RNA, 15 nt, Human
ugguuuucaaaauaa

SEQ ID NO: 2602641 - RNA, 17 nt, Human
ugguuuucaaaauaaaa

SEQ ID NO: 2602642 - RNA, 15 nt, Human
ugguuuguaaauuaa

SEQ ID NO: 2602643 - RNA, 14 nt, Human
ugguuuucaaaaua

SEQ ID NO: 2602644 - RNA, 19 nt, Human
ugguuuggggcgaggcaga

SEQ ID NO: 2602645 - RNA, 23 nt, Human
ugguuuggcccuucuccuuuuga

SEQ ID NO: 2602646 - RNA, 22 nt, Human
ugguuuggcccuucuccuuuug

SEQ ID NO: 2602647 - RNA, 21 nt, Human
ugguuuggcccuucuccuuuu

SEQ ID NO: 2602648 - RNA, 20 nt, Human
ugguuuggccaucucuggau

SEQ ID NO: 2602649 - RNA, 19 nt, Human
ugguuuggccaucucugga

SEQ ID NO: 2602650 - RNA, 22 nt, Human
ugguuuggaaugcuucuucuca

SEQ ID NO: 2602651 - RNA, 16 nt, Human
ugguuuggaaugcuuc

SEQ ID NO: 2602652 - RNA, 14 nt, Human
ugguuugcuacuuc

SEQ ID NO: 2602653 - RNA, 14 nt, Human
ugguuuccugcccu

SEQ ID NO: 2602654 - RNA, 15 nt, Human
ugguuuccugcccug

SEQ ID NO: 2602655 - RNA, 17 nt, Human
ugguuugcagaugacaa

SEQ ID NO: 2602656 - RNA, 20 nt, Human
ugguuucccccuucuacauu

SEQ ID NO: 2602657 - RNA, 19 nt, Human
ugguuugcagaugacaaaa

SEQ ID NO: 2602658 - RNA, 20 nt, Human
ugguuuccugcccugggagg

SEQ ID NO: 2602659 - RNA, 12 nt, Human
ugguuuccugcc

SEQ ID NO: 2602660 - RNA, 13 nt, Human
ugguuuccugccc

SEQ ID NO: 2602661 - RNA, 17 nt, Human
ugguuucccccuucuac

SEQ ID NO: 2602662 - RNA, 19 nt, Human
ugguuuccucauuccugaa

SEQ ID NO: 2602663 - RNA, 14 nt, Human
ugguuauggagagg

SEQ ID NO: 2602664 - RNA, 16 nt, Human
ugguuauaaaagugau

SEQ ID NO: 2602665 - RNA, 20 nt, Human
ugguuauaaaagugauuguu

SEQ ID NO: 2602666 - RNA, 15 nt, Human
ugguuauaaaaguga

SEQ ID NO: 2602667 - RNA, 20 nt, Human
agggggugucucaggccaca

SEQ ID NO: 2602668 - RNA, 20 nt, Human
aggggguggccucccaacuc

SEQ ID NO: 2602669 - RNA, 19 nt, Human
agggguaggcagagccuuu

SEQ ID NO: 2602670 - RNA, 17 nt, Human
agggguaggcagagccu

SEQ ID NO: 2602671 - RNA, 14 nt, Human
aggggucaaagaaa

SEQ ID NO: 2602672 - RNA, 22 nt, Human
agggguacauuucccugugcug

SEQ ID NO: 2602673 - RNA, 19 nt, Human
agggguaauauauugcugc

SEQ ID NO: 2602674 - RNA, 20 nt, Human
aggggguuugcuggggaacu

SEQ ID NO: 2602675 - RNA, 16 nt, Human
aggggguuugggggcu

SEQ ID NO: 2602676 - RNA, 22 nt, Human
aggggguuugggggcuugcaag

SEQ ID NO: 2602677 - RNA, 15 nt, Human
agggguggagacugc

SEQ ID NO: 2602678 - RNA, 17 nt, Human
agggguggagacugcuu

SEQ ID NO: 2602679 - RNA, 23 nt, Human
aggggugcccccuccucucccau

SEQ ID NO: 2602680 - RNA, 18 nt, Human
aggggugggacacccugu

SEQ ID NO: 2602681 - RNA, 21 nt, Human
aggggugcccccuccucuccc

SEQ ID NO: 2602682 - RNA, 20 nt, Human
aggggugcccccuccucucc

SEQ ID NO: 2602683 - RNA, 17 nt, Human
aggggugcccccuccuc

SEQ ID NO: 2602684 - RNA, 16 nt, Human
aggggugcccccuccu

SEQ ID NO: 2602685 - RNA, 13 nt, Human
aggggugcccccu

SEQ ID NO: 2602686 - RNA, 11 nt, Human
aggggugcccc

SEQ ID NO: 2602687 - RNA, 22 nt, Human
aggggugauuucagagagggca

SEQ ID NO: 2602688 - RNA, 16 nt, Human
aggggucaaagaaaug

SEQ ID NO: 2602689 - RNA, 13 nt, Human
aggggucaggcuc

SEQ ID NO: 2602690 - RNA, 17 nt, Human
aggggugauuucagaga

SEQ ID NO: 2602691 - RNA, 13 nt, Human
aggggugauuuca

SEQ ID NO: 2602692 - RNA, 16 nt, Human
agggucucacucuguc

SEQ ID NO: 2602693 - RNA, 15 nt, Human
agggucucacucugu

SEQ ID NO: 2602694 - RNA, 14 nt, Human
agggucucacucug

SEQ ID NO: 2602695 - RNA, 15 nt, Human
aggguaaggcugugg

SEQ ID NO: 2602696 - RNA, 22 nt, Human
agggguuuucgaagcucagccc

SEQ ID NO: 2602697 - RNA, 22 nt, Human
agggguuuuaggucucuucccc

SEQ ID NO: 2602698 - RNA, 21 nt, Human
agggguuuucgaagcucagcc

SEQ ID NO: 2602699 - RNA, 23 nt, Human
agggguugccacaggccucccug

SEQ ID NO: 2602700 - RNA, 22 nt, Human
agggguugccacaggccucccu

SEQ ID NO: 2602701 - RNA, 20 nt, Human
agggguggagacugcuuccc

SEQ ID NO: 2602702 - RNA, 20 nt, Human
agggguggcugccucauuua

SEQ ID NO: 2602703 - RNA, 21 nt, Human
agggguggcugccucauuuag

SEQ ID NO: 2602704 - RNA, 21 nt, Human
agggguugccacaggccuccc

SEQ ID NO: 2602705 - RNA, 19 nt, Human
agggguugguugaggugga

SEQ ID NO: 2602706 - RNA, 23 nt, Human
agggguugguugagguggaagcc

SEQ ID NO: 2602707 - RNA, 20 nt, Human
agggguuuuaggucucuucc

SEQ ID NO: 2602708 - RNA, 17 nt, Human
agggguuuggucuggga

SEQ ID NO: 2602709 - RNA, 20 nt, Human
agggguugguugagguggaa

SEQ ID NO: 2602710 - RNA, 13 nt, Human
aggggagcccacu

SEQ ID NO: 2602711 - RNA, 17 nt, Human
aggggagcccacugucc

SEQ ID NO: 2602712 - RNA, 21 nt, Human
aggggagcccacuguccuggg

SEQ ID NO: 2602713 - RNA, 24 nt, Human
aggggagcccacuguccugggccu

SEQ ID NO: 2602714 - RNA, 12 nt, Human
aggggagcccac

SEQ ID NO: 2602715 - RNA, 15 nt, Human
aggggaaucagaacu

SEQ ID NO: 2602716 - RNA, 16 nt, Human
aggggaaucagaacuc

SEQ ID NO: 2602717 - RNA, 18 nt, Human
aggggagcaugggaagug

SEQ ID NO: 2602718 - RNA, 16 nt, Human
aggggaauugaggaca

SEQ ID NO: 2602719 - RNA, 21 nt, Human
aggggaauguuugccucugcc

SEQ ID NO: 2602720 - RNA, 20 nt, Human
aggggaauguuugccucugc

SEQ ID NO: 2602721 - RNA, 19 nt, Human
aggggaauguuugccucug

SEQ ID NO: 2602722 - RNA, 20 nt, Human
aggggcugcccgcucccagu

SEQ ID NO: 2602723 - RNA, 19 nt, Human
aggggcugcccgcucccag

SEQ ID NO: 2602724 - RNA, 17 nt, Human
aggggcugcccgcuccc

SEQ ID NO: 2602725 - RNA, 16 nt, Human
aggggcugcccgcucc

SEQ ID NO: 2602726 - RNA, 15 nt, Human
aggggcugcccgcuc

SEQ ID NO: 2602727 - RNA, 13 nt, Human
aggggcugcccgc

SEQ ID NO: 2602728 - RNA, 12 nt, Human
aggggcugcccg

SEQ ID NO: 2602729 - RNA, 20 nt, Human
aggggcugaaagaacaugga

SEQ ID NO: 2602730 - RNA, 20 nt, Human
aggggcugcuuccuccugga

SEQ ID NO: 2602731 - RNA, 18 nt, Human
aggggcugcuuccuccug

SEQ ID NO: 2602732 - RNA, 16 nt, Human
aggggcugcuuccucc

SEQ ID NO: 2602733 - RNA, 15 nt, Human
aggggcugcuuccuc

SEQ ID NO: 2602734 - RNA, 22 nt, Human
aggggcucucagcucagcgcca

SEQ ID NO: 2602735 - RNA, 16 nt, Human
aggggagcccuccacg

SEQ ID NO: 2602736 - RNA, 17 nt, Human
aggggcucucagcucag

SEQ ID NO: 2602737 - RNA, 21 nt, Human
aggggcucuggagagaaacaa

SEQ ID NO: 2602738 - RNA, 17 nt, Human
aggggcucuggagagaa

SEQ ID NO: 2602739 - RNA, 15 nt, Human
aggggcucuggagag

SEQ ID NO: 2602740 - RNA, 12 nt, Human
aggggagcccuc

SEQ ID NO: 2602741 - RNA, 11 nt, Human
aggggagcccu

SEQ ID NO: 2602742 - RNA, 13 nt, Human
aggggcuccugga

SEQ ID NO: 2602743 - RNA, 14 nt, Human
aggggcuccuggaa

SEQ ID NO: 2602744 - RNA, 23 nt, Human
aggggcuccuggaaaggcucagu

SEQ ID NO: 2602745 - RNA, 22 nt, Human
aggggcugcugaccuccacagc

SEQ ID NO: 2602746 - RNA, 15 nt, Human
agggggccaggugca

SEQ ID NO: 2602747 - RNA, 19 nt, Human
agggggccaccuccccagg

SEQ ID NO: 2602748 - RNA, 21 nt, Human
aggggcugcuuccuccuggaa

SEQ ID NO: 2602749 - RNA, 15 nt, Human
agggggccaccuccc

SEQ ID NO: 2602750 - RNA, 10 nt, Human
agggggccac

SEQ ID NO: 2602751 - RNA, 20 nt, Human
ugguacccccuucugggcau

SEQ ID NO: 2602752 - RNA, 17 nt, Human
ugguacccccuucuggg

SEQ ID NO: 2602753 - RNA, 16 nt, Human
ugguacccccuucugg

SEQ ID NO: 2602754 - RNA, 22 nt, Human
ugguacccagccaucugcccag

SEQ ID NO: 2602755 - RNA, 21 nt, Human
ugguacccagccaucugccca

SEQ ID NO: 2602756 - RNA, 19 nt, Human
ugguacccagccaucugcc

SEQ ID NO: 2602757 - RNA, 18 nt, Human
ugguacccagccaucugc

SEQ ID NO: 2602758 - RNA, 17 nt, Human
ugguacccagccaucug

SEQ ID NO: 2602759 - RNA, 14 nt, Human
ugguacccucugga

SEQ ID NO: 2602760 - RNA, 21 nt, Human
ugguacccuccuggcucuuga

SEQ ID NO: 2602761 - RNA, 16 nt, Human
ugguacccuccuggcu

SEQ ID NO: 2602762 - RNA, 15 nt, Human
ugguacccuccuggc

SEQ ID NO: 2602763 - RNA, 14 nt, Human
ugguacccagccau

SEQ ID NO: 2602764 - RNA, 13 nt, Human
ugguacccagcca

SEQ ID NO: 2602765 - RNA, 18 nt, Human
ugguaccaggucuccucc

SEQ ID NO: 2602766 - RNA, 15 nt, Human
ugguaccaggucucc

SEQ ID NO: 2602767 - RNA, 18 nt, Human
ugguaccagauaaaauua

SEQ ID NO: 2602768 - RNA, 15 nt, Human
ugguaccagauaaaa

SEQ ID NO: 2602769 - RNA, 14 nt, Human
ugguaccagauaaa

SEQ ID NO: 2602770 - RNA, 13 nt, Human
ugguagagauuca

SEQ ID NO: 2602771 - RNA, 22 nt, Human
ugguagagaccgagccucuguc

SEQ ID NO: 2602772 - RNA, 17 nt, Human
ugguagaccaaaauaaa

SEQ ID NO: 2602773 - RNA, 12 nt, Human
ugguagcucagg

SEQ ID NO: 2602774 - RNA, 19 nt, Human
ugguagccaguugaauuua

SEQ ID NO: 2602775 - RNA, 22 nt, Human
ugguacuuuuaugauguauauu

SEQ ID NO: 2602776 - RNA, 21 nt, Human
ugguacuuuuaugauguauau

SEQ ID NO: 2602777 - RNA, 19 nt, Human
ugguacuuuuaugauguau

SEQ ID NO: 2602778 - RNA, 23 nt, Human
ugguacuuuuaugauguauauuu

SEQ ID NO: 2602779 - RNA, 20 nt, Human
ugguagaauuggagaguaaa

SEQ ID NO: 2602780 - RNA, 20 nt, Human
ugguagagugugccugaagu

SEQ ID NO: 2602781 - RNA, 13 nt, Human
ugguaacuguuaa

SEQ ID NO: 2602782 - RNA, 22 nt, Human
ugguaagaagccgggaacagac

SEQ ID NO: 2602783 - RNA, 17 nt, Human
ugguaacaguucauguu

SEQ ID NO: 2602784 - RNA, 23 nt, Human
ugguaaauuuccccaacagugug

SEQ ID NO: 2602785 - RNA, 22 nt, Human
ugguaaauuuccccaacagugu

SEQ ID NO: 2602786 - RNA, 20 nt, Human
ugguaaauuuccccaacagu

SEQ ID NO: 2602787 - RNA, 21 nt, Human
ugguaacaguucauguuugcu

SEQ ID NO: 2602788 - RNA, 18 nt, Human
ugguaacaguucauguuu

SEQ ID NO: 2602789 - RNA, 21 nt, Human
ugguaacauccuuucuauuga

SEQ ID NO: 2602790 - RNA, 23 nt, Human
ugggugcgaccccaucugcccag

SEQ ID NO: 2602791 - RNA, 19 nt, Human
ugguaaauuuccccaacag

SEQ ID NO: 2602792 - RNA, 16 nt, Human
ugguaaauuuccccaa

SEQ ID NO: 2602793 - RNA, 21 nt, Human
ugguaaauuaguauuuauuua

SEQ ID NO: 2602794 - RNA, 17 nt, Human
uggguggcaccagcagc

SEQ ID NO: 2602795 - RNA, 20 nt, Human
uggguggcaccagcagccug

SEQ ID NO: 2602796 - RNA, 22 nt, Human
ugggugcgaccccaucugccca

SEQ ID NO: 2602797 - RNA, 21 nt, Human
ugggugcgaccccaucugccc

SEQ ID NO: 2602798 - RNA, 20 nt, Human
ugggugcgaccccaucugcc

SEQ ID NO: 2602799 - RNA, 19 nt, Human
ugggugcgaccccaucugc

SEQ ID NO: 2602800 - RNA, 21 nt, Human
uggguggcaccagcagccugg

SEQ ID NO: 2602801 - RNA, 14 nt, Human
agggugggcuucag

SEQ ID NO: 2602802 - RNA, 18 nt, Human
uggguccaugggcagagc

SEQ ID NO: 2602803 - RNA, 16 nt, Human
aggguggugaccucug

SEQ ID NO: 2602804 - RNA, 16 nt, Human
agggucuugggaaaua

SEQ ID NO: 2602805 - RNA, 15 nt, Human
agggucuugggaaau

SEQ ID NO: 2602806 - RNA, 17 nt, Human
agggugggauggaggag

SEQ ID NO: 2602807 - RNA, 18 nt, Human
agggugggauggaggaga

SEQ ID NO: 2602808 - RNA, 15 nt, Human
agggugggagugggc

SEQ ID NO: 2602809 - RNA, 20 nt, Human
agggucugcucuuucucugc

SEQ ID NO: 2602810 - RNA, 17 nt, Human
agggucugcucuuucuc

SEQ ID NO: 2602811 - RNA, 14 nt, Human
agggucugcucuuu

SEQ ID NO: 2602812 - RNA, 13 nt, Human
agggucugcucuu

SEQ ID NO: 2602813 - RNA, 22 nt, Human
agggucugcucuuucucugcca

SEQ ID NO: 2602814 - RNA, 21 nt, Human
agggucugcucuuucucugcc

SEQ ID NO: 2602815 - RNA, 23 nt, Human
agggucugcucuuucucugccag

SEQ ID NO: 2602816 - RNA, 13 nt, Human
agggucuggagaa

SEQ ID NO: 2602817 - RNA, 14 nt, Human
agggucuggagaag

SEQ ID NO: 2602818 - RNA, 19 nt, Human
agggucuggagaagcagug

SEQ ID NO: 2602819 - RNA, 17 nt, Human
agggucugggcaggacu

SEQ ID NO: 2602820 - RNA, 15 nt, Human
agggucuggagaagc

SEQ ID NO: 2602821 - RNA, 15 nt, Human
agggucuucccuacc

SEQ ID NO: 2602822 - RNA, 14 nt, Human
agggucuugggaaa

SEQ ID NO: 2602823 - RNA, 17 nt, Human
agggucuucccuaccuc

SEQ ID NO: 2602824 - RNA, 18 nt, Human
ugggucgcccuggacugu

SEQ ID NO: 2602825 - RNA, 16 nt, Human
ugggucgcccuggacu

SEQ ID NO: 2602826 - RNA, 20 nt, Human
ugggucccacuuccccuccu

SEQ ID NO: 2602827 - RNA, 19 nt, Human
ugggucccacuuccccucc

SEQ ID NO: 2602828 - RNA, 17 nt, Human
ugggucccacuuccccu

SEQ ID NO: 2602829 - RNA, 22 nt, Human
ugggucccacuuccccuccuac

SEQ ID NO: 2602830 - RNA, 21 nt, Human
uggguccugggucuuucaugg

SEQ ID NO: 2602831 - RNA, 18 nt, Human
uggguccucacaucuuuc

SEQ ID NO: 2602832 - RNA, 17 nt, Human
ugggucccccacgugac

SEQ ID NO: 2602833 - RNA, 19 nt, Human
ugggugagaugcuggagaa

SEQ ID NO: 2602834 - RNA, 18 nt, Human
ugggugagaugcuggaga

SEQ ID NO: 2602835 - RNA, 13 nt, Human
ugggugagaacaa

SEQ ID NO: 2602836 - RNA, 23 nt, Human
ugggugaccaguugcacuuggcc

SEQ ID NO: 2602837 - RNA, 12 nt, Human
ugggugacauuu

SEQ ID NO: 2602838 - RNA, 17 nt, Human
ugggugacagagcaaga

SEQ ID NO: 2602839 - RNA, 14 nt, Human
ugggugacagagca

SEQ ID NO: 2602840 - RNA, 15 nt, Human
ugggugaagggagag

SEQ ID NO: 2602841 - RNA, 18 nt, Human
uggguccuuuucagaagu

SEQ ID NO: 2602842 - RNA, 13 nt, Human
ugggugcgacccc

SEQ ID NO: 2602843 - RNA, 18 nt, Human
ugggugcccaagcucaga

SEQ ID NO: 2602844 - RNA, 17 nt, Human
ugggugcccaagcucag

SEQ ID NO: 2602845 - RNA, 23 nt, Human
ugggugccccccuugccagacau

SEQ ID NO: 2602846 - RNA, 21 nt, Human
ugggugagaugcuggagaaga

SEQ ID NO: 2602847 - RNA, 15 nt, Human
uggggccuggagcag

SEQ ID NO: 2602848 - RNA, 20 nt, Human
uggggccuggaccugccucc

SEQ ID NO: 2602849 - RNA, 19 nt, Human
uggggccuggaccugccuc

SEQ ID NO: 2602850 - RNA, 17 nt, Human
uggggccuggaccugcc

SEQ ID NO: 2602851 - RNA, 16 nt, Human
uggggccuggaccugc

SEQ ID NO: 2602852 - RNA, 15 nt, Human
uggggccuggaccug

SEQ ID NO: 2602853 - RNA, 19 nt, Human
uggggccugauggggaggg

SEQ ID NO: 2602854 - RNA, 17 nt, Human
uggggcucacacaccug

SEQ ID NO: 2602855 - RNA, 20 nt, Human
uggggcuagggggagccccu

SEQ ID NO: 2602856 - RNA, 15 nt, Human
uggggcucagagugg

SEQ ID NO: 2602857 - RNA, 23 nt, Human
uggggcugcaccggcuggccugg

SEQ ID NO: 2602858 - RNA, 22 nt, Human
uggggcugcaccggcuggccug

SEQ ID NO: 2602859 - RNA, 17 nt, Human
uggggcucgccaugccg

SEQ ID NO: 2602860 - RNA, 13 nt, Human
uggggcucgccau

SEQ ID NO: 2602861 - RNA, 23 nt, Human
uggggcuccuuucuccagccagc

SEQ ID NO: 2602862 - RNA, 21 nt, Human
uggggcuccuuucuccagcca

SEQ ID NO: 2602863 - RNA, 11 nt, Human
uggggcuccuu

SEQ ID NO: 2602864 - RNA, 14 nt, Human
uggggcucccgccc

SEQ ID NO: 2602865 - RNA, 20 nt, Human
uggggaggggcgcuggccca

SEQ ID NO: 2602866 - RNA, 19 nt, Human
uggggaggggcgcuggccc

SEQ ID NO: 2602867 - RNA, 15 nt, Human
uggggaggggcgcug

SEQ ID NO: 2602868 - RNA, 12 nt, Human
uggggaggggcg

SEQ ID NO: 2602869 - RNA, 22 nt, Human
uggggaggggcgcuggcccagc

SEQ ID NO: 2602870 - RNA, 21 nt, Human
uggggaggggcgcuggcccag

SEQ ID NO: 2602871 - RNA, 21 nt, Human
uggggagggccguaccccacc

SEQ ID NO: 2602872 - RNA, 17 nt, Human
uggggagggccguaccc

SEQ ID NO: 2602873 - RNA, 22 nt, Human
uggggagggauucugguuccag

SEQ ID NO: 2602874 - RNA, 22 nt, Human
uggggagggauuuggggcucag

SEQ ID NO: 2602875 - RNA, 21 nt, Human
uggggccaguuggucccccuu

SEQ ID NO: 2602876 - RNA, 12 nt, Human
uggggcccugcc

SEQ ID NO: 2602877 - RNA, 23 nt, Human
uggggaggggcgcuggcccagcc

SEQ ID NO: 2602878 - RNA, 21 nt, Human
uggggccccuuuuuacucccc

SEQ ID NO: 2602879 - RNA, 22 nt, Human
uggggccccuuuuuacuccccu

SEQ ID NO: 2602880 - RNA, 22 nt, Human
uggggccuaucagugugccccc

SEQ ID NO: 2602881 - RNA, 19 nt, Human
uggggccuaucagugugcc

SEQ ID NO: 2602882 - RNA, 14 nt, Human
uggggccuccagaa

SEQ ID NO: 2602883 - RNA, 20 nt, Human
uggggccuccagaacucacu

SEQ ID NO: 2602884 - RNA, 11 nt, Human
uggggccucug

SEQ ID NO: 2602885 - RNA, 20 nt, Human
uggggccuaucagugugccc

SEQ ID NO: 2602886 - RNA, 12 nt, Human
uggggccucugu

SEQ ID NO: 2602887 - RNA, 12 nt, Human
agggcuccagac

SEQ ID NO: 2602888 - RNA, 15 nt, Human
agggcuccagacaca

SEQ ID NO: 2602889 - RNA, 14 nt, Human
agggcucagccugg

SEQ ID NO: 2602890 - RNA, 15 nt, Human
agggcucagccuggu

SEQ ID NO: 2602891 - RNA, 23 nt, Human
agggcucaggauuucgugggucu

SEQ ID NO: 2602892 - RNA, 13 nt, Human
agggcucaggauu

SEQ ID NO: 2602893 - RNA, 24 nt, Human
agggcucaggauuucgugggucug

SEQ ID NO: 2602894 - RNA, 23 nt, Human
agggcucuaaaaaaagccccaaa

SEQ ID NO: 2602895 - RNA, 15 nt, Human
agggcucuaaaaaaa

SEQ ID NO: 2602896 - RNA, 15 nt, Human
uggggaccucaggcc

SEQ ID NO: 2602897 - RNA, 14 nt, Human
uggggaccucaggc

SEQ ID NO: 2602898 - RNA, 21 nt, Human
agggcucucuuuccuucuugc

SEQ ID NO: 2602899 - RNA, 19 nt, Human
agggcucucuuuccuucuu

SEQ ID NO: 2602900 - RNA, 15 nt, Human
agggcucugaccagu

SEQ ID NO: 2602901 - RNA, 14 nt, Human
agggcucugaccag

SEQ ID NO: 2602902 - RNA, 15 nt, Human
agggcucugauauuc

SEQ ID NO: 2602903 - RNA, 22 nt, Human
agggcucugauauuccaugaau

SEQ ID NO: 2602904 - RNA, 17 nt, Human
uggggaccucaggccug

SEQ ID NO: 2602905 - RNA, 16 nt, Human
uggggaccucaggccu

SEQ ID NO: 2602906 - RNA, 21 nt, Human
uggggagacugggcugaggga

SEQ ID NO: 2602907 - RNA, 17 nt, Human
uggggagacugggcuga

SEQ ID NO: 2602908 - RNA, 14 nt, Human
agggcugaaagcca

SEQ ID NO: 2602909 - RNA, 17 nt, Human
agggcucugauauucca

SEQ ID NO: 2602910 - RNA, 15 nt, Human
agggcucuuuagcca

SEQ ID NO: 2602911 - RNA, 21 nt, Human
agggcucugauauuccaugaa

SEQ ID NO: 2602912 - RNA, 21 nt, Human
uggggagcccgucucaguguu

SEQ ID NO: 2602913 - RNA, 19 nt, Human
uggggagcccgucucagug

SEQ ID NO: 2602914 - RNA, 18 nt, Human
uggggagcccgucucagu

SEQ ID NO: 2602915 - RNA, 22 nt, Human
uggggagccaacagaagcuucc

SEQ ID NO: 2602916 - RNA, 16 nt, Human
uggggagccaacagaa

SEQ ID NO: 2602917 - RNA, 15 nt, Human
uggggagcagagaca

SEQ ID NO: 2602918 - RNA, 17 nt, Human
uggggagcagagacacu

SEQ ID NO: 2602919 - RNA, 18 nt, Human
uggggagggauucugguu

SEQ ID NO: 2602920 - RNA, 23 nt, Human
uggggaggcggacguuccagccg

SEQ ID NO: 2602921 - RNA, 14 nt, Human
uggggagggauuug

SEQ ID NO: 2602922 - RNA, 22 nt, Human
uggggaggcggacguuccagcc

SEQ ID NO: 2602923 - RNA, 13 nt, Human
aggggaaaagagg

SEQ ID NO: 2602924 - RNA, 18 nt, Human
agggcuuuguuuugcaca

SEQ ID NO: 2602925 - RNA, 18 nt, Human
uggggugcugggaggagg

SEQ ID NO: 2602926 - RNA, 16 nt, Human
uggggugggccucugg

SEQ ID NO: 2602927 - RNA, 12 nt, Human
uggggugggccu

SEQ ID NO: 2602928 - RNA, 13 nt, Human
uggggugggagag

SEQ ID NO: 2602929 - RNA, 15 nt, Human
uggggugggagaggu

SEQ ID NO: 2602930 - RNA, 13 nt, Human
uggggucuguaaa

SEQ ID NO: 2602931 - RNA, 18 nt, Human
uggggucuggcagccucc

SEQ ID NO: 2602932 - RNA, 14 nt, Human
uggggucuggcagc

SEQ ID NO: 2602933 - RNA, 17 nt, Human
uggggucuggcagccuc

SEQ ID NO: 2602934 - RNA, 14 nt, Human
uggggucugacccc

SEQ ID NO: 2602935 - RNA, 21 nt, Human
uggggucuggaguugaucugg

SEQ ID NO: 2602936 - RNA, 16 nt, Human
uggggucuguaaaauc

SEQ ID NO: 2602937 - RNA, 14 nt, Human
uggggugaggacca

SEQ ID NO: 2602938 - RNA, 17 nt, Human
uggggugaggaccacuc

SEQ ID NO: 2602939 - RNA, 17 nt, Human
uggggugaugcugggcu

SEQ ID NO: 2602940 - RNA, 13 nt, Human
uggggugcuggga

SEQ ID NO: 2602941 - RNA, 17 nt, Human
uggggugccgccugccc

SEQ ID NO: 2602942 - RNA, 15 nt, Human
uggggugccgccugc

SEQ ID NO: 2602943 - RNA, 13 nt, Human
aggggaaaaugaa

SEQ ID NO: 2602944 - RNA, 23 nt, Human
aggggaaaccaguguagccuugc

SEQ ID NO: 2602945 - RNA, 20 nt, Human
aggggaaaccaguguagccu

SEQ ID NO: 2602946 - RNA, 21 nt, Human
aggggaaaccaguguagccuu

SEQ ID NO: 2602947 - RNA, 14 nt, Human
aggggaacagacug

SEQ ID NO: 2602948 - RNA, 18 nt, Human
aggggaaaaucagccugc

SEQ ID NO: 2602949 - RNA, 22 nt, Human
aggggaaaaucagccugcucca

SEQ ID NO: 2602950 - RNA, 18 nt, Human
aggggaagaguguacugg

SEQ ID NO: 2602951 - RNA, 16 nt, Human
aggggaagaguguacu

SEQ ID NO: 2602952 - RNA, 21 nt, Human
aggggaauaaacuguugaguc

SEQ ID NO: 2602953 - RNA, 22 nt, Human
aggggaagaguguacugggggu

SEQ ID NO: 2602954 - RNA, 13 nt, Human
aggggaauguuug

SEQ ID NO: 2602955 - RNA, 14 nt, Human
aggggaagggccag

SEQ ID NO: 2602956 - RNA, 23 nt, Human
aggggaagggccagucugggcug

SEQ ID NO: 2602957 - RNA, 17 nt, Human
aggggaauaauagaaga

SEQ ID NO: 2602958 - RNA, 18 nt, Human
aggggaauaauagaagaa

SEQ ID NO: 2602959 - RNA, 19 nt, Human
aggggaauaauagaagaac

SEQ ID NO: 2602960 - RNA, 14 nt, Human
uggggucacucugg

SEQ ID NO: 2602961 - RNA, 13 nt, Human
uggggucacucug

SEQ ID NO: 2602962 - RNA, 19 nt, Human
ugggguacccacugcucug

SEQ ID NO: 2602963 - RNA, 18 nt, Human
ugggguacccacugcucu

SEQ ID NO: 2602964 - RNA, 17 nt, Human
ugggguacccacugcuc

SEQ ID NO: 2602965 - RNA, 14 nt, Human
uggggcuggcacaa

SEQ ID NO: 2602966 - RNA, 14 nt, Human
uggggcuggccucc

SEQ ID NO: 2602967 - RNA, 13 nt, Human
uggggcugcuggc

SEQ ID NO: 2602968 - RNA, 12 nt, Human
uggggcugcugg

SEQ ID NO: 2602969 - RNA, 19 nt, Human
uggggcugcuccuccaggg

SEQ ID NO: 2602970 - RNA, 21 nt, Human
uggggcugcuccuccagggcc

SEQ ID NO: 2602971 - RNA, 14 nt, Human
uggggcugcuccuc

SEQ ID NO: 2602972 - RNA, 15 nt, Human
uggggcugcuccucc

SEQ ID NO: 2602973 - RNA, 16 nt, Human
uggggcugcuccucca

SEQ ID NO: 2602974 - RNA, 17 nt, Human
uggggcugcuccuccag

SEQ ID NO: 2602975 - RNA, 22 nt, Human
uggggucacucuggcagcucag

SEQ ID NO: 2602976 - RNA, 15 nt, Human
uggggucagccaggg

SEQ ID NO: 2602977 - RNA, 14 nt, Human
uggggucagccagg

SEQ ID NO: 2602978 - RNA, 13 nt, Human
uggggucagccag

SEQ ID NO: 2602979 - RNA, 17 nt, Human
uggggucagagacugcu

SEQ ID NO: 2602980 - RNA, 19 nt, Human
uggggucagccagggccag

SEQ ID NO: 2602981 - RNA, 18 nt, Human
uggggucagccagggcca

SEQ ID NO: 2602982 - RNA, 21 nt, Human
uggggucagccagggccaggg

SEQ ID NO: 2602983 - RNA, 16 nt, Human
uggggucacucuggca

SEQ ID NO: 2602984 - RNA, 21 nt, Human
ugggguauuuggggcuuauuu

SEQ ID NO: 2602985 - RNA, 24 nt, Human
ugggguauuuaccacagcagcuga

SEQ ID NO: 2602986 - RNA, 20 nt, Human
ugggguauuuaccacagcag

SEQ ID NO: 2602987 - RNA, 16 nt, Human
uggggcugggcagcua

SEQ ID NO: 2602988 - RNA, 19 nt, Human
ugggguccuggccauccca

SEQ ID NO: 2602989 - RNA, 15 nt, Human
ugggguccuggccau

SEQ ID NO: 2602990 - RNA, 16 nt, Human
ugggguccuggccauc

SEQ ID NO: 2602991 - RNA, 16 nt, Human
ugggguccuggggccu

SEQ ID NO: 2602992 - RNA, 21 nt, Human
uggggucucacaguguugccc

SEQ ID NO: 2602993 - RNA, 23 nt, Human
uggggucucacaguguugcccag

SEQ ID NO: 2602994 - RNA, 13 nt, Human
uggggucucccuc

SEQ ID NO: 2602995 - RNA, 19 nt, Human
uggggucucccucuccugc

SEQ ID NO: 2602996 - RNA, 21 nt, Human
uggggucucccucuccugccu

SEQ ID NO: 2602997 - RNA, 22 nt, Human
uggggucucccucuccugccua

SEQ ID NO: 2602998 - RNA, 13 nt, Human
ugggguccccauc

SEQ ID NO: 2602999 - RNA, 20 nt, Human
ugggguccuggagcagacca

SEQ ID NO: 2603000 - RNA, 13 nt, Human
uggggucccucua

SEQ ID NO: 2603001 - RNA, 12 nt, Human
ugggguccuggc

SEQ ID NO: 2603002 - RNA, 13 nt, Human
uggggucaugccc

SEQ ID NO: 2603003 - RNA, 18 nt, Human
uggggucaugcccuccuc

SEQ ID NO: 2603004 - RNA, 20 nt, Human
uggggucaugcccuccucuc

SEQ ID NO: 2603005 - RNA, 14 nt, Human
ugggguccagggag

SEQ ID NO: 2603006 - RNA, 18 nt, Human
agggagggacauggcccc

SEQ ID NO: 2603007 - RNA, 15 nt, Human
agggaggcaagcccu

SEQ ID NO: 2603008 - RNA, 13 nt, Human
agggagggcucca

SEQ ID NO: 2603009 - RNA, 15 nt, Human
agggagggagggcuc

SEQ ID NO: 2603010 - RNA, 19 nt, Human
ugggccccugccucucugc

SEQ ID NO: 2603011 - RNA, 15 nt, Human
ugggccccugccucu

SEQ ID NO: 2603012 - RNA, 15 nt, Human
ugggccccugccaga

SEQ ID NO: 2603013 - RNA, 16 nt, Human
agggaggcaagcccug

SEQ ID NO: 2603014 - RNA, 13 nt, Human
agggaggcaagcc

SEQ ID NO: 2603015 - RNA, 14 nt, Human
agggaggcaagccc

SEQ ID NO: 2603016 - RNA, 22 nt, Human
ugggccccagcccacccuccug

SEQ ID NO: 2603017 - RNA, 20 nt, Human
ugggccccagcccacccucc

SEQ ID NO: 2603018 - RNA, 18 nt, Human
ugggccccagcccacccu

SEQ ID NO: 2603019 - RNA, 17 nt, Human
ugggccccagcccaccc

SEQ ID NO: 2603020 - RNA, 18 nt, Human
ugggccccaguuguauuu

SEQ ID NO: 2603021 - RNA, 20 nt, Human
ugggccauacuggccucgcc

SEQ ID NO: 2603022 - RNA, 18 nt, Human
ugggccauacuggccucg

SEQ ID NO: 2603023 - RNA, 17 nt, Human
ugggccauacuggccuc

SEQ ID NO: 2603024 - RNA, 16 nt, Human
ugggccauacuggccu

SEQ ID NO: 2603025 - RNA, 18 nt, Human
ugggccauagcuccugcu

SEQ ID NO: 2603026 - RNA, 24 nt, Human
ugggccauacuggccucgccuggc

SEQ ID NO: 2603027 - RNA, 19 nt, Human
ugggcagaagggagaagga

SEQ ID NO: 2603028 - RNA, 18 nt, Human
ugggcagaagggagaagg

SEQ ID NO: 2603029 - RNA, 16 nt, Human
ugggccagucugugga

SEQ ID NO: 2603030 - RNA, 20 nt, Human
ugggccagucuguggaucag

SEQ ID NO: 2603031 - RNA, 15 nt, Human
ugggccauacuggcc

SEQ ID NO: 2603032 - RNA, 14 nt, Human
ugggccaguguggg

SEQ ID NO: 2603033 - RNA, 16 nt, Human
ugggcccccaaaugga

SEQ ID NO: 2603034 - RNA, 15 nt, Human
ugggccccagccuuc

SEQ ID NO: 2603035 - RNA, 22 nt, Human
ugggccccaguuguauuuauuu

SEQ ID NO: 2603036 - RNA, 21 nt, Human
ugggcccccaaauggaaaugg

SEQ ID NO: 2603037 - RNA, 23 nt, Human
ugggccccucaucugcucagcag

SEQ ID NO: 2603038 - RNA, 19 nt, Human
ugggccccucaucugcuca

SEQ ID NO: 2603039 - RNA, 15 nt, Human
ugggccccucuccca

SEQ ID NO: 2603040 - RNA, 18 nt, Human
ugggccaggagccuccug

SEQ ID NO: 2603041 - RNA, 12 nt, Human
ugggcagagcag

SEQ ID NO: 2603042 - RNA, 11 nt, Human
ugggcagagca

SEQ ID NO: 2603043 - RNA, 12 nt, Human
ugggcagaagga

SEQ ID NO: 2603044 - RNA, 22 nt, Human
ugggcacugggaugagccgcug

SEQ ID NO: 2603045 - RNA, 22 nt, Human
ugggcacugcuggguggcccau

SEQ ID NO: 2603046 - RNA, 21 nt, Human
ugggcacugcuggguggccca

SEQ ID NO: 2603047 - RNA, 17 nt, Human
ugggcagaagggagaag

SEQ ID NO: 2603048 - RNA, 15 nt, Human
ugggcagaagggaga

SEQ ID NO: 2603049 - RNA, 18 nt, Human
ugggcagaaggccaagag

SEQ ID NO: 2603050 - RNA, 17 nt, Human
ugggcagaaggccaaga

SEQ ID NO: 2603051 - RNA, 16 nt, Human
ugggcagaaggccaag

SEQ ID NO: 2603052 - RNA, 15 nt, Human
ugggcacuuuuuaau

SEQ ID NO: 2603053 - RNA, 16 nt, Human
ugggcacugggaugag

SEQ ID NO: 2603054 - RNA, 15 nt, Human
ugggcacugggauga

SEQ ID NO: 2603055 - RNA, 23 nt, Human
ugggcacugcuggguggcccauc

SEQ ID NO: 2603056 - RNA, 15 nt, Human
ugggcagaaggccaa

SEQ ID NO: 2603057 - RNA, 20 nt, Human
ugggaggaucucuugagccu

SEQ ID NO: 2603058 - RNA, 21 nt, Human
ugggaggaucucuugagccug

SEQ ID NO: 2603059 - RNA, 22 nt, Human
ugggaggaucucuugagccugg

SEQ ID NO: 2603060 - RNA, 19 nt, Human
ugggaggccaaggugggag

SEQ ID NO: 2603061 - RNA, 20 nt, Human
ugggaggccaaggugggagg

SEQ ID NO: 2603062 - RNA, 19 nt, Human
ugggaggcaagaggggugg

SEQ ID NO: 2603063 - RNA, 18 nt, Human
ugggaggcaagaggggug

SEQ ID NO: 2603064 - RNA, 16 nt, Human
ugggaggcauggcccu

SEQ ID NO: 2603065 - RNA, 18 nt, Human
ugggaggcauggcccugg

SEQ ID NO: 2603066 - RNA, 23 nt, Human
ugggaggcaagagggguggagac

SEQ ID NO: 2603067 - RNA, 14 nt, Human
ugggaggccaagga

SEQ ID NO: 2603068 - RNA, 16 nt, Human
ugggaggccccacugg

SEQ ID NO: 2603069 - RNA, 20 nt, Human
ugggaggccccacuggggaa

SEQ ID NO: 2603070 - RNA, 15 nt, Human
ugggcaccuggggag

SEQ ID NO: 2603071 - RNA, 18 nt, Human
ugggaggccccacugggg

SEQ ID NO: 2603072 - RNA, 17 nt, Human
ugggcaccuggggagug

SEQ ID NO: 2603073 - RNA, 19 nt, Human
ugggcaccuggggaguggg

SEQ ID NO: 2603074 - RNA, 20 nt, Human
ugggcaccuggggaguggga

SEQ ID NO: 2603075 - RNA, 17 nt, Human
ugggcacugcugggugg

SEQ ID NO: 2603076 - RNA, 16 nt, Human
ugggcacugcugggug

SEQ ID NO: 2603077 - RNA, 14 nt, Human
ugggcacugcuggg

SEQ ID NO: 2603078 - RNA, 21 nt, Human
ugggcacgcugugggcaggug

SEQ ID NO: 2603079 - RNA, 19 nt, Human
ugggcacgcugugggcagg

SEQ ID NO: 2603080 - RNA, 15 nt, Human
agggcccugagcuga

SEQ ID NO: 2603081 - RNA, 16 nt, Human
agggcccugagcucgg

SEQ ID NO: 2603082 - RNA, 23 nt, Human
agggccccucugcccagcuuggg

SEQ ID NO: 2603083 - RNA, 21 nt, Human
agggccccucugcccagcuug

SEQ ID NO: 2603084 - RNA, 13 nt, Human
agggcccuaccug

SEQ ID NO: 2603085 - RNA, 19 nt, Human
agggcccugagcugagggc

SEQ ID NO: 2603086 - RNA, 18 nt, Human
agggcccugagcugaggg

SEQ ID NO: 2603087 - RNA, 12 nt, Human
agggcccugcag

SEQ ID NO: 2603088 - RNA, 13 nt, Human
agggcccugcaga

SEQ ID NO: 2603089 - RNA, 15 nt, Human
agggcccuucacugc

SEQ ID NO: 2603090 - RNA, 24 nt, Human
agggcccugguguuucuagcacug

SEQ ID NO: 2603091 - RNA, 13 nt, Human
agggcccuggugu

SEQ ID NO: 2603092 - RNA, 12 nt, Human
agggcucagccu

SEQ ID NO: 2603093 - RNA, 13 nt, Human
agggcucagccug

SEQ ID NO: 2603094 - RNA, 23 nt, Human
agggcucagcggggacagcuccu

SEQ ID NO: 2603095 - RNA, 22 nt, Human
agggcucagcggggacagcucc

SEQ ID NO: 2603096 - RNA, 20 nt, Human
agggcucagcggggacagcu

SEQ ID NO: 2603097 - RNA, 19 nt, Human
agggcucagcggggacagc

SEQ ID NO: 2603098 - RNA, 20 nt, Human
agggccccucugcccagcuu

SEQ ID NO: 2603099 - RNA, 19 nt, Human
agggccccucugcccagcu

SEQ ID NO: 2603100 - RNA, 18 nt, Human
agggccccucugcccagc

SEQ ID NO: 2603101 - RNA, 17 nt, Human
agggccccucugcccag

SEQ ID NO: 2603102 - RNA, 16 nt, Human
agggccccucugccca

SEQ ID NO: 2603103 - RNA, 15 nt, Human
agggccccucugccc

SEQ ID NO: 2603104 - RNA, 14 nt, Human
agggccccucugcc

SEQ ID NO: 2603105 - RNA, 13 nt, Human
agggccccucugc

SEQ ID NO: 2603106 - RNA, 17 nt, Human
agggcccaagucccugu

SEQ ID NO: 2603107 - RNA, 16 nt, Human
agggcccaagucccug

SEQ ID NO: 2603108 - RNA, 19 nt, Human
agggccaugcugaagggac

SEQ ID NO: 2603109 - RNA, 22 nt, Human
agggcccaagucccuguuuucu

SEQ ID NO: 2603110 - RNA, 19 nt, Human
agggcccaagucccuguuu

SEQ ID NO: 2603111 - RNA, 23 nt, Human
agggccaugcugaggccugggcc

SEQ ID NO: 2603112 - RNA, 22 nt, Human
agggccaugcugaggccugggc

SEQ ID NO: 2603113 - RNA, 21 nt, Human
agggccaugcugaggccuggg

SEQ ID NO: 2603114 - RNA, 20 nt, Human
agggccaugcugaggccugg

SEQ ID NO: 2603115 - RNA, 19 nt, Human
agggccaugcugaggccug

SEQ ID NO: 2603116 - RNA, 18 nt, Human
agggccaugcugaaggga

SEQ ID NO: 2603117 - RNA, 17 nt, Human
agggccaugccugcccc

SEQ ID NO: 2603118 - RNA, 15 nt, Human
agggccagagccagg

SEQ ID NO: 2603119 - RNA, 19 nt, Human
agggccaguccugccuggc

SEQ ID NO: 2603120 - RNA, 21 nt, Human
agggccaguccugccuggcca

SEQ ID NO: 2603121 - RNA, 15 nt, Human
agggccagucugggc

SEQ ID NO: 2603122 - RNA, 22 nt, Human
agggccaguccugccuggccag

SEQ ID NO: 2603123 - RNA, 23 nt, Human
agggccaguccugccuggccagg

SEQ ID NO: 2603124 - RNA, 11 nt, Human
agggccagagc

SEQ ID NO: 2603125 - RNA, 12 nt, Human
agggccagagcc

SEQ ID NO: 2603126 - RNA, 13 nt, Human
agggccagagcca

SEQ ID NO: 2603127 - RNA, 14 nt, Human
agggccagagccag

SEQ ID NO: 2603128 - RNA, 18 nt, Human
agggccacgugccaggcc

SEQ ID NO: 2603129 - RNA, 19 nt, Human
agggccacgugccaggccc

SEQ ID NO: 2603130 - RNA, 20 nt, Human
agggccacgugccaggcccg

SEQ ID NO: 2603131 - RNA, 14 nt, Human
agggccacucugcc

SEQ ID NO: 2603132 - RNA, 15 nt, Human
agggccacucugccu

SEQ ID NO: 2603133 - RNA, 18 nt, Human
agggccacucugccucug

SEQ ID NO: 2603134 - RNA, 14 nt, Human
agggccacugaaga

SEQ ID NO: 2603135 - RNA, 17 nt, Human
agggcaucuuagcuucu

SEQ ID NO: 2603136 - RNA, 22 nt, Human
agggcaucuugguccaggaaau

SEQ ID NO: 2603137 - RNA, 22 nt, Human
agggcaugccccggccaccucu

SEQ ID NO: 2603138 - RNA, 21 nt, Human
agggcaugccccggccaccuc

SEQ ID NO: 2603139 - RNA, 20 nt, Human
agggcaugccccggccaccu

SEQ ID NO: 2603140 - RNA, 15 nt, Human
agggcaugccccggc

SEQ ID NO: 2603141 - RNA, 22 nt, Human
agggcaugccacgugggcucau

SEQ ID NO: 2603142 - RNA, 18 nt, Human
agggcaugcauuuugcag

SEQ ID NO: 2603143 - RNA, 21 nt, Human
agggccacaugggaggcucac

SEQ ID NO: 2603144 - RNA, 15 nt, Human
agggccacgugccag

SEQ ID NO: 2603145 - RNA, 16 nt, Human
agggccacgugccagg

SEQ ID NO: 2603146 - RNA, 20 nt, Human
agggccacaugggaggcuca

SEQ ID NO: 2603147 - RNA, 23 nt, Human
agggcaugccccggccaccucug

SEQ ID NO: 2603148 - RNA, 17 nt, Human
agggcaugcgcacaagg

SEQ ID NO: 2603149 - RNA, 21 nt, Human
agggcaugcgcacaaggcuga

SEQ ID NO: 2603150 - RNA, 23 nt, Human
agggcaggaaggagagccugcug

SEQ ID NO: 2603151 - RNA, 19 nt, Human
agggcaggaaggagagccu

SEQ ID NO: 2603152 - RNA, 21 nt, Human
agggcaggaaggagagccugc

SEQ ID NO: 2603153 - RNA, 23 nt, Human
agggcagcuugccccggccccgg

SEQ ID NO: 2603154 - RNA, 18 nt, Human
agggcagcuugccccggc

SEQ ID NO: 2603155 - RNA, 17 nt, Human
agggcagcuugccccgg

SEQ ID NO: 2603156 - RNA, 13 nt, Human
agggcagcuugcc

SEQ ID NO: 2603157 - RNA, 16 nt, Human
agggcaggaaggagag

SEQ ID NO: 2603158 - RNA, 18 nt, Human
agggcaggaaggagagcc

SEQ ID NO: 2603159 - RNA, 12 nt, Human
agggcaucuccu

SEQ ID NO: 2603160 - RNA, 21 nt, Human
agggcaucuccugugcauggg

SEQ ID NO: 2603161 - RNA, 23 nt, Human
agggcaucuccugugcaugggug

SEQ ID NO: 2603162 - RNA, 11 nt, Human
agggcaggcau

SEQ ID NO: 2603163 - RNA, 13 nt, Human
agggcaucuccug

SEQ ID NO: 2603164 - RNA, 14 nt, Human
agggcaucuccugu

SEQ ID NO: 2603165 - RNA, 16 nt, Human
agggcaucuccugugc

SEQ ID NO: 2603166 - RNA, 15 nt, Human
agggagggcuccaga

SEQ ID NO: 2603167 - RNA, 14 nt, Human
agggagggcuccag

SEQ ID NO: 2603168 - RNA, 16 nt, Human
agggagggcuccagac

SEQ ID NO: 2603169 - RNA, 20 nt, Human
agggcacauuccuugccugc

SEQ ID NO: 2603170 - RNA, 19 nt, Human
agggcacauuccuugccug

SEQ ID NO: 2603171 - RNA, 14 nt, Human
agggcaccaggggu

SEQ ID NO: 2603172 - RNA, 15 nt, Human
agggcacuggagcug

SEQ ID NO: 2603173 - RNA, 13 nt, Human
agggcacuggagc

SEQ ID NO: 2603174 - RNA, 21 nt, Human
agggcacauuccuugccugca

SEQ ID NO: 2603175 - RNA, 14 nt, Human
agggcacugguggc

SEQ ID NO: 2603176 - RNA, 21 nt, Human
agggcaccagggguuucucgc

SEQ ID NO: 2603177 - RNA, 19 nt, Human
agggcaccagggguuucuc

SEQ ID NO: 2603178 - RNA, 21 nt, Human
agggcacccuaguucuaccuc

SEQ ID NO: 2603179 - RNA, 16 nt, Human
agggcacugcugcugc

SEQ ID NO: 2603180 - RNA, 11 nt, Human
agggcagcuug

SEQ ID NO: 2603181 - RNA, 20 nt, Human
agggcagcugggcccaaccc

SEQ ID NO: 2603182 - RNA, 18 nt, Human
agggcagcugggcccaac

SEQ ID NO: 2603183 - RNA, 17 nt, Human
agggcagcugggcccaa

SEQ ID NO: 2603184 - RNA, 16 nt, Human
agggcagcugggccca

SEQ ID NO: 2603185 - RNA, 15 nt, Human
agggcagcugggccc

SEQ ID NO: 2603186 - RNA, 14 nt, Human
agggcagcugggcc

SEQ ID NO: 2603187 - RNA, 16 nt, Human
agggcacugguggccc

SEQ ID NO: 2603188 - RNA, 17 nt, Human
agggcagcgccaggcug

SEQ ID NO: 2603189 - RNA, 23 nt, Human
agggaaggaacucuggcuuccag

SEQ ID NO: 2603190 - RNA, 21 nt, Human
agggaagcuacagguuacaac

SEQ ID NO: 2603191 - RNA, 16 nt, Human
agggaagcuggccgag

SEQ ID NO: 2603192 - RNA, 13 nt, Human
agggaagcuacag

SEQ ID NO: 2603193 - RNA, 19 nt, Human
agggaagcacugccucccu

SEQ ID NO: 2603194 - RNA, 19 nt, Human
agggaagcuacagguuaca

SEQ ID NO: 2603195 - RNA, 16 nt, Human
agggaagcuacagguu

SEQ ID NO: 2603196 - RNA, 13 nt, Human
agggaagcuggcc

SEQ ID NO: 2603197 - RNA, 16 nt, Human
agggaagccugaaaaa

SEQ ID NO: 2603198 - RNA, 14 nt, Human
agggaagagugcau

SEQ ID NO: 2603199 - RNA, 12 nt, Human
agggaagagcag

SEQ ID NO: 2603200 - RNA, 15 nt, Human
agggaagagaaagug

SEQ ID NO: 2603201 - RNA, 13 nt, Human
agggaacagacag

SEQ ID NO: 2603202 - RNA, 14 nt, Human
agggaacagacagg

SEQ ID NO: 2603203 - RNA, 15 nt, Human
agggaacagacagga

SEQ ID NO: 2603204 - RNA, 14 nt, Human
agggaacagugagg

SEQ ID NO: 2603205 - RNA, 21 nt, Human
agggaacagacaggagaaaug

SEQ ID NO: 2603206 - RNA, 17 nt, Human
agggaacagacaggaga

SEQ ID NO: 2603207 - RNA, 18 nt, Human
agggaacagacaggagaa

SEQ ID NO: 2603208 - RNA, 19 nt, Human
agggaacagacaggagaaa

SEQ ID NO: 2603209 - RNA, 20 nt, Human
agggaacagacaggagaaau

SEQ ID NO: 2603210 - RNA, 15 nt, Human
agggaacucuggggu

SEQ ID NO: 2603211 - RNA, 14 nt, Human
agggaacucugggg

SEQ ID NO: 2603212 - RNA, 16 nt, Human
agggaagaaaagagcu

SEQ ID NO: 2603213 - RNA, 19 nt, Human
agggaaccguuauuauaau

SEQ ID NO: 2603214 - RNA, 22 nt, Human
agggaaccguuauuauaauugu

SEQ ID NO: 2603215 - RNA, 14 nt, Human
agggaaccuguguc

SEQ ID NO: 2603216 - RNA, 19 nt, Human
agggaacgggguccuucaa

SEQ ID NO: 2603217 - RNA, 22 nt, Human
aggcccucccuguuccccagag

SEQ ID NO: 2603218 - RNA, 23 nt, Human
aggcccucccuguuccccagaga

SEQ ID NO: 2603219 - RNA, 13 nt, Human
agggaaauuucag

SEQ ID NO: 2603220 - RNA, 20 nt, Human
aggcccucccuguuccccag

SEQ ID NO: 2603221 - RNA, 22 nt, Human
aggcccuaucuguuuacagugu

SEQ ID NO: 2603222 - RNA, 15 nt, Human
aggcccggggcuggc

SEQ ID NO: 2603223 - RNA, 20 nt, Human
aggcccggcuccaggcuccu

SEQ ID NO: 2603224 - RNA, 18 nt, Human
aggcccggcuccaggcuc

SEQ ID NO: 2603225 - RNA, 21 nt, Human
aggcccggcuccaggcuccuu

SEQ ID NO: 2603226 - RNA, 20 nt, Human
aggcccgcucuacaucuucu

SEQ ID NO: 2603227 - RNA, 13 nt, Human
aggcccggggcug

SEQ ID NO: 2603228 - RNA, 14 nt, Human
aggcccggggcugg

SEQ ID NO: 2603229 - RNA, 15 nt, Human
aggcccguccggcag

SEQ ID NO: 2603230 - RNA, 13 nt, Human
agggaagggccug

SEQ ID NO: 2603231 - RNA, 14 nt, Human
agggaagggccugc

SEQ ID NO: 2603232 - RNA, 16 nt, Human
agggaagggccugcca

SEQ ID NO: 2603233 - RNA, 13 nt, Human
agggaaggggaca

SEQ ID NO: 2603234 - RNA, 22 nt, Human
agggaaggggacaaggacuagg

SEQ ID NO: 2603235 - RNA, 16 nt, Human
agggaaguaacaguaa

SEQ ID NO: 2603236 - RNA, 12 nt, Human
agggaagggugg

SEQ ID NO: 2603237 - RNA, 21 nt, Human
agggaaggggaggcagccggc

SEQ ID NO: 2603238 - RNA, 18 nt, Human
agggaagggccugccaca

SEQ ID NO: 2603239 - RNA, 20 nt, Human
agggaaggggaggcagccgg

SEQ ID NO: 2603240 - RNA, 22 nt, Human
agggaaggauacaaaagcaugu

SEQ ID NO: 2603241 - RNA, 18 nt, Human
agggaaggaacucuggcu

SEQ ID NO: 2603242 - RNA, 16 nt, Human
agggaaggccccacag

SEQ ID NO: 2603243 - RNA, 23 nt, Human
agggaauccccgaaggugcugga

SEQ ID NO: 2603244 - RNA, 20 nt, Human
agggaauccccgaaggugcu

SEQ ID NO: 2603245 - RNA, 18 nt, Human
agggaauccccgaaggug

SEQ ID NO: 2603246 - RNA, 16 nt, Human
agggaauccccgaagg

SEQ ID NO: 2603247 - RNA, 22 nt, Human
agggaaugccugagugccuggc

SEQ ID NO: 2603248 - RNA, 21 nt, Human
agggaaugccugagugccugg

SEQ ID NO: 2603249 - RNA, 18 nt, Human
agggaaugccugagugcc

SEQ ID NO: 2603250 - RNA, 14 nt, Human
agggaaugccugag

SEQ ID NO: 2603251 - RNA, 13 nt, Human
agggaaugccuga

SEQ ID NO: 2603252 - RNA, 23 nt, Human
agggaaugagacaggaccuagga

SEQ ID NO: 2603253 - RNA, 18 nt, Human
agggaaugaaccuggagg

SEQ ID NO: 2603254 - RNA, 21 nt, Human
agggaaugaaggugucagaau

SEQ ID NO: 2603255 - RNA, 22 nt, Human
agggaaguaacaguaacgcagg

SEQ ID NO: 2603256 - RNA, 15 nt, Human
agggaaguccccagg

SEQ ID NO: 2603257 - RNA, 13 nt, Human
agggaaguuuugu

SEQ ID NO: 2603258 - RNA, 22 nt, Human
agggacaaguggacucagggca

SEQ ID NO: 2603259 - RNA, 18 nt, Human
agggaauugaggucugcu

SEQ ID NO: 2603260 - RNA, 16 nt, Human
agggaauugcagagua

SEQ ID NO: 2603261 - RNA, 21 nt, Human
agggaauuucuucaacucccu

SEQ ID NO: 2603262 - RNA, 15 nt, Human
agggaauuucaggaa

SEQ ID NO: 2603263 - RNA, 15 nt, Human
agggaauggcacagc

SEQ ID NO: 2603264 - RNA, 16 nt, Human
ugggacuacaggcacc

SEQ ID NO: 2603265 - RNA, 15 nt, Human
ugggacuacaggcac

SEQ ID NO: 2603266 - RNA, 19 nt, Human
agggaggaggccaccucuc

SEQ ID NO: 2603267 - RNA, 17 nt, Human
agggaggaggccaccuc

SEQ ID NO: 2603268 - RNA, 16 nt, Human
agggaggaggccaccu

SEQ ID NO: 2603269 - RNA, 21 nt, Human
agggaggaggccaccucucca

SEQ ID NO: 2603270 - RNA, 20 nt, Human
agggaggaggccaccucucc

SEQ ID NO: 2603271 - RNA, 20 nt, Human
ugggacguggcucagccagc

SEQ ID NO: 2603272 - RNA, 14 nt, Human
ugggacuacaggca

SEQ ID NO: 2603273 - RNA, 21 nt, Human
agggaggacgcucucuggccu

SEQ ID NO: 2603274 - RNA, 22 nt, Human
agggaggacgcucucuggccuu

SEQ ID NO: 2603275 - RNA, 23 nt, Human
agggaggacgcucucuggccuuc

SEQ ID NO: 2603276 - RNA, 22 nt, Human
agggaggaccagggcagggcca

SEQ ID NO: 2603277 - RNA, 15 nt, Human
agggaggaggccacc

SEQ ID NO: 2603278 - RNA, 21 nt, Human
agggaggaaucgaggaaccag

SEQ ID NO: 2603279 - RNA, 22 nt, Human
agggaggaaucgaggaaccaga

SEQ ID NO: 2603280 - RNA, 23 nt, Human
agggaggaaucgaggaaccagag

SEQ ID NO: 2603281 - RNA, 22 nt, Human
agggagagagagagagagagga

SEQ ID NO: 2603282 - RNA, 14 nt, Human
agggacagagccau

SEQ ID NO: 2603283 - RNA, 16 nt, Human
agggacagaggcccca

SEQ ID NO: 2603284 - RNA, 13 nt, Human
agggagagagaga

SEQ ID NO: 2603285 - RNA, 23 nt, Human
agggagagagagagagagaggac

SEQ ID NO: 2603286 - RNA, 15 nt, Human
agggagagccagcuc

SEQ ID NO: 2603287 - RNA, 14 nt, Human
agggagagcggggc

SEQ ID NO: 2603288 - RNA, 17 nt, Human
agggagaggagugacug

SEQ ID NO: 2603289 - RNA, 13 nt, Human
agggagaggagug

SEQ ID NO: 2603290 - RNA, 16 nt, Human
agggagagcggggcag

SEQ ID NO: 2603291 - RNA, 21 nt, Human
agggacaccagccaggcucug

SEQ ID NO: 2603292 - RNA, 20 nt, Human
agggacaccagccaggcucu

SEQ ID NO: 2603293 - RNA, 18 nt, Human
agggacaccagccaggcu

SEQ ID NO: 2603294 - RNA, 16 nt, Human
agggacaccagccagg

SEQ ID NO: 2603295 - RNA, 15 nt, Human
agggacaccagccag

SEQ ID NO: 2603296 - RNA, 14 nt, Human
agggacaccagcca

SEQ ID NO: 2603297 - RNA, 19 nt, Human
agggacaaguggacucagg

SEQ ID NO: 2603298 - RNA, 10 nt, Human
agggacagag

SEQ ID NO: 2603299 - RNA, 18 nt, Human
agggacagagacaccugc

SEQ ID NO: 2603300 - RNA, 19 nt, Human
agggacagagacaccugca

SEQ ID NO: 2603301 - RNA, 20 nt, Human
agggacagagacaccugcac

SEQ ID NO: 2603302 - RNA, 23 nt, Human
agggaggaagaagcuuaggcagg

SEQ ID NO: 2603303 - RNA, 21 nt, Human
agggaggaagaagcuuaggca

SEQ ID NO: 2603304 - RNA, 15 nt, Human
agggaggaagaagcu

SEQ ID NO: 2603305 - RNA, 13 nt, Human
agggagcugggac

SEQ ID NO: 2603306 - RNA, 13 nt, Human
agggagcacuggg

SEQ ID NO: 2603307 - RNA, 14 nt, Human
agggagcagacagg

SEQ ID NO: 2603308 - RNA, 16 nt, Human
agggagagguggagca

SEQ ID NO: 2603309 - RNA, 14 nt, Human
agggagagggaggu

SEQ ID NO: 2603310 - RNA, 13 nt, Human
agggagagggagg

SEQ ID NO: 2603311 - RNA, 19 nt, Human
agggagagucauauuuuga

SEQ ID NO: 2603312 - RNA, 21 nt, Human
agggagcaaguccuucccuuu

SEQ ID NO: 2603313 - RNA, 19 nt, Human
agggagcaaguccuucccu

SEQ ID NO: 2603314 - RNA, 20 nt, Human
ugggacucaaugcacugaca

SEQ ID NO: 2603315 - RNA, 13 nt, Human
ugggacucagccu

SEQ ID NO: 2603316 - RNA, 21 nt, Human
ugggacguggcucagccagca

SEQ ID NO: 2603317 - RNA, 23 nt, Human
agggaggaggccaccucuccaag

SEQ ID NO: 2603318 - RNA, 23 nt, Human
ugggacucagccuucagacagag

SEQ ID NO: 2603319 - RNA, 17 nt, Human
ugggacucagccuucag

SEQ ID NO: 2603320 - RNA, 16 nt, Human
ugggacugagccaguc

SEQ ID NO: 2603321 - RNA, 15 nt, Human
ugggacugagccagu

SEQ ID NO: 2603322 - RNA, 14 nt, Human
ugggacugagccag

SEQ ID NO: 2603323 - RNA, 18 nt, Human
ugggacugcuaaauaaaa

SEQ ID NO: 2603324 - RNA, 17 nt, Human
ugggacugcuaaauaaa

SEQ ID NO: 2603325 - RNA, 20 nt, Human
ugggacugagccagucccag

SEQ ID NO: 2603326 - RNA, 18 nt, Human
ugggacugcugcuucuua

SEQ ID NO: 2603327 - RNA, 23 nt, Human
ugggacuggccagguuucugccc

SEQ ID NO: 2603328 - RNA, 22 nt, Human
ugggagaaccaaaaagaggcua

SEQ ID NO: 2603329 - RNA, 14 nt, Human
ugggagaaccucag

SEQ ID NO: 2603330 - RNA, 15 nt, Human
ugggagaaccucagg

SEQ ID NO: 2603331 - RNA, 22 nt, Human
ugggagaaccucaggcuuccuu

SEQ ID NO: 2603332 - RNA, 23 nt, Human
ugggagaaccucaggcuuccuug

SEQ ID NO: 2603333 - RNA, 19 nt, Human
ugggagaaugucaguaugu

SEQ ID NO: 2603334 - RNA, 20 nt, Human
ugggagaaugucaguaugug

SEQ ID NO: 2603335 - RNA, 22 nt, Human
ugggagaaugucaguaugugga

SEQ ID NO: 2603336 - RNA, 21 nt, Human
ugggagaauucuuacauguuu

SEQ ID NO: 2603337 - RNA, 22 nt, Human
ugggagaauucuuacauguuuu

SEQ ID NO: 2603338 - RNA, 18 nt, Human
ugggagacugcugaguca

SEQ ID NO: 2603339 - RNA, 21 nt, Human
ugggagagagacguguacaua

SEQ ID NO: 2603340 - RNA, 14 nt, Human
ugggagagcccagc

SEQ ID NO: 2603341 - RNA, 18 nt, Human
ugggagagcccagccauu

SEQ ID NO: 2603342 - RNA, 16 nt, Human
ugggagagccuuccag

SEQ ID NO: 2603343 - RNA, 18 nt, Human
ugggaggaucucuugagc

SEQ ID NO: 2603344 - RNA, 21 nt, Human
ugggagagaagagaaugcaca

SEQ ID NO: 2603345 - RNA, 19 nt, Human
ugggagagaagagaaugca

SEQ ID NO: 2603346 - RNA, 16 nt, Human
ugggagacaugugaca

SEQ ID NO: 2603347 - RNA, 22 nt, Human
ugggagacaagaaaucccuguu

SEQ ID NO: 2603348 - RNA, 18 nt, Human
ugggagaccuguaaucau

SEQ ID NO: 2603349 - RNA, 15 nt, Human
ugggagacaugugac

SEQ ID NO: 2603350 - RNA, 14 nt, Human
ugggagacauguga

SEQ ID NO: 2603351 - RNA, 19 nt, Human
ugggagacacccaaagggu

SEQ ID NO: 2603352 - RNA, 21 nt, Human
ugggagacaagaaaucccugu

SEQ ID NO: 2603353 - RNA, 13 nt, Human
uuaauaaacacuc

SEQ ID NO: 2603354 - RNA, 22 nt, Human
uuaaguucuggaugcauuucuc

SEQ ID NO: 2603355 - RNA, 12 nt, Human
uuaaguuacuuc

SEQ ID NO: 2603356 - RNA, 17 nt, Human
uuaauaaacacucuuga

SEQ ID NO: 2603357 - RNA, 18 nt, Human
uuaaguugcugaugaacu

SEQ ID NO: 2603358 - RNA, 22 nt, Human
uuaauaaacuuuuuuuugagaa

SEQ ID NO: 2603359 - RNA, 23 nt, Human
uuaaugaaagacuguacaaagua

SEQ ID NO: 2603360 - RNA, 20 nt, Human
uuaaugaaagacuguacaaa

SEQ ID NO: 2603361 - RNA, 20 nt, Human
uuaauaaauuauuuauuauu

SEQ ID NO: 2603362 - RNA, 18 nt, Human
uuaauaaauuauuuauua

SEQ ID NO: 2603363 - RNA, 12 nt, Human
uuaauaacaauu

SEQ ID NO: 2603364 - RNA, 14 nt, Human
uuaauaaagacagg

SEQ ID NO: 2603365 - RNA, 13 nt, Human
uuaauaaagacag

SEQ ID NO: 2603366 - RNA, 21 nt, Human
uuaaugaaauaucuguauuua

SEQ ID NO: 2603367 - RNA, 17 nt, Human
uuaaugaaauaucugua

SEQ ID NO: 2603368 - RNA, 22 nt, Human
uuaaugaaauaucuguauuuaa

SEQ ID NO: 2603369 - RNA, 14 nt, Human
uuaaugaagaaagu

SEQ ID NO: 2603370 - RNA, 18 nt, Human
uuaaugaagaaaguggaa

SEQ ID NO: 2603371 - RNA, 23 nt, Human
uuaaugaagaaaguggaaaacaa

SEQ ID NO: 2603372 - RNA, 14 nt, Human
uuaaugaaguuuga

SEQ ID NO: 2603373 - RNA, 14 nt, Human
uuaauucauguuuc

SEQ ID NO: 2603374 - RNA, 17 nt, Human
uuaauuccaauuauaug

SEQ ID NO: 2603375 - RNA, 21 nt, Human
uuaauuccaugaaucgcuucu

SEQ ID NO: 2603376 - RNA, 19 nt, Human
uuaauuccaauaugaugac

SEQ ID NO: 2603377 - RNA, 15 nt, Human
uuaauucauguuucu

SEQ ID NO: 2603378 - RNA, 16 nt, Human
uuaauuccuuucucau

SEQ ID NO: 2603379 - RNA, 15 nt, Human
uuaauucuuagcuca

SEQ ID NO: 2603380 - RNA, 13 nt, Human
uuaauuguuguuu

SEQ ID NO: 2603381 - RNA, 15 nt, Human
uuaauuguucauuuu

SEQ ID NO: 2603382 - RNA, 17 nt, Human
uuaauucucuuucaaag

SEQ ID NO: 2603383 - RNA, 17 nt, Human
uuaauucucaugugauc

SEQ ID NO: 2603384 - RNA, 22 nt, Human
uuaauuccaugaaucgcuucuc

SEQ ID NO: 2603385 - RNA, 14 nt, Human
uuaauucucuugaa

SEQ ID NO: 2603386 - RNA, 22 nt, Human
uuaauuguuguuucuuucuagu

SEQ ID NO: 2603387 - RNA, 20 nt, Human
uuaauuguuguuucuuucua

SEQ ID NO: 2603388 - RNA, 19 nt, Human
uuaauuguuguuucuuucu

SEQ ID NO: 2603389 - RNA, 16 nt, Human
uuaauuguuguuucuu

SEQ ID NO: 2603390 - RNA, 18 nt, Human
uuaauuguuuugcacuuu

SEQ ID NO: 2603391 - RNA, 18 nt, Human
uuaauuuaaacaccuccu

SEQ ID NO: 2603392 - RNA, 19 nt, Human
uuaauuguuuugcacuuuu

SEQ ID NO: 2603393 - RNA, 23 nt, Human
auaaacaagaccacguuucuaaa

SEQ ID NO: 2603394 - RNA, 15 nt, Human
auaaacaagaccacg

SEQ ID NO: 2603395 - RNA, 22 nt, Human
auaaacaagaccacguuucuaa

SEQ ID NO: 2603396 - RNA, 23 nt, Human
auaaaauuguaaaauuguauaga

SEQ ID NO: 2603397 - RNA, 13 nt, Human
auaaaauuuguug

SEQ ID NO: 2603398 - RNA, 16 nt, Human
auaaaauuuguugcau

SEQ ID NO: 2603399 - RNA, 17 nt, Human
auaaaauuuuuuuucau

SEQ ID NO: 2603400 - RNA, 19 nt, Human
auaaaauuuuuuuucaugu

SEQ ID NO: 2603401 - RNA, 19 nt, Human
auaaacaacuuaauguucu

SEQ ID NO: 2603402 - RNA, 16 nt, Human
auaaacaacuuaaugu

SEQ ID NO: 2603403 - RNA, 23 nt, Human
auaaaauuuuuuuucauguuuua

SEQ ID NO: 2603404 - RNA, 15 nt, Human
auaaacaaaguuacu

SEQ ID NO: 2603405 - RNA, 20 nt, Human
auaaaauuuuuaaucuuuaa

SEQ ID NO: 2603406 - RNA, 18 nt, Human
auaaaauuauuuuggauu

SEQ ID NO: 2603407 - RNA, 13 nt, Human
auaaaauuauuuu

SEQ ID NO: 2603408 - RNA, 21 nt, Human
auaaaauuguaaaauuguaua

SEQ ID NO: 2603409 - RNA, 11 nt, Human
auaaaauugua

SEQ ID NO: 2603410 - RNA, 22 nt, Human
auaaaauucuauuacaguaugu

SEQ ID NO: 2603411 - RNA, 14 nt, Human
auaaaauuauagau

SEQ ID NO: 2603412 - RNA, 13 nt, Human
auaaaauuauaga

SEQ ID NO: 2603413 - RNA, 19 nt, Human
auaaaauguugaaaaguca

SEQ ID NO: 2603414 - RNA, 21 nt, Human
auaaaauuauagaugggaaug

SEQ ID NO: 2603415 - RNA, 20 nt, Human
auaaaauuauagaugggaau

SEQ ID NO: 2603416 - RNA, 23 nt, Human
auaaaauuauagaugggaaugaa

SEQ ID NO: 2603417 - RNA, 13 nt, Human
auaaaauuauucc

SEQ ID NO: 2603418 - RNA, 13 nt, Human
auaaaauuaugcc

SEQ ID NO: 2603419 - RNA, 17 nt, Human
uuacaaaacuacaugag

SEQ ID NO: 2603420 - RNA, 18 nt, Human
uuacaaaacuacaugaga

SEQ ID NO: 2603421 - RNA, 20 nt, Human
uuacaaaacuacaugagaac

SEQ ID NO: 2603422 - RNA, 16 nt, Human
auaaaauuaaagcuga

SEQ ID NO: 2603423 - RNA, 19 nt, Human
uuaauuuuuuugagacaga

SEQ ID NO: 2603424 - RNA, 17 nt, Human
uuaauuuuuuuauuguu

SEQ ID NO: 2603425 - RNA, 15 nt, Human
uuaauuuuuuuauug

SEQ ID NO: 2603426 - RNA, 23 nt, Human
uuaauuuuuuuaaccaaagguga

SEQ ID NO: 2603427 - RNA, 22 nt, Human
uuaauuuuuuuaaccaaaggug

SEQ ID NO: 2603428 - RNA, 18 nt, Human
uuacaaaaauauaaaaua

SEQ ID NO: 2603429 - RNA, 22 nt, Human
uuaauuuacaaaaauauaaaau

SEQ ID NO: 2603430 - RNA, 14 nt, Human
uuaauuuacaaaaa

SEQ ID NO: 2603431 - RNA, 23 nt, Human
uuaauuuacaaaaauauaaaaua

SEQ ID NO: 2603432 - RNA, 18 nt, Human
uuaauuuuuuuaaccaaa

SEQ ID NO: 2603433 - RNA, 17 nt, Human
uuaauuuuuuuaaccaa

SEQ ID NO: 2603434 - RNA, 16 nt, Human
uuaagaagcuguugua

SEQ ID NO: 2603435 - RNA, 14 nt, Human
uuaagaagcuguug

SEQ ID NO: 2603436 - RNA, 13 nt, Human
uuaagaagcuguu

SEQ ID NO: 2603437 - RNA, 11 nt, Human
uuaagaagcug

SEQ ID NO: 2603438 - RNA, 22 nt, Human
uuaagaagacugcauuauauuu

SEQ ID NO: 2603439 - RNA, 22 nt, Human
uuaagaagcuguuguacauuua

SEQ ID NO: 2603440 - RNA, 21 nt, Human
uuaagaagcuguuguacauuu

SEQ ID NO: 2603441 - RNA, 20 nt, Human
uuaagaagcuguuguacauu

SEQ ID NO: 2603442 - RNA, 18 nt, Human
uuaagaagcuguuguaca

SEQ ID NO: 2603443 - RNA, 12 nt, Human
uuaagaaggcaa

SEQ ID NO: 2603444 - RNA, 14 nt, Human
uuaagaaggcaaaa

SEQ ID NO: 2603445 - RNA, 13 nt, Human
uuaagaggcaggg

SEQ ID NO: 2603446 - RNA, 16 nt, Human
uuaagaggcagggucu

SEQ ID NO: 2603447 - RNA, 15 nt, Human
uuaagaggcaggguc

SEQ ID NO: 2603448 - RNA, 18 nt, Human
uuaaguaaggaauuuuau

SEQ ID NO: 2603449 - RNA, 20 nt, Human
uuaagaggcagaaaauugca

SEQ ID NO: 2603450 - RNA, 23 nt, Human
uuaagaagcuguuguacauuuau

SEQ ID NO: 2603451 - RNA, 23 nt, Human
uuaagagccauauaaguuugaag

SEQ ID NO: 2603452 - RNA, 22 nt, Human
uuaagguuauuuauuuaaaugu

SEQ ID NO: 2603453 - RNA, 15 nt, Human
uuaagguuauuuauu

SEQ ID NO: 2603454 - RNA, 17 nt, Human
uuaagucuguuuuauga

SEQ ID NO: 2603455 - RNA, 18 nt, Human
uuaagucuguuuuaugac

SEQ ID NO: 2603456 - RNA, 20 nt, Human
uuaagucuguuuuaugacuu

SEQ ID NO: 2603457 - RNA, 21 nt, Human
uuaagucuguuuuaugacuuc

SEQ ID NO: 2603458 - RNA, 18 nt, Human
uuaaguaaugauaacugg

SEQ ID NO: 2603459 - RNA, 17 nt, Human
uuaaguacuauguauca

SEQ ID NO: 2603460 - RNA, 22 nt, Human
uuaagugcugcauuuaaaagau

SEQ ID NO: 2603461 - RNA, 13 nt, Human
uuaagugaauguc

SEQ ID NO: 2603462 - RNA, 16 nt, Human
uuaagugaugaacauu

SEQ ID NO: 2603463 - RNA, 21 nt, Human
uuaagugcguguguagaguua

SEQ ID NO: 2603464 - RNA, 19 nt, Human
uuaagugcguguguagagu

SEQ ID NO: 2603465 - RNA, 18 nt, Human
uuaagugcguguguagag

SEQ ID NO: 2603466 - RNA, 17 nt, Human
uuaagugcguguguaga

SEQ ID NO: 2603467 - RNA, 16 nt, Human
uuaagugcuuuguaau

SEQ ID NO: 2603468 - RNA, 22 nt, Human
uuaaguuacacauuuuucagau

SEQ ID NO: 2603469 - RNA, 21 nt, Human
uuaaguguuguaaauauuuau

SEQ ID NO: 2603470 - RNA, 18 nt, Human
uuaaguuagggaauggca

SEQ ID NO: 2603471 - RNA, 22 nt, Human
auaaaauaauuuuuauauuuga

SEQ ID NO: 2603472 - RNA, 21 nt, Human
auaaaauaauuuuuauauuug

SEQ ID NO: 2603473 - RNA, 16 nt, Human
auaaaauaauuuuuau

SEQ ID NO: 2603474 - RNA, 13 nt, Human
auaaaauaaagua

SEQ ID NO: 2603475 - RNA, 14 nt, Human
auaaaauaaaguau

SEQ ID NO: 2603476 - RNA, 20 nt, Human
aguuucaggugacaugugaa

SEQ ID NO: 2603477 - RNA, 18 nt, Human
aguuucaggugacaugug

SEQ ID NO: 2603478 - RNA, 17 nt, Human
aguuucaggugacaugu

SEQ ID NO: 2603479 - RNA, 16 nt, Human
aguuucaggugacaug

SEQ ID NO: 2603480 - RNA, 15 nt, Human
aguuucaggugacau

SEQ ID NO: 2603481 - RNA, 14 nt, Human
aguuucaggugaca

SEQ ID NO: 2603482 - RNA, 11 nt, Human
aguuucaggug

SEQ ID NO: 2603483 - RNA, 20 nt, Human
aguuucaggauacaugugcc

SEQ ID NO: 2603484 - RNA, 22 nt, Human
aguuucaggugacaugugaaac

SEQ ID NO: 2603485 - RNA, 21 nt, Human
aguuucaggugacaugugaaa

SEQ ID NO: 2603486 - RNA, 22 nt, Human
auaaaagggacugagaaauuua

SEQ ID NO: 2603487 - RNA, 20 nt, Human
auaaaaggucggaccagcuu

SEQ ID NO: 2603488 - RNA, 13 nt, Human
auaaaagugauca

SEQ ID NO: 2603489 - RNA, 17 nt, Human
auaaaagugaucaauaa

SEQ ID NO: 2603490 - RNA, 18 nt, Human
auaaaagugaucaauaaa

SEQ ID NO: 2603491 - RNA, 22 nt, Human
auaaaagugaucaauaaaaugu

SEQ ID NO: 2603492 - RNA, 18 nt, Human
auaaaagugauuguuggc

SEQ ID NO: 2603493 - RNA, 14 nt, Human
auaaaagugauugu

SEQ ID NO: 2603494 - RNA, 21 nt, Human
auaaaagugauuguuggcaca

SEQ ID NO: 2603495 - RNA, 21 nt, Human
auaaaaguacauguuaaacuu

SEQ ID NO: 2603496 - RNA, 15 nt, Human
auaaaaguacauguu

SEQ ID NO: 2603497 - RNA, 19 nt, Human
auaaaauccauacauuugu

SEQ ID NO: 2603498 - RNA, 18 nt, Human
auaaaauccauacauuug

SEQ ID NO: 2603499 - RNA, 23 nt, Human
auaaaaucagccaauuauguuaa

SEQ ID NO: 2603500 - RNA, 22 nt, Human
auaaaaucagccaauuauguua

SEQ ID NO: 2603501 - RNA, 18 nt, Human
auaaaaucagccaauuau

SEQ ID NO: 2603502 - RNA, 16 nt, Human
auaaaaucagccaauu

SEQ ID NO: 2603503 - RNA, 16 nt, Human
auaaaauaaaguauau

SEQ ID NO: 2603504 - RNA, 17 nt, Human
auaaaauguugaaaagu

SEQ ID NO: 2603505 - RNA, 16 nt, Human
auaaaauguugaaaag

SEQ ID NO: 2603506 - RNA, 13 nt, Human
auaaaauguugaa

SEQ ID NO: 2603507 - RNA, 12 nt, Human
auaaaauguuga

SEQ ID NO: 2603508 - RNA, 13 nt, Human
auaaaaugugauu

SEQ ID NO: 2603509 - RNA, 20 nt, Human
auaaaaugugauuuuucuga

SEQ ID NO: 2603510 - RNA, 18 nt, Human
auaaaaugaggacauguu

SEQ ID NO: 2603511 - RNA, 13 nt, Human
auaaaaugaccag

SEQ ID NO: 2603512 - RNA, 19 nt, Human
auaaaaugaggacauguuu

SEQ ID NO: 2603513 - RNA, 18 nt, Human
auaaaaucauguacauuu

SEQ ID NO: 2603514 - RNA, 20 nt, Human
auaaaaucauguacauuucu

SEQ ID NO: 2603515 - RNA, 15 nt, Human
auaaaaugaccagua

SEQ ID NO: 2603516 - RNA, 22 nt, Human
auaaaugguuaaaagagguuuu

SEQ ID NO: 2603517 - RNA, 17 nt, Human
auaaauguaucauagaa

SEQ ID NO: 2603518 - RNA, 21 nt, Human
auaaauguaucauagaaaugu

SEQ ID NO: 2603519 - RNA, 13 nt, Human
auaaauguaucau

SEQ ID NO: 2603520 - RNA, 15 nt, Human
auaaauguacauuaa

SEQ ID NO: 2603521 - RNA, 20 nt, Human
auaaaugagcuauguauuaa

SEQ ID NO: 2603522 - RNA, 18 nt, Human
auaaaugagcuauguauu

SEQ ID NO: 2603523 - RNA, 17 nt, Human
auaaaugagcuauguau

SEQ ID NO: 2603524 - RNA, 17 nt, Human
auaaaugaauuuuaguu

SEQ ID NO: 2603525 - RNA, 16 nt, Human
auaaaugguuaaaaga

SEQ ID NO: 2603526 - RNA, 22 nt, Human
auaaaugguauagcaaauguuu

SEQ ID NO: 2603527 - RNA, 16 nt, Human
auaaaugaauuuuagu

SEQ ID NO: 2603528 - RNA, 20 nt, Human
auaaaugaagcagcuuuaaa

SEQ ID NO: 2603529 - RNA, 18 nt, Human
auaaaugaagcagcuuua

SEQ ID NO: 2603530 - RNA, 11 nt, Human
auaaaugaaug

SEQ ID NO: 2603531 - RNA, 14 nt, Human
auaacuaaauaaag

SEQ ID NO: 2603532 - RNA, 16 nt, Human
auaacuaaaagguaug

SEQ ID NO: 2603533 - RNA, 18 nt, Human
auaaauguaucuuauuca

SEQ ID NO: 2603534 - RNA, 15 nt, Human
auaaauguaucuuau

SEQ ID NO: 2603535 - RNA, 17 nt, Human
auaaaugucauuaaaau

SEQ ID NO: 2603536 - RNA, 20 nt, Human
auaacuacuccggagacagg

SEQ ID NO: 2603537 - RNA, 19 nt, Human
auaacuacuccggagacag

SEQ ID NO: 2603538 - RNA, 13 nt, Human
auaacuacugugu

SEQ ID NO: 2603539 - RNA, 15 nt, Human
auaacuacuguguuc

SEQ ID NO: 2603540 - RNA, 15 nt, Human
uuacagccucugacu

SEQ ID NO: 2603541 - RNA, 14 nt, Human
uuacagccucugac

SEQ ID NO: 2603542 - RNA, 15 nt, Human
uuacagcgagaggca

SEQ ID NO: 2603543 - RNA, 13 nt, Human
uuacagcugccug

SEQ ID NO: 2603544 - RNA, 20 nt, Human
auaacuagauggugcugaga

SEQ ID NO: 2603545 - RNA, 21 nt, Human
auaacuagauggugcugagaa

SEQ ID NO: 2603546 - RNA, 17 nt, Human
uuacagccucacuugaa

SEQ ID NO: 2603547 - RNA, 19 nt, Human
auaacuagauggugcugag

SEQ ID NO: 2603548 - RNA, 19 nt, Human
auaacuacuguguuccugg

SEQ ID NO: 2603549 - RNA, 16 nt, Human
auaacuacuguguucc

SEQ ID NO: 2603550 - RNA, 18 nt, Human
auaacuacuguguuccug

SEQ ID NO: 2603551 - RNA, 14 nt, Human
uuacaggaaguacu

SEQ ID NO: 2603552 - RNA, 21 nt, Human
uuacagcuggguggcacugcc

SEQ ID NO: 2603553 - RNA, 20 nt, Human
uuacagcuggguggcacugc

SEQ ID NO: 2603554 - RNA, 21 nt, Human
uuacagcgagaggcagagaaa

SEQ ID NO: 2603555 - RNA, 14 nt, Human
uuacagcugccugc

SEQ ID NO: 2603556 - RNA, 11 nt, Human
uuacagcugug

SEQ ID NO: 2603557 - RNA, 19 nt, Human
uuacaguaggagcccagcu

SEQ ID NO: 2603558 - RNA, 17 nt, Human
uuacagugaaaauguaa

SEQ ID NO: 2603559 - RNA, 22 nt, Human
auaaauaugccucuccuuugua

SEQ ID NO: 2603560 - RNA, 14 nt, Human
auaaauaugcagug

SEQ ID NO: 2603561 - RNA, 13 nt, Human
auaaauaugcagu

SEQ ID NO: 2603562 - RNA, 12 nt, Human
auaaauauuaua

SEQ ID NO: 2603563 - RNA, 22 nt, Human
auaaauauuauauuauauauau

SEQ ID NO: 2603564 - RNA, 14 nt, Human
auaaaucuguugcc

SEQ ID NO: 2603565 - RNA, 17 nt, Human
auaaaugaagcagcuuu

SEQ ID NO: 2603566 - RNA, 11 nt, Human
auaaaugaagc

SEQ ID NO: 2603567 - RNA, 20 nt, Human
auaaauauauauauccucug

SEQ ID NO: 2603568 - RNA, 12 nt, Human
auaaauaugaag

SEQ ID NO: 2603569 - RNA, 15 nt, Human
auaaauaugagugcc

SEQ ID NO: 2603570 - RNA, 14 nt, Human
auaaauaugagugc

SEQ ID NO: 2603571 - RNA, 14 nt, Human
auaaauaugaagcu

SEQ ID NO: 2603572 - RNA, 23 nt, Human
auaaauauauauauauauaaaau

SEQ ID NO: 2603573 - RNA, 22 nt, Human
auaaauauauauauauauaaaa

SEQ ID NO: 2603574 - RNA, 21 nt, Human
auaaauauauauauauauaaa

SEQ ID NO: 2603575 - RNA, 21 nt, Human
auaaauauauauaaauauaua

SEQ ID NO: 2603576 - RNA, 20 nt, Human
auaaauauauauaaauauau

SEQ ID NO: 2603577 - RNA, 11 nt, Human
auaaauagcua

SEQ ID NO: 2603578 - RNA, 23 nt, Human
auaaauaccucuuagcugagugg

SEQ ID NO: 2603579 - RNA, 18 nt, Human
auaaauaccucuuagcug

SEQ ID NO: 2603580 - RNA, 14 nt, Human
auaaauaccucuua

SEQ ID NO: 2603581 - RNA, 15 nt, Human
auaaauaaucuguac

SEQ ID NO: 2603582 - RNA, 21 nt, Human
auaaauaaucggcccacagcu

SEQ ID NO: 2603583 - RNA, 12 nt, Human
auaaaguuugcu

SEQ ID NO: 2603584 - RNA, 13 nt, Human
auaaaguuucuca

SEQ ID NO: 2603585 - RNA, 18 nt, Human
auaaaguuggugacagau

SEQ ID NO: 2603586 - RNA, 14 nt, Human
auaaauaacuuuuu

SEQ ID NO: 2603587 - RNA, 19 nt, Human
auaaaguuugcuuagaaaa

SEQ ID NO: 2603588 - RNA, 12 nt, Human
auaaauaacuuu

SEQ ID NO: 2603589 - RNA, 15 nt, Human
auaaaguucuguacu

SEQ ID NO: 2603590 - RNA, 22 nt, Human
auaaaguugaagcuaagauuua

SEQ ID NO: 2603591 - RNA, 21 nt, Human
auaaaguucugaguguuuuua

SEQ ID NO: 2603592 - RNA, 17 nt, Human
auaaaguuggugacaga

SEQ ID NO: 2603593 - RNA, 16 nt, Human
auaaaguuggugacag

SEQ ID NO: 2603594 - RNA, 17 nt, Human
auaaacacccaugaauc

SEQ ID NO: 2603595 - RNA, 13 nt, Human
auaaaguguaaua

SEQ ID NO: 2603596 - RNA, 21 nt, Human
auaacuuauauuguaagaaau

SEQ ID NO: 2603597 - RNA, 22 nt, Human
auaacuuauauuguaagaaaua

SEQ ID NO: 2603598 - RNA, 23 nt, Human
auaacuuauauuguaagaaauac

SEQ ID NO: 2603599 - RNA, 20 nt, Human
auaacuuauauuguaagaaa

SEQ ID NO: 2603600 - RNA, 23 nt, Human
uuagacacuggcugccagcuauu

SEQ ID NO: 2603601 - RNA, 23 nt, Human
uuagacaaauacucauguguaug

SEQ ID NO: 2603602 - RNA, 16 nt, Human
uuagacaagagauggg

SEQ ID NO: 2603603 - RNA, 22 nt, Human
uuagacaaauacucauguguau

SEQ ID NO: 2603604 - RNA, 21 nt, Human
uuagacaaauacucaugugua

SEQ ID NO: 2603605 - RNA, 20 nt, Human
uuagacaaauacucaugugu

SEQ ID NO: 2603606 - RNA, 19 nt, Human
uuagacaaauacucaugug

SEQ ID NO: 2603607 - RNA, 18 nt, Human
uuagacaaauacucaugu

SEQ ID NO: 2603608 - RNA, 15 nt, Human
uuagacaaauacuca

SEQ ID NO: 2603609 - RNA, 11 nt, Human
uuagacagagu

SEQ ID NO: 2603610 - RNA, 18 nt, Human
uuagaagauauuagucuu

SEQ ID NO: 2603611 - RNA, 18 nt, Human
uuagaacauuuuaauuca

SEQ ID NO: 2603612 - RNA, 16 nt, Human
uuagaagaaguguguc

SEQ ID NO: 2603613 - RNA, 23 nt, Human
uuagaagauauuagucuuggggc

SEQ ID NO: 2603614 - RNA, 14 nt, Human
uuagaagaagugug

SEQ ID NO: 2603615 - RNA, 15 nt, Human
uuagaagaagugugu

SEQ ID NO: 2603616 - RNA, 12 nt, Human
uuagaacauuuu

SEQ ID NO: 2603617 - RNA, 13 nt, Human
uuagaaccuuucu

SEQ ID NO: 2603618 - RNA, 11 nt, Human
uuagaaauaua

SEQ ID NO: 2603619 - RNA, 13 nt, Human
uuagaaauagaca

SEQ ID NO: 2603620 - RNA, 15 nt, Human
uuagaaauagacagu

SEQ ID NO: 2603621 - RNA, 12 nt, Human
uuagaaauauaa

SEQ ID NO: 2603622 - RNA, 14 nt, Human
uuagaaauauaauu

SEQ ID NO: 2603623 - RNA, 15 nt, Human
uuacuguaagaaaau

SEQ ID NO: 2603624 - RNA, 18 nt, Human
uuacugguccaaaagauu

SEQ ID NO: 2603625 - RNA, 13 nt, Human
uuacugcaaaugu

SEQ ID NO: 2603626 - RNA, 19 nt, Human
uuacugaucaugcauuguu

SEQ ID NO: 2603627 - RNA, 18 nt, Human
uuacugcaaaugucauca

SEQ ID NO: 2603628 - RNA, 15 nt, Human
uuacugguccaaaag

SEQ ID NO: 2603629 - RNA, 17 nt, Human
uuacugguccaaaagau

SEQ ID NO: 2603630 - RNA, 14 nt, Human
uuacugguccaaaa

SEQ ID NO: 2603631 - RNA, 18 nt, Human
uuacucagaauucucuag

SEQ ID NO: 2603632 - RNA, 23 nt, Human
uuacucagaauucucuaguuuga

SEQ ID NO: 2603633 - RNA, 19 nt, Human
uuaccuuagauuagcucug

SEQ ID NO: 2603634 - RNA, 15 nt, Human
uuacucaacccucuc

SEQ ID NO: 2603635 - RNA, 19 nt, Human
uuacuauuuuacuucuaga

SEQ ID NO: 2603636 - RNA, 21 nt, Human
uuaccuuagauuagcucugga

SEQ ID NO: 2603637 - RNA, 23 nt, Human
uuaccuguuuucgcaccuaccau

SEQ ID NO: 2603638 - RNA, 14 nt, Human
uuacugauauauuu

SEQ ID NO: 2603639 - RNA, 23 nt, Human
uuacugauauauuuuacaauuuu

SEQ ID NO: 2603640 - RNA, 22 nt, Human
uuacugauagggauacaugcuc

SEQ ID NO: 2603641 - RNA, 19 nt, Human
uuacugagcuucucuguga

SEQ ID NO: 2603642 - RNA, 13 nt, Human
uuacugaucaugc

SEQ ID NO: 2603643 - RNA, 14 nt, Human
uuacugaucaugca

SEQ ID NO: 2603644 - RNA, 15 nt, Human
uuacugaucaugcau

SEQ ID NO: 2603645 - RNA, 16 nt, Human
uuacugaucaugcauu

SEQ ID NO: 2603646 - RNA, 17 nt, Human
uuacugaucaugcauug

SEQ ID NO: 2603647 - RNA, 18 nt, Human
uuacugaucaugcauugu

SEQ ID NO: 2603648 - RNA, 21 nt, Human
uuacugaucaugcauuguuga

SEQ ID NO: 2603649 - RNA, 23 nt, Human
uuacugaaugcaccauggucaaa

SEQ ID NO: 2603650 - RNA, 12 nt, Human
uuacucagcccu

SEQ ID NO: 2603651 - RNA, 13 nt, Human
uuacugagcuucu

SEQ ID NO: 2603652 - RNA, 12 nt, Human
uuacugaccagc

SEQ ID NO: 2603653 - RNA, 18 nt, Human
uuacugagcuucucugug

SEQ ID NO: 2603654 - RNA, 17 nt, Human
uuacugagcuucucugu

SEQ ID NO: 2603655 - RNA, 16 nt, Human
uuacugagcuucucug

SEQ ID NO: 2603656 - RNA, 14 nt, Human
uuacugagcuucuc

SEQ ID NO: 2603657 - RNA, 12 nt, Human
uuaccugggaaa

SEQ ID NO: 2603658 - RNA, 18 nt, Human
uuaccugggcauucuugu

SEQ ID NO: 2603659 - RNA, 14 nt, Human
uuacaucuguuuua

SEQ ID NO: 2603660 - RNA, 14 nt, Human
uuaccuuacagaag

SEQ ID NO: 2603661 - RNA, 22 nt, Human
uuaccuguuuucgcaccuacca

SEQ ID NO: 2603662 - RNA, 13 nt, Human
uuaccugugaaau

SEQ ID NO: 2603663 - RNA, 20 nt, Human
uuacauaagauaaaugugcu

SEQ ID NO: 2603664 - RNA, 21 nt, Human
uuacauaaucuguacaaugaa

SEQ ID NO: 2603665 - RNA, 20 nt, Human
uuacagugaaaauguaagcu

SEQ ID NO: 2603666 - RNA, 19 nt, Human
uuacagugaaaauguaagc

SEQ ID NO: 2603667 - RNA, 14 nt, Human
uuacauacugcugu

SEQ ID NO: 2603668 - RNA, 13 nt, Human
uuacauccuuaaa

SEQ ID NO: 2603669 - RNA, 20 nt, Human
uuacaucauuuuuguaucua

SEQ ID NO: 2603670 - RNA, 18 nt, Human
uuacaucauuuuuguauc

SEQ ID NO: 2603671 - RNA, 14 nt, Human
uuacaucauuuuug

SEQ ID NO: 2603672 - RNA, 13 nt, Human
uuacaucauuuuu

SEQ ID NO: 2603673 - RNA, 22 nt, Human
uuacauauuugcauauguauga

SEQ ID NO: 2603674 - RNA, 16 nt, Human
uuacauagguauauau

SEQ ID NO: 2603675 - RNA, 22 nt, Human
uuacauaucaccucauggccua

SEQ ID NO: 2603676 - RNA, 18 nt, Human
uuacaucaaggcuucaaa

SEQ ID NO: 2603677 - RNA, 23 nt, Human
aguuguuugauucagacagcugc

SEQ ID NO: 2603678 - RNA, 21 nt, Human
aguuguuugauucagacagcu

SEQ ID NO: 2603679 - RNA, 22 nt, Human
aguuguaaauauauaaauauau

SEQ ID NO: 2603680 - RNA, 20 nt, Human
aguuguaaauauauaaauau

SEQ ID NO: 2603681 - RNA, 18 nt, Human
aguuguaaauauauaaau

SEQ ID NO: 2603682 - RNA, 17 nt, Human
aguuguaaauauauaaa

SEQ ID NO: 2603683 - RNA, 16 nt, Human
aguuguaaauauauaa

SEQ ID NO: 2603684 - RNA, 15 nt, Human
aguuguaaauauaua

SEQ ID NO: 2603685 - RNA, 14 nt, Human
aguuguaaauauau

SEQ ID NO: 2603686 - RNA, 13 nt, Human
aguuguaaauaua

SEQ ID NO: 2603687 - RNA, 18 nt, Human
aguuggucccccuuccau

SEQ ID NO: 2603688 - RNA, 16 nt, Human
aguugggagcacugga

SEQ ID NO: 2603689 - RNA, 13 nt, Human
aguuggugacaga

SEQ ID NO: 2603690 - RNA, 16 nt, Human
aguuuaggauaaaaua

SEQ ID NO: 2603691 - RNA, 20 nt, Human
aguuuaauggugccuucauu

SEQ ID NO: 2603692 - RNA, 22 nt, Human
aguuuaauccuucuaguuuccc

SEQ ID NO: 2603693 - RNA, 23 nt, Human
aguuuaaccaaaaagaccagacu

SEQ ID NO: 2603694 - RNA, 22 nt, Human
aguuuaacacaaguccugugaa

SEQ ID NO: 2603695 - RNA, 14 nt, Human
aguuuaaggaauau

SEQ ID NO: 2603696 - RNA, 12 nt, Human
aguuuaaaaaaa

SEQ ID NO: 2603697 - RNA, 13 nt, Human
aguuguuugcaug

SEQ ID NO: 2603698 - RNA, 19 nt, Human
aguuguuuucagacucaga

SEQ ID NO: 2603699 - RNA, 16 nt, Human
aguuggcuaggacccc

SEQ ID NO: 2603700 - RNA, 18 nt, Human
aguuggcuggaugaaauu

SEQ ID NO: 2603701 - RNA, 18 nt, Human
aguuggcuaggggagcag

SEQ ID NO: 2603702 - RNA, 16 nt, Human
aguuggccagagagcc

SEQ ID NO: 2603703 - RNA, 16 nt, Human
aguugcugcaaaccug

SEQ ID NO: 2603704 - RNA, 17 nt, Human
aguugcugcaaaccuga

SEQ ID NO: 2603705 - RNA, 16 nt, Human
aguugcguggacucug

SEQ ID NO: 2603706 - RNA, 21 nt, Human
aguugcuccgccucugcuggc

SEQ ID NO: 2603707 - RNA, 17 nt, Human
aguuggguggaugccug

SEQ ID NO: 2603708 - RNA, 13 nt, Human
aguuggcuucuaa

SEQ ID NO: 2603709 - RNA, 23 nt, Human
aguugggaacuucagauggaccu

SEQ ID NO: 2603710 - RNA, 21 nt, Human
aguuggguggaugccuggugg

SEQ ID NO: 2603711 - RNA, 13 nt, Human
aguugggagcacu

SEQ ID NO: 2603712 - RNA, 15 nt, Human
aguugggagcacugg

SEQ ID NO: 2603713 - RNA, 20 nt, Human
aguugcguggacucugcaca

SEQ ID NO: 2603714 - RNA, 23 nt, Human
aguugcagacucaguuugucaga

SEQ ID NO: 2603715 - RNA, 17 nt, Human
aguugcacggcugcuga

SEQ ID NO: 2603716 - RNA, 16 nt, Human
aguugcacggcugcug

SEQ ID NO: 2603717 - RNA, 15 nt, Human
aguugcacggcugcu

SEQ ID NO: 2603718 - RNA, 17 nt, Human
aguugcacagcuaugaa

SEQ ID NO: 2603719 - RNA, 15 nt, Human
aguugcacugauauu

SEQ ID NO: 2603720 - RNA, 20 nt, Human
aguugcacggcugcugaggc

SEQ ID NO: 2603721 - RNA, 20 nt, Human
aguugcacuuggccucugga

SEQ ID NO: 2603722 - RNA, 11 nt, Human
aguugcagaaa

SEQ ID NO: 2603723 - RNA, 16 nt, Human
aguugcagacucaguu

SEQ ID NO: 2603724 - RNA, 17 nt, Human
aguugcagacucaguuu

SEQ ID NO: 2603725 - RNA, 18 nt, Human
aguugcagacucaguuug

SEQ ID NO: 2603726 - RNA, 22 nt, Human
aguugcagacucaguuugucag

SEQ ID NO: 2603727 - RNA, 16 nt, Human
aguugcagauucauuu

SEQ ID NO: 2603728 - RNA, 15 nt, Human
aguucuucgggaaga

SEQ ID NO: 2603729 - RNA, 22 nt, Human
aguucuuaaggauugugauauu

SEQ ID NO: 2603730 - RNA, 21 nt, Human
aguucuuaguugcuguauguc

SEQ ID NO: 2603731 - RNA, 20 nt, Human
aguucuuaguugcuguaugu

SEQ ID NO: 2603732 - RNA, 19 nt, Human
uuaaaggcuucucucucac

SEQ ID NO: 2603733 - RNA, 17 nt, Human
uuaaaggcuucucucuc

SEQ ID NO: 2603734 - RNA, 20 nt, Human
uuaaaggcuucucucucacc

SEQ ID NO: 2603735 - RNA, 19 nt, Human
uuaaaggguguacuuauau

SEQ ID NO: 2603736 - RNA, 21 nt, Human
uuaaaggggcagaaaaacucu

SEQ ID NO: 2603737 - RNA, 20 nt, Human
uuaaauaaauuguauauuca

SEQ ID NO: 2603738 - RNA, 18 nt, Human
uuaaauaaauuguauauu

SEQ ID NO: 2603739 - RNA, 21 nt, Human
uuaaauaaaugucauuaaaau

SEQ ID NO: 2603740 - RNA, 17 nt, Human
uuaaauaaauuguauau

SEQ ID NO: 2603741 - RNA, 15 nt, Human
uuaaauaaauuguau

SEQ ID NO: 2603742 - RNA, 13 nt, Human
uuaaauaaauugu

SEQ ID NO: 2603743 - RNA, 18 nt, Human
uuaaauaaaugucauuaa

SEQ ID NO: 2603744 - RNA, 20 nt, Human
uuaaauaaaugucauuaaaa

SEQ ID NO: 2603745 - RNA, 16 nt, Human
uuaaaggaaaaaaugu

SEQ ID NO: 2603746 - RNA, 12 nt, Human
uuaaaggaaaaa

SEQ ID NO: 2603747 - RNA, 15 nt, Human
uuaaaauuuauugcu

SEQ ID NO: 2603748 - RNA, 22 nt, Human
uuaaaggaagguucugguguga

SEQ ID NO: 2603749 - RNA, 12 nt, Human
uuaaaggaguua

SEQ ID NO: 2603750 - RNA, 17 nt, Human
uuaaaggaaaaaauguu

SEQ ID NO: 2603751 - RNA, 20 nt, Human
uuaaaggaagguucuggugu

SEQ ID NO: 2603752 - RNA, 18 nt, Human
uuaaaggcaccaucuaau

SEQ ID NO: 2603753 - RNA, 17 nt, Human
uuaaaggauguuggugu

SEQ ID NO: 2603754 - RNA, 16 nt, Human
uuaaaggcuucucucu

SEQ ID NO: 2603755 - RNA, 15 nt, Human
uuaaaggcuucucuc

SEQ ID NO: 2603756 - RNA, 15 nt, Human
uuaaaggcuguggua

SEQ ID NO: 2603757 - RNA, 12 nt, Human
uuaaaaaauguc

SEQ ID NO: 2603758 - RNA, 13 nt, Human
uuaaaaaaugucc

SEQ ID NO: 2603759 - RNA, 16 nt, Human
uuaaaaaauguccaug

SEQ ID NO: 2603760 - RNA, 16 nt, Human
aguuuauacucaccuu

SEQ ID NO: 2603761 - RNA, 17 nt, Human
aguuuaguaaggcugug

SEQ ID NO: 2603762 - RNA, 20 nt, Human
uuaaaaagaaacaagaugcu

SEQ ID NO: 2603763 - RNA, 17 nt, Human
uuaaaaagaaacaagau

SEQ ID NO: 2603764 - RNA, 16 nt, Human
uuaaaaacuauuuaac

SEQ ID NO: 2603765 - RNA, 13 nt, Human
uuaaaauguucac

SEQ ID NO: 2603766 - RNA, 23 nt, Human
uuaaaaagggcagggcaucuccu

SEQ ID NO: 2603767 - RNA, 13 nt, Human
uuaaaauugugau

SEQ ID NO: 2603768 - RNA, 18 nt, Human
uuaaaauugugauguguc

SEQ ID NO: 2603769 - RNA, 12 nt, Human
uuaaaauuuauu

SEQ ID NO: 2603770 - RNA, 15 nt, Human
uuaacaaaagcaaga

SEQ ID NO: 2603771 - RNA, 21 nt, Human
uuaacaacaauaacacugucu

SEQ ID NO: 2603772 - RNA, 23 nt, Human
uuaacaaacaucacucugcugcu

SEQ ID NO: 2603773 - RNA, 22 nt, Human
uuaacaaacaucacucugcugc

SEQ ID NO: 2603774 - RNA, 17 nt, Human
uuaaauuuguaaguuuc

SEQ ID NO: 2603775 - RNA, 15 nt, Human
uuaaauuuguaaguu

SEQ ID NO: 2603776 - RNA, 14 nt, Human
uuaaauuuguaagu

SEQ ID NO: 2603777 - RNA, 13 nt, Human
uuaaauuuguaag

SEQ ID NO: 2603778 - RNA, 16 nt, Human
uuaaauuuuaauuuau

SEQ ID NO: 2603779 - RNA, 21 nt, Human
uuaaauuuguaaguuucaggu

SEQ ID NO: 2603780 - RNA, 15 nt, Human
uuaaauuuuaauuua

SEQ ID NO: 2603781 - RNA, 16 nt, Human
uuaaauaauaaagauc

SEQ ID NO: 2603782 - RNA, 20 nt, Human
uuaaauucuugcaaaguauc

SEQ ID NO: 2603783 - RNA, 16 nt, Human
uuaaauugcuguguau

SEQ ID NO: 2603784 - RNA, 15 nt, Human
uuaaauuucuaccgc

SEQ ID NO: 2603785 - RNA, 23 nt, Human
aguuucagauauauaucauauug

SEQ ID NO: 2603786 - RNA, 17 nt, Human
aguuucagauauauauc

SEQ ID NO: 2603787 - RNA, 15 nt, Human
aguuucagauauaua

SEQ ID NO: 2603788 - RNA, 14 nt, Human
aguuucagauauau

SEQ ID NO: 2603789 - RNA, 18 nt, Human
aguuucagagaaguucug

SEQ ID NO: 2603790 - RNA, 17 nt, Human
aguuucacugccauaua

SEQ ID NO: 2603791 - RNA, 12 nt, Human
aguuucagagaa

SEQ ID NO: 2603792 - RNA, 15 nt, Human
aguuucacugacuua

SEQ ID NO: 2603793 - RNA, 17 nt, Human
aguuucaauucagugcu

SEQ ID NO: 2603794 - RNA, 16 nt, Human
aguuucaauucagugc

SEQ ID NO: 2603795 - RNA, 17 nt, Human
uuaacaguuuuccauga

SEQ ID NO: 2603796 - RNA, 19 nt, Human
uuaacaguuuuccaugaaa

SEQ ID NO: 2603797 - RNA, 20 nt, Human
uuaacaguuuuccaugaaaa

SEQ ID NO: 2603798 - RNA, 21 nt, Human
uuaacaguuuuccaugaaaac

SEQ ID NO: 2603799 - RNA, 22 nt, Human
uuaacaacaauaacacugucuc

SEQ ID NO: 2603800 - RNA, 14 nt, Human
uuaacaacuugucu

SEQ ID NO: 2603801 - RNA, 17 nt, Human
uuaacagucauuuaaaa

SEQ ID NO: 2603802 - RNA, 16 nt, Human
uuaacagucauuuaaa

SEQ ID NO: 2603803 - RNA, 13 nt, Human
uuaacaguuuucc

SEQ ID NO: 2603804 - RNA, 14 nt, Human
uuaacaguuuucca

SEQ ID NO: 2603805 - RNA, 16 nt, Human
uuaacaguuuuccaug

SEQ ID NO: 2603806 - RNA, 15 nt, Human
uuaacagucauuuaa

SEQ ID NO: 2603807 - RNA, 22 nt, Human
uuaacagggucucuagugcugu

SEQ ID NO: 2603808 - RNA, 13 nt, Human
uuaacagggaggg

SEQ ID NO: 2603809 - RNA, 16 nt, Human
uguuuugccaacauug

SEQ ID NO: 2603810 - RNA, 14 nt, Human
uguuuugcacuuuu

SEQ ID NO: 2603811 - RNA, 14 nt, Human
uguuuugcaagcca

SEQ ID NO: 2603812 - RNA, 13 nt, Human
uguuuugcacuuu

SEQ ID NO: 2603813 - RNA, 12 nt, Human
uguuuugcacuu

SEQ ID NO: 2603814 - RNA, 20 nt, Human
uguuuugauaaaguaguaaa

SEQ ID NO: 2603815 - RNA, 18 nt, Human
uguuuugauaaaguagua

SEQ ID NO: 2603816 - RNA, 20 nt, Human
uguuuugauguuuguggccu

SEQ ID NO: 2603817 - RNA, 16 nt, Human
aguucugcagauaaac

SEQ ID NO: 2603818 - RNA, 14 nt, Human
aguucugacuugac

SEQ ID NO: 2603819 - RNA, 13 nt, Human
aguucugaagaau

SEQ ID NO: 2603820 - RNA, 14 nt, Human
aguucugaguguuu

SEQ ID NO: 2603821 - RNA, 15 nt, Human
aguucugaguguuuu

SEQ ID NO: 2603822 - RNA, 21 nt, Human
aguucugcagauaaacaguag

SEQ ID NO: 2603823 - RNA, 22 nt, Human
aguucugaguguuuuuacuaca

SEQ ID NO: 2603824 - RNA, 14 nt, Human
aguucugguuccua

SEQ ID NO: 2603825 - RNA, 11 nt, Human
aguucugggca

SEQ ID NO: 2603826 - RNA, 12 nt, Human
aguucugcucua

SEQ ID NO: 2603827 - RNA, 12 nt, Human
aguucugggugc

SEQ ID NO: 2603828 - RNA, 19 nt, Human
aguucugggugcucccuac

SEQ ID NO: 2603829 - RNA, 14 nt, Human
aguucuguaaaaua

SEQ ID NO: 2603830 - RNA, 17 nt, Human
aguucugggugcucccu

SEQ ID NO: 2603831 - RNA, 12 nt, Human
aguucuguagaa

SEQ ID NO: 2603832 - RNA, 23 nt, Human
aguucuguacucaaauguagcca

SEQ ID NO: 2603833 - RNA, 16 nt, Human
aguucuuaguugcugu

SEQ ID NO: 2603834 - RNA, 15 nt, Human
aguucugcuccucuc

SEQ ID NO: 2603835 - RNA, 14 nt, Human
aguucugcuccucu

SEQ ID NO: 2603836 - RNA, 12 nt, Human
aguucugcuccu

SEQ ID NO: 2603837 - RNA, 19 nt, Human
aguucugcuccucuccagg

SEQ ID NO: 2603838 - RNA, 18 nt, Human
aguucugcuccucuccag

SEQ ID NO: 2603839 - RNA, 17 nt, Human
aguucugcuccucucca

SEQ ID NO: 2603840 - RNA, 16 nt, Human
aguucugcuccucucc

SEQ ID NO: 2603841 - RNA, 21 nt, Human
aguucugcuccucuccaggca

SEQ ID NO: 2603842 - RNA, 20 nt, Human
aguucugcuccucuccaggc

SEQ ID NO: 2603843 - RNA, 21 nt, Human
uguuuuauuuuaauucaguug

SEQ ID NO: 2603844 - RNA, 13 nt, Human
uguuuggagacag

SEQ ID NO: 2603845 - RNA, 18 nt, Human
uguuuuaugacuucauua

SEQ ID NO: 2603846 - RNA, 12 nt, Human
uguuuuaucaug

SEQ ID NO: 2603847 - RNA, 23 nt, Human
uguuuuaucaugacauguuauau

SEQ ID NO: 2603848 - RNA, 22 nt, Human
uguuugcacguuaugguguuuc

SEQ ID NO: 2603849 - RNA, 21 nt, Human
uguuugaugcauuaaaagaaa

SEQ ID NO: 2603850 - RNA, 23 nt, Human
uguuugcacguuaugguguuucu

SEQ ID NO: 2603851 - RNA, 24 nt, Human
uguuugcucucccgguucuuccag

SEQ ID NO: 2603852 - RNA, 15 nt, Human
uguuugcuuauuguu

SEQ ID NO: 2603853 - RNA, 16 nt, Human
uguuugcuuauuguuc

SEQ ID NO: 2603854 - RNA, 18 nt, Human
uguuugcuuauuguucca

SEQ ID NO: 2603855 - RNA, 18 nt, Human
uguuuggaauauugucca

SEQ ID NO: 2603856 - RNA, 23 nt, Human
uguuugcucucccgguucuucca

SEQ ID NO: 2603857 - RNA, 20 nt, Human
uguuugcuuauuguuccaag

SEQ ID NO: 2603858 - RNA, 21 nt, Human
uguuugcuuauuguuccaaga

SEQ ID NO: 2603859 - RNA, 18 nt, Human
uguuugcuucauaaauga

SEQ ID NO: 2603860 - RNA, 23 nt, Human
uguuugcuuauuguuccaagaca

SEQ ID NO: 2603861 - RNA, 20 nt, Human
uguuuuccaugaguccccug

SEQ ID NO: 2603862 - RNA, 17 nt, Human
uguuuuccagcuccuca

SEQ ID NO: 2603863 - RNA, 15 nt, Human
uguuuuccagcuccu

SEQ ID NO: 2603864 - RNA, 22 nt, Human
uguuuucccgagcaaagucuaa

SEQ ID NO: 2603865 - RNA, 23 nt, Human
uguuuucccgagcaaagucuaaa

SEQ ID NO: 2603866 - RNA, 18 nt, Human
uguuuuccauuguuugaa

SEQ ID NO: 2603867 - RNA, 12 nt, Human
uguuuucccuga

SEQ ID NO: 2603868 - RNA, 19 nt, Human
uguuuucauuaucucaaaa

SEQ ID NO: 2603869 - RNA, 15 nt, Human
uguuuuauuccugua

SEQ ID NO: 2603870 - RNA, 14 nt, Human
uguuuuauuccugu

SEQ ID NO: 2603871 - RNA, 15 nt, Human
uguuuucauaauaaa

SEQ ID NO: 2603872 - RNA, 20 nt, Human
uguuuucauggugaaaaugu

SEQ ID NO: 2603873 - RNA, 12 nt, Human
uguuuugauaaa

SEQ ID NO: 2603874 - RNA, 19 nt, Human
uguuuugagcuuuccaugu

SEQ ID NO: 2603875 - RNA, 18 nt, Human
uguuuugagcuuuccaug

SEQ ID NO: 2603876 - RNA, 16 nt, Human
uguuuugagcuuucca

SEQ ID NO: 2603877 - RNA, 17 nt, Human
uguuuugacggaugauu

SEQ ID NO: 2603878 - RNA, 22 nt, Human
uguuuugaaugguguuguaugc

SEQ ID NO: 2603879 - RNA, 19 nt, Human
uguuuugaaugguguugua

SEQ ID NO: 2603880 - RNA, 17 nt, Human
uguuuugaaggcaaaau

SEQ ID NO: 2603881 - RNA, 23 nt, Human
uguuuucugagcccgggcugccu

SEQ ID NO: 2603882 - RNA, 12 nt, Human
uguuuucugaau

SEQ ID NO: 2603883 - RNA, 17 nt, Human
uguuuucugaauaacau

SEQ ID NO: 2603884 - RNA, 17 nt, Human
uguuuucuuuugguaaa

SEQ ID NO: 2603885 - RNA, 11 nt, Human
uguuuucuucu

SEQ ID NO: 2603886 - RNA, 19 nt, Human
uguuuauugucaaaguggu

SEQ ID NO: 2603887 - RNA, 17 nt, Human
uguuuauugucaaagug

SEQ ID NO: 2603888 - RNA, 13 nt, Human
uguuuauuaacaa

SEQ ID NO: 2603889 - RNA, 14 nt, Human
uguuuauuaacaaa

SEQ ID NO: 2603890 - RNA, 16 nt, Human
uguuuauuaacaaauu

SEQ ID NO: 2603891 - RNA, 19 nt, Human
uguuuauuaacaaauuaug

SEQ ID NO: 2603892 - RNA, 16 nt, Human
uguuuaugugugugug

SEQ ID NO: 2603893 - RNA, 13 nt, Human
uguuuaugugugu

SEQ ID NO: 2603894 - RNA, 16 nt, Human
uguuuauaaacauugu

SEQ ID NO: 2603895 - RNA, 21 nt, Human
uguuuauagcaaacuuggaau

SEQ ID NO: 2603896 - RNA, 16 nt, Human
uguuuauaccuuugcc

SEQ ID NO: 2603897 - RNA, 15 nt, Human
uguuuauacagcuca

SEQ ID NO: 2603898 - RNA, 20 nt, Human
uguuuauauaaaugcuuuua

SEQ ID NO: 2603899 - RNA, 16 nt, Human
uguuuauauaaaugcu

SEQ ID NO: 2603900 - RNA, 14 nt, Human
uguuuauauaaaug

SEQ ID NO: 2603901 - RNA, 13 nt, Human
uguugcugaauag

SEQ ID NO: 2603902 - RNA, 23 nt, Human
uguugcucaaaucuauucagaca

SEQ ID NO: 2603903 - RNA, 14 nt, Human
uguuuaguugcaga

SEQ ID NO: 2603904 - RNA, 11 nt, Human
uguugcugaau

SEQ ID NO: 2603905 - RNA, 21 nt, Human
uguugcucaaaucuauucaga

SEQ ID NO: 2603906 - RNA, 14 nt, Human
uguugcucagucuc

SEQ ID NO: 2603907 - RNA, 21 nt, Human
uguugcuaagccccagcaagc

SEQ ID NO: 2603908 - RNA, 12 nt, Human
uguugcuaagcc

SEQ ID NO: 2603909 - RNA, 22 nt, Human
uguugcuaagccccagcaagca

SEQ ID NO: 2603910 - RNA, 19 nt, Human
uguugcucaaaaaaugagc

SEQ ID NO: 2603911 - RNA, 18 nt, Human
uguugccuuuaugguuuc

SEQ ID NO: 2603912 - RNA, 11 nt, Human
uguugcuaagc

SEQ ID NO: 2603913 - RNA, 19 nt, Human
uguugccuugcauaauggu

SEQ ID NO: 2603914 - RNA, 20 nt, Human
uguugcacacccacucagcu

SEQ ID NO: 2603915 - RNA, 21 nt, Human
uguugcacacccacucagcuc

SEQ ID NO: 2603916 - RNA, 22 nt, Human
uguugcacacccacucagcucc

SEQ ID NO: 2603917 - RNA, 22 nt, Human
uguugccuugaaccacuucccu

SEQ ID NO: 2603918 - RNA, 19 nt, Human
uguugcccaggcaggucuu

SEQ ID NO: 2603919 - RNA, 19 nt, Human
uguuucuuuguaaugaaaa

SEQ ID NO: 2603920 - RNA, 18 nt, Human
uguuucuuuguaaugaaa

SEQ ID NO: 2603921 - RNA, 13 nt, Human
uguuucuuucuag

SEQ ID NO: 2603922 - RNA, 18 nt, Human
uguuucuuccaaagcaca

SEQ ID NO: 2603923 - RNA, 19 nt, Human
uguuucuguuauuaacaaa

SEQ ID NO: 2603924 - RNA, 15 nt, Human
uguuucuguuauuaa

SEQ ID NO: 2603925 - RNA, 14 nt, Human
uguuucuguuauua

SEQ ID NO: 2603926 - RNA, 17 nt, Human
uguuucuguucaccuuc

SEQ ID NO: 2603927 - RNA, 17 nt, Human
uguuucuuccaaagcac

SEQ ID NO: 2603928 - RNA, 19 nt, Human
uguuucuuccaaagcacau

SEQ ID NO: 2603929 - RNA, 24 nt, Human
uguuuauuuauagaguguacuuaa

SEQ ID NO: 2603930 - RNA, 14 nt, Human
uguuuauuuauaga

SEQ ID NO: 2603931 - RNA, 22 nt, Human
uguuuauuuauaagcagauuua

SEQ ID NO: 2603932 - RNA, 23 nt, Human
uguuuauuuauaagcagauuuaa

SEQ ID NO: 2603933 - RNA, 13 nt, Human
uguuucuguuauu

SEQ ID NO: 2603934 - RNA, 12 nt, Human
uguuucuguuau

SEQ ID NO: 2603935 - RNA, 15 nt, Human
uguuuauuuaucagu

SEQ ID NO: 2603936 - RNA, 22 nt, Human
uguuugauucagacagcugccu

SEQ ID NO: 2603937 - RNA, 17 nt, Human
uguuugauucagacagc

SEQ ID NO: 2603938 - RNA, 13 nt, Human
uguuugaugcauu

SEQ ID NO: 2603939 - RNA, 16 nt, Human
uguuugaugcauuaaa

SEQ ID NO: 2603940 - RNA, 19 nt, Human
uguuugaugcauuaaaaga

SEQ ID NO: 2603941 - RNA, 22 nt, Human
uguuugaggauauauuuucacu

SEQ ID NO: 2603942 - RNA, 18 nt, Human
uguuugagcucugcagcc

SEQ ID NO: 2603943 - RNA, 22 nt, Human
uguuugagguuuuuaagccuua

SEQ ID NO: 2603944 - RNA, 14 nt, Human
uguuugagcucaga

SEQ ID NO: 2603945 - RNA, 23 nt, Human
uguuugagcucagacccccacuc

SEQ ID NO: 2603946 - RNA, 21 nt, Human
uguuucuuuuguauguaaaug

SEQ ID NO: 2603947 - RNA, 20 nt, Human
uguuucuuuuguauguaaau

SEQ ID NO: 2603948 - RNA, 14 nt, Human
uguuucuuuuguau

SEQ ID NO: 2603949 - RNA, 13 nt, Human
uguuucuuuugua

SEQ ID NO: 2603950 - RNA, 15 nt, Human
uguuucuuuucacau

SEQ ID NO: 2603951 - RNA, 13 nt, Human
uguuugaaaucuu

SEQ ID NO: 2603952 - RNA, 18 nt, Human
uguuugaaacaaagaagg

SEQ ID NO: 2603953 - RNA, 13 nt, Human
uguuugagcucag

SEQ ID NO: 2603954 - RNA, 14 nt, Human
uguuugagaaauua

SEQ ID NO: 2603955 - RNA, 22 nt, Human
uguuugacaaaguuacugauuc

SEQ ID NO: 2603956 - RNA, 22 nt, Human
uguuugacaaagaaacccaagu

SEQ ID NO: 2603957 - RNA, 17 nt, Human
uguuugaagccugcccu

SEQ ID NO: 2603958 - RNA, 22 nt, Human
uguuugaaucccacgcuucucu

SEQ ID NO: 2603959 - RNA, 21 nt, Human
uguuugacaaagaaacccaag

SEQ ID NO: 2603960 - RNA, 21 nt, Human
uguuugacgggaaacaaaacu

SEQ ID NO: 2603961 - RNA, 19 nt, Human
aguggugguuuucuguucu

SEQ ID NO: 2603962 - RNA, 20 nt, Human
aguggugguuuucuguucuu

SEQ ID NO: 2603963 - RNA, 21 nt, Human
aguggugguuuucuguucuuu

SEQ ID NO: 2603964 - RNA, 23 nt, Human
aguggugguuuucuguucuuucu

SEQ ID NO: 2603965 - RNA, 17 nt, Human
aguggugguuuucuguu

SEQ ID NO: 2603966 - RNA, 18 nt, Human
aguggugguuuucuguuc

SEQ ID NO: 2603967 - RNA, 21 nt, Human
agugguggugaacagaacaaa

SEQ ID NO: 2603968 - RNA, 20 nt, Human
aguggugguaacccuggugg

SEQ ID NO: 2603969 - RNA, 18 nt, Human
aguggugguaacccuggu

SEQ ID NO: 2603970 - RNA, 19 nt, Human
aguggugguaacccuggug

SEQ ID NO: 2603971 - RNA, 18 nt, Human
agugguggcagggccuag

SEQ ID NO: 2603972 - RNA, 16 nt, Human
agugguggcagggccu

SEQ ID NO: 2603973 - RNA, 15 nt, Human
agugguggcagggcc

SEQ ID NO: 2603974 - RNA, 14 nt, Human
agugguggcagggc

SEQ ID NO: 2603975 - RNA, 13 nt, Human
agugguggcaggg

SEQ ID NO: 2603976 - RNA, 11 nt, Human
agugguggcag

SEQ ID NO: 2603977 - RNA, 22 nt, Human
aguggugcucaguuguagaaug

SEQ ID NO: 2603978 - RNA, 20 nt, Human
aguggugcucaguuguagaa

SEQ ID NO: 2603979 - RNA, 17 nt, Human
aguggugcucaguugua

SEQ ID NO: 2603980 - RNA, 16 nt, Human
aguggugcucaguugu

SEQ ID NO: 2603981 - RNA, 15 nt, Human
aguggugcucaguug

SEQ ID NO: 2603982 - RNA, 13 nt, Human
aguggugcucagu

SEQ ID NO: 2603983 - RNA, 20 nt, Human
aguggaccaggacaggacca

SEQ ID NO: 2603984 - RNA, 16 nt, Human
aguggaccaggacagg

SEQ ID NO: 2603985 - RNA, 19 nt, Human
aguggaccaggacaggacc

SEQ ID NO: 2603986 - RNA, 20 nt, Human
aguggacauuguuggcagca

SEQ ID NO: 2603987 - RNA, 13 nt, Human
aguggaccaggac

SEQ ID NO: 2603988 - RNA, 14 nt, Human
aguggaccaggaca

SEQ ID NO: 2603989 - RNA, 15 nt, Human
aguggaccaggacag

SEQ ID NO: 2603990 - RNA, 17 nt, Human
aguggugcgaucugggu

SEQ ID NO: 2603991 - RNA, 22 nt, Human
aguggaaugcuuccuagaaguu

SEQ ID NO: 2603992 - RNA, 23 nt, Human
aguggaauaguauccuccagguu

SEQ ID NO: 2603993 - RNA, 22 nt, Human
aguggaauaguauccuccaggu

SEQ ID NO: 2603994 - RNA, 21 nt, Human
aguggaauaguauccuccagg

SEQ ID NO: 2603995 - RNA, 20 nt, Human
aguggaauaguauccuccag

SEQ ID NO: 2603996 - RNA, 19 nt, Human
aguggaauaguauccucca

SEQ ID NO: 2603997 - RNA, 17 nt, Human
aguggaauaguauccuc

SEQ ID NO: 2603998 - RNA, 13 nt, Human
aguggacaggagu

SEQ ID NO: 2603999 - RNA, 20 nt, Human
aguggacaccaggagucccu

SEQ ID NO: 2604000 - RNA, 22 nt, Human
aguggacaccaggagucccugg

SEQ ID NO: 2604001 - RNA, 18 nt, Human
uguuacaaaguuguaugu

SEQ ID NO: 2604002 - RNA, 14 nt, Human
uguuacaaauugua

SEQ ID NO: 2604003 - RNA, 21 nt, Human
aguguaaaauauuuugaauca

SEQ ID NO: 2604004 - RNA, 18 nt, Human
aguguaaaauauuuugaa

SEQ ID NO: 2604005 - RNA, 14 nt, Human
aguguaaaauauuu

SEQ ID NO: 2604006 - RNA, 15 nt, Human
aguggugugaucuca

SEQ ID NO: 2604007 - RNA, 22 nt, Human
aguguaaagcauuccaacaaag

SEQ ID NO: 2604008 - RNA, 20 nt, Human
aguguaaagcauuccaacaa

SEQ ID NO: 2604009 - RNA, 18 nt, Human
aguguaaagcauuccaac

SEQ ID NO: 2604010 - RNA, 17 nt, Human
aguguaaagcauuccaa

SEQ ID NO: 2604011 - RNA, 16 nt, Human
aguguaaagcauucca

SEQ ID NO: 2604012 - RNA, 14 nt, Human
aguguaaagcauuc

SEQ ID NO: 2604013 - RNA, 13 nt, Human
aguguaaagcauu

SEQ ID NO: 2604014 - RNA, 21 nt, Human
aguguaaauaguuacuccagu

SEQ ID NO: 2604015 - RNA, 14 nt, Human
aguguaaauccuuu

SEQ ID NO: 2604016 - RNA, 21 nt, Human
aguguaaauccuuuuucuuua

SEQ ID NO: 2604017 - RNA, 13 nt, Human
aguguaacagcug

SEQ ID NO: 2604018 - RNA, 14 nt, Human
aguguaacagcuga

SEQ ID NO: 2604019 - RNA, 15 nt, Human
aguguaacagcugag

SEQ ID NO: 2604020 - RNA, 16 nt, Human
aguguaacagcugagg

SEQ ID NO: 2604021 - RNA, 17 nt, Human
aguguaacagcugaggu

SEQ ID NO: 2604022 - RNA, 16 nt, Human
aguguaccauuugccu

SEQ ID NO: 2604023 - RNA, 16 nt, Human
aguguagaagcauucc

SEQ ID NO: 2604024 - RNA, 15 nt, Human
aguguagaagcauuc

SEQ ID NO: 2604025 - RNA, 14 nt, Human
aguguagaagcauu

SEQ ID NO: 2604026 - RNA, 13 nt, Human
aguguagaagcau

SEQ ID NO: 2604027 - RNA, 12 nt, Human
aguguagaagca

SEQ ID NO: 2604028 - RNA, 20 nt, Human
aguguagaagcauuccuucu

SEQ ID NO: 2604029 - RNA, 19 nt, Human
aguguagaagcauuccuuc

SEQ ID NO: 2604030 - RNA, 18 nt, Human
aguguagaagcauuccuu

SEQ ID NO: 2604031 - RNA, 17 nt, Human
aguguagaagcauuccu

SEQ ID NO: 2604032 - RNA, 18 nt, Human
agugugauugggaauaaa

SEQ ID NO: 2604033 - RNA, 23 nt, Human
aguguacccccgcccaggcuggc

SEQ ID NO: 2604034 - RNA, 22 nt, Human
aguguacccccgcccaggcugg

SEQ ID NO: 2604035 - RNA, 20 nt, Human
aguguacccccgcccaggcu

SEQ ID NO: 2604036 - RNA, 19 nt, Human
aguguacccccgcccaggc

SEQ ID NO: 2604037 - RNA, 17 nt, Human
aguguacuuaacuauuc

SEQ ID NO: 2604038 - RNA, 20 nt, Human
agugugccccccauccuggc

SEQ ID NO: 2604039 - RNA, 19 nt, Human
agugugccccccauccugg

SEQ ID NO: 2604040 - RNA, 17 nt, Human
agugugccccccauccu

SEQ ID NO: 2604041 - RNA, 13 nt, Human
agugugcccccca

SEQ ID NO: 2604042 - RNA, 19 nt, Human
agugugcauauuguacacu

SEQ ID NO: 2604043 - RNA, 18 nt, Human
agugugcauauuguacac

SEQ ID NO: 2604044 - RNA, 17 nt, Human
agugugcauauuguaca

SEQ ID NO: 2604045 - RNA, 16 nt, Human
agugugguguuuccug

SEQ ID NO: 2604046 - RNA, 22 nt, Human
agugugauugggaauaaauaug

SEQ ID NO: 2604047 - RNA, 21 nt, Human
agugugauugggaauaaauau

SEQ ID NO: 2604048 - RNA, 20 nt, Human
agugugauugggaauaaaua

SEQ ID NO: 2604049 - RNA, 19 nt, Human
agugugauugggaauaaau

SEQ ID NO: 2604050 - RNA, 12 nt, Human
agugugcaaaau

SEQ ID NO: 2604051 - RNA, 23 nt, Human
agugugauugggaauaaauaugc

SEQ ID NO: 2604052 - RNA, 14 nt, Human
agugugcaaaauau

SEQ ID NO: 2604053 - RNA, 16 nt, Human
agugugcauauuguac

SEQ ID NO: 2604054 - RNA, 15 nt, Human
agugugcauauugua

SEQ ID NO: 2604055 - RNA, 21 nt, Human
agugugcaguucuaguuugca

SEQ ID NO: 2604056 - RNA, 17 nt, Human
agugugcacuaaggggc

SEQ ID NO: 2604057 - RNA, 22 nt, Human
agugugcacuaaggggcccggc

SEQ ID NO: 2604058 - RNA, 19 nt, Human
agugugguguuuccuggca

SEQ ID NO: 2604059 - RNA, 20 nt, Human
aguguguauuaaaaaaaaca

SEQ ID NO: 2604060 - RNA, 23 nt, Human
aguguguauuaaaaaaaacaaaa

SEQ ID NO: 2604061 - RNA, 22 nt, Human
aguguguauuaaaaaaaacaaa

SEQ ID NO: 2604062 - RNA, 15 nt, Human
aguguguauuguucc

SEQ ID NO: 2604063 - RNA, 16 nt, Human
aguguguauuguuccc

SEQ ID NO: 2604064 - RNA, 17 nt, Human
agugugguguuuccugg

SEQ ID NO: 2604065 - RNA, 23 nt, Human
agugugccccccauccuggccca

SEQ ID NO: 2604066 - RNA, 22 nt, Human
agugugccccccauccuggccc

SEQ ID NO: 2604067 - RNA, 23 nt, Human
agugugguguuuccugcaggcca

SEQ ID NO: 2604068 - RNA, 18 nt, Human
uguugcccaggcaggucu

SEQ ID NO: 2604069 - RNA, 17 nt, Human
uguugcccaggcagguc

SEQ ID NO: 2604070 - RNA, 16 nt, Human
uguugcccaggcaggu

SEQ ID NO: 2604071 - RNA, 15 nt, Human
uguugcccaggcagg

SEQ ID NO: 2604072 - RNA, 12 nt, Human
uguugcccaggc

SEQ ID NO: 2604073 - RNA, 13 nt, Human
uguugcccaggca

SEQ ID NO: 2604074 - RNA, 15 nt, Human
uguugauuuucuguu

SEQ ID NO: 2604075 - RNA, 18 nt, Human
uguugauuuucuguugua

SEQ ID NO: 2604076 - RNA, 14 nt, Human
uguugauuuucugu

SEQ ID NO: 2604077 - RNA, 20 nt, Human
uguugauuucuuuccagagg

SEQ ID NO: 2604078 - RNA, 19 nt, Human
uguugauuucuuuccagag

SEQ ID NO: 2604079 - RNA, 17 nt, Human
uguugcaagugcaauaa

SEQ ID NO: 2604080 - RNA, 19 nt, Human
uguugcaaguacugcugua

SEQ ID NO: 2604081 - RNA, 17 nt, Human
uguugcaaguacugcug

SEQ ID NO: 2604082 - RNA, 14 nt, Human
uguucugugucuuu

SEQ ID NO: 2604083 - RNA, 22 nt, Human
uguucuguggaaaguguaaagc

SEQ ID NO: 2604084 - RNA, 21 nt, Human
uguucuguggaaaguguaaag

SEQ ID NO: 2604085 - RNA, 13 nt, Human
uguucugugucuu

SEQ ID NO: 2604086 - RNA, 20 nt, Human
uguucuguggaaaguguaaa

SEQ ID NO: 2604087 - RNA, 19 nt, Human
uguucuguggaaaguguaa

SEQ ID NO: 2604088 - RNA, 18 nt, Human
uguucuguggaaagugua

SEQ ID NO: 2604089 - RNA, 17 nt, Human
uguucuguggaaagugu

SEQ ID NO: 2604090 - RNA, 13 nt, Human
uguucuguggaaa

SEQ ID NO: 2604091 - RNA, 23 nt, Human
uguucugugaugaggggaggggg

SEQ ID NO: 2604092 - RNA, 18 nt, Human
uguucugugauauaagug

SEQ ID NO: 2604093 - RNA, 15 nt, Human
uguucugugauauaa

SEQ ID NO: 2604094 - RNA, 19 nt, Human
uguucuguuuaauacucau

SEQ ID NO: 2604095 - RNA, 13 nt, Human
uguucuguuuaau

SEQ ID NO: 2604096 - RNA, 19 nt, Human
uguugauugcuaaauguaa

SEQ ID NO: 2604097 - RNA, 18 nt, Human
uguugauugcuaaaugua

SEQ ID NO: 2604098 - RNA, 17 nt, Human
uguugauugcuaaaugu

SEQ ID NO: 2604099 - RNA, 16 nt, Human
uguugauugcuaaaug

SEQ ID NO: 2604100 - RNA, 14 nt, Human
uguuauauaaaugg

SEQ ID NO: 2604101 - RNA, 13 nt, Human
uguuauauaaaug

SEQ ID NO: 2604102 - RNA, 18 nt, Human
uguuauagguuguuggau

SEQ ID NO: 2604103 - RNA, 18 nt, Human
uguuccagauucaaucga

SEQ ID NO: 2604104 - RNA, 14 nt, Human
uguuccagcaguuu

SEQ ID NO: 2604105 - RNA, 20 nt, Human
uguuccacaaguuaaauaaa

SEQ ID NO: 2604106 - RNA, 20 nt, Human
agugugucuuagugugugca

SEQ ID NO: 2604107 - RNA, 14 nt, Human
agugugucuaaauu

SEQ ID NO: 2604108 - RNA, 19 nt, Human
aguguguauuguucccagu

SEQ ID NO: 2604109 - RNA, 21 nt, Human
aguguguauuguucccaguga

SEQ ID NO: 2604110 - RNA, 18 nt, Human
aguguguccaagugugug

SEQ ID NO: 2604111 - RNA, 21 nt, Human
aguguguccaagugugugugc

SEQ ID NO: 2604112 - RNA, 15 nt, Human
uguuauaaucuuuca

SEQ ID NO: 2604113 - RNA, 21 nt, Human
agugugugauuuuuugcauuc

SEQ ID NO: 2604114 - RNA, 17 nt, Human
agugugugcaaguaugu

SEQ ID NO: 2604115 - RNA, 18 nt, Human
agugugugcacaugugug

SEQ ID NO: 2604116 - RNA, 19 nt, Human
agugugugcacaugugugc

SEQ ID NO: 2604117 - RNA, 14 nt, Human
uguuccuagugaaa

SEQ ID NO: 2604118 - RNA, 18 nt, Human
uguuccuagugaaagagg

SEQ ID NO: 2604119 - RNA, 20 nt, Human
uguucuggugaggccuugcu

SEQ ID NO: 2604120 - RNA, 21 nt, Human
uguucuggugaggccuugcuc

SEQ ID NO: 2604121 - RNA, 15 nt, Human
uguuccuacgggcuu

SEQ ID NO: 2604122 - RNA, 14 nt, Human
uguuccuagaguag

SEQ ID NO: 2604123 - RNA, 16 nt, Human
uguuccuagaguagag

SEQ ID NO: 2604124 - RNA, 16 nt, Human
uguucugggacacagu

SEQ ID NO: 2604125 - RNA, 17 nt, Human
uguuccagccugcccuc

SEQ ID NO: 2604126 - RNA, 18 nt, Human
uguuccaguaaucuaaua

SEQ ID NO: 2604127 - RNA, 14 nt, Human
uguuccagcucuuu

SEQ ID NO: 2604128 - RNA, 20 nt, Human
uguucccaccaggcugcuca

SEQ ID NO: 2604129 - RNA, 21 nt, Human
uguucccaccaggcugcucag

SEQ ID NO: 2604130 - RNA, 17 nt, Human
uguucccaccugcugga

SEQ ID NO: 2604131 - RNA, 21 nt, Human
uguuccgugguuaaacucgcu

SEQ ID NO: 2604132 - RNA, 19 nt, Human
uguuccuacagccccuuuu

SEQ ID NO: 2604133 - RNA, 22 nt, Human
uguuccgaaaccaaagaagaaa

SEQ ID NO: 2604134 - RNA, 15 nt, Human
uguuccuacagcccc

SEQ ID NO: 2604135 - RNA, 19 nt, Human
uguucccucugcuccugga

SEQ ID NO: 2604136 - RNA, 18 nt, Human
uguucccucugcuccugg

SEQ ID NO: 2604137 - RNA, 16 nt, Human
uguucccucugcuccu

SEQ ID NO: 2604138 - RNA, 22 nt, Human
uguucccagugacacuucagag

SEQ ID NO: 2604139 - RNA, 14 nt, Human
uguucccucugcuc

SEQ ID NO: 2604140 - RNA, 14 nt, Human
ugugucuuuugcau

SEQ ID NO: 2604141 - RNA, 22 nt, Human
ugugugaaaggaagcuccacug

SEQ ID NO: 2604142 - RNA, 22 nt, Human
ugugucuuucacagcuccuccc

SEQ ID NO: 2604143 - RNA, 18 nt, Human
ugugucuuucacagcucc

SEQ ID NO: 2604144 - RNA, 20 nt, Human
ugugugaaagguacuucaaa

SEQ ID NO: 2604145 - RNA, 12 nt, Human
ugugugugggag

SEQ ID NO: 2604146 - RNA, 20 nt, Human
ugugugugggaguguguaau

SEQ ID NO: 2604147 - RNA, 14 nt, Human
uguguguguaugug

SEQ ID NO: 2604148 - RNA, 23 nt, Human
uguguguuuauugucaaaguggu

SEQ ID NO: 2604149 - RNA, 19 nt, Human
uguguguuuauugucaaag

SEQ ID NO: 2604150 - RNA, 13 nt, Human
ugugugugugaau

SEQ ID NO: 2604151 - RNA, 14 nt, Human
uguguguguauguu

SEQ ID NO: 2604152 - RNA, 20 nt, Human
ugugugugguuuuuuuucua

SEQ ID NO: 2604153 - RNA, 16 nt, Human
ugugucuuuugcauga

SEQ ID NO: 2604154 - RNA, 19 nt, Human
ugugugugggcugugagug

SEQ ID NO: 2604155 - RNA, 13 nt, Human
ugugugugguuuu

SEQ ID NO: 2604156 - RNA, 14 nt, Human
uguguguguaugcu

SEQ ID NO: 2604157 - RNA, 13 nt, Human
uguguguguaugu

SEQ ID NO: 2604158 - RNA, 21 nt, Human
ugugucucuugguccugcugc

SEQ ID NO: 2604159 - RNA, 18 nt, Human
uguguaauagaaaacuga

SEQ ID NO: 2604160 - RNA, 21 nt, Human
ugugucuugcaauggcagccu

SEQ ID NO: 2604161 - RNA, 20 nt, Human
ugugucucuugguccugcug

SEQ ID NO: 2604162 - RNA, 17 nt, Human
ugugucucuugguccug

SEQ ID NO: 2604163 - RNA, 13 nt, Human
uguguaaguagau

SEQ ID NO: 2604164 - RNA, 16 nt, Human
uguguaauagaaaacu

SEQ ID NO: 2604165 - RNA, 16 nt, Human
uguuaaguauguguaa

SEQ ID NO: 2604166 - RNA, 15 nt, Human
uguuaaguaugugua

SEQ ID NO: 2604167 - RNA, 22 nt, Human
uguuaauucagcacugauuuca

SEQ ID NO: 2604168 - RNA, 20 nt, Human
uguuaauucagcacugauuu

SEQ ID NO: 2604169 - RNA, 15 nt, Human
uguuaauucagcacu

SEQ ID NO: 2604170 - RNA, 12 nt, Human
uguuaauuauac

SEQ ID NO: 2604171 - RNA, 15 nt, Human
uguuaaguauuuuca

SEQ ID NO: 2604172 - RNA, 20 nt, Human
uguuaaggaaacucuuaucu

SEQ ID NO: 2604173 - RNA, 17 nt, Human
uguuaaggaaacucuua

SEQ ID NO: 2604174 - RNA, 16 nt, Human
uguuaaggaaacucuu

SEQ ID NO: 2604175 - RNA, 15 nt, Human
uguuaaggaaacucu

SEQ ID NO: 2604176 - RNA, 14 nt, Human
uguuaaggaaacuc

SEQ ID NO: 2604177 - RNA, 20 nt, Human
uguuaagcgugucuguauuu

SEQ ID NO: 2604178 - RNA, 22 nt, Human
uguuaaggaaacucuuaucuca

SEQ ID NO: 2604179 - RNA, 21 nt, Human
uguuaaggaaacucuuaucuc

SEQ ID NO: 2604180 - RNA, 20 nt, Human
uguuaagggaagaauuccag

SEQ ID NO: 2604181 - RNA, 23 nt, Human
uguuaaggaaacucuuaucucag

SEQ ID NO: 2604182 - RNA, 21 nt, Human
uguuaaauuuguaaguuucag

SEQ ID NO: 2604183 - RNA, 19 nt, Human
uguuaaauuuguaaguuuc

SEQ ID NO: 2604184 - RNA, 18 nt, Human
uguuaaauuuguaaguuu

SEQ ID NO: 2604185 - RNA, 17 nt, Human
uguuaaauuuguaaguu

SEQ ID NO: 2604186 - RNA, 16 nt, Human
uguuaaauuuguaagu

SEQ ID NO: 2604187 - RNA, 15 nt, Human
uguuaaauuuguaag

SEQ ID NO: 2604188 - RNA, 14 nt, Human
uguuaaauuuguaa

SEQ ID NO: 2604189 - RNA, 18 nt, Human
uguuaaauugcuguguau

SEQ ID NO: 2604190 - RNA, 18 nt, Human
uguuaaaugaaauuguaa

SEQ ID NO: 2604191 - RNA, 14 nt, Human
uguuaaaugaaacc

SEQ ID NO: 2604192 - RNA, 19 nt, Human
uguuaaaugaaauuguaaa

SEQ ID NO: 2604193 - RNA, 22 nt, Human
uguuaaauaucaguagaaacuc

SEQ ID NO: 2604194 - RNA, 16 nt, Human
uguuaaauauuuacau

SEQ ID NO: 2604195 - RNA, 24 nt, Human
uguuaaaucccauucauaacuuuc

SEQ ID NO: 2604196 - RNA, 16 nt, Human
uguuaaauaaauugua

SEQ ID NO: 2604197 - RNA, 14 nt, Human
uguuaaauaaauug

SEQ ID NO: 2604198 - RNA, 13 nt, Human
uguuaaauaaauu

SEQ ID NO: 2604199 - RNA, 20 nt, Human
uguuaaauaaauuguauauu

SEQ ID NO: 2604200 - RNA, 18 nt, Human
uguuaaauaaauuguaua

SEQ ID NO: 2604201 - RNA, 17 nt, Human
uguguucugauuagaaa

SEQ ID NO: 2604202 - RNA, 19 nt, Human
uguguuaaguauguguaaa

SEQ ID NO: 2604203 - RNA, 17 nt, Human
uguguucccauuucagc

SEQ ID NO: 2604204 - RNA, 15 nt, Human
uguguguuucacuuu

SEQ ID NO: 2604205 - RNA, 13 nt, Human
uguguguuucacu

SEQ ID NO: 2604206 - RNA, 15 nt, Human
uguguuccccaaagg

SEQ ID NO: 2604207 - RNA, 19 nt, Human
uguguucccauuucagcug

SEQ ID NO: 2604208 - RNA, 11 nt, Human
uguguuccugg

SEQ ID NO: 2604209 - RNA, 10 nt, Human
uguguuccug

SEQ ID NO: 2604210 - RNA, 15 nt, Human
uguguuccuggcaau

SEQ ID NO: 2604211 - RNA, 16 nt, Human
uguguuccuggcaaua

SEQ ID NO: 2604212 - RNA, 24 nt, Human
uguguuccuggcaauaguguguuc

SEQ ID NO: 2604213 - RNA, 20 nt, Human
uguguucgcgugugugggug

SEQ ID NO: 2604214 - RNA, 23 nt, Human
agugaguugauagcacagacccu

SEQ ID NO: 2604215 - RNA, 22 nt, Human
agugaguugauagcacagaccc

SEQ ID NO: 2604216 - RNA, 15 nt, Human
agugaggugcccagc

SEQ ID NO: 2604217 - RNA, 22 nt, Human
agugaggguuucugagcugcuc

SEQ ID NO: 2604218 - RNA, 16 nt, Human
agugcugaacagugga

SEQ ID NO: 2604219 - RNA, 12 nt, Human
agugcugcauuu

SEQ ID NO: 2604220 - RNA, 13 nt, Human
agugcugcauuua

SEQ ID NO: 2604221 - RNA, 12 nt, Human
agugcugagacc

SEQ ID NO: 2604222 - RNA, 22 nt, Human
agugcugucugaucugugcuuu

SEQ ID NO: 2604223 - RNA, 21 nt, Human
agugcugucugaucugugcuu

SEQ ID NO: 2604224 - RNA, 20 nt, Human
agugcugucugaucugugcu

SEQ ID NO: 2604225 - RNA, 19 nt, Human
agugcugucugaucugugc

SEQ ID NO: 2604226 - RNA, 22 nt, Human
agugcuguauaaaaucagccaa

SEQ ID NO: 2604227 - RNA, 19 nt, Human
agugcuguauaaaaucagc

SEQ ID NO: 2604228 - RNA, 17 nt, Human
agugcuguauaaaauca

SEQ ID NO: 2604229 - RNA, 16 nt, Human
agugcuguauaaaauc

SEQ ID NO: 2604230 - RNA, 15 nt, Human
agugcuguauaaaau

SEQ ID NO: 2604231 - RNA, 14 nt, Human
agugcuguauaaaa

SEQ ID NO: 2604232 - RNA, 21 nt, Human
agugcugggauuacaggugug

SEQ ID NO: 2604233 - RNA, 13 nt, Human
agugcuguauaaa

SEQ ID NO: 2604234 - RNA, 12 nt, Human
agugcuguauaa

SEQ ID NO: 2604235 - RNA, 12 nt, Human
agugcuguaaaa

SEQ ID NO: 2604236 - RNA, 16 nt, Human
agugcugcauuuaaaa

SEQ ID NO: 2604237 - RNA, 17 nt, Human
agugcugcauuuaaaag

SEQ ID NO: 2604238 - RNA, 19 nt, Human
agugcugcauuuaaaagau

SEQ ID NO: 2604239 - RNA, 20 nt, Human
agugcugggauuacaggugu

SEQ ID NO: 2604240 - RNA, 20 nt, Human
uguggucacaggaaguagag

SEQ ID NO: 2604241 - RNA, 23 nt, Human
uguggguuucuaaagcugccagc

SEQ ID NO: 2604242 - RNA, 22 nt, Human
uguggguggauauaaauauaua

SEQ ID NO: 2604243 - RNA, 20 nt, Human
uguggguggauauaaauaua

SEQ ID NO: 2604244 - RNA, 17 nt, Human
uguggguggauauaaau

SEQ ID NO: 2604245 - RNA, 13 nt, Human
ugugggugggaga

SEQ ID NO: 2604246 - RNA, 21 nt, Human
uguggguuucuaaagcugcca

SEQ ID NO: 2604247 - RNA, 12 nt, Human
agugcugugaaa

SEQ ID NO: 2604248 - RNA, 13 nt, Human
agugcugugaaaa

SEQ ID NO: 2604249 - RNA, 14 nt, Human
agugcugugaaaaa

SEQ ID NO: 2604250 - RNA, 16 nt, Human
agugcugugaaaaaaa

SEQ ID NO: 2604251 - RNA, 14 nt, Human
agugcuguggccug

SEQ ID NO: 2604252 - RNA, 16 nt, Human
agugcuguggccuggg

SEQ ID NO: 2604253 - RNA, 17 nt, Human
agugcuguggccugggc

SEQ ID NO: 2604254 - RNA, 18 nt, Human
agugcuguggccugggca

SEQ ID NO: 2604255 - RNA, 20 nt, Human
agugcuguggccugggcaag

SEQ ID NO: 2604256 - RNA, 16 nt, Human
ugugguguuuccuggc

SEQ ID NO: 2604257 - RNA, 14 nt, Human
ugugguguuuccug

SEQ ID NO: 2604258 - RNA, 15 nt, Human
uguguaacagcuccu

SEQ ID NO: 2604259 - RNA, 20 nt, Human
ugugguguuuccuggcacug

SEQ ID NO: 2604260 - RNA, 14 nt, Human
uguguaacagcucc

SEQ ID NO: 2604261 - RNA, 21 nt, Human
ugugguguuuccugcaggcca

SEQ ID NO: 2604262 - RNA, 15 nt, Human
uguggucccacccca

SEQ ID NO: 2604263 - RNA, 13 nt, Human
uguggucccaccc

SEQ ID NO: 2604264 - RNA, 16 nt, Human
uguggucccaacagga

SEQ ID NO: 2604265 - RNA, 23 nt, Human
uguggugugucccccucugucca

SEQ ID NO: 2604266 - RNA, 14 nt, Human
uguggugucugugu

SEQ ID NO: 2604267 - RNA, 16 nt, Human
ugucuugggcagagcu

SEQ ID NO: 2604268 - RNA, 13 nt, Human
ugucuugggcaga

SEQ ID NO: 2604269 - RNA, 12 nt, Human
ugucuugggcag

SEQ ID NO: 2604270 - RNA, 19 nt, Human
ugucuuggacacuguacaa

SEQ ID NO: 2604271 - RNA, 22 nt, Human
ugucuugggcagagcuggcucu

SEQ ID NO: 2604272 - RNA, 21 nt, Human
ugucuugggcagagcuggcuc

SEQ ID NO: 2604273 - RNA, 13 nt, Human
ugucuuguacaug

SEQ ID NO: 2604274 - RNA, 23 nt, Human
ugucagacauccauguuuguaaa

SEQ ID NO: 2604275 - RNA, 20 nt, Human
ugucagaccuauuugacaua

SEQ ID NO: 2604276 - RNA, 12 nt, Human
ugucagacuuua

SEQ ID NO: 2604277 - RNA, 13 nt, Human
ugucagacuggcu

SEQ ID NO: 2604278 - RNA, 14 nt, Human
ugucagacuuuaaa

SEQ ID NO: 2604279 - RNA, 23 nt, Human
ugucagacuuuaaagaauaauau

SEQ ID NO: 2604280 - RNA, 11 nt, Human
ugucagagcug

SEQ ID NO: 2604281 - RNA, 18 nt, Human
ugucacuuugcucugggu

SEQ ID NO: 2604282 - RNA, 21 nt, Human
agucacguggaggagcagugc

SEQ ID NO: 2604283 - RNA, 18 nt, Human
agucacguggaggagcag

SEQ ID NO: 2604284 - RNA, 16 nt, Human
ugucagaaaccaguua

SEQ ID NO: 2604285 - RNA, 21 nt, Human
ugucagaacuagaauuugauu

SEQ ID NO: 2604286 - RNA, 21 nt, Human
ugucagaaaccaguuauguga

SEQ ID NO: 2604287 - RNA, 21 nt, Human
ugugaaaggaaagagggaggu

SEQ ID NO: 2604288 - RNA, 18 nt, Human
ugugaaaggaaagaggcu

SEQ ID NO: 2604289 - RNA, 22 nt, Human
ugucuuguacauguguagccug

SEQ ID NO: 2604290 - RNA, 20 nt, Human
ugucuuguacauguguagcc

SEQ ID NO: 2604291 - RNA, 17 nt, Human
ugucuuguacaugugua

SEQ ID NO: 2604292 - RNA, 16 nt, Human
ugucuuguacaugugu

SEQ ID NO: 2604293 - RNA, 15 nt, Human
ugugaaaggaaagag

SEQ ID NO: 2604294 - RNA, 21 nt, Human
ugugaaauaaaacuggcuuug

SEQ ID NO: 2604295 - RNA, 14 nt, Human
ugugaaaugaaaac

SEQ ID NO: 2604296 - RNA, 21 nt, Human
ugugaaauaguucaaagccaa

SEQ ID NO: 2604297 - RNA, 20 nt, Human
ugugaaaggaagcuccacug

SEQ ID NO: 2604298 - RNA, 20 nt, Human
ugugaaauaaaacuggcuuu

SEQ ID NO: 2604299 - RNA, 22 nt, Human
ugugaaagucagaugcccagag

SEQ ID NO: 2604300 - RNA, 19 nt, Human
ugucuuggcuuucauguua

SEQ ID NO: 2604301 - RNA, 21 nt, Human
ugugaaagucagaugcccaga

SEQ ID NO: 2604302 - RNA, 15 nt, Human
ugucuuguguuucuu

SEQ ID NO: 2604303 - RNA, 12 nt, Human
ugugaaauuauu

SEQ ID NO: 2604304 - RNA, 14 nt, Human
ugugaaaugcuggc

SEQ ID NO: 2604305 - RNA, 22 nt, Human
ugugaacuggacccuguugcua

SEQ ID NO: 2604306 - RNA, 21 nt, Human
ugugaacuggacccuguugcu

SEQ ID NO: 2604307 - RNA, 19 nt, Human
ugugaacuggacccuguug

SEQ ID NO: 2604308 - RNA, 20 nt, Human
ugugaacaaaagaugcucuu

SEQ ID NO: 2604309 - RNA, 17 nt, Human
ugugaaccaccacaccc

SEQ ID NO: 2604310 - RNA, 20 nt, Human
ugugaacuuggggaacaagg

SEQ ID NO: 2604311 - RNA, 21 nt, Human
ugugaaccaccacacccagcc

SEQ ID NO: 2604312 - RNA, 20 nt, Human
ugugaaccaccacacccagc

SEQ ID NO: 2604313 - RNA, 15 nt, Human
ugugaacagcggcug

SEQ ID NO: 2604314 - RNA, 19 nt, Human
ugugaaccaccacacccag

SEQ ID NO: 2604315 - RNA, 16 nt, Human
ugugaccuuaguguuu

SEQ ID NO: 2604316 - RNA, 15 nt, Human
ugugaccuuaguguu

SEQ ID NO: 2604317 - RNA, 15 nt, Human
ugugaccugaaguuc

SEQ ID NO: 2604318 - RNA, 14 nt, Human
ugugaccugaaguu

SEQ ID NO: 2604319 - RNA, 21 nt, Human
ugugaccucaggcacuagccu

SEQ ID NO: 2604320 - RNA, 20 nt, Human
ugugaccucaggcacuagcc

SEQ ID NO: 2604321 - RNA, 13 nt, Human
ugugaccugaggg

SEQ ID NO: 2604322 - RNA, 16 nt, Human
ugugaccugaaguuca

SEQ ID NO: 2604323 - RNA, 14 nt, Human
ugugaccugagggc

SEQ ID NO: 2604324 - RNA, 14 nt, Human
ugugaagagaacca

SEQ ID NO: 2604325 - RNA, 14 nt, Human
ugugaccucaggca

SEQ ID NO: 2604326 - RNA, 13 nt, Human
ugugaccucaggc

SEQ ID NO: 2604327 - RNA, 16 nt, Human
ugugacccucugaaug

SEQ ID NO: 2604328 - RNA, 14 nt, Human
ugugacccucugaa

SEQ ID NO: 2604329 - RNA, 18 nt, Human
ugugaacuuuauuaaaua

SEQ ID NO: 2604330 - RNA, 22 nt, Human
ugugacuauauagagauguuuu

SEQ ID NO: 2604331 - RNA, 18 nt, Human
ugugacuauauagagaug

SEQ ID NO: 2604332 - RNA, 23 nt, Human
ugugacuaauuguauaacagguu

SEQ ID NO: 2604333 - RNA, 22 nt, Human
ugugacuaauuguauaacaggu

SEQ ID NO: 2604334 - RNA, 19 nt, Human
ugugacuaauuguauaaca

SEQ ID NO: 2604335 - RNA, 18 nt, Human
ugugacuaauuguauaac

SEQ ID NO: 2604336 - RNA, 17 nt, Human
ugugacuaauuguauaa

SEQ ID NO: 2604337 - RNA, 15 nt, Human
ugugacuaauuguau

SEQ ID NO: 2604338 - RNA, 19 nt, Human
ugugaccuuaguguuucug

SEQ ID NO: 2604339 - RNA, 18 nt, Human
ugugaccuuaguguuucu

SEQ ID NO: 2604340 - RNA, 22 nt, Human
agucucaggaaaucaaauaugc

SEQ ID NO: 2604341 - RNA, 15 nt, Human
ugugagaugcuagaa

SEQ ID NO: 2604342 - RNA, 19 nt, Human
ugugagaugcuagaacucc

SEQ ID NO: 2604343 - RNA, 23 nt, Human
ugugacucuuuuuagggccaggc

SEQ ID NO: 2604344 - RNA, 20 nt, Human
ugugacuauauagagauguu

SEQ ID NO: 2604345 - RNA, 15 nt, Human
ugugagagguuugac

SEQ ID NO: 2604346 - RNA, 16 nt, Human
ugugagagguuugacu

SEQ ID NO: 2604347 - RNA, 16 nt, Human
ugugacugaauuucuu

SEQ ID NO: 2604348 - RNA, 15 nt, Human
ugugacugaauuucu

SEQ ID NO: 2604349 - RNA, 15 nt, Human
agucucuaucauuaa

SEQ ID NO: 2604350 - RNA, 21 nt, Human
agucucaguuugugugucuua

SEQ ID NO: 2604351 - RNA, 20 nt, Human
agucucaguuugugugucuu

SEQ ID NO: 2604352 - RNA, 18 nt, Human
agucucaguuuguguguc

SEQ ID NO: 2604353 - RNA, 10 nt, Human
agucucaguu

SEQ ID NO: 2604354 - RNA, 19 nt, Human
agucucaguggcuucaucu

SEQ ID NO: 2604355 - RNA, 13 nt, Human
agucucaggagca

SEQ ID NO: 2604356 - RNA, 17 nt, Human
agucucaggagcauggg

SEQ ID NO: 2604357 - RNA, 14 nt, Human
agucucuucuccac

SEQ ID NO: 2604358 - RNA, 13 nt, Human
agucucuucucca

SEQ ID NO: 2604359 - RNA, 16 nt, Human
agucucugugcuuuga

SEQ ID NO: 2604360 - RNA, 20 nt, Human
agucucucucucucucuccc

SEQ ID NO: 2604361 - RNA, 19 nt, Human
agucucucucucucucucc

SEQ ID NO: 2604362 - RNA, 21 nt, Human
agucucuaucauuaaaguucu

SEQ ID NO: 2604363 - RNA, 20 nt, Human
agucucuaucauuaaaguuc

SEQ ID NO: 2604364 - RNA, 22 nt, Human
agucucucuggggccacacaga

SEQ ID NO: 2604365 - RNA, 19 nt, Human
agucucuaucauuaaaguu

SEQ ID NO: 2604366 - RNA, 18 nt, Human
agucucuaucauuaaagu

SEQ ID NO: 2604367 - RNA, 17 nt, Human
agucucuaucauuaaag

SEQ ID NO: 2604368 - RNA, 16 nt, Human
agucucuaucauuaaa

SEQ ID NO: 2604369 - RNA, 14 nt, Human
agucuuuguacaga

SEQ ID NO: 2604370 - RNA, 13 nt, Human
agugaaacugcuu

SEQ ID NO: 2604371 - RNA, 21 nt, Human
agugaaacugcuuguuuccua

SEQ ID NO: 2604372 - RNA, 24 nt, Human
agugaaacugcuuguuuccuagca

SEQ ID NO: 2604373 - RNA, 18 nt, Human
agucuuguauuaaguugu

SEQ ID NO: 2604374 - RNA, 16 nt, Human
agucuuguauuaaguu

SEQ ID NO: 2604375 - RNA, 17 nt, Human
agucuuggggcaggaug

SEQ ID NO: 2604376 - RNA, 22 nt, Human
agucuuggcggcagcagccauc

SEQ ID NO: 2604377 - RNA, 21 nt, Human
agucuuggcggcagcagccau

SEQ ID NO: 2604378 - RNA, 15 nt, Human
agucuuggcucacug

SEQ ID NO: 2604379 - RNA, 20 nt, Human
agucuuucuuagugccugug

SEQ ID NO: 2604380 - RNA, 16 nt, Human
agucuucacucucuga

SEQ ID NO: 2604381 - RNA, 17 nt, Human
agucuucacucucugaa

SEQ ID NO: 2604382 - RNA, 23 nt, Human
agucuucaagcagauuggagaaa

SEQ ID NO: 2604383 - RNA, 17 nt, Human
agucucuucuccacugg

SEQ ID NO: 2604384 - RNA, 16 nt, Human
agucuuaucaagcagc

SEQ ID NO: 2604385 - RNA, 15 nt, Human
agucuuaucaagcag

SEQ ID NO: 2604386 - RNA, 12 nt, Human
agucucuucaga

SEQ ID NO: 2604387 - RNA, 16 nt, Human
agucucuucuccacug

SEQ ID NO: 2604388 - RNA, 15 nt, Human
agucucuucuccacu

SEQ ID NO: 2604389 - RNA, 19 nt, Human
agucuucacucucugaaga

SEQ ID NO: 2604390 - RNA, 14 nt, Human
agucuuccaaacca

SEQ ID NO: 2604391 - RNA, 15 nt, Human
agucuuggcggcagc

SEQ ID NO: 2604392 - RNA, 21 nt, Human
agucuugcuaccucagucagu

SEQ ID NO: 2604393 - RNA, 16 nt, Human
agucuugcagcaggau

SEQ ID NO: 2604394 - RNA, 17 nt, Human
agucuugacgaguguga

SEQ ID NO: 2604395 - RNA, 17 nt, Human
agugaggcucugcccuu

SEQ ID NO: 2604396 - RNA, 16 nt, Human
agugaggcucugcccu

SEQ ID NO: 2604397 - RNA, 14 nt, Human
agugaggcucugcc

SEQ ID NO: 2604398 - RNA, 15 nt, Human
agugaggcucugccc

SEQ ID NO: 2604399 - RNA, 14 nt, Human
uguggccaaggagc

SEQ ID NO: 2604400 - RNA, 24 nt, Human
uguggccaaaggagggucaggaag

SEQ ID NO: 2604401 - RNA, 16 nt, Human
uguggccaaaggaggg

SEQ ID NO: 2604402 - RNA, 17 nt, Human
uguggcaucuuugccuu

SEQ ID NO: 2604403 - RNA, 21 nt, Human
uguggcaucuuugccuugggc

SEQ ID NO: 2604404 - RNA, 19 nt, Human
uguggccagggugagagcu

SEQ ID NO: 2604405 - RNA, 20 nt, Human
uguggccaaggagcugcuau

SEQ ID NO: 2604406 - RNA, 21 nt, Human
uguggccaaggagcugcuaua

SEQ ID NO: 2604407 - RNA, 15 nt, Human
uguggccaaggagcu

SEQ ID NO: 2604408 - RNA, 17 nt, Human
uguggccaaggagcugc

SEQ ID NO: 2604409 - RNA, 18 nt, Human
uguggccaaggagcugcu

SEQ ID NO: 2604410 - RNA, 19 nt, Human
uguggccaaggagcugcua

SEQ ID NO: 2604411 - RNA, 18 nt, Human
uguggccaaguucuuagu

SEQ ID NO: 2604412 - RNA, 20 nt, Human
agugaggcucugcccuuggu

SEQ ID NO: 2604413 - RNA, 19 nt, Human
agugaggcucugcccuugg

SEQ ID NO: 2604414 - RNA, 21 nt, Human
agugaggcucugcccuugguu

SEQ ID NO: 2604415 - RNA, 20 nt, Human
uguggccagggugagagcug

SEQ ID NO: 2604416 - RNA, 19 nt, Human
agugagggagggcugucau

SEQ ID NO: 2604417 - RNA, 14 nt, Human
agugagggauuauc

SEQ ID NO: 2604418 - RNA, 21 nt, Human
agugaguugauagcacagacc

SEQ ID NO: 2604419 - RNA, 15 nt, Human
agugagucgaggaca

SEQ ID NO: 2604420 - RNA, 16 nt, Human
agugagggucagagag

SEQ ID NO: 2604421 - RNA, 22 nt, Human
agugagggucagagaggaguca

SEQ ID NO: 2604422 - RNA, 17 nt, Human
agugaggguuucugagc

SEQ ID NO: 2604423 - RNA, 23 nt, Human
agugagggucagagaggagucag

SEQ ID NO: 2604424 - RNA, 21 nt, Human
agugaggguuucugagcugcu

SEQ ID NO: 2604425 - RNA, 20 nt, Human
agugaggguuucugagcugc

SEQ ID NO: 2604426 - RNA, 14 nt, Human
agugaggugcccag

SEQ ID NO: 2604427 - RNA, 24 nt, Human
agugagggguaaaagcugaucugg

SEQ ID NO: 2604428 - RNA, 22 nt, Human
agugagggguaaaagcugaucu

SEQ ID NO: 2604429 - RNA, 13 nt, Human
agugagggucaga

SEQ ID NO: 2604430 - RNA, 15 nt, Human
agugagggucagaga

SEQ ID NO: 2604431 - RNA, 18 nt, Human
agugaggggaaaccaggg

SEQ ID NO: 2604432 - RNA, 20 nt, Human
agugagggcuugucauuacc

SEQ ID NO: 2604433 - RNA, 12 nt, Human
agugagggccug

SEQ ID NO: 2604434 - RNA, 20 nt, Human
ugugcuggauggagcccagg

SEQ ID NO: 2604435 - RNA, 19 nt, Human
ugugcuggauggagcccag

SEQ ID NO: 2604436 - RNA, 15 nt, Human
ugugcuggaggacug

SEQ ID NO: 2604437 - RNA, 20 nt, Human
ugugcuggagccacuaacua

SEQ ID NO: 2604438 - RNA, 19 nt, Human
ugugcuggagccacuaacu

SEQ ID NO: 2604439 - RNA, 15 nt, Human
ugugcuggagccacu

SEQ ID NO: 2604440 - RNA, 14 nt, Human
ugugcuggagccac

SEQ ID NO: 2604441 - RNA, 13 nt, Human
ugugcuggagcca

SEQ ID NO: 2604442 - RNA, 17 nt, Human
ugugcugggagcuccac

SEQ ID NO: 2604443 - RNA, 12 nt, Human
ugugcugggagc

SEQ ID NO: 2604444 - RNA, 10 nt, Human
ugugcuggga

SEQ ID NO: 2604445 - RNA, 21 nt, Human
ugugcuggauggagcccaggc

SEQ ID NO: 2604446 - RNA, 18 nt, Human
ugugcuggagauguuuua

SEQ ID NO: 2604447 - RNA, 13 nt, Human
ugugcuggagaug

SEQ ID NO: 2604448 - RNA, 18 nt, Human
ugugcuggaauucuaaca

SEQ ID NO: 2604449 - RNA, 21 nt, Human
ugugcccccauguaagcaccc

SEQ ID NO: 2604450 - RNA, 19 nt, Human
ugugcccagcccggaccuu

SEQ ID NO: 2604451 - RNA, 19 nt, Human
ugugcccaugggcacugcu

SEQ ID NO: 2604452 - RNA, 18 nt, Human
ugugcccaugggcacugc

SEQ ID NO: 2604453 - RNA, 14 nt, Human
ugugcccaugggca

SEQ ID NO: 2604454 - RNA, 21 nt, Human
ugugcccaugggcacugcugg

SEQ ID NO: 2604455 - RNA, 20 nt, Human
ugugcccaugggcacugcug

SEQ ID NO: 2604456 - RNA, 14 nt, Human
ugugccccaugccu

SEQ ID NO: 2604457 - RNA, 22 nt, Human
ugugcccaugggcacugcuggg

SEQ ID NO: 2604458 - RNA, 23 nt, Human
ugugccccaugccuguccagccu

SEQ ID NO: 2604459 - RNA, 15 nt, Human
ugugccccaugccug

SEQ ID NO: 2604460 - RNA, 19 nt, Human
ugugccccaugccugucca

SEQ ID NO: 2604461 - RNA, 22 nt, Human
ugugcccccagacgcacguggg

SEQ ID NO: 2604462 - RNA, 16 nt, Human
ugugcccccagacgca

SEQ ID NO: 2604463 - RNA, 16 nt, Human
uguggcagugguuuug

SEQ ID NO: 2604464 - RNA, 15 nt, Human
uguggcagugguuuu

SEQ ID NO: 2604465 - RNA, 12 nt, Human
uguggcaguggu

SEQ ID NO: 2604466 - RNA, 11 nt, Human
uguggcagugg

SEQ ID NO: 2604467 - RNA, 23 nt, Human
uguggcaggcagcgccaagcaac

SEQ ID NO: 2604468 - RNA, 23 nt, Human
uguggcaguuuggcaaacucucc

SEQ ID NO: 2604469 - RNA, 21 nt, Human
uguggaguucaucuugaauug

SEQ ID NO: 2604470 - RNA, 14 nt, Human
uguggcaggcagcg

SEQ ID NO: 2604471 - RNA, 21 nt, Human
ugugcugggagcuccacucug

SEQ ID NO: 2604472 - RNA, 20 nt, Human
uguggaggaguccaggccau

SEQ ID NO: 2604473 - RNA, 20 nt, Human
uguggaggaaggauuguaaa

SEQ ID NO: 2604474 - RNA, 13 nt, Human
uguggagggcaca

SEQ ID NO: 2604475 - RNA, 21 nt, Human
uguggaggaaggauuguaaaa

SEQ ID NO: 2604476 - RNA, 21 nt, Human
uguggagguacacucuuauag

SEQ ID NO: 2604477 - RNA, 17 nt, Human
uguggaguucaucuuga

SEQ ID NO: 2604478 - RNA, 18 nt, Human
uguggaguggggcaguag

SEQ ID NO: 2604479 - RNA, 16 nt, Human
uguggaguggggcagu

SEQ ID NO: 2604480 - RNA, 12 nt, Human
uguggagugggg

SEQ ID NO: 2604481 - RNA, 19 nt, Human
uguggagggcacauuccuu

SEQ ID NO: 2604482 - RNA, 15 nt, Human
agugaaagaaaauaa

SEQ ID NO: 2604483 - RNA, 16 nt, Human
agugaaagcuagagau

SEQ ID NO: 2604484 - RNA, 16 nt, Human
agugaacaaauuuaca

SEQ ID NO: 2604485 - RNA, 20 nt, Human
agugaacaaauuuacagaga

SEQ ID NO: 2604486 - RNA, 20 nt, Human
ugugaucuaucaauagucaa

SEQ ID NO: 2604487 - RNA, 20 nt, Human
ugugaucaggcuauguaugg

SEQ ID NO: 2604488 - RNA, 21 nt, Human
ugugauccuuuuauguuauuu

SEQ ID NO: 2604489 - RNA, 17 nt, Human
ugugauccuuuuauguu

SEQ ID NO: 2604490 - RNA, 13 nt, Human
ugugaucgucuga

SEQ ID NO: 2604491 - RNA, 18 nt, Human
ugugaucccaagugccag

SEQ ID NO: 2604492 - RNA, 23 nt, Human
ugugaucccaagugccagucuug

SEQ ID NO: 2604493 - RNA, 20 nt, Human
ugugauggggcccugccucc

SEQ ID NO: 2604494 - RNA, 19 nt, Human
ugugauggggcccugccuc

SEQ ID NO: 2604495 - RNA, 18 nt, Human
ugugauggggcccugccu

SEQ ID NO: 2604496 - RNA, 16 nt, Human
ugugaugaauacugua

SEQ ID NO: 2604497 - RNA, 18 nt, Human
ugugaugaauacuguauu

SEQ ID NO: 2604498 - RNA, 14 nt, Human
ugugaugaauacug

SEQ ID NO: 2604499 - RNA, 15 nt, Human
ugugaugaacuuucu

SEQ ID NO: 2604500 - RNA, 22 nt, Human
ugugauuucccguggccccagc

SEQ ID NO: 2604501 - RNA, 20 nt, Human
ugugauuucccguggcccca

SEQ ID NO: 2604502 - RNA, 19 nt, Human
ugugauuucccguggcccc

SEQ ID NO: 2604503 - RNA, 15 nt, Human
ugugauuucccgugg

SEQ ID NO: 2604504 - RNA, 23 nt, Human
ugugauuuagaacuguaugucag

SEQ ID NO: 2604505 - RNA, 18 nt, Human
ugugauuuagaacuguau

SEQ ID NO: 2604506 - RNA, 17 nt, Human
ugugauuuagaacugua

SEQ ID NO: 2604507 - RNA, 22 nt, Human
ugugauuuaauaguguuaauca

SEQ ID NO: 2604508 - RNA, 20 nt, Human
ugugauuuaauaguguuaau

SEQ ID NO: 2604509 - RNA, 19 nt, Human
ugugauuuaauaguguuaa

SEQ ID NO: 2604510 - RNA, 17 nt, Human
ugugauuuaauaguguu

SEQ ID NO: 2604511 - RNA, 16 nt, Human
ugugauuuaauagugu

SEQ ID NO: 2604512 - RNA, 15 nt, Human
ugugauuuaauagug

SEQ ID NO: 2604513 - RNA, 23 nt, Human
ugugaugguucguucuguuuaca

SEQ ID NO: 2604514 - RNA, 17 nt, Human
ugugauuguggaaugga

SEQ ID NO: 2604515 - RNA, 18 nt, Human
ugugaugacaacuggaau

SEQ ID NO: 2604516 - RNA, 14 nt, Human
ugugauguauucua

SEQ ID NO: 2604517 - RNA, 22 nt, Human
ugugaugguucguucuguuuac

SEQ ID NO: 2604518 - RNA, 19 nt, Human
ugugaugguucguucuguu

SEQ ID NO: 2604519 - RNA, 16 nt, Human
ugugauguauucuagc

SEQ ID NO: 2604520 - RNA, 20 nt, Human
ugugauugggaauaaauaug

SEQ ID NO: 2604521 - RNA, 14 nt, Human
ugugauuguggaau

SEQ ID NO: 2604522 - RNA, 14 nt, Human
ugugauugugccua

SEQ ID NO: 2604523 - RNA, 23 nt, Human
ugugccacucaccgaagccacuu

SEQ ID NO: 2604524 - RNA, 22 nt, Human
ugugccacccugggcucugugg

SEQ ID NO: 2604525 - RNA, 21 nt, Human
ugugccacccugggcucugug

SEQ ID NO: 2604526 - RNA, 17 nt, Human
ugugccacccugggcuc

SEQ ID NO: 2604527 - RNA, 16 nt, Human
ugugccacccugggcu

SEQ ID NO: 2604528 - RNA, 15 nt, Human
ugugccacccugggc

SEQ ID NO: 2604529 - RNA, 14 nt, Human
ugugccacccuggg

SEQ ID NO: 2604530 - RNA, 12 nt, Human
ugugccacccug

SEQ ID NO: 2604531 - RNA, 18 nt, Human
ugugccagauuuaugcau

SEQ ID NO: 2604532 - RNA, 18 nt, Human
ugugccaauauguauugu

SEQ ID NO: 2604533 - RNA, 16 nt, Human
ugugccacccaccagg

SEQ ID NO: 2604534 - RNA, 20 nt, Human
ugugccacccaccagggcga

SEQ ID NO: 2604535 - RNA, 17 nt, Human
ugugccaauauguauug

SEQ ID NO: 2604536 - RNA, 21 nt, Human
ugugcauuuuugugaaaugaa

SEQ ID NO: 2604537 - RNA, 16 nt, Human
ugugccaauauguauu

SEQ ID NO: 2604538 - RNA, 22 nt, Human
ugugcauuuuugugaaaugaaa

SEQ ID NO: 2604539 - RNA, 15 nt, Human
ugugauuugacuguu

SEQ ID NO: 2604540 - RNA, 14 nt, Human
ugugauuugacugu

SEQ ID NO: 2604541 - RNA, 13 nt, Human
ugugauuugacug

SEQ ID NO: 2604542 - RNA, 12 nt, Human
ugugauuugacu

SEQ ID NO: 2604543 - RNA, 23 nt, Human
ugugauuuccuacuaaccuguuc

SEQ ID NO: 2604544 - RNA, 24 nt, Human
ugugauuucccguggccccagccu

SEQ ID NO: 2604545 - RNA, 23 nt, Human
ugugauuucccguggccccagcc

SEQ ID NO: 2604546 - RNA, 23 nt, Human
ugugauuugacuguuuuuaccca

SEQ ID NO: 2604547 - RNA, 23 nt, Human
ugugcauuuggugguuucagaaa

SEQ ID NO: 2604548 - RNA, 22 nt, Human
ugugauuugacuguuuuuaccc

SEQ ID NO: 2604549 - RNA, 17 nt, Human
ugugauuugacuguuuu

SEQ ID NO: 2604550 - RNA, 22 nt, Human
ugugccauagaguuuaacacaa

SEQ ID NO: 2604551 - RNA, 21 nt, Human
ugugccauagucacauggccu

SEQ ID NO: 2604552 - RNA, 18 nt, Human
ugugccauagucacaugg

SEQ ID NO: 2604553 - RNA, 16 nt, Human
ugugccauagucacau

SEQ ID NO: 2604554 - RNA, 18 nt, Human
ugugccagggcaaugaug

SEQ ID NO: 2604555 - RNA, 21 nt, Human
ugugccagggcaaugaugaau

SEQ ID NO: 2604556 - RNA, 21 nt, Human
ugugccauagaguuuaacaca

SEQ ID NO: 2604557 - RNA, 20 nt, Human
ugugccauagaguuuaacac

SEQ ID NO: 2604558 - RNA, 18 nt, Human
ugugccauagaguuuaac

SEQ ID NO: 2604559 - RNA, 20 nt, Human
ugugccagauuuaugcauau

SEQ ID NO: 2604560 - RNA, 20 nt, Human
ugugccagguuuuuggucug

SEQ ID NO: 2604561 - RNA, 16 nt, Human
ugugccaugugccagg

SEQ ID NO: 2604562 - RNA, 12 nt, Human
ugugccaugugc

SEQ ID NO: 2604563 - RNA, 14 nt, Human
ugugcccacccucc

SEQ ID NO: 2604564 - RNA, 23 nt, Human
ugugcccacccuccacucuccuc

SEQ ID NO: 2604565 - RNA, 21 nt, Human
ugugcccacaucccaggcuuc

SEQ ID NO: 2604566 - RNA, 20 nt, Human
ugugcccacaucccaggcuu

SEQ ID NO: 2604567 - RNA, 17 nt, Human
ugugcccacaucccagg

SEQ ID NO: 2604568 - RNA, 22 nt, Human
ugugccauuuuaaaaaaaaagg

SEQ ID NO: 2604569 - RNA, 12 nt, Human
ugugcccaaguu

SEQ ID NO: 2604570 - RNA, 17 nt, Human
auauugcacaugucuua

SEQ ID NO: 2604571 - RNA, 16 nt, Human
auauugcacaugucuu

SEQ ID NO: 2604572 - RNA, 15 nt, Human
auauugcacaugucu

SEQ ID NO: 2604573 - RNA, 13 nt, Human
auauugcacaugu

SEQ ID NO: 2604574 - RNA, 22 nt, Human
auauugauuucugccuuccuug

SEQ ID NO: 2604575 - RNA, 16 nt, Human
auauugauuucugccu

SEQ ID NO: 2604576 - RNA, 21 nt, Human
auauugcacaugucuuaauga

SEQ ID NO: 2604577 - RNA, 20 nt, Human
auauugcacaugucuuaaug

SEQ ID NO: 2604578 - RNA, 19 nt, Human
auauugcacaugucuuaau

SEQ ID NO: 2604579 - RNA, 16 nt, Human
auauugccgcacuagg

SEQ ID NO: 2604580 - RNA, 16 nt, Human
auauugcauaugcaua

SEQ ID NO: 2604581 - RNA, 21 nt, Human
auauugcugauggugcaauga

SEQ ID NO: 2604582 - RNA, 17 nt, Human
auauugcugauggugca

SEQ ID NO: 2604583 - RNA, 18 nt, Human
auauuguguugugaaugu

SEQ ID NO: 2604584 - RNA, 13 nt, Human
auauuguguuugu

SEQ ID NO: 2604585 - RNA, 17 nt, Human
auauuguguugugaaug

SEQ ID NO: 2604586 - RNA, 22 nt, Human
auauugcugagagaaauaugga

SEQ ID NO: 2604587 - RNA, 20 nt, Human
auauuguuuucaguguacau

SEQ ID NO: 2604588 - RNA, 17 nt, Human
auauuguguuuguguau

SEQ ID NO: 2604589 - RNA, 21 nt, Human
auauuguguuuguguauuuac

SEQ ID NO: 2604590 - RNA, 20 nt, Human
auauuguuauuauauaauua

SEQ ID NO: 2604591 - RNA, 13 nt, Human
auauuugaaauau

SEQ ID NO: 2604592 - RNA, 15 nt, Human
auauuucugauauaa

SEQ ID NO: 2604593 - RNA, 18 nt, Human
auauuuaaacagcagugu

SEQ ID NO: 2604594 - RNA, 14 nt, Human
auauuuaaacagca

SEQ ID NO: 2604595 - RNA, 12 nt, Human
auauuuaaacag

SEQ ID NO: 2604596 - RNA, 15 nt, Human
auauuuaaaagaaag

SEQ ID NO: 2604597 - RNA, 14 nt, Human
auauuuaaagacag

SEQ ID NO: 2604598 - RNA, 21 nt, Human
auauuuaaacaugguuacaau

SEQ ID NO: 2604599 - RNA, 23 nt, Human
auauuuaaacaugguuacaauca

SEQ ID NO: 2604600 - RNA, 22 nt, Human
auauuuaaaggcccuaucuguu

SEQ ID NO: 2604601 - RNA, 15 nt, Human
auauuucgaaagcug

SEQ ID NO: 2604602 - RNA, 12 nt, Human
auauuuuaacuu

SEQ ID NO: 2604603 - RNA, 16 nt, Human
auauuuuaaaaugaga

SEQ ID NO: 2604604 - RNA, 14 nt, Human
auauuuuaaaauga

SEQ ID NO: 2604605 - RNA, 15 nt, Human
auauuuguuauguag

SEQ ID NO: 2604606 - RNA, 13 nt, Human
auauuuguuaaau

SEQ ID NO: 2604607 - RNA, 21 nt, Human
auauuuguuaaauauuuacau

SEQ ID NO: 2604608 - RNA, 22 nt, Human
auauuuguuaaauauuuacaua

SEQ ID NO: 2604609 - RNA, 22 nt, Human
auauuuguaucacaaaucuuaa

SEQ ID NO: 2604610 - RNA, 18 nt, Human
auauuuguauaguugcuu

SEQ ID NO: 2604611 - RNA, 12 nt, Human
auauuuguagaa

SEQ ID NO: 2604612 - RNA, 20 nt, Human
auauuugugauagcacuuuc

SEQ ID NO: 2604613 - RNA, 21 nt, Human
auauuugugauagcacuuucu

SEQ ID NO: 2604614 - RNA, 22 nt, Human
auauuugugauagcacuuucua

SEQ ID NO: 2604615 - RNA, 17 nt, Human
auauuuguguauuuaac

SEQ ID NO: 2604616 - RNA, 14 nt, Human
auauuuguggaaua

SEQ ID NO: 2604617 - RNA, 19 nt, Human
auauuugaaauauugacuu

SEQ ID NO: 2604618 - RNA, 14 nt, Human
auauuugaaauauu

SEQ ID NO: 2604619 - RNA, 23 nt, Human
auauuugaaauauugacuuuuua

SEQ ID NO: 2604620 - RNA, 14 nt, Human
auauuugaaucuug

SEQ ID NO: 2604621 - RNA, 13 nt, Human
auauuugaaucuu

SEQ ID NO: 2604622 - RNA, 11 nt, Human
auauuugaauc

SEQ ID NO: 2604623 - RNA, 14 nt, Human
auauuuguacaaaa

SEQ ID NO: 2604624 - RNA, 13 nt, Human
auauuuguacaaa

SEQ ID NO: 2604625 - RNA, 11 nt, Human
auauuuguaca

SEQ ID NO: 2604626 - RNA, 13 nt, Human
auauuuguacaua

SEQ ID NO: 2604627 - RNA, 12 nt, Human
auauuuguacau

SEQ ID NO: 2604628 - RNA, 20 nt, Human
auauuuguaaauuuauguga

SEQ ID NO: 2604629 - RNA, 15 nt, Human
auauuugaaucuugu

SEQ ID NO: 2604630 - RNA, 14 nt, Human
auauuaaugccuuu

SEQ ID NO: 2604631 - RNA, 14 nt, Human
auauuaauauuccu

SEQ ID NO: 2604632 - RNA, 15 nt, Human
auauuaaugccuuua

SEQ ID NO: 2604633 - RNA, 19 nt, Human
auauuaauauauaucugcu

SEQ ID NO: 2604634 - RNA, 21 nt, Human
auauucauuguauaaaaauag

SEQ ID NO: 2604635 - RNA, 23 nt, Human
auauucauuguauaaaaauagaa

SEQ ID NO: 2604636 - RNA, 24 nt, Human
auauuaagaaagacuaucuaaaug

SEQ ID NO: 2604637 - RNA, 22 nt, Human
auauuaaggaagacaaugugaa

SEQ ID NO: 2604638 - RNA, 12 nt, Human
auauuaaaucug

SEQ ID NO: 2604639 - RNA, 13 nt, Human
auauuaaaucugc

SEQ ID NO: 2604640 - RNA, 17 nt, Human
auauuaaauacagacac

SEQ ID NO: 2604641 - RNA, 13 nt, Human
auauuaaauacag

SEQ ID NO: 2604642 - RNA, 12 nt, Human
auauuaaauaca

SEQ ID NO: 2604643 - RNA, 14 nt, Human
auauuaaaggaguu

SEQ ID NO: 2604644 - RNA, 20 nt, Human
auauuaaauacagacacuaa

SEQ ID NO: 2604645 - RNA, 19 nt, Human
auauuaaauacagacacua

SEQ ID NO: 2604646 - RNA, 23 nt, Human
auauuaaauauguuagcaaagag

SEQ ID NO: 2604647 - RNA, 14 nt, Human
uucauguuugcuuc

SEQ ID NO: 2604648 - RNA, 15 nt, Human
uucauguuuuaacaa

SEQ ID NO: 2604649 - RNA, 17 nt, Human
uucauguuuuaacaaaa

SEQ ID NO: 2604650 - RNA, 18 nt, Human
uucauguuuugugacuau

SEQ ID NO: 2604651 - RNA, 17 nt, Human
uucauguuuugugacua

SEQ ID NO: 2604652 - RNA, 16 nt, Human
uucauguuuugugacu

SEQ ID NO: 2604653 - RNA, 18 nt, Human
uucauguuuuaacaaaaa

SEQ ID NO: 2604654 - RNA, 22 nt, Human
uucauguugcacacccacucag

SEQ ID NO: 2604655 - RNA, 12 nt, Human
uucauguuucuu

SEQ ID NO: 2604656 - RNA, 13 nt, Human
uucauguuucuua

SEQ ID NO: 2604657 - RNA, 18 nt, Human
auauguuuuaagaggcag

SEQ ID NO: 2604658 - RNA, 17 nt, Human
auauguuuuuuagauca

SEQ ID NO: 2604659 - RNA, 14 nt, Human
auauguuuuuuaga

SEQ ID NO: 2604660 - RNA, 21 nt, Human
auauguuuugugggaacagau

SEQ ID NO: 2604661 - RNA, 20 nt, Human
auauguuuuaagaggcaggg

SEQ ID NO: 2604662 - RNA, 22 nt, Human
auauugauccagaaagaaaacu

SEQ ID NO: 2604663 - RNA, 15 nt, Human
auauugauccagaaa

SEQ ID NO: 2604664 - RNA, 16 nt, Human
auauugaaaaaauaga

SEQ ID NO: 2604665 - RNA, 23 nt, Human
auauucuuauguaugugaaaguu

SEQ ID NO: 2604666 - RNA, 21 nt, Human
auauugauuuccguuaaaaua

SEQ ID NO: 2604667 - RNA, 22 nt, Human
auauugauuuccguuaaaauac

SEQ ID NO: 2604668 - RNA, 19 nt, Human
auauugauuuccguuaaaa

SEQ ID NO: 2604669 - RNA, 13 nt, Human
auauugaugugug

SEQ ID NO: 2604670 - RNA, 21 nt, Human
auauugaauauaauauauuug

SEQ ID NO: 2604671 - RNA, 18 nt, Human
auauugaauauaauauau

SEQ ID NO: 2604672 - RNA, 15 nt, Human
auauuccugaaugaa

SEQ ID NO: 2604673 - RNA, 17 nt, Human
auauuccugaaugaaau

SEQ ID NO: 2604674 - RNA, 18 nt, Human
auauuccugaaugaaaua

SEQ ID NO: 2604675 - RNA, 22 nt, Human
auauuccugaaugaaauaucag

SEQ ID NO: 2604676 - RNA, 23 nt, Human
auauuccugaaugaaauaucaga

SEQ ID NO: 2604677 - RNA, 17 nt, Human
auauucccuagaaacuu

SEQ ID NO: 2604678 - RNA, 23 nt, Human
auauucccuagaaacuuccaaau

SEQ ID NO: 2604679 - RNA, 15 nt, Human
auauuccaugaaugu

SEQ ID NO: 2604680 - RNA, 16 nt, Human
auauuccaugaaugua

SEQ ID NO: 2604681 - RNA, 19 nt, Human
auauuccaugaauguauca

SEQ ID NO: 2604682 - RNA, 18 nt, Human
auauuccccuaucucuag

SEQ ID NO: 2604683 - RNA, 13 nt, Human
auauucauuucaa

SEQ ID NO: 2604684 - RNA, 13 nt, Human
auauucauuugga

SEQ ID NO: 2604685 - RNA, 15 nt, Human
auauucauuuggaaa

SEQ ID NO: 2604686 - RNA, 18 nt, Human
auauuccauauauuagca

SEQ ID NO: 2604687 - RNA, 21 nt, Human
auauuccugcagccuggaggc

SEQ ID NO: 2604688 - RNA, 22 nt, Human
auauucucacgggcaguagcug

SEQ ID NO: 2604689 - RNA, 16 nt, Human
auauucuguuggccag

SEQ ID NO: 2604690 - RNA, 14 nt, Human
auauucuuauguau

SEQ ID NO: 2604691 - RNA, 21 nt, Human
aucacaacgugcauugugcuu

SEQ ID NO: 2604692 - RNA, 18 nt, Human
aucacaacgugcauugug

SEQ ID NO: 2604693 - RNA, 17 nt, Human
aucacaacgugcauugu

SEQ ID NO: 2604694 - RNA, 15 nt, Human
aucacaacgugcauu

SEQ ID NO: 2604695 - RNA, 17 nt, Human
aucacaacacuggcuga

SEQ ID NO: 2604696 - RNA, 16 nt, Human
aucacaacaagaaauu

SEQ ID NO: 2604697 - RNA, 19 nt, Human
aucaaucaucugugugaaa

SEQ ID NO: 2604698 - RNA, 20 nt, Human
aucaaucacagcuuguauuu

SEQ ID NO: 2604699 - RNA, 14 nt, Human
aucaaucacagcuu

SEQ ID NO: 2604700 - RNA, 20 nt, Human
aucaaucaucugugugaaaa

SEQ ID NO: 2604701 - RNA, 22 nt, Human
aucacaacgugcauugugcuuc

SEQ ID NO: 2604702 - RNA, 22 nt, Human
aucacggcucacugcagccuca

SEQ ID NO: 2604703 - RNA, 13 nt, Human
aucacuacugcag

SEQ ID NO: 2604704 - RNA, 22 nt, Human
aucacggucgccaccuggcauu

SEQ ID NO: 2604705 - RNA, 14 nt, Human
aucacuacugcagu

SEQ ID NO: 2604706 - RNA, 20 nt, Human
aucacuaauacuaauucauu

SEQ ID NO: 2604707 - RNA, 21 nt, Human
aucacguaaagcuagaaauga

SEQ ID NO: 2604708 - RNA, 14 nt, Human
aucacguaaagcua

SEQ ID NO: 2604709 - RNA, 18 nt, Human
uuccuuuguguuucuauu

SEQ ID NO: 2604710 - RNA, 20 nt, Human
uuccuuuuaaaacacuucca

SEQ ID NO: 2604711 - RNA, 22 nt, Human
uuccuuuuaaaacacuuccaua

SEQ ID NO: 2604712 - RNA, 21 nt, Human
uuccuuuuaaaacacuuccau

SEQ ID NO: 2604713 - RNA, 12 nt, Human
uuccuuuuaauu

SEQ ID NO: 2604714 - RNA, 21 nt, Human
uuccuuuguuuuuuuuuccug

SEQ ID NO: 2604715 - RNA, 20 nt, Human
uuccuuuuagccuaguucau

SEQ ID NO: 2604716 - RNA, 15 nt, Human
uuccuuuucccugcu

SEQ ID NO: 2604717 - RNA, 14 nt, Human
uuccuuuucccugc

SEQ ID NO: 2604718 - RNA, 12 nt, Human
uuccuuuuauca

SEQ ID NO: 2604719 - RNA, 22 nt, Human
aucacugguugcacuuaugauu

SEQ ID NO: 2604720 - RNA, 12 nt, Human
aucacugucuuu

SEQ ID NO: 2604721 - RNA, 14 nt, Human
aucacugucuuucc

SEQ ID NO: 2604722 - RNA, 15 nt, Human
aucacugucuuuccu

SEQ ID NO: 2604723 - RNA, 16 nt, Human
aucacugucuuuccua

SEQ ID NO: 2604724 - RNA, 18 nt, Human
aucacugucuuuccuaga

SEQ ID NO: 2604725 - RNA, 19 nt, Human
aucacugucuuuccuagau

SEQ ID NO: 2604726 - RNA, 22 nt, Human
aucacuggcaaugaaaaauucu

SEQ ID NO: 2604727 - RNA, 23 nt, Human
aucacuggcaaugaaaaauucuc

SEQ ID NO: 2604728 - RNA, 16 nt, Human
aucacuggcaaugaaa

SEQ ID NO: 2604729 - RNA, 18 nt, Human
aucacuggcaaugaaaaa

SEQ ID NO: 2604730 - RNA, 21 nt, Human
aucacugucuuuccuagaugg

SEQ ID NO: 2604731 - RNA, 15 nt, Human
uuccuuuggagcuuu

SEQ ID NO: 2604732 - RNA, 14 nt, Human
aucaaguauuauac

SEQ ID NO: 2604733 - RNA, 18 nt, Human
aucaaguauuauaccuuu

SEQ ID NO: 2604734 - RNA, 13 nt, Human
aucaaguauuaua

SEQ ID NO: 2604735 - RNA, 18 nt, Human
aucaagaugucagacugg

SEQ ID NO: 2604736 - RNA, 17 nt, Human
aucaauacacuaguugu

SEQ ID NO: 2604737 - RNA, 12 nt, Human
aucaauacacua

SEQ ID NO: 2604738 - RNA, 21 nt, Human
aucaauaauauauuuucuguu

SEQ ID NO: 2604739 - RNA, 20 nt, Human
aucaauaauauauuuucugu

SEQ ID NO: 2604740 - RNA, 18 nt, Human
aucaauaauauauuuucu

SEQ ID NO: 2604741 - RNA, 16 nt, Human
aucaauaauauauuuu

SEQ ID NO: 2604742 - RNA, 19 nt, Human
aucaauacacuaguuguuu

SEQ ID NO: 2604743 - RNA, 22 nt, Human
aucaauauugucauuccuguau

SEQ ID NO: 2604744 - RNA, 13 nt, Human
aucaaucaacuua

SEQ ID NO: 2604745 - RNA, 20 nt, Human
aucaauauugucauuccugu

SEQ ID NO: 2604746 - RNA, 18 nt, Human
aucaauauugucauuccu

SEQ ID NO: 2604747 - RNA, 13 nt, Human
aucaaucaaaccc

SEQ ID NO: 2604748 - RNA, 12 nt, Human
aucaagaaaguc

SEQ ID NO: 2604749 - RNA, 14 nt, Human
auauuuuguauaua

SEQ ID NO: 2604750 - RNA, 13 nt, Human
auauuuuguauau

SEQ ID NO: 2604751 - RNA, 21 nt, Human
auauuuuguauauaucugcuu

SEQ ID NO: 2604752 - RNA, 23 nt, Human
aucaagaauggggaucacagaga

SEQ ID NO: 2604753 - RNA, 15 nt, Human
aucaagaaaguguug

SEQ ID NO: 2604754 - RNA, 15 nt, Human
aucaagacuggaagg

SEQ ID NO: 2604755 - RNA, 17 nt, Human
aucaagagcugcccucc

SEQ ID NO: 2604756 - RNA, 16 nt, Human
aucaagagcugcccuc

SEQ ID NO: 2604757 - RNA, 15 nt, Human
aucaagagcugcccu

SEQ ID NO: 2604758 - RNA, 22 nt, Human
aucaagaugagagaacuggagg

SEQ ID NO: 2604759 - RNA, 20 nt, Human
aucaagagcugcccuccuug

SEQ ID NO: 2604760 - RNA, 19 nt, Human
aucaagagcugcccuccuu

SEQ ID NO: 2604761 - RNA, 19 nt, Human
auauuuugggaaucuuuuc

SEQ ID NO: 2604762 - RNA, 21 nt, Human
auauuuugcacaguuagcaaa

SEQ ID NO: 2604763 - RNA, 19 nt, Human
auauuuugauuauuguauu

SEQ ID NO: 2604764 - RNA, 17 nt, Human
auauuuugauuauugua

SEQ ID NO: 2604765 - RNA, 13 nt, Human
auauuuugauuau

SEQ ID NO: 2604766 - RNA, 14 nt, Human
auauuuugaaucaa

SEQ ID NO: 2604767 - RNA, 19 nt, Human
auauuuugaaucaauaaua

SEQ ID NO: 2604768 - RNA, 13 nt, Human
auauuuugaauca

SEQ ID NO: 2604769 - RNA, 12 nt, Human
auauuuugaauc

SEQ ID NO: 2604770 - RNA, 21 nt, Human
auauuuucuuuaaaagacaaa

SEQ ID NO: 2604771 - RNA, 18 nt, Human
auauuuucuuuaaugcuu

SEQ ID NO: 2604772 - RNA, 21 nt, Human
uuccugguacccagccaucug

SEQ ID NO: 2604773 - RNA, 19 nt, Human
uuccugguacccagccauc

SEQ ID NO: 2604774 - RNA, 14 nt, Human
uuccuggucuguag

SEQ ID NO: 2604775 - RNA, 18 nt, Human
uuccugguacccagccau

SEQ ID NO: 2604776 - RNA, 17 nt, Human
uuccugguacccagcca

SEQ ID NO: 2604777 - RNA, 16 nt, Human
uuccugguacccagcc

SEQ ID NO: 2604778 - RNA, 19 nt, Human
uuccuggugccaauuucaa

SEQ ID NO: 2604779 - RNA, 20 nt, Human
uuccuggugccaauuucaag

SEQ ID NO: 2604780 - RNA, 21 nt, Human
uuccuguguguccaaaacugc

SEQ ID NO: 2604781 - RNA, 23 nt, Human
uuccuguuagguauuagaaagug

SEQ ID NO: 2604782 - RNA, 22 nt, Human
uuccuguguguccaaaacugcc

SEQ ID NO: 2604783 - RNA, 17 nt, Human
uuccuguucccaugaga

SEQ ID NO: 2604784 - RNA, 11 nt, Human
uuccucuuucc

SEQ ID NO: 2604785 - RNA, 15 nt, Human
uuccugguacccagc

SEQ ID NO: 2604786 - RNA, 15 nt, Human
uuccuucagggugau

SEQ ID NO: 2604787 - RNA, 14 nt, Human
uuccuucaggguga

SEQ ID NO: 2604788 - RNA, 24 nt, Human
auauuuucaaauuguaucuagugc

SEQ ID NO: 2604789 - RNA, 20 nt, Human
auauuuucaacgcagcccug

SEQ ID NO: 2604790 - RNA, 19 nt, Human
auauuuucaacgcagcccu

SEQ ID NO: 2604791 - RNA, 23 nt, Human
auauuuucaugacuuuuccaugu

SEQ ID NO: 2604792 - RNA, 22 nt, Human
uuccuucagggugaugccaggu

SEQ ID NO: 2604793 - RNA, 21 nt, Human
auauuuucaccauuugauuau

SEQ ID NO: 2604794 - RNA, 22 nt, Human
uuccuucagugcaucugggaag

SEQ ID NO: 2604795 - RNA, 14 nt, Human
uuccuucagugccu

SEQ ID NO: 2604796 - RNA, 11 nt, Human
uuccuucagug

SEQ ID NO: 2604797 - RNA, 20 nt, Human
uuccuguuggauuuguuuaa

SEQ ID NO: 2604798 - RNA, 19 nt, Human
uuccuguuggauuuguuua

SEQ ID NO: 2604799 - RNA, 15 nt, Human
uuccuucagcuucca

SEQ ID NO: 2604800 - RNA, 13 nt, Human
uuccuguucugaa

SEQ ID NO: 2604801 - RNA, 15 nt, Human
uuccuguucugaacu

SEQ ID NO: 2604802 - RNA, 20 nt, Human
uuccuguucuuaagacguga

SEQ ID NO: 2604803 - RNA, 14 nt, Human
auauuuuaagacga

SEQ ID NO: 2604804 - RNA, 12 nt, Human
auauuuuaaaua

SEQ ID NO: 2604805 - RNA, 14 nt, Human
auauuuuauaauuu

SEQ ID NO: 2604806 - RNA, 15 nt, Human
auauuuuaugugaga

SEQ ID NO: 2604807 - RNA, 15 nt, Human
uuccuaauccucuag

SEQ ID NO: 2604808 - RNA, 13 nt, Human
uuccuaauccucu

SEQ ID NO: 2604809 - RNA, 15 nt, Human
auauuuuauuauaua

SEQ ID NO: 2604810 - RNA, 20 nt, Human
auauuuuaugugagagaaag

SEQ ID NO: 2604811 - RNA, 17 nt, Human
auauuuucaaauuguau

SEQ ID NO: 2604812 - RNA, 13 nt, Human
uuccuaagugauu

SEQ ID NO: 2604813 - RNA, 16 nt, Human
uuccuaauaaaguucu

SEQ ID NO: 2604814 - RNA, 19 nt, Human
uuccuaauaaaguucugua

SEQ ID NO: 2604815 - RNA, 15 nt, Human
uuccuaauaaaguuc

SEQ ID NO: 2604816 - RNA, 11 nt, Human
uuccuccuggg

SEQ ID NO: 2604817 - RNA, 14 nt, Human
uuccuccugggccc

SEQ ID NO: 2604818 - RNA, 15 nt, Human
uuccuccugggcccu

SEQ ID NO: 2604819 - RNA, 21 nt, Human
uuccuccugggcccucucugc

SEQ ID NO: 2604820 - RNA, 14 nt, Human
uuccuccuggaaau

SEQ ID NO: 2604821 - RNA, 22 nt, Human
uuccuaauaaaguucuguacuc

SEQ ID NO: 2604822 - RNA, 13 nt, Human
uuccuccugugua

SEQ ID NO: 2604823 - RNA, 14 nt, Human
uuccuccuggcaga

SEQ ID NO: 2604824 - RNA, 23 nt, Human
uuccuccugggcccucucugcuc

SEQ ID NO: 2604825 - RNA, 17 nt, Human
uuccuccuguguacagg

SEQ ID NO: 2604826 - RNA, 18 nt, Human
uuccucgcagagaggcca

SEQ ID NO: 2604827 - RNA, 15 nt, Human
uuccuccuuccaugg

SEQ ID NO: 2604828 - RNA, 14 nt, Human
uuccucgcccuggg

SEQ ID NO: 2604829 - RNA, 15 nt, Human
uuccucuagaagcca

SEQ ID NO: 2604830 - RNA, 19 nt, Human
uuccucuagugcccuccac

SEQ ID NO: 2604831 - RNA, 21 nt, Human
uuccucuguuucuccuucuga

SEQ ID NO: 2604832 - RNA, 12 nt, Human
uuccucugggaa

SEQ ID NO: 2604833 - RNA, 19 nt, Human
uuccucuuccccuugcccu

SEQ ID NO: 2604834 - RNA, 18 nt, Human
uuccucuuccccuugccc

SEQ ID NO: 2604835 - RNA, 20 nt, Human
uuccucuucuauuuuguaaa

SEQ ID NO: 2604836 - RNA, 13 nt, Human
uuccucuucccca

SEQ ID NO: 2604837 - RNA, 16 nt, Human
uuccucuuccccuugc

SEQ ID NO: 2604838 - RNA, 17 nt, Human
uuccucuaguucuuugu

SEQ ID NO: 2604839 - RNA, 17 nt, Human
uuccucuauugauguac

SEQ ID NO: 2604840 - RNA, 17 nt, Human
uuccucuagaagccaag

SEQ ID NO: 2604841 - RNA, 23 nt, Human
uuccucuagugcccuccacagcc

SEQ ID NO: 2604842 - RNA, 13 nt, Human
aucauuugcuuuu

SEQ ID NO: 2604843 - RNA, 18 nt, Human
aucauuuguuggaaugaa

SEQ ID NO: 2604844 - RNA, 19 nt, Human
aucauuuguucaaagcugu

SEQ ID NO: 2604845 - RNA, 18 nt, Human
aucauuugcccuuaagga

SEQ ID NO: 2604846 - RNA, 15 nt, Human
aucauuugcccuuaa

SEQ ID NO: 2604847 - RNA, 12 nt, Human
aucauuuguuca

SEQ ID NO: 2604848 - RNA, 17 nt, Human
aucauuugaacaacuag

SEQ ID NO: 2604849 - RNA, 18 nt, Human
uucuguacucaaauguag

SEQ ID NO: 2604850 - RNA, 20 nt, Human
uucuguacugauuuuuguaa

SEQ ID NO: 2604851 - RNA, 14 nt, Human
uucuguacugauuu

SEQ ID NO: 2604852 - RNA, 15 nt, Human
aucauuucuugggcc

SEQ ID NO: 2604853 - RNA, 18 nt, Human
aucauuucuugggcccuc

SEQ ID NO: 2604854 - RNA, 19 nt, Human
aucauuucuugggcccucc

SEQ ID NO: 2604855 - RNA, 22 nt, Human
aucauuucuugggcccuccuga

SEQ ID NO: 2604856 - RNA, 14 nt, Human
auccagguaaucca

SEQ ID NO: 2604857 - RNA, 15 nt, Human
aucauuuuaauuauu

SEQ ID NO: 2604858 - RNA, 14 nt, Human
aucauuuuaauuau

SEQ ID NO: 2604859 - RNA, 17 nt, Human
auccaggguggugguga

SEQ ID NO: 2604860 - RNA, 16 nt, Human
auccagguucagcuug

SEQ ID NO: 2604861 - RNA, 15 nt, Human
auccagguucagcuu

SEQ ID NO: 2604862 - RNA, 15 nt, Human
aucccaacugucuuu

SEQ ID NO: 2604863 - RNA, 19 nt, Human
aucccaagaucugugcagc

SEQ ID NO: 2604864 - RNA, 17 nt, Human
aucccaagacccagggc

SEQ ID NO: 2604865 - RNA, 17 nt, Human
aucccaacugucuuuuu

SEQ ID NO: 2604866 - RNA, 23 nt, Human
aucccaacugucuuuuuuucccu

SEQ ID NO: 2604867 - RNA, 23 nt, Human
aucccaggaucgcaagagccaug

SEQ ID NO: 2604868 - RNA, 21 nt, Human
aucccaagaucugugcagccc

SEQ ID NO: 2604869 - RNA, 17 nt, Human
aucccaggauguacaag

SEQ ID NO: 2604870 - RNA, 19 nt, Human
auccauguaagguaucagu

SEQ ID NO: 2604871 - RNA, 12 nt, Human
auccauguacug

SEQ ID NO: 2604872 - RNA, 14 nt, Human
auccauguacugua

SEQ ID NO: 2604873 - RNA, 18 nt, Human
auccauguacuguaguuu

SEQ ID NO: 2604874 - RNA, 22 nt, Human
auccauguacuguaguuuuucu

SEQ ID NO: 2604875 - RNA, 20 nt, Human
auccauguacuguaguuuuu

SEQ ID NO: 2604876 - RNA, 18 nt, Human
auccauguuaguuuuuac

SEQ ID NO: 2604877 - RNA, 18 nt, Human
auccauuaucauguguaa

SEQ ID NO: 2604878 - RNA, 17 nt, Human
auccauuaucaugugua

SEQ ID NO: 2604879 - RNA, 16 nt, Human
auccauuaucaugugu

SEQ ID NO: 2604880 - RNA, 22 nt, Human
auccauuccucagggacagaga

SEQ ID NO: 2604881 - RNA, 14 nt, Human
auccauuccucagg

SEQ ID NO: 2604882 - RNA, 18 nt, Human
auccauuccucagggaca

SEQ ID NO: 2604883 - RNA, 15 nt, Human
auccauuaucaugug

SEQ ID NO: 2604884 - RNA, 14 nt, Human
auccauuaucaugu

SEQ ID NO: 2604885 - RNA, 16 nt, Human
auccauguuuguaaaa

SEQ ID NO: 2604886 - RNA, 19 nt, Human
auccauguuaguuuuuacu

SEQ ID NO: 2604887 - RNA, 20 nt, Human
auccauguuaguuuuuacuu

SEQ ID NO: 2604888 - RNA, 18 nt, Human
aucccuguguugucucua

SEQ ID NO: 2604889 - RNA, 18 nt, Human
aucccuguuacccagaga

SEQ ID NO: 2604890 - RNA, 21 nt, Human
aucccuguuuaauauuuaaac

SEQ ID NO: 2604891 - RNA, 20 nt, Human
aucccuguuuaauauuuaaa

SEQ ID NO: 2604892 - RNA, 18 nt, Human
aucccuguuuaauauuua

SEQ ID NO: 2604893 - RNA, 17 nt, Human
aucccuguuuaauauuu

SEQ ID NO: 2604894 - RNA, 23 nt, Human
aucccuguuuaauauuuaaacag

SEQ ID NO: 2604895 - RNA, 22 nt, Human
aucccuguuuaauauuuaaaca

SEQ ID NO: 2604896 - RNA, 16 nt, Human
aucccuguuuaauauu

SEQ ID NO: 2604897 - RNA, 15 nt, Human
aucccuguuuaauau

SEQ ID NO: 2604898 - RNA, 14 nt, Human
aucccuguuuaaua

SEQ ID NO: 2604899 - RNA, 19 nt, Human
aucccuguuacccagagaa

SEQ ID NO: 2604900 - RNA, 13 nt, Human
aucccuguuuaau

SEQ ID NO: 2604901 - RNA, 20 nt, Human
aucccucuacagagcuuccc

SEQ ID NO: 2604902 - RNA, 21 nt, Human
aucccucuacagagcuucccu

SEQ ID NO: 2604903 - RNA, 22 nt, Human
aucccucuacagagcuucccug

SEQ ID NO: 2604904 - RNA, 23 nt, Human
aucccucuacagagcuucccuga

SEQ ID NO: 2604905 - RNA, 22 nt, Human
aucccucuccauaaccccaccc

SEQ ID NO: 2604906 - RNA, 12 nt, Human
aucccucuccau

SEQ ID NO: 2604907 - RNA, 11 nt, Human
aucccucucca

SEQ ID NO: 2604908 - RNA, 16 nt, Human
aucccucucuggauug

SEQ ID NO: 2604909 - RNA, 14 nt, Human
aucccucucuggau

SEQ ID NO: 2604910 - RNA, 14 nt, Human
aucccucuccuccc

SEQ ID NO: 2604911 - RNA, 16 nt, Human
aucccugggcauugcu

SEQ ID NO: 2604912 - RNA, 17 nt, Human
aucccugggcauugcuu

SEQ ID NO: 2604913 - RNA, 18 nt, Human
aucccugggcauugcuuu

SEQ ID NO: 2604914 - RNA, 15 nt, Human
aucccugccugguca

SEQ ID NO: 2604915 - RNA, 17 nt, Human
aucccucuacagagcuu

SEQ ID NO: 2604916 - RNA, 11 nt, Human
aucccucaucu

SEQ ID NO: 2604917 - RNA, 18 nt, Human
aucccucccccccaugca

SEQ ID NO: 2604918 - RNA, 19 nt, Human
aucccucccccccaugcac

SEQ ID NO: 2604919 - RNA, 21 nt, Human
aucccucccccccaugcacug

SEQ ID NO: 2604920 - RNA, 22 nt, Human
aucccucccccccaugcacugu

SEQ ID NO: 2604921 - RNA, 16 nt, Human
aucccuccccaguuca

SEQ ID NO: 2604922 - RNA, 15 nt, Human
aucccuccccaguuc

SEQ ID NO: 2604923 - RNA, 13 nt, Human
aucccucaucugu

SEQ ID NO: 2604924 - RNA, 17 nt, Human
aucccucaucugucccu

SEQ ID NO: 2604925 - RNA, 17 nt, Human
aucccauaugccugggc

SEQ ID NO: 2604926 - RNA, 16 nt, Human
aucccauaugccuggg

SEQ ID NO: 2604927 - RNA, 19 nt, Human
aucccaggcuucacccuga

SEQ ID NO: 2604928 - RNA, 12 nt, Human
aucccaggggac

SEQ ID NO: 2604929 - RNA, 19 nt, Human
aucccaggggaccacaccu

SEQ ID NO: 2604930 - RNA, 19 nt, Human
aucccaggggcccaaggcg

SEQ ID NO: 2604931 - RNA, 17 nt, Human
aucccaggggcccaagg

SEQ ID NO: 2604932 - RNA, 20 nt, Human
aucccaggggaccacaccuc

SEQ ID NO: 2604933 - RNA, 23 nt, Human
aucccaggggaccacaccucccu

SEQ ID NO: 2604934 - RNA, 22 nt, Human
uucugggacacaguucaauucu

SEQ ID NO: 2604935 - RNA, 11 nt, Human
uucugggacac

SEQ ID NO: 2604936 - RNA, 14 nt, Human
uucugccucugagg

SEQ ID NO: 2604937 - RNA, 10 nt, Human
uucugggaca

SEQ ID NO: 2604938 - RNA, 23 nt, Human
uucugccgcagcccugcagaggg

SEQ ID NO: 2604939 - RNA, 17 nt, Human
uucugccacuucccagg

SEQ ID NO: 2604940 - RNA, 14 nt, Human
uucugccacuuccc

SEQ ID NO: 2604941 - RNA, 16 nt, Human
uucugccgcagcccug

SEQ ID NO: 2604942 - RNA, 13 nt, Human
uucugccucucaa

SEQ ID NO: 2604943 - RNA, 16 nt, Human
uucugccgugugcccu

SEQ ID NO: 2604944 - RNA, 17 nt, Human
uucugccggcccugggg

SEQ ID NO: 2604945 - RNA, 18 nt, Human
uucugccggcccuggggc

SEQ ID NO: 2604946 - RNA, 12 nt, Human
uucuggugugaa

SEQ ID NO: 2604947 - RNA, 19 nt, Human
uucuggugggguguguucc

SEQ ID NO: 2604948 - RNA, 19 nt, Human
uucuguacauagccuauau

SEQ ID NO: 2604949 - RNA, 18 nt, Human
uucuguacauagccuaua

SEQ ID NO: 2604950 - RNA, 16 nt, Human
uucuguacauagccua

SEQ ID NO: 2604951 - RNA, 15 nt, Human
uucuguacauagccu

SEQ ID NO: 2604952 - RNA, 22 nt, Human
uucuguacaugcauugagcucu

SEQ ID NO: 2604953 - RNA, 22 nt, Human
uucuguacauagccuauauuua

SEQ ID NO: 2604954 - RNA, 17 nt, Human
uucuguaccaaaguguu

SEQ ID NO: 2604955 - RNA, 21 nt, Human
uucuggucucuaggcugggga

SEQ ID NO: 2604956 - RNA, 19 nt, Human
uucuggugaggccuugcuc

SEQ ID NO: 2604957 - RNA, 19 nt, Human
uucugguagauagaaauaa

SEQ ID NO: 2604958 - RNA, 18 nt, Human
uucugguacucuccuaga

SEQ ID NO: 2604959 - RNA, 17 nt, Human
uucugguagauagaaau

SEQ ID NO: 2604960 - RNA, 18 nt, Human
uucugguagauagaaaua

SEQ ID NO: 2604961 - RNA, 15 nt, Human
uucugguacucuccu

SEQ ID NO: 2604962 - RNA, 19 nt, Human
uucuggguggggcaguggg

SEQ ID NO: 2604963 - RNA, 18 nt, Human
uucuggguggccucggga

SEQ ID NO: 2604964 - RNA, 13 nt, Human
uucugggugucca

SEQ ID NO: 2604965 - RNA, 14 nt, Human
uucuggguggccuc

SEQ ID NO: 2604966 - RNA, 22 nt, Human
uucugggagacacccaaagggu

SEQ ID NO: 2604967 - RNA, 23 nt, Human
uucugggaaauggcuugaagcca

SEQ ID NO: 2604968 - RNA, 23 nt, Human
uucugcaucagcugcugaaacaa

SEQ ID NO: 2604969 - RNA, 14 nt, Human
uucugaagaagaug

SEQ ID NO: 2604970 - RNA, 23 nt, Human
uucugcauuuuauucuggaugga

SEQ ID NO: 2604971 - RNA, 18 nt, Human
uucugcauuuugcuauug

SEQ ID NO: 2604972 - RNA, 17 nt, Human
uucugcauuuugcuauu

SEQ ID NO: 2604973 - RNA, 21 nt, Human
uucugcauuuugcuauuguaa

SEQ ID NO: 2604974 - RNA, 13 nt, Human
uucugaagaagau

SEQ ID NO: 2604975 - RNA, 12 nt, Human
uucugaagaaga

SEQ ID NO: 2604976 - RNA, 19 nt, Human
aucauugaaaucuuuuugc

SEQ ID NO: 2604977 - RNA, 13 nt, Human
uucucugucucau

SEQ ID NO: 2604978 - RNA, 17 nt, Human
uucucugucucauccau

SEQ ID NO: 2604979 - RNA, 17 nt, Human
uucucugucucaugugu

SEQ ID NO: 2604980 - RNA, 19 nt, Human
uucucuguguuuguuccua

SEQ ID NO: 2604981 - RNA, 18 nt, Human
uucucuguguuuguuccu

SEQ ID NO: 2604982 - RNA, 24 nt, Human
uucucuguguuuguuccuacagcc

SEQ ID NO: 2604983 - RNA, 20 nt, Human
uucucugugaacgauuuaga

SEQ ID NO: 2604984 - RNA, 12 nt, Human
uucucugugaac

SEQ ID NO: 2604985 - RNA, 13 nt, Human
uucucuucacuca

SEQ ID NO: 2604986 - RNA, 15 nt, Human
uucugaaaauauaac

SEQ ID NO: 2604987 - RNA, 16 nt, Human
uucucuuacugcaaau

SEQ ID NO: 2604988 - RNA, 14 nt, Human
uucucuuacugcaa

SEQ ID NO: 2604989 - RNA, 23 nt, Human
uucucuuacugcaaaugucauca

SEQ ID NO: 2604990 - RNA, 15 nt, Human
uucucuuaauuuaau

SEQ ID NO: 2604991 - RNA, 15 nt, Human
uucugaaagggacgc

SEQ ID NO: 2604992 - RNA, 19 nt, Human
uucugaaaauuaacacugc

SEQ ID NO: 2604993 - RNA, 13 nt, Human
aucaucaaggcac

SEQ ID NO: 2604994 - RNA, 18 nt, Human
aucaucaaggcacugccu

SEQ ID NO: 2604995 - RNA, 21 nt, Human
aucauauugguauucacuaau

SEQ ID NO: 2604996 - RNA, 15 nt, Human
aucauauuauacaga

SEQ ID NO: 2604997 - RNA, 16 nt, Human
aucauauuauacagac

SEQ ID NO: 2604998 - RNA, 22 nt, Human
aucauaggaagggaccaaggca

SEQ ID NO: 2604999 - RNA, 21 nt, Human
aucauaggaagggaccaaggc

SEQ ID NO: 2605000 - RNA, 17 nt, Human
aucauagguauuucaaa

SEQ ID NO: 2605001 - RNA, 16 nt, Human
aucauagguauuucaa

SEQ ID NO: 2605002 - RNA, 18 nt, Human
aucauagguauuucaaaa

SEQ ID NO: 2605003 - RNA, 12 nt, Human
aucauaguacag

SEQ ID NO: 2605004 - RNA, 21 nt, Human
aucauaugauucugcuuuuac

SEQ ID NO: 2605005 - RNA, 18 nt, Human
aucauguuuacagaggac

SEQ ID NO: 2605006 - RNA, 23 nt, Human
aucauguuuacagaggacaguau

SEQ ID NO: 2605007 - RNA, 17 nt, Human
aucaucaguauugaagc

SEQ ID NO: 2605008 - RNA, 22 nt, Human
aucaucagcauaccuuuauugu

SEQ ID NO: 2605009 - RNA, 20 nt, Human
aucaucagcauaccuuuauu

SEQ ID NO: 2605010 - RNA, 19 nt, Human
aucaucaaggcacugccug

SEQ ID NO: 2605011 - RNA, 15 nt, Human
aucaucaguauugaa

SEQ ID NO: 2605012 - RNA, 12 nt, Human
aucauucaagug

SEQ ID NO: 2605013 - RNA, 14 nt, Human
aucauucauuuucu

SEQ ID NO: 2605014 - RNA, 15 nt, Human
aucauguuugcucuc

SEQ ID NO: 2605015 - RNA, 14 nt, Human
aucauguuugcucu

SEQ ID NO: 2605016 - RNA, 13 nt, Human
aucauguuugcuc

SEQ ID NO: 2605017 - RNA, 12 nt, Human
aucauguuugcu

SEQ ID NO: 2605018 - RNA, 16 nt, Human
aucauguuugcucucc

SEQ ID NO: 2605019 - RNA, 16 nt, Human
aucauuauguaauguc

SEQ ID NO: 2605020 - RNA, 22 nt, Human
aucauuaaagccugaguuugcu

SEQ ID NO: 2605021 - RNA, 15 nt, Human
aucauugaaaucuuu

SEQ ID NO: 2605022 - RNA, 14 nt, Human
aucauugaaaucuu

SEQ ID NO: 2605023 - RNA, 22 nt, Human
aucauucauucuuagcucuuaa

SEQ ID NO: 2605024 - RNA, 15 nt, Human
aucaguauugaagca

SEQ ID NO: 2605025 - RNA, 22 nt, Human
aucaguauugaagcauuuuaua

SEQ ID NO: 2605026 - RNA, 19 nt, Human
aucagucauaacuaaauaa

SEQ ID NO: 2605027 - RNA, 13 nt, Human
aucagucaauauu

SEQ ID NO: 2605028 - RNA, 22 nt, Human
aucaguauaauucuguacugau

SEQ ID NO: 2605029 - RNA, 21 nt, Human
aucaguauaauucuguacuga

SEQ ID NO: 2605030 - RNA, 16 nt, Human
aucaguauaauucugu

SEQ ID NO: 2605031 - RNA, 16 nt, Human
aucaguauaaacaaag

SEQ ID NO: 2605032 - RNA, 14 nt, Human
aucaguauaauucu

SEQ ID NO: 2605033 - RNA, 18 nt, Human
aucaguauaaacaaaguu

SEQ ID NO: 2605034 - RNA, 17 nt, Human
aucagcacgauuucugu

SEQ ID NO: 2605035 - RNA, 18 nt, Human
aucagcacgauuucuguu

SEQ ID NO: 2605036 - RNA, 15 nt, Human
aucagcacgauuucu

SEQ ID NO: 2605037 - RNA, 16 nt, Human
aucagcacgauuucug

SEQ ID NO: 2605038 - RNA, 22 nt, Human
aucagaugaacucuuagaaaug

SEQ ID NO: 2605039 - RNA, 22 nt, Human
aucagaucauuucaaaacucau

SEQ ID NO: 2605040 - RNA, 23 nt, Human
aucagaugaacucuuagaaauga

SEQ ID NO: 2605041 - RNA, 17 nt, Human
aucagaguugcugcaaa

SEQ ID NO: 2605042 - RNA, 17 nt, Human
aucagaggccuauaaug

SEQ ID NO: 2605043 - RNA, 18 nt, Human
aucagaucauuucaaaac

SEQ ID NO: 2605044 - RNA, 14 nt, Human
aucagugugccccc

SEQ ID NO: 2605045 - RNA, 13 nt, Human
aucagugugcccc

SEQ ID NO: 2605046 - RNA, 15 nt, Human
aucagugucucacac

SEQ ID NO: 2605047 - RNA, 14 nt, Human
aucagugucucaca

SEQ ID NO: 2605048 - RNA, 19 nt, Human
aucagugugucuaaauuug

SEQ ID NO: 2605049 - RNA, 22 nt, Human
aucagugugccccccauccugg

SEQ ID NO: 2605050 - RNA, 15 nt, Human
aucagugugcccccc

SEQ ID NO: 2605051 - RNA, 17 nt, Human
aucauaagauauuuuuc

SEQ ID NO: 2605052 - RNA, 20 nt, Human
aucagugugucuaaauuuga

SEQ ID NO: 2605053 - RNA, 17 nt, Human
aucauacacuuccuucu

SEQ ID NO: 2605054 - RNA, 12 nt, Human
aucauagaaaug

SEQ ID NO: 2605055 - RNA, 15 nt, Human
aucauagaaauguaa

SEQ ID NO: 2605056 - RNA, 16 nt, Human
aucagucccuauguau

SEQ ID NO: 2605057 - RNA, 23 nt, Human
aucaguccccucccaucugggag

SEQ ID NO: 2605058 - RNA, 22 nt, Human
aucaguccccucccaucuggga

SEQ ID NO: 2605059 - RNA, 17 nt, Human
aucaguccccucccauc

SEQ ID NO: 2605060 - RNA, 16 nt, Human
aucaguccccucccau

SEQ ID NO: 2605061 - RNA, 15 nt, Human
aucaguccccuccca

SEQ ID NO: 2605062 - RNA, 13 nt, Human
aucaguccccucc

SEQ ID NO: 2605063 - RNA, 21 nt, Human
aucagucccuauguauuugca

SEQ ID NO: 2605064 - RNA, 21 nt, Human
aucaguccucuuucaaaggua

SEQ ID NO: 2605065 - RNA, 19 nt, Human
aucagucuauccacagaga

SEQ ID NO: 2605066 - RNA, 14 nt, Human
aucaguccuuugau

SEQ ID NO: 2605067 - RNA, 13 nt, Human
aucaguggagcca

SEQ ID NO: 2605068 - RNA, 22 nt, Human
aucaguggcauggcuccagucu

SEQ ID NO: 2605069 - RNA, 19 nt, Human
aucagugguuauuuaggga

SEQ ID NO: 2605070 - RNA, 16 nt, Human
aucagugucuuuccac

SEQ ID NO: 2605071 - RNA, 19 nt, Human
aucaguguaccauuugccu

SEQ ID NO: 2605072 - RNA, 17 nt, Human
aucaguguccucuugcu

SEQ ID NO: 2605073 - RNA, 14 nt, Human
uucucaguuuucau

SEQ ID NO: 2605074 - RNA, 22 nt, Human
uucucagacuuuggaaaaugca

SEQ ID NO: 2605075 - RNA, 15 nt, Human
uucucaguuuucaua

SEQ ID NO: 2605076 - RNA, 23 nt, Human
uucucagaaucucaaauaacuaa

SEQ ID NO: 2605077 - RNA, 22 nt, Human
uucucagucaguaauugccaaa

SEQ ID NO: 2605078 - RNA, 22 nt, Human
uucucacacccaccguccgccc

SEQ ID NO: 2605079 - RNA, 18 nt, Human
uucucacacccaccgucc

SEQ ID NO: 2605080 - RNA, 15 nt, Human
uucucacacccaccg

SEQ ID NO: 2605081 - RNA, 14 nt, Human
uucucacacccacc

SEQ ID NO: 2605082 - RNA, 19 nt, Human
uucucagaaucucaaauaa

SEQ ID NO: 2605083 - RNA, 22 nt, Human
uucucagaaucucaaauaacua

SEQ ID NO: 2605084 - RNA, 23 nt, Human
aucagaaauacagauuuugauag

SEQ ID NO: 2605085 - RNA, 19 nt, Human
aucagaaauacagauuuug

SEQ ID NO: 2605086 - RNA, 15 nt, Human
aucagaaauacagau

SEQ ID NO: 2605087 - RNA, 14 nt, Human
aucagaaauacaga

SEQ ID NO: 2605088 - RNA, 15 nt, Human
uucucaucacucccc

SEQ ID NO: 2605089 - RNA, 24 nt, Human
uucucauaggaaaaguacauuuaa

SEQ ID NO: 2605090 - RNA, 22 nt, Human
uucucauaggaaaaguacauuu

SEQ ID NO: 2605091 - RNA, 17 nt, Human
uucucaucacuccccuc

SEQ ID NO: 2605092 - RNA, 16 nt, Human
uucucaucacuccccu

SEQ ID NO: 2605093 - RNA, 17 nt, Human
uucucaucccacgcacu

SEQ ID NO: 2605094 - RNA, 13 nt, Human
uucucauagcauu

SEQ ID NO: 2605095 - RNA, 14 nt, Human
uucucauagcauua

SEQ ID NO: 2605096 - RNA, 17 nt, Human
uucucauagcauuaacu

SEQ ID NO: 2605097 - RNA, 18 nt, Human
uucucauagcauuaacua

SEQ ID NO: 2605098 - RNA, 21 nt, Human
uucucauagcauuaacuaauc

SEQ ID NO: 2605099 - RNA, 22 nt, Human
uucucauagcauuaacuaaucu

SEQ ID NO: 2605100 - RNA, 20 nt, Human
uucucauaggaaaaguacau

SEQ ID NO: 2605101 - RNA, 13 nt, Human
aucagaagauaac

SEQ ID NO: 2605102 - RNA, 22 nt, Human
aucagaagaccacaaaaauuga

SEQ ID NO: 2605103 - RNA, 23 nt, Human
aucagaagaccacaaaaauugac

SEQ ID NO: 2605104 - RNA, 22 nt, Human
aucagaacucaaauggggccag

SEQ ID NO: 2605105 - RNA, 23 nt, Human
aucagaacucaaauggggccaga

SEQ ID NO: 2605106 - RNA, 13 nt, Human
aucagaacagcag

SEQ ID NO: 2605107 - RNA, 14 nt, Human
aucagaacagcaga

SEQ ID NO: 2605108 - RNA, 21 nt, Human
aucagagcagcagugaaaaca

SEQ ID NO: 2605109 - RNA, 15 nt, Human
aucagaggccuauaa

SEQ ID NO: 2605110 - RNA, 14 nt, Human
aucagaggccuaua

SEQ ID NO: 2605111 - RNA, 22 nt, Human
aucagagaugcaccaccaagcc

SEQ ID NO: 2605112 - RNA, 17 nt, Human
aucagaagauaacuuga

SEQ ID NO: 2605113 - RNA, 14 nt, Human
aucagaagauaacu

SEQ ID NO: 2605114 - RNA, 12 nt, Human
aucagaaggaga

SEQ ID NO: 2605115 - RNA, 17 nt, Human
uucucaagugccuuaau

SEQ ID NO: 2605116 - RNA, 23 nt, Human
uucuaguuuucaguuuguauaua

SEQ ID NO: 2605117 - RNA, 23 nt, Human
uucuauaaggccauaaaacaggu

SEQ ID NO: 2605118 - RNA, 14 nt, Human
uucucaaccuacca

SEQ ID NO: 2605119 - RNA, 22 nt, Human
uucucaacaaagcacaguguua

SEQ ID NO: 2605120 - RNA, 15 nt, Human
uucucaaccuaccac

SEQ ID NO: 2605121 - RNA, 22 nt, Human
uucucaagauacugcuacugua

SEQ ID NO: 2605122 - RNA, 15 nt, Human
uucucaagugccuua

SEQ ID NO: 2605123 - RNA, 11 nt, Human
uucucaagugc

SEQ ID NO: 2605124 - RNA, 15 nt, Human
uucucaagcccugca

SEQ ID NO: 2605125 - RNA, 14 nt, Human
uucucaagcccugc

SEQ ID NO: 2605126 - RNA, 18 nt, Human
uucucaacuccaaacuga

SEQ ID NO: 2605127 - RNA, 14 nt, Human
uucucaacuccaaa

SEQ ID NO: 2605128 - RNA, 15 nt, Human
uucuaguuugcauuc

SEQ ID NO: 2605129 - RNA, 14 nt, Human
uucuaguuugcauu

SEQ ID NO: 2605130 - RNA, 19 nt, Human
uucuaguuuucaguuugua

SEQ ID NO: 2605131 - RNA, 14 nt, Human
uucuaguuuucagu

SEQ ID NO: 2605132 - RNA, 13 nt, Human
uucuaguuuuguc

SEQ ID NO: 2605133 - RNA, 14 nt, Human
uucuauaaggccau

SEQ ID NO: 2605134 - RNA, 21 nt, Human
uucuauaaggccauaaaacag

SEQ ID NO: 2605135 - RNA, 13 nt, Human
uucuauaaggcca

SEQ ID NO: 2605136 - RNA, 22 nt, Human
uucuaggcuacaauuuucuccc

SEQ ID NO: 2605137 - RNA, 23 nt, Human
uucuaggcuacaauuuucuccca

SEQ ID NO: 2605138 - RNA, 18 nt, Human
uucuagguggcaaggcug

SEQ ID NO: 2605139 - RNA, 15 nt, Human
uucuagggaaaugaa

SEQ ID NO: 2605140 - RNA, 23 nt, Human
uucuagguggcaaggcugugcuc

SEQ ID NO: 2605141 - RNA, 15 nt, Human
uucuagguucuaaaa

SEQ ID NO: 2605142 - RNA, 22 nt, Human
uucuaguuucccacaauauaaa

SEQ ID NO: 2605143 - RNA, 15 nt, Human
uucuaguuucccaca

SEQ ID NO: 2605144 - RNA, 15 nt, Human
uuccuuuuuuauaca

SEQ ID NO: 2605145 - RNA, 21 nt, Human
uuccuuuuuuaaaaaugcaaa

SEQ ID NO: 2605146 - RNA, 13 nt, Human
uucuaggccuggg

SEQ ID NO: 2605147 - RNA, 23 nt, Human
uuccuuuugaacgccccccccca

SEQ ID NO: 2605148 - RNA, 17 nt, Human
uuccuuuuguguacagu

SEQ ID NO: 2605149 - RNA, 15 nt, Human
uuccuuuuguguaca

SEQ ID NO: 2605150 - RNA, 17 nt, Human
uuccuuuucccugcuuc

SEQ ID NO: 2605151 - RNA, 16 nt, Human
uuccuuuucccugcuu

SEQ ID NO: 2605152 - RNA, 18 nt, Human
uuccuuuucuaacucucc

SEQ ID NO: 2605153 - RNA, 20 nt, Human
uuccuuuugaacgccccccc

SEQ ID NO: 2605154 - RNA, 20 nt, Human
uuauuuaugccucuguauuu

SEQ ID NO: 2605155 - RNA, 14 nt, Human
uuauuuaugccucu

SEQ ID NO: 2605156 - RNA, 14 nt, Human
uuauuuaucaguga

SEQ ID NO: 2605157 - RNA, 18 nt, Human
uuauuuaucagugacaga

SEQ ID NO: 2605158 - RNA, 13 nt, Human
uuauuuauuuaau

SEQ ID NO: 2605159 - RNA, 15 nt, Human
uuauuuauuuaaaug

SEQ ID NO: 2605160 - RNA, 15 nt, Human
uuauuuauuggagau

SEQ ID NO: 2605161 - RNA, 13 nt, Human
uuauuuauuaaga

SEQ ID NO: 2605162 - RNA, 22 nt, Human
uuauuuauucagcuucauuugu

SEQ ID NO: 2605163 - RNA, 17 nt, Human
uuauuuauucagcuuca

SEQ ID NO: 2605164 - RNA, 14 nt, Human
uuauuuauuaagau

SEQ ID NO: 2605165 - RNA, 15 nt, Human
uuauuuauuaagaug

SEQ ID NO: 2605166 - RNA, 19 nt, Human
uuauuuccuaguucuguag

SEQ ID NO: 2605167 - RNA, 18 nt, Human
uuauuuccuaguucugua

SEQ ID NO: 2605168 - RNA, 19 nt, Human
uuauuuccaaauaaaauga

SEQ ID NO: 2605169 - RNA, 17 nt, Human
uuauuuccaaauaaaau

SEQ ID NO: 2605170 - RNA, 18 nt, Human
uuauuucauaaacaacuu

SEQ ID NO: 2605171 - RNA, 15 nt, Human
uuauuucaugaaaau

SEQ ID NO: 2605172 - RNA, 20 nt, Human
uuauuucaucauauuauaca

SEQ ID NO: 2605173 - RNA, 14 nt, Human
uuauuuauuuaaua

SEQ ID NO: 2605174 - RNA, 15 nt, Human
uuauuuauuuaugga

SEQ ID NO: 2605175 - RNA, 23 nt, Human
uuauuucaaaauauacauucaaa

SEQ ID NO: 2605176 - RNA, 21 nt, Human
uuauuucacuuuagaugcuga

SEQ ID NO: 2605177 - RNA, 20 nt, Human
uuauuucacuuuagaugcug

SEQ ID NO: 2605178 - RNA, 11 nt, Human
uuauuucagaa

SEQ ID NO: 2605179 - RNA, 15 nt, Human
uuauuucagaaaugu

SEQ ID NO: 2605180 - RNA, 17 nt, Human
uuauuucagaaauguac

SEQ ID NO: 2605181 - RNA, 23 nt, Human
uuauuuagacucaucuuacugua

SEQ ID NO: 2605182 - RNA, 17 nt, Human
uuauuuagacucaucuu

SEQ ID NO: 2605183 - RNA, 18 nt, Human
uuauuuagacaagagaug

SEQ ID NO: 2605184 - RNA, 17 nt, Human
uuauuuagcaccaggga

SEQ ID NO: 2605185 - RNA, 16 nt, Human
uuauuuagacaagaga

SEQ ID NO: 2605186 - RNA, 15 nt, Human
uuauuuagacaagag

SEQ ID NO: 2605187 - RNA, 14 nt, Human
uuauuuagacaaga

SEQ ID NO: 2605188 - RNA, 15 nt, Human
uuauuuacugcuagu

SEQ ID NO: 2605189 - RNA, 22 nt, Human
uuauuuacugagcuucucugug

SEQ ID NO: 2605190 - RNA, 15 nt, Human
uuauuuacagaugaa

SEQ ID NO: 2605191 - RNA, 20 nt, Human
uuauuuacagaugaauguau

SEQ ID NO: 2605192 - RNA, 19 nt, Human
uuauuuaauaacauuaccu

SEQ ID NO: 2605193 - RNA, 16 nt, Human
uuauuuaauguuaugu

SEQ ID NO: 2605194 - RNA, 14 nt, Human
uuauuuaauuaaaa

SEQ ID NO: 2605195 - RNA, 17 nt, Human
uuauuuacuaauuuucu

SEQ ID NO: 2605196 - RNA, 21 nt, Human
uuauuuacugagcuucucugu

SEQ ID NO: 2605197 - RNA, 17 nt, Human
uuauuuacugagcuucu

SEQ ID NO: 2605198 - RNA, 15 nt, Human
uuauuuauacacugu

SEQ ID NO: 2605199 - RNA, 16 nt, Human
uuauuuaggcuuugua

SEQ ID NO: 2605200 - RNA, 17 nt, Human
uuauuuauaaucacuuu

SEQ ID NO: 2605201 - RNA, 15 nt, Human
uuauuuaguauuuau

SEQ ID NO: 2605202 - RNA, 16 nt, Human
uuauuuaguuccuuga

SEQ ID NO: 2605203 - RNA, 18 nt, Human
uuauuuagacucaucuua

SEQ ID NO: 2605204 - RNA, 17 nt, Human
uuauuuagggaacugcu

SEQ ID NO: 2605205 - RNA, 18 nt, Human
uuauuuagggaacugcuu

SEQ ID NO: 2605206 - RNA, 21 nt, Human
uuauuuagggaacugcuugac

SEQ ID NO: 2605207 - RNA, 17 nt, Human
auagcuguacaaauaua

SEQ ID NO: 2605208 - RNA, 15 nt, Human
auagcuguacaaaua

SEQ ID NO: 2605209 - RNA, 23 nt, Human
auagcuggucuuauuuguaaagc

SEQ ID NO: 2605210 - RNA, 22 nt, Human
auagcuggucuuauuuguaaag

SEQ ID NO: 2605211 - RNA, 17 nt, Human
auagcugggacuacagg

SEQ ID NO: 2605212 - RNA, 18 nt, Human
auagcuguauugaaucau

SEQ ID NO: 2605213 - RNA, 17 nt, Human
auagcuguauugaauca

SEQ ID NO: 2605214 - RNA, 16 nt, Human
auagcuguauugaauc

SEQ ID NO: 2605215 - RNA, 15 nt, Human
auagcuguauugaau

SEQ ID NO: 2605216 - RNA, 13 nt, Human
auagcuguauuga

SEQ ID NO: 2605217 - RNA, 18 nt, Human
auagcuguacaaauauaa

SEQ ID NO: 2605218 - RNA, 23 nt, Human
auagcuguacaaauauaagaaua

SEQ ID NO: 2605219 - RNA, 19 nt, Human
uuauuguguuugucauuag

SEQ ID NO: 2605220 - RNA, 22 nt, Human
auagcuguauugaaucauguag

SEQ ID NO: 2605221 - RNA, 18 nt, Human
uuauuguguuugucauua

SEQ ID NO: 2605222 - RNA, 17 nt, Human
uuauuguuuaaaaucau

SEQ ID NO: 2605223 - RNA, 22 nt, Human
uuauuguguuugucauuagccu

SEQ ID NO: 2605224 - RNA, 20 nt, Human
uuauuguguuugucauuagc

SEQ ID NO: 2605225 - RNA, 20 nt, Human
uuauuguguuuuuaauuuau

SEQ ID NO: 2605226 - RNA, 13 nt, Human
uuauuguuccaag

SEQ ID NO: 2605227 - RNA, 16 nt, Human
uuauuguuccaagaca

SEQ ID NO: 2605228 - RNA, 18 nt, Human
uuauuuaaugaaagacug

SEQ ID NO: 2605229 - RNA, 22 nt, Human
uuauuuaaugaaagacuguaca

SEQ ID NO: 2605230 - RNA, 15 nt, Human
uuauuuaauaacauu

SEQ ID NO: 2605231 - RNA, 14 nt, Human
uuauuuaauaacau

SEQ ID NO: 2605232 - RNA, 14 nt, Human
uuauuuaauaacaa

SEQ ID NO: 2605233 - RNA, 13 nt, Human
uuauuuaauaaca

SEQ ID NO: 2605234 - RNA, 12 nt, Human
uuauuuaauaac

SEQ ID NO: 2605235 - RNA, 10 nt, Human
uuauuuaaua

SEQ ID NO: 2605236 - RNA, 23 nt, Human
uuauuuaacagcugaauuaucua

SEQ ID NO: 2605237 - RNA, 16 nt, Human
uuauuuaaaugucuaa

SEQ ID NO: 2605238 - RNA, 15 nt, Human
uuauuuaaaugucua

SEQ ID NO: 2605239 - RNA, 20 nt, Human
uuauuuaaaugucuaaugua

SEQ ID NO: 2605240 - RNA, 13 nt, Human
uuauuuaacagcu

SEQ ID NO: 2605241 - RNA, 12 nt, Human
uuauuuaaauga

SEQ ID NO: 2605242 - RNA, 20 nt, Human
uuauuuaaacucuguugcaa

SEQ ID NO: 2605243 - RNA, 14 nt, Human
uuauuuaaauuuua

SEQ ID NO: 2605244 - RNA, 16 nt, Human
uuauuuaaaagauuca

SEQ ID NO: 2605245 - RNA, 15 nt, Human
uuauuuaaaagauuc

SEQ ID NO: 2605246 - RNA, 14 nt, Human
uuauuuaaaagauu

SEQ ID NO: 2605247 - RNA, 22 nt, Human
uuauuguuuaaagcaacugucu

SEQ ID NO: 2605248 - RNA, 18 nt, Human
uuauuuaaaagauucauu

SEQ ID NO: 2605249 - RNA, 17 nt, Human
uuauuuaaaagauucau

SEQ ID NO: 2605250 - RNA, 13 nt, Human
uuauuuaaaagau

SEQ ID NO: 2605251 - RNA, 12 nt, Human
uuauuguuuaaa

SEQ ID NO: 2605252 - RNA, 23 nt, Human
uuauuguuccaagacauugucaa

SEQ ID NO: 2605253 - RNA, 17 nt, Human
uuauuguuccaagacau

SEQ ID NO: 2605254 - RNA, 18 nt, Human
uuauuguuccaagacauu

SEQ ID NO: 2605255 - RNA, 19 nt, Human
uuauuguuccaagacauug

SEQ ID NO: 2605256 - RNA, 22 nt, Human
uuauuguuccaagacauuguca

SEQ ID NO: 2605257 - RNA, 18 nt, Human
auagcuacuaauuuuaaa

SEQ ID NO: 2605258 - RNA, 16 nt, Human
auagcuacaggaagca

SEQ ID NO: 2605259 - RNA, 19 nt, Human
auagcucaggugucccugc

SEQ ID NO: 2605260 - RNA, 14 nt, Human
auagcuauauccau

SEQ ID NO: 2605261 - RNA, 16 nt, Human
auagcuauauccaugu

SEQ ID NO: 2605262 - RNA, 17 nt, Human
auagcuauauccaugua

SEQ ID NO: 2605263 - RNA, 19 nt, Human
auagcuauauccauguacu

SEQ ID NO: 2605264 - RNA, 20 nt, Human
auagcuauauccauguacug

SEQ ID NO: 2605265 - RNA, 22 nt, Human
auagcuauauccauguacugua

SEQ ID NO: 2605266 - RNA, 14 nt, Human
auagcuauuacugu

SEQ ID NO: 2605267 - RNA, 23 nt, Human
auagcuauauccauguacuguag

SEQ ID NO: 2605268 - RNA, 21 nt, Human
auagcuaagaaauaaaacugu

SEQ ID NO: 2605269 - RNA, 15 nt, Human
auagcuacaggaagc

SEQ ID NO: 2605270 - RNA, 22 nt, Human
auagcucaggugucccugcacu

SEQ ID NO: 2605271 - RNA, 20 nt, Human
auagcuccccgcuucugccu

SEQ ID NO: 2605272 - RNA, 20 nt, Human
auagcuauuuuuauggaauu

SEQ ID NO: 2605273 - RNA, 13 nt, Human
auagcucaguuua

SEQ ID NO: 2605274 - RNA, 22 nt, Human
auagcuauuacugucugguuuu

SEQ ID NO: 2605275 - RNA, 18 nt, Human
auagcuauuacugucugg

SEQ ID NO: 2605276 - RNA, 12 nt, Human
auagcuauuuuu

SEQ ID NO: 2605277 - RNA, 18 nt, Human
auagcuauuuuuauggaa

SEQ ID NO: 2605278 - RNA, 21 nt, Human
auagcucaggugucccugcac

SEQ ID NO: 2605279 - RNA, 20 nt, Human
auagcucaggugucccugca

SEQ ID NO: 2605280 - RNA, 12 nt, Human
auagcugggacu

SEQ ID NO: 2605281 - RNA, 20 nt, Human
auagcucuuuggcagucuau

SEQ ID NO: 2605282 - RNA, 15 nt, Human
auagcucuuucaggg

SEQ ID NO: 2605283 - RNA, 17 nt, Human
auagcugagauuccugg

SEQ ID NO: 2605284 - RNA, 21 nt, Human
auagcugagauuccugguucg

SEQ ID NO: 2605285 - RNA, 23 nt, Human
auagcuccccgcuucugccugca

SEQ ID NO: 2605286 - RNA, 20 nt, Human
auagcuccugcuccacagcc

SEQ ID NO: 2605287 - RNA, 22 nt, Human
auagcucaguuuauccaaggug

SEQ ID NO: 2605288 - RNA, 21 nt, Human
auaacuuugcuugcaguagau

SEQ ID NO: 2605289 - RNA, 14 nt, Human
auaacuuugcuugc

SEQ ID NO: 2605290 - RNA, 12 nt, Human
auaacuuugcuu

SEQ ID NO: 2605291 - RNA, 13 nt, Human
auaacuugucuaa

SEQ ID NO: 2605292 - RNA, 20 nt, Human
auaagagagucauaaaccuu

SEQ ID NO: 2605293 - RNA, 19 nt, Human
auaagagggcacacacugu

SEQ ID NO: 2605294 - RNA, 17 nt, Human
auaagagggcacacacu

SEQ ID NO: 2605295 - RNA, 21 nt, Human
auaagaggcugauaauuccag

SEQ ID NO: 2605296 - RNA, 17 nt, Human
auaacuucuuaaaaguu

SEQ ID NO: 2605297 - RNA, 16 nt, Human
auaacuucuuaaaagu

SEQ ID NO: 2605298 - RNA, 19 nt, Human
auaacuucuuaaaaguugu

SEQ ID NO: 2605299 - RNA, 16 nt, Human
auaacuucaagcaaac

SEQ ID NO: 2605300 - RNA, 15 nt, Human
auaagauauuuuuca

SEQ ID NO: 2605301 - RNA, 16 nt, Human
auaagaguagaaacug

SEQ ID NO: 2605302 - RNA, 18 nt, Human
auagccugccucuucucu

SEQ ID NO: 2605303 - RNA, 13 nt, Human
auaagauaaaugu

SEQ ID NO: 2605304 - RNA, 17 nt, Human
auaagauaaaugugcug

SEQ ID NO: 2605305 - RNA, 14 nt, Human
auagcuacuaauuu

SEQ ID NO: 2605306 - RNA, 17 nt, Human
auagcuacuaauuuuaa

SEQ ID NO: 2605307 - RNA, 23 nt, Human
auagcuaacauuuuaaauaaaag

SEQ ID NO: 2605308 - RNA, 22 nt, Human
auagcuaacauuuuaaauaaaa

SEQ ID NO: 2605309 - RNA, 15 nt, Human
auagcuaacauuuua

SEQ ID NO: 2605310 - RNA, 20 nt, Human
auagcggguuacuuucacau

SEQ ID NO: 2605311 - RNA, 21 nt, Human
uucaaggauccugagccagau

SEQ ID NO: 2605312 - RNA, 19 nt, Human
uucaaggauccugagccag

SEQ ID NO: 2605313 - RNA, 18 nt, Human
uucaaggauccugagcca

SEQ ID NO: 2605314 - RNA, 16 nt, Human
uucaaggauccugagc

SEQ ID NO: 2605315 - RNA, 12 nt, Human
uucaacuuuucc

SEQ ID NO: 2605316 - RNA, 22 nt, Human
uucaagaaaacaacuucaauau

SEQ ID NO: 2605317 - RNA, 13 nt, Human
uucaagaaacuga

SEQ ID NO: 2605318 - RNA, 20 nt, Human
uucaagaaacugaggaauuu

SEQ ID NO: 2605319 - RNA, 12 nt, Human
uucaagaaacug

SEQ ID NO: 2605320 - RNA, 15 nt, Human
uucaaggauccugag

SEQ ID NO: 2605321 - RNA, 22 nt, Human
uucaagaaagcuucaaacugca

SEQ ID NO: 2605322 - RNA, 23 nt, Human
uucaagaaacugaggaauuuucu

SEQ ID NO: 2605323 - RNA, 19 nt, Human
uucaagaaaaguaagcccu

SEQ ID NO: 2605324 - RNA, 18 nt, Human
uucaaguggggcucgcca

SEQ ID NO: 2605325 - RNA, 22 nt, Human
uucaagugcaugcucucugcag

SEQ ID NO: 2605326 - RNA, 20 nt, Human
uucaagugauucuccugccu

SEQ ID NO: 2605327 - RNA, 19 nt, Human
uucaaguguaaaauauuuu

SEQ ID NO: 2605328 - RNA, 22 nt, Human
uucaaguggggcucgccaugcc

SEQ ID NO: 2605329 - RNA, 13 nt, Human
uucaaguuaaagu

SEQ ID NO: 2605330 - RNA, 16 nt, Human
uucaaguuagcucagg

SEQ ID NO: 2605331 - RNA, 17 nt, Human
uucaaguuaaauuuuau

SEQ ID NO: 2605332 - RNA, 23 nt, Human
uucaaguuccaaguugcuaauac

SEQ ID NO: 2605333 - RNA, 17 nt, Human
uucaaguuauuguacag

SEQ ID NO: 2605334 - RNA, 14 nt, Human
uucaaguuauugua

SEQ ID NO: 2605335 - RNA, 17 nt, Human
uucaaguuagcucagga

SEQ ID NO: 2605336 - RNA, 20 nt, Human
uucaaguuauuguacagcug

SEQ ID NO: 2605337 - RNA, 14 nt, Human
uucaaguucaaucc

SEQ ID NO: 2605338 - RNA, 16 nt, Human
uucaauaaagcauuua

SEQ ID NO: 2605339 - RNA, 18 nt, Human
uucaauaaagcauuuaua

SEQ ID NO: 2605340 - RNA, 20 nt, Human
uucaagugauucucaugccu

SEQ ID NO: 2605341 - RNA, 22 nt, Human
uucaagugauucucaugccuca

SEQ ID NO: 2605342 - RNA, 20 nt, Human
uucaaggcaucaugcagagu

SEQ ID NO: 2605343 - RNA, 17 nt, Human
uucaaggccauccuucc

SEQ ID NO: 2605344 - RNA, 16 nt, Human
uucaaggccauccuuc

SEQ ID NO: 2605345 - RNA, 17 nt, Human
uucaaaaaguguuuauu

SEQ ID NO: 2605346 - RNA, 14 nt, Human
uucaaaaaguguuu

SEQ ID NO: 2605347 - RNA, 13 nt, Human
uucaaaaaguguu

SEQ ID NO: 2605348 - RNA, 15 nt, Human
uucaaaaauauaacu

SEQ ID NO: 2605349 - RNA, 17 nt, Human
uucaaaauaaaaaugag

SEQ ID NO: 2605350 - RNA, 23 nt, Human
uucaaaaacacaguguuuuugua

SEQ ID NO: 2605351 - RNA, 17 nt, Human
uucaaaaacacaguguu

SEQ ID NO: 2605352 - RNA, 18 nt, Human
uucaaaaaaauaaaauaa

SEQ ID NO: 2605353 - RNA, 18 nt, Human
uucaaaaaaacacuaguu

SEQ ID NO: 2605354 - RNA, 15 nt, Human
uucaaaaacuguauu

SEQ ID NO: 2605355 - RNA, 21 nt, Human
uucaaaaagucuacgcucucc

SEQ ID NO: 2605356 - RNA, 16 nt, Human
uucaaaaaacuuguaa

SEQ ID NO: 2605357 - RNA, 17 nt, Human
uucaaaaaaacacuagu

SEQ ID NO: 2605358 - RNA, 14 nt, Human
uucaaaaaaacacu

SEQ ID NO: 2605359 - RNA, 16 nt, Human
uuauuucucugauuug

SEQ ID NO: 2605360 - RNA, 12 nt, Human
uuauuucugcau

SEQ ID NO: 2605361 - RNA, 13 nt, Human
uuauuucugcaua

SEQ ID NO: 2605362 - RNA, 15 nt, Human
uuauuucugcauaug

SEQ ID NO: 2605363 - RNA, 20 nt, Human
uuauuucugcauauguugaa

SEQ ID NO: 2605364 - RNA, 22 nt, Human
uuauuucugcauauguugaaua

SEQ ID NO: 2605365 - RNA, 16 nt, Human
uuauuuuuuucugauu

SEQ ID NO: 2605366 - RNA, 15 nt, Human
uuauuuuuuucugau

SEQ ID NO: 2605367 - RNA, 19 nt, Human
uuauuucuaggaagaauuu

SEQ ID NO: 2605368 - RNA, 22 nt, Human
uuauuucucagacuuuggaaaa

SEQ ID NO: 2605369 - RNA, 14 nt, Human
uuauuucucugauu

SEQ ID NO: 2605370 - RNA, 21 nt, Human
uuauuuccuaguucuguagaa

SEQ ID NO: 2605371 - RNA, 17 nt, Human
uucaaaaugcuuuuuau

SEQ ID NO: 2605372 - RNA, 20 nt, Human
uucaaaaugcuuuuuauuau

SEQ ID NO: 2605373 - RNA, 16 nt, Human
uucaaaauauguucuu

SEQ ID NO: 2605374 - RNA, 16 nt, Human
uucaaaauggagggaa

SEQ ID NO: 2605375 - RNA, 14 nt, Human
uucaaaaugucugu

SEQ ID NO: 2605376 - RNA, 18 nt, Human
uucaaaaugucuguagcu

SEQ ID NO: 2605377 - RNA, 15 nt, Human
uucaaacuggggccu

SEQ ID NO: 2605378 - RNA, 16 nt, Human
uucaaacuggggccuc

SEQ ID NO: 2605379 - RNA, 21 nt, Human
uucaaacuggggccuccagaa

SEQ ID NO: 2605380 - RNA, 21 nt, Human
uucaacugccaaaaugcucua

SEQ ID NO: 2605381 - RNA, 15 nt, Human
uucaaacauauauaa

SEQ ID NO: 2605382 - RNA, 12 nt, Human
uucaccagagca

SEQ ID NO: 2605383 - RNA, 18 nt, Human
uucacauagcugucuaga

SEQ ID NO: 2605384 - RNA, 17 nt, Human
uucacauuuuuguauuu

SEQ ID NO: 2605385 - RNA, 19 nt, Human
uucaccagaggaaucacuc

SEQ ID NO: 2605386 - RNA, 18 nt, Human
uucaccagauuugcuaau

SEQ ID NO: 2605387 - RNA, 19 nt, Human
uucacauuuuccuuuucaa

SEQ ID NO: 2605388 - RNA, 22 nt, Human
uucaccacaugugcacaugcac

SEQ ID NO: 2605389 - RNA, 17 nt, Human
uucacauauugauuucc

SEQ ID NO: 2605390 - RNA, 19 nt, Human
uucacauuguauucagagu

SEQ ID NO: 2605391 - RNA, 15 nt, Human
uucacauagcugucu

SEQ ID NO: 2605392 - RNA, 18 nt, Human
uucacauccuguguuucu

SEQ ID NO: 2605393 - RNA, 10 nt, Human
uucacaggcg

SEQ ID NO: 2605394 - RNA, 19 nt, Human
uucacaggcgaggccugga

SEQ ID NO: 2605395 - RNA, 12 nt, Human
uucacaguguuu

SEQ ID NO: 2605396 - RNA, 19 nt, Human
uucacauaaaauagauuuu

SEQ ID NO: 2605397 - RNA, 13 nt, Human
uucacaguuuuuc

SEQ ID NO: 2605398 - RNA, 15 nt, Human
uucacauacccuccc

SEQ ID NO: 2605399 - RNA, 20 nt, Human
uucacauaagcucagaaucc

SEQ ID NO: 2605400 - RNA, 18 nt, Human
uucacauaagcucagaau

SEQ ID NO: 2605401 - RNA, 22 nt, Human
uucacaguguuucgacagcuga

SEQ ID NO: 2605402 - RNA, 17 nt, Human
uucacauagagaucauc

SEQ ID NO: 2605403 - RNA, 17 nt, Human
uucacauacccuccccc

SEQ ID NO: 2605404 - RNA, 19 nt, Human
uucacauagagaucauccu

SEQ ID NO: 2605405 - RNA, 17 nt, Human
uucacauagaugucccu

SEQ ID NO: 2605406 - RNA, 15 nt, Human
uucacagcuccuccc

SEQ ID NO: 2605407 - RNA, 13 nt, Human
uucacagcuccuc

SEQ ID NO: 2605408 - RNA, 21 nt, Human
uucaauaaaguauuuaauuag

SEQ ID NO: 2605409 - RNA, 17 nt, Human
uucacagcuccucccac

SEQ ID NO: 2605410 - RNA, 15 nt, Human
uucacagcucugugu

SEQ ID NO: 2605411 - RNA, 23 nt, Human
uucacagcucuguguugccaugu

SEQ ID NO: 2605412 - RNA, 20 nt, Human
uucaauaaagcauuuauaaa

SEQ ID NO: 2605413 - RNA, 13 nt, Human
uucaauaaaguau

SEQ ID NO: 2605414 - RNA, 12 nt, Human
uucaauaaagua

SEQ ID NO: 2605415 - RNA, 19 nt, Human
uucaauaaaguauuuaauu

SEQ ID NO: 2605416 - RNA, 18 nt, Human
uucaauaaaguauuuaau

SEQ ID NO: 2605417 - RNA, 14 nt, Human
uucaauaaaguauu

SEQ ID NO: 2605418 - RNA, 14 nt, Human
uucaauaaaguauc

SEQ ID NO: 2605419 - RNA, 19 nt, Human
uucaauaaaguaucuacau

SEQ ID NO: 2605420 - RNA, 17 nt, Human
auaggcacaggaaacca

SEQ ID NO: 2605421 - RNA, 22 nt, Human
auaggcaccuaccaccacgccc

SEQ ID NO: 2605422 - RNA, 18 nt, Human
auaggaaugugaaagcac

SEQ ID NO: 2605423 - RNA, 23 nt, Human
auaggaucauuuguuggaaugaa

SEQ ID NO: 2605424 - RNA, 17 nt, Human
auagggcugagcucucu

SEQ ID NO: 2605425 - RNA, 14 nt, Human
auagggcugagcuc

SEQ ID NO: 2605426 - RNA, 14 nt, Human
auagggucuaacuc

SEQ ID NO: 2605427 - RNA, 15 nt, Human
auagggagaaaccaa

SEQ ID NO: 2605428 - RNA, 14 nt, Human
auaggcuggagaag

SEQ ID NO: 2605429 - RNA, 13 nt, Human
auaggcuggagaa

SEQ ID NO: 2605430 - RNA, 22 nt, Human
auaggcucugcacagauggauu

SEQ ID NO: 2605431 - RNA, 18 nt, Human
auaggcuggagaagcuca

SEQ ID NO: 2605432 - RNA, 16 nt, Human
auaggcuggagaagcu

SEQ ID NO: 2605433 - RNA, 21 nt, Human
auaggcuggagaagcucaccc

SEQ ID NO: 2605434 - RNA, 20 nt, Human
auaggcagacuggguuucua

SEQ ID NO: 2605435 - RNA, 17 nt, Human
auaggcagacuggguuu

SEQ ID NO: 2605436 - RNA, 22 nt, Human
auaggccaaacuggcaaacuuc

SEQ ID NO: 2605437 - RNA, 19 nt, Human
auaggaacuuaaauaaugu

SEQ ID NO: 2605438 - RNA, 10 nt, Human
auagcuuuau

SEQ ID NO: 2605439 - RNA, 18 nt, Human
auagcuuuauuuuuuaag

SEQ ID NO: 2605440 - RNA, 19 nt, Human
auagcuuuauuuuuuaagu

SEQ ID NO: 2605441 - RNA, 21 nt, Human
auagcuuuauuuuuuaaguau

SEQ ID NO: 2605442 - RNA, 21 nt, Human
auaggaauugacccacaagaa

SEQ ID NO: 2605443 - RNA, 22 nt, Human
auagcuuuauuuuuuaaguauu

SEQ ID NO: 2605444 - RNA, 23 nt, Human
auagcuuuauuuuuuaaguauuu

SEQ ID NO: 2605445 - RNA, 22 nt, Human
uucaccauguuggccaggcugc

SEQ ID NO: 2605446 - RNA, 22 nt, Human
uucaccauguuggccaggcugg

SEQ ID NO: 2605447 - RNA, 24 nt, Human
uucaccauuuggcaaugccaucau

SEQ ID NO: 2605448 - RNA, 22 nt, Human
auagcuuacaagccagcuggag

SEQ ID NO: 2605449 - RNA, 21 nt, Human
auagcuucaccccaaucccag

SEQ ID NO: 2605450 - RNA, 20 nt, Human
auagcuuguauaguguaaaa

SEQ ID NO: 2605451 - RNA, 17 nt, Human
auagcuuguauagugua

SEQ ID NO: 2605452 - RNA, 14 nt, Human
auagcuuguauagu

SEQ ID NO: 2605453 - RNA, 23 nt, Human
auagcuugcgcauucucauggag

SEQ ID NO: 2605454 - RNA, 19 nt, Human
auagcuugcgcauucucau

SEQ ID NO: 2605455 - RNA, 22 nt, Human
auagcuucaccccaaucccagc

SEQ ID NO: 2605456 - RNA, 20 nt, Human
uucagcaaacucuuuuccca

SEQ ID NO: 2605457 - RNA, 13 nt, Human
uucagcaagacaa

SEQ ID NO: 2605458 - RNA, 19 nt, Human
uucagaugucuucugccug

SEQ ID NO: 2605459 - RNA, 18 nt, Human
uucagaugucuucugccu

SEQ ID NO: 2605460 - RNA, 17 nt, Human
uucagaugucuucugcc

SEQ ID NO: 2605461 - RNA, 14 nt, Human
uucagaugucuucu

SEQ ID NO: 2605462 - RNA, 23 nt, Human
uucagaugucuucugccuguuau

SEQ ID NO: 2605463 - RNA, 20 nt, Human
uucagaugucuucugccugu

SEQ ID NO: 2605464 - RNA, 15 nt, Human
uucagaugcuucugg

SEQ ID NO: 2605465 - RNA, 19 nt, Human
uucagaugcuucugggaga

SEQ ID NO: 2605466 - RNA, 17 nt, Human
uucagaucucuaacuuc

SEQ ID NO: 2605467 - RNA, 16 nt, Human
uucagaucauggcauc

SEQ ID NO: 2605468 - RNA, 17 nt, Human
uucagaucagugcuuga

SEQ ID NO: 2605469 - RNA, 15 nt, Human
uucagacaagcaaca

SEQ ID NO: 2605470 - RNA, 20 nt, Human
uucagacaagcaacagguuu

SEQ ID NO: 2605471 - RNA, 21 nt, Human
uucagacaagcaacagguuuu

SEQ ID NO: 2605472 - RNA, 21 nt, Human
uucagaaucacuucugagaac

SEQ ID NO: 2605473 - RNA, 19 nt, Human
uucagaaucacuucugaga

SEQ ID NO: 2605474 - RNA, 21 nt, Human
uucagccaucaacaagaguug

SEQ ID NO: 2605475 - RNA, 17 nt, Human
uucagccaggagcuggg

SEQ ID NO: 2605476 - RNA, 13 nt, Human
uucagcccaucuc

SEQ ID NO: 2605477 - RNA, 20 nt, Human
uucagcccauauuucaucgu

SEQ ID NO: 2605478 - RNA, 13 nt, Human
uucagccccuccu

SEQ ID NO: 2605479 - RNA, 11 nt, Human
uucagccaagg

SEQ ID NO: 2605480 - RNA, 18 nt, Human
uucagccaccagccccug

SEQ ID NO: 2605481 - RNA, 13 nt, Human
uucagccaggagc

SEQ ID NO: 2605482 - RNA, 12 nt, Human
uucagccaggag

SEQ ID NO: 2605483 - RNA, 16 nt, Human
uucagcccucaccccu

SEQ ID NO: 2605484 - RNA, 12 nt, Human
uucagcccucac

SEQ ID NO: 2605485 - RNA, 14 nt, Human
uucagccccuccuc

SEQ ID NO: 2605486 - RNA, 15 nt, Human
uucagccccuccucu

SEQ ID NO: 2605487 - RNA, 16 nt, Human
uucagccccuccucug

SEQ ID NO: 2605488 - RNA, 17 nt, Human
uucagccccuccucugc

SEQ ID NO: 2605489 - RNA, 18 nt, Human
uucagccccuccucugcc

SEQ ID NO: 2605490 - RNA, 19 nt, Human
uucagccccuccucugcca

SEQ ID NO: 2605491 - RNA, 20 nt, Human
uucagccccuccucugccac

SEQ ID NO: 2605492 - RNA, 23 nt, Human
uucagccccuccucugccaccuc

SEQ ID NO: 2605493 - RNA, 19 nt, Human
uucagccaagaauucuuaa

SEQ ID NO: 2605494 - RNA, 13 nt, Human
uucagcacugucc

SEQ ID NO: 2605495 - RNA, 14 nt, Human
uucagccaagaauu

SEQ ID NO: 2605496 - RNA, 16 nt, Human
uucagcaccacccuag

SEQ ID NO: 2605497 - RNA, 22 nt, Human
uucagcaccuacaguguacagu

SEQ ID NO: 2605498 - RNA, 23 nt, Human
uucagcaccuacaguguacaguc

SEQ ID NO: 2605499 - RNA, 16 nt, Human
uucacuggaguuacau

SEQ ID NO: 2605500 - RNA, 23 nt, Human
uucacugcugcaaggccuuucug

SEQ ID NO: 2605501 - RNA, 19 nt, Human
uucacugcugcaaggccuu

SEQ ID NO: 2605502 - RNA, 13 nt, Human
uucacugcugcaa

SEQ ID NO: 2605503 - RNA, 19 nt, Human
uucacugcuggcugccuua

SEQ ID NO: 2605504 - RNA, 18 nt, Human
uucacugcuggcugccuu

SEQ ID NO: 2605505 - RNA, 17 nt, Human
uucacugcuggcugccu

SEQ ID NO: 2605506 - RNA, 16 nt, Human
uucacugcuggcugcc

SEQ ID NO: 2605507 - RNA, 15 nt, Human
uucacugcuggcugc

SEQ ID NO: 2605508 - RNA, 13 nt, Human
uucacugcuggcu

SEQ ID NO: 2605509 - RNA, 12 nt, Human
uucacugcugca

SEQ ID NO: 2605510 - RNA, 16 nt, Human
uucacugccuuugcuc

SEQ ID NO: 2605511 - RNA, 13 nt, Human
uucacugccccca

SEQ ID NO: 2605512 - RNA, 20 nt, Human
uucacugcauggcucccaca

SEQ ID NO: 2605513 - RNA, 14 nt, Human
auauauauaaaccu

SEQ ID NO: 2605514 - RNA, 13 nt, Human
auauauauaaacc

SEQ ID NO: 2605515 - RNA, 12 nt, Human
auauauauaaac

SEQ ID NO: 2605516 - RNA, 11 nt, Human
auauauauaaa

SEQ ID NO: 2605517 - RNA, 13 nt, Human
auauauagaaucu

SEQ ID NO: 2605518 - RNA, 22 nt, Human
auauauacauagcaugacauuu

SEQ ID NO: 2605519 - RNA, 23 nt, Human
auauauacaguaacuuuaugugu

SEQ ID NO: 2605520 - RNA, 21 nt, Human
auauauacaguaacuuuaugu

SEQ ID NO: 2605521 - RNA, 20 nt, Human
auauauacaguaacuuuaug

SEQ ID NO: 2605522 - RNA, 14 nt, Human
auauauacauauau

SEQ ID NO: 2605523 - RNA, 20 nt, Human
uucagaaaauauuauguguu

SEQ ID NO: 2605524 - RNA, 14 nt, Human
uucagaaaauauua

SEQ ID NO: 2605525 - RNA, 16 nt, Human
uucacuguauaaauag

SEQ ID NO: 2605526 - RNA, 15 nt, Human
uucacuguauaaaua

SEQ ID NO: 2605527 - RNA, 13 nt, Human
uucacuguauaaa

SEQ ID NO: 2605528 - RNA, 13 nt, Human
uucagaaaauauu

SEQ ID NO: 2605529 - RNA, 19 nt, Human
uucacuggaguuacauuaa

SEQ ID NO: 2605530 - RNA, 17 nt, Human
uucacuggaguuacauu

SEQ ID NO: 2605531 - RNA, 20 nt, Human
uucacuggccacaguuguuu

SEQ ID NO: 2605532 - RNA, 15 nt, Human
uucacuguagaauga

SEQ ID NO: 2605533 - RNA, 22 nt, Human
uucacuguagaaugauuucaug

SEQ ID NO: 2605534 - RNA, 20 nt, Human
uucacuguaagacucauucc

SEQ ID NO: 2605535 - RNA, 13 nt, Human
uucacuggcccaa

SEQ ID NO: 2605536 - RNA, 21 nt, Human
uucagaaaauauuauguguuu

SEQ ID NO: 2605537 - RNA, 19 nt, Human
uucacuguauaaauaggag

SEQ ID NO: 2605538 - RNA, 18 nt, Human
uucacuguauaaauagga

SEQ ID NO: 2605539 - RNA, 19 nt, Human
uucagaaagcauuacauuu

SEQ ID NO: 2605540 - RNA, 13 nt, Human
uucagaaagcauu

SEQ ID NO: 2605541 - RNA, 15 nt, Human
uucagaaagaagugg

SEQ ID NO: 2605542 - RNA, 23 nt, Human
uucagaagugagcuuugcugcua

SEQ ID NO: 2605543 - RNA, 22 nt, Human
uucagaagugagcuuugcugcu

SEQ ID NO: 2605544 - RNA, 16 nt, Human
uucagaaggggagggg

SEQ ID NO: 2605545 - RNA, 21 nt, Human
uucagaagugagcuuugcugc

SEQ ID NO: 2605546 - RNA, 12 nt, Human
uucagaagagau

SEQ ID NO: 2605547 - RNA, 20 nt, Human
uucagaaguuuggcaauagu

SEQ ID NO: 2605548 - RNA, 15 nt, Human
uucagaaucacuucu

SEQ ID NO: 2605549 - RNA, 23 nt, Human
uucagaaguuuggcaauaguuug

SEQ ID NO: 2605550 - RNA, 21 nt, Human
auauagguuuuguuugcuauc

SEQ ID NO: 2605551 - RNA, 20 nt, Human
auauagguuuuguuugcuau

SEQ ID NO: 2605552 - RNA, 19 nt, Human
auauagguuuuguuugcua

SEQ ID NO: 2605553 - RNA, 18 nt, Human
auauagguuuuguuugcu

SEQ ID NO: 2605554 - RNA, 16 nt, Human
auauagguugugcaaa

SEQ ID NO: 2605555 - RNA, 15 nt, Human
auauagguugugcaa

SEQ ID NO: 2605556 - RNA, 22 nt, Human
auauagguugugcaaauuaaca

SEQ ID NO: 2605557 - RNA, 14 nt, Human
auauagguuuuguu

SEQ ID NO: 2605558 - RNA, 13 nt, Human
auauaguuuuacu

SEQ ID NO: 2605559 - RNA, 16 nt, Human
auauaguuuuacuuuu

SEQ ID NO: 2605560 - RNA, 18 nt, Human
auauaguuuuacuuuuaa

SEQ ID NO: 2605561 - RNA, 23 nt, Human
auauaguuuuacuuuuaaacugu

SEQ ID NO: 2605562 - RNA, 12 nt, Human
auauaguuuuac

SEQ ID NO: 2605563 - RNA, 16 nt, Human
auauaguuuacuauuu

SEQ ID NO: 2605564 - RNA, 23 nt, Human
auauagguuuuguuugcuaucuu

SEQ ID NO: 2605565 - RNA, 18 nt, Human
auauauaacaaugcugua

SEQ ID NO: 2605566 - RNA, 17 nt, Human
auauauaacaaugcugu

SEQ ID NO: 2605567 - RNA, 19 nt, Human
auauauaacaaugcuguau

SEQ ID NO: 2605568 - RNA, 19 nt, Human
auauauaaaaagaaaagau

SEQ ID NO: 2605569 - RNA, 18 nt, Human
auauauacaguaacuuua

SEQ ID NO: 2605570 - RNA, 10 nt, Human
auauauaaaa

SEQ ID NO: 2605571 - RNA, 16 nt, Human
auauauacaguaacuu

SEQ ID NO: 2605572 - RNA, 19 nt, Human
auauaagcuuguauuccuu

SEQ ID NO: 2605573 - RNA, 17 nt, Human
auauaacaaugcuguau

SEQ ID NO: 2605574 - RNA, 14 nt, Human
auauaagaauaaaa

SEQ ID NO: 2605575 - RNA, 23 nt, Human
auauaaggaaagcaauaaaugaa

SEQ ID NO: 2605576 - RNA, 15 nt, Human
auauaacaaugcugu

SEQ ID NO: 2605577 - RNA, 12 nt, Human
auauaacaaugc

SEQ ID NO: 2605578 - RNA, 22 nt, Human
auauaaauuuuuuuuguuucau

SEQ ID NO: 2605579 - RNA, 17 nt, Human
auauaaauuuuuuuugu

SEQ ID NO: 2605580 - RNA, 15 nt, Human
auauaaauggcuggu

SEQ ID NO: 2605581 - RNA, 22 nt, Human
auauaaaugcuuuuaaaaaucu

SEQ ID NO: 2605582 - RNA, 18 nt, Human
auauaaauggcugguuuu

SEQ ID NO: 2605583 - RNA, 18 nt, Human
auagucaaauugugugaa

SEQ ID NO: 2605584 - RNA, 17 nt, Human
auagucaaauuguguga

SEQ ID NO: 2605585 - RNA, 22 nt, Human
auagucaagaaaaauuauugua

SEQ ID NO: 2605586 - RNA, 19 nt, Human
auagucaauguuucuuuua

SEQ ID NO: 2605587 - RNA, 22 nt, Human
auagucauguaagcugaaaaua

SEQ ID NO: 2605588 - RNA, 14 nt, Human
auagucacaagagc

SEQ ID NO: 2605589 - RNA, 21 nt, Human
auagucaagaaaaauuauugu

SEQ ID NO: 2605590 - RNA, 21 nt, Human
auagggucucuucagguucuu

SEQ ID NO: 2605591 - RNA, 22 nt, Human
auagggccuggucccugggagg

SEQ ID NO: 2605592 - RNA, 16 nt, Human
auagggucucuucagg

SEQ ID NO: 2605593 - RNA, 15 nt, Human
auaguuuguacaugc

SEQ ID NO: 2605594 - RNA, 13 nt, Human
auaguuuguacau

SEQ ID NO: 2605595 - RNA, 15 nt, Human
auaguuuuacuuuua

SEQ ID NO: 2605596 - RNA, 21 nt, Human
auaguuuuacuuuuaaacugu

SEQ ID NO: 2605597 - RNA, 22 nt, Human
auaguuuuacuuuuaaacugug

SEQ ID NO: 2605598 - RNA, 17 nt, Human
auaguccagcuuuguuc

SEQ ID NO: 2605599 - RNA, 21 nt, Human
auaguuucagauauauaucau

SEQ ID NO: 2605600 - RNA, 14 nt, Human
auaguuucagauau

SEQ ID NO: 2605601 - RNA, 22 nt, Human
auauaaaugcaauauuaaugcc

SEQ ID NO: 2605602 - RNA, 23 nt, Human
auauaaauggcugguuuuuagaa

SEQ ID NO: 2605603 - RNA, 17 nt, Human
auauaaaugguuaaaag

SEQ ID NO: 2605604 - RNA, 21 nt, Human
auauaaauauauauaaauaua

SEQ ID NO: 2605605 - RNA, 20 nt, Human
auauaaauauauauaaauau

SEQ ID NO: 2605606 - RNA, 23 nt, Human
auauaaauauauauauauauaaa

SEQ ID NO: 2605607 - RNA, 22 nt, Human
auauaaauauuagaaacagcuu

SEQ ID NO: 2605608 - RNA, 16 nt, Human
auauaaauauuagaaa

SEQ ID NO: 2605609 - RNA, 21 nt, Human
auauaaaccuaaaaaagauau

SEQ ID NO: 2605610 - RNA, 20 nt, Human
auauaaaccuaaaaaagaua

SEQ ID NO: 2605611 - RNA, 17 nt, Human
auauaaauauauauaaa

SEQ ID NO: 2605612 - RNA, 15 nt, Human
auauaaauauauaua

SEQ ID NO: 2605613 - RNA, 24 nt, Human
auauaaaauaaauauauauaaacc

SEQ ID NO: 2605614 - RNA, 21 nt, Human
auauaaaauaaauauauauaa

SEQ ID NO: 2605615 - RNA, 18 nt, Human
auauaaaauaaauauaua

SEQ ID NO: 2605616 - RNA, 14 nt, Human
auauaaaauaugaa

SEQ ID NO: 2605617 - RNA, 16 nt, Human
auauaaaauaaauaua

SEQ ID NO: 2605618 - RNA, 15 nt, Human
auauaaaauaaauau

SEQ ID NO: 2605619 - RNA, 23 nt, Human
auauaaaaggcaaauguguacau

SEQ ID NO: 2605620 - RNA, 21 nt, Human
auauaaaaggcaaauguguac

SEQ ID NO: 2605621 - RNA, 23 nt, Human
auaguuuuacuuuuaaacugugu

SEQ ID NO: 2605622 - RNA, 16 nt, Human
auaguuuuauuaauaa

SEQ ID NO: 2605623 - RNA, 13 nt, Human
auauaaaauauuu

SEQ ID NO: 2605624 - RNA, 19 nt, Human
auauaaaccuaaaaaagau

SEQ ID NO: 2605625 - RNA, 14 nt, Human
auauaaaccuaaaa

SEQ ID NO: 2605626 - RNA, 15 nt, Human
auauaaacacuauau

SEQ ID NO: 2605627 - RNA, 13 nt, Human
auauaaacacuau

SEQ ID NO: 2605628 - RNA, 22 nt, Human
uucagggaauuucaggaacuag

SEQ ID NO: 2605629 - RNA, 18 nt, Human
uucagggcagggcucuga

SEQ ID NO: 2605630 - RNA, 16 nt, Human
uucaggggacucagcc

SEQ ID NO: 2605631 - RNA, 17 nt, Human
uucaggggacucagccc

SEQ ID NO: 2605632 - RNA, 19 nt, Human
uucaggggacucagcccug

SEQ ID NO: 2605633 - RNA, 20 nt, Human
uucaggggacucagcccuga

SEQ ID NO: 2605634 - RNA, 23 nt, Human
uucagcccuaaaucuagacucaa

SEQ ID NO: 2605635 - RNA, 20 nt, Human
uucagccuagccgaccucag

SEQ ID NO: 2605636 - RNA, 21 nt, Human
uucagccuagccgaccucagc

SEQ ID NO: 2605637 - RNA, 22 nt, Human
uucagccuagccgaccucagcc

SEQ ID NO: 2605638 - RNA, 15 nt, Human
uucagccucuuucug

SEQ ID NO: 2605639 - RNA, 12 nt, Human
uucagccucugg

SEQ ID NO: 2605640 - RNA, 23 nt, Human
uucagccuagccgaccucagccu

SEQ ID NO: 2605641 - RNA, 20 nt, Human
uucaguaauaaacuguguuu

SEQ ID NO: 2605642 - RNA, 15 nt, Human
uucagggugaugcca

SEQ ID NO: 2605643 - RNA, 16 nt, Human
uucaggguccugagau

SEQ ID NO: 2605644 - RNA, 22 nt, Human
uucaguacccucucagcuccag

SEQ ID NO: 2605645 - RNA, 21 nt, Human
uucaguacccucucagcucca

SEQ ID NO: 2605646 - RNA, 14 nt, Human
uucaguaauaacuc

SEQ ID NO: 2605647 - RNA, 21 nt, Human
uucaggggagucccgucagga

SEQ ID NO: 2605648 - RNA, 23 nt, Human
uucaggggacucagcccugaggu

SEQ ID NO: 2605649 - RNA, 22 nt, Human
uucaggggcugcccgcucccag

SEQ ID NO: 2605650 - RNA, 13 nt, Human
uucagggggccag

SEQ ID NO: 2605651 - RNA, 21 nt, Human
uucagggggguugugaggccu

SEQ ID NO: 2605652 - RNA, 23 nt, Human
uucaggggcugcccgcucccagu

SEQ ID NO: 2605653 - RNA, 22 nt, Human
uucagggggccaggugcacaga

SEQ ID NO: 2605654 - RNA, 22 nt, Human
uucagggggguugugaggccug

SEQ ID NO: 2605655 - RNA, 13 nt, Human
uucagggucauag

SEQ ID NO: 2605656 - RNA, 17 nt, Human
uucauagacccucucaa

SEQ ID NO: 2605657 - RNA, 13 nt, Human
uucauagcccagu

SEQ ID NO: 2605658 - RNA, 19 nt, Human
uucauagcuaagaaauaaa

SEQ ID NO: 2605659 - RNA, 14 nt, Human
uucauagauuuccu

SEQ ID NO: 2605660 - RNA, 16 nt, Human
uucauauuuacuucuu

SEQ ID NO: 2605661 - RNA, 21 nt, Human
uucauauuuacuucuuauaca

SEQ ID NO: 2605662 - RNA, 16 nt, Human
uucauaccuacaugua

SEQ ID NO: 2605663 - RNA, 19 nt, Human
uucauaccuacauguauuu

SEQ ID NO: 2605664 - RNA, 17 nt, Human
uucauacucuagauuuu

SEQ ID NO: 2605665 - RNA, 14 nt, Human
uucauacucuagau

SEQ ID NO: 2605666 - RNA, 17 nt, Human
uucaguauguugucaaa

SEQ ID NO: 2605667 - RNA, 16 nt, Human
uucauagacccucuca

SEQ ID NO: 2605668 - RNA, 17 nt, Human
uucaguauuuuggagaa

SEQ ID NO: 2605669 - RNA, 19 nt, Human
uucaguauguugucaaaga

SEQ ID NO: 2605670 - RNA, 20 nt, Human
uucaguauaauuuaacuuca

SEQ ID NO: 2605671 - RNA, 23 nt, Human
uucaguauaauuuaacuucagag

SEQ ID NO: 2605672 - RNA, 23 nt, Human
uucaguaccuggaggaggagcag

SEQ ID NO: 2605673 - RNA, 16 nt, Human
uucaguaccuggagga

SEQ ID NO: 2605674 - RNA, 15 nt, Human
uucaguaccuggagg

SEQ ID NO: 2605675 - RNA, 17 nt, Human
uucaguaccuggaggag

SEQ ID NO: 2605676 - RNA, 16 nt, Human
uucaguauaauuuaac

SEQ ID NO: 2605677 - RNA, 22 nt, Human
auauauuaaaaauauaaaacug

SEQ ID NO: 2605678 - RNA, 18 nt, Human
auauauuaaaaauauaaa

SEQ ID NO: 2605679 - RNA, 17 nt, Human
auauauuaaaaauauaa

SEQ ID NO: 2605680 - RNA, 16 nt, Human
auauauuaaaaauaua

SEQ ID NO: 2605681 - RNA, 17 nt, Human
auauauguuuuugaagg

SEQ ID NO: 2605682 - RNA, 18 nt, Human
auauauguuuuugaaggc

SEQ ID NO: 2605683 - RNA, 18 nt, Human
uucauccaauccucacug

SEQ ID NO: 2605684 - RNA, 20 nt, Human
uucauccaauccucacuggg

SEQ ID NO: 2605685 - RNA, 21 nt, Human
uucauccaauccucacugggu

SEQ ID NO: 2605686 - RNA, 22 nt, Human
uucauccaauccucacugggug

SEQ ID NO: 2605687 - RNA, 16 nt, Human
uucauccaauccucac

SEQ ID NO: 2605688 - RNA, 21 nt, Human
uucaucauccuaagcuauuca

SEQ ID NO: 2605689 - RNA, 18 nt, Human
uucaucauccuaagcuau

SEQ ID NO: 2605690 - RNA, 22 nt, Human
auaucuaaauugaauaauggua

SEQ ID NO: 2605691 - RNA, 14 nt, Human
auaucuaaauuuag

SEQ ID NO: 2605692 - RNA, 18 nt, Human
auaucuaaauugaauaau

SEQ ID NO: 2605693 - RNA, 17 nt, Human
auaucuaaauugaauaa

SEQ ID NO: 2605694 - RNA, 20 nt, Human
auaucuaauuauuuugcagu

SEQ ID NO: 2605695 - RNA, 18 nt, Human
auauauucagccuggcuu

SEQ ID NO: 2605696 - RNA, 14 nt, Human
auaucuaaauugaa

SEQ ID NO: 2605697 - RNA, 13 nt, Human
auaucuaaauuga

SEQ ID NO: 2605698 - RNA, 17 nt, Human
auaucgacuuguuuuug

SEQ ID NO: 2605699 - RNA, 14 nt, Human
auauccuuugccuc

SEQ ID NO: 2605700 - RNA, 15 nt, Human
auaucugaaauguga

SEQ ID NO: 2605701 - RNA, 20 nt, Human
auaucugccuuuauuguguu

SEQ ID NO: 2605702 - RNA, 18 nt, Human
auaucugccuuuauugug

SEQ ID NO: 2605703 - RNA, 16 nt, Human
auaucugccuuuauug

SEQ ID NO: 2605704 - RNA, 14 nt, Human
auaucugccuuuau

SEQ ID NO: 2605705 - RNA, 22 nt, Human
auaucugaaaauguauguguaa

SEQ ID NO: 2605706 - RNA, 20 nt, Human
auaucuaucuuauauaguuu

SEQ ID NO: 2605707 - RNA, 21 nt, Human
auaucuaucuuauauaguuua

SEQ ID NO: 2605708 - RNA, 13 nt, Human
auaucuaucuuau

SEQ ID NO: 2605709 - RNA, 14 nt, Human
auaucuaucuuaua

SEQ ID NO: 2605710 - RNA, 24 nt, Human
auaucuguauuuaauuuugacacu

SEQ ID NO: 2605711 - RNA, 18 nt, Human
auaucuguauuuaauuuu

SEQ ID NO: 2605712 - RNA, 15 nt, Human
auaucuguauauaaa

SEQ ID NO: 2605713 - RNA, 20 nt, Human
auaucuguauuuaauuuuga

SEQ ID NO: 2605714 - RNA, 15 nt, Human
auaucuggacaagcc

SEQ ID NO: 2605715 - RNA, 16 nt, Human
auaucugcuucagugg

SEQ ID NO: 2605716 - RNA, 13 nt, Human
auaucugcuucag

SEQ ID NO: 2605717 - RNA, 21 nt, Human
auaucugggauucuacuuuaa

SEQ ID NO: 2605718 - RNA, 17 nt, Human
auaucugggauucuacu

SEQ ID NO: 2605719 - RNA, 11 nt, Human
auaucugcugu

SEQ ID NO: 2605720 - RNA, 23 nt, Human
auaucugccuuuauuguguuugu

SEQ ID NO: 2605721 - RNA, 18 nt, Human
auaucugcuguccagaca

SEQ ID NO: 2605722 - RNA, 13 nt, Human
auaucugcugucc

SEQ ID NO: 2605723 - RNA, 12 nt, Human
auaucugcuguc

SEQ ID NO: 2605724 - RNA, 20 nt, Human
auaugauuuaaaucagccgu

SEQ ID NO: 2605725 - RNA, 15 nt, Human
auaucuugaaaugaa

SEQ ID NO: 2605726 - RNA, 19 nt, Human
auaucuucugauuuguccc

SEQ ID NO: 2605727 - RNA, 16 nt, Human
auaugcaaagcacuga

SEQ ID NO: 2605728 - RNA, 15 nt, Human
auaugauucugcuuu

SEQ ID NO: 2605729 - RNA, 13 nt, Human
auaugauuuaaaa

SEQ ID NO: 2605730 - RNA, 23 nt, Human
auaugcaaagcacugacuucuaa

SEQ ID NO: 2605731 - RNA, 16 nt, Human
auaugauuuaaaacau

SEQ ID NO: 2605732 - RNA, 15 nt, Human
auaugauuuaaaaca

SEQ ID NO: 2605733 - RNA, 20 nt, Human
auaugauuuaaaacauguaa

SEQ ID NO: 2605734 - RNA, 15 nt, Human
auaugcacaauagca

SEQ ID NO: 2605735 - RNA, 19 nt, Human
auaugcacacagugcuuuc

SEQ ID NO: 2605736 - RNA, 16 nt, Human
auauguauuaauauuc

SEQ ID NO: 2605737 - RNA, 16 nt, Human
auauguauguguguau

SEQ ID NO: 2605738 - RNA, 15 nt, Human
auauguaugugugua

SEQ ID NO: 2605739 - RNA, 16 nt, Human
auaugcaaugugaagc

SEQ ID NO: 2605740 - RNA, 21 nt, Human
auauguauuguaaacaugugu

SEQ ID NO: 2605741 - RNA, 14 nt, Human
auauguauuguaaa

SEQ ID NO: 2605742 - RNA, 14 nt, Human
auaugucaagccau

SEQ ID NO: 2605743 - RNA, 16 nt, Human
auaugugaacauuuau

SEQ ID NO: 2605744 - RNA, 21 nt, Human
uucauggacacuuugaaaugu

SEQ ID NO: 2605745 - RNA, 11 nt, Human
auauguccugg

SEQ ID NO: 2605746 - RNA, 14 nt, Human
auaugucagggcgu

SEQ ID NO: 2605747 - RNA, 19 nt, Human
uucauguaaacugugcacc

SEQ ID NO: 2605748 - RNA, 18 nt, Human
uucauguaauccucaaga

SEQ ID NO: 2605749 - RNA, 21 nt, Human
uucauguacaagaugaaggag

SEQ ID NO: 2605750 - RNA, 22 nt, Human
uucaugucaacuucuggcuccu

SEQ ID NO: 2605751 - RNA, 17 nt, Human
uucauguacaagaugaa

SEQ ID NO: 2605752 - RNA, 19 nt, Human
uucauguaaacaaaauuua

SEQ ID NO: 2605753 - RNA, 19 nt, Human
uucauggugaaaauguacu

SEQ ID NO: 2605754 - RNA, 14 nt, Human
uucauguaaacugu

SEQ ID NO: 2605755 - RNA, 17 nt, Human
uucauguaaacugugca

SEQ ID NO: 2605756 - RNA, 18 nt, Human
uucauguaaacugugcac

SEQ ID NO: 2605757 - RNA, 17 nt, Human
uucauggcagaaggcaa

SEQ ID NO: 2605758 - RNA, 13 nt, Human
auaugugaacauu

SEQ ID NO: 2605759 - RNA, 21 nt, Human
uucauggggugaugcugggcu

SEQ ID NO: 2605760 - RNA, 22 nt, Human
uuguaaguuucaggugacaugu

SEQ ID NO: 2605761 - RNA, 19 nt, Human
uuguaaguuucaggugaca

SEQ ID NO: 2605762 - RNA, 18 nt, Human
uuguaaguuucaggugac

SEQ ID NO: 2605763 - RNA, 17 nt, Human
uuguaaguuucagguga

SEQ ID NO: 2605764 - RNA, 16 nt, Human
uuguaaguuucaggug

SEQ ID NO: 2605765 - RNA, 17 nt, Human
uuguaagaugcuggguu

SEQ ID NO: 2605766 - RNA, 13 nt, Human
uuguaaguuucag

SEQ ID NO: 2605767 - RNA, 22 nt, Human
uuguaagaguguagaagcauuc

SEQ ID NO: 2605768 - RNA, 21 nt, Human
uuguaagaguguagaagcauu

SEQ ID NO: 2605769 - RNA, 19 nt, Human
uuguaagaguguagaagca

SEQ ID NO: 2605770 - RNA, 17 nt, Human
uuguaagaguguagaag

SEQ ID NO: 2605771 - RNA, 15 nt, Human
uuguaagaugcuggg

SEQ ID NO: 2605772 - RNA, 13 nt, Human
uuguaagaugcug

SEQ ID NO: 2605773 - RNA, 18 nt, Human
uuguaauugcuuacauuu

SEQ ID NO: 2605774 - RNA, 17 nt, Human
uuguaauugcuuacauu

SEQ ID NO: 2605775 - RNA, 19 nt, Human
uuguaauugcuuacauuuu

SEQ ID NO: 2605776 - RNA, 23 nt, Human
uuguaauucuaaaugaauguuua

SEQ ID NO: 2605777 - RNA, 22 nt, Human
uuguaauuuaaacaggcccagc

SEQ ID NO: 2605778 - RNA, 21 nt, Human
uuguaauuuaaacaggcccag

SEQ ID NO: 2605779 - RNA, 23 nt, Human
uuguaauuuaaacaggcccagca

SEQ ID NO: 2605780 - RNA, 18 nt, Human
uuguaauuauugugauuu

SEQ ID NO: 2605781 - RNA, 14 nt, Human
uuguaauuauugug

SEQ ID NO: 2605782 - RNA, 17 nt, Human
uuguaauucuaaaugaa

SEQ ID NO: 2605783 - RNA, 14 nt, Human
uuguaauucuaaau

SEQ ID NO: 2605784 - RNA, 12 nt, Human
uuguaauuauug

SEQ ID NO: 2605785 - RNA, 14 nt, Human
uuguaaucacuguu

SEQ ID NO: 2605786 - RNA, 15 nt, Human
uuguaaucguuaugu

SEQ ID NO: 2605787 - RNA, 20 nt, Human
uuguaaucguuaugugugua

SEQ ID NO: 2605788 - RNA, 20 nt, Human
uuguaaccucagcucuggga

SEQ ID NO: 2605789 - RNA, 19 nt, Human
uuguaaccucagcucuggg

SEQ ID NO: 2605790 - RNA, 18 nt, Human
uuguaaccucagcucugg

SEQ ID NO: 2605791 - RNA, 16 nt, Human
uuguaaccucagcucu

SEQ ID NO: 2605792 - RNA, 16 nt, Human
uuguaacguugcugug

SEQ ID NO: 2605793 - RNA, 15 nt, Human
uuguaacguugcugu

SEQ ID NO: 2605794 - RNA, 17 nt, Human
uuguaacagacauuguu

SEQ ID NO: 2605795 - RNA, 16 nt, Human
uuguaacagacauugu

SEQ ID NO: 2605796 - RNA, 16 nt, Human
uuguaacccagauuuu

SEQ ID NO: 2605797 - RNA, 15 nt, Human
uuguaaccucagcuc

SEQ ID NO: 2605798 - RNA, 14 nt, Human
uuguaaccucagcu

SEQ ID NO: 2605799 - RNA, 22 nt, Human
uuguaacccagauuuugcugua

SEQ ID NO: 2605800 - RNA, 18 nt, Human
uuguaagacaaagguuuu

SEQ ID NO: 2605801 - RNA, 21 nt, Human
uuguaagacaaagguuuuccu

SEQ ID NO: 2605802 - RNA, 17 nt, Human
uuguaagaaauacugua

SEQ ID NO: 2605803 - RNA, 19 nt, Human
uuguaagacaauccaugua

SEQ ID NO: 2605804 - RNA, 16 nt, Human
uuguaagacaauccau

SEQ ID NO: 2605805 - RNA, 22 nt, Human
uuguaagacaaagguuuuccuc

SEQ ID NO: 2605806 - RNA, 20 nt, Human
uuguaagaguggaaccaaca

SEQ ID NO: 2605807 - RNA, 15 nt, Human
uuguaagaguguaga

SEQ ID NO: 2605808 - RNA, 15 nt, Human
uugguuuugacugga

SEQ ID NO: 2605809 - RNA, 19 nt, Human
uuguaaauuuaugugaugg

SEQ ID NO: 2605810 - RNA, 15 nt, Human
uuguaacagacauug

SEQ ID NO: 2605811 - RNA, 14 nt, Human
uuguaacagacauu

SEQ ID NO: 2605812 - RNA, 13 nt, Human
uuguaaauuguca

SEQ ID NO: 2605813 - RNA, 13 nt, Human
uugguuuugacug

SEQ ID NO: 2605814 - RNA, 18 nt, Human
augaaugucagugugacu

SEQ ID NO: 2605815 - RNA, 16 nt, Human
augaaugucaguguga

SEQ ID NO: 2605816 - RNA, 18 nt, Human
uugggguggguauaaaag

SEQ ID NO: 2605817 - RNA, 16 nt, Human
uugggguuguguuguc

SEQ ID NO: 2605818 - RNA, 15 nt, Human
uugggguuguguugu

SEQ ID NO: 2605819 - RNA, 20 nt, Human
uugggguggguauaaaagau

SEQ ID NO: 2605820 - RNA, 18 nt, Human
uuggguaccuauuuucau

SEQ ID NO: 2605821 - RNA, 14 nt, Human
uuggguaggcggga

SEQ ID NO: 2605822 - RNA, 19 nt, Human
uugggucaccccuccagga

SEQ ID NO: 2605823 - RNA, 18 nt, Human
uuggugguuucagaaaug

SEQ ID NO: 2605824 - RNA, 19 nt, Human
uuggugguuucagaaaugu

SEQ ID NO: 2605825 - RNA, 14 nt, Human
uuggguccuggguc

SEQ ID NO: 2605826 - RNA, 16 nt, Human
uugggguuuuuuaaua

SEQ ID NO: 2605827 - RNA, 19 nt, Human
uuggguggagaagccauug

SEQ ID NO: 2605828 - RNA, 18 nt, Human
uuggguggagaagccauu

SEQ ID NO: 2605829 - RNA, 17 nt, Human
uuggguggagaagccau

SEQ ID NO: 2605830 - RNA, 16 nt, Human
uuggguggagaagcca

SEQ ID NO: 2605831 - RNA, 15 nt, Human
uuggguggagaagcc

SEQ ID NO: 2605832 - RNA, 14 nt, Human
uuggguggagaagc

SEQ ID NO: 2605833 - RNA, 19 nt, Human
uuggugucgggcaugacac

SEQ ID NO: 2605834 - RNA, 18 nt, Human
uuggugucgggcaugaca

SEQ ID NO: 2605835 - RNA, 17 nt, Human
uuggugucgggcaugac

SEQ ID NO: 2605836 - RNA, 20 nt, Human
uugguguaaagccaacaccc

SEQ ID NO: 2605837 - RNA, 12 nt, Human
uuggugguuuuu

SEQ ID NO: 2605838 - RNA, 14 nt, Human
uugguuuguaaauu

SEQ ID NO: 2605839 - RNA, 20 nt, Human
uugguuuggccaucucugga

SEQ ID NO: 2605840 - RNA, 18 nt, Human
uugguuugcagaugacaa

SEQ ID NO: 2605841 - RNA, 16 nt, Human
uugguguguggagaug

SEQ ID NO: 2605842 - RNA, 13 nt, Human
uugguguugacau

SEQ ID NO: 2605843 - RNA, 23 nt, Human
augaaauuuucuagacuuucugu

SEQ ID NO: 2605844 - RNA, 21 nt, Human
augaaauuuucuagacuuucu

SEQ ID NO: 2605845 - RNA, 19 nt, Human
augaaauuuucuagacuuu

SEQ ID NO: 2605846 - RNA, 22 nt, Human
augaaauuuucuagacuuucug

SEQ ID NO: 2605847 - RNA, 21 nt, Human
augaaauuuaauauagcuauu

SEQ ID NO: 2605848 - RNA, 20 nt, Human
augaaauuuuccaaugucug

SEQ ID NO: 2605849 - RNA, 20 nt, Human
augaaauacacaaguaaaca

SEQ ID NO: 2605850 - RNA, 19 nt, Human
augaaauacacaaguaaac

SEQ ID NO: 2605851 - RNA, 17 nt, Human
augaaauacuauuuaaa

SEQ ID NO: 2605852 - RNA, 22 nt, Human
augaaauacuguuugagguuuu

SEQ ID NO: 2605853 - RNA, 15 nt, Human
augaaauaugcaucu

SEQ ID NO: 2605854 - RNA, 13 nt, Human
augaaauaugcau

SEQ ID NO: 2605855 - RNA, 13 nt, Human
augaaauaucaga

SEQ ID NO: 2605856 - RNA, 15 nt, Human
augaaauaucuguau

SEQ ID NO: 2605857 - RNA, 19 nt, Human
augaaauaucagacuagug

SEQ ID NO: 2605858 - RNA, 18 nt, Human
augaacaaauugaacucu

SEQ ID NO: 2605859 - RNA, 15 nt, Human
augaacaaauugaac

SEQ ID NO: 2605860 - RNA, 13 nt, Human
augaacacacugu

SEQ ID NO: 2605861 - RNA, 22 nt, Human
augaacacacuguguccuggug

SEQ ID NO: 2605862 - RNA, 15 nt, Human
augaacacacugugu

SEQ ID NO: 2605863 - RNA, 22 nt, Human
augaaccacaucuugcucugcu

SEQ ID NO: 2605864 - RNA, 23 nt, Human
augaaccacaucuugcucugcug

SEQ ID NO: 2605865 - RNA, 16 nt, Human
uuggcccaagcucuug

SEQ ID NO: 2605866 - RNA, 16 nt, Human
uuggccaucucuggau

SEQ ID NO: 2605867 - RNA, 14 nt, Human
uuggagcugagccu

SEQ ID NO: 2605868 - RNA, 14 nt, Human
uuggagccugcagg

SEQ ID NO: 2605869 - RNA, 18 nt, Human
uuggagccugcagagcug

SEQ ID NO: 2605870 - RNA, 14 nt, Human
uuggagcuucaugg

SEQ ID NO: 2605871 - RNA, 21 nt, Human
uuggagcuuuuuucuuuaaga

SEQ ID NO: 2605872 - RNA, 15 nt, Human
uuggaggccagccag

SEQ ID NO: 2605873 - RNA, 16 nt, Human
uuggaggccuuuagau

SEQ ID NO: 2605874 - RNA, 22 nt, Human
augaaauaacuccuucuuguag

SEQ ID NO: 2605875 - RNA, 20 nt, Human
augaaauaacuccuucuugu

SEQ ID NO: 2605876 - RNA, 14 nt, Human
augaaauaaagaaa

SEQ ID NO: 2605877 - RNA, 18 nt, Human
augaacuuguaaaggaau

SEQ ID NO: 2605878 - RNA, 17 nt, Human
augaacuuucucuucau

SEQ ID NO: 2605879 - RNA, 17 nt, Human
augaaccuggagggcua

SEQ ID NO: 2605880 - RNA, 15 nt, Human
augaagaaaaaauac

SEQ ID NO: 2605881 - RNA, 17 nt, Human
augaagaaaaaauacau

SEQ ID NO: 2605882 - RNA, 19 nt, Human
augaagaaaaaauacauuu

SEQ ID NO: 2605883 - RNA, 20 nt, Human
augaagaaaaaauacauuuu

SEQ ID NO: 2605884 - RNA, 22 nt, Human
augaagaaaaaauacauuuuau

SEQ ID NO: 2605885 - RNA, 19 nt, Human
augaagaaaagugggccag

SEQ ID NO: 2605886 - RNA, 22 nt, Human
augaacccaggacgcuucugaa

SEQ ID NO: 2605887 - RNA, 21 nt, Human
augaacccaggacgcuucuga

SEQ ID NO: 2605888 - RNA, 16 nt, Human
augaacacuuaauaaa

SEQ ID NO: 2605889 - RNA, 13 nt, Human
augaaccuggagg

SEQ ID NO: 2605890 - RNA, 17 nt, Human
augaaccgcugaauaug

SEQ ID NO: 2605891 - RNA, 23 nt, Human
augaaccucaagcugcaucuaga

SEQ ID NO: 2605892 - RNA, 14 nt, Human
augaaccuucuggc

SEQ ID NO: 2605893 - RNA, 14 nt, Human
augaagaacugagg

SEQ ID NO: 2605894 - RNA, 14 nt, Human
augaagaaagugga

SEQ ID NO: 2605895 - RNA, 19 nt, Human
augaagaaaaucacuuagg

SEQ ID NO: 2605896 - RNA, 21 nt, Human
augaagaaaagugggccagug

SEQ ID NO: 2605897 - RNA, 22 nt, Human
augaagaaaagugggccagugu

SEQ ID NO: 2605898 - RNA, 14 nt, Human
augaagcaaugcuu

SEQ ID NO: 2605899 - RNA, 21 nt, Human
augaagaugucuaauaguuau

SEQ ID NO: 2605900 - RNA, 22 nt, Human
augaagauguuucaaaaaaucu

SEQ ID NO: 2605901 - RNA, 19 nt, Human
augaagauucuccugugcu

SEQ ID NO: 2605902 - RNA, 14 nt, Human
augaagcaaacaca

SEQ ID NO: 2605903 - RNA, 18 nt, Human
augaaucuauuauacugu

SEQ ID NO: 2605904 - RNA, 23 nt, Human
augaaucuauuauacuguauuaa

SEQ ID NO: 2605905 - RNA, 17 nt, Human
augaaugaaacauuuug

SEQ ID NO: 2605906 - RNA, 15 nt, Human
augaauguauuuauu

SEQ ID NO: 2605907 - RNA, 17 nt, Human
augaauguauuuauuug

SEQ ID NO: 2605908 - RNA, 19 nt, Human
augaauguaugugcacugu

SEQ ID NO: 2605909 - RNA, 20 nt, Human
augaauguauuuauuuggga

SEQ ID NO: 2605910 - RNA, 14 nt, Human
augaaugaaugaau

SEQ ID NO: 2605911 - RNA, 16 nt, Human
augaaucuuuuccacu

SEQ ID NO: 2605912 - RNA, 15 nt, Human
augaauguaucagga

SEQ ID NO: 2605913 - RNA, 18 nt, Human
augaauguaugugcacug

SEQ ID NO: 2605914 - RNA, 17 nt, Human
augaauguaugugcacu

SEQ ID NO: 2605915 - RNA, 16 nt, Human
augaauguaugugcac

SEQ ID NO: 2605916 - RNA, 16 nt, Human
augaauguaucaggaa

SEQ ID NO: 2605917 - RNA, 16 nt, Human
augaaucuauuauacu

SEQ ID NO: 2605918 - RNA, 21 nt, Human
augaaucuaugccaaagauca

SEQ ID NO: 2605919 - RNA, 14 nt, Human
augaaucuaugcca

SEQ ID NO: 2605920 - RNA, 11 nt, Human
augaaucuaug

SEQ ID NO: 2605921 - RNA, 16 nt, Human
augaaucuaagcagca

SEQ ID NO: 2605922 - RNA, 14 nt, Human
augaaucuaagcag

SEQ ID NO: 2605923 - RNA, 20 nt, Human
augaaucgcuucucuuuuga

SEQ ID NO: 2605924 - RNA, 17 nt, Human
augaaucgcuucucuuu

SEQ ID NO: 2605925 - RNA, 22 nt, Human
augaagcagcuuuaaacaaauu

SEQ ID NO: 2605926 - RNA, 18 nt, Human
augaaucccacccacaug

SEQ ID NO: 2605927 - RNA, 15 nt, Human
augaaucgcuucucu

SEQ ID NO: 2605928 - RNA, 21 nt, Human
augaaucccacccacauguga

SEQ ID NO: 2605929 - RNA, 15 nt, Human
augaagcaaugcuuc

SEQ ID NO: 2605930 - RNA, 15 nt, Human
augaagcagcuuuaa

SEQ ID NO: 2605931 - RNA, 13 nt, Human
augaagcagcuuu

SEQ ID NO: 2605932 - RNA, 22 nt, Human
augaagauucuccugugcuaga

SEQ ID NO: 2605933 - RNA, 15 nt, Human
augaagcaaacacau

SEQ ID NO: 2605934 - RNA, 15 nt, Human
uugcuuugugauuuu

SEQ ID NO: 2605935 - RNA, 13 nt, Human
uugcuuugcccug

SEQ ID NO: 2605936 - RNA, 14 nt, Human
uugcuuugcccagc

SEQ ID NO: 2605937 - RNA, 13 nt, Human
uugcuuuguaugc

SEQ ID NO: 2605938 - RNA, 20 nt, Human
uugcuuucugcucagcuucu

SEQ ID NO: 2605939 - RNA, 14 nt, Human
uugcuuucugaaau

SEQ ID NO: 2605940 - RNA, 15 nt, Human
uugcuuucugaaauu

SEQ ID NO: 2605941 - RNA, 16 nt, Human
uugcuuuauaaauaaa

SEQ ID NO: 2605942 - RNA, 20 nt, Human
uugcuuuaugccuucuuauu

SEQ ID NO: 2605943 - RNA, 13 nt, Human
uugcuuucugaaa

SEQ ID NO: 2605944 - RNA, 22 nt, Human
uugcuuugaagcaguuguguca

SEQ ID NO: 2605945 - RNA, 16 nt, Human
uugcuuugaagcaguu

SEQ ID NO: 2605946 - RNA, 11 nt, Human
uugcuuugagc

SEQ ID NO: 2605947 - RNA, 15 nt, Human
uugcuuugaagcagu

SEQ ID NO: 2605948 - RNA, 15 nt, Human
uugcuuucugcucag

SEQ ID NO: 2605949 - RNA, 14 nt, Human
uugcuuugaagcag

SEQ ID NO: 2605950 - RNA, 15 nt, Human
uugcuuuauuccaga

SEQ ID NO: 2605951 - RNA, 17 nt, Human
uugcuucauaaaugaag

SEQ ID NO: 2605952 - RNA, 15 nt, Human
uugcuucauaaauga

SEQ ID NO: 2605953 - RNA, 20 nt, Human
uugcuucauaaaugaagcag

SEQ ID NO: 2605954 - RNA, 13 nt, Human
uugcuuaugacau

SEQ ID NO: 2605955 - RNA, 15 nt, Human
uugcuuauuguucca

SEQ ID NO: 2605956 - RNA, 16 nt, Human
uugcuuauuguuccaa

SEQ ID NO: 2605957 - RNA, 18 nt, Human
uugcuuauuguuccaaga

SEQ ID NO: 2605958 - RNA, 20 nt, Human
uugcuuauuguuccaagaca

SEQ ID NO: 2605959 - RNA, 14 nt, Human
uugcuucauaaaug

SEQ ID NO: 2605960 - RNA, 12 nt, Human
uugcuucacuca

SEQ ID NO: 2605961 - RNA, 22 nt, Human
uugcuuauuguuccaagacauu

SEQ ID NO: 2605962 - RNA, 23 nt, Human
uugcuuauuguuccaagacauug

SEQ ID NO: 2605963 - RNA, 17 nt, Human
uugcucuugaugccugg

SEQ ID NO: 2605964 - RNA, 14 nt, Human
uugcucuugaugcc

SEQ ID NO: 2605965 - RNA, 18 nt, Human
uugcucuugaugccuggc

SEQ ID NO: 2605966 - RNA, 17 nt, Human
uugcugaaaaugguauu

SEQ ID NO: 2605967 - RNA, 16 nt, Human
uugcucuuucuacucu

SEQ ID NO: 2605968 - RNA, 22 nt, Human
uugcuuagucacuuauuucaua

SEQ ID NO: 2605969 - RNA, 12 nt, Human
aucuuuaaaaua

SEQ ID NO: 2605970 - RNA, 15 nt, Human
aucuuuaaaauacac

SEQ ID NO: 2605971 - RNA, 15 nt, Human
aucuuguuuuuccac

SEQ ID NO: 2605972 - RNA, 23 nt, Human
aucuuguuuuuccacuacugcua

SEQ ID NO: 2605973 - RNA, 23 nt, Human
uugcucuguaaucucguuucaaa

SEQ ID NO: 2605974 - RNA, 14 nt, Human
uugcucugggugga

SEQ ID NO: 2605975 - RNA, 19 nt, Human
uugcucuuaaguuguggag

SEQ ID NO: 2605976 - RNA, 14 nt, Human
uugcucuggcugag

SEQ ID NO: 2605977 - RNA, 18 nt, Human
uuggagacacaacuauuu

SEQ ID NO: 2605978 - RNA, 18 nt, Human
uuggagaauuuagguuuu

SEQ ID NO: 2605979 - RNA, 21 nt, Human
uuggagaguuuccugaaacaa

SEQ ID NO: 2605980 - RNA, 14 nt, Human
uuggagaaauuauu

SEQ ID NO: 2605981 - RNA, 20 nt, Human
uuggagaagcccgugugaga

SEQ ID NO: 2605982 - RNA, 18 nt, Human
uuggagaagguuaucaaa

SEQ ID NO: 2605983 - RNA, 15 nt, Human
uuggagaaauuauuu

SEQ ID NO: 2605984 - RNA, 13 nt, Human
uuggagaauuuag

SEQ ID NO: 2605985 - RNA, 14 nt, Human
uuggagaucaagga

SEQ ID NO: 2605986 - RNA, 20 nt, Human
uuggagauaaucuagaacac

SEQ ID NO: 2605987 - RNA, 11 nt, Human
uuggagccugc

SEQ ID NO: 2605988 - RNA, 15 nt, Human
uuggagccugcagag

SEQ ID NO: 2605989 - RNA, 13 nt, Human
uuggagccugcag

SEQ ID NO: 2605990 - RNA, 18 nt, Human
uuggagaguuuccugaaa

SEQ ID NO: 2605991 - RNA, 22 nt, Human
uuggagaagaacugaaaucaua

SEQ ID NO: 2605992 - RNA, 17 nt, Human
uuggagaagaacugaaa

SEQ ID NO: 2605993 - RNA, 15 nt, Human
uuggagaagaacuga

SEQ ID NO: 2605994 - RNA, 15 nt, Human
uuggaaaaugcauug

SEQ ID NO: 2605995 - RNA, 19 nt, Human
uuggaaaagaauacagaaa

SEQ ID NO: 2605996 - RNA, 22 nt, Human
uuggaaaagaauacagaaagau

SEQ ID NO: 2605997 - RNA, 13 nt, Human
uuggacuugagga

SEQ ID NO: 2605998 - RNA, 15 nt, Human
uuggacuggaugcau

SEQ ID NO: 2605999 - RNA, 15 nt, Human
uuggacugacauuua

SEQ ID NO: 2606000 - RNA, 16 nt, Human
uuggacucuugcucuu

SEQ ID NO: 2606001 - RNA, 15 nt, Human
uuggacucuugcucu

SEQ ID NO: 2606002 - RNA, 17 nt, Human
uuggacucuugcucuuu

SEQ ID NO: 2606003 - RNA, 14 nt, Human
uuggacugacauuu

SEQ ID NO: 2606004 - RNA, 15 nt, Human
uuggaaaauaaauca

SEQ ID NO: 2606005 - RNA, 12 nt, Human
uuggaaaauaaa

SEQ ID NO: 2606006 - RNA, 17 nt, Human
uuggaaaauaaauuauu

SEQ ID NO: 2606007 - RNA, 17 nt, Human
uuggaaaaagugaugga

SEQ ID NO: 2606008 - RNA, 13 nt, Human
uuggaaaaaguga

SEQ ID NO: 2606009 - RNA, 14 nt, Human
uuggaaaagaauac

SEQ ID NO: 2606010 - RNA, 21 nt, Human
uuggaaaaauccagaaagaaa

SEQ ID NO: 2606011 - RNA, 20 nt, Human
uugcuuugugauuuuuguaa

SEQ ID NO: 2606012 - RNA, 16 nt, Human
uugcuuuguaugcacu

SEQ ID NO: 2606013 - RNA, 21 nt, Human
aucugugaggggcucucucau

SEQ ID NO: 2606014 - RNA, 22 nt, Human
aucugugaggggcucucucaug

SEQ ID NO: 2606015 - RNA, 22 nt, Human
aucugucauuugagcagggcuc

SEQ ID NO: 2606016 - RNA, 17 nt, Human
aucugucauuugagcag

SEQ ID NO: 2606017 - RNA, 12 nt, Human
aucugucauuug

SEQ ID NO: 2606018 - RNA, 23 nt, Human
uugccccggccccggccccagcc

SEQ ID NO: 2606019 - RNA, 22 nt, Human
uugccccggccccggccccagc

SEQ ID NO: 2606020 - RNA, 17 nt, Human
uugcccggauucuggga

SEQ ID NO: 2606021 - RNA, 13 nt, Human
uugccccugagac

SEQ ID NO: 2606022 - RNA, 12 nt, Human
uugccccccacc

SEQ ID NO: 2606023 - RNA, 13 nt, Human
uugccccccaccc

SEQ ID NO: 2606024 - RNA, 16 nt, Human
uugccccccaccccag

SEQ ID NO: 2606025 - RNA, 19 nt, Human
uugccccccaccccagccu

SEQ ID NO: 2606026 - RNA, 17 nt, Human
aucugucacaccagcca

SEQ ID NO: 2606027 - RNA, 23 nt, Human
aucugucaagugggaucugucac

SEQ ID NO: 2606028 - RNA, 15 nt, Human
uugcccugaccuccc

SEQ ID NO: 2606029 - RNA, 13 nt, Human
uugcccugaccuc

SEQ ID NO: 2606030 - RNA, 12 nt, Human
uugcccugaccu

SEQ ID NO: 2606031 - RNA, 15 nt, Human
uugcccucccauccc

SEQ ID NO: 2606032 - RNA, 12 nt, Human
uugcccucccau

SEQ ID NO: 2606033 - RNA, 19 nt, Human
uugcccggauucugggagg

SEQ ID NO: 2606034 - RNA, 13 nt, Human
aucugugucuugu

SEQ ID NO: 2606035 - RNA, 20 nt, Human
aucuguuuuuaaaaaucaua

SEQ ID NO: 2606036 - RNA, 12 nt, Human
aucugugucuug

SEQ ID NO: 2606037 - RNA, 18 nt, Human
aucuguguacaaagaaau

SEQ ID NO: 2606038 - RNA, 22 nt, Human
aucuguguacaaagaaauaaca

SEQ ID NO: 2606039 - RNA, 17 nt, Human
aucuguguacaaagaaa

SEQ ID NO: 2606040 - RNA, 16 nt, Human
aucuguguacaaagaa

SEQ ID NO: 2606041 - RNA, 15 nt, Human
aucuguguacaaaga

SEQ ID NO: 2606042 - RNA, 22 nt, Human
aucugugggcauggucaaaggc

SEQ ID NO: 2606043 - RNA, 17 nt, Human
aucugugcuuuccagcu

SEQ ID NO: 2606044 - RNA, 16 nt, Human
aucugugcuuuccagc

SEQ ID NO: 2606045 - RNA, 15 nt, Human
aucugugcuuuccag

SEQ ID NO: 2606046 - RNA, 19 nt, Human
aucugugcuuuccagcuca

SEQ ID NO: 2606047 - RNA, 18 nt, Human
aucugugcuuuccagcuc

SEQ ID NO: 2606048 - RNA, 19 nt, Human
aucugugggcauggucaaa

SEQ ID NO: 2606049 - RNA, 21 nt, Human
aucugugcccagagaugggac

SEQ ID NO: 2606050 - RNA, 16 nt, Human
aucugugcgugaaaca

SEQ ID NO: 2606051 - RNA, 17 nt, Human
aucugugcgugaaacac

SEQ ID NO: 2606052 - RNA, 19 nt, Human
aucugugcucaggacucag

SEQ ID NO: 2606053 - RNA, 18 nt, Human
aucugugcgugaaacaca

SEQ ID NO: 2606054 - RNA, 19 nt, Human
aucugugcgugaaacacac

SEQ ID NO: 2606055 - RNA, 12 nt, Human
aucugugcccca

SEQ ID NO: 2606056 - RNA, 13 nt, Human
aucugugccccau

SEQ ID NO: 2606057 - RNA, 15 nt, Human
aucugugccccaugc

SEQ ID NO: 2606058 - RNA, 23 nt, Human
aucugugccccaugccuguccag

SEQ ID NO: 2606059 - RNA, 17 nt, Human
aucugugauaauuuucu

SEQ ID NO: 2606060 - RNA, 18 nt, Human
aucugucacaccagccau

SEQ ID NO: 2606061 - RNA, 16 nt, Human
aucugugcacugccca

SEQ ID NO: 2606062 - RNA, 14 nt, Human
aucugugcccagag

SEQ ID NO: 2606063 - RNA, 17 nt, Human
aucugugcccagagaug

SEQ ID NO: 2606064 - RNA, 22 nt, Human
aucugugcaaauccuugauacu

SEQ ID NO: 2606065 - RNA, 12 nt, Human
aucugugaugau

SEQ ID NO: 2606066 - RNA, 15 nt, Human
aucuuauaauuuaaa

SEQ ID NO: 2606067 - RNA, 16 nt, Human
aucuuaaggggcagcu

SEQ ID NO: 2606068 - RNA, 19 nt, Human
aucuuaaaguguguuucua

SEQ ID NO: 2606069 - RNA, 16 nt, Human
aucuuauaauuuaaaa

SEQ ID NO: 2606070 - RNA, 16 nt, Human
aucuuaauuauuguac

SEQ ID NO: 2606071 - RNA, 14 nt, Human
aucuugcucugcug

SEQ ID NO: 2606072 - RNA, 12 nt, Human
aucuuaauuuug

SEQ ID NO: 2606073 - RNA, 14 nt, Human
aucuuggacugaca

SEQ ID NO: 2606074 - RNA, 16 nt, Human
aucuuggacugacauu

SEQ ID NO: 2606075 - RNA, 19 nt, Human
aucuuggacugacauuuag

SEQ ID NO: 2606076 - RNA, 21 nt, Human
aucuuggacugacauuuagcg

SEQ ID NO: 2606077 - RNA, 16 nt, Human
aucuugcucugcugac

SEQ ID NO: 2606078 - RNA, 15 nt, Human
aucuugcucugcuga

SEQ ID NO: 2606079 - RNA, 17 nt, Human
aucuuggggacaucucu

SEQ ID NO: 2606080 - RNA, 18 nt, Human
aucuugggacuggguuug

SEQ ID NO: 2606081 - RNA, 17 nt, Human
aucuugggacuggguuu

SEQ ID NO: 2606082 - RNA, 13 nt, Human
aucuugggacugg

SEQ ID NO: 2606083 - RNA, 15 nt, Human
aucuuggcucacugc

SEQ ID NO: 2606084 - RNA, 23 nt, Human
aucuuggcacauuuaagagacag

SEQ ID NO: 2606085 - RNA, 23 nt, Human
aucuuggggggguggccgcugag

SEQ ID NO: 2606086 - RNA, 20 nt, Human
aucuuggggggguggccgcu

SEQ ID NO: 2606087 - RNA, 23 nt, Human
aucuuggggacaucucuuugaau

SEQ ID NO: 2606088 - RNA, 22 nt, Human
aucuuggggacaucucuuugaa

SEQ ID NO: 2606089 - RNA, 16 nt, Human
aucuuggggggguggc

SEQ ID NO: 2606090 - RNA, 12 nt, Human
aucuugguaaau

SEQ ID NO: 2606091 - RNA, 23 nt, Human
aucuugggggacagggcuggccc

SEQ ID NO: 2606092 - RNA, 23 nt, Human
aucucacacaugagcaucaggcc

SEQ ID NO: 2606093 - RNA, 19 nt, Human
aucucaaauucucaaccua

SEQ ID NO: 2606094 - RNA, 23 nt, Human
aucuagaggcuuccuucauuucc

SEQ ID NO: 2606095 - RNA, 16 nt, Human
aucucaaauuucuaaa

SEQ ID NO: 2606096 - RNA, 17 nt, Human
aucucaaauuucuaaau

SEQ ID NO: 2606097 - RNA, 13 nt, Human
aucucaccccauc

SEQ ID NO: 2606098 - RNA, 14 nt, Human
aucucaccccaucc

SEQ ID NO: 2606099 - RNA, 16 nt, Human
aucucaccccauccca

SEQ ID NO: 2606100 - RNA, 22 nt, Human
aucucaccccaucccacacccu

SEQ ID NO: 2606101 - RNA, 23 nt, Human
aucucaccccaucccacacccug

SEQ ID NO: 2606102 - RNA, 14 nt, Human
aucugacccagugc

SEQ ID NO: 2606103 - RNA, 18 nt, Human
aucugacccagugccccc

SEQ ID NO: 2606104 - RNA, 15 nt, Human
aucugaaggagauuu

SEQ ID NO: 2606105 - RNA, 13 nt, Human
aucugacccagug

SEQ ID NO: 2606106 - RNA, 16 nt, Human
aucucuuguuuaaauu

SEQ ID NO: 2606107 - RNA, 15 nt, Human
aucucuugaggccag

SEQ ID NO: 2606108 - RNA, 22 nt, Human
aucucuuuguucuaaagaugga

SEQ ID NO: 2606109 - RNA, 22 nt, Human
aucucuuuugaauccaugcuug

SEQ ID NO: 2606110 - RNA, 21 nt, Human
aucugaagagcuauuauauaa

SEQ ID NO: 2606111 - RNA, 21 nt, Human
aucucuuugaauuuucugugu

SEQ ID NO: 2606112 - RNA, 15 nt, Human
aucucuuugaauuuu

SEQ ID NO: 2606113 - RNA, 19 nt, Human
aucucuuuuugcuuucgaa

SEQ ID NO: 2606114 - RNA, 15 nt, Human
uugauuaaauucuug

SEQ ID NO: 2606115 - RNA, 16 nt, Human
uugauuaaauucuugc

SEQ ID NO: 2606116 - RNA, 20 nt, Human
uugauuaaauucuugcaaag

SEQ ID NO: 2606117 - RNA, 21 nt, Human
uugauuaaauucuugcaaagu

SEQ ID NO: 2606118 - RNA, 17 nt, Human
uugcaacuuuguauaaa

SEQ ID NO: 2606119 - RNA, 16 nt, Human
uugcaacuuuguauaa

SEQ ID NO: 2606120 - RNA, 18 nt, Human
uugcaacuuuguauaaaa

SEQ ID NO: 2606121 - RNA, 14 nt, Human
uugcaagaaucagu

SEQ ID NO: 2606122 - RNA, 16 nt, Human
uugcaagucauggcug

SEQ ID NO: 2606123 - RNA, 23 nt, Human
uugauguucuuucacccuuuucu

SEQ ID NO: 2606124 - RNA, 16 nt, Human
uugauguuaacacauu

SEQ ID NO: 2606125 - RNA, 14 nt, Human
uugauguuaacaca

SEQ ID NO: 2606126 - RNA, 13 nt, Human
uugauguuggcug

SEQ ID NO: 2606127 - RNA, 16 nt, Human
uugauguuggcuggga

SEQ ID NO: 2606128 - RNA, 13 nt, Human
uugauguuugugg

SEQ ID NO: 2606129 - RNA, 15 nt, Human
uugauguuuguggcc

SEQ ID NO: 2606130 - RNA, 16 nt, Human
uugauguuuguggccu

SEQ ID NO: 2606131 - RNA, 17 nt, Human
uugauguuuguggccuc

SEQ ID NO: 2606132 - RNA, 18 nt, Human
uugauguuuguggccuca

SEQ ID NO: 2606133 - RNA, 19 nt, Human
uugauguuuguggccucag

SEQ ID NO: 2606134 - RNA, 18 nt, Human
aucugacucacaagaaga

SEQ ID NO: 2606135 - RNA, 13 nt, Human
aucugaaggagau

SEQ ID NO: 2606136 - RNA, 18 nt, Human
aucugagaaaagcuuuga

SEQ ID NO: 2606137 - RNA, 20 nt, Human
aucugacccagugcccccac

SEQ ID NO: 2606138 - RNA, 21 nt, Human
aucugacccagugcccccacu

SEQ ID NO: 2606139 - RNA, 16 nt, Human
aucugagaaucuuuau

SEQ ID NO: 2606140 - RNA, 14 nt, Human
aucugagaaucuuu

SEQ ID NO: 2606141 - RNA, 22 nt, Human
aucugagaaaagcuuugaaccc

SEQ ID NO: 2606142 - RNA, 13 nt, Human
aucugagaaucuu

SEQ ID NO: 2606143 - RNA, 21 nt, Human
uugccccaacccccagcaccc

SEQ ID NO: 2606144 - RNA, 17 nt, Human
uugccccaacccccagc

SEQ ID NO: 2606145 - RNA, 16 nt, Human
uugccccaacccccag

SEQ ID NO: 2606146 - RNA, 22 nt, Human
uugcccccagggcacuucacag

SEQ ID NO: 2606147 - RNA, 15 nt, Human
uugcccccagggcac

SEQ ID NO: 2606148 - RNA, 15 nt, Human
uugcccauccaucug

SEQ ID NO: 2606149 - RNA, 14 nt, Human
uugcccauccaucu

SEQ ID NO: 2606150 - RNA, 15 nt, Human
uugccccaaccccca

SEQ ID NO: 2606151 - RNA, 14 nt, Human
uugccccaaccccc

SEQ ID NO: 2606152 - RNA, 18 nt, Human
uugccaccccacccuccc

SEQ ID NO: 2606153 - RNA, 17 nt, Human
uugccaccccacccucc

SEQ ID NO: 2606154 - RNA, 12 nt, Human
uugccaccccac

SEQ ID NO: 2606155 - RNA, 18 nt, Human
uugccacaggccucccug

SEQ ID NO: 2606156 - RNA, 18 nt, Human
uugcccaggcuggucuca

SEQ ID NO: 2606157 - RNA, 17 nt, Human
uugcccagggcucagcc

SEQ ID NO: 2606158 - RNA, 18 nt, Human
uugcccagggcucagccu

SEQ ID NO: 2606159 - RNA, 19 nt, Human
uugcccagggcucagccug

SEQ ID NO: 2606160 - RNA, 20 nt, Human
uugcccagggcucagccugg

SEQ ID NO: 2606161 - RNA, 23 nt, Human
uugcccaggcuggcgugcagugg

SEQ ID NO: 2606162 - RNA, 14 nt, Human
uugcccaggcuggc

SEQ ID NO: 2606163 - RNA, 12 nt, Human
uugcccaggcug

SEQ ID NO: 2606164 - RNA, 11 nt, Human
uugcccaggcu

SEQ ID NO: 2606165 - RNA, 18 nt, Human
uugcccaggcaggucuug

SEQ ID NO: 2606166 - RNA, 16 nt, Human
uugcccaggcaggucu

SEQ ID NO: 2606167 - RNA, 14 nt, Human
uugcccaggcaggu

SEQ ID NO: 2606168 - RNA, 13 nt, Human
uugcccaggcagg

SEQ ID NO: 2606169 - RNA, 18 nt, Human
uugccacaggacacaguc

SEQ ID NO: 2606170 - RNA, 15 nt, Human
uugccacaacccugu

SEQ ID NO: 2606171 - RNA, 13 nt, Human
uugccacagcucu

SEQ ID NO: 2606172 - RNA, 21 nt, Human
uugccaaugaggucugaaaug

SEQ ID NO: 2606173 - RNA, 16 nt, Human
uugccacaggccuccc

SEQ ID NO: 2606174 - RNA, 15 nt, Human
uugccacaggccucc

SEQ ID NO: 2606175 - RNA, 11 nt, Human
uugccacaggc

SEQ ID NO: 2606176 - RNA, 19 nt, Human
uugccacaggccucccugu

SEQ ID NO: 2606177 - RNA, 13 nt, Human
uugccaccaggag

SEQ ID NO: 2606178 - RNA, 14 nt, Human
uugccaccaggaga

SEQ ID NO: 2606179 - RNA, 15 nt, Human
uugccaccaggagaa

SEQ ID NO: 2606180 - RNA, 16 nt, Human
uugccaccaggagaac

SEQ ID NO: 2606181 - RNA, 16 nt, Human
uugcacccgccucucc

SEQ ID NO: 2606182 - RNA, 16 nt, Human
uugcaccccucccauu

SEQ ID NO: 2606183 - RNA, 15 nt, Human
uugcaccccucccau

SEQ ID NO: 2606184 - RNA, 14 nt, Human
uugcaccccuccca

SEQ ID NO: 2606185 - RNA, 13 nt, Human
uugcaccccuccc

SEQ ID NO: 2606186 - RNA, 12 nt, Human
uugcaccccucc

SEQ ID NO: 2606187 - RNA, 24 nt, Human
uugcaccccucacucuggccucag

SEQ ID NO: 2606188 - RNA, 22 nt, Human
uugcaccccucacucuggccuc

SEQ ID NO: 2606189 - RNA, 13 nt, Human
uugcaccccucac

SEQ ID NO: 2606190 - RNA, 19 nt, Human
uugcaccccaugcuguuga

SEQ ID NO: 2606191 - RNA, 22 nt, Human
uugcaccccaaagcuuuccugc

SEQ ID NO: 2606192 - RNA, 19 nt, Human
uugcacccagcccuggucu

SEQ ID NO: 2606193 - RNA, 16 nt, Human
uugcacccagcccugg

SEQ ID NO: 2606194 - RNA, 21 nt, Human
uugcaccccaaagcuuuccug

SEQ ID NO: 2606195 - RNA, 20 nt, Human
uugcaauccacaaucugaca

SEQ ID NO: 2606196 - RNA, 15 nt, Human
uugcacccagcccug

SEQ ID NO: 2606197 - RNA, 13 nt, Human
uugcacccagccc

SEQ ID NO: 2606198 - RNA, 12 nt, Human
uugcacccagcc

SEQ ID NO: 2606199 - RNA, 21 nt, Human
uugcaccacugcacuccagcc

SEQ ID NO: 2606200 - RNA, 18 nt, Human
uugcaagugaagguuuac

SEQ ID NO: 2606201 - RNA, 13 nt, Human
uugcaauaauacu

SEQ ID NO: 2606202 - RNA, 15 nt, Human
uugcaagugaagguu

SEQ ID NO: 2606203 - RNA, 22 nt, Human
uugcaacuucaugucaacuucu

SEQ ID NO: 2606204 - RNA, 14 nt, Human
uugcaauggcagcc

SEQ ID NO: 2606205 - RNA, 20 nt, Human
uugcaauaauacuucucaaa

SEQ ID NO: 2606206 - RNA, 14 nt, Human
uugcaauaauacuu

SEQ ID NO: 2606207 - RNA, 12 nt, Human
uugcaacuucau

SEQ ID NO: 2606208 - RNA, 22 nt, Human
uugcaugggcuaaugaagauca

SEQ ID NO: 2606209 - RNA, 18 nt, Human
uugcaugggcuaaugaag

SEQ ID NO: 2606210 - RNA, 17 nt, Human
uugcaugggcuaaugaa

SEQ ID NO: 2606211 - RNA, 20 nt, Human
uugcauggcuccagaaaugu

SEQ ID NO: 2606212 - RNA, 19 nt, Human
uugcauggcuccagaaaug

SEQ ID NO: 2606213 - RNA, 19 nt, Human
uugcauggcaucaccucca

SEQ ID NO: 2606214 - RNA, 19 nt, Human
uugcauggcacuugcaucu

SEQ ID NO: 2606215 - RNA, 15 nt, Human
uugcaugauguauuu

SEQ ID NO: 2606216 - RNA, 14 nt, Human
uugcaugaggcuag

SEQ ID NO: 2606217 - RNA, 12 nt, Human
uugcaugaggcu

SEQ ID NO: 2606218 - RNA, 14 nt, Human
uugcaugauguauu

SEQ ID NO: 2606219 - RNA, 14 nt, Human
uugcaccugcucuc

SEQ ID NO: 2606220 - RNA, 17 nt, Human
uugcaccuaccucacag

SEQ ID NO: 2606221 - RNA, 22 nt, Human
uugccaaccuguaauaaauaug

SEQ ID NO: 2606222 - RNA, 21 nt, Human
uugccaaccuguaauaaauau

SEQ ID NO: 2606223 - RNA, 19 nt, Human
uugccaaccuguaauaaau

SEQ ID NO: 2606224 - RNA, 18 nt, Human
uugccaaccuguaauaaa

SEQ ID NO: 2606225 - RNA, 16 nt, Human
uugccaacauugccua

SEQ ID NO: 2606226 - RNA, 13 nt, Human
uugccaacauugc

SEQ ID NO: 2606227 - RNA, 18 nt, Human
uugccaaauauguccugg

SEQ ID NO: 2606228 - RNA, 17 nt, Human
uugccaaauauguccug

SEQ ID NO: 2606229 - RNA, 16 nt, Human
uugccaaauauguccu

SEQ ID NO: 2606230 - RNA, 22 nt, Human
uugccaaccuuauagggaugag

SEQ ID NO: 2606231 - RNA, 23 nt, Human
uugccaaccuguaauaaauauga

SEQ ID NO: 2606232 - RNA, 15 nt, Human
uugccaagcucagga

SEQ ID NO: 2606233 - RNA, 22 nt, Human
uugccaagcuccaagccccauc

SEQ ID NO: 2606234 - RNA, 14 nt, Human
aucucaaauuucua

SEQ ID NO: 2606235 - RNA, 23 nt, Human
aucucaaauaacuaaaagguaug

SEQ ID NO: 2606236 - RNA, 14 nt, Human
aucucaaauaacua

SEQ ID NO: 2606237 - RNA, 21 nt, Human
aucucaaauaacuaaaaggua

SEQ ID NO: 2606238 - RNA, 19 nt, Human
aucucaaaacugcacuguc

SEQ ID NO: 2606239 - RNA, 20 nt, Human
aucucaaaacugcacuguca

SEQ ID NO: 2606240 - RNA, 15 nt, Human
aucucaaaacugcac

SEQ ID NO: 2606241 - RNA, 19 nt, Human
aucuauuuuuggcagucug

SEQ ID NO: 2606242 - RNA, 23 nt, Human
aucuauuuuuggcagucugaauu

SEQ ID NO: 2606243 - RNA, 14 nt, Human
aucucaaaaaauaa

SEQ ID NO: 2606244 - RNA, 19 nt, Human
aucuagauacuguaucaug

SEQ ID NO: 2606245 - RNA, 16 nt, Human
aucuagauaucgacuu

SEQ ID NO: 2606246 - RNA, 18 nt, Human
aucuacucccaaguaugg

SEQ ID NO: 2606247 - RNA, 16 nt, Human
aucuacucagaaauuu

SEQ ID NO: 2606248 - RNA, 13 nt, Human
aucuacucccaag

SEQ ID NO: 2606249 - RNA, 19 nt, Human
aucuagauuauggagcuuu

SEQ ID NO: 2606250 - RNA, 14 nt, Human
aucuagcaaauguu

SEQ ID NO: 2606251 - RNA, 22 nt, Human
aucuagcaaucacaacacuggc

SEQ ID NO: 2606252 - RNA, 18 nt, Human
aucuagcaaauguuaugc

SEQ ID NO: 2606253 - RNA, 15 nt, Human
aucuagcaaucacaa

SEQ ID NO: 2606254 - RNA, 18 nt, Human
aucuaggaagacuuugga

SEQ ID NO: 2606255 - RNA, 17 nt, Human
aucuaggaagacuuugg

SEQ ID NO: 2606256 - RNA, 19 nt, Human
aucuaggaagacuuuggaa

SEQ ID NO: 2606257 - RNA, 22 nt, Human
aucuauuuuggauuguauauug

SEQ ID NO: 2606258 - RNA, 11 nt, Human
uugagugccuu

SEQ ID NO: 2606259 - RNA, 21 nt, Human
uugagugcugucuccauguuu

SEQ ID NO: 2606260 - RNA, 23 nt, Human
uugagugggguuaucucuguguu

SEQ ID NO: 2606261 - RNA, 17 nt, Human
uugagccagcagacauu

SEQ ID NO: 2606262 - RNA, 17 nt, Human
uugaguguuuuaagaua

SEQ ID NO: 2606263 - RNA, 14 nt, Human
uugagugcucugau

SEQ ID NO: 2606264 - RNA, 15 nt, Human
uugagugcucugauc

SEQ ID NO: 2606265 - RNA, 17 nt, Human
uugaguggaugauguuu

SEQ ID NO: 2606266 - RNA, 19 nt, Human
uugaguggaugauguuucg

SEQ ID NO: 2606267 - RNA, 15 nt, Human
uugauacuacaguuu

SEQ ID NO: 2606268 - RNA, 17 nt, Human
uugauacuacaguuugu

SEQ ID NO: 2606269 - RNA, 18 nt, Human
uugauagcacagacccug

SEQ ID NO: 2606270 - RNA, 13 nt, Human
uugauagcaaagc

SEQ ID NO: 2606271 - RNA, 16 nt, Human
uugauacuuguucaaa

SEQ ID NO: 2606272 - RNA, 17 nt, Human
uugauacuuguucaaaa

SEQ ID NO: 2606273 - RNA, 21 nt, Human
aucuaccuucuguaguuuuau

SEQ ID NO: 2606274 - RNA, 17 nt, Human
aucuaccuucuguaguu

SEQ ID NO: 2606275 - RNA, 15 nt, Human
aucuaccuucuguag

SEQ ID NO: 2606276 - RNA, 22 nt, Human
aucuaccuuccagucaggauga

SEQ ID NO: 2606277 - RNA, 15 nt, Human
aucuacuaauuccac

SEQ ID NO: 2606278 - RNA, 19 nt, Human
aucuacuaauuccacaccu

SEQ ID NO: 2606279 - RNA, 18 nt, Human
aucuagauacuguaucau

SEQ ID NO: 2606280 - RNA, 21 nt, Human
aucuaccucacuauucaagua

SEQ ID NO: 2606281 - RNA, 17 nt, Human
aucuaccccuuacuuau

SEQ ID NO: 2606282 - RNA, 21 nt, Human
aucuacccaaaggauacugua

SEQ ID NO: 2606283 - RNA, 15 nt, Human
aucuacccaaaggau

SEQ ID NO: 2606284 - RNA, 14 nt, Human
aucuacccaaagga

SEQ ID NO: 2606285 - RNA, 23 nt, Human
aucuaauauguaacaagccaccc

SEQ ID NO: 2606286 - RNA, 20 nt, Human
aucuaauauguaacaagcca

SEQ ID NO: 2606287 - RNA, 14 nt, Human
aucuaauauuaaaa

SEQ ID NO: 2606288 - RNA, 16 nt, Human
aucuaauuauuuugca

SEQ ID NO: 2606289 - RNA, 13 nt, Human
uugacaugggaca

SEQ ID NO: 2606290 - RNA, 23 nt, Human
uugacaugagauuuauaagguuu

SEQ ID NO: 2606291 - RNA, 19 nt, Human
uugacagcuuugcugcuga

SEQ ID NO: 2606292 - RNA, 16 nt, Human
uugacaucaacugcau

SEQ ID NO: 2606293 - RNA, 13 nt, Human
uugacaucaacug

SEQ ID NO: 2606294 - RNA, 12 nt, Human
uugacagggcac

SEQ ID NO: 2606295 - RNA, 10 nt, Human
uugacagggc

SEQ ID NO: 2606296 - RNA, 22 nt, Human
uugacacuauaucuguauauaa

SEQ ID NO: 2606297 - RNA, 19 nt, Human
uugacacuauaucuguaua

SEQ ID NO: 2606298 - RNA, 18 nt, Human
uugacacuauaucuguau

SEQ ID NO: 2606299 - RNA, 14 nt, Human
uugacacuauaucu

SEQ ID NO: 2606300 - RNA, 22 nt, Human
uugacaccagcuguucuguccc

SEQ ID NO: 2606301 - RNA, 23 nt, Human
uugacacuagcccaaugaaauga

SEQ ID NO: 2606302 - RNA, 19 nt, Human
uugacaggauuauuggaaa

SEQ ID NO: 2606303 - RNA, 19 nt, Human
auccgaaccuccucuguga

SEQ ID NO: 2606304 - RNA, 20 nt, Human
auccgaaccuccucugugaa

SEQ ID NO: 2606305 - RNA, 16 nt, Human
auccgaaccuccucug

SEQ ID NO: 2606306 - RNA, 18 nt, Human
uugacaauaaaugugcuu

SEQ ID NO: 2606307 - RNA, 18 nt, Human
uugacaauaauuucaggu

SEQ ID NO: 2606308 - RNA, 22 nt, Human
aucccuuuauuacccccuccuu

SEQ ID NO: 2606309 - RNA, 18 nt, Human
aucccuuuuugaagugua

SEQ ID NO: 2606310 - RNA, 22 nt, Human
aucccuugaccaggccugggcc

SEQ ID NO: 2606311 - RNA, 14 nt, Human
uugacacaagugga

SEQ ID NO: 2606312 - RNA, 17 nt, Human
uugacacaaguggaccu

SEQ ID NO: 2606313 - RNA, 16 nt, Human
uugacacagaaaaugu

SEQ ID NO: 2606314 - RNA, 18 nt, Human
uugacacaaguggaccuu

SEQ ID NO: 2606315 - RNA, 12 nt, Human
uugacaccugcu

SEQ ID NO: 2606316 - RNA, 19 nt, Human
uugacacaggucuuuccua

SEQ ID NO: 2606317 - RNA, 22 nt, Human
uugacacaggucuuuccuaagg

SEQ ID NO: 2606318 - RNA, 13 nt, Human
uugacacaggucu

SEQ ID NO: 2606319 - RNA, 13 nt, Human
aucccuuuauuac

SEQ ID NO: 2606320 - RNA, 14 nt, Human
aucccuuuauuacc

SEQ ID NO: 2606321 - RNA, 18 nt, Human
aucccuugaccaggccug

SEQ ID NO: 2606322 - RNA, 14 nt, Human
aucccuugaccagg

SEQ ID NO: 2606323 - RNA, 19 nt, Human
aucccuuccuuuuagccua

SEQ ID NO: 2606324 - RNA, 21 nt, Human
aucccuuccuuuuagccuagu

SEQ ID NO: 2606325 - RNA, 11 nt, Human
uugagacagag

SEQ ID NO: 2606326 - RNA, 10 nt, Human
uugagacaga

SEQ ID NO: 2606327 - RNA, 22 nt, Human
uugagacacggagcccagcccu

SEQ ID NO: 2606328 - RNA, 20 nt, Human
uugagacacugguuuacacu

SEQ ID NO: 2606329 - RNA, 13 nt, Human
uugagaauuuuaa

SEQ ID NO: 2606330 - RNA, 19 nt, Human
uugagaaguuuuguacaga

SEQ ID NO: 2606331 - RNA, 18 nt, Human
uugagaaguuuuguacag

SEQ ID NO: 2606332 - RNA, 16 nt, Human
uugagaaguuuuguac

SEQ ID NO: 2606333 - RNA, 23 nt, Human
uugagaaaccuuauuguaccucu

SEQ ID NO: 2606334 - RNA, 19 nt, Human
uugagaaagagcacuuaag

SEQ ID NO: 2606335 - RNA, 20 nt, Human
uugagaaacaaauaauuugu

SEQ ID NO: 2606336 - RNA, 23 nt, Human
uugagaaucccaaauuugauuga

SEQ ID NO: 2606337 - RNA, 22 nt, Human
uugagaauugugcucaaaauuu

SEQ ID NO: 2606338 - RNA, 18 nt, Human
uugagaaugguuacaaag

SEQ ID NO: 2606339 - RNA, 22 nt, Human
uugagacacugguuuacacuuu

SEQ ID NO: 2606340 - RNA, 18 nt, Human
uugagcagggauccuggu

SEQ ID NO: 2606341 - RNA, 18 nt, Human
uugagcaacuuucuuaca

SEQ ID NO: 2606342 - RNA, 12 nt, Human
uugagcagggcu

SEQ ID NO: 2606343 - RNA, 19 nt, Human
uugagcaguggcuggucca

SEQ ID NO: 2606344 - RNA, 14 nt, Human
uugagccagcagac

SEQ ID NO: 2606345 - RNA, 13 nt, Human
uugagccagcaga

SEQ ID NO: 2606346 - RNA, 16 nt, Human
uugagcagggcucagc

SEQ ID NO: 2606347 - RNA, 14 nt, Human
uugacauugcguuu

SEQ ID NO: 2606348 - RNA, 18 nt, Human
uugacauguacagagaac

SEQ ID NO: 2606349 - RNA, 14 nt, Human
uugacauguacaga

SEQ ID NO: 2606350 - RNA, 13 nt, Human
uugacauguacag

SEQ ID NO: 2606351 - RNA, 14 nt, Human
uugacauguggaaa

SEQ ID NO: 2606352 - RNA, 22 nt, Human
uugacauguggaaagugaauuu

SEQ ID NO: 2606353 - RNA, 18 nt, Human
uugacauugcguuugacc

SEQ ID NO: 2606354 - RNA, 16 nt, Human
uugaccaagcaggaag

SEQ ID NO: 2606355 - RNA, 18 nt, Human
uugaccaagcaggaagcu

SEQ ID NO: 2606356 - RNA, 20 nt, Human
uugaccaagcaggaagcuca

SEQ ID NO: 2606357 - RNA, 22 nt, Human
uugaccaagcaggaagcucaga

SEQ ID NO: 2606358 - RNA, 11 nt, Human
uugaccaggcc

SEQ ID NO: 2606359 - RNA, 21 nt, Human
uugaccagcagaucccagcuc

SEQ ID NO: 2606360 - RNA, 22 nt, Human
uugaccagcagaucccagcuca

SEQ ID NO: 2606361 - RNA, 12 nt, Human
uugacuuuuuau

SEQ ID NO: 2606362 - RNA, 17 nt, Human
uugaccauucuccaccu

SEQ ID NO: 2606363 - RNA, 17 nt, Human
uugacuuuuugcauuua

SEQ ID NO: 2606364 - RNA, 16 nt, Human
uugacuuuuugcauuu

SEQ ID NO: 2606365 - RNA, 22 nt, Human
uugagaaaccuuauuguaccuc

SEQ ID NO: 2606366 - RNA, 10 nt, Human
uugagaaacc

SEQ ID NO: 2606367 - RNA, 22 nt, Human
augcgugcauaccacuuuuguu

SEQ ID NO: 2606368 - RNA, 20 nt, Human
augcgugcauaccacuuuug

SEQ ID NO: 2606369 - RNA, 12 nt, Human
augcgugugugu

SEQ ID NO: 2606370 - RNA, 18 nt, Human
augcuacaggauuugaaa

SEQ ID NO: 2606371 - RNA, 14 nt, Human
augcgcaggcuggc

SEQ ID NO: 2606372 - RNA, 18 nt, Human
augcgcaggcuggcccug

SEQ ID NO: 2606373 - RNA, 20 nt, Human
augcgcaggcuggcccugcc

SEQ ID NO: 2606374 - RNA, 22 nt, Human
augcgcaggcuggcccugcccu

SEQ ID NO: 2606375 - RNA, 21 nt, Human
augccucuccuuuguauauua

SEQ ID NO: 2606376 - RNA, 20 nt, Human
augccucuccuuuguauauu

SEQ ID NO: 2606377 - RNA, 17 nt, Human
augccucuccuuuguau

SEQ ID NO: 2606378 - RNA, 19 nt, Human
augcgagugcucauuucag

SEQ ID NO: 2606379 - RNA, 13 nt, Human
augcgcaggcugg

SEQ ID NO: 2606380 - RNA, 22 nt, Human
augccuuuucccaacuccagaa

SEQ ID NO: 2606381 - RNA, 20 nt, Human
augccuuuucccaacuccag

SEQ ID NO: 2606382 - RNA, 14 nt, Human
augccuuuucccaa

SEQ ID NO: 2606383 - RNA, 15 nt, Human
augccucucucaggc

SEQ ID NO: 2606384 - RNA, 14 nt, Human
augccucucucagg

SEQ ID NO: 2606385 - RNA, 13 nt, Human
augccucucucag

SEQ ID NO: 2606386 - RNA, 14 nt, Human
augcccucagggga

SEQ ID NO: 2606387 - RNA, 16 nt, Human
augccucuccuuugua

SEQ ID NO: 2606388 - RNA, 16 nt, Human
augccccuggcuggga

SEQ ID NO: 2606389 - RNA, 20 nt, Human
augccccuguacuccagccu

SEQ ID NO: 2606390 - RNA, 17 nt, Human
augcccggcuaauuuuu

SEQ ID NO: 2606391 - RNA, 17 nt, Human
augcccagggccacucu

SEQ ID NO: 2606392 - RNA, 14 nt, Human
augccaucaucucc

SEQ ID NO: 2606393 - RNA, 15 nt, Human
augccaucaucuccu

SEQ ID NO: 2606394 - RNA, 21 nt, Human
augccauccucaaacacugca

SEQ ID NO: 2606395 - RNA, 12 nt, Human
augccauccuca

SEQ ID NO: 2606396 - RNA, 16 nt, Human
augccaucaucuccug

SEQ ID NO: 2606397 - RNA, 21 nt, Human
augccaugaggaacaaggcaa

SEQ ID NO: 2606398 - RNA, 16 nt, Human
augcccagccccuucu

SEQ ID NO: 2606399 - RNA, 15 nt, Human
augcccagccccuuc

SEQ ID NO: 2606400 - RNA, 23 nt, Human
augccauccucaaacacugcagg

SEQ ID NO: 2606401 - RNA, 17 nt, Human
augccaucugugggcac

SEQ ID NO: 2606402 - RNA, 21 nt, Human
augccccgucccccucuggcu

SEQ ID NO: 2606403 - RNA, 18 nt, Human
augccccgucccccucug

SEQ ID NO: 2606404 - RNA, 17 nt, Human
augcccagccccuucug

SEQ ID NO: 2606405 - RNA, 21 nt, Human
augcccagggccacucugccu

SEQ ID NO: 2606406 - RNA, 15 nt, Human
augcccagcguuuga

SEQ ID NO: 2606407 - RNA, 16 nt, Human
augcccagcucagagg

SEQ ID NO: 2606408 - RNA, 20 nt, Human
augccaguaggcucaacuag

SEQ ID NO: 2606409 - RNA, 23 nt, Human
augccaguaacgcgucuuccuga

SEQ ID NO: 2606410 - RNA, 21 nt, Human
augccagguucuauuuggaau

SEQ ID NO: 2606411 - RNA, 20 nt, Human
augccagguucuauuuggaa

SEQ ID NO: 2606412 - RNA, 22 nt, Human
augccaguaacgcgucuuccug

SEQ ID NO: 2606413 - RNA, 19 nt, Human
augccagguucuauuugga

SEQ ID NO: 2606414 - RNA, 18 nt, Human
augccagguucuauuugg

SEQ ID NO: 2606415 - RNA, 16 nt, Human
augccagcuacuuccu

SEQ ID NO: 2606416 - RNA, 18 nt, Human
augccagcucagucccau

SEQ ID NO: 2606417 - RNA, 12 nt, Human
augccaggacac

SEQ ID NO: 2606418 - RNA, 19 nt, Human
augccagcucagucccauc

SEQ ID NO: 2606419 - RNA, 18 nt, Human
augccacugccuucgcuu

SEQ ID NO: 2606420 - RNA, 15 nt, Human
augccacugccuucg

SEQ ID NO: 2606421 - RNA, 17 nt, Human
augccacugccuucgcu

SEQ ID NO: 2606422 - RNA, 22 nt, Human
augccagagacggaagccuuuu

SEQ ID NO: 2606423 - RNA, 21 nt, Human
uuuaaugaaagacuguacaaa

SEQ ID NO: 2606424 - RNA, 23 nt, Human
uuuaaugaaagacuguacaaagu

SEQ ID NO: 2606425 - RNA, 17 nt, Human
uuuaggauaaaauaaug

SEQ ID NO: 2606426 - RNA, 20 nt, Human
uuuaggagggaguuaucuaa

SEQ ID NO: 2606427 - RNA, 23 nt, Human
uuuagggacucaauuucucccca

SEQ ID NO: 2606428 - RNA, 18 nt, Human
uuuaggcugguggcccag

SEQ ID NO: 2606429 - RNA, 19 nt, Human
uuuaggcagggauuugagg

SEQ ID NO: 2606430 - RNA, 19 nt, Human
uuuagggagagucauauuu

SEQ ID NO: 2606431 - RNA, 21 nt, Human
uuuagggagagucauauuuug

SEQ ID NO: 2606432 - RNA, 14 nt, Human
uuuagggccaggca

SEQ ID NO: 2606433 - RNA, 15 nt, Human
uuuagggcagcuugc

SEQ ID NO: 2606434 - RNA, 13 nt, Human
uuuagggcagcuu

SEQ ID NO: 2606435 - RNA, 17 nt, Human
uuuacuuaucuuaugcc

SEQ ID NO: 2606436 - RNA, 16 nt, Human
uuuacuuaucuuaugc

SEQ ID NO: 2606437 - RNA, 22 nt, Human
uuuacuuaaagauuuaucaaau

SEQ ID NO: 2606438 - RNA, 20 nt, Human
uuuacuuaaagauuuaucaa

SEQ ID NO: 2606439 - RNA, 23 nt, Human
uuuacuuaaagauuuaucaaauc

SEQ ID NO: 2606440 - RNA, 13 nt, Human
uuuacuucuuaua

SEQ ID NO: 2606441 - RNA, 14 nt, Human
uuuacuucuuauac

SEQ ID NO: 2606442 - RNA, 15 nt, Human
uuuacuucuuauaca

SEQ ID NO: 2606443 - RNA, 17 nt, Human
uuuaggagauuuuaggu

SEQ ID NO: 2606444 - RNA, 21 nt, Human
uuuauaugcuucuguuuuaua

SEQ ID NO: 2606445 - RNA, 13 nt, Human
uuuauauguacau

SEQ ID NO: 2606446 - RNA, 14 nt, Human
uuuauauguacaug

SEQ ID NO: 2606447 - RNA, 16 nt, Human
uuuaguuacagcugug

SEQ ID NO: 2606448 - RNA, 17 nt, Human
uuuaguuaaauuucugg

SEQ ID NO: 2606449 - RNA, 23 nt, Human
uuuauauggaugauucagaaauu

SEQ ID NO: 2606450 - RNA, 19 nt, Human
uuuaucacauguauguuuu

SEQ ID NO: 2606451 - RNA, 17 nt, Human
uuuauauguacaugaga

SEQ ID NO: 2606452 - RNA, 19 nt, Human
uuuagugaucacagcagcu

SEQ ID NO: 2606453 - RNA, 16 nt, Human
uuuagggccaggcagg

SEQ ID NO: 2606454 - RNA, 20 nt, Human
uuuagggcuguaaaaugcau

SEQ ID NO: 2606455 - RNA, 19 nt, Human
uuuauaugcuucuguuuua

SEQ ID NO: 2606456 - RNA, 13 nt, Human
uuuaguggcuuca

SEQ ID NO: 2606457 - RNA, 18 nt, Human
uuuaccugaagucuuugu

SEQ ID NO: 2606458 - RNA, 22 nt, Human
uuuaccugaagucuuuguacag

SEQ ID NO: 2606459 - RNA, 15 nt, Human
uuuaccuauguaaca

SEQ ID NO: 2606460 - RNA, 18 nt, Human
uuuaccuaccacaguguc

SEQ ID NO: 2606461 - RNA, 18 nt, Human
uuuaccguuucuucccug

SEQ ID NO: 2606462 - RNA, 13 nt, Human
uuuacccuuggcu

SEQ ID NO: 2606463 - RNA, 19 nt, Human
uuuaccuaccacagugucu

SEQ ID NO: 2606464 - RNA, 20 nt, Human
augcuacugucucacugaaa

SEQ ID NO: 2606465 - RNA, 14 nt, Human
augcuacugucuca

SEQ ID NO: 2606466 - RNA, 21 nt, Human
augcuacuacaaaaaaguugu

SEQ ID NO: 2606467 - RNA, 20 nt, Human
uuuacccuucuuuucugacu

SEQ ID NO: 2606468 - RNA, 22 nt, Human
augcuacgugugauuuuucugg

SEQ ID NO: 2606469 - RNA, 20 nt, Human
augcuacgugugauuuuucu

SEQ ID NO: 2606470 - RNA, 19 nt, Human
augcuacgugugauuuuuc

SEQ ID NO: 2606471 - RNA, 17 nt, Human
augcuacgugugauuuu

SEQ ID NO: 2606472 - RNA, 16 nt, Human
augcuacgugugauuu

SEQ ID NO: 2606473 - RNA, 15 nt, Human
augcuacgugugauu

SEQ ID NO: 2606474 - RNA, 14 nt, Human
augcuacgugugau

SEQ ID NO: 2606475 - RNA, 23 nt, Human
augcuaccuugugacccagcacu

SEQ ID NO: 2606476 - RNA, 20 nt, Human
augcuaaaccuuaguacuga

SEQ ID NO: 2606477 - RNA, 14 nt, Human
augcuaaaccuuag

SEQ ID NO: 2606478 - RNA, 17 nt, Human
augcguguuucugacuc

SEQ ID NO: 2606479 - RNA, 12 nt, Human
augcuaaaccuu

SEQ ID NO: 2606480 - RNA, 16 nt, Human
augcgugugugugugu

SEQ ID NO: 2606481 - RNA, 16 nt, Human
augcguguuucugacu

SEQ ID NO: 2606482 - RNA, 16 nt, Human
uuuacugcagcuuugu

SEQ ID NO: 2606483 - RNA, 21 nt, Human
uuuacugagcuucucugugaa

SEQ ID NO: 2606484 - RNA, 18 nt, Human
uuuacugagcuucucugu

SEQ ID NO: 2606485 - RNA, 17 nt, Human
uuuacugagcuucucug

SEQ ID NO: 2606486 - RNA, 14 nt, Human
uuuacugagcuucu

SEQ ID NO: 2606487 - RNA, 21 nt, Human
uuuacuccaguggugaagaaa

SEQ ID NO: 2606488 - RNA, 13 nt, Human
uuuacuccagugg

SEQ ID NO: 2606489 - RNA, 12 nt, Human
uuuacuccccuu

SEQ ID NO: 2606490 - RNA, 13 nt, Human
uuuacuccccuug

SEQ ID NO: 2606491 - RNA, 18 nt, Human
uuuacuccccuugagcug

SEQ ID NO: 2606492 - RNA, 13 nt, Human
uuuacugaacaau

SEQ ID NO: 2606493 - RNA, 14 nt, Human
uuuacugaagccuu

SEQ ID NO: 2606494 - RNA, 12 nt, Human
uuuacugccacu

SEQ ID NO: 2606495 - RNA, 11 nt, Human
uuuacugccac

SEQ ID NO: 2606496 - RNA, 22 nt, Human
uuuacugccaaagggaaauauc

SEQ ID NO: 2606497 - RNA, 17 nt, Human
uuuacugugaaacuggc

SEQ ID NO: 2606498 - RNA, 20 nt, Human
uuuacugucaaaauaauuuu

SEQ ID NO: 2606499 - RNA, 11 nt, Human
uuuacuuaaac

SEQ ID NO: 2606500 - RNA, 16 nt, Human
uuuacuuaaagauuua

SEQ ID NO: 2606501 - RNA, 15 nt, Human
uuuacuuaaagauuu

SEQ ID NO: 2606502 - RNA, 14 nt, Human
uuuacuuaaagauu

SEQ ID NO: 2606503 - RNA, 14 nt, Human
uuuacuguuuguua

SEQ ID NO: 2606504 - RNA, 16 nt, Human
uuucccuauuagagaa

SEQ ID NO: 2606505 - RNA, 12 nt, Human
uuucccaauuca

SEQ ID NO: 2606506 - RNA, 20 nt, Human
uuucccuaagccaagggccu

SEQ ID NO: 2606507 - RNA, 12 nt, Human
uuucccaacucu

SEQ ID NO: 2606508 - RNA, 15 nt, Human
uuucccaauuaggaa

SEQ ID NO: 2606509 - RNA, 14 nt, Human
uuuccauuguuuga

SEQ ID NO: 2606510 - RNA, 21 nt, Human
uuuccauugguuuaccuguga

SEQ ID NO: 2606511 - RNA, 14 nt, Human
uuuccauuccagaa

SEQ ID NO: 2606512 - RNA, 13 nt, Human
uuuccauuccaga

SEQ ID NO: 2606513 - RNA, 21 nt, Human
uuuccauuauuuauauuaguu

SEQ ID NO: 2606514 - RNA, 13 nt, Human
uuuccauguaucu

SEQ ID NO: 2606515 - RNA, 19 nt, Human
uuuccaugcguguuucuga

SEQ ID NO: 2606516 - RNA, 14 nt, Human
uuuccauguugcug

SEQ ID NO: 2606517 - RNA, 17 nt, Human
uuuccauguugcugcca

SEQ ID NO: 2606518 - RNA, 13 nt, Human
uuuccauuauuua

SEQ ID NO: 2606519 - RNA, 18 nt, Human
uuucauguaaacugugca

SEQ ID NO: 2606520 - RNA, 19 nt, Human
uuucauguaaacugugcac

SEQ ID NO: 2606521 - RNA, 12 nt, Human
uuucauguacaa

SEQ ID NO: 2606522 - RNA, 18 nt, Human
uuucauguacaagaugaa

SEQ ID NO: 2606523 - RNA, 22 nt, Human
uuucauggugaaaauguacuga

SEQ ID NO: 2606524 - RNA, 21 nt, Human
uuucauggugaaaauguacug

SEQ ID NO: 2606525 - RNA, 20 nt, Human
uuucauggugaaaauguacu

SEQ ID NO: 2606526 - RNA, 13 nt, Human
uuucauggacacu

SEQ ID NO: 2606527 - RNA, 18 nt, Human
uuucauggacacuuugaa

SEQ ID NO: 2606528 - RNA, 22 nt, Human
uuucauggggugaugcugggcu

SEQ ID NO: 2606529 - RNA, 11 nt, Human
uuucagaaaug

SEQ ID NO: 2606530 - RNA, 12 nt, Human
uuucagaaaugu

SEQ ID NO: 2606531 - RNA, 23 nt, Human
uuucaucccuaugggauucagug

SEQ ID NO: 2606532 - RNA, 21 nt, Human
uuucauccacuagugcaaauc

SEQ ID NO: 2606533 - RNA, 20 nt, Human
uuucauccacuagugcaaau

SEQ ID NO: 2606534 - RNA, 20 nt, Human
uuucagaaauaugugguuuc

SEQ ID NO: 2606535 - RNA, 20 nt, Human
uuucaucugcucuccuuccu

SEQ ID NO: 2606536 - RNA, 19 nt, Human
uuucaucugcucuccuucc

SEQ ID NO: 2606537 - RNA, 18 nt, Human
uuucaucugcucuccuuc

SEQ ID NO: 2606538 - RNA, 17 nt, Human
uuucaucugcucuccuu

SEQ ID NO: 2606539 - RNA, 16 nt, Human
uuucaucugcucuccu

SEQ ID NO: 2606540 - RNA, 15 nt, Human
uuucaucugcucucc

SEQ ID NO: 2606541 - RNA, 11 nt, Human
uuucaucugcu

SEQ ID NO: 2606542 - RNA, 16 nt, Human
uuucaucuauuucuga

SEQ ID NO: 2606543 - RNA, 13 nt, Human
uuucaucuauuuc

SEQ ID NO: 2606544 - RNA, 18 nt, Human
uuucaucuauuucugaga

SEQ ID NO: 2606545 - RNA, 16 nt, Human
uuucaucucuuguaua

SEQ ID NO: 2606546 - RNA, 19 nt, Human
uuucaaacauauauaacaa

SEQ ID NO: 2606547 - RNA, 12 nt, Human
uuucaaacuuua

SEQ ID NO: 2606548 - RNA, 20 nt, Human
uuucaaacuccugacuuugu

SEQ ID NO: 2606549 - RNA, 14 nt, Human
uuucacaugaacau

SEQ ID NO: 2606550 - RNA, 15 nt, Human
uuucacauuaauauu

SEQ ID NO: 2606551 - RNA, 19 nt, Human
auggaaugguuauaaaagu

SEQ ID NO: 2606552 - RNA, 20 nt, Human
auggaaugguuauaaaagug

SEQ ID NO: 2606553 - RNA, 13 nt, Human
auggaauugauuu

SEQ ID NO: 2606554 - RNA, 14 nt, Human
auggaauugauuug

SEQ ID NO: 2606555 - RNA, 15 nt, Human
auggaauugauuugc

SEQ ID NO: 2606556 - RNA, 16 nt, Human
auggaauugauuugca

SEQ ID NO: 2606557 - RNA, 17 nt, Human
auggaaugcuguguuaa

SEQ ID NO: 2606558 - RNA, 21 nt, Human
auggaaugcuguguuaaauaa

SEQ ID NO: 2606559 - RNA, 18 nt, Human
auggaaugguuauaaaag

SEQ ID NO: 2606560 - RNA, 16 nt, Human
auggaaugguuauaaa

SEQ ID NO: 2606561 - RNA, 20 nt, Human
auggaaugcuugaaaaaugu

SEQ ID NO: 2606562 - RNA, 16 nt, Human
auggaaugcuugaaaa

SEQ ID NO: 2606563 - RNA, 22 nt, Human
auggaagcuuccaguccaaucu

SEQ ID NO: 2606564 - RNA, 15 nt, Human
auggaagcuuccagu

SEQ ID NO: 2606565 - RNA, 15 nt, Human
auggaaugcuugaaa

SEQ ID NO: 2606566 - RNA, 16 nt, Human
uuucagaaauaugugg

SEQ ID NO: 2606567 - RNA, 15 nt, Human
uuucacuauuuccuu

SEQ ID NO: 2606568 - RNA, 16 nt, Human
uuucacuauuuccuuu

SEQ ID NO: 2606569 - RNA, 21 nt, Human
uuucagaaagaaguggggaca

SEQ ID NO: 2606570 - RNA, 14 nt, Human
uuucacggaaguuu

SEQ ID NO: 2606571 - RNA, 23 nt, Human
uuucaccuguuuuuaagcuguuu

SEQ ID NO: 2606572 - RNA, 22 nt, Human
uuucacggugccagguuuucug

SEQ ID NO: 2606573 - RNA, 23 nt, Human
uuucacggaaguuuucaaugaug

SEQ ID NO: 2606574 - RNA, 19 nt, Human
uuucacggaaguuuucaau

SEQ ID NO: 2606575 - RNA, 18 nt, Human
uuucacggaaguuuucaa

SEQ ID NO: 2606576 - RNA, 15 nt, Human
uuucacgggagauuu

SEQ ID NO: 2606577 - RNA, 13 nt, Human
uuucacauucuua

SEQ ID NO: 2606578 - RNA, 13 nt, Human
uuucaccuguaaa

SEQ ID NO: 2606579 - RNA, 16 nt, Human
uuucacauucuuauaa

SEQ ID NO: 2606580 - RNA, 15 nt, Human
uuucacauucuuaua

SEQ ID NO: 2606581 - RNA, 21 nt, Human
uuucacauucuuauaaauaug

SEQ ID NO: 2606582 - RNA, 14 nt, Human
uuucaccuguaaac

SEQ ID NO: 2606583 - RNA, 17 nt, Human
uuucaccuguaaaccug

SEQ ID NO: 2606584 - RNA, 18 nt, Human
uuucaccuguaaaccuga

SEQ ID NO: 2606585 - RNA, 22 nt, Human
uuucaccuguuuuuaagcuguu

SEQ ID NO: 2606586 - RNA, 18 nt, Human
auggaagacagcucuuau

SEQ ID NO: 2606587 - RNA, 17 nt, Human
auggaagacagcucuua

SEQ ID NO: 2606588 - RNA, 14 nt, Human
auggaaggggcuga

SEQ ID NO: 2606589 - RNA, 14 nt, Human
augcuucugggaga

SEQ ID NO: 2606590 - RNA, 17 nt, Human
auggaagauuuuaaauu

SEQ ID NO: 2606591 - RNA, 16 nt, Human
auggaagauuuuaaau

SEQ ID NO: 2606592 - RNA, 17 nt, Human
augcuucugacuucaua

SEQ ID NO: 2606593 - RNA, 21 nt, Human
augcuucuguuuuauaauuuu

SEQ ID NO: 2606594 - RNA, 16 nt, Human
augcuucucacugcca

SEQ ID NO: 2606595 - RNA, 20 nt, Human
augcuucucacugccaugcc

SEQ ID NO: 2606596 - RNA, 22 nt, Human
augcuguauuuuaaaagaauga

SEQ ID NO: 2606597 - RNA, 19 nt, Human
augcuguauuuuaaaagaa

SEQ ID NO: 2606598 - RNA, 20 nt, Human
augcuggcuguuggcugggg

SEQ ID NO: 2606599 - RNA, 19 nt, Human
augcuggcuguuggcuggg

SEQ ID NO: 2606600 - RNA, 23 nt, Human
augcuguauuuuaaaagaaugau

SEQ ID NO: 2606601 - RNA, 15 nt, Human
augcuguugauugcu

SEQ ID NO: 2606602 - RNA, 12 nt, Human
augcuguugauu

SEQ ID NO: 2606603 - RNA, 11 nt, Human
augcuguugau

SEQ ID NO: 2606604 - RNA, 20 nt, Human
augcugucaacuaugauaug

SEQ ID NO: 2606605 - RNA, 15 nt, Human
augcuguugccucau

SEQ ID NO: 2606606 - RNA, 16 nt, Human
augcuguugccucauc

SEQ ID NO: 2606607 - RNA, 17 nt, Human
augcuguugccucaucu

SEQ ID NO: 2606608 - RNA, 18 nt, Human
augcuguugccucaucua

SEQ ID NO: 2606609 - RNA, 19 nt, Human
augcuguugauugcuaaau

SEQ ID NO: 2606610 - RNA, 18 nt, Human
augcuguugauugcuaaa

SEQ ID NO: 2606611 - RNA, 17 nt, Human
augcuguugauugcuaa

SEQ ID NO: 2606612 - RNA, 16 nt, Human
augcuguugauugcua

SEQ ID NO: 2606613 - RNA, 22 nt, Human
augcuguugauugcuaaaugua

SEQ ID NO: 2606614 - RNA, 21 nt, Human
augcuguugauugcuaaaugu

SEQ ID NO: 2606615 - RNA, 23 nt, Human
augcuguugauugcuaaauguaa

SEQ ID NO: 2606616 - RNA, 14 nt, Human
augcuguugccuca

SEQ ID NO: 2606617 - RNA, 16 nt, Human
augcuggagccugugu

SEQ ID NO: 2606618 - RNA, 14 nt, Human
augcuggagccugu

SEQ ID NO: 2606619 - RNA, 13 nt, Human
augcuggagccug

SEQ ID NO: 2606620 - RNA, 12 nt, Human
augcuggagccu

SEQ ID NO: 2606621 - RNA, 11 nt, Human
augcuggagcc

SEQ ID NO: 2606622 - RNA, 15 nt, Human
augcuggagagguua

SEQ ID NO: 2606623 - RNA, 14 nt, Human
augcuggagagguu

SEQ ID NO: 2606624 - RNA, 13 nt, Human
augcuggagaggu

SEQ ID NO: 2606625 - RNA, 12 nt, Human
augcuggagagg

SEQ ID NO: 2606626 - RNA, 23 nt, Human
augcuggagaagagaggagagga

SEQ ID NO: 2606627 - RNA, 19 nt, Human
augcuggagaagagaggag

SEQ ID NO: 2606628 - RNA, 18 nt, Human
augcuggagaagagagga

SEQ ID NO: 2606629 - RNA, 17 nt, Human
augcuggagaagagagg

SEQ ID NO: 2606630 - RNA, 16 nt, Human
augcuggagaagagag

SEQ ID NO: 2606631 - RNA, 15 nt, Human
augcuggagaagaga

SEQ ID NO: 2606632 - RNA, 14 nt, Human
augcuggagaagag

SEQ ID NO: 2606633 - RNA, 18 nt, Human
augcuggcuguuggcugg

SEQ ID NO: 2606634 - RNA, 22 nt, Human
augcuggagccuguguaacagc

SEQ ID NO: 2606635 - RNA, 18 nt, Human
augcuggagccuguguaa

SEQ ID NO: 2606636 - RNA, 19 nt, Human
augcuggaugcuccuucca

SEQ ID NO: 2606637 - RNA, 17 nt, Human
augcuggaugucugcca

SEQ ID NO: 2606638 - RNA, 23 nt, Human
augcuggagccuguguaacagcu

SEQ ID NO: 2606639 - RNA, 14 nt, Human
augcuccuggccca

SEQ ID NO: 2606640 - RNA, 15 nt, Human
augcuccaaaugcug

SEQ ID NO: 2606641 - RNA, 12 nt, Human
augcuggagaag

SEQ ID NO: 2606642 - RNA, 21 nt, Human
augcuggacggcauuccugcu

SEQ ID NO: 2606643 - RNA, 22 nt, Human
augcuggacggcauuccugcuu

SEQ ID NO: 2606644 - RNA, 19 nt, Human
augcuccuggcccacugca

SEQ ID NO: 2606645 - RNA, 16 nt, Human
augcucaucugcuggu

SEQ ID NO: 2606646 - RNA, 14 nt, Human
augcucaucugcug

SEQ ID NO: 2606647 - RNA, 16 nt, Human
augcucccuccccugc

SEQ ID NO: 2606648 - RNA, 17 nt, Human
augcucccuccccugcc

SEQ ID NO: 2606649 - RNA, 18 nt, Human
augcucccuccccugccc

SEQ ID NO: 2606650 - RNA, 19 nt, Human
augcucccuccccugcccu

SEQ ID NO: 2606651 - RNA, 20 nt, Human
augcucccuccccugcccug

SEQ ID NO: 2606652 - RNA, 22 nt, Human
augcucccuccccugcccuggu

SEQ ID NO: 2606653 - RNA, 16 nt, Human
augcucauaacggauc

SEQ ID NO: 2606654 - RNA, 13 nt, Human
augcucaucugcu

SEQ ID NO: 2606655 - RNA, 21 nt, Human
augcucauaacggaucagaaa

SEQ ID NO: 2606656 - RNA, 18 nt, Human
augcucagcccugacugg

SEQ ID NO: 2606657 - RNA, 13 nt, Human
augcucagcccug

SEQ ID NO: 2606658 - RNA, 17 nt, Human
augcucagaccagcucu

SEQ ID NO: 2606659 - RNA, 22 nt, Human
uuuaucacauguauguuuuggu

SEQ ID NO: 2606660 - RNA, 14 nt, Human
uuuaucagaauucu

SEQ ID NO: 2606661 - RNA, 13 nt, Human
uuuaucagugaca

SEQ ID NO: 2606662 - RNA, 18 nt, Human
uuuaucagugacagaguu

SEQ ID NO: 2606663 - RNA, 14 nt, Human
augcucaaguuuuu

SEQ ID NO: 2606664 - RNA, 21 nt, Human
uuuaucagugacagaguucac

SEQ ID NO: 2606665 - RNA, 16 nt, Human
augcucaaguuuuuca

SEQ ID NO: 2606666 - RNA, 15 nt, Human
augcucaaguuuuuc

SEQ ID NO: 2606667 - RNA, 20 nt, Human
augcucaaguuuuucagaaa

SEQ ID NO: 2606668 - RNA, 15 nt, Human
augcucacagucuca

SEQ ID NO: 2606669 - RNA, 12 nt, Human
augcucagacca

SEQ ID NO: 2606670 - RNA, 14 nt, Human
augcucagaccagc

SEQ ID NO: 2606671 - RNA, 21 nt, Human
uuuaaaaaauuaaucugggcc

SEQ ID NO: 2606672 - RNA, 19 nt, Human
augcagaguugacaugaga

SEQ ID NO: 2606673 - RNA, 16 nt, Human
augcagaguugacaug

SEQ ID NO: 2606674 - RNA, 23 nt, Human
augcagagguaaaagugugagca

SEQ ID NO: 2606675 - RNA, 15 nt, Human
augcagagucagcag

SEQ ID NO: 2606676 - RNA, 16 nt, Human
augcagagucagcaga

SEQ ID NO: 2606677 - RNA, 17 nt, Human
augcagagucagcagaa

SEQ ID NO: 2606678 - RNA, 18 nt, Human
uuuaaaaaaauuuaagug

SEQ ID NO: 2606679 - RNA, 17 nt, Human
uuuaaaaaaauuuaagu

SEQ ID NO: 2606680 - RNA, 16 nt, Human
uuuaaaaaaauuuaag

SEQ ID NO: 2606681 - RNA, 21 nt, Human
uuuaaaaaaauaaaacauuuu

SEQ ID NO: 2606682 - RNA, 21 nt, Human
uuuaaaaagaaacaagaugcu

SEQ ID NO: 2606683 - RNA, 23 nt, Human
uuuaaaaacuauuuaacuugagc

SEQ ID NO: 2606684 - RNA, 14 nt, Human
uuuaaaaacuauuu

SEQ ID NO: 2606685 - RNA, 15 nt, Human
uuuaaaaaccuugua

SEQ ID NO: 2606686 - RNA, 21 nt, Human
uuuaaaaacuauuuaacuuga

SEQ ID NO: 2606687 - RNA, 15 nt, Human
uuuaaaaagucuuca

SEQ ID NO: 2606688 - RNA, 23 nt, Human
uuuaaaaauacagauagauauau

SEQ ID NO: 2606689 - RNA, 14 nt, Human
uuuaaaucugugau

SEQ ID NO: 2606690 - RNA, 14 nt, Human
uuuaaaugaagaaa

SEQ ID NO: 2606691 - RNA, 18 nt, Human
uuuaaaugcauaaaugca

SEQ ID NO: 2606692 - RNA, 11 nt, Human
uuuaaaugcac

SEQ ID NO: 2606693 - RNA, 15 nt, Human
uuuaaauguaaagau

SEQ ID NO: 2606694 - RNA, 20 nt, Human
uuuaagacgaaacauuuguu

SEQ ID NO: 2606695 - RNA, 18 nt, Human
uuuaaauguaaagauauu

SEQ ID NO: 2606696 - RNA, 14 nt, Human
uuuaaauggacaga

SEQ ID NO: 2606697 - RNA, 16 nt, Human
uuuaaauguaaaacau

SEQ ID NO: 2606698 - RNA, 21 nt, Human
uuuaaauauaugcuaagucuu

SEQ ID NO: 2606699 - RNA, 20 nt, Human
uuuaaggaugcuuguacaua

SEQ ID NO: 2606700 - RNA, 21 nt, Human
uuuaaggaugcuuguacauaa

SEQ ID NO: 2606701 - RNA, 22 nt, Human
uuuaaggaugcuuguacauaau

SEQ ID NO: 2606702 - RNA, 18 nt, Human
uuuaaggcuaaaacuuaa

SEQ ID NO: 2606703 - RNA, 22 nt, Human
uuuaaggguuuguggaaaauga

SEQ ID NO: 2606704 - RNA, 16 nt, Human
uuuaaugaaagacugu

SEQ ID NO: 2606705 - RNA, 20 nt, Human
uuuaaggguuuguggaaaau

SEQ ID NO: 2606706 - RNA, 17 nt, Human
uuuaaggguuuguggaa

SEQ ID NO: 2606707 - RNA, 19 nt, Human
uuuaaggaugcuuguacau

SEQ ID NO: 2606708 - RNA, 12 nt, Human
uuuaaggaaaca

SEQ ID NO: 2606709 - RNA, 11 nt, Human
uuuaaggaaaa

SEQ ID NO: 2606710 - RNA, 14 nt, Human
uuuaagcuguaaaa

SEQ ID NO: 2606711 - RNA, 12 nt, Human
uuuaaggaauau

SEQ ID NO: 2606712 - RNA, 21 nt, Human
uuuaagcuguuacugucuuca

SEQ ID NO: 2606713 - RNA, 18 nt, Human
uuuaagcuguuuccauag

SEQ ID NO: 2606714 - RNA, 22 nt, Human
uuuaagcuuauuuaauuaaaaa

SEQ ID NO: 2606715 - RNA, 13 nt, Human
uuuaagcuguuuc

SEQ ID NO: 2606716 - RNA, 12 nt, Human
uuuaagcuguuu

SEQ ID NO: 2606717 - RNA, 14 nt, Human
uuuaagagacagcc

SEQ ID NO: 2606718 - RNA, 14 nt, Human
uuuaagaggcaggg

SEQ ID NO: 2606719 - RNA, 11 nt, Human
uuuaagcuguu

SEQ ID NO: 2606720 - RNA, 12 nt, Human
uuuaagagaaau

SEQ ID NO: 2606721 - RNA, 14 nt, Human
uuuaagacuguaau

SEQ ID NO: 2606722 - RNA, 19 nt, Human
uuuaagacguguuuguguu

SEQ ID NO: 2606723 - RNA, 17 nt, Human
uuuaagacguguuugug

SEQ ID NO: 2606724 - RNA, 22 nt, Human
augcacuguucccccugugcag

SEQ ID NO: 2606725 - RNA, 23 nt, Human
augcacuuuguucuggcucuucc

SEQ ID NO: 2606726 - RNA, 14 nt, Human
augcagaauacuuu

SEQ ID NO: 2606727 - RNA, 13 nt, Human
augcagaaggaag

SEQ ID NO: 2606728 - RNA, 14 nt, Human
augcagagagccau

SEQ ID NO: 2606729 - RNA, 13 nt, Human
augcagagagcca

SEQ ID NO: 2606730 - RNA, 22 nt, Human
augcagacaugagugcgugcuc

SEQ ID NO: 2606731 - RNA, 20 nt, Human
augcagaauguuuuuaaaau

SEQ ID NO: 2606732 - RNA, 18 nt, Human
uuuaaaaaaauuccaagu

SEQ ID NO: 2606733 - RNA, 23 nt, Human
augcagagcgccgugaguucuca

SEQ ID NO: 2606734 - RNA, 21 nt, Human
augcagagcgccgugaguucu

SEQ ID NO: 2606735 - RNA, 23 nt, Human
augcagagagccauuuugugaau

SEQ ID NO: 2606736 - RNA, 22 nt, Human
augcagagagccauuuugugaa

SEQ ID NO: 2606737 - RNA, 21 nt, Human
augcagagagccauuuuguga

SEQ ID NO: 2606738 - RNA, 20 nt, Human
augcagagagccauuuugug

SEQ ID NO: 2606739 - RNA, 19 nt, Human
augcagagagccauuuugu

SEQ ID NO: 2606740 - RNA, 16 nt, Human
augcagagagccauuu

SEQ ID NO: 2606741 - RNA, 17 nt, Human
augcagagguccacaac

SEQ ID NO: 2606742 - RNA, 18 nt, Human
augcagagguccacaaca

SEQ ID NO: 2606743 - RNA, 12 nt, Human
augcaaagcacu

SEQ ID NO: 2606744 - RNA, 13 nt, Human
augcaaagcacug

SEQ ID NO: 2606745 - RNA, 14 nt, Human
augcaaagcacuga

SEQ ID NO: 2606746 - RNA, 21 nt, Human
augcaccuugugucuguacac

SEQ ID NO: 2606747 - RNA, 19 nt, Human
augcaccuugugucuguac

SEQ ID NO: 2606748 - RNA, 16 nt, Human
augcaaagaggcaaga

SEQ ID NO: 2606749 - RNA, 21 nt, Human
augcacuguucccccugugca

SEQ ID NO: 2606750 - RNA, 20 nt, Human
augcacugugaaggacccuu

SEQ ID NO: 2606751 - RNA, 18 nt, Human
augcacugugaaggaccc

SEQ ID NO: 2606752 - RNA, 19 nt, Human
augcacugugaaggacccu

SEQ ID NO: 2606753 - RNA, 21 nt, Human
augcacuuuguucuggcucuu

SEQ ID NO: 2606754 - RNA, 16 nt, Human
augcacuaugaggaau

SEQ ID NO: 2606755 - RNA, 13 nt, Human
augcacuaugagg

SEQ ID NO: 2606756 - RNA, 16 nt, Human
augcacgaccuuggga

SEQ ID NO: 2606757 - RNA, 14 nt, Human
augcacgaccuugg

SEQ ID NO: 2606758 - RNA, 22 nt, Human
augcacgugugcacacacacca

SEQ ID NO: 2606759 - RNA, 12 nt, Human
augcacugugaa

SEQ ID NO: 2606760 - RNA, 13 nt, Human
augcacugugaag

SEQ ID NO: 2606761 - RNA, 14 nt, Human
augcacucagcucu

SEQ ID NO: 2606762 - RNA, 17 nt, Human
uuguucuugguuuguaa

SEQ ID NO: 2606763 - RNA, 19 nt, Human
uuguucuugguuuguaaau

SEQ ID NO: 2606764 - RNA, 17 nt, Human
uuguucuuaauugcacu

SEQ ID NO: 2606765 - RNA, 14 nt, Human
uuguucuucuuaaa

SEQ ID NO: 2606766 - RNA, 14 nt, Human
augauuguaaaaua

SEQ ID NO: 2606767 - RNA, 18 nt, Human
augauuuaaaacauguaa

SEQ ID NO: 2606768 - RNA, 14 nt, Human
augauuuaaaacau

SEQ ID NO: 2606769 - RNA, 13 nt, Human
augauuuaaaaca

SEQ ID NO: 2606770 - RNA, 18 nt, Human
augauuguaaaauagcuu

SEQ ID NO: 2606771 - RNA, 15 nt, Human
augauuguaaaauag

SEQ ID NO: 2606772 - RNA, 22 nt, Human
augauugugcacauacuugaga

SEQ ID NO: 2606773 - RNA, 16 nt, Human
augauuuaauaaaaua

SEQ ID NO: 2606774 - RNA, 14 nt, Human
augauuuaauaaaa

SEQ ID NO: 2606775 - RNA, 13 nt, Human
augauuuaauaaa

SEQ ID NO: 2606776 - RNA, 16 nt, Human
augauuuaaaagggaa

SEQ ID NO: 2606777 - RNA, 19 nt, Human
augauuuaauaaaauaauu

SEQ ID NO: 2606778 - RNA, 18 nt, Human
augauuuaauaaaauaau

SEQ ID NO: 2606779 - RNA, 13 nt, Human
augauuuauaguu

SEQ ID NO: 2606780 - RNA, 22 nt, Human
augauuuaauaaaauaauucua

SEQ ID NO: 2606781 - RNA, 13 nt, Human
augauuucauuca

SEQ ID NO: 2606782 - RNA, 14 nt, Human
augauuucauuuca

SEQ ID NO: 2606783 - RNA, 15 nt, Human
augauuuauaguuug

SEQ ID NO: 2606784 - RNA, 14 nt, Human
augauuuauaguuu

SEQ ID NO: 2606785 - RNA, 20 nt, Human
augauuuauaguuuguacau

SEQ ID NO: 2606786 - RNA, 17 nt, Human
augauuuccuugaaugu

SEQ ID NO: 2606787 - RNA, 18 nt, Human
augauuuccuugaaugug

SEQ ID NO: 2606788 - RNA, 19 nt, Human
augauuuccuugaaugugg

SEQ ID NO: 2606789 - RNA, 15 nt, Human
augauuuccuugaau

SEQ ID NO: 2606790 - RNA, 16 nt, Human
augauuuccuugaaug

SEQ ID NO: 2606791 - RNA, 13 nt, Human
augauuuccuuga

SEQ ID NO: 2606792 - RNA, 20 nt, Human
augauuuccaaagagaaaaa

SEQ ID NO: 2606793 - RNA, 15 nt, Human
augauuuuugucauc

SEQ ID NO: 2606794 - RNA, 22 nt, Human
augauuuuuagaugagauuguu

SEQ ID NO: 2606795 - RNA, 17 nt, Human
augauuuuuuuuucaua

SEQ ID NO: 2606796 - RNA, 21 nt, Human
augauuuuuuuuucauacacu

SEQ ID NO: 2606797 - RNA, 21 nt, Human
augcaaaauaauaccugucca

SEQ ID NO: 2606798 - RNA, 21 nt, Human
augcaaaaguucugacuugac

SEQ ID NO: 2606799 - RNA, 20 nt, Human
augcaaaaguucugacuuga

SEQ ID NO: 2606800 - RNA, 14 nt, Human
augcaaagaggcaa

SEQ ID NO: 2606801 - RNA, 15 nt, Human
augcaaagaggcaag

SEQ ID NO: 2606802 - RNA, 12 nt, Human
augcaaaaagaa

SEQ ID NO: 2606803 - RNA, 23 nt, Human
augcaaaagguucacuaaagcag

SEQ ID NO: 2606804 - RNA, 19 nt, Human
augcaaaaauuagccgggc

SEQ ID NO: 2606805 - RNA, 18 nt, Human
augaggucagagccugca

SEQ ID NO: 2606806 - RNA, 16 nt, Human
augaggucagagccug

SEQ ID NO: 2606807 - RNA, 21 nt, Human
augagguacaaccuguucugc

SEQ ID NO: 2606808 - RNA, 15 nt, Human
augaggucagagccu

SEQ ID NO: 2606809 - RNA, 20 nt, Human
augaggucagagccugcagu

SEQ ID NO: 2606810 - RNA, 19 nt, Human
augaggucagagccugcag

SEQ ID NO: 2606811 - RNA, 15 nt, Human
augaguaaaggagua

SEQ ID NO: 2606812 - RNA, 18 nt, Human
augagguugcuuacuaag

SEQ ID NO: 2606813 - RNA, 22 nt, Human
augagguucaacuguugauugc

SEQ ID NO: 2606814 - RNA, 22 nt, Human
augaggucagagccugcaguua

SEQ ID NO: 2606815 - RNA, 17 nt, Human
augagguacugagagug

SEQ ID NO: 2606816 - RNA, 18 nt, Human
augagguacugagaguga

SEQ ID NO: 2606817 - RNA, 15 nt, Human
augagguacugagag

SEQ ID NO: 2606818 - RNA, 23 nt, Human
uuguaauuuuuuuaauuuacaaa

SEQ ID NO: 2606819 - RNA, 22 nt, Human
uuguacaaaaaaaaaguuuuau

SEQ ID NO: 2606820 - RNA, 16 nt, Human
uuguacaaaaaaaaag

SEQ ID NO: 2606821 - RNA, 12 nt, Human
uuguacaaaaua

SEQ ID NO: 2606822 - RNA, 16 nt, Human
uuguagcauuucuuga

SEQ ID NO: 2606823 - RNA, 16 nt, Human
uuguagccuuccucca

SEQ ID NO: 2606824 - RNA, 22 nt, Human
uuguagccuuccuccacauccu

SEQ ID NO: 2606825 - RNA, 14 nt, Human
uuguccacccaccu

SEQ ID NO: 2606826 - RNA, 22 nt, Human
uuguccaauuguugacaguucu

SEQ ID NO: 2606827 - RNA, 19 nt, Human
uuguccaauuguugacagu

SEQ ID NO: 2606828 - RNA, 21 nt, Human
uuguccaacccgaggcccgca

SEQ ID NO: 2606829 - RNA, 21 nt, Human
uugucauauaagauucauauu

SEQ ID NO: 2606830 - RNA, 15 nt, Human
uugucagugacagua

SEQ ID NO: 2606831 - RNA, 15 nt, Human
uugucaguaucugua

SEQ ID NO: 2606832 - RNA, 13 nt, Human
uugucagagcugg

SEQ ID NO: 2606833 - RNA, 15 nt, Human
uugucagagcuggga

SEQ ID NO: 2606834 - RNA, 18 nt, Human
uugucagauaugauaugu

SEQ ID NO: 2606835 - RNA, 12 nt, Human
uugucagcuacu

SEQ ID NO: 2606836 - RNA, 12 nt, Human
uugucagacuuu

SEQ ID NO: 2606837 - RNA, 14 nt, Human
uugucagacuuuaa

SEQ ID NO: 2606838 - RNA, 18 nt, Human
uugucagacuuuaaagaa

SEQ ID NO: 2606839 - RNA, 20 nt, Human
uugucagacuuuaaagaaua

SEQ ID NO: 2606840 - RNA, 23 nt, Human
uugucacaauccuaacacauuau

SEQ ID NO: 2606841 - RNA, 19 nt, Human
uugucaauauuuaaacaug

SEQ ID NO: 2606842 - RNA, 19 nt, Human
uugucaauauuaaauacag

SEQ ID NO: 2606843 - RNA, 18 nt, Human
uugucaauauuaaauaca

SEQ ID NO: 2606844 - RNA, 14 nt, Human
uugucaauauuaaa

SEQ ID NO: 2606845 - RNA, 20 nt, Human
uugucaagucucugcuggcc

SEQ ID NO: 2606846 - RNA, 17 nt, Human
uugucacacacuuuggc

SEQ ID NO: 2606847 - RNA, 20 nt, Human
uugucaauaaaauccauaca

SEQ ID NO: 2606848 - RNA, 14 nt, Human
augaguuugcuuau

SEQ ID NO: 2606849 - RNA, 15 nt, Human
augaguuugcccugg

SEQ ID NO: 2606850 - RNA, 22 nt, Human
augaguuugcccugguuucacu

SEQ ID NO: 2606851 - RNA, 20 nt, Human
augaguuucauagcuaagaa

SEQ ID NO: 2606852 - RNA, 15 nt, Human
augaguuucauagcu

SEQ ID NO: 2606853 - RNA, 19 nt, Human
augaguuguuuucagacuc

SEQ ID NO: 2606854 - RNA, 20 nt, Human
augaguuguuuucagacuca

SEQ ID NO: 2606855 - RNA, 22 nt, Human
augaguuguuuucagacucaga

SEQ ID NO: 2606856 - RNA, 23 nt, Human
augaguuguuuucagacucagac

SEQ ID NO: 2606857 - RNA, 13 nt, Human
augaguccccugu

SEQ ID NO: 2606858 - RNA, 17 nt, Human
augagucaaugugcagu

SEQ ID NO: 2606859 - RNA, 16 nt, Human
augagucaaugugcag

SEQ ID NO: 2606860 - RNA, 19 nt, Human
augagucaaugugcagugu

SEQ ID NO: 2606861 - RNA, 15 nt, Human
augagucccaguggg

SEQ ID NO: 2606862 - RNA, 23 nt, Human
augaguccccuguuuguuucuga

SEQ ID NO: 2606863 - RNA, 18 nt, Human
augaguuggcugggaaua

SEQ ID NO: 2606864 - RNA, 16 nt, Human
augagucccaguggga

SEQ ID NO: 2606865 - RNA, 20 nt, Human
uuguccccaccgcagacagg

SEQ ID NO: 2606866 - RNA, 18 nt, Human
uuguccccaccgcagaca

SEQ ID NO: 2606867 - RNA, 13 nt, Human
uuguccauugucc

SEQ ID NO: 2606868 - RNA, 19 nt, Human
uuguccagcugagcgccag

SEQ ID NO: 2606869 - RNA, 19 nt, Human
uugucccacuaucugggug

SEQ ID NO: 2606870 - RNA, 12 nt, Human
uuguccccacac

SEQ ID NO: 2606871 - RNA, 11 nt, Human
uuguccccaca

SEQ ID NO: 2606872 - RNA, 23 nt, Human
uuguccccaaauccgaaccuccu

SEQ ID NO: 2606873 - RNA, 21 nt, Human
uugucccagaggcugccccac

SEQ ID NO: 2606874 - RNA, 23 nt, Human
uugucccauuucuaaaggccucu

SEQ ID NO: 2606875 - RNA, 13 nt, Human
uuguccagcgccu

SEQ ID NO: 2606876 - RNA, 20 nt, Human
uugucccacucaagccaagc

SEQ ID NO: 2606877 - RNA, 16 nt, Human
uuguccccgacccuug

SEQ ID NO: 2606878 - RNA, 15 nt, Human
uuguccccgacccuu

SEQ ID NO: 2606879 - RNA, 17 nt, Human
uuguccccacacuccua

SEQ ID NO: 2606880 - RNA, 15 nt, Human
uuguccccacacucc

SEQ ID NO: 2606881 - RNA, 11 nt, Human
uuguccccagu

SEQ ID NO: 2606882 - RNA, 18 nt, Human
uugugaggaagccgcugg

SEQ ID NO: 2606883 - RNA, 17 nt, Human
uugugaggaagccgcug

SEQ ID NO: 2606884 - RNA, 22 nt, Human
uugugaggaaagucauuggcuu

SEQ ID NO: 2606885 - RNA, 15 nt, Human
uugugauagcacuuu

SEQ ID NO: 2606886 - RNA, 18 nt, Human
uugugagccaccacgucc

SEQ ID NO: 2606887 - RNA, 20 nt, Human
uugugauacaaugcugugcc

SEQ ID NO: 2606888 - RNA, 21 nt, Human
uugugaauggauuggauuauu

SEQ ID NO: 2606889 - RNA, 14 nt, Human
uugugaauggauug

SEQ ID NO: 2606890 - RNA, 13 nt, Human
uugugaauggauu

SEQ ID NO: 2606891 - RNA, 15 nt, Human
uugugaauggauugg

SEQ ID NO: 2606892 - RNA, 19 nt, Human
uugugacagauuauacaga

SEQ ID NO: 2606893 - RNA, 13 nt, Human
uugugaggaagcc

SEQ ID NO: 2606894 - RNA, 17 nt, Human
uugugaggaaagucauu

SEQ ID NO: 2606895 - RNA, 16 nt, Human
uugugaggaaagucau

SEQ ID NO: 2606896 - RNA, 16 nt, Human
uugugaccaaguuaua

SEQ ID NO: 2606897 - RNA, 16 nt, Human
uugugaccugaaguuc

SEQ ID NO: 2606898 - RNA, 18 nt, Human
uugugaugugaguugcac

SEQ ID NO: 2606899 - RNA, 12 nt, Human
uugugauguguc

SEQ ID NO: 2606900 - RNA, 22 nt, Human
uugugaugucccaacuuguaaa

SEQ ID NO: 2606901 - RNA, 18 nt, Human
uugugaugucccaacuug

SEQ ID NO: 2606902 - RNA, 16 nt, Human
uugugauauggagccc

SEQ ID NO: 2606903 - RNA, 21 nt, Human
uugugauagcacuuucuacaa

SEQ ID NO: 2606904 - RNA, 20 nt, Human
uugugauagcuaacauuuua

SEQ ID NO: 2606905 - RNA, 16 nt, Human
uugugauagcacuuuc

SEQ ID NO: 2606906 - RNA, 19 nt, Human
uugugauagcacuuucuac

SEQ ID NO: 2606907 - RNA, 17 nt, Human
uugugauauggagcccu

SEQ ID NO: 2606908 - RNA, 23 nt, Human
uugugaucagaccauaauguuac

SEQ ID NO: 2606909 - RNA, 23 nt, Human
uugugauuauuucacuuuagaug

SEQ ID NO: 2606910 - RNA, 22 nt, Human
uugugauuauuucacuuuagau

SEQ ID NO: 2606911 - RNA, 18 nt, Human
uugugauuauuucacuuu

SEQ ID NO: 2606912 - RNA, 17 nt, Human
uugugauuauuucacuu

SEQ ID NO: 2606913 - RNA, 19 nt, Human
uugugauucaaucuguaaa

SEQ ID NO: 2606914 - RNA, 23 nt, Human
uugugauucaaucuguaaacugu

SEQ ID NO: 2606915 - RNA, 14 nt, Human
uugugauucugccu

SEQ ID NO: 2606916 - RNA, 15 nt, Human
uuguguacaguuauu

SEQ ID NO: 2606917 - RNA, 21 nt, Human
uuguguaauagaaaacugaaa

SEQ ID NO: 2606918 - RNA, 19 nt, Human
uuguguaauagaaaacuga

SEQ ID NO: 2606919 - RNA, 15 nt, Human
uuguguacagugugu

SEQ ID NO: 2606920 - RNA, 13 nt, Human
uuguucacacucu

SEQ ID NO: 2606921 - RNA, 22 nt, Human
uuguucaauaauaaauauuuuu

SEQ ID NO: 2606922 - RNA, 17 nt, Human
uugugucugcaggauug

SEQ ID NO: 2606923 - RNA, 13 nt, Human
uuguucaauuaga

SEQ ID NO: 2606924 - RNA, 15 nt, Human
uuguucaauuagaau

SEQ ID NO: 2606925 - RNA, 20 nt, Human
uuguucaauaauaaauauuu

SEQ ID NO: 2606926 - RNA, 15 nt, Human
uugugucuguacacg

SEQ ID NO: 2606927 - RNA, 14 nt, Human
uugugucuguacac

SEQ ID NO: 2606928 - RNA, 13 nt, Human
uugugucuguaca

SEQ ID NO: 2606929 - RNA, 13 nt, Human
uugugucugcagg

SEQ ID NO: 2606930 - RNA, 20 nt, Human
uuguguaucguaaccagcca

SEQ ID NO: 2606931 - RNA, 23 nt, Human
uuguguauccauuaucaugugua

SEQ ID NO: 2606932 - RNA, 22 nt, Human
uuguguauccauuaucaugugu

SEQ ID NO: 2606933 - RNA, 21 nt, Human
uuguguauccauuaucaugug

SEQ ID NO: 2606934 - RNA, 20 nt, Human
uuguguauccauuaucaugu

SEQ ID NO: 2606935 - RNA, 14 nt, Human
uuguguauuuaaca

SEQ ID NO: 2606936 - RNA, 13 nt, Human
uuguguauuuaac

SEQ ID NO: 2606937 - RNA, 19 nt, Human
uuguguauuuacgcuuuga

SEQ ID NO: 2606938 - RNA, 21 nt, Human
uuguguauuuaacagggaggg

SEQ ID NO: 2606939 - RNA, 18 nt, Human
uugugucccaugaucccu

SEQ ID NO: 2606940 - RNA, 21 nt, Human
uuguguaucguaaccagccag

SEQ ID NO: 2606941 - RNA, 19 nt, Human
uugugucauguuuaagaaa

SEQ ID NO: 2606942 - RNA, 20 nt, Human
uuguguauuuacgcuuugau

SEQ ID NO: 2606943 - RNA, 22 nt, Human
uuguguauuuacgcuuugauuc

SEQ ID NO: 2606944 - RNA, 23 nt, Human
uuguguauuuacgcuuugauuca

SEQ ID NO: 2606945 - RNA, 21 nt, Human
uugugucaaugggcaaugaca

SEQ ID NO: 2606946 - RNA, 23 nt, Human
auuaaucaaucaucugugugaaa

SEQ ID NO: 2606947 - RNA, 13 nt, Human
auuaaucacuauu

SEQ ID NO: 2606948 - RNA, 16 nt, Human
auuaaucacuauuguu

SEQ ID NO: 2606949 - RNA, 13 nt, Human
auuaaguuaucuu

SEQ ID NO: 2606950 - RNA, 24 nt, Human
auuaagucugugagauucauucau

SEQ ID NO: 2606951 - RNA, 16 nt, Human
auuaauauucauugua

SEQ ID NO: 2606952 - RNA, 17 nt, Human
auuaauauuccucaguu

SEQ ID NO: 2606953 - RNA, 20 nt, Human
auuaagcccucuuccaucau

SEQ ID NO: 2606954 - RNA, 17 nt, Human
auuaauauucauuguau

SEQ ID NO: 2606955 - RNA, 19 nt, Human
auuaauauucauuguauaa

SEQ ID NO: 2606956 - RNA, 14 nt, Human
auuaauauuuuaau

SEQ ID NO: 2606957 - RNA, 16 nt, Human
auuacuguaagaaaau

SEQ ID NO: 2606958 - RNA, 15 nt, Human
auuacuguaagaaaa

SEQ ID NO: 2606959 - RNA, 15 nt, Human
auuacugguccaaaa

SEQ ID NO: 2606960 - RNA, 13 nt, Human
auuacuguuuguc

SEQ ID NO: 2606961 - RNA, 15 nt, Human
auuaaucaugaaugu

SEQ ID NO: 2606962 - RNA, 19 nt, Human
auuaaucaucuauaaagaa

SEQ ID NO: 2606963 - RNA, 14 nt, Human
auuaaucaucuaua

SEQ ID NO: 2606964 - RNA, 18 nt, Human
auuacugucugguuuuaa

SEQ ID NO: 2606965 - RNA, 13 nt, Human
auuacuucugcua

SEQ ID NO: 2606966 - RNA, 12 nt, Human
auuacuucugcu

SEQ ID NO: 2606967 - RNA, 14 nt, Human
auuacuucugcuac

SEQ ID NO: 2606968 - RNA, 15 nt, Human
auuagacuccuccuc

SEQ ID NO: 2606969 - RNA, 16 nt, Human
auuagacuccuccucc

SEQ ID NO: 2606970 - RNA, 13 nt, Human
auuagacuccucc

SEQ ID NO: 2606971 - RNA, 22 nt, Human
auuagacuguaggaagaguagc

SEQ ID NO: 2606972 - RNA, 13 nt, Human
auuagagaagaga

SEQ ID NO: 2606973 - RNA, 20 nt, Human
uuuugcuuuuucugacucca

SEQ ID NO: 2606974 - RNA, 21 nt, Human
uuuugcuuucgaacugcuagu

SEQ ID NO: 2606975 - RNA, 21 nt, Human
uuuugcuuuuggcaaaacucu

SEQ ID NO: 2606976 - RNA, 17 nt, Human
uuuugcuuuuucugacu

SEQ ID NO: 2606977 - RNA, 21 nt, Human
uuuugcuguuguuucuaaaca

SEQ ID NO: 2606978 - RNA, 18 nt, Human
uuuugcuguuuccuuuua

SEQ ID NO: 2606979 - RNA, 14 nt, Human
auuaaaauccucaa

SEQ ID NO: 2606980 - RNA, 16 nt, Human
auuaaaauccucaauc

SEQ ID NO: 2606981 - RNA, 22 nt, Human
auuaaaauauggcuauaaauau

SEQ ID NO: 2606982 - RNA, 11 nt, Human
auuaaaaucuu

SEQ ID NO: 2606983 - RNA, 12 nt, Human
auuaaaaucuua

SEQ ID NO: 2606984 - RNA, 13 nt, Human
auuaaaaucuuaa

SEQ ID NO: 2606985 - RNA, 19 nt, Human
auuaaaaugauuguaaaau

SEQ ID NO: 2606986 - RNA, 18 nt, Human
auuaaaaugauuguaaaa

SEQ ID NO: 2606987 - RNA, 15 nt, Human
auuaaaaucuuaaac

SEQ ID NO: 2606988 - RNA, 13 nt, Human
auuaaaaugaaua

SEQ ID NO: 2606989 - RNA, 20 nt, Human
auuaaaaugauuguaaaaua

SEQ ID NO: 2606990 - RNA, 18 nt, Human
auuaaacagauuuuuaca

SEQ ID NO: 2606991 - RNA, 23 nt, Human
uuuugugcauuaucuagauacug

SEQ ID NO: 2606992 - RNA, 13 nt, Human
uuuugugagaugu

SEQ ID NO: 2606993 - RNA, 21 nt, Human
uuuuguggucauuaagcauug

SEQ ID NO: 2606994 - RNA, 13 nt, Human
uuuuguguacagu

SEQ ID NO: 2606995 - RNA, 14 nt, Human
uuuugugaagcaaa

SEQ ID NO: 2606996 - RNA, 15 nt, Human
uuuuggaggugcuua

SEQ ID NO: 2606997 - RNA, 13 nt, Human
uuuuggaggugcu

SEQ ID NO: 2606998 - RNA, 20 nt, Human
uuuuggagaagguuaucaaa

SEQ ID NO: 2606999 - RNA, 22 nt, Human
uuuugugaaaugaaaacaugua

SEQ ID NO: 2607000 - RNA, 24 nt, Human
uuuugugaaaugaaaacauguaau

SEQ ID NO: 2607001 - RNA, 23 nt, Human
uuuugugacuauauagagauguu

SEQ ID NO: 2607002 - RNA, 23 nt, Human
uuuugugaauggauuggauuauu

SEQ ID NO: 2607003 - RNA, 14 nt, Human
uuuugugaagacug

SEQ ID NO: 2607004 - RNA, 19 nt, Human
uuuugugaauggauuggau

SEQ ID NO: 2607005 - RNA, 14 nt, Human
uuuugugaacuuuu

SEQ ID NO: 2607006 - RNA, 21 nt, Human
uuuugugaaguuuaauugacu

SEQ ID NO: 2607007 - RNA, 15 nt, Human
uuuuuauauuuaguu

SEQ ID NO: 2607008 - RNA, 13 nt, Human
uuuuuacaauaaa

SEQ ID NO: 2607009 - RNA, 19 nt, Human
uuuuuacaaguuuuaaaua

SEQ ID NO: 2607010 - RNA, 14 nt, Human
uuuuuauauauaca

SEQ ID NO: 2607011 - RNA, 21 nt, Human
uuuuuaaugugcuguguaaag

SEQ ID NO: 2607012 - RNA, 20 nt, Human
uuuuuaaugugcuguguaaa

SEQ ID NO: 2607013 - RNA, 19 nt, Human
uuuuuaauucaccaaagua

SEQ ID NO: 2607014 - RNA, 12 nt, Human
uuuuuaauuauu

SEQ ID NO: 2607015 - RNA, 17 nt, Human
uuuuguuuuucauucag

SEQ ID NO: 2607016 - RNA, 20 nt, Human
uuuuuaauuguuguuucuuu

SEQ ID NO: 2607017 - RNA, 18 nt, Human
uuuuuaauuguuguuucu

SEQ ID NO: 2607018 - RNA, 23 nt, Human
uuuuuaauuuacaaaaauauaaa

SEQ ID NO: 2607019 - RNA, 21 nt, Human
uuuuuaauuuauuauugaaau

SEQ ID NO: 2607020 - RNA, 16 nt, Human
uuuuuaauuuauuuau

SEQ ID NO: 2607021 - RNA, 18 nt, Human
uuuuuacaaguuuuaaau

SEQ ID NO: 2607022 - RNA, 18 nt, Human
uuuuuaauuuuguauuuu

SEQ ID NO: 2607023 - RNA, 12 nt, Human
uuuuuaauuuug

SEQ ID NO: 2607024 - RNA, 15 nt, Human
uuuuguuuucauuau

SEQ ID NO: 2607025 - RNA, 15 nt, Human
uuuuguuuuggcuga

SEQ ID NO: 2607026 - RNA, 16 nt, Human
uuuuguuuuaaaauua

SEQ ID NO: 2607027 - RNA, 16 nt, Human
uuuuguuuuugucuua

SEQ ID NO: 2607028 - RNA, 23 nt, Human
uuuuguucgcauggucacacacu

SEQ ID NO: 2607029 - RNA, 19 nt, Human
uuuuguucuuaauugcacu

SEQ ID NO: 2607030 - RNA, 19 nt, Human
uuuuguuccccuccuccac

SEQ ID NO: 2607031 - RNA, 15 nt, Human
uuuuguuccccuccu

SEQ ID NO: 2607032 - RNA, 16 nt, Human
uuuuguuaccuuuaug

SEQ ID NO: 2607033 - RNA, 14 nt, Human
uuuuguuccccucc

SEQ ID NO: 2607034 - RNA, 10 nt, Human
uuuuuguaaa

SEQ ID NO: 2607035 - RNA, 18 nt, Human
uuuuugguugucaauauu

SEQ ID NO: 2607036 - RNA, 16 nt, Human
uuuuuguagccuuccu

SEQ ID NO: 2607037 - RNA, 14 nt, Human
uuuuuguaaagugu

SEQ ID NO: 2607038 - RNA, 20 nt, Human
uuuuuggaggugcuuaagca

SEQ ID NO: 2607039 - RNA, 20 nt, Human
uuuuuggcuuuagacacugg

SEQ ID NO: 2607040 - RNA, 22 nt, Human
uuuuugggaaaagaaaagucaa

SEQ ID NO: 2607041 - RNA, 12 nt, Human
uuuuuggggaua

SEQ ID NO: 2607042 - RNA, 16 nt, Human
uuuuuggggauaugcu

SEQ ID NO: 2607043 - RNA, 18 nt, Human
auuaaguacuauguauca

SEQ ID NO: 2607044 - RNA, 17 nt, Human
auuaaguaucugacauc

SEQ ID NO: 2607045 - RNA, 19 nt, Human
auuaaguacuauguaucaa

SEQ ID NO: 2607046 - RNA, 15 nt, Human
auuaaggauuuuaug

SEQ ID NO: 2607047 - RNA, 17 nt, Human
auuaaggauuuuaugcu

SEQ ID NO: 2607048 - RNA, 20 nt, Human
auuaaggauuuuaugcuuua

SEQ ID NO: 2607049 - RNA, 13 nt, Human
auuaaggaagaca

SEQ ID NO: 2607050 - RNA, 17 nt, Human
auuaagcccucuuccau

SEQ ID NO: 2607051 - RNA, 16 nt, Human
auuaagcccucuucca

SEQ ID NO: 2607052 - RNA, 15 nt, Human
auuaagccuuccaca

SEQ ID NO: 2607053 - RNA, 11 nt, Human
uuuuuguauuu

SEQ ID NO: 2607054 - RNA, 12 nt, Human
uuuuuguauguu

SEQ ID NO: 2607055 - RNA, 20 nt, Human
uuuuugaggcuaugaauaua

SEQ ID NO: 2607056 - RNA, 15 nt, Human
uuuuugcaagugaag

SEQ ID NO: 2607057 - RNA, 18 nt, Human
uuuuugcaagugaagguu

SEQ ID NO: 2607058 - RNA, 21 nt, Human
uuuuugauaaaguuucucaga

SEQ ID NO: 2607059 - RNA, 14 nt, Human
uuuuugauagcuuu

SEQ ID NO: 2607060 - RNA, 17 nt, Human
uuuuugcauuuaaaaca

SEQ ID NO: 2607061 - RNA, 14 nt, Human
uuuuugccuucauu

SEQ ID NO: 2607062 - RNA, 21 nt, Human
uuuuugcauggcacuugcauc

SEQ ID NO: 2607063 - RNA, 20 nt, Human
uuuuugcaccccaugcuguu

SEQ ID NO: 2607064 - RNA, 19 nt, Human
uuuuugcaccccaugcugu

SEQ ID NO: 2607065 - RNA, 20 nt, Human
uuuuugcacauguuuccucu

SEQ ID NO: 2607066 - RNA, 23 nt, Human
uuuuugcaccccaugcuguugau

SEQ ID NO: 2607067 - RNA, 22 nt, Human
uuuuugcaccccaugcuguuga

SEQ ID NO: 2607068 - RNA, 18 nt, Human
uuuuugcaggagcaguau

SEQ ID NO: 2607069 - RNA, 22 nt, Human
uuuuuggaagaggacuccuuaa

SEQ ID NO: 2607070 - RNA, 15 nt, Human
uuuuuggaggugcuu

SEQ ID NO: 2607071 - RNA, 22 nt, Human
uuuuuggagggguuuaugcuca

SEQ ID NO: 2607072 - RNA, 21 nt, Human
uuuuuggagaagguuaucaaa

SEQ ID NO: 2607073 - RNA, 15 nt, Human
uuuuugaagcuguau

SEQ ID NO: 2607074 - RNA, 24 nt, Human
uuuuugaaguguaggcagacacag

SEQ ID NO: 2607075 - RNA, 14 nt, Human
uuuuugaaguguag

SEQ ID NO: 2607076 - RNA, 12 nt, Human
uuuuugaagugu

SEQ ID NO: 2607077 - RNA, 11 nt, Human
uuuuugaagug

SEQ ID NO: 2607078 - RNA, 12 nt, Human
uuuuucaauuaa

SEQ ID NO: 2607079 - RNA, 22 nt, Human
uuuuugaaggcagaaagcaaaa

SEQ ID NO: 2607080 - RNA, 23 nt, Human
uuuuugaaggcagaaagcaaaau

SEQ ID NO: 2607081 - RNA, 19 nt, Human
uuuuucaaagauguguugc

SEQ ID NO: 2607082 - RNA, 16 nt, Human
uuuuucaauauuuauu

SEQ ID NO: 2607083 - RNA, 17 nt, Human
uuuuuauauuugaaaua

SEQ ID NO: 2607084 - RNA, 12 nt, Human
uuuuuauuucug

SEQ ID NO: 2607085 - RNA, 19 nt, Human
uuuuuauuuguuugugcau

SEQ ID NO: 2607086 - RNA, 15 nt, Human
auucagccuggcuuc

SEQ ID NO: 2607087 - RNA, 19 nt, Human
auuauuuuuucagaccgaa

SEQ ID NO: 2607088 - RNA, 17 nt, Human
auuauuuuuucagaccg

SEQ ID NO: 2607089 - RNA, 16 nt, Human
auucaaaaaguguuua

SEQ ID NO: 2607090 - RNA, 14 nt, Human
auucaaaaaguguu

SEQ ID NO: 2607091 - RNA, 17 nt, Human
auucaaaaaguguuuau

SEQ ID NO: 2607092 - RNA, 13 nt, Human
auuauuuaauaaa

SEQ ID NO: 2607093 - RNA, 12 nt, Human
auuauuuaauaa

SEQ ID NO: 2607094 - RNA, 22 nt, Human
auuauuuuuccacuuuguucuu

SEQ ID NO: 2607095 - RNA, 19 nt, Human
auuauuuuuccacuuuguu

SEQ ID NO: 2607096 - RNA, 21 nt, Human
auuauuuuuucagaccgaaaa

SEQ ID NO: 2607097 - RNA, 16 nt, Human
auuauuuuuucagacc

SEQ ID NO: 2607098 - RNA, 15 nt, Human
auuauuuuuucagac

SEQ ID NO: 2607099 - RNA, 14 nt, Human
auuauuuuuucaga

SEQ ID NO: 2607100 - RNA, 13 nt, Human
auuauuuuuucag

SEQ ID NO: 2607101 - RNA, 12 nt, Human
auuauuuaaaca

SEQ ID NO: 2607102 - RNA, 11 nt, Human
auuauuuaaac

SEQ ID NO: 2607103 - RNA, 19 nt, Human
auuauugugauuucccgug

SEQ ID NO: 2607104 - RNA, 16 nt, Human
auuauuguauuuauuc

SEQ ID NO: 2607105 - RNA, 13 nt, Human
auuauuguauuua

SEQ ID NO: 2607106 - RNA, 18 nt, Human
auuauuguugcauuaaaa

SEQ ID NO: 2607107 - RNA, 23 nt, Human
auuauuguguguuauuuaaauga

SEQ ID NO: 2607108 - RNA, 18 nt, Human
auuauuggaauuaaccug

SEQ ID NO: 2607109 - RNA, 14 nt, Human
auuauuggaauuaa

SEQ ID NO: 2607110 - RNA, 13 nt, Human
auuauugcuguug

SEQ ID NO: 2607111 - RNA, 15 nt, Human
auuauucagugucac

SEQ ID NO: 2607112 - RNA, 12 nt, Human
auuauugcauua

SEQ ID NO: 2607113 - RNA, 21 nt, Human
auucacucauacaucuggccg

SEQ ID NO: 2607114 - RNA, 14 nt, Human
auucacuauuggcu

SEQ ID NO: 2607115 - RNA, 20 nt, Human
auucacuauuggcugggagu

SEQ ID NO: 2607116 - RNA, 13 nt, Human
auucacucccaca

SEQ ID NO: 2607117 - RNA, 12 nt, Human
auucacucccac

SEQ ID NO: 2607118 - RNA, 15 nt, Human
auucacucuuccaga

SEQ ID NO: 2607119 - RNA, 23 nt, Human
auucaccuuccagugucucggag

SEQ ID NO: 2607120 - RNA, 16 nt, Human
auucacccccaaacag

SEQ ID NO: 2607121 - RNA, 16 nt, Human
auucacccccuuuccu

SEQ ID NO: 2607122 - RNA, 13 nt, Human
auucaccugagca

SEQ ID NO: 2607123 - RNA, 19 nt, Human
auucaccugccccaacucu

SEQ ID NO: 2607124 - RNA, 22 nt, Human
auucacccccuuuccuggacac

SEQ ID NO: 2607125 - RNA, 19 nt, Human
auucacccagacagcuccc

SEQ ID NO: 2607126 - RNA, 14 nt, Human
auucacccagacag

SEQ ID NO: 2607127 - RNA, 22 nt, Human
auucaaacagucucaggaaauc

SEQ ID NO: 2607128 - RNA, 17 nt, Human
auucaaacuggggccuc

SEQ ID NO: 2607129 - RNA, 19 nt, Human
auucaaacuggggccucca

SEQ ID NO: 2607130 - RNA, 17 nt, Human
auucaaagcucuauuaa

SEQ ID NO: 2607131 - RNA, 19 nt, Human
auucaaagcaccaaaauaa

SEQ ID NO: 2607132 - RNA, 22 nt, Human
auucaaacuggggccuccagaa

SEQ ID NO: 2607133 - RNA, 13 nt, Human
auuauucaguguc

SEQ ID NO: 2607134 - RNA, 14 nt, Human
auuauucaguguca

SEQ ID NO: 2607135 - RNA, 20 nt, Human
auuauauggcuugaguuuaa

SEQ ID NO: 2607136 - RNA, 16 nt, Human
auuauaucuaauuauu

SEQ ID NO: 2607137 - RNA, 19 nt, Human
auuauaucaauuuccucau

SEQ ID NO: 2607138 - RNA, 15 nt, Human
auuauaacuuaaaaa

SEQ ID NO: 2607139 - RNA, 22 nt, Human
auuauaacuuaaaaaaaugaca

SEQ ID NO: 2607140 - RNA, 15 nt, Human
auuauaacuuaaaau

SEQ ID NO: 2607141 - RNA, 15 nt, Human
auuauaaauuauguu

SEQ ID NO: 2607142 - RNA, 21 nt, Human
auuauaacugaaggagaaggu

SEQ ID NO: 2607143 - RNA, 13 nt, Human
auuaguuuugauu

SEQ ID NO: 2607144 - RNA, 17 nt, Human
auuccaagugauugaaa

SEQ ID NO: 2607145 - RNA, 16 nt, Human
auuccagaauaucugg

SEQ ID NO: 2607146 - RNA, 17 nt, Human
auuccaauaugaugacu

SEQ ID NO: 2607147 - RNA, 18 nt, Human
auuccaauaugaugacuc

SEQ ID NO: 2607148 - RNA, 12 nt, Human
auuccagaauau

SEQ ID NO: 2607149 - RNA, 12 nt, Human
auuccacagcug

SEQ ID NO: 2607150 - RNA, 15 nt, Human
auuccagaaugcugu

SEQ ID NO: 2607151 - RNA, 19 nt, Human
auuccagaaugcuguacau

SEQ ID NO: 2607152 - RNA, 14 nt, Human
auuccagaaugcug

SEQ ID NO: 2607153 - RNA, 18 nt, Human
auuccagaauaucuggga

SEQ ID NO: 2607154 - RNA, 20 nt, Human
auuccagaaugcuguacauc

SEQ ID NO: 2607155 - RNA, 23 nt, Human
auuccagaaugcuguacaucuau

SEQ ID NO: 2607156 - RNA, 17 nt, Human
auuccagaccugaagaa

SEQ ID NO: 2607157 - RNA, 18 nt, Human
auuccagaccugaagaau

SEQ ID NO: 2607158 - RNA, 23 nt, Human
auuccagacugcuuccaauuuuc

SEQ ID NO: 2607159 - RNA, 18 nt, Human
auuccagagaguggcucc

SEQ ID NO: 2607160 - RNA, 17 nt, Human
auucccaagcucugcuc

SEQ ID NO: 2607161 - RNA, 19 nt, Human
auucccaagcucugcuccu

SEQ ID NO: 2607162 - RNA, 18 nt, Human
auucccaagcucugcucc

SEQ ID NO: 2607163 - RNA, 20 nt, Human
auuccccaggaggccagccu

SEQ ID NO: 2607164 - RNA, 19 nt, Human
auucccacaccuccacagu

SEQ ID NO: 2607165 - RNA, 18 nt, Human
auucccacaccuccacag

SEQ ID NO: 2607166 - RNA, 18 nt, Human
auuccagagacaucagca

SEQ ID NO: 2607167 - RNA, 22 nt, Human
auuccccaggaggccagccuug

SEQ ID NO: 2607168 - RNA, 14 nt, Human
auuccccauucuuc

SEQ ID NO: 2607169 - RNA, 15 nt, Human
auucccaccaagguc

SEQ ID NO: 2607170 - RNA, 14 nt, Human
auucccaccaaggu

SEQ ID NO: 2607171 - RNA, 21 nt, Human
auuccccagguggcugaccca

SEQ ID NO: 2607172 - RNA, 22 nt, Human
auuccccagguggcugacccag

SEQ ID NO: 2607173 - RNA, 19 nt, Human
auuccuaaacuaucuuuuu

SEQ ID NO: 2607174 - RNA, 17 nt, Human
auuccuaaacuaucuuu

SEQ ID NO: 2607175 - RNA, 15 nt, Human
auuccuaaacuaucu

SEQ ID NO: 2607176 - RNA, 20 nt, Human
auuccccauugccuccuccu

SEQ ID NO: 2607177 - RNA, 17 nt, Human
auuccccauugccuccu

SEQ ID NO: 2607178 - RNA, 13 nt, Human
auuccccauugcc

SEQ ID NO: 2607179 - RNA, 15 nt, Human
auuccccauucuucc

SEQ ID NO: 2607180 - RNA, 20 nt, Human
auuccuaacacagcaugugu

SEQ ID NO: 2607181 - RNA, 20 nt, Human
auuccuaaacuaucuuuuuu

SEQ ID NO: 2607182 - RNA, 18 nt, Human
auuccuacaaagauguuu

SEQ ID NO: 2607183 - RNA, 13 nt, Human
auucagguauguu

SEQ ID NO: 2607184 - RNA, 18 nt, Human
auucagguauguugccuu

SEQ ID NO: 2607185 - RNA, 15 nt, Human
auucagugagggucu

SEQ ID NO: 2607186 - RNA, 17 nt, Human
auucagguauguugccu

SEQ ID NO: 2607187 - RNA, 16 nt, Human
auucagugagggucuu

SEQ ID NO: 2607188 - RNA, 21 nt, Human
auucagugagggucuucuuac

SEQ ID NO: 2607189 - RNA, 22 nt, Human
auucaggagaguagaacagaua

SEQ ID NO: 2607190 - RNA, 21 nt, Human
auucaggagaguagaacagau

SEQ ID NO: 2607191 - RNA, 22 nt, Human
auucaggacuuaacggcuccag

SEQ ID NO: 2607192 - RNA, 11 nt, Human
auucaggcugc

SEQ ID NO: 2607193 - RNA, 13 nt, Human
auucaggcugcuu

SEQ ID NO: 2607194 - RNA, 16 nt, Human
auucaggcugcuuggg

SEQ ID NO: 2607195 - RNA, 17 nt, Human
auucagugauuacuguc

SEQ ID NO: 2607196 - RNA, 19 nt, Human
auucagugauuacugucaa

SEQ ID NO: 2607197 - RNA, 15 nt, Human
auucagugauuacug

SEQ ID NO: 2607198 - RNA, 17 nt, Human
auucagugcuguggccu

SEQ ID NO: 2607199 - RNA, 20 nt, Human
auucagugcuguggccuggg

SEQ ID NO: 2607200 - RNA, 19 nt, Human
auucaguggcgagaaauaa

SEQ ID NO: 2607201 - RNA, 14 nt, Human
auucagugcuucuu

SEQ ID NO: 2607202 - RNA, 17 nt, Human
auucagugcuucuuaaa

SEQ ID NO: 2607203 - RNA, 21 nt, Human
auucagugcuguggccugggc

SEQ ID NO: 2607204 - RNA, 22 nt, Human
auucagugcuguggccugggca

SEQ ID NO: 2607205 - RNA, 14 nt, Human
auucagugucacug

SEQ ID NO: 2607206 - RNA, 19 nt, Human
auucaguguuaaaugugau

SEQ ID NO: 2607207 - RNA, 16 nt, Human
auucaguucccagaau

SEQ ID NO: 2607208 - RNA, 19 nt, Human
auucaguucccagaaucaa

SEQ ID NO: 2607209 - RNA, 17 nt, Human
auucaguucccagaauc

SEQ ID NO: 2607210 - RNA, 19 nt, Human
auucagugcuucuuaaaga

SEQ ID NO: 2607211 - RNA, 17 nt, Human
auucagauuguuaucua

SEQ ID NO: 2607212 - RNA, 19 nt, Human
auucagauuuuaaaaaguc

SEQ ID NO: 2607213 - RNA, 14 nt, Human
auucagauuuuaaa

SEQ ID NO: 2607214 - RNA, 17 nt, Human
auucagcacugauuuca

SEQ ID NO: 2607215 - RNA, 14 nt, Human
auucagcacugauu

SEQ ID NO: 2607216 - RNA, 14 nt, Human
auucagccuggcuu

SEQ ID NO: 2607217 - RNA, 21 nt, Human
auucagcacugauuucacaac

SEQ ID NO: 2607218 - RNA, 20 nt, Human
auucagcacugauuucacaa

SEQ ID NO: 2607219 - RNA, 19 nt, Human
auucagcacugauuucaca

SEQ ID NO: 2607220 - RNA, 21 nt, Human
auucaggacuuaacggcucca

SEQ ID NO: 2607221 - RNA, 19 nt, Human
auucacucuuccagaaucc

SEQ ID NO: 2607222 - RNA, 21 nt, Human
auucacucccacacccaagaa

SEQ ID NO: 2607223 - RNA, 15 nt, Human
auucacugcccccag

SEQ ID NO: 2607224 - RNA, 20 nt, Human
auucacugcccccagcucuu

SEQ ID NO: 2607225 - RNA, 16 nt, Human
auucacuuauauguuc

SEQ ID NO: 2607226 - RNA, 12 nt, Human
auucagaaaaaa

SEQ ID NO: 2607227 - RNA, 14 nt, Human
auucacuugcauuu

SEQ ID NO: 2607228 - RNA, 23 nt, Human
augugauauauaaguguacauau

SEQ ID NO: 2607229 - RNA, 22 nt, Human
augugauauauaaguguacaua

SEQ ID NO: 2607230 - RNA, 21 nt, Human
augugauauauaaguguacau

SEQ ID NO: 2607231 - RNA, 19 nt, Human
augugauauauaaguguac

SEQ ID NO: 2607232 - RNA, 17 nt, Human
augugauauauaagugu

SEQ ID NO: 2607233 - RNA, 16 nt, Human
augugauauauaagug

SEQ ID NO: 2607234 - RNA, 23 nt, Human
augugauccuuuuauguuauuua

SEQ ID NO: 2607235 - RNA, 21 nt, Human
augugauccuuuuauguuauu

SEQ ID NO: 2607236 - RNA, 18 nt, Human
augugauccuuuuauguu

SEQ ID NO: 2607237 - RNA, 17 nt, Human
augugauccuuuuaugu

SEQ ID NO: 2607238 - RNA, 16 nt, Human
augugauccuuuuaug

SEQ ID NO: 2607239 - RNA, 18 nt, Human
augugauccuuuuggagu

SEQ ID NO: 2607240 - RNA, 17 nt, Human
augugaugaauacugua

SEQ ID NO: 2607241 - RNA, 19 nt, Human
augugaugaauacuguauu

SEQ ID NO: 2607242 - RNA, 21 nt, Human
uuuguaagaguguagaagcau

SEQ ID NO: 2607243 - RNA, 19 nt, Human
uuuguaagaguguagaagc

SEQ ID NO: 2607244 - RNA, 18 nt, Human
uuuguaagaguguagaag

SEQ ID NO: 2607245 - RNA, 17 nt, Human
uuuguaagaguguagaa

SEQ ID NO: 2607246 - RNA, 16 nt, Human
uuuguaagaguguaga

SEQ ID NO: 2607247 - RNA, 12 nt, Human
uuuguaagagug

SEQ ID NO: 2607248 - RNA, 14 nt, Human
uuuguaagaugcug

SEQ ID NO: 2607249 - RNA, 22 nt, Human
uuuguaagaguguagaagcauu

SEQ ID NO: 2607250 - RNA, 23 nt, Human
uuuguaagaguguagaagcauuc

SEQ ID NO: 2607251 - RNA, 15 nt, Human
uuuguaagaugcugg

SEQ ID NO: 2607252 - RNA, 22 nt, Human
uuuguaaguuagguaacuguau

SEQ ID NO: 2607253 - RNA, 13 nt, Human
uuuguaaguuuau

SEQ ID NO: 2607254 - RNA, 16 nt, Human
uuuguaauuuuuuuau

SEQ ID NO: 2607255 - RNA, 23 nt, Human
uuuguacaaaaaaaaaguuuuau

SEQ ID NO: 2607256 - RNA, 14 nt, Human
uuuguaaguuucag

SEQ ID NO: 2607257 - RNA, 21 nt, Human
uuuguaaguuuaugucuaaag

SEQ ID NO: 2607258 - RNA, 21 nt, Human
uuuguaaguuucaggugacau

SEQ ID NO: 2607259 - RNA, 14 nt, Human
uuuguacagacaac

SEQ ID NO: 2607260 - RNA, 17 nt, Human
uuuguacaguuugcugu

SEQ ID NO: 2607261 - RNA, 19 nt, Human
uuuguacagacguaugcuu

SEQ ID NO: 2607262 - RNA, 22 nt, Human
uuuguacagacguaugcuuauu

SEQ ID NO: 2607263 - RNA, 21 nt, Human
uuuguacaauugaacuuaaau

SEQ ID NO: 2607264 - RNA, 10 nt, Human
uuuguacaga

SEQ ID NO: 2607265 - RNA, 18 nt, Human
uuuguacagacguaugcu

SEQ ID NO: 2607266 - RNA, 17 nt, Human
uuuguaguguuggagaa

SEQ ID NO: 2607267 - RNA, 19 nt, Human
uuuguacauaguuauuuau

SEQ ID NO: 2607268 - RNA, 18 nt, Human
uuuguacaguuugcugua

SEQ ID NO: 2607269 - RNA, 22 nt, Human
uuugugauacaaugcugugccc

SEQ ID NO: 2607270 - RNA, 19 nt, Human
uuugucuuauauauauuuc

SEQ ID NO: 2607271 - RNA, 14 nt, Human
uuugucuuauauau

SEQ ID NO: 2607272 - RNA, 20 nt, Human
uuugucuuauauauauuucu

SEQ ID NO: 2607273 - RNA, 15 nt, Human
uuugugauacaaugc

SEQ ID NO: 2607274 - RNA, 19 nt, Human
uuugugcauuaucuagaua

SEQ ID NO: 2607275 - RNA, 20 nt, Human
uuugugauauggagcccugu

SEQ ID NO: 2607276 - RNA, 19 nt, Human
uuugugauauggagcccug

SEQ ID NO: 2607277 - RNA, 15 nt, Human
uuugugauucaaucu

SEQ ID NO: 2607278 - RNA, 16 nt, Human
uuugugauacaaugcu

SEQ ID NO: 2607279 - RNA, 23 nt, Human
uuugucuuaaaaaguggaaaaau

SEQ ID NO: 2607280 - RNA, 13 nt, Human
uuugucuuaaaaa

SEQ ID NO: 2607281 - RNA, 14 nt, Human
uuugucuuaaaaag

SEQ ID NO: 2607282 - RNA, 23 nt, Human
uuugugcuaucagacuguaggau

SEQ ID NO: 2607283 - RNA, 22 nt, Human
uuugugcugaauguugggacug

SEQ ID NO: 2607284 - RNA, 13 nt, Human
uuugugccagccg

SEQ ID NO: 2607285 - RNA, 13 nt, Human
uuuguuucauauu

SEQ ID NO: 2607286 - RNA, 22 nt, Human
uuugugcauuaucuagauacug

SEQ ID NO: 2607287 - RNA, 17 nt, Human
uuugugauuuagaacug

SEQ ID NO: 2607288 - RNA, 20 nt, Human
uuugugauucaaucuguaaa

SEQ ID NO: 2607289 - RNA, 14 nt, Human
uuuguuucugaaag

SEQ ID NO: 2607290 - RNA, 14 nt, Human
uuuguuuccuuugu

SEQ ID NO: 2607291 - RNA, 15 nt, Human
uuuguuuccuuuguu

SEQ ID NO: 2607292 - RNA, 18 nt, Human
uuuguuucucccccuggg

SEQ ID NO: 2607293 - RNA, 15 nt, Human
uuuguuucuaccucc

SEQ ID NO: 2607294 - RNA, 16 nt, Human
uuuguuucugaaaggg

SEQ ID NO: 2607295 - RNA, 15 nt, Human
uuuguuuuaaaauua

SEQ ID NO: 2607296 - RNA, 13 nt, Human
augugagaccauu

SEQ ID NO: 2607297 - RNA, 14 nt, Human
augugagacugguu

SEQ ID NO: 2607298 - RNA, 18 nt, Human
augugacuuugcaucagc

SEQ ID NO: 2607299 - RNA, 14 nt, Human
augugagagaaagu

SEQ ID NO: 2607300 - RNA, 16 nt, Human
augugagagguuugac

SEQ ID NO: 2607301 - RNA, 15 nt, Human
augugagagaaagug

SEQ ID NO: 2607302 - RNA, 15 nt, Human
augugauauauaagu

SEQ ID NO: 2607303 - RNA, 13 nt, Human
augugauauauaa

SEQ ID NO: 2607304 - RNA, 21 nt, Human
augugauacccauagcuucca

SEQ ID NO: 2607305 - RNA, 21 nt, Human
augugauaaguucuuaugcca

SEQ ID NO: 2607306 - RNA, 20 nt, Human
augugauaaggaucagaaca

SEQ ID NO: 2607307 - RNA, 17 nt, Human
augugagagguuugacu

SEQ ID NO: 2607308 - RNA, 23 nt, Human
augucgucaaagcugaaauggac

SEQ ID NO: 2607309 - RNA, 21 nt, Human
augucgugaccaacuagacau

SEQ ID NO: 2607310 - RNA, 20 nt, Human
augucgugaccaacuagaca

SEQ ID NO: 2607311 - RNA, 19 nt, Human
augucgugaccaacuagac

SEQ ID NO: 2607312 - RNA, 13 nt, Human
augucggccucua

SEQ ID NO: 2607313 - RNA, 17 nt, Human
auguccuccuuguucua

SEQ ID NO: 2607314 - RNA, 15 nt, Human
augucgccucugcau

SEQ ID NO: 2607315 - RNA, 23 nt, Human
auguccuccagaagccucuggcu

SEQ ID NO: 2607316 - RNA, 20 nt, Human
auguccuccagaagccucug

SEQ ID NO: 2607317 - RNA, 22 nt, Human
auguccuccagaagccucuggc

SEQ ID NO: 2607318 - RNA, 22 nt, Human
augucgugaccaacuagacauu

SEQ ID NO: 2607319 - RNA, 13 nt, Human
augucuaaagagc

SEQ ID NO: 2607320 - RNA, 11 nt, Human
augucuaaaga

SEQ ID NO: 2607321 - RNA, 18 nt, Human
augugacaauuuuguaca

SEQ ID NO: 2607322 - RNA, 20 nt, Human
augugacaauuuuguacaaa

SEQ ID NO: 2607323 - RNA, 21 nt, Human
augugacaauuuuguacaaau

SEQ ID NO: 2607324 - RNA, 16 nt, Human
augugacagguaaacu

SEQ ID NO: 2607325 - RNA, 11 nt, Human
augugacacau

SEQ ID NO: 2607326 - RNA, 17 nt, Human
augucuaaaugcugaaa

SEQ ID NO: 2607327 - RNA, 19 nt, Human
augugacaugcgggcuggg

SEQ ID NO: 2607328 - RNA, 19 nt, Human
augugacauuuauauauug

SEQ ID NO: 2607329 - RNA, 14 nt, Human
augugacauuuaua

SEQ ID NO: 2607330 - RNA, 13 nt, Human
augugacauuuau

SEQ ID NO: 2607331 - RNA, 17 nt, Human
auguccaagaagcccag

SEQ ID NO: 2607332 - RNA, 16 nt, Human
auguccaagaagccca

SEQ ID NO: 2607333 - RNA, 21 nt, Human
auguccuaaggacacacuaau

SEQ ID NO: 2607334 - RNA, 19 nt, Human
auguccuauauuggcuaaa

SEQ ID NO: 2607335 - RNA, 15 nt, Human
auguccucaccacau

SEQ ID NO: 2607336 - RNA, 17 nt, Human
auguccucaccacaugc

SEQ ID NO: 2607337 - RNA, 16 nt, Human
auguccuccagaagcc

SEQ ID NO: 2607338 - RNA, 18 nt, Human
auguccuccagaagccuc

SEQ ID NO: 2607339 - RNA, 19 nt, Human
auguccuccagaagccucu

SEQ ID NO: 2607340 - RNA, 14 nt, Human
augucccuugcugu

SEQ ID NO: 2607341 - RNA, 13 nt, Human
augucauuuccuu

SEQ ID NO: 2607342 - RNA, 20 nt, Human
auguccuaaggacacacuaa

SEQ ID NO: 2607343 - RNA, 19 nt, Human
auguccuaaggacacacua

SEQ ID NO: 2607344 - RNA, 18 nt, Human
auguccuaaggacacacu

SEQ ID NO: 2607345 - RNA, 17 nt, Human
auguccuaaggacacac

SEQ ID NO: 2607346 - RNA, 20 nt, Human
augucccuuucuuggccagu

SEQ ID NO: 2607347 - RNA, 16 nt, Human
auguccuaaggacaca

SEQ ID NO: 2607348 - RNA, 16 nt, Human
augucccuuucuuggc

SEQ ID NO: 2607349 - RNA, 15 nt, Human
augucauuucauuuc

SEQ ID NO: 2607350 - RNA, 18 nt, Human
augucauuucauuuccua

SEQ ID NO: 2607351 - RNA, 13 nt, Human
augucauuaaaug

SEQ ID NO: 2607352 - RNA, 17 nt, Human
augucauuaaaauaaau

SEQ ID NO: 2607353 - RNA, 18 nt, Human
augucauugaguaauaua

SEQ ID NO: 2607354 - RNA, 20 nt, Human
augucauuaaaauaaauaaa

SEQ ID NO: 2607355 - RNA, 17 nt, Human
augucauauauuacuag

SEQ ID NO: 2607356 - RNA, 21 nt, Human
augucauguguacaaaaguuu

SEQ ID NO: 2607357 - RNA, 15 nt, Human
augucaucauacaug

SEQ ID NO: 2607358 - RNA, 14 nt, Human
augucaucauacau

SEQ ID NO: 2607359 - RNA, 19 nt, Human
auguauauuuaaaagaaag

SEQ ID NO: 2607360 - RNA, 12 nt, Human
auguaucaauga

SEQ ID NO: 2607361 - RNA, 19 nt, Human
auguauauuuuauaucaau

SEQ ID NO: 2607362 - RNA, 16 nt, Human
auguauauguguucau

SEQ ID NO: 2607363 - RNA, 20 nt, Human
auguauauacccacacacau

SEQ ID NO: 2607364 - RNA, 16 nt, Human
auguauauacauuuau

SEQ ID NO: 2607365 - RNA, 19 nt, Human
uuuggcaaacgcuaaagag

SEQ ID NO: 2607366 - RNA, 14 nt, Human
uuuggauuugacau

SEQ ID NO: 2607367 - RNA, 18 nt, Human
uuuggcaaacucuccacc

SEQ ID NO: 2607368 - RNA, 21 nt, Human
uuuggcugaaauucuccugga

SEQ ID NO: 2607369 - RNA, 20 nt, Human
uuuggcugaaauucuccugg

SEQ ID NO: 2607370 - RNA, 23 nt, Human
uuuggcucuccucagaagaaaga

SEQ ID NO: 2607371 - RNA, 13 nt, Human
uuuggcugcugaa

SEQ ID NO: 2607372 - RNA, 12 nt, Human
uuuggcugcuga

SEQ ID NO: 2607373 - RNA, 20 nt, Human
uuugggcagaagggagaagg

SEQ ID NO: 2607374 - RNA, 15 nt, Human
uuugggcccagggac

SEQ ID NO: 2607375 - RNA, 14 nt, Human
uuugggcccaggga

SEQ ID NO: 2607376 - RNA, 12 nt, Human
uuugggcccagg

SEQ ID NO: 2607377 - RNA, 15 nt, Human
uuugggccccucucc

SEQ ID NO: 2607378 - RNA, 14 nt, Human
uuugggcugcccug

SEQ ID NO: 2607379 - RNA, 14 nt, Human
uuuggcuuccauga

SEQ ID NO: 2607380 - RNA, 19 nt, Human
uuuggcugugucuaaacug

SEQ ID NO: 2607381 - RNA, 17 nt, Human
uuuggcugugucuaaac

SEQ ID NO: 2607382 - RNA, 15 nt, Human
uuuggcugugucuaa

SEQ ID NO: 2607383 - RNA, 14 nt, Human
uuuggcugugucua

SEQ ID NO: 2607384 - RNA, 13 nt, Human
uuuggcugugucu

SEQ ID NO: 2607385 - RNA, 22 nt, Human
uuuggcugaaauucuccuggag

SEQ ID NO: 2607386 - RNA, 22 nt, Human
uuugggauaggaaaaaugagua

SEQ ID NO: 2607387 - RNA, 17 nt, Human
uuugggaggcugaggcg

SEQ ID NO: 2607388 - RNA, 22 nt, Human
uuugggguacccacugcucugg

SEQ ID NO: 2607389 - RNA, 20 nt, Human
uuugggguagcuagaggaac

SEQ ID NO: 2607390 - RNA, 17 nt, Human
uuuggguaccuauuuuc

SEQ ID NO: 2607391 - RNA, 13 nt, Human
uuuggggaagaac

SEQ ID NO: 2607392 - RNA, 21 nt, Human
uuugggguacccacugcucug

SEQ ID NO: 2607393 - RNA, 17 nt, Human
auguauauaaacaugcu

SEQ ID NO: 2607394 - RNA, 21 nt, Human
auguauaauucaaagcaccaa

SEQ ID NO: 2607395 - RNA, 23 nt, Human
auguauaauauuuuuaauuaaau

SEQ ID NO: 2607396 - RNA, 14 nt, Human
auguauaauauuuu

SEQ ID NO: 2607397 - RNA, 12 nt, Human
uuugccuuuugc

SEQ ID NO: 2607398 - RNA, 22 nt, Human
uuugccuguucaguuacagaaa

SEQ ID NO: 2607399 - RNA, 19 nt, Human
uuugccuuuugcaaacuuu

SEQ ID NO: 2607400 - RNA, 23 nt, Human
uuugccuguucaguuacagaaag

SEQ ID NO: 2607401 - RNA, 20 nt, Human
uuugccuguucaguuacaga

SEQ ID NO: 2607402 - RNA, 19 nt, Human
uuugccuguucaguuacag

SEQ ID NO: 2607403 - RNA, 21 nt, Human
uuugccuugggcugcuccuca

SEQ ID NO: 2607404 - RNA, 19 nt, Human
uuugcaaacuuuauuuuca

SEQ ID NO: 2607405 - RNA, 15 nt, Human
uuugcaaaggagcuc

SEQ ID NO: 2607406 - RNA, 12 nt, Human
uuugcaaaauuu

SEQ ID NO: 2607407 - RNA, 16 nt, Human
uuugccuguucaguua

SEQ ID NO: 2607408 - RNA, 15 nt, Human
uuugccuguucaguu

SEQ ID NO: 2607409 - RNA, 14 nt, Human
uuugccuguucagu

SEQ ID NO: 2607410 - RNA, 12 nt, Human
uuugccugugcc

SEQ ID NO: 2607411 - RNA, 14 nt, Human
uuugauuucauuaa

SEQ ID NO: 2607412 - RNA, 13 nt, Human
uuugauuucuauu

SEQ ID NO: 2607413 - RNA, 14 nt, Human
uuugauuuaauguu

SEQ ID NO: 2607414 - RNA, 12 nt, Human
uuugauuuaugc

SEQ ID NO: 2607415 - RNA, 18 nt, Human
uuugauucagacagcugc

SEQ ID NO: 2607416 - RNA, 22 nt, Human
uuugauugagaguaacuuaagu

SEQ ID NO: 2607417 - RNA, 21 nt, Human
uuugauugagaguaacuuaag

SEQ ID NO: 2607418 - RNA, 15 nt, Human
uuugauugauuugaa

SEQ ID NO: 2607419 - RNA, 21 nt, Human
uuugauucuccuucagcccuc

SEQ ID NO: 2607420 - RNA, 15 nt, Human
uuugauucugugugu

SEQ ID NO: 2607421 - RNA, 19 nt, Human
uuugcuaagcauuccaacu

SEQ ID NO: 2607422 - RNA, 20 nt, Human
uuugcuggagcucugcccau

SEQ ID NO: 2607423 - RNA, 19 nt, Human
uuugcuggggccgaaagaa

SEQ ID NO: 2607424 - RNA, 22 nt, Human
uuugcuggggccgaaagaacag

SEQ ID NO: 2607425 - RNA, 20 nt, Human
uuuggauuggggucccucua

SEQ ID NO: 2607426 - RNA, 14 nt, Human
uuuggauuguauau

SEQ ID NO: 2607427 - RNA, 16 nt, Human
uuuggauuugacauug

SEQ ID NO: 2607428 - RNA, 22 nt, Human
uuuggauuggaugaauuccaaa

SEQ ID NO: 2607429 - RNA, 19 nt, Human
uuugcuguacuagagaucu

SEQ ID NO: 2607430 - RNA, 18 nt, Human
uuuggauucuuauguagc

SEQ ID NO: 2607431 - RNA, 20 nt, Human
uuuggauucuuauguagcag

SEQ ID NO: 2607432 - RNA, 18 nt, Human
uuuggauugacucugcau

SEQ ID NO: 2607433 - RNA, 19 nt, Human
uuugcugggcaguuuuucu

SEQ ID NO: 2607434 - RNA, 22 nt, Human
uuugcuaacuagcuuggaaacu

SEQ ID NO: 2607435 - RNA, 19 nt, Human
uuugaccucugcagcaaua

SEQ ID NO: 2607436 - RNA, 21 nt, Human
uuugaccucugcagcaauaaa

SEQ ID NO: 2607437 - RNA, 14 nt, Human
uuugacaaggggca

SEQ ID NO: 2607438 - RNA, 18 nt, Human
uuugacaaagguaaauca

SEQ ID NO: 2607439 - RNA, 18 nt, Human
uuugacacuauaucugua

SEQ ID NO: 2607440 - RNA, 17 nt, Human
uuugacacuauaucugu

SEQ ID NO: 2607441 - RNA, 15 nt, Human
uuugacacuauaucu

SEQ ID NO: 2607442 - RNA, 16 nt, Human
uuugaauuuucugugu

SEQ ID NO: 2607443 - RNA, 15 nt, Human
uuugacaacaaauua

SEQ ID NO: 2607444 - RNA, 20 nt, Human
uuugacaacguuucagcgac

SEQ ID NO: 2607445 - RNA, 20 nt, Human
uuucccuucaguacccucuc

SEQ ID NO: 2607446 - RNA, 19 nt, Human
uuucccuucaguacccucu

SEQ ID NO: 2607447 - RNA, 14 nt, Human
uuucccuuaucaaa

SEQ ID NO: 2607448 - RNA, 15 nt, Human
uuucccuugaggaaa

SEQ ID NO: 2607449 - RNA, 20 nt, Human
uuugaauguuauuuguuauu

SEQ ID NO: 2607450 - RNA, 19 nt, Human
uuucccuccacuccuuccu

SEQ ID NO: 2607451 - RNA, 23 nt, Human
uuucccucccuuccucuuuccau

SEQ ID NO: 2607452 - RNA, 14 nt, Human
uuucccucgcuggg

SEQ ID NO: 2607453 - RNA, 16 nt, Human
uuucccugccucucau

SEQ ID NO: 2607454 - RNA, 13 nt, Human
uuucccugaccuc

SEQ ID NO: 2607455 - RNA, 13 nt, Human
uuucccugugcug

SEQ ID NO: 2607456 - RNA, 14 nt, Human
uuucccugacuccu

SEQ ID NO: 2607457 - RNA, 16 nt, Human
uuucccuucaguaccc

SEQ ID NO: 2607458 - RNA, 12 nt, Human
uuucccugugcu

SEQ ID NO: 2607459 - RNA, 22 nt, Human
uuucccugcuuaaugaaaagcu

SEQ ID NO: 2607460 - RNA, 15 nt, Human
uuugauucagacagc

SEQ ID NO: 2607461 - RNA, 18 nt, Human
uuugaugcuggagagguu

SEQ ID NO: 2607462 - RNA, 16 nt, Human
uuugaugcuggagagg

SEQ ID NO: 2607463 - RNA, 16 nt, Human
uuugaugccaagaaag

SEQ ID NO: 2607464 - RNA, 16 nt, Human
uuugauuauuguauuu

SEQ ID NO: 2607465 - RNA, 18 nt, Human
uuugauuaauccagaaua

SEQ ID NO: 2607466 - RNA, 14 nt, Human
uuugauuauuguau

SEQ ID NO: 2607467 - RNA, 15 nt, Human
uuugauccaagcugg

SEQ ID NO: 2607468 - RNA, 13 nt, Human
uuugagaguucua

SEQ ID NO: 2607469 - RNA, 14 nt, Human
uuugauccaagcug

SEQ ID NO: 2607470 - RNA, 15 nt, Human
uuugaugaguuguga

SEQ ID NO: 2607471 - RNA, 10 nt, Human
uuugagacgg

SEQ ID NO: 2607472 - RNA, 13 nt, Human
uuugagacagagu

SEQ ID NO: 2607473 - RNA, 16 nt, Human
uuugagaaauuaagua

SEQ ID NO: 2607474 - RNA, 13 nt, Human
uuugagacaggag

SEQ ID NO: 2607475 - RNA, 19 nt, Human
uuugagacaguuucuuagc

SEQ ID NO: 2607476 - RNA, 18 nt, Human
uuugagacaguuucuuag

SEQ ID NO: 2607477 - RNA, 17 nt, Human
uuugagacaguuucuua

SEQ ID NO: 2607478 - RNA, 16 nt, Human
uuugagacaguuucuu

SEQ ID NO: 2607479 - RNA, 14 nt, Human
uuugagaagaaaac

SEQ ID NO: 2607480 - RNA, 15 nt, Human
uuugagacaguuucu

SEQ ID NO: 2607481 - RNA, 18 nt, Human
uuugagaagaaaacaucu

SEQ ID NO: 2607482 - RNA, 21 nt, Human
uuugagagaaauaugaagaac

SEQ ID NO: 2607483 - RNA, 19 nt, Human
uuugagaccagccugggca

SEQ ID NO: 2607484 - RNA, 22 nt, Human
uuugagacaguuucuuagcuuu

SEQ ID NO: 2607485 - RNA, 20 nt, Human
uuugagacaguuucuuagcu

SEQ ID NO: 2607486 - RNA, 16 nt, Human
uuugagaccagccugg

SEQ ID NO: 2607487 - RNA, 20 nt, Human
uuugacuguuuuuacccaua

SEQ ID NO: 2607488 - RNA, 13 nt, Human
uuugaccuuuuau

SEQ ID NO: 2607489 - RNA, 23 nt, Human
uuugaccuguugggagugaggau

SEQ ID NO: 2607490 - RNA, 18 nt, Human
uuugaccucugcagcaau

SEQ ID NO: 2607491 - RNA, 13 nt, Human
uuugagaaaugca

SEQ ID NO: 2607492 - RNA, 21 nt, Human
uuugagaaacaacaauuucua

SEQ ID NO: 2607493 - RNA, 19 nt, Human
uuugacuguuuuuacccau

SEQ ID NO: 2607494 - RNA, 16 nt, Human
uuugacuguuuuuacc

SEQ ID NO: 2607495 - RNA, 21 nt, Human
augugcuaguaauuggaaagg

SEQ ID NO: 2607496 - RNA, 19 nt, Human
augugcuauacugcauacu

SEQ ID NO: 2607497 - RNA, 18 nt, Human
augugcuauacugcauac

SEQ ID NO: 2607498 - RNA, 19 nt, Human
augugcuguguaaaguuag

SEQ ID NO: 2607499 - RNA, 18 nt, Human
augugcuguguaaaguua

SEQ ID NO: 2607500 - RNA, 17 nt, Human
augugcuguguaaaguu

SEQ ID NO: 2607501 - RNA, 16 nt, Human
augugcuguguaaagu

SEQ ID NO: 2607502 - RNA, 15 nt, Human
augugcuguguaaag

SEQ ID NO: 2607503 - RNA, 14 nt, Human
augugcuguguaaa

SEQ ID NO: 2607504 - RNA, 13 nt, Human
augugcuguguaa

SEQ ID NO: 2607505 - RNA, 18 nt, Human
augugcugcgugccugug

SEQ ID NO: 2607506 - RNA, 11 nt, Human
augugcugugu

SEQ ID NO: 2607507 - RNA, 20 nt, Human
augugcuaguaauuggaaag

SEQ ID NO: 2607508 - RNA, 21 nt, Human
augugccagguuuuuggucug

SEQ ID NO: 2607509 - RNA, 20 nt, Human
augugccagggcaaugauga

SEQ ID NO: 2607510 - RNA, 21 nt, Human
augugccagggcaaugaugaa

SEQ ID NO: 2607511 - RNA, 15 nt, Human
augugccaagguggg

SEQ ID NO: 2607512 - RNA, 13 nt, Human
augugccaaggug

SEQ ID NO: 2607513 - RNA, 23 nt, Human
augugcaguguagcccacacuug

SEQ ID NO: 2607514 - RNA, 19 nt, Human
augugcauucuuuuaaaag

SEQ ID NO: 2607515 - RNA, 20 nt, Human
augugcauucuuuuaaaaga

SEQ ID NO: 2607516 - RNA, 19 nt, Human
augugcagguuuguuacau

SEQ ID NO: 2607517 - RNA, 20 nt, Human
augugcauuuuugugaaaug

SEQ ID NO: 2607518 - RNA, 21 nt, Human
augugcauuuuugugaaauga

SEQ ID NO: 2607519 - RNA, 13 nt, Human
uuuguuuucuuug

SEQ ID NO: 2607520 - RNA, 14 nt, Human
uuuguuuucauggu

SEQ ID NO: 2607521 - RNA, 12 nt, Human
uuuguuuugcac

SEQ ID NO: 2607522 - RNA, 18 nt, Human
uuuguuuugcuuuuucug

SEQ ID NO: 2607523 - RNA, 12 nt, Human
uuuguuuuucau

SEQ ID NO: 2607524 - RNA, 13 nt, Human
uuuguuuuuaauu

SEQ ID NO: 2607525 - RNA, 14 nt, Human
uuuguuuuuaugaa

SEQ ID NO: 2607526 - RNA, 18 nt, Human
augugcacugucacuuug

SEQ ID NO: 2607527 - RNA, 15 nt, Human
augugcacugucacu

SEQ ID NO: 2607528 - RNA, 22 nt, Human
uuuuaaaaaaauaaaacauuuu

SEQ ID NO: 2607529 - RNA, 21 nt, Human
uuuuaaaaaaauaaaacauuu

SEQ ID NO: 2607530 - RNA, 22 nt, Human
augugcacugucacuuugcucu

SEQ ID NO: 2607531 - RNA, 17 nt, Human
augugcagguuuguuac

SEQ ID NO: 2607532 - RNA, 20 nt, Human
uuuuaaaaaaauaaaacauu

SEQ ID NO: 2607533 - RNA, 19 nt, Human
uuuuaaaaaaauaaaacau

SEQ ID NO: 2607534 - RNA, 18 nt, Human
uuuuaaaaaaauaaaaca

SEQ ID NO: 2607535 - RNA, 13 nt, Human
uuuuaaaaaaaua

SEQ ID NO: 2607536 - RNA, 22 nt, Human
augugcacccaugggcucugac

SEQ ID NO: 2607537 - RNA, 13 nt, Human
uuuguuuuuuggu

SEQ ID NO: 2607538 - RNA, 22 nt, Human
uuuguuuuuuuccaacuguguu

SEQ ID NO: 2607539 - RNA, 16 nt, Human
uuuguuuuuuuccaac

SEQ ID NO: 2607540 - RNA, 18 nt, Human
uuuuaaaaaacugcugac

SEQ ID NO: 2607541 - RNA, 21 nt, Human
auguguguccacgacugucuc

SEQ ID NO: 2607542 - RNA, 22 nt, Human
auguguguccacgacugucucc

SEQ ID NO: 2607543 - RNA, 18 nt, Human
auguguguguguugugug

SEQ ID NO: 2607544 - RNA, 22 nt, Human
auguguguguguuguguguggg

SEQ ID NO: 2607545 - RNA, 23 nt, Human
auguguguguguuguguguggga

SEQ ID NO: 2607546 - RNA, 20 nt, Human
auguguguagacaaauauuu

SEQ ID NO: 2607547 - RNA, 14 nt, Human
auguguguauaugu

SEQ ID NO: 2607548 - RNA, 12 nt, Human
auguguguauau

SEQ ID NO: 2607549 - RNA, 16 nt, Human
auguguguauauguau

SEQ ID NO: 2607550 - RNA, 17 nt, Human
auguguguauauguaug

SEQ ID NO: 2607551 - RNA, 18 nt, Human
auguguguauauguaugu

SEQ ID NO: 2607552 - RNA, 22 nt, Human
auguguguauauguaugugugu

SEQ ID NO: 2607553 - RNA, 20 nt, Human
auguguguaugggugugugu

SEQ ID NO: 2607554 - RNA, 13 nt, Human
augugcuuuucuc

SEQ ID NO: 2607555 - RNA, 20 nt, Human
augugcuguguaaaguuagu

SEQ ID NO: 2607556 - RNA, 17 nt, Human
augugcuuuucuccaau

SEQ ID NO: 2607557 - RNA, 16 nt, Human
augugcuuuucuccaa

SEQ ID NO: 2607558 - RNA, 15 nt, Human
augugcuuuucucca

SEQ ID NO: 2607559 - RNA, 23 nt, Human
auguggaaaagccaagaggcugc

SEQ ID NO: 2607560 - RNA, 13 nt, Human
auguggaaaacag

SEQ ID NO: 2607561 - RNA, 15 nt, Human
auguggaaagugaau

SEQ ID NO: 2607562 - RNA, 16 nt, Human
auguggaaagugaauu

SEQ ID NO: 2607563 - RNA, 17 nt, Human
auguggaaagugaauuu

SEQ ID NO: 2607564 - RNA, 14 nt, Human
auguguggccugca

SEQ ID NO: 2607565 - RNA, 19 nt, Human
auguguguagacaaauauu

SEQ ID NO: 2607566 - RNA, 17 nt, Human
auguguguaagugugug

SEQ ID NO: 2607567 - RNA, 10 nt, Human
auguguguau

SEQ ID NO: 2607568 - RNA, 19 nt, Human
auguggaaagugaauuuga

SEQ ID NO: 2607569 - RNA, 15 nt, Human
auguguggcagauuu

SEQ ID NO: 2607570 - RNA, 12 nt, Human
auguguuuccau

SEQ ID NO: 2607571 - RNA, 15 nt, Human
auguguuugaacuuc

SEQ ID NO: 2607572 - RNA, 16 nt, Human
auguguuugugugugu

SEQ ID NO: 2607573 - RNA, 12 nt, Human
auguguuugugu

SEQ ID NO: 2607574 - RNA, 18 nt, Human
auguguuugguucugggg

SEQ ID NO: 2607575 - RNA, 13 nt, Human
auguuaaauaaau

SEQ ID NO: 2607576 - RNA, 15 nt, Human
auguguuuucugaau

SEQ ID NO: 2607577 - RNA, 14 nt, Human
auguguuuucugaa

SEQ ID NO: 2607578 - RNA, 21 nt, Human
auguuaaacuuacuuaguguu

SEQ ID NO: 2607579 - RNA, 17 nt, Human
auguguguuuaaauaaa

SEQ ID NO: 2607580 - RNA, 16 nt, Human
auguguguuuaaauaa

SEQ ID NO: 2607581 - RNA, 15 nt, Human
auguguguuuaaaua

SEQ ID NO: 2607582 - RNA, 12 nt, Human
auguguguuuaa

SEQ ID NO: 2607583 - RNA, 23 nt, Human
auguguguccacgacugucucca

SEQ ID NO: 2607584 - RNA, 19 nt, Human
auguguguuuaaauaaagu

SEQ ID NO: 2607585 - RNA, 14 nt, Human
auguuauguaaaag

SEQ ID NO: 2607586 - RNA, 21 nt, Human
auguuauguaaaaggccaaac

SEQ ID NO: 2607587 - RNA, 18 nt, Human
auguuaugcccagcguuu

SEQ ID NO: 2607588 - RNA, 13 nt, Human
auguuauguaaaa

SEQ ID NO: 2607589 - RNA, 18 nt, Human
auguuaugcauaaaguca

SEQ ID NO: 2607590 - RNA, 13 nt, Human
auguuauuuaaca

SEQ ID NO: 2607591 - RNA, 23 nt, Human
auguuauuuaacagcugaauuau

SEQ ID NO: 2607592 - RNA, 15 nt, Human
auguuauugcauaau

SEQ ID NO: 2607593 - RNA, 20 nt, Human
auguuauuuauauauuggua

SEQ ID NO: 2607594 - RNA, 20 nt, Human
auguuauuuguuauuuucag

SEQ ID NO: 2607595 - RNA, 18 nt, Human
auguuauuuauauauugg

SEQ ID NO: 2607596 - RNA, 12 nt, Human
auguuauuuaua

SEQ ID NO: 2607597 - RNA, 19 nt, Human
auguuauuuuuuaauuauu

SEQ ID NO: 2607598 - RNA, 17 nt, Human
auguuauuuuuuaauua

SEQ ID NO: 2607599 - RNA, 18 nt, Human
auguuauuuucuguugaa

SEQ ID NO: 2607600 - RNA, 21 nt, Human
auguuauuuucuguugaaguu

SEQ ID NO: 2607601 - RNA, 20 nt, Human
auguuacauaagauaaaugu

SEQ ID NO: 2607602 - RNA, 14 nt, Human
auguuacauuauua

SEQ ID NO: 2607603 - RNA, 17 nt, Human
auguuacaucacagugu

SEQ ID NO: 2607604 - RNA, 20 nt, Human
auguuacaucuguuuuaaau

SEQ ID NO: 2607605 - RNA, 17 nt, Human
auguuacacuaagggug

SEQ ID NO: 2607606 - RNA, 14 nt, Human
auguuacauuguuu

SEQ ID NO: 2607607 - RNA, 17 nt, Human
auguuaugcauaaaguc

SEQ ID NO: 2607608 - RNA, 13 nt, Human
auguuaagcagau

SEQ ID NO: 2607609 - RNA, 19 nt, Human
auguuacauaagauaaaug

SEQ ID NO: 2607610 - RNA, 12 nt, Human
auguuaagcaga

SEQ ID NO: 2607611 - RNA, 23 nt, Human
auguuaacacauuuuguauaauu

SEQ ID NO: 2607612 - RNA, 22 nt, Human
auguuaacacauuuuguauaau

SEQ ID NO: 2607613 - RNA, 21 nt, Human
auguuaacacauuuuguauaa

SEQ ID NO: 2607614 - RNA, 20 nt, Human
auguuaacacauuuuguaua

SEQ ID NO: 2607615 - RNA, 23 nt, Human
auguuaaccagaauaaaguucug

SEQ ID NO: 2607616 - RNA, 18 nt, Human
auguuaaccucaguguca

SEQ ID NO: 2607617 - RNA, 21 nt, Human
auguuaaccucagugucauuu

SEQ ID NO: 2607618 - RNA, 18 nt, Human
auguuaaauaaauuguau

SEQ ID NO: 2607619 - RNA, 17 nt, Human
auguuaaauaaauugua

SEQ ID NO: 2607620 - RNA, 16 nt, Human
auguuaaauaaauugu

SEQ ID NO: 2607621 - RNA, 14 nt, Human
auguuaaauaaauu

SEQ ID NO: 2607622 - RNA, 20 nt, Human
auguuaaauaaauuguauau

SEQ ID NO: 2607623 - RNA, 19 nt, Human
auguuaaauaaauuguaua

SEQ ID NO: 2607624 - RNA, 22 nt, Human
auguuaaauaaauuguauauuc

SEQ ID NO: 2607625 - RNA, 18 nt, Human
auguuaaaucccauucau

SEQ ID NO: 2607626 - RNA, 18 nt, Human
auguuaacacauuuugua

SEQ ID NO: 2607627 - RNA, 16 nt, Human
auguuaacacauuuug

SEQ ID NO: 2607628 - RNA, 15 nt, Human
auguuaacacauuuu

SEQ ID NO: 2607629 - RNA, 13 nt, Human
auguuaacacauu

SEQ ID NO: 2607630 - RNA, 12 nt, Human
auguuaacacau

SEQ ID NO: 2607631 - RNA, 22 nt, Human
auguuaaauuuguaaguuucag

SEQ ID NO: 2607632 - RNA, 23 nt, Human
auguuaaauuuguaaguuucagg

SEQ ID NO: 2607633 - RNA, 20 nt, Human
auguuaaauuuguaaguuuc

SEQ ID NO: 2607634 - RNA, 18 nt, Human
auguuaaauuuguaaguu

SEQ ID NO: 2607635 - RNA, 17 nt, Human
auguuaaauuuguaagu

SEQ ID NO: 2607636 - RNA, 16 nt, Human
auguuaaauuuguaag

SEQ ID NO: 2607637 - RNA, 15 nt, Human
auguuaaauuuguaa

SEQ ID NO: 2607638 - RNA, 14 nt, Human
auguuaaauuugua

SEQ ID NO: 2607639 - RNA, 12 nt, Human
auguuaaauuug

SEQ ID NO: 2607640 - RNA, 20 nt, Human
auguuaaaucccauucauaa

SEQ ID NO: 2607641 - RNA, 16 nt, Human
auguugaaaagucaaa

SEQ ID NO: 2607642 - RNA, 12 nt, Human
auguugaaagau

SEQ ID NO: 2607643 - RNA, 20 nt, Human
auguuauuuuuuaauuauua

SEQ ID NO: 2607644 - RNA, 22 nt, Human
auguuauuuguuauuuucagua

SEQ ID NO: 2607645 - RNA, 14 nt, Human
auguucaacuggag

SEQ ID NO: 2607646 - RNA, 18 nt, Human
auguucacuuuugacaaa

SEQ ID NO: 2607647 - RNA, 14 nt, Human
auguucacuuuuga

SEQ ID NO: 2607648 - RNA, 22 nt, Human
auguucaacuggagacacuauu

SEQ ID NO: 2607649 - RNA, 15 nt, Human
auguugcccaggcag

SEQ ID NO: 2607650 - RNA, 14 nt, Human
auguugcccaggca

SEQ ID NO: 2607651 - RNA, 13 nt, Human
auguugcccaggc

SEQ ID NO: 2607652 - RNA, 18 nt, Human
auguugaaagaucaaaag

SEQ ID NO: 2607653 - RNA, 18 nt, Human
auguuggauuuauaaaug

SEQ ID NO: 2607654 - RNA, 16 nt, Human
auguuggauuuauaaa

SEQ ID NO: 2607655 - RNA, 21 nt, Human
auguuggauuuauaaaugcua

SEQ ID NO: 2607656 - RNA, 20 nt, Human
auguuggauuuauaaaugcu

SEQ ID NO: 2607657 - RNA, 20 nt, Human
uuuuagacaaauacucaugu

SEQ ID NO: 2607658 - RNA, 18 nt, Human
uuuuagacaaauacucau

SEQ ID NO: 2607659 - RNA, 17 nt, Human
uuuuagaguugauacua

SEQ ID NO: 2607660 - RNA, 21 nt, Human
uuuuagacccuauugcugcuu

SEQ ID NO: 2607661 - RNA, 19 nt, Human
auguugaaaagucaaacug

SEQ ID NO: 2607662 - RNA, 20 nt, Human
auguugcucagucucccuuu

SEQ ID NO: 2607663 - RNA, 19 nt, Human
auguugcucagucucccuu

SEQ ID NO: 2607664 - RNA, 20 nt, Human
auguugcugaggagugagga

SEQ ID NO: 2607665 - RNA, 13 nt, Human
auguugcugccaa

SEQ ID NO: 2607666 - RNA, 11 nt, Human
auguugcugcc

SEQ ID NO: 2607667 - RNA, 15 nt, Human
auguugcuggacugu

SEQ ID NO: 2607668 - RNA, 17 nt, Human
auguuggaagagaaagc

SEQ ID NO: 2607669 - RNA, 19 nt, Human
auguugcuggacugucaua

SEQ ID NO: 2607670 - RNA, 17 nt, Human
auguugcuuaggaugug

SEQ ID NO: 2607671 - RNA, 18 nt, Human
uuuuauggcuuuugugca

SEQ ID NO: 2607672 - RNA, 19 nt, Human
uuuuauggcuuuugugcau

SEQ ID NO: 2607673 - RNA, 22 nt, Human
uuuuauggcacuaguauuucua

SEQ ID NO: 2607674 - RNA, 18 nt, Human
uuuuaguuaaauuucugg

SEQ ID NO: 2607675 - RNA, 16 nt, Human
uuuuaguucuuuggaa

SEQ ID NO: 2607676 - RNA, 22 nt, Human
uuuuagacaaauacucaugugu

SEQ ID NO: 2607677 - RNA, 21 nt, Human
uuuuagacaaauacucaugug

SEQ ID NO: 2607678 - RNA, 21 nt, Human
uuuuagacagucucacuuugu

SEQ ID NO: 2607679 - RNA, 15 nt, Human
uuuuaguagagacag

SEQ ID NO: 2607680 - RNA, 14 nt, Human
uuuuagucacuuuu

SEQ ID NO: 2607681 - RNA, 13 nt, Human
uuuuagucacuuu

SEQ ID NO: 2607682 - RNA, 18 nt, Human
uuuuagugauuuuaauaa

SEQ ID NO: 2607683 - RNA, 23 nt, Human
uuuuagacaaauacucaugugua

SEQ ID NO: 2607684 - RNA, 12 nt, Human
uuuuauuaauaa

SEQ ID NO: 2607685 - RNA, 22 nt, Human
uuuuauuaauaaacauucuauc

SEQ ID NO: 2607686 - RNA, 19 nt, Human
uuuuauuaauaaacauucu

SEQ ID NO: 2607687 - RNA, 21 nt, Human
uuuuauggcuuuugugcauua

SEQ ID NO: 2607688 - RNA, 12 nt, Human
uuuuauuaaauu

SEQ ID NO: 2607689 - RNA, 13 nt, Human
uuuuauuaaugca

SEQ ID NO: 2607690 - RNA, 20 nt, Human
uuuuauucauaagccaauuu

SEQ ID NO: 2607691 - RNA, 11 nt, Human
uuuuauuaaug

SEQ ID NO: 2607692 - RNA, 13 nt, Human
uuuuauuccacau

SEQ ID NO: 2607693 - RNA, 15 nt, Human
uuuuauuccacaucu

SEQ ID NO: 2607694 - RNA, 18 nt, Human
uuuuauuccuguauguug

SEQ ID NO: 2607695 - RNA, 15 nt, Human
uuuuauuccuguaug

SEQ ID NO: 2607696 - RNA, 21 nt, Human
uuuuauuguaacagacauugu

SEQ ID NO: 2607697 - RNA, 20 nt, Human
uuuuauuguaacagacauug

SEQ ID NO: 2607698 - RNA, 19 nt, Human
uuuuauuguaacagacauu

SEQ ID NO: 2607699 - RNA, 16 nt, Human
uuuuauuguaacagac

SEQ ID NO: 2607700 - RNA, 18 nt, Human
uuuuauugacacagaaaa

SEQ ID NO: 2607701 - RNA, 19 nt, Human
uuuuauugagaauuuuaaa

SEQ ID NO: 2607702 - RNA, 16 nt, Human
uuuuauugacacagaa

SEQ ID NO: 2607703 - RNA, 19 nt, Human
uuuuauugaaucuauuuaa

SEQ ID NO: 2607704 - RNA, 17 nt, Human
uuuucagcuucugcugg

SEQ ID NO: 2607705 - RNA, 20 nt, Human
uuuucagcuucugcugggcu

SEQ ID NO: 2607706 - RNA, 15 nt, Human
uuuucagcuucugcu

SEQ ID NO: 2607707 - RNA, 12 nt, Human
uuuucagcuucu

SEQ ID NO: 2607708 - RNA, 16 nt, Human
uuuucaguauuuugga

SEQ ID NO: 2607709 - RNA, 23 nt, Human
uuuucagucauauaaaagcuaug

SEQ ID NO: 2607710 - RNA, 15 nt, Human
uuuucagucauauaa

SEQ ID NO: 2607711 - RNA, 23 nt, Human
uuuucaguauuuuggagaaauua

SEQ ID NO: 2607712 - RNA, 23 nt, Human
uuuucaguagggcuacaaaaccu

SEQ ID NO: 2607713 - RNA, 20 nt, Human
uuuucaggcuagauguaugu

SEQ ID NO: 2607714 - RNA, 17 nt, Human
uuuuauuguuuaaagca

SEQ ID NO: 2607715 - RNA, 20 nt, Human
uuuuauuguauaaacuauca

SEQ ID NO: 2607716 - RNA, 22 nt, Human
uuuuauuguaacagacauuguu

SEQ ID NO: 2607717 - RNA, 10 nt, Human
uuuuauuguu

SEQ ID NO: 2607718 - RNA, 11 nt, Human
uuuuauugugu

SEQ ID NO: 2607719 - RNA, 13 nt, Human
uuuuccacuuugu

SEQ ID NO: 2607720 - RNA, 13 nt, Human
uuuuccacuacug

SEQ ID NO: 2607721 - RNA, 15 nt, Human
uuuuccacuacugcu

SEQ ID NO: 2607722 - RNA, 14 nt, Human
uuuuccaaugucug

SEQ ID NO: 2607723 - RNA, 15 nt, Human
uuuuccaaugucugc

SEQ ID NO: 2607724 - RNA, 22 nt, Human
uuuuccacaagauucccagaga

SEQ ID NO: 2607725 - RNA, 15 nt, Human
uuuuccacccuggaa

SEQ ID NO: 2607726 - RNA, 22 nt, Human
uuuuccaaauguaauaaacuuu

SEQ ID NO: 2607727 - RNA, 18 nt, Human
uuuuccaagugugcauau

SEQ ID NO: 2607728 - RNA, 11 nt, Human
uuuuccaaaug

SEQ ID NO: 2607729 - RNA, 19 nt, Human
uuuuccaaagagugauagu

SEQ ID NO: 2607730 - RNA, 14 nt, Human
uuuucaguguacau

SEQ ID NO: 2607731 - RNA, 16 nt, Human
uuuucucugguaauau

SEQ ID NO: 2607732 - RNA, 14 nt, Human
uuuucucugguaau

SEQ ID NO: 2607733 - RNA, 21 nt, Human
uuuucucugguaauauugacu

SEQ ID NO: 2607734 - RNA, 22 nt, Human
uuuucucuugggcugagacugg

SEQ ID NO: 2607735 - RNA, 12 nt, Human
uuuucucuuucu

SEQ ID NO: 2607736 - RNA, 14 nt, Human
uuuucucuuucucc

SEQ ID NO: 2607737 - RNA, 15 nt, Human
uuuucucuuucucuc

SEQ ID NO: 2607738 - RNA, 22 nt, Human
uuuucucuuucuccuuagucuu

SEQ ID NO: 2607739 - RNA, 21 nt, Human
uuuucuagcccgaauacaaac

SEQ ID NO: 2607740 - RNA, 18 nt, Human
uuuucuagacuuucuguu

SEQ ID NO: 2607741 - RNA, 16 nt, Human
uuuucuauaauuuaaa

SEQ ID NO: 2607742 - RNA, 13 nt, Human
uuuuccagcuccu

SEQ ID NO: 2607743 - RNA, 20 nt, Human
uuuuccagcuggaugagaau

SEQ ID NO: 2607744 - RNA, 12 nt, Human
uuuuccaggcug

SEQ ID NO: 2607745 - RNA, 14 nt, Human
uuuucuagacuuuc

SEQ ID NO: 2607746 - RNA, 13 nt, Human
uuuucuagacuuu

SEQ ID NO: 2607747 - RNA, 18 nt, Human
uuuucuagcccgaauaca

SEQ ID NO: 2607748 - RNA, 17 nt, Human
uuuucuacuuuuuuuaa

SEQ ID NO: 2607749 - RNA, 14 nt, Human
auguuuauuccuug

SEQ ID NO: 2607750 - RNA, 20 nt, Human
auguuuuuaaaaguuucaau

SEQ ID NO: 2607751 - RNA, 14 nt, Human
auguuuauuccuga

SEQ ID NO: 2607752 - RNA, 22 nt, Human
auguuuuuaaaaguuucaaugu

SEQ ID NO: 2607753 - RNA, 18 nt, Human
auguuuauuccugauaau

SEQ ID NO: 2607754 - RNA, 23 nt, Human
auguuuuuaaaaguuucaaugug

SEQ ID NO: 2607755 - RNA, 15 nt, Human
auguuuuucaugaaa

SEQ ID NO: 2607756 - RNA, 21 nt, Human
auguuuuucugccagggagcu

SEQ ID NO: 2607757 - RNA, 22 nt, Human
auguuuuucugccagggagcuu

SEQ ID NO: 2607758 - RNA, 21 nt, Human
auguuuuuguuuucuuugaau

SEQ ID NO: 2607759 - RNA, 19 nt, Human
auuaaaacacaacaucuuu

SEQ ID NO: 2607760 - RNA, 14 nt, Human
auuaaaacaauauu

SEQ ID NO: 2607761 - RNA, 18 nt, Human
auuaaaacaauauuguuu

SEQ ID NO: 2607762 - RNA, 20 nt, Human
auuaaaacaauauuguuucu

SEQ ID NO: 2607763 - RNA, 21 nt, Human
auuaaaacaauauuguuucua

SEQ ID NO: 2607764 - RNA, 23 nt, Human
auuaaaaaucucaaauuucuaaa

SEQ ID NO: 2607765 - RNA, 22 nt, Human
auuaaaaaugaaauuauuuaua

SEQ ID NO: 2607766 - RNA, 12 nt, Human
auuaaaaaacaa

SEQ ID NO: 2607767 - RNA, 23 nt, Human
auuaaaaaaaacaaaaagaacaa

SEQ ID NO: 2607768 - RNA, 20 nt, Human
auuaaaaaaaacaaaaagaa

SEQ ID NO: 2607769 - RNA, 19 nt, Human
auuaaaaaaaacaaaaaga

SEQ ID NO: 2607770 - RNA, 15 nt, Human
auuaaaaaaaacaaa

SEQ ID NO: 2607771 - RNA, 14 nt, Human
auuaaaaaaaacaa

SEQ ID NO: 2607772 - RNA, 14 nt, Human
auuaaaaaaaaaga

SEQ ID NO: 2607773 - RNA, 20 nt, Human
auuaaaaaaaaagaucuguu

SEQ ID NO: 2607774 - RNA, 15 nt, Human
auguuuuuuuuuaaa

SEQ ID NO: 2607775 - RNA, 19 nt, Human
auguuuuuuagaucaaaua

SEQ ID NO: 2607776 - RNA, 22 nt, Human
auguuuuuuaaaauauuuaucu

SEQ ID NO: 2607777 - RNA, 22 nt, Human
auguuuuuuagaucaaauacuu

SEQ ID NO: 2607778 - RNA, 21 nt, Human
auguuuacacucuuuguaaga

SEQ ID NO: 2607779 - RNA, 19 nt, Human
auguuuacacucuuuguaa

SEQ ID NO: 2607780 - RNA, 18 nt, Human
auguuuacacucuuugua

SEQ ID NO: 2607781 - RNA, 16 nt, Human
auguuuacacucuuug

SEQ ID NO: 2607782 - RNA, 16 nt, Human
auguuuacaaauggac

SEQ ID NO: 2607783 - RNA, 19 nt, Human
auguuuaacuuaaucaauu

SEQ ID NO: 2607784 - RNA, 17 nt, Human
auguuuaacuuaaucaa

SEQ ID NO: 2607785 - RNA, 18 nt, Human
auguuggucauuuuaugu

SEQ ID NO: 2607786 - RNA, 13 nt, Human
auguuggcuggga

SEQ ID NO: 2607787 - RNA, 14 nt, Human
auguugguguucca

SEQ ID NO: 2607788 - RNA, 12 nt, Human
auguugggacug

SEQ ID NO: 2607789 - RNA, 20 nt, Human
auguugggaaacuuggcucg

SEQ ID NO: 2607790 - RNA, 19 nt, Human
auguugggaaacuuggcuc

SEQ ID NO: 2607791 - RNA, 12 nt, Human
auguuggcuggg

SEQ ID NO: 2607792 - RNA, 12 nt, Human
uuuucuuaacca

SEQ ID NO: 2607793 - RNA, 17 nt, Human
auguuggccaggcuggu

SEQ ID NO: 2607794 - RNA, 21 nt, Human
uuuucugauuguaacguugcu

SEQ ID NO: 2607795 - RNA, 14 nt, Human
uuuucugauuguaa

SEQ ID NO: 2607796 - RNA, 17 nt, Human
uuuucucuuucucuccu

SEQ ID NO: 2607797 - RNA, 16 nt, Human
uuuucugcaagccugc

SEQ ID NO: 2607798 - RNA, 23 nt, Human
uuuucugauuguaacguugcugu

SEQ ID NO: 2607799 - RNA, 20 nt, Human
uuuucugcacugagcagagu

SEQ ID NO: 2607800 - RNA, 16 nt, Human
uuuucugcacugagca

SEQ ID NO: 2607801 - RNA, 13 nt, Human
uuuucugcacuga

SEQ ID NO: 2607802 - RNA, 21 nt, Human
uuuucuggaauacaugaaaua

SEQ ID NO: 2607803 - RNA, 17 nt, Human
uuuucuggaauacauga

SEQ ID NO: 2607804 - RNA, 16 nt, Human
uuuucugcuuuugaaa

SEQ ID NO: 2607805 - RNA, 16 nt, Human
uuuucugcccuggcug

SEQ ID NO: 2607806 - RNA, 15 nt, Human
uuuucugcccuggcu

SEQ ID NO: 2607807 - RNA, 13 nt, Human
uuuucugcccugg

SEQ ID NO: 2607808 - RNA, 12 nt, Human
uuuucugcccug

SEQ ID NO: 2607809 - RNA, 14 nt, Human
uuuucuuaaauaau

SEQ ID NO: 2607810 - RNA, 23 nt, Human
uuuucuuaaauaauaaagaucau

SEQ ID NO: 2607811 - RNA, 13 nt, Human
uuuucuguucuuu

SEQ ID NO: 2607812 - RNA, 12 nt, Human
uuuucuguuaua

SEQ ID NO: 2607813 - RNA, 23 nt, Human
uuuucuguugaaguuuacaauca

SEQ ID NO: 2607814 - RNA, 15 nt, Human
auugcaaaauagcau

SEQ ID NO: 2607815 - RNA, 16 nt, Human
auugauuugcauugaa

SEQ ID NO: 2607816 - RNA, 20 nt, Human
auugauuugcauugaacaca

SEQ ID NO: 2607817 - RNA, 13 nt, Human
auugauuugcauu

SEQ ID NO: 2607818 - RNA, 15 nt, Human
auugauuugcauuga

SEQ ID NO: 2607819 - RNA, 12 nt, Human
auugauuugcau

SEQ ID NO: 2607820 - RNA, 20 nt, Human
auugauuucugccuuccuug

SEQ ID NO: 2607821 - RNA, 14 nt, Human
auugauuugaagaa

SEQ ID NO: 2607822 - RNA, 16 nt, Human
auugauuugaagaaca

SEQ ID NO: 2607823 - RNA, 21 nt, Human
auugauuucugccuuccuugc

SEQ ID NO: 2607824 - RNA, 15 nt, Human
auugauuucugccuu

SEQ ID NO: 2607825 - RNA, 19 nt, Human
auugauguguuuauuuaua

SEQ ID NO: 2607826 - RNA, 22 nt, Human
auugauguacagucugucauga

SEQ ID NO: 2607827 - RNA, 13 nt, Human
auugauggggaag

SEQ ID NO: 2607828 - RNA, 13 nt, Human
auugacaaacucu

SEQ ID NO: 2607829 - RNA, 12 nt, Human
auugauguguuu

SEQ ID NO: 2607830 - RNA, 21 nt, Human
auugauguacagucugucaug

SEQ ID NO: 2607831 - RNA, 16 nt, Human
auugauggggaaggag

SEQ ID NO: 2607832 - RNA, 19 nt, Human
auugcaacaggcugggcuu

SEQ ID NO: 2607833 - RNA, 12 nt, Human
auugcaccacug

SEQ ID NO: 2607834 - RNA, 18 nt, Human
auugcaacaggcugggcu

SEQ ID NO: 2607835 - RNA, 17 nt, Human
auugcaacaggcugggc

SEQ ID NO: 2607836 - RNA, 19 nt, Human
auugcacguggccucuuga

SEQ ID NO: 2607837 - RNA, 17 nt, Human
auugcacguggccucuu

SEQ ID NO: 2607838 - RNA, 16 nt, Human
auugcacguggccucu

SEQ ID NO: 2607839 - RNA, 15 nt, Human
auugcacguggccuc

SEQ ID NO: 2607840 - RNA, 15 nt, Human
auugcacauuguaaa

SEQ ID NO: 2607841 - RNA, 23 nt, Human
auugcacguggccucuugagcag

SEQ ID NO: 2607842 - RNA, 15 nt, Human
auugcacuccagccu

SEQ ID NO: 2607843 - RNA, 21 nt, Human
auugcacaugucuuaaugaag

SEQ ID NO: 2607844 - RNA, 17 nt, Human
auugcacuccagccugg

SEQ ID NO: 2607845 - RNA, 16 nt, Human
auugcacuccagccug

SEQ ID NO: 2607846 - RNA, 18 nt, Human
auugcacuccagccuggg

SEQ ID NO: 2607847 - RNA, 20 nt, Human
auugcacucuaaaagguuca

SEQ ID NO: 2607848 - RNA, 19 nt, Human
auugcacuccagccugggc

SEQ ID NO: 2607849 - RNA, 14 nt, Human
auugaaguaaugaa

SEQ ID NO: 2607850 - RNA, 15 nt, Human
auugaaguaaugaau

SEQ ID NO: 2607851 - RNA, 18 nt, Human
auugaagucagauguggu

SEQ ID NO: 2607852 - RNA, 16 nt, Human
auugaagucagaugug

SEQ ID NO: 2607853 - RNA, 19 nt, Human
auugaaguauuuugcugga

SEQ ID NO: 2607854 - RNA, 16 nt, Human
auugaaguaaugaauu

SEQ ID NO: 2607855 - RNA, 22 nt, Human
auugaauaaugguaccagauaa

SEQ ID NO: 2607856 - RNA, 14 nt, Human
auugaauaauggua

SEQ ID NO: 2607857 - RNA, 19 nt, Human
auugaauaaaguugaagcu

SEQ ID NO: 2607858 - RNA, 13 nt, Human
auugaaucaguau

SEQ ID NO: 2607859 - RNA, 13 nt, Human
auugaaucaugua

SEQ ID NO: 2607860 - RNA, 20 nt, Human
auugaaucaguauaaacaaa

SEQ ID NO: 2607861 - RNA, 23 nt, Human
auugaauauaauauauuugugua

SEQ ID NO: 2607862 - RNA, 21 nt, Human
auugaauuaucuugguugaaa

SEQ ID NO: 2607863 - RNA, 20 nt, Human
auugaauucuugguugagga

SEQ ID NO: 2607864 - RNA, 22 nt, Human
auugaauucuugguugaggaaa

SEQ ID NO: 2607865 - RNA, 23 nt, Human
auugaauucuugguugaggaaac

SEQ ID NO: 2607866 - RNA, 16 nt, Human
auugaauguuuccaac

SEQ ID NO: 2607867 - RNA, 23 nt, Human
auugaaucugauuggacauuuuc

SEQ ID NO: 2607868 - RNA, 14 nt, Human
auugaaucugauug

SEQ ID NO: 2607869 - RNA, 13 nt, Human
auugaauuaucuu

SEQ ID NO: 2607870 - RNA, 16 nt, Human
auugaaucuauuuaag

SEQ ID NO: 2607871 - RNA, 14 nt, Human
auugaaucuauuua

SEQ ID NO: 2607872 - RNA, 20 nt, Human
auugaaucauguaguaucaa

SEQ ID NO: 2607873 - RNA, 14 nt, Human
auugaaucauguag

SEQ ID NO: 2607874 - RNA, 10 nt, Human
auugaaucua

SEQ ID NO: 2607875 - RNA, 16 nt, Human
auugaaauuguacaua

SEQ ID NO: 2607876 - RNA, 17 nt, Human
auugaaauucugagaaa

SEQ ID NO: 2607877 - RNA, 13 nt, Human
auugaaauucuga

SEQ ID NO: 2607878 - RNA, 14 nt, Human
auuccuauugugau

SEQ ID NO: 2607879 - RNA, 14 nt, Human
auugaaauuuauac

SEQ ID NO: 2607880 - RNA, 17 nt, Human
auugaaauuguacauau

SEQ ID NO: 2607881 - RNA, 21 nt, Human
auugaaauuguacauauuugu

SEQ ID NO: 2607882 - RNA, 14 nt, Human
auugaacacaaacu

SEQ ID NO: 2607883 - RNA, 22 nt, Human
auugaacaaguuguuucauuga

SEQ ID NO: 2607884 - RNA, 21 nt, Human
auuccuauacgcagcgugcuu

SEQ ID NO: 2607885 - RNA, 17 nt, Human
auuccuauauaguuuau

SEQ ID NO: 2607886 - RNA, 17 nt, Human
auuccuaccucccugca

SEQ ID NO: 2607887 - RNA, 15 nt, Human
auugaacacaaacug

SEQ ID NO: 2607888 - RNA, 16 nt, Human
auugaacacaaacugu

SEQ ID NO: 2607889 - RNA, 17 nt, Human
auugaacacaaacugua

SEQ ID NO: 2607890 - RNA, 18 nt, Human
auugaacacaaacuguaa

SEQ ID NO: 2607891 - RNA, 19 nt, Human
auugaacacaaacuguaaa

SEQ ID NO: 2607892 - RNA, 20 nt, Human
auugaacacaaacuguaaau

SEQ ID NO: 2607893 - RNA, 15 nt, Human
auugaacccaggagg

SEQ ID NO: 2607894 - RNA, 16 nt, Human
auugaaauuuauacac

SEQ ID NO: 2607895 - RNA, 14 nt, Human
auugaacccaggag

SEQ ID NO: 2607896 - RNA, 20 nt, Human
auuggcuagagguucaaaga

SEQ ID NO: 2607897 - RNA, 22 nt, Human
auuggcuagagguucaaagaua

SEQ ID NO: 2607898 - RNA, 19 nt, Human
auuggcuagagguucaaag

SEQ ID NO: 2607899 - RNA, 14 nt, Human
auuggcauguguau

SEQ ID NO: 2607900 - RNA, 12 nt, Human
auuggccuggag

SEQ ID NO: 2607901 - RNA, 11 nt, Human
auuggccugga

SEQ ID NO: 2607902 - RNA, 17 nt, Human
auuggcauguguauguu

SEQ ID NO: 2607903 - RNA, 22 nt, Human
auuggccauucuauuguggcaa

SEQ ID NO: 2607904 - RNA, 17 nt, Human
auuggagcucgugggac

SEQ ID NO: 2607905 - RNA, 16 nt, Human
auuggagcucguggaa

SEQ ID NO: 2607906 - RNA, 17 nt, Human
auuggagauagggaaag

SEQ ID NO: 2607907 - RNA, 22 nt, Human
auuggagaaguaauccuaggga

SEQ ID NO: 2607908 - RNA, 15 nt, Human
auuggcagcagauuu

SEQ ID NO: 2607909 - RNA, 22 nt, Human
auuggcagcaggugcugcuacc

SEQ ID NO: 2607910 - RNA, 19 nt, Human
auuggcagcaggugcugcu

SEQ ID NO: 2607911 - RNA, 17 nt, Human
auuggagccaccaugcc

SEQ ID NO: 2607912 - RNA, 18 nt, Human
auuggcagcaggugcugc

SEQ ID NO: 2607913 - RNA, 18 nt, Human
auuggagaguaaaaacug

SEQ ID NO: 2607914 - RNA, 18 nt, Human
auuggcuauuuaaaacuu

SEQ ID NO: 2607915 - RNA, 17 nt, Human
auuggcuauuuaaaacu

SEQ ID NO: 2607916 - RNA, 23 nt, Human
auuggcuagagguucaaagauau

SEQ ID NO: 2607917 - RNA, 16 nt, Human
auuggcucacacugag

SEQ ID NO: 2607918 - RNA, 15 nt, Human
auuggcucacacuga

SEQ ID NO: 2607919 - RNA, 13 nt, Human
auuggcucacacu

SEQ ID NO: 2607920 - RNA, 19 nt, Human
auuggcuauuuaaagacaa

SEQ ID NO: 2607921 - RNA, 14 nt, Human
auugcaucuguaua

SEQ ID NO: 2607922 - RNA, 13 nt, Human
auugcaucuguau

SEQ ID NO: 2607923 - RNA, 22 nt, Human
auugcaucuggguagcuguaag

SEQ ID NO: 2607924 - RNA, 19 nt, Human
auugcaucuguauaaguaa

SEQ ID NO: 2607925 - RNA, 15 nt, Human
auugcaucuguauaa

SEQ ID NO: 2607926 - RNA, 15 nt, Human
auugcaugugacucu

SEQ ID NO: 2607927 - RNA, 17 nt, Human
auugcaugugacucuga

SEQ ID NO: 2607928 - RNA, 23 nt, Human
auugcauuaaauauaauaugcac

SEQ ID NO: 2607929 - RNA, 13 nt, Human
auugcaugugacu

SEQ ID NO: 2607930 - RNA, 14 nt, Human
auugcaugugacuc

SEQ ID NO: 2607931 - RNA, 11 nt, Human
auugcauugac

SEQ ID NO: 2607932 - RNA, 15 nt, Human
auugccugcagagag

SEQ ID NO: 2607933 - RNA, 16 nt, Human
auugccugcagagaga

SEQ ID NO: 2607934 - RNA, 18 nt, Human
auugcaugugacucugaa

SEQ ID NO: 2607935 - RNA, 18 nt, Human
auugccuuaacuggagcc

SEQ ID NO: 2607936 - RNA, 17 nt, Human
auugccugcagagagaa

SEQ ID NO: 2607937 - RNA, 22 nt, Human
auugcaucucccagauaaugug

SEQ ID NO: 2607938 - RNA, 23 nt, Human
auugcaucucccagauaauguga

SEQ ID NO: 2607939 - RNA, 20 nt, Human
auugcaucuggguagcugua

SEQ ID NO: 2607940 - RNA, 21 nt, Human
auugcaucuggguagcuguaa

SEQ ID NO: 2607941 - RNA, 15 nt, Human
auugcaucucccaga

SEQ ID NO: 2607942 - RNA, 13 nt, Human
auugcacucuaaa

SEQ ID NO: 2607943 - RNA, 16 nt, Human
auugcauauaacuuau

SEQ ID NO: 2607944 - RNA, 18 nt, Human
auugcauauaacuuauau

SEQ ID NO: 2607945 - RNA, 22 nt, Human
auugcauauaacuuauauugua

SEQ ID NO: 2607946 - RNA, 16 nt, Human
auugcauauauacaua

SEQ ID NO: 2607947 - RNA, 23 nt, Human
auugccuuuagugaucacagcag

SEQ ID NO: 2607948 - RNA, 15 nt, Human
auuggacccuuccau

SEQ ID NO: 2607949 - RNA, 18 nt, Human
auuggaaugggcagcuca

SEQ ID NO: 2607950 - RNA, 16 nt, Human
auuggaacagaauguu

SEQ ID NO: 2607951 - RNA, 16 nt, Human
auuggaagaccccacc

SEQ ID NO: 2607952 - RNA, 19 nt, Human
auuggaagaaauuccugua

SEQ ID NO: 2607953 - RNA, 18 nt, Human
auuggaagaaauuccugu

SEQ ID NO: 2607954 - RNA, 14 nt, Human
auuggaagaaauuc

SEQ ID NO: 2607955 - RNA, 17 nt, Human
auuggcucacacugaga

SEQ ID NO: 2607956 - RNA, 18 nt, Human
auugaaucuauuuaagua

SEQ ID NO: 2607957 - RNA, 15 nt, Human
auuucuuugccuguu

SEQ ID NO: 2607958 - RNA, 18 nt, Human
auuugaauguuaagcaga

SEQ ID NO: 2607959 - RNA, 13 nt, Human
auuugaauguuaa

SEQ ID NO: 2607960 - RNA, 14 nt, Human
auuucuuuccagag

SEQ ID NO: 2607961 - RNA, 13 nt, Human
auuucuuuccaga

SEQ ID NO: 2607962 - RNA, 23 nt, Human
auuugaauguaugcuucauacag

SEQ ID NO: 2607963 - RNA, 13 nt, Human
auuucuugugccu

SEQ ID NO: 2607964 - RNA, 20 nt, Human
auuucuugggcccuccugaa

SEQ ID NO: 2607965 - RNA, 20 nt, Human
auuucuugguaagaagccgg

SEQ ID NO: 2607966 - RNA, 17 nt, Human
auuucuugggcccuccu

SEQ ID NO: 2607967 - RNA, 18 nt, Human
auuucuugggcccuccug

SEQ ID NO: 2607968 - RNA, 19 nt, Human
auuucuugguaagaagccg

SEQ ID NO: 2607969 - RNA, 14 nt, Human
auuucuugggcccu

SEQ ID NO: 2607970 - RNA, 16 nt, Human
auuucuugggcccucc

SEQ ID NO: 2607971 - RNA, 20 nt, Human
auuucuugagguaaaagcau

SEQ ID NO: 2607972 - RNA, 16 nt, Human
auuucuuccacaagag

SEQ ID NO: 2607973 - RNA, 21 nt, Human
auuucuugaguuuuguuuuaa

SEQ ID NO: 2607974 - RNA, 19 nt, Human
auuucuuaucaccacagua

SEQ ID NO: 2607975 - RNA, 21 nt, Human
auuucuuauauaugugaacau

SEQ ID NO: 2607976 - RNA, 14 nt, Human
auuucuuauauaug

SEQ ID NO: 2607977 - RNA, 11 nt, Human
auuucuuauag

SEQ ID NO: 2607978 - RNA, 18 nt, Human
auuucuuaucaccacagu

SEQ ID NO: 2607979 - RNA, 15 nt, Human
auuucuuaucaccac

SEQ ID NO: 2607980 - RNA, 13 nt, Human
auuucuucacugu

SEQ ID NO: 2607981 - RNA, 17 nt, Human
auuugaggucuguucuu

SEQ ID NO: 2607982 - RNA, 18 nt, Human
auuugaggucuguucuuu

SEQ ID NO: 2607983 - RNA, 16 nt, Human
auuugagcagggcuca

SEQ ID NO: 2607984 - RNA, 15 nt, Human
auuugagcagggcuc

SEQ ID NO: 2607985 - RNA, 19 nt, Human
auuugaauguuaagcagau

SEQ ID NO: 2607986 - RNA, 12 nt, Human
auuugagaaaug

SEQ ID NO: 2607987 - RNA, 16 nt, Human
auuugagaaaugcaua

SEQ ID NO: 2607988 - RNA, 14 nt, Human
auuugagaaaugca

SEQ ID NO: 2607989 - RNA, 17 nt, Human
auuugagaaaugcauau

SEQ ID NO: 2607990 - RNA, 17 nt, Human
auuugagagaaauauga

SEQ ID NO: 2607991 - RNA, 21 nt, Human
auuugagaauauaaaaaacuu

SEQ ID NO: 2607992 - RNA, 14 nt, Human
auuugagaauauaa

SEQ ID NO: 2607993 - RNA, 21 nt, Human
auuuggaguguuccccuucca

SEQ ID NO: 2607994 - RNA, 17 nt, Human
auuuggagacucugugg

SEQ ID NO: 2607995 - RNA, 11 nt, Human
auuuggagacu

SEQ ID NO: 2607996 - RNA, 23 nt, Human
auuugaugcuguuugacaaaguu

SEQ ID NO: 2607997 - RNA, 16 nt, Human
auuugaugcuguuuga

SEQ ID NO: 2607998 - RNA, 19 nt, Human
auuugaugcuggagagguu

SEQ ID NO: 2607999 - RNA, 17 nt, Human
auuugaugcuggagagg

SEQ ID NO: 2608000 - RNA, 15 nt, Human
auuugaugccaggac

SEQ ID NO: 2608001 - RNA, 16 nt, Human
auuugaugcuggagag

SEQ ID NO: 2608002 - RNA, 14 nt, Human
auuugaugcuaaau

SEQ ID NO: 2608003 - RNA, 21 nt, Human
auuugaggucuguucuuucca

SEQ ID NO: 2608004 - RNA, 18 nt, Human
auuugagagaaauaugaa

SEQ ID NO: 2608005 - RNA, 21 nt, Human
auuugagauguauuucaacuu

SEQ ID NO: 2608006 - RNA, 17 nt, Human
auuugaucguuccaguu

SEQ ID NO: 2608007 - RNA, 15 nt, Human
auuugauaucacagu

SEQ ID NO: 2608008 - RNA, 23 nt, Human
auuugaucguuccaguucccacu

SEQ ID NO: 2608009 - RNA, 14 nt, Human
auuugauaucacag

SEQ ID NO: 2608010 - RNA, 20 nt, Human
auuugauaguauugugcaua

SEQ ID NO: 2608011 - RNA, 20 nt, Human
auuuguaauugcuuacauuu

SEQ ID NO: 2608012 - RNA, 19 nt, Human
auuuguaauugcuuacauu

SEQ ID NO: 2608013 - RNA, 15 nt, Human
auuuguaauugcuua

SEQ ID NO: 2608014 - RNA, 15 nt, Human
auuuguacaguucag

SEQ ID NO: 2608015 - RNA, 13 nt, Human
auuuguacaguuc

SEQ ID NO: 2608016 - RNA, 21 nt, Human
auuuguacauaguuauuuauu

SEQ ID NO: 2608017 - RNA, 23 nt, Human
auuuguaauugcuuacauuuuua

SEQ ID NO: 2608018 - RNA, 13 nt, Human
auuuguacaaaaa

SEQ ID NO: 2608019 - RNA, 21 nt, Human
auuuggugguuucagaaaugu

SEQ ID NO: 2608020 - RNA, 19 nt, Human
auuuggcaaugccaucauc

SEQ ID NO: 2608021 - RNA, 16 nt, Human
auuugguucauuaauu

SEQ ID NO: 2608022 - RNA, 21 nt, Human
auuugguucauuaauucuaua

SEQ ID NO: 2608023 - RNA, 18 nt, Human
auuugguucuaggccggg

SEQ ID NO: 2608024 - RNA, 15 nt, Human
auuugguucuaauag

SEQ ID NO: 2608025 - RNA, 22 nt, Human
auuugguuuggccaucucugga

SEQ ID NO: 2608026 - RNA, 20 nt, Human
auuugguuuggccaucucug

SEQ ID NO: 2608027 - RNA, 21 nt, Human
auuuauaaaacuucucaagau

SEQ ID NO: 2608028 - RNA, 14 nt, Human
auuuauaaaacuuc

SEQ ID NO: 2608029 - RNA, 15 nt, Human
auuuauaaaacuucu

SEQ ID NO: 2608030 - RNA, 17 nt, Human
auuuauaaagcuaaaau

SEQ ID NO: 2608031 - RNA, 21 nt, Human
auuuauaaagcuaaaauaacc

SEQ ID NO: 2608032 - RNA, 15 nt, Human
auuuauaaacuuuuu

SEQ ID NO: 2608033 - RNA, 18 nt, Human
auuuauggucaacacuua

SEQ ID NO: 2608034 - RNA, 17 nt, Human
auuuauaaaugcuauuu

SEQ ID NO: 2608035 - RNA, 23 nt, Human
auuuauguaaacugcauuagaaa

SEQ ID NO: 2608036 - RNA, 14 nt, Human
auuuauaaaugcua

SEQ ID NO: 2608037 - RNA, 13 nt, Human
auuuauaaaugcu

SEQ ID NO: 2608038 - RNA, 22 nt, Human
auuuauaaauauauuuaagaua

SEQ ID NO: 2608039 - RNA, 16 nt, Human
auuuauaaaugcuauu

SEQ ID NO: 2608040 - RNA, 15 nt, Human
auuuauaaaugcuau

SEQ ID NO: 2608041 - RNA, 13 nt, Human
auuuauaacucau

SEQ ID NO: 2608042 - RNA, 13 nt, Human
auuuauguuugca

SEQ ID NO: 2608043 - RNA, 15 nt, Human
auuuauuaauugcuu

SEQ ID NO: 2608044 - RNA, 16 nt, Human
auuuauuaauugcuuu

SEQ ID NO: 2608045 - RNA, 17 nt, Human
auuuauuaauugcuuug

SEQ ID NO: 2608046 - RNA, 18 nt, Human
auuuauuaauugcuuuga

SEQ ID NO: 2608047 - RNA, 13 nt, Human
auuuaugugugag

SEQ ID NO: 2608048 - RNA, 18 nt, Human
auuuaugugugaggagcu

SEQ ID NO: 2608049 - RNA, 19 nt, Human
auuuaugugugaggagcug

SEQ ID NO: 2608050 - RNA, 22 nt, Human
auuuaugugugaggagcugcug

SEQ ID NO: 2608051 - RNA, 22 nt, Human
auuuaugucuauuuaagccuca

SEQ ID NO: 2608052 - RNA, 20 nt, Human
auuuauguagaugugcauuu

SEQ ID NO: 2608053 - RNA, 21 nt, Human
auuuauguagaugugcauuuu

SEQ ID NO: 2608054 - RNA, 12 nt, Human
auuuauguaaac

SEQ ID NO: 2608055 - RNA, 12 nt, Human
auuuauguagau

SEQ ID NO: 2608056 - RNA, 14 nt, Human
auuuauguagaugu

SEQ ID NO: 2608057 - RNA, 18 nt, Human
auuuauguagaugugcau

SEQ ID NO: 2608058 - RNA, 16 nt, Human
auuuaguguucauaaa

SEQ ID NO: 2608059 - RNA, 22 nt, Human
auuuacuugccauuacucaauu

SEQ ID NO: 2608060 - RNA, 15 nt, Human
auuuacuuugaauuu

SEQ ID NO: 2608061 - RNA, 19 nt, Human
auuuacuucuuauacauuu

SEQ ID NO: 2608062 - RNA, 20 nt, Human
auuuacuucuuauacauuug

SEQ ID NO: 2608063 - RNA, 14 nt, Human
auuuaguuauaguu

SEQ ID NO: 2608064 - RNA, 13 nt, Human
auuuaguuauagu

SEQ ID NO: 2608065 - RNA, 21 nt, Human
auuuaguguuuuuaccucugu

SEQ ID NO: 2608066 - RNA, 20 nt, Human
auuuacuugccauuacucaa

SEQ ID NO: 2608067 - RNA, 17 nt, Human
auuuaguguucauaaau

SEQ ID NO: 2608068 - RNA, 23 nt, Human
auuuauaaaaauaaaaaacacug

SEQ ID NO: 2608069 - RNA, 17 nt, Human
auuuaguucuuuguuau

SEQ ID NO: 2608070 - RNA, 13 nt, Human
auuuaguuauuga

SEQ ID NO: 2608071 - RNA, 16 nt, Human
auuuaguuauaguuuc

SEQ ID NO: 2608072 - RNA, 12 nt, Human
auuuaguucuuu

SEQ ID NO: 2608073 - RNA, 16 nt, Human
auuuaguucuuuguua

SEQ ID NO: 2608074 - RNA, 14 nt, Human
auuuauugcuugau

SEQ ID NO: 2608075 - RNA, 18 nt, Human
auuguagagccagagguc

SEQ ID NO: 2608076 - RNA, 17 nt, Human
auuguagagccagaggu

SEQ ID NO: 2608077 - RNA, 16 nt, Human
auuguaguccuguaau

SEQ ID NO: 2608078 - RNA, 18 nt, Human
auuguagcauuucuugau

SEQ ID NO: 2608079 - RNA, 16 nt, Human
auuguagcauuucuug

SEQ ID NO: 2608080 - RNA, 14 nt, Human
auuguaguuaauga

SEQ ID NO: 2608081 - RNA, 15 nt, Human
auuguagcauuucuu

SEQ ID NO: 2608082 - RNA, 22 nt, Human
auuguacucaauggauuugaug

SEQ ID NO: 2608083 - RNA, 18 nt, Human
auuguacucaauggauuu

SEQ ID NO: 2608084 - RNA, 17 nt, Human
auuguuuucaguguaca

SEQ ID NO: 2608085 - RNA, 14 nt, Human
auuguauaaaaaua

SEQ ID NO: 2608086 - RNA, 15 nt, Human
auuguauaaaaauag

SEQ ID NO: 2608087 - RNA, 10 nt, Human
auuguuuuca

SEQ ID NO: 2608088 - RNA, 13 nt, Human
auuguuuuaucau

SEQ ID NO: 2608089 - RNA, 17 nt, Human
auuguauaaaaauagaa

SEQ ID NO: 2608090 - RNA, 18 nt, Human
auuguuuugccaacauug

SEQ ID NO: 2608091 - RNA, 15 nt, Human
auuguuuugcacuuu

SEQ ID NO: 2608092 - RNA, 20 nt, Human
auuguuuugagcuuuccaug

SEQ ID NO: 2608093 - RNA, 18 nt, Human
auuguuuuaucaugacau

SEQ ID NO: 2608094 - RNA, 17 nt, Human
auuuaaaaaaaaaccug

SEQ ID NO: 2608095 - RNA, 18 nt, Human
auuguuuucaguguacau

SEQ ID NO: 2608096 - RNA, 19 nt, Human
auuguuuucaguguacaug

SEQ ID NO: 2608097 - RNA, 21 nt, Human
auuuaaaagggaagucuagag

SEQ ID NO: 2608098 - RNA, 19 nt, Human
auuuaaaagggaagucuag

SEQ ID NO: 2608099 - RNA, 15 nt, Human
auuuaaaagggaagu

SEQ ID NO: 2608100 - RNA, 19 nt, Human
auuuaaaagauucauuuuu

SEQ ID NO: 2608101 - RNA, 18 nt, Human
auuuaaaagauucauuuu

SEQ ID NO: 2608102 - RNA, 16 nt, Human
auuuaaaagauucauu

SEQ ID NO: 2608103 - RNA, 18 nt, Human
auuguuuugguuugcuac

SEQ ID NO: 2608104 - RNA, 19 nt, Human
auuuaaaaaaaaaagagga

SEQ ID NO: 2608105 - RNA, 14 nt, Human
auuuaaaaaaaauc

SEQ ID NO: 2608106 - RNA, 15 nt, Human
auuuacuaagccaca

SEQ ID NO: 2608107 - RNA, 21 nt, Human
auuuaccacagcagcugaaca

SEQ ID NO: 2608108 - RNA, 15 nt, Human
auuuacuacuuuugc

SEQ ID NO: 2608109 - RNA, 22 nt, Human
auuuacuaagccacaagaaauu

SEQ ID NO: 2608110 - RNA, 21 nt, Human
auuuacuaagccacaagaaau

SEQ ID NO: 2608111 - RNA, 23 nt, Human
auuuacuaagccacaagaaauuu

SEQ ID NO: 2608112 - RNA, 20 nt, Human
auuuacugagcuucucugug

SEQ ID NO: 2608113 - RNA, 13 nt, Human
auuuacugagcuu

SEQ ID NO: 2608114 - RNA, 22 nt, Human
auuuacucauucauuuauucau

SEQ ID NO: 2608115 - RNA, 15 nt, Human
auuuaccacuugugu

SEQ ID NO: 2608116 - RNA, 19 nt, Human
auuuacauguauuauuuca

SEQ ID NO: 2608117 - RNA, 16 nt, Human
auuuacauguauuauu

SEQ ID NO: 2608118 - RNA, 20 nt, Human
auuuacaugaauugcauuuu

SEQ ID NO: 2608119 - RNA, 21 nt, Human
auuuacaugaauugcauuuua

SEQ ID NO: 2608120 - RNA, 18 nt, Human
auuuacaugaauugcauu

SEQ ID NO: 2608121 - RNA, 16 nt, Human
auuuacauaugaaauu

SEQ ID NO: 2608122 - RNA, 21 nt, Human
auuuacauaugaaauuuaaua

SEQ ID NO: 2608123 - RNA, 22 nt, Human
auuuaccacuuguguuuugcaa

SEQ ID NO: 2608124 - RNA, 15 nt, Human
auuuaccacagcagc

SEQ ID NO: 2608125 - RNA, 22 nt, Human
auuuacauguauuauuucauua

SEQ ID NO: 2608126 - RNA, 18 nt, Human
auuuaccacagcagcuga

SEQ ID NO: 2608127 - RNA, 17 nt, Human
auuuaccacagcagcug

SEQ ID NO: 2608128 - RNA, 16 nt, Human
auuuaaaaugauuaga

SEQ ID NO: 2608129 - RNA, 14 nt, Human
auuuaaaaugauua

SEQ ID NO: 2608130 - RNA, 13 nt, Human
auuuaaaaugauu

SEQ ID NO: 2608131 - RNA, 15 nt, Human
auuuaaaauugugau

SEQ ID NO: 2608132 - RNA, 21 nt, Human
auuuaaauacagucuuccauu

SEQ ID NO: 2608133 - RNA, 21 nt, Human
auuuaaaauguguuucuuaca

SEQ ID NO: 2608134 - RNA, 15 nt, Human
auuuaaauauaauuc

SEQ ID NO: 2608135 - RNA, 13 nt, Human
auuuaaauauaau

SEQ ID NO: 2608136 - RNA, 22 nt, Human
auuuaaauauaauucuguaaau

SEQ ID NO: 2608137 - RNA, 20 nt, Human
auuuaaauauaauucuguaa

SEQ ID NO: 2608138 - RNA, 19 nt, Human
auuuaaauauaauucugua

SEQ ID NO: 2608139 - RNA, 18 nt, Human
auuuaaauauaauucugu

SEQ ID NO: 2608140 - RNA, 23 nt, Human
auuuaaauauaauucuguaaaug

SEQ ID NO: 2608141 - RNA, 16 nt, Human
auuuaaauauuaaaua

SEQ ID NO: 2608142 - RNA, 14 nt, Human
auuuacacugggag

SEQ ID NO: 2608143 - RNA, 17 nt, Human
auuuaaaugucuaaugu

SEQ ID NO: 2608144 - RNA, 13 nt, Human
auuuacaguuuca

SEQ ID NO: 2608145 - RNA, 23 nt, Human
auuuacagugaaaauguaagcug

SEQ ID NO: 2608146 - RNA, 22 nt, Human
auuuacagugaaaauguaagcu

SEQ ID NO: 2608147 - RNA, 21 nt, Human
auuuacagugaaaauguaagc

SEQ ID NO: 2608148 - RNA, 24 nt, Human
auuuacaguuucaaaaacuguauu

SEQ ID NO: 2608149 - RNA, 15 nt, Human
auuuacaguuucaaa

SEQ ID NO: 2608150 - RNA, 14 nt, Human
auuuacauaugaaa

SEQ ID NO: 2608151 - RNA, 15 nt, Human
auuuacauaugaaau

SEQ ID NO: 2608152 - RNA, 20 nt, Human
auuuacagugaaaauguaag

SEQ ID NO: 2608153 - RNA, 21 nt, Human
auuuacagccucacuugaaug

SEQ ID NO: 2608154 - RNA, 19 nt, Human
auuuacagaugaauguauu

SEQ ID NO: 2608155 - RNA, 20 nt, Human
auuuauuacuguaagaaaau

SEQ ID NO: 2608156 - RNA, 19 nt, Human
auuuauuacuguaagaaaa

SEQ ID NO: 2608157 - RNA, 15 nt, Human
auuuauuaccucuga

SEQ ID NO: 2608158 - RNA, 14 nt, Human
auuuauuaccucug

SEQ ID NO: 2608159 - RNA, 19 nt, Human
auuuauugcuugauacuuu

SEQ ID NO: 2608160 - RNA, 20 nt, Human
auuuauugcuugauacuuuu

SEQ ID NO: 2608161 - RNA, 13 nt, Human
auuuauugcuuua

SEQ ID NO: 2608162 - RNA, 12 nt, Human
auuuauugcuuu

SEQ ID NO: 2608163 - RNA, 14 nt, Human
auuuauugcuuuau

SEQ ID NO: 2608164 - RNA, 17 nt, Human
auuuauuuuugcauggc

SEQ ID NO: 2608165 - RNA, 19 nt, Human
auuuauuuuuuacauuauu

SEQ ID NO: 2608166 - RNA, 21 nt, Human
auuuauuuuucucaugaaucu

SEQ ID NO: 2608167 - RNA, 18 nt, Human
auuuauuuuuuacauuau

SEQ ID NO: 2608168 - RNA, 14 nt, Human
auuuauuuuuuaca

SEQ ID NO: 2608169 - RNA, 17 nt, Human
auuuauuuuccucccca

SEQ ID NO: 2608170 - RNA, 13 nt, Human
auuuauuuuccuc

SEQ ID NO: 2608171 - RNA, 20 nt, Human
auuuauuuuccuccccagca

SEQ ID NO: 2608172 - RNA, 21 nt, Human
auuuauuuuaauaauguuuca

SEQ ID NO: 2608173 - RNA, 19 nt, Human
auuuauuguuuauuuauca

SEQ ID NO: 2608174 - RNA, 20 nt, Human
auuuauuguuuauuuaucag

SEQ ID NO: 2608175 - RNA, 21 nt, Human
auuuauuguuuauuuaucagu

SEQ ID NO: 2608176 - RNA, 22 nt, Human
auuucaugugucaacuucaaca

SEQ ID NO: 2608177 - RNA, 14 nt, Human
auuucaugugucaa

SEQ ID NO: 2608178 - RNA, 14 nt, Human
auuucauuccuaac

SEQ ID NO: 2608179 - RNA, 22 nt, Human
auuuccauauaaauauuagaaa

SEQ ID NO: 2608180 - RNA, 17 nt, Human
auuuccauauggauuuu

SEQ ID NO: 2608181 - RNA, 15 nt, Human
auuuccauauggauu

SEQ ID NO: 2608182 - RNA, 17 nt, Human
auuuccauuccagaaua

SEQ ID NO: 2608183 - RNA, 16 nt, Human
auuuccauuccagaau

SEQ ID NO: 2608184 - RNA, 15 nt, Human
auuuccauuccagaa

SEQ ID NO: 2608185 - RNA, 15 nt, Human
auuuccauuauuuau

SEQ ID NO: 2608186 - RNA, 17 nt, Human
auuuccauuauuuauau

SEQ ID NO: 2608187 - RNA, 18 nt, Human
auuucaugcuaucucugu

SEQ ID NO: 2608188 - RNA, 15 nt, Human
auuucaugauuucau

SEQ ID NO: 2608189 - RNA, 19 nt, Human
auuucaaaaauauaacuua

SEQ ID NO: 2608190 - RNA, 14 nt, Human
auuucaugaaaauu

SEQ ID NO: 2608191 - RNA, 21 nt, Human
auuucaucugcucuccuuccu

SEQ ID NO: 2608192 - RNA, 20 nt, Human
auuucaucugcucuccuucc

SEQ ID NO: 2608193 - RNA, 18 nt, Human
auuucaaaaauauaacuu

SEQ ID NO: 2608194 - RNA, 17 nt, Human
auuucaaaaauauaacu

SEQ ID NO: 2608195 - RNA, 15 nt, Human
auuucaaaaauauaa

SEQ ID NO: 2608196 - RNA, 14 nt, Human
auuucaaaaauaua

SEQ ID NO: 2608197 - RNA, 20 nt, Human
auuucaaaaaaauaaaauaa

SEQ ID NO: 2608198 - RNA, 19 nt, Human
auuucaaaaaaauaaaaua

SEQ ID NO: 2608199 - RNA, 19 nt, Human
auuucaucugcucuccuuc

SEQ ID NO: 2608200 - RNA, 18 nt, Human
auuucaucugcucuccuu

SEQ ID NO: 2608201 - RNA, 14 nt, Human
auuucaaaacucau

SEQ ID NO: 2608202 - RNA, 16 nt, Human
auuucccaaagcagug

SEQ ID NO: 2608203 - RNA, 14 nt, Human
auuucccaaagcag

SEQ ID NO: 2608204 - RNA, 17 nt, Human
auuuccguuaaaauacc

SEQ ID NO: 2608205 - RNA, 14 nt, Human
auuuccuaaauaua

SEQ ID NO: 2608206 - RNA, 19 nt, Human
auuuccuaauuuugagaaa

SEQ ID NO: 2608207 - RNA, 15 nt, Human
auuuccuaguucugu

SEQ ID NO: 2608208 - RNA, 20 nt, Human
auuuccuaguucuguagaaa

SEQ ID NO: 2608209 - RNA, 18 nt, Human
auuuccuaguucuguaga

SEQ ID NO: 2608210 - RNA, 22 nt, Human
auuuccuaguucuguagaaaug

SEQ ID NO: 2608211 - RNA, 18 nt, Human
auuuccuaucaccuauuu

SEQ ID NO: 2608212 - RNA, 21 nt, Human
auuuccuaaauauauuuuaag

SEQ ID NO: 2608213 - RNA, 13 nt, Human
auuuccuuuauaa

SEQ ID NO: 2608214 - RNA, 18 nt, Human
auuuccuuuggagcuuuu

SEQ ID NO: 2608215 - RNA, 23 nt, Human
auuuccuugaauguggcuugaga

SEQ ID NO: 2608216 - RNA, 20 nt, Human
auuuccugcccuuccucagu

SEQ ID NO: 2608217 - RNA, 13 nt, Human
auuuccugcccuu

SEQ ID NO: 2608218 - RNA, 19 nt, Human
auuuccucuauugauguac

SEQ ID NO: 2608219 - RNA, 18 nt, Human
auuuccucuauugaugua

SEQ ID NO: 2608220 - RNA, 22 nt, Human
auuuccucuauugauguacagu

SEQ ID NO: 2608221 - RNA, 22 nt, Human
auuuccucaugugaucacaauu

SEQ ID NO: 2608222 - RNA, 21 nt, Human
auuuccucaugugaucacaau

SEQ ID NO: 2608223 - RNA, 16 nt, Human
auuuccuccacaaauu

SEQ ID NO: 2608224 - RNA, 11 nt, Human
auuuccucuau

SEQ ID NO: 2608225 - RNA, 20 nt, Human
auuuccuccgucaccucaga

SEQ ID NO: 2608226 - RNA, 24 nt, Human
auuuccucaacguugcuccccauc

SEQ ID NO: 2608227 - RNA, 22 nt, Human
auuuccucaacguugcucccca

SEQ ID NO: 2608228 - RNA, 19 nt, Human
auuuccuauuuuuggaaga

SEQ ID NO: 2608229 - RNA, 20 nt, Human
auuuccuauguaacugcauu

SEQ ID NO: 2608230 - RNA, 21 nt, Human
auuucgucuguuuauaaacau

SEQ ID NO: 2608231 - RNA, 20 nt, Human
auuucgugggucuguuuucc

SEQ ID NO: 2608232 - RNA, 14 nt, Human
auuucuaaaaaaca

SEQ ID NO: 2608233 - RNA, 20 nt, Human
auuucuaaaaaacagaggcc

SEQ ID NO: 2608234 - RNA, 19 nt, Human
auuuccuuuuuuguuauua

SEQ ID NO: 2608235 - RNA, 21 nt, Human
auuucgccguugaagaggaag

SEQ ID NO: 2608236 - RNA, 20 nt, Human
auuucuuacuaaacauuuug

SEQ ID NO: 2608237 - RNA, 13 nt, Human
auuucuuacaggc

SEQ ID NO: 2608238 - RNA, 21 nt, Human
auuucuaaaaaacagaggcca

SEQ ID NO: 2608239 - RNA, 22 nt, Human
auuucgugggucuguuuuccuu

SEQ ID NO: 2608240 - RNA, 20 nt, Human
caccagagcagaugcagaga

SEQ ID NO: 2608241 - RNA, 19 nt, Human
caccagagcagaugcagag

SEQ ID NO: 2608242 - RNA, 18 nt, Human
caccagagcagaugcaga

SEQ ID NO: 2608243 - RNA, 17 nt, Human
caccagagcagaugcag

SEQ ID NO: 2608244 - RNA, 16 nt, Human
caccagagcagaugca

SEQ ID NO: 2608245 - RNA, 12 nt, Human
caccagagcaga

SEQ ID NO: 2608246 - RNA, 21 nt, Human
caccagagagggacugacacc

SEQ ID NO: 2608247 - RNA, 15 nt, Human
caccagagcccaccu

SEQ ID NO: 2608248 - RNA, 11 nt, Human
caccagagacc

SEQ ID NO: 2608249 - RNA, 19 nt, Human
caccagacacccaggacuu

SEQ ID NO: 2608250 - RNA, 20 nt, Human
caccagacacccaggacuua

SEQ ID NO: 2608251 - RNA, 14 nt, Human
caccagagagggac

SEQ ID NO: 2608252 - RNA, 21 nt, Human
caccagagaccguccucaccc

SEQ ID NO: 2608253 - RNA, 20 nt, Human
caccagagaccguccucacc

SEQ ID NO: 2608254 - RNA, 19 nt, Human
caccagagaccguccucac

SEQ ID NO: 2608255 - RNA, 16 nt, Human
caccagagaccguccu

SEQ ID NO: 2608256 - RNA, 22 nt, Human
caccacgauguggcccuggccu

SEQ ID NO: 2608257 - RNA, 22 nt, Human
caccagagcccaccuuggcuca

SEQ ID NO: 2608258 - RNA, 20 nt, Human
caccagagcccaccuuggcu

SEQ ID NO: 2608259 - RNA, 18 nt, Human
caccagagcccaccuugg

SEQ ID NO: 2608260 - RNA, 17 nt, Human
caccagagcccaccuug

SEQ ID NO: 2608261 - RNA, 16 nt, Human
caccacacccagccuc

SEQ ID NO: 2608262 - RNA, 15 nt, Human
caccacacccagccu

SEQ ID NO: 2608263 - RNA, 14 nt, Human
caccacacucagcc

SEQ ID NO: 2608264 - RNA, 19 nt, Human
caccacacccagcccacuu

SEQ ID NO: 2608265 - RNA, 15 nt, Human
caccacacucagccc

SEQ ID NO: 2608266 - RNA, 19 nt, Human
caccacacugauccagccc

SEQ ID NO: 2608267 - RNA, 13 nt, Human
caccacagacaca

SEQ ID NO: 2608268 - RNA, 12 nt, Human
caccacagacac

SEQ ID NO: 2608269 - RNA, 18 nt, Human
caccacacccagccucag

SEQ ID NO: 2608270 - RNA, 17 nt, Human
caccacacccagccuca

SEQ ID NO: 2608271 - RNA, 14 nt, Human
caccacagacacac

SEQ ID NO: 2608272 - RNA, 13 nt, Human
caccaccuuccca

SEQ ID NO: 2608273 - RNA, 14 nt, Human
caccaccuucccag

SEQ ID NO: 2608274 - RNA, 15 nt, Human
caccagacacccagg

SEQ ID NO: 2608275 - RNA, 16 nt, Human
caccagacacccagga

SEQ ID NO: 2608276 - RNA, 17 nt, Human
caccagacacccaggac

SEQ ID NO: 2608277 - RNA, 18 nt, Human
caccagacacccaggacu

SEQ ID NO: 2608278 - RNA, 14 nt, Human
caccagacacccag

SEQ ID NO: 2608279 - RNA, 19 nt, Human
caccacgcuggggucuggg

SEQ ID NO: 2608280 - RNA, 15 nt, Human
caccacgcccggcua

SEQ ID NO: 2608281 - RNA, 14 nt, Human
caccacgcccggcu

SEQ ID NO: 2608282 - RNA, 18 nt, Human
caccacgauguggcccug

SEQ ID NO: 2608283 - RNA, 19 nt, Human
caccacgauguggcccugg

SEQ ID NO: 2608284 - RNA, 20 nt, Human
caccacgauguggcccuggc

SEQ ID NO: 2608285 - RNA, 21 nt, Human
caccacgauguggcccuggcc

SEQ ID NO: 2608286 - RNA, 15 nt, Human
caccaccuucccagc

SEQ ID NO: 2608287 - RNA, 16 nt, Human
caccaccuucccagcu

SEQ ID NO: 2608288 - RNA, 18 nt, Human
caccaccuucccagcucu

SEQ ID NO: 2608289 - RNA, 19 nt, Human
caccaccuucccagcucuc

SEQ ID NO: 2608290 - RNA, 22 nt, Human
caccaccuucccagcucucccu

SEQ ID NO: 2608291 - RNA, 21 nt, Human
caccaccuucccagcucuccc

SEQ ID NO: 2608292 - RNA, 15 nt, Human
caccacgauguggcc

SEQ ID NO: 2608293 - RNA, 22 nt, Human
cacauguccaagaagcccagga

SEQ ID NO: 2608294 - RNA, 21 nt, Human
cacauguccaagaagcccagg

SEQ ID NO: 2608295 - RNA, 19 nt, Human
cacauguccaagaagccca

SEQ ID NO: 2608296 - RNA, 18 nt, Human
cacauguccaagaagccc

SEQ ID NO: 2608297 - RNA, 17 nt, Human
caccaacgucugugcca

SEQ ID NO: 2608298 - RNA, 14 nt, Human
caccaacucuugca

SEQ ID NO: 2608299 - RNA, 14 nt, Human
caccaagcacagca

SEQ ID NO: 2608300 - RNA, 15 nt, Human
caccaagcacagcag

SEQ ID NO: 2608301 - RNA, 16 nt, Human
caccaagcacagcagc

SEQ ID NO: 2608302 - RNA, 17 nt, Human
caccaagcacagcagcc

SEQ ID NO: 2608303 - RNA, 13 nt, Human
caccaagcacagc

SEQ ID NO: 2608304 - RNA, 22 nt, Human
caccaagacuuguuuuaugcuc

SEQ ID NO: 2608305 - RNA, 18 nt, Human
caccaacucuugcagguc

SEQ ID NO: 2608306 - RNA, 15 nt, Human
caccaagaaagcagg

SEQ ID NO: 2608307 - RNA, 21 nt, Human
caccaaggucuucagccauca

SEQ ID NO: 2608308 - RNA, 20 nt, Human
caccaaggucuucagccauc

SEQ ID NO: 2608309 - RNA, 15 nt, Human
caccaaggucuucag

SEQ ID NO: 2608310 - RNA, 14 nt, Human
caccaaggucuuca

SEQ ID NO: 2608311 - RNA, 23 nt, Human
caccaagggcgcaagaguagcgg

SEQ ID NO: 2608312 - RNA, 19 nt, Human
caccaagggcgcaagagua

SEQ ID NO: 2608313 - RNA, 18 nt, Human
caccaagggcgcaagagu

SEQ ID NO: 2608314 - RNA, 10 nt, Human
caccaagggc

SEQ ID NO: 2608315 - RNA, 23 nt, Human
caccaagcugugccacccugggc

SEQ ID NO: 2608316 - RNA, 22 nt, Human
caccaagcugugccacccuggg

SEQ ID NO: 2608317 - RNA, 21 nt, Human
caccaagcugugccacccugg

SEQ ID NO: 2608318 - RNA, 20 nt, Human
caccaagcugugccacccug

SEQ ID NO: 2608319 - RNA, 18 nt, Human
caccaagcugugccaccc

SEQ ID NO: 2608320 - RNA, 16 nt, Human
caccaagcugugccac

SEQ ID NO: 2608321 - RNA, 15 nt, Human
caccaagcugugcca

SEQ ID NO: 2608322 - RNA, 18 nt, Human
caccaauugauuuuaaac

SEQ ID NO: 2608323 - RNA, 13 nt, Human
caccaagccaagg

SEQ ID NO: 2608324 - RNA, 21 nt, Human
caccaagcaggaaaugaaaau

SEQ ID NO: 2608325 - RNA, 18 nt, Human
caccaagcacagcagccu

SEQ ID NO: 2608326 - RNA, 19 nt, Human
caccaagcacagcagccug

SEQ ID NO: 2608327 - RNA, 12 nt, Human
caccaagcccag

SEQ ID NO: 2608328 - RNA, 13 nt, Human
caccaagcccagu

SEQ ID NO: 2608329 - RNA, 14 nt, Human
caccaagcugugcc

SEQ ID NO: 2608330 - RNA, 14 nt, Human
caccaagccaaggg

SEQ ID NO: 2608331 - RNA, 24 nt, Human
caccaucaagccaccaacauacuc

SEQ ID NO: 2608332 - RNA, 19 nt, Human
caccaucaagccaccaaca

SEQ ID NO: 2608333 - RNA, 17 nt, Human
caccaucaagccaccaa

SEQ ID NO: 2608334 - RNA, 16 nt, Human
caccaucaagccacca

SEQ ID NO: 2608335 - RNA, 21 nt, Human
caccaucccuuuuugaagugu

SEQ ID NO: 2608336 - RNA, 20 nt, Human
caccaucccuuuuugaagug

SEQ ID NO: 2608337 - RNA, 19 nt, Human
caccaucccuuuuugaagu

SEQ ID NO: 2608338 - RNA, 16 nt, Human
caccaucccuuuuuga

SEQ ID NO: 2608339 - RNA, 15 nt, Human
caccaucccuuuuug

SEQ ID NO: 2608340 - RNA, 18 nt, Human
caccaucaugucuggcua

SEQ ID NO: 2608341 - RNA, 17 nt, Human
caccaucaugucuggcu

SEQ ID NO: 2608342 - RNA, 15 nt, Human
caccaucaugucugg

SEQ ID NO: 2608343 - RNA, 21 nt, Human
caccaugccaggcuaauuuuu

SEQ ID NO: 2608344 - RNA, 22 nt, Human
caccaugcagugccccuagcuu

SEQ ID NO: 2608345 - RNA, 21 nt, Human
caccaugcagugccccuagcu

SEQ ID NO: 2608346 - RNA, 11 nt, Human
caccaugaaac

SEQ ID NO: 2608347 - RNA, 14 nt, Human
caccaucuuugcag

SEQ ID NO: 2608348 - RNA, 23 nt, Human
caccaucuuaagagaugccucau

SEQ ID NO: 2608349 - RNA, 22 nt, Human
caccaucucaggccaccugccc

SEQ ID NO: 2608350 - RNA, 18 nt, Human
caccaucucaggccaccu

SEQ ID NO: 2608351 - RNA, 19 nt, Human
caccaucucaggccaccug

SEQ ID NO: 2608352 - RNA, 20 nt, Human
caccaucucaggccaccugc

SEQ ID NO: 2608353 - RNA, 21 nt, Human
caccaucucaggccaccugcc

SEQ ID NO: 2608354 - RNA, 21 nt, Human
caccauccugcagccuccucc

SEQ ID NO: 2608355 - RNA, 20 nt, Human
caccauccugcagccuccuc

SEQ ID NO: 2608356 - RNA, 15 nt, Human
caccauccugcagcc

SEQ ID NO: 2608357 - RNA, 18 nt, Human
caccauccgccagggccc

SEQ ID NO: 2608358 - RNA, 13 nt, Human
caccauccugcug

SEQ ID NO: 2608359 - RNA, 13 nt, Human
caccaucucaggc

SEQ ID NO: 2608360 - RNA, 14 nt, Human
caccaucucaggcc

SEQ ID NO: 2608361 - RNA, 20 nt, Human
caccauguugcccaggcugg

SEQ ID NO: 2608362 - RNA, 18 nt, Human
caccauguacauagcuug

SEQ ID NO: 2608363 - RNA, 23 nt, Human
caccaugggguccuaccaauaga

SEQ ID NO: 2608364 - RNA, 18 nt, Human
caccaugggguccuacca

SEQ ID NO: 2608365 - RNA, 12 nt, Human
caccauggccag

SEQ ID NO: 2608366 - RNA, 16 nt, Human
caccauggccagccaa

SEQ ID NO: 2608367 - RNA, 20 nt, Human
caccauguuggccaggcugc

SEQ ID NO: 2608368 - RNA, 20 nt, Human
caccauguuggccaggcugg

SEQ ID NO: 2608369 - RNA, 19 nt, Human
caccauguuggccaggcug

SEQ ID NO: 2608370 - RNA, 15 nt, Human
caccaucaagccacc

SEQ ID NO: 2608371 - RNA, 14 nt, Human
caccaucaagccac

SEQ ID NO: 2608372 - RNA, 13 nt, Human
caccaucaagcca

SEQ ID NO: 2608373 - RNA, 16 nt, Human
caccauauucagugcu

SEQ ID NO: 2608374 - RNA, 21 nt, Human
caccauauucagugcuguggc

SEQ ID NO: 2608375 - RNA, 21 nt, Human
caccauauuaccacagacaua

SEQ ID NO: 2608376 - RNA, 18 nt, Human
caccauaggucaccuuua

SEQ ID NO: 2608377 - RNA, 18 nt, Human
caccaguuccuuucaaug

SEQ ID NO: 2608378 - RNA, 19 nt, Human
caccaggggcaggcacagc

SEQ ID NO: 2608379 - RNA, 18 nt, Human
caccaggggcaggcacag

SEQ ID NO: 2608380 - RNA, 17 nt, Human
caccaggggcaggcaca

SEQ ID NO: 2608381 - RNA, 16 nt, Human
caccaggggcaggcac

SEQ ID NO: 2608382 - RNA, 13 nt, Human
caccaggggcagg

SEQ ID NO: 2608383 - RNA, 12 nt, Human
caccaggggcag

SEQ ID NO: 2608384 - RNA, 21 nt, Human
caccaggggcaggcacagcac

SEQ ID NO: 2608385 - RNA, 20 nt, Human
caccaggggcaggcacagca

SEQ ID NO: 2608386 - RNA, 15 nt, Human
caccagggguuucuc

SEQ ID NO: 2608387 - RNA, 19 nt, Human
caccaggguugaccccaga

SEQ ID NO: 2608388 - RNA, 20 nt, Human
caccagaggcugcagaaggc

SEQ ID NO: 2608389 - RNA, 16 nt, Human
caccagaggcugcaga

SEQ ID NO: 2608390 - RNA, 11 nt, Human
caccagagcug

SEQ ID NO: 2608391 - RNA, 21 nt, Human
caccagagcauuuccaacacc

SEQ ID NO: 2608392 - RNA, 23 nt, Human
caccagaggcugcagaaggccaa

SEQ ID NO: 2608393 - RNA, 21 nt, Human
caccagaggcugcagaaggcc

SEQ ID NO: 2608394 - RNA, 11 nt, Human
caccagcacca

SEQ ID NO: 2608395 - RNA, 18 nt, Human
caccaguguccccuccac

SEQ ID NO: 2608396 - RNA, 16 nt, Human
caccaguguccccucc

SEQ ID NO: 2608397 - RNA, 14 nt, Human
caccaguguccccu

SEQ ID NO: 2608398 - RNA, 13 nt, Human
caccagugucccc

SEQ ID NO: 2608399 - RNA, 21 nt, Human
caccagugacuuuuucuaaga

SEQ ID NO: 2608400 - RNA, 22 nt, Human
caccaggguugaccccagagga

SEQ ID NO: 2608401 - RNA, 23 nt, Human
caccaggguugaccccagaggau

SEQ ID NO: 2608402 - RNA, 16 nt, Human
caccagguagaacaca

SEQ ID NO: 2608403 - RNA, 15 nt, Human
caccagucacugucc

SEQ ID NO: 2608404 - RNA, 17 nt, Human
caccagucacugucccu

SEQ ID NO: 2608405 - RNA, 15 nt, Human
cacaugcauacacac

SEQ ID NO: 2608406 - RNA, 16 nt, Human
cacaugcauacacaca

SEQ ID NO: 2608407 - RNA, 17 nt, Human
cacaugcauacacacac

SEQ ID NO: 2608408 - RNA, 18 nt, Human
cacaugcauacacacaca

SEQ ID NO: 2608409 - RNA, 13 nt, Human
cacaugcauacac

SEQ ID NO: 2608410 - RNA, 14 nt, Human
cacaugcauacaca

SEQ ID NO: 2608411 - RNA, 20 nt, Human
cacaugcaaggucauuuuuu

SEQ ID NO: 2608412 - RNA, 18 nt, Human
cacaugcacgugugugca

SEQ ID NO: 2608413 - RNA, 17 nt, Human
cacaugcaaggucauuu

SEQ ID NO: 2608414 - RNA, 19 nt, Human
cacaugcaaggucauuuuu

SEQ ID NO: 2608415 - RNA, 17 nt, Human
cacaugagucccagugg

SEQ ID NO: 2608416 - RNA, 15 nt, Human
cacaugagucccagu

SEQ ID NO: 2608417 - RNA, 18 nt, Human
cacaugagucccaguggg

SEQ ID NO: 2608418 - RNA, 16 nt, Human
cacaugagauaauaug

SEQ ID NO: 2608419 - RNA, 14 nt, Human
cacaugagucccag

SEQ ID NO: 2608420 - RNA, 18 nt, Human
cacaugagcuauuuccau

SEQ ID NO: 2608421 - RNA, 21 nt, Human
cacaugagaucuaggugagga

SEQ ID NO: 2608422 - RNA, 17 nt, Human
cacauguccaagaagcc

SEQ ID NO: 2608423 - RNA, 16 nt, Human
cacauguccaagaagc

SEQ ID NO: 2608424 - RNA, 23 nt, Human
cacaugucaccguggaccuuccu

SEQ ID NO: 2608425 - RNA, 22 nt, Human
cacaugucaccguggaccuucc

SEQ ID NO: 2608426 - RNA, 20 nt, Human
cacaugucaccguggaccuu

SEQ ID NO: 2608427 - RNA, 19 nt, Human
cacaugucaccguggaccu

SEQ ID NO: 2608428 - RNA, 20 nt, Human
cacaugucaguaccuucaaa

SEQ ID NO: 2608429 - RNA, 12 nt, Human
cacaugucaccg

SEQ ID NO: 2608430 - RNA, 22 nt, Human
cacaugcugagucucccaaggc

SEQ ID NO: 2608431 - RNA, 19 nt, Human
cacauguauguuuugguau

SEQ ID NO: 2608432 - RNA, 18 nt, Human
cacaugcggagaacaaau

SEQ ID NO: 2608433 - RNA, 22 nt, Human
cacaugcucaaugacucucugg

SEQ ID NO: 2608434 - RNA, 21 nt, Human
cacaugcugagucucccaagg

SEQ ID NO: 2608435 - RNA, 18 nt, Human
cacaugcugagucuccca

SEQ ID NO: 2608436 - RNA, 17 nt, Human
cacaugcugagucuccc

SEQ ID NO: 2608437 - RNA, 16 nt, Human
cacaugcugagucucc

SEQ ID NO: 2608438 - RNA, 21 nt, Human
cacaugccucucucaggccaa

SEQ ID NO: 2608439 - RNA, 20 nt, Human
cacaugccucucucaggcca

SEQ ID NO: 2608440 - RNA, 14 nt, Human
cacaugcagcugca

SEQ ID NO: 2608441 - RNA, 21 nt, Human
cacaugagcaucaggccaggc

SEQ ID NO: 2608442 - RNA, 20 nt, Human
cacaugagcaucaggccagg

SEQ ID NO: 2608443 - RNA, 19 nt, Human
cacaugagcaucaggccag

SEQ ID NO: 2608444 - RNA, 18 nt, Human
cacaugagcaucaggcca

SEQ ID NO: 2608445 - RNA, 17 nt, Human
cacaugagcaucaggcc

SEQ ID NO: 2608446 - RNA, 13 nt, Human
cacaugagcauca

SEQ ID NO: 2608447 - RNA, 20 nt, Human
cacaguuuugguugcuuuaa

SEQ ID NO: 2608448 - RNA, 24 nt, Human
cacaugaaucccacccacauguga

SEQ ID NO: 2608449 - RNA, 20 nt, Human
cacaugacucgggggugggg

SEQ ID NO: 2608450 - RNA, 21 nt, Human
cacaugacaacuuugccagcu

SEQ ID NO: 2608451 - RNA, 15 nt, Human
cacaugagauaauau

SEQ ID NO: 2608452 - RNA, 20 nt, Human
cacaugaaguccaagcauuu

SEQ ID NO: 2608453 - RNA, 17 nt, Human
cacaugaaguccaagca

SEQ ID NO: 2608454 - RNA, 16 nt, Human
cacaugaaguccaagc

SEQ ID NO: 2608455 - RNA, 21 nt, Human
cacaguuuucuggcuggagcc

SEQ ID NO: 2608456 - RNA, 19 nt, Human
cacaguuuugguugcuuua

SEQ ID NO: 2608457 - RNA, 21 nt, Human
cacaguuuucugagaaagacu

SEQ ID NO: 2608458 - RNA, 22 nt, Human
cacaguuuucugagaaagacua

SEQ ID NO: 2608459 - RNA, 15 nt, Human
cacagugaagugcug

SEQ ID NO: 2608460 - RNA, 15 nt, Human
cacagugaagcaaau

SEQ ID NO: 2608461 - RNA, 17 nt, Human
cacagugaaggcugucc

SEQ ID NO: 2608462 - RNA, 18 nt, Human
cacagugacucgggcucc

SEQ ID NO: 2608463 - RNA, 22 nt, Human
cacagugaaggcuguccuuacc

SEQ ID NO: 2608464 - RNA, 22 nt, Human
cacagugacucgggcuccugug

SEQ ID NO: 2608465 - RNA, 21 nt, Human
cacagugacucgggcuccugu

SEQ ID NO: 2608466 - RNA, 20 nt, Human
cacagugacucgggcuccug

SEQ ID NO: 2608467 - RNA, 19 nt, Human
cacagugacucgggcuccu

SEQ ID NO: 2608468 - RNA, 23 nt, Human
cacagugacucgggcuccugugc

SEQ ID NO: 2608469 - RNA, 22 nt, Human
cacaggcccccuugaguggggu

SEQ ID NO: 2608470 - RNA, 21 nt, Human
cacaggcccccuugagugggg

SEQ ID NO: 2608471 - RNA, 13 nt, Human
cacaggcccccuu

SEQ ID NO: 2608472 - RNA, 12 nt, Human
cacaggcccccu

SEQ ID NO: 2608473 - RNA, 14 nt, Human
cacaggcccggcuc

SEQ ID NO: 2608474 - RNA, 23 nt, Human
cacaguccuuaccagcagagcac

SEQ ID NO: 2608475 - RNA, 17 nt, Human
cacagucuaauuuuuau

SEQ ID NO: 2608476 - RNA, 16 nt, Human
cacagucuaauuuuua

SEQ ID NO: 2608477 - RNA, 14 nt, Human
cacagucucucucu

SEQ ID NO: 2608478 - RNA, 22 nt, Human
cacagucucuuuaaucuucagu

SEQ ID NO: 2608479 - RNA, 19 nt, Human
cacaggcagguccaggguu

SEQ ID NO: 2608480 - RNA, 20 nt, Human
cacaggcaguuacuucugag

SEQ ID NO: 2608481 - RNA, 20 nt, Human
cacaggcaaaauccuugcuu

SEQ ID NO: 2608482 - RNA, 13 nt, Human
cacaggcaacuga

SEQ ID NO: 2608483 - RNA, 16 nt, Human
cacaggcaaaauccuu

SEQ ID NO: 2608484 - RNA, 24 nt, Human
cacaggauccuauucucaccagga

SEQ ID NO: 2608485 - RNA, 14 nt, Human
cacaggcaacugag

SEQ ID NO: 2608486 - RNA, 17 nt, Human
cacaggcaacugaggca

SEQ ID NO: 2608487 - RNA, 18 nt, Human
cacaggcaacugaggcag

SEQ ID NO: 2608488 - RNA, 19 nt, Human
cacaggcaacugaggcaga

SEQ ID NO: 2608489 - RNA, 20 nt, Human
cacagcucuucuccaggcug

SEQ ID NO: 2608490 - RNA, 19 nt, Human
cacagcucuucuccaggcu

SEQ ID NO: 2608491 - RNA, 22 nt, Human
cacaggacaugcgguagccagc

SEQ ID NO: 2608492 - RNA, 23 nt, Human
cacaggacaugcgguagccagca

SEQ ID NO: 2608493 - RNA, 20 nt, Human
cacaggacaugcgguagcca

SEQ ID NO: 2608494 - RNA, 17 nt, Human
cacaggacacagucaga

SEQ ID NO: 2608495 - RNA, 19 nt, Human
cacaggacacagucagauu

SEQ ID NO: 2608496 - RNA, 16 nt, Human
cacaggacacagucag

SEQ ID NO: 2608497 - RNA, 15 nt, Human
cacaggacauuucuc

SEQ ID NO: 2608498 - RNA, 17 nt, Human
cacaggacauuucucua

SEQ ID NO: 2608499 - RNA, 19 nt, Human
cacaggacccccuuccccu

SEQ ID NO: 2608500 - RNA, 17 nt, Human
cacaggacccccuuccc

SEQ ID NO: 2608501 - RNA, 16 nt, Human
cacaggacccccuucc

SEQ ID NO: 2608502 - RNA, 16 nt, Human
cacaggacucugccuc

SEQ ID NO: 2608503 - RNA, 15 nt, Human
cacaggacucugccu

SEQ ID NO: 2608504 - RNA, 17 nt, Human
cacaggaucagucugau

SEQ ID NO: 2608505 - RNA, 23 nt, Human
cacaggauccuauucucaccagg

SEQ ID NO: 2608506 - RNA, 20 nt, Human
cacaggauccuauucucacc

SEQ ID NO: 2608507 - RNA, 19 nt, Human
cacaggauccuauucucac

SEQ ID NO: 2608508 - RNA, 16 nt, Human
cacaggaugaaggcaa

SEQ ID NO: 2608509 - RNA, 14 nt, Human
cacagcaaccccag

SEQ ID NO: 2608510 - RNA, 17 nt, Human
cacagcaaccccaggcu

SEQ ID NO: 2608511 - RNA, 18 nt, Human
cacagcaaccccaggcug

SEQ ID NO: 2608512 - RNA, 16 nt, Human
cacacgugcaauuugu

SEQ ID NO: 2608513 - RNA, 20 nt, Human
cacacgucauuucuuagcua

SEQ ID NO: 2608514 - RNA, 19 nt, Human
cacacgucauguuucuuca

SEQ ID NO: 2608515 - RNA, 20 nt, Human
cacacgucugacccucucca

SEQ ID NO: 2608516 - RNA, 24 nt, Human
cacacgucugacccucuccacccc

SEQ ID NO: 2608517 - RNA, 20 nt, Human
cacacguaaugaaacuugga

SEQ ID NO: 2608518 - RNA, 19 nt, Human
cacacgguuugaagccugg

SEQ ID NO: 2608519 - RNA, 21 nt, Human
cacacggaggcaucugcaccc

SEQ ID NO: 2608520 - RNA, 20 nt, Human
cacacgguuugaagccugga

SEQ ID NO: 2608521 - RNA, 17 nt, Human
cacacguacuuaaauga

SEQ ID NO: 2608522 - RNA, 19 nt, Human
cacacguaaugaaacuugg

SEQ ID NO: 2608523 - RNA, 18 nt, Human
cacacggaggcaucugca

SEQ ID NO: 2608524 - RNA, 20 nt, Human
cacacggaggcaucugcacc

SEQ ID NO: 2608525 - RNA, 22 nt, Human
cacacgcuccucccucugaggc

SEQ ID NO: 2608526 - RNA, 22 nt, Human
cacacggacacucaaaagcugg

SEQ ID NO: 2608527 - RNA, 19 nt, Human
cacacgcaggaacucccag

SEQ ID NO: 2608528 - RNA, 14 nt, Human
cacacgcaggaacu

SEQ ID NO: 2608529 - RNA, 21 nt, Human
cacacgcacgcacacacacaa

SEQ ID NO: 2608530 - RNA, 19 nt, Human
cacacgcacgcacacacac

SEQ ID NO: 2608531 - RNA, 17 nt, Human
cacacgcacgcacacac

SEQ ID NO: 2608532 - RNA, 15 nt, Human
cacacgcacgcacac

SEQ ID NO: 2608533 - RNA, 14 nt, Human
cacacgcacgcaca

SEQ ID NO: 2608534 - RNA, 13 nt, Human
cacacgcacgcac

SEQ ID NO: 2608535 - RNA, 22 nt, Human
cacacgcaggaacucccagcaa

SEQ ID NO: 2608536 - RNA, 20 nt, Human
cacacgccucccacuggggu

SEQ ID NO: 2608537 - RNA, 21 nt, Human
cacacgcaggaacucccagca

SEQ ID NO: 2608538 - RNA, 20 nt, Human
cacacgcaggaacucccagc

SEQ ID NO: 2608539 - RNA, 17 nt, Human
cacacgccucccacugg

SEQ ID NO: 2608540 - RNA, 15 nt, Human
cacagcaaggcaccu

SEQ ID NO: 2608541 - RNA, 23 nt, Human
cacagcaaggaggcuggcugggg

SEQ ID NO: 2608542 - RNA, 22 nt, Human
cacagcaaggaggcuggcuggg

SEQ ID NO: 2608543 - RNA, 21 nt, Human
cacagcaaggaggcuggcugg

SEQ ID NO: 2608544 - RNA, 18 nt, Human
cacagcaaggaggcuggc

SEQ ID NO: 2608545 - RNA, 16 nt, Human
cacagcaaggaggcug

SEQ ID NO: 2608546 - RNA, 19 nt, Human
cacagcaaggcaccugcag

SEQ ID NO: 2608547 - RNA, 17 nt, Human
cacagcaaggcaccugc

SEQ ID NO: 2608548 - RNA, 20 nt, Human
cacagccagcaccuggcauc

SEQ ID NO: 2608549 - RNA, 17 nt, Human
cacagccagcaccuggc

SEQ ID NO: 2608550 - RNA, 16 nt, Human
cacagccagcaccugg

SEQ ID NO: 2608551 - RNA, 15 nt, Human
cacagccagcaccug

SEQ ID NO: 2608552 - RNA, 15 nt, Human
cacagcacagccaac

SEQ ID NO: 2608553 - RNA, 12 nt, Human
cacagcacagcc

SEQ ID NO: 2608554 - RNA, 20 nt, Human
cacagcccacguccugucag

SEQ ID NO: 2608555 - RNA, 18 nt, Human
cacagcccacguccuguc

SEQ ID NO: 2608556 - RNA, 17 nt, Human
cacagcccacguccugu

SEQ ID NO: 2608557 - RNA, 16 nt, Human
cacagcccacguccug

SEQ ID NO: 2608558 - RNA, 18 nt, Human
cacagcucuucuccaggc

SEQ ID NO: 2608559 - RNA, 13 nt, Human
cacagccauccca

SEQ ID NO: 2608560 - RNA, 20 nt, Human
cacagccaggugccuuggag

SEQ ID NO: 2608561 - RNA, 19 nt, Human
cacagccaggugccuugga

SEQ ID NO: 2608562 - RNA, 17 nt, Human
cacagccaggugccuug

SEQ ID NO: 2608563 - RNA, 16 nt, Human
cacagccaggugccuu

SEQ ID NO: 2608564 - RNA, 15 nt, Human
cacagccaggugccu

SEQ ID NO: 2608565 - RNA, 20 nt, Human
cacagccaucccagccuugg

SEQ ID NO: 2608566 - RNA, 19 nt, Human
cacagccaucccagccuug

SEQ ID NO: 2608567 - RNA, 17 nt, Human
cacagccaucccagccu

SEQ ID NO: 2608568 - RNA, 16 nt, Human
cacagccaucccagcc

SEQ ID NO: 2608569 - RNA, 14 nt, Human
cacagcccacgucc

SEQ ID NO: 2608570 - RNA, 22 nt, Human
cacagccaucccagccuuggca

SEQ ID NO: 2608571 - RNA, 19 nt, Human
cacagcccaaagaaggaaa

SEQ ID NO: 2608572 - RNA, 19 nt, Human
caccauguuugagcucaga

SEQ ID NO: 2608573 - RNA, 22 nt, Human
caccauguuugagcucagaccc

SEQ ID NO: 2608574 - RNA, 18 nt, Human
caccauguuugagcucag

SEQ ID NO: 2608575 - RNA, 22 nt, Human
caccauuaaaagggauuaccca

SEQ ID NO: 2608576 - RNA, 14 nt, Human
caccauuaaaaggg

SEQ ID NO: 2608577 - RNA, 23 nt, Human
caccauguuugagcucagacccc

SEQ ID NO: 2608578 - RNA, 14 nt, Human
caccauuccuggaa

SEQ ID NO: 2608579 - RNA, 23 nt, Human
caccauuccuggaaaccacaguc

SEQ ID NO: 2608580 - RNA, 13 nt, Human
caccauuccugga

SEQ ID NO: 2608581 - RNA, 13 nt, Human
caccauucagguc

SEQ ID NO: 2608582 - RNA, 13 nt, Human
caccauucugacu

SEQ ID NO: 2608583 - RNA, 14 nt, Human
caccauucugacuc

SEQ ID NO: 2608584 - RNA, 17 nt, Human
caccauuuggcaaugcc

SEQ ID NO: 2608585 - RNA, 22 nt, Human
cacccaaagagguauuuaucuu

SEQ ID NO: 2608586 - RNA, 14 nt, Human
cacccaaaagucaa

SEQ ID NO: 2608587 - RNA, 23 nt, Human
cacccaaaagucaaaaggugccu

SEQ ID NO: 2608588 - RNA, 21 nt, Human
cacccaagcuuggcagccgag

SEQ ID NO: 2608589 - RNA, 19 nt, Human
cacccaagcuuggcagccg

SEQ ID NO: 2608590 - RNA, 17 nt, Human
cacccaagcuuggcagc

SEQ ID NO: 2608591 - RNA, 13 nt, Human
cacccaagggccu

SEQ ID NO: 2608592 - RNA, 16 nt, Human
cacccaagcaaggcca

SEQ ID NO: 2608593 - RNA, 15 nt, Human
cacccaagcuuggca

SEQ ID NO: 2608594 - RNA, 14 nt, Human
cacccaagcuuggc

SEQ ID NO: 2608595 - RNA, 13 nt, Human
cacccaagcuugg

SEQ ID NO: 2608596 - RNA, 19 nt, Human
cacccaagagauuguuguu

SEQ ID NO: 2608597 - RNA, 15 nt, Human
caaacuggggccucc

SEQ ID NO: 2608598 - RNA, 20 nt, Human
caacaggcugggcuucagug

SEQ ID NO: 2608599 - RNA, 21 nt, Human
caaauuggagcuucauggcag

SEQ ID NO: 2608600 - RNA, 20 nt, Human
caaauugcuuacuuuggaau

SEQ ID NO: 2608601 - RNA, 15 nt, Human
caaauuaaucuuucu

SEQ ID NO: 2608602 - RNA, 22 nt, Human
caaauugcuccuaagcuucaaa

SEQ ID NO: 2608603 - RNA, 19 nt, Human
caaauugcuugaaagaaaa

SEQ ID NO: 2608604 - RNA, 17 nt, Human
caaauugcuugaaagaa

SEQ ID NO: 2608605 - RNA, 16 nt, Human
caaauuaauaaucuua

SEQ ID NO: 2608606 - RNA, 17 nt, Human
caaauuaauaaucuuau

SEQ ID NO: 2608607 - RNA, 14 nt, Human
caaauucuguuucu

SEQ ID NO: 2608608 - RNA, 14 nt, Human
caaauucuucugaa

SEQ ID NO: 2608609 - RNA, 15 nt, Human
caaauucuguuucuu

SEQ ID NO: 2608610 - RNA, 15 nt, Human
caaauucuucugaac

SEQ ID NO: 2608611 - RNA, 17 nt, Human
caaauugaacucuuuga

SEQ ID NO: 2608612 - RNA, 19 nt, Human
caaauugagagaauggaaa

SEQ ID NO: 2608613 - RNA, 13 nt, Human
caaauuaacuuga

SEQ ID NO: 2608614 - RNA, 22 nt, Human
caaauuaaggguuaagaaaaga

SEQ ID NO: 2608615 - RNA, 15 nt, Human
caaauuaauaaucuu

SEQ ID NO: 2608616 - RNA, 18 nt, Human
caaauucugucucuggau

SEQ ID NO: 2608617 - RNA, 22 nt, Human
caaauguuuacagggagccucc

SEQ ID NO: 2608618 - RNA, 20 nt, Human
caaauguuuacagggagccu

SEQ ID NO: 2608619 - RNA, 18 nt, Human
caaauguuuacagggagc

SEQ ID NO: 2608620 - RNA, 17 nt, Human
caaauguuuacagggag

SEQ ID NO: 2608621 - RNA, 15 nt, Human
caaauguuuugacau

SEQ ID NO: 2608622 - RNA, 14 nt, Human
caaauguuucugca

SEQ ID NO: 2608623 - RNA, 11 nt, Human
caaauguuucu

SEQ ID NO: 2608624 - RNA, 22 nt, Human
caaaguucccuacuuccuguga

SEQ ID NO: 2608625 - RNA, 19 nt, Human
caaaguggugagaggcauc

SEQ ID NO: 2608626 - RNA, 21 nt, Human
caaaguucccuacuuccugug

SEQ ID NO: 2608627 - RNA, 15 nt, Human
caaauauuuauuuuc

SEQ ID NO: 2608628 - RNA, 16 nt, Human
caaauauuuauuuucu

SEQ ID NO: 2608629 - RNA, 12 nt, Human
caaauauuuauu

SEQ ID NO: 2608630 - RNA, 14 nt, Human
caaauauuuauuuu

SEQ ID NO: 2608631 - RNA, 13 nt, Human
caaauauuccaga

SEQ ID NO: 2608632 - RNA, 17 nt, Human
caaauauuccagagacu

SEQ ID NO: 2608633 - RNA, 22 nt, Human
caaagccccaugcuggagccug

SEQ ID NO: 2608634 - RNA, 21 nt, Human
caaagccccaugcuggagccu

SEQ ID NO: 2608635 - RNA, 15 nt, Human
caaagcccuaaaauu

SEQ ID NO: 2608636 - RNA, 23 nt, Human
caaagccccuugcucuccccugc

SEQ ID NO: 2608637 - RNA, 14 nt, Human
caaaggagauugga

SEQ ID NO: 2608638 - RNA, 15 nt, Human
caaaggacuccaccc

SEQ ID NO: 2608639 - RNA, 16 nt, Human
caaaggaccucagcug

SEQ ID NO: 2608640 - RNA, 20 nt, Human
caaaggagauaaaucuagua

SEQ ID NO: 2608641 - RNA, 23 nt, Human
caaaggacuguuuuuuccugagc

SEQ ID NO: 2608642 - RNA, 18 nt, Human
caaaggacuugacuugca

SEQ ID NO: 2608643 - RNA, 20 nt, Human
caaaggagauuggaaggaac

SEQ ID NO: 2608644 - RNA, 17 nt, Human
caaagggaaauaucauu

SEQ ID NO: 2608645 - RNA, 15 nt, Human
caaagggaaauauca

SEQ ID NO: 2608646 - RNA, 18 nt, Human
caaagggaaauaucauuu

SEQ ID NO: 2608647 - RNA, 14 nt, Human
caaagggagagaga

SEQ ID NO: 2608648 - RNA, 15 nt, Human
caaagggagcagaac

SEQ ID NO: 2608649 - RNA, 22 nt, Human
caaagggagcacuggguugacu

SEQ ID NO: 2608650 - RNA, 17 nt, Human
caaaguggugagaggca

SEQ ID NO: 2608651 - RNA, 16 nt, Human
caaaguggugagaggc

SEQ ID NO: 2608652 - RNA, 23 nt, Human
caaaggguaucaggugcugccau

SEQ ID NO: 2608653 - RNA, 19 nt, Human
caaagugguauagaaaugc

SEQ ID NO: 2608654 - RNA, 18 nt, Human
caaagugguauagaaaug

SEQ ID NO: 2608655 - RNA, 21 nt, Human
caaaggguaucaggugcugcc

SEQ ID NO: 2608656 - RNA, 20 nt, Human
caaaggguaucaggugcugc

SEQ ID NO: 2608657 - RNA, 18 nt, Human
caaagggcugaaagccau

SEQ ID NO: 2608658 - RNA, 21 nt, Human
caaagggcugaaagccauuug

SEQ ID NO: 2608659 - RNA, 17 nt, Human
caaagggcugaaagcca

SEQ ID NO: 2608660 - RNA, 14 nt, Human
caaagggcugaaag

SEQ ID NO: 2608661 - RNA, 13 nt, Human
caaagaaauuaug

SEQ ID NO: 2608662 - RNA, 20 nt, Human
caaagacaaauucuguuucu

SEQ ID NO: 2608663 - RNA, 21 nt, Human
caaagacaaauucuguuucuu

SEQ ID NO: 2608664 - RNA, 15 nt, Human
caaagaauguuuaua

SEQ ID NO: 2608665 - RNA, 14 nt, Human
caaagaaauguaag

SEQ ID NO: 2608666 - RNA, 12 nt, Human
caaagaaauuau

SEQ ID NO: 2608667 - RNA, 19 nt, Human
caaacuggcaaacuucaga

SEQ ID NO: 2608668 - RNA, 17 nt, Human
caaacuggcaaacuuca

SEQ ID NO: 2608669 - RNA, 19 nt, Human
caaacugccuuggcuucag

SEQ ID NO: 2608670 - RNA, 16 nt, Human
caaagaccuugugugu

SEQ ID NO: 2608671 - RNA, 21 nt, Human
caaagaccacacauuugugua

SEQ ID NO: 2608672 - RNA, 14 nt, Human
caaagacagaagcc

SEQ ID NO: 2608673 - RNA, 18 nt, Human
caaagaccaaauuccuug

SEQ ID NO: 2608674 - RNA, 17 nt, Human
caaagacgaccuuuacc

SEQ ID NO: 2608675 - RNA, 23 nt, Human
caaagaccuuguguguaugugua

SEQ ID NO: 2608676 - RNA, 18 nt, Human
caaagaccuuguguguau

SEQ ID NO: 2608677 - RNA, 16 nt, Human
caaagacuuaguauau

SEQ ID NO: 2608678 - RNA, 19 nt, Human
caaagacuuaguauauuuu

SEQ ID NO: 2608679 - RNA, 20 nt, Human
caaagacuuaguauauuuuc

SEQ ID NO: 2608680 - RNA, 14 nt, Human
caaagagguuuuaa

SEQ ID NO: 2608681 - RNA, 21 nt, Human
caaagagguuuuaaaaaaauc

SEQ ID NO: 2608682 - RNA, 20 nt, Human
caaagccccaugcuggagcc

SEQ ID NO: 2608683 - RNA, 19 nt, Human
caaagccccaugcuggagc

SEQ ID NO: 2608684 - RNA, 16 nt, Human
caaagccccaugcugg

SEQ ID NO: 2608685 - RNA, 15 nt, Human
caaagccccaugcug

SEQ ID NO: 2608686 - RNA, 13 nt, Human
caaagcccagcuu

SEQ ID NO: 2608687 - RNA, 17 nt, Human
caaagaguguagaucag

SEQ ID NO: 2608688 - RNA, 14 nt, Human
caaagcccaaggga

SEQ ID NO: 2608689 - RNA, 19 nt, Human
caaagcccaaagugguaua

SEQ ID NO: 2608690 - RNA, 22 nt, Human
caaagagugggcugcaucuggg

SEQ ID NO: 2608691 - RNA, 20 nt, Human
caaagagugggcugcaucug

SEQ ID NO: 2608692 - RNA, 16 nt, Human
caaagaguuaauauau

SEQ ID NO: 2608693 - RNA, 17 nt, Human
caaagcccaaaguggua

SEQ ID NO: 2608694 - RNA, 17 nt, Human
caaagaguagacauuuc

SEQ ID NO: 2608695 - RNA, 18 nt, Human
caaagaggugacugggcc

SEQ ID NO: 2608696 - RNA, 14 nt, Human
caaagaguagaauu

SEQ ID NO: 2608697 - RNA, 16 nt, Human
caaagagguauuuauc

SEQ ID NO: 2608698 - RNA, 16 nt, Human
auuuuaaauggacaga

SEQ ID NO: 2608699 - RNA, 15 nt, Human
auuuuaaauggacag

SEQ ID NO: 2608700 - RNA, 21 nt, Human
auuuuaaauaaaagugaucaa

SEQ ID NO: 2608701 - RNA, 14 nt, Human
auuuuaaauaaaag

SEQ ID NO: 2608702 - RNA, 15 nt, Human
auuuuaaauaaaaga

SEQ ID NO: 2608703 - RNA, 16 nt, Human
auuuuaaauaaaagaa

SEQ ID NO: 2608704 - RNA, 20 nt, Human
auuuuaaauaaaagugauca

SEQ ID NO: 2608705 - RNA, 18 nt, Human
auuuguacaguucaguuc

SEQ ID NO: 2608706 - RNA, 16 nt, Human
auuuguacauauguaa

SEQ ID NO: 2608707 - RNA, 18 nt, Human
auuuguacauauguaaaa

SEQ ID NO: 2608708 - RNA, 19 nt, Human
auuuguacauauguaaaau

SEQ ID NO: 2608709 - RNA, 21 nt, Human
auuuguacauauguaaaauaa

SEQ ID NO: 2608710 - RNA, 13 nt, Human
auuuuaacaaaag

SEQ ID NO: 2608711 - RNA, 22 nt, Human
auuuuaaauuauaacuuaaaau

SEQ ID NO: 2608712 - RNA, 16 nt, Human
auuuuaaauucacaau

SEQ ID NO: 2608713 - RNA, 18 nt, Human
auuuuaacaaaagcaaga

SEQ ID NO: 2608714 - RNA, 16 nt, Human
auuuuaacaaaagcaa

SEQ ID NO: 2608715 - RNA, 21 nt, Human
auuuuaagacguguuuguguu

SEQ ID NO: 2608716 - RNA, 20 nt, Human
auuuuaagacguguuugugu

SEQ ID NO: 2608717 - RNA, 19 nt, Human
auuuuaauaauguuucaaa

SEQ ID NO: 2608718 - RNA, 18 nt, Human
auuuuaauaauguuucaa

SEQ ID NO: 2608719 - RNA, 20 nt, Human
auuuuaaguauugcaucugu

SEQ ID NO: 2608720 - RNA, 19 nt, Human
auuuuaaguauugcaucug

SEQ ID NO: 2608721 - RNA, 16 nt, Human
auuuuaaguauugcau

SEQ ID NO: 2608722 - RNA, 14 nt, Human
auuuuaaguauugc

SEQ ID NO: 2608723 - RNA, 23 nt, Human
auuuuaaguauugcaucuguaua

SEQ ID NO: 2608724 - RNA, 22 nt, Human
auuuuaaguauugcaucuguau

SEQ ID NO: 2608725 - RNA, 12 nt, Human
auuuuaagugcu

SEQ ID NO: 2608726 - RNA, 14 nt, Human
auuuuaagugcuuu

SEQ ID NO: 2608727 - RNA, 16 nt, Human
auuuuaagugcuuugu

SEQ ID NO: 2608728 - RNA, 17 nt, Human
auuuuaagugcuuugua

SEQ ID NO: 2608729 - RNA, 18 nt, Human
auuuuaagugcuuuguaa

SEQ ID NO: 2608730 - RNA, 23 nt, Human
caaacugccuaagcccuccgcca

SEQ ID NO: 2608731 - RNA, 18 nt, Human
caaacugccuaagcccuc

SEQ ID NO: 2608732 - RNA, 17 nt, Human
caaacugccuaagcccu

SEQ ID NO: 2608733 - RNA, 23 nt, Human
auuuuaaugaagaaaguggaaaa

SEQ ID NO: 2608734 - RNA, 14 nt, Human
auuuuaaucaaguu

SEQ ID NO: 2608735 - RNA, 18 nt, Human
auuuuaaucaaguugaau

SEQ ID NO: 2608736 - RNA, 13 nt, Human
auuuuaaucuaau

SEQ ID NO: 2608737 - RNA, 22 nt, Human
caaacugaggaauuucaccugu

SEQ ID NO: 2608738 - RNA, 17 nt, Human
caaacugaggaauuuca

SEQ ID NO: 2608739 - RNA, 16 nt, Human
caagcauaccaacacg

SEQ ID NO: 2608740 - RNA, 21 nt, Human
caagcagucgugccugugucc

SEQ ID NO: 2608741 - RNA, 18 nt, Human
caagcagucuacccaccu

SEQ ID NO: 2608742 - RNA, 20 nt, Human
caagcagucgugccuguguc

SEQ ID NO: 2608743 - RNA, 19 nt, Human
caagcagucgugccugugu

SEQ ID NO: 2608744 - RNA, 18 nt, Human
caagcagucgugccugug

SEQ ID NO: 2608745 - RNA, 16 nt, Human
caagcagucgugccug

SEQ ID NO: 2608746 - RNA, 17 nt, Human
caagcaggaaaugaaaa

SEQ ID NO: 2608747 - RNA, 23 nt, Human
caagcaggaaaugaaaaugucuu

SEQ ID NO: 2608748 - RNA, 15 nt, Human
caagcagucgugccu

SEQ ID NO: 2608749 - RNA, 12 nt, Human
caagcaggaagc

SEQ ID NO: 2608750 - RNA, 13 nt, Human
caagcaggaagcu

SEQ ID NO: 2608751 - RNA, 21 nt, Human
caagcaucuuggggggguggc

SEQ ID NO: 2608752 - RNA, 13 nt, Human
caagcauucuccu

SEQ ID NO: 2608753 - RNA, 15 nt, Human
caagcauucuccugu

SEQ ID NO: 2608754 - RNA, 21 nt, Human
caagcauaccaacacgagcag

SEQ ID NO: 2608755 - RNA, 19 nt, Human
caagcauuuagauguauag

SEQ ID NO: 2608756 - RNA, 16 nt, Human
caagcauuuagaugua

SEQ ID NO: 2608757 - RNA, 14 nt, Human
caagcauucugucu

SEQ ID NO: 2608758 - RNA, 21 nt, Human
caagcauuuaauguagccaug

SEQ ID NO: 2608759 - RNA, 18 nt, Human
caagccaacgacaaagcc

SEQ ID NO: 2608760 - RNA, 19 nt, Human
caagccaacgacaaagcca

SEQ ID NO: 2608761 - RNA, 20 nt, Human
caagccaacuuguaaauaca

SEQ ID NO: 2608762 - RNA, 18 nt, Human
caagccaacuuguaaaua

SEQ ID NO: 2608763 - RNA, 15 nt, Human
caagccaacuuguaa

SEQ ID NO: 2608764 - RNA, 22 nt, Human
caagcauuuaauguagccaugg

SEQ ID NO: 2608765 - RNA, 21 nt, Human
caagccaacuuguaaauacac

SEQ ID NO: 2608766 - RNA, 13 nt, Human
caagccaagcagc

SEQ ID NO: 2608767 - RNA, 14 nt, Human
caagccaagcagcc

SEQ ID NO: 2608768 - RNA, 15 nt, Human
caagccaagcagcca

SEQ ID NO: 2608769 - RNA, 17 nt, Human
caagcccagcacugcuu

SEQ ID NO: 2608770 - RNA, 12 nt, Human
caagcccaggag

SEQ ID NO: 2608771 - RNA, 16 nt, Human
caagccaagcagccaa

SEQ ID NO: 2608772 - RNA, 14 nt, Human
caagccagcuggag

SEQ ID NO: 2608773 - RNA, 20 nt, Human
caagcccaguucagcuuggg

SEQ ID NO: 2608774 - RNA, 13 nt, Human
caagccccaggca

SEQ ID NO: 2608775 - RNA, 15 nt, Human
caagccccaggcagg

SEQ ID NO: 2608776 - RNA, 17 nt, Human
caagccccaggcaggcu

SEQ ID NO: 2608777 - RNA, 18 nt, Human
caagccccaggcaggcug

SEQ ID NO: 2608778 - RNA, 16 nt, Human
caagcccccccuucca

SEQ ID NO: 2608779 - RNA, 14 nt, Human
caagcccccccuuc

SEQ ID NO: 2608780 - RNA, 16 nt, Human
caaggauccugagcca

SEQ ID NO: 2608781 - RNA, 15 nt, Human
caaggauccugagcc

SEQ ID NO: 2608782 - RNA, 22 nt, Human
caaggacugagggacucugaag

SEQ ID NO: 2608783 - RNA, 15 nt, Human
caaggacugagggac

SEQ ID NO: 2608784 - RNA, 20 nt, Human
caagcuuggcagccgagcuc

SEQ ID NO: 2608785 - RNA, 14 nt, Human
caaggacugaggga

SEQ ID NO: 2608786 - RNA, 17 nt, Human
caaggauccugagccag

SEQ ID NO: 2608787 - RNA, 23 nt, Human
caagggaauuucuucaacucccu

SEQ ID NO: 2608788 - RNA, 14 nt, Human
caaggcugucaauu

SEQ ID NO: 2608789 - RNA, 13 nt, Human
caaggcugucaau

SEQ ID NO: 2608790 - RNA, 21 nt, Human
caaggcugggggaagaagcuc

SEQ ID NO: 2608791 - RNA, 14 nt, Human
caaggauccugagc

SEQ ID NO: 2608792 - RNA, 20 nt, Human
caaggacuaggguccugggg

SEQ ID NO: 2608793 - RNA, 21 nt, Human
caaggacuaggguccugggga

SEQ ID NO: 2608794 - RNA, 16 nt, Human
caaggacuaggguccu

SEQ ID NO: 2608795 - RNA, 16 nt, Human
caagcuuggcagccga

SEQ ID NO: 2608796 - RNA, 14 nt, Human
caagcuuggcagcc

SEQ ID NO: 2608797 - RNA, 14 nt, Human
caaggacuaggguc

SEQ ID NO: 2608798 - RNA, 18 nt, Human
caaggacuaggguccugg

SEQ ID NO: 2608799 - RNA, 19 nt, Human
caaggacuaggguccuggg

SEQ ID NO: 2608800 - RNA, 19 nt, Human
caagcuucaguuuccuggu

SEQ ID NO: 2608801 - RNA, 12 nt, Human
caagcuucaguu

SEQ ID NO: 2608802 - RNA, 22 nt, Human
caagcuucaguuuccuggucug

SEQ ID NO: 2608803 - RNA, 16 nt, Human
caagcuguuuucuucu

SEQ ID NO: 2608804 - RNA, 17 nt, Human
caagcuuguccaacccg

SEQ ID NO: 2608805 - RNA, 13 nt, Human
caagcuuggcagc

SEQ ID NO: 2608806 - RNA, 13 nt, Human
caagcuucuuuua

SEQ ID NO: 2608807 - RNA, 21 nt, Human
caagcugugccacccugggcu

SEQ ID NO: 2608808 - RNA, 20 nt, Human
caagcugugccacccugggc

SEQ ID NO: 2608809 - RNA, 19 nt, Human
caagcugugccacccuggg

SEQ ID NO: 2608810 - RNA, 18 nt, Human
caagcugugccacccugg

SEQ ID NO: 2608811 - RNA, 14 nt, Human
caagcuguuuucuu

SEQ ID NO: 2608812 - RNA, 17 nt, Human
caagcugugccacccug

SEQ ID NO: 2608813 - RNA, 16 nt, Human
caagcugugccacccu

SEQ ID NO: 2608814 - RNA, 15 nt, Human
caagcugugccaccc

SEQ ID NO: 2608815 - RNA, 14 nt, Human
caagcugugccacc

SEQ ID NO: 2608816 - RNA, 12 nt, Human
caagcugugcca

SEQ ID NO: 2608817 - RNA, 23 nt, Human
caagcugugagacagugggaaau

SEQ ID NO: 2608818 - RNA, 22 nt, Human
caagcugugagacagugggaaa

SEQ ID NO: 2608819 - RNA, 17 nt, Human
caagagggucugaggaa

SEQ ID NO: 2608820 - RNA, 16 nt, Human
caagagggucugagga

SEQ ID NO: 2608821 - RNA, 12 nt, Human
caagagggucug

SEQ ID NO: 2608822 - RNA, 21 nt, Human
caagaggggguggaggggugu

SEQ ID NO: 2608823 - RNA, 18 nt, Human
caagaggggguggagggg

SEQ ID NO: 2608824 - RNA, 17 nt, Human
caagaggggguggaggg

SEQ ID NO: 2608825 - RNA, 15 nt, Human
caagaggggguggag

SEQ ID NO: 2608826 - RNA, 12 nt, Human
caagagccuugg

SEQ ID NO: 2608827 - RNA, 18 nt, Human
caagagccuuggugucca

SEQ ID NO: 2608828 - RNA, 14 nt, Human
caagagggggugga

SEQ ID NO: 2608829 - RNA, 21 nt, Human
caagagccuugguguccaccu

SEQ ID NO: 2608830 - RNA, 22 nt, Human
caagaggguccuuuaguaccug

SEQ ID NO: 2608831 - RNA, 23 nt, Human
caagagggguggagacugcuucc

SEQ ID NO: 2608832 - RNA, 21 nt, Human
caagagggguggagacugcuu

SEQ ID NO: 2608833 - RNA, 16 nt, Human
caagagggguggagac

SEQ ID NO: 2608834 - RNA, 20 nt, Human
caagcagagguggccagagc

SEQ ID NO: 2608835 - RNA, 12 nt, Human
caagcagccaag

SEQ ID NO: 2608836 - RNA, 13 nt, Human
caagcagccaagc

SEQ ID NO: 2608837 - RNA, 14 nt, Human
caagcagccaagcu

SEQ ID NO: 2608838 - RNA, 18 nt, Human
caagcagagguggccaga

SEQ ID NO: 2608839 - RNA, 17 nt, Human
caagcagagguggccag

SEQ ID NO: 2608840 - RNA, 21 nt, Human
caagcagauuggagaaacccu

SEQ ID NO: 2608841 - RNA, 22 nt, Human
caagcagcgaccgcccccuccu

SEQ ID NO: 2608842 - RNA, 21 nt, Human
caagcagccugagcaacucuu

SEQ ID NO: 2608843 - RNA, 22 nt, Human
caagcagccaagcuccuuggga

SEQ ID NO: 2608844 - RNA, 23 nt, Human
caagagccugagagugaggugga

SEQ ID NO: 2608845 - RNA, 22 nt, Human
caagagcccccuugacaccggg

SEQ ID NO: 2608846 - RNA, 17 nt, Human
caagagcccccuugaca

SEQ ID NO: 2608847 - RNA, 20 nt, Human
caagagggcacugguggccc

SEQ ID NO: 2608848 - RNA, 19 nt, Human
caagagggcacugguggcc

SEQ ID NO: 2608849 - RNA, 18 nt, Human
caagagggcacugguggc

SEQ ID NO: 2608850 - RNA, 17 nt, Human
caagagggcacuggugg

SEQ ID NO: 2608851 - RNA, 11 nt, Human
caagagccuga

SEQ ID NO: 2608852 - RNA, 13 nt, Human
caagagccugaga

SEQ ID NO: 2608853 - RNA, 17 nt, Human
caagagcccaggccucc

SEQ ID NO: 2608854 - RNA, 21 nt, Human
caagacuucaguauguuguca

SEQ ID NO: 2608855 - RNA, 16 nt, Human
caagacuucaguaugu

SEQ ID NO: 2608856 - RNA, 15 nt, Human
caagacuuggcaaca

SEQ ID NO: 2608857 - RNA, 20 nt, Human
caagacuuggcaacagaagc

SEQ ID NO: 2608858 - RNA, 21 nt, Human
caagacuugguguccuuuccc

SEQ ID NO: 2608859 - RNA, 17 nt, Human
caagacuguugcucaaa

SEQ ID NO: 2608860 - RNA, 16 nt, Human
caagacuguugcucaa

SEQ ID NO: 2608861 - RNA, 18 nt, Human
caagacuguugcucaaau

SEQ ID NO: 2608862 - RNA, 22 nt, Human
caagacuggaagguggggacag

SEQ ID NO: 2608863 - RNA, 14 nt, Human
caagacuguugcuc

SEQ ID NO: 2608864 - RNA, 22 nt, Human
caacuugcauccaacuccagga

SEQ ID NO: 2608865 - RNA, 22 nt, Human
caacuugagggcccagagcagg

SEQ ID NO: 2608866 - RNA, 21 nt, Human
caacuugagggcccagagcag

SEQ ID NO: 2608867 - RNA, 20 nt, Human
caacuugagggcccagagca

SEQ ID NO: 2608868 - RNA, 19 nt, Human
caacuugagggcccagagc

SEQ ID NO: 2608869 - RNA, 16 nt, Human
caacuugagggcccag

SEQ ID NO: 2608870 - RNA, 18 nt, Human
caacuucuucagagcuga

SEQ ID NO: 2608871 - RNA, 13 nt, Human
caacuugagggcc

SEQ ID NO: 2608872 - RNA, 20 nt, Human
caacuucuuuuuauuuucuu

SEQ ID NO: 2608873 - RNA, 23 nt, Human
caacuucuccauccuuucugccu

SEQ ID NO: 2608874 - RNA, 14 nt, Human
caacuucuucagag

SEQ ID NO: 2608875 - RNA, 14 nt, Human
caacuucuggcucc

SEQ ID NO: 2608876 - RNA, 19 nt, Human
caacuucuacuucugcccu

SEQ ID NO: 2608877 - RNA, 14 nt, Human
caagaaaucccugu

SEQ ID NO: 2608878 - RNA, 21 nt, Human
caagaaauaaaaggaagccaa

SEQ ID NO: 2608879 - RNA, 23 nt, Human
caagacccuuguggucccacccc

SEQ ID NO: 2608880 - RNA, 15 nt, Human
caagaaaucccuguu

SEQ ID NO: 2608881 - RNA, 13 nt, Human
caagaaaugaaag

SEQ ID NO: 2608882 - RNA, 19 nt, Human
caagaaauaaaaggaagcc

SEQ ID NO: 2608883 - RNA, 20 nt, Human
caagaaauaaaaggaagcca

SEQ ID NO: 2608884 - RNA, 13 nt, Human
caagaaauaaaag

SEQ ID NO: 2608885 - RNA, 12 nt, Human
caagaaagucca

SEQ ID NO: 2608886 - RNA, 22 nt, Human
caagacgcugugcugcccugcc

SEQ ID NO: 2608887 - RNA, 21 nt, Human
caagacgcugugcugcccugc

SEQ ID NO: 2608888 - RNA, 20 nt, Human
caagaccuucaccaaacaua

SEQ ID NO: 2608889 - RNA, 17 nt, Human
caagaccuguugguucc

SEQ ID NO: 2608890 - RNA, 19 nt, Human
caagacugcacaucaaaau

SEQ ID NO: 2608891 - RNA, 20 nt, Human
caagacgcugugcugcccug

SEQ ID NO: 2608892 - RNA, 17 nt, Human
caagaccucagugccuu

SEQ ID NO: 2608893 - RNA, 14 nt, Human
caagaccuguuggu

SEQ ID NO: 2608894 - RNA, 13 nt, Human
caagaccuucucc

SEQ ID NO: 2608895 - RNA, 18 nt, Human
caagguucccucugagaa

SEQ ID NO: 2608896 - RNA, 17 nt, Human
caagguucccucugaga

SEQ ID NO: 2608897 - RNA, 16 nt, Human
caagguucccucugag

SEQ ID NO: 2608898 - RNA, 15 nt, Human
caagguucccucuga

SEQ ID NO: 2608899 - RNA, 22 nt, Human
caagguuuaaacuucucugaag

SEQ ID NO: 2608900 - RNA, 19 nt, Human
caagguucccucugagaau

SEQ ID NO: 2608901 - RNA, 22 nt, Human
caagugaaaaaggaggaagaga

SEQ ID NO: 2608902 - RNA, 23 nt, Human
caagugaaaaaggaggaagagaa

SEQ ID NO: 2608903 - RNA, 17 nt, Human
caagguuuaggcuggug

SEQ ID NO: 2608904 - RNA, 12 nt, Human
caagugaagguu

SEQ ID NO: 2608905 - RNA, 11 nt, Human
caagugaaggu

SEQ ID NO: 2608906 - RNA, 14 nt, Human
caagugaagaaaag

SEQ ID NO: 2608907 - RNA, 19 nt, Human
caagugaacacuagccaga

SEQ ID NO: 2608908 - RNA, 14 nt, Human
caagugagacccug

SEQ ID NO: 2608909 - RNA, 21 nt, Human
caagugaagguuuacaauuua

SEQ ID NO: 2608910 - RNA, 14 nt, Human
caagugaagguuua

SEQ ID NO: 2608911 - RNA, 19 nt, Human
caagugaauuuuucucuaa

SEQ ID NO: 2608912 - RNA, 15 nt, Human
caagugacaucucuu

SEQ ID NO: 2608913 - RNA, 16 nt, Human
caagugacaucucuuu

SEQ ID NO: 2608914 - RNA, 18 nt, Human
caagugauucuccugccu

SEQ ID NO: 2608915 - RNA, 19 nt, Human
caagugauucuccugccuc

SEQ ID NO: 2608916 - RNA, 15 nt, Human
caagugagacccugu

SEQ ID NO: 2608917 - RNA, 19 nt, Human
caagugagacccugucuca

SEQ ID NO: 2608918 - RNA, 19 nt, Human
caagugcaugcucucugca

SEQ ID NO: 2608919 - RNA, 22 nt, Human
caagugccacugcccgagcugg

SEQ ID NO: 2608920 - RNA, 15 nt, Human
caagugccagaggug

SEQ ID NO: 2608921 - RNA, 14 nt, Human
caagugccagaggu

SEQ ID NO: 2608922 - RNA, 13 nt, Human
caagugccagagg

SEQ ID NO: 2608923 - RNA, 23 nt, Human
caagugccacugcccgagcuggu

SEQ ID NO: 2608924 - RNA, 20 nt, Human
caagugccagaggugggcag

SEQ ID NO: 2608925 - RNA, 19 nt, Human
caagugccagaggugggca

SEQ ID NO: 2608926 - RNA, 17 nt, Human
caagugccagagguggg

SEQ ID NO: 2608927 - RNA, 16 nt, Human
caagugccagaggugg

SEQ ID NO: 2608928 - RNA, 22 nt, Human
caagugccagaggugggcaggu

SEQ ID NO: 2608929 - RNA, 21 nt, Human
caagugccagaggugggcagg

SEQ ID NO: 2608930 - RNA, 20 nt, Human
caagugccagucuugugucu

SEQ ID NO: 2608931 - RNA, 13 nt, Human
caagugaaucuaa

SEQ ID NO: 2608932 - RNA, 17 nt, Human
caagugcaugcucucug

SEQ ID NO: 2608933 - RNA, 20 nt, Human
caagugauucuccugccuca

SEQ ID NO: 2608934 - RNA, 14 nt, Human
caagggccuggccu

SEQ ID NO: 2608935 - RNA, 13 nt, Human
caagggccuggcc

SEQ ID NO: 2608936 - RNA, 15 nt, Human
caagggccuggccug

SEQ ID NO: 2608937 - RNA, 21 nt, Human
caaggggaauguuugccucug

SEQ ID NO: 2608938 - RNA, 17 nt, Human
caagggaucugguccua

SEQ ID NO: 2608939 - RNA, 20 nt, Human
caagggaucugguccuaccc

SEQ ID NO: 2608940 - RNA, 21 nt, Human
caagggaucugguccuaccca

SEQ ID NO: 2608941 - RNA, 20 nt, Human
caagggagagaccucaucag

SEQ ID NO: 2608942 - RNA, 19 nt, Human
caagggagagaccucauca

SEQ ID NO: 2608943 - RNA, 17 nt, Human
caagggagagaccucau

SEQ ID NO: 2608944 - RNA, 15 nt, Human
caagggagagaccuc

SEQ ID NO: 2608945 - RNA, 14 nt, Human
caagggagagaccu

SEQ ID NO: 2608946 - RNA, 19 nt, Human
caagggcaaaauucccagg

SEQ ID NO: 2608947 - RNA, 17 nt, Human
caagggcaaaauuccca

SEQ ID NO: 2608948 - RNA, 19 nt, Human
caagggcaaaaagucuaca

SEQ ID NO: 2608949 - RNA, 13 nt, Human
caagggauggugc

SEQ ID NO: 2608950 - RNA, 20 nt, Human
caagggcagaacacuaaccu

SEQ ID NO: 2608951 - RNA, 20 nt, Human
caagggccaugcugaaggga

SEQ ID NO: 2608952 - RNA, 14 nt, Human
caagggccaugcug

SEQ ID NO: 2608953 - RNA, 23 nt, Human
caaggggaauguuugccucugcc

SEQ ID NO: 2608954 - RNA, 18 nt, Human
caaggggaaucagaacuc

SEQ ID NO: 2608955 - RNA, 16 nt, Human
caaggggaaaaucuca

SEQ ID NO: 2608956 - RNA, 21 nt, Human
caagggccaugcugaagggac

SEQ ID NO: 2608957 - RNA, 12 nt, Human
caagggccucuu

SEQ ID NO: 2608958 - RNA, 18 nt, Human
caaggggcagucuggagg

SEQ ID NO: 2608959 - RNA, 16 nt, Human
caaggggcagucugga

SEQ ID NO: 2608960 - RNA, 19 nt, Human
caaggggcagucuggaggg

SEQ ID NO: 2608961 - RNA, 19 nt, Human
caaggguucagagacucag

SEQ ID NO: 2608962 - RNA, 20 nt, Human
caaggguucagagacucagg

SEQ ID NO: 2608963 - RNA, 22 nt, Human
caagguaauuucuugugccucu

SEQ ID NO: 2608964 - RNA, 16 nt, Human
caagguagccauccca

SEQ ID NO: 2608965 - RNA, 15 nt, Human
caagguagccauccc

SEQ ID NO: 2608966 - RNA, 16 nt, Human
caagguagcccuggcc

SEQ ID NO: 2608967 - RNA, 21 nt, Human
caagguagcccuggccagagg

SEQ ID NO: 2608968 - RNA, 13 nt, Human
caaggucauuuuu

SEQ ID NO: 2608969 - RNA, 23 nt, Human
caagguagcccuggccagaggcu

SEQ ID NO: 2608970 - RNA, 23 nt, Human
caacugcaucaagaugugacaug

SEQ ID NO: 2608971 - RNA, 20 nt, Human
caacugcaucaagaugugac

SEQ ID NO: 2608972 - RNA, 17 nt, Human
caacugcaucaagaugu

SEQ ID NO: 2608973 - RNA, 18 nt, Human
caacugaaugaggucagc

SEQ ID NO: 2608974 - RNA, 18 nt, Human
caacugaauaaauaccuc

SEQ ID NO: 2608975 - RNA, 19 nt, Human
caacuggacauugucugcg

SEQ ID NO: 2608976 - RNA, 22 nt, Human
caacuggccggucugcaaguca

SEQ ID NO: 2608977 - RNA, 13 nt, Human
caacugggcccaa

SEQ ID NO: 2608978 - RNA, 21 nt, Human
caacugucuauuucugcugaa

SEQ ID NO: 2608979 - RNA, 18 nt, Human
caacugucuauuucugcu

SEQ ID NO: 2608980 - RNA, 21 nt, Human
caacugucucgaugcaaugaa

SEQ ID NO: 2608981 - RNA, 15 nt, Human
caacuguauauauuc

SEQ ID NO: 2608982 - RNA, 13 nt, Human
caacuguauauau

SEQ ID NO: 2608983 - RNA, 12 nt, Human
caacuguauaua

SEQ ID NO: 2608984 - RNA, 16 nt, Human
caacuguguucauuag

SEQ ID NO: 2608985 - RNA, 23 nt, Human
caacugucucgaugcaaugaaca

SEQ ID NO: 2608986 - RNA, 21 nt, Human
caaccugauugugucucuugg

SEQ ID NO: 2608987 - RNA, 19 nt, Human
caaccugauugugucucuu

SEQ ID NO: 2608988 - RNA, 19 nt, Human
caaccuccgccucccgggu

SEQ ID NO: 2608989 - RNA, 17 nt, Human
caaccugauugugucuc

SEQ ID NO: 2608990 - RNA, 17 nt, Human
caacucuugcaggucuc

SEQ ID NO: 2608991 - RNA, 13 nt, Human
caacucuuugaga

SEQ ID NO: 2608992 - RNA, 16 nt, Human
caacucuugauuaucc

SEQ ID NO: 2608993 - RNA, 18 nt, Human
caacucuugauuauccau

SEQ ID NO: 2608994 - RNA, 21 nt, Human
caaccugccugacauuuggag

SEQ ID NO: 2608995 - RNA, 17 nt, Human
caaccugcaaagaucug

SEQ ID NO: 2608996 - RNA, 12 nt, Human
caacucuugauu

SEQ ID NO: 2608997 - RNA, 14 nt, Human
caacucuuugagaa

SEQ ID NO: 2608998 - RNA, 15 nt, Human
caacucuuugagaaa

SEQ ID NO: 2608999 - RNA, 16 nt, Human
caacucuuugagaaac

SEQ ID NO: 2609000 - RNA, 13 nt, Human
caacugaaaagac

SEQ ID NO: 2609001 - RNA, 14 nt, Human
caacugaaaagacu

SEQ ID NO: 2609002 - RNA, 22 nt, Human
caacugaaaagacucaguguuc

SEQ ID NO: 2609003 - RNA, 16 nt, Human
caaauuuacagagaca

SEQ ID NO: 2609004 - RNA, 17 nt, Human
caaauuuacagagacag

SEQ ID NO: 2609005 - RNA, 23 nt, Human
caaauuuacagagacagaaagca

SEQ ID NO: 2609006 - RNA, 14 nt, Human
caacaggcugggcu

SEQ ID NO: 2609007 - RNA, 23 nt, Human
caacagugugaaguuagaauucc

SEQ ID NO: 2609008 - RNA, 22 nt, Human
caacagugugaaguuagaauuc

SEQ ID NO: 2609009 - RNA, 21 nt, Human
caacagugugaaguuagaauu

SEQ ID NO: 2609010 - RNA, 19 nt, Human
caacagugugaaguuagaa

SEQ ID NO: 2609011 - RNA, 18 nt, Human
caacagugugaaguuaga

SEQ ID NO: 2609012 - RNA, 17 nt, Human
caacagugugaaguuag

SEQ ID NO: 2609013 - RNA, 16 nt, Human
caacagugugaaguua

SEQ ID NO: 2609014 - RNA, 14 nt, Human
caacagugugaagu

SEQ ID NO: 2609015 - RNA, 17 nt, Human
caacagugcuaaaaaug

SEQ ID NO: 2609016 - RNA, 16 nt, Human
caacagugcuaaaaau

SEQ ID NO: 2609017 - RNA, 14 nt, Human
caacagugcuaaaa

SEQ ID NO: 2609018 - RNA, 13 nt, Human
caacagugcuaaa

SEQ ID NO: 2609019 - RNA, 13 nt, Human
caacagugugaag

SEQ ID NO: 2609020 - RNA, 18 nt, Human
caacagugcuaaaaaugg

SEQ ID NO: 2609021 - RNA, 12 nt, Human
caacagugugaa

SEQ ID NO: 2609022 - RNA, 12 nt, Human
caacagugcuaa

SEQ ID NO: 2609023 - RNA, 12 nt, Human
caacagugaguc

SEQ ID NO: 2609024 - RNA, 11 nt, Human
caacagugagu

SEQ ID NO: 2609025 - RNA, 17 nt, Human
caacaggcugggcuuca

SEQ ID NO: 2609026 - RNA, 15 nt, Human
caacauacucccauc

SEQ ID NO: 2609027 - RNA, 14 nt, Human
caacauacucccau

SEQ ID NO: 2609028 - RNA, 22 nt, Human
caacaguuuuuuaugcuaauca

SEQ ID NO: 2609029 - RNA, 23 nt, Human
caacaguguuaggccuggcacag

SEQ ID NO: 2609030 - RNA, 22 nt, Human
caacaguguuaggccuggcaca

SEQ ID NO: 2609031 - RNA, 20 nt, Human
caacaguguuaggccuggca

SEQ ID NO: 2609032 - RNA, 14 nt, Human
caacaguuccuuca

SEQ ID NO: 2609033 - RNA, 16 nt, Human
caacauacucccaucu

SEQ ID NO: 2609034 - RNA, 21 nt, Human
caaccuaccaccccuuccugu

SEQ ID NO: 2609035 - RNA, 20 nt, Human
caaccuaccaccccuuccug

SEQ ID NO: 2609036 - RNA, 18 nt, Human
caaccuaccaccccuucc

SEQ ID NO: 2609037 - RNA, 13 nt, Human
caaccuaaauuug

SEQ ID NO: 2609038 - RNA, 18 nt, Human
caaccuaaccccuuuccu

SEQ ID NO: 2609039 - RNA, 18 nt, Human
caaccucaacugccuacu

SEQ ID NO: 2609040 - RNA, 22 nt, Human
caaccuaccaccccuuccuguc

SEQ ID NO: 2609041 - RNA, 14 nt, Human
caaccucauugaca

SEQ ID NO: 2609042 - RNA, 15 nt, Human
caccacagacacaca

SEQ ID NO: 2609043 - RNA, 21 nt, Human
cacacuaaccuggguucccuu

SEQ ID NO: 2609044 - RNA, 13 nt, Human
cacacacacacaa

SEQ ID NO: 2609045 - RNA, 18 nt, Human
cacacagauuugagcuca

SEQ ID NO: 2609046 - RNA, 20 nt, Human
cacacagauuugagcucagc

SEQ ID NO: 2609047 - RNA, 17 nt, Human
cacacagaaaauauacu

SEQ ID NO: 2609048 - RNA, 18 nt, Human
cacacagaaaauauacug

SEQ ID NO: 2609049 - RNA, 19 nt, Human
cacacagaaaauauacugu

SEQ ID NO: 2609050 - RNA, 14 nt, Human
cacacagagugguc

SEQ ID NO: 2609051 - RNA, 20 nt, Human
cacacagaguggucuuucug

SEQ ID NO: 2609052 - RNA, 13 nt, Human
cacacagaaaaua

SEQ ID NO: 2609053 - RNA, 14 nt, Human
cacacagaaaauau

SEQ ID NO: 2609054 - RNA, 15 nt, Human
cacacagaaaauaua

SEQ ID NO: 2609055 - RNA, 16 nt, Human
cacacagaaaauauac

SEQ ID NO: 2609056 - RNA, 21 nt, Human
cacacagaggcugccucuccc

SEQ ID NO: 2609057 - RNA, 11 nt, Human
cacacagaaaa

SEQ ID NO: 2609058 - RNA, 12 nt, Human
cacacagaaaau

SEQ ID NO: 2609059 - RNA, 23 nt, Human
cacacacugugcuuucuauugua

SEQ ID NO: 2609060 - RNA, 22 nt, Human
cacacacugugcuuucuauugu

SEQ ID NO: 2609061 - RNA, 12 nt, Human
cacacacuuuug

SEQ ID NO: 2609062 - RNA, 14 nt, Human
cacacacuuuggcu

SEQ ID NO: 2609063 - RNA, 21 nt, Human
cacacacucgcccgcccacug

SEQ ID NO: 2609064 - RNA, 20 nt, Human
cacacacucgcccgcccacu

SEQ ID NO: 2609065 - RNA, 14 nt, Human
cacacacugaugcu

SEQ ID NO: 2609066 - RNA, 15 nt, Human
cacacacucacugcg

SEQ ID NO: 2609067 - RNA, 11 nt, Human
cacacacacac

SEQ ID NO: 2609068 - RNA, 12 nt, Human
cacacacacaca

SEQ ID NO: 2609069 - RNA, 13 nt, Human
cacacaccccaau

SEQ ID NO: 2609070 - RNA, 20 nt, Human
cacacaccagagcccaccuu

SEQ ID NO: 2609071 - RNA, 16 nt, Human
cacacaccagagccca

SEQ ID NO: 2609072 - RNA, 15 nt, Human
cacacaccagagccc

SEQ ID NO: 2609073 - RNA, 20 nt, Human
cacaaucucggcucacugca

SEQ ID NO: 2609074 - RNA, 22 nt, Human
cacaaucucggcucacugcauc

SEQ ID NO: 2609075 - RNA, 23 nt, Human
cacaaucucggcucacugcaucc

SEQ ID NO: 2609076 - RNA, 24 nt, Human
cacaaucucggcucacugcauccu

SEQ ID NO: 2609077 - RNA, 19 nt, Human
cacacaaggauagaugcug

SEQ ID NO: 2609078 - RNA, 16 nt, Human
cacacaagaagaaggg

SEQ ID NO: 2609079 - RNA, 18 nt, Human
cacacaagaagaagggca

SEQ ID NO: 2609080 - RNA, 16 nt, Human
cacacgcacacacaca

SEQ ID NO: 2609081 - RNA, 23 nt, Human
cacacgcacacacacacacagga

SEQ ID NO: 2609082 - RNA, 17 nt, Human
cacaccucccugaacca

SEQ ID NO: 2609083 - RNA, 14 nt, Human
cacaccucccugaa

SEQ ID NO: 2609084 - RNA, 16 nt, Human
cacaccucccugaacc

SEQ ID NO: 2609085 - RNA, 13 nt, Human
cacaccuccacag

SEQ ID NO: 2609086 - RNA, 12 nt, Human
cacaccuccaca

SEQ ID NO: 2609087 - RNA, 22 nt, Human
cacaccucaguucccuuggccu

SEQ ID NO: 2609088 - RNA, 14 nt, Human
cacaccuagcguca

SEQ ID NO: 2609089 - RNA, 15 nt, Human
cacaccucagaggcu

SEQ ID NO: 2609090 - RNA, 23 nt, Human
cacaccuaagggacauguuuuga

SEQ ID NO: 2609091 - RNA, 13 nt, Human
cacaccucaguuc

SEQ ID NO: 2609092 - RNA, 17 nt, Human
cacaccucaguucccuu

SEQ ID NO: 2609093 - RNA, 18 nt, Human
cacaccucaguucccuug

SEQ ID NO: 2609094 - RNA, 20 nt, Human
cacaccucaguucccuuggc

SEQ ID NO: 2609095 - RNA, 21 nt, Human
cacaccucaguucccuuggcc

SEQ ID NO: 2609096 - RNA, 20 nt, Human
cacacccagcccacuucugc

SEQ ID NO: 2609097 - RNA, 14 nt, Human
cacacccagcccac

SEQ ID NO: 2609098 - RNA, 16 nt, Human
cacaccuaagggacau

SEQ ID NO: 2609099 - RNA, 20 nt, Human
cacaccguguaaaccaaagc

SEQ ID NO: 2609100 - RNA, 19 nt, Human
cacacccagccucaguccu

SEQ ID NO: 2609101 - RNA, 18 nt, Human
cacacccagccucagucc

SEQ ID NO: 2609102 - RNA, 16 nt, Human
cacacccagccucagu

SEQ ID NO: 2609103 - RNA, 15 nt, Human
cacacccagccucag

SEQ ID NO: 2609104 - RNA, 14 nt, Human
cacacccagccuca

SEQ ID NO: 2609105 - RNA, 13 nt, Human
cacacccagccuc

SEQ ID NO: 2609106 - RNA, 14 nt, Human
cacaccaggcugug

SEQ ID NO: 2609107 - RNA, 17 nt, Human
cacaccaggcugugggc

SEQ ID NO: 2609108 - RNA, 12 nt, Human
cacacccagccu

SEQ ID NO: 2609109 - RNA, 19 nt, Human
cacaccaggcugugggccu

SEQ ID NO: 2609110 - RNA, 22 nt, Human
cacaccagagcccaccuuggcu

SEQ ID NO: 2609111 - RNA, 21 nt, Human
cacaccagagcccaccuuggc

SEQ ID NO: 2609112 - RNA, 22 nt, Human
cacaccaggccguccucccggg

SEQ ID NO: 2609113 - RNA, 12 nt, Human
cacaccagccau

SEQ ID NO: 2609114 - RNA, 15 nt, Human
cacacagaguggucu

SEQ ID NO: 2609115 - RNA, 23 nt, Human
cacaccaggccguccucccgggc

SEQ ID NO: 2609116 - RNA, 13 nt, Human
cacaccaggcugu

SEQ ID NO: 2609117 - RNA, 20 nt, Human
cacaccaggcugugggccuc

SEQ ID NO: 2609118 - RNA, 15 nt, Human
cacacagcucugucc

SEQ ID NO: 2609119 - RNA, 14 nt, Human
cacacagcucuguc

SEQ ID NO: 2609120 - RNA, 13 nt, Human
cacacagcucugu

SEQ ID NO: 2609121 - RNA, 22 nt, Human
cacacagauuugagcucagccc

SEQ ID NO: 2609122 - RNA, 15 nt, Human
cacacagcagcaguu

SEQ ID NO: 2609123 - RNA, 19 nt, Human
cacacagcaagucaggguu

SEQ ID NO: 2609124 - RNA, 18 nt, Human
caauuuuucugcacugag

SEQ ID NO: 2609125 - RNA, 15 nt, Human
cacaaacagaggccg

SEQ ID NO: 2609126 - RNA, 13 nt, Human
caauuuuucugca

SEQ ID NO: 2609127 - RNA, 11 nt, Human
caauuuuucca

SEQ ID NO: 2609128 - RNA, 17 nt, Human
cacaaaccugccugggu

SEQ ID NO: 2609129 - RNA, 13 nt, Human
cacaaaccugccu

SEQ ID NO: 2609130 - RNA, 14 nt, Human
caauuuuucugcac

SEQ ID NO: 2609131 - RNA, 15 nt, Human
cacaaaccaugcaaa

SEQ ID NO: 2609132 - RNA, 13 nt, Human
cacaaacucacca

SEQ ID NO: 2609133 - RNA, 23 nt, Human
cacaaacguuuacuuaucuuaug

SEQ ID NO: 2609134 - RNA, 22 nt, Human
cacaaacguauguaaauguaua

SEQ ID NO: 2609135 - RNA, 15 nt, Human
cacaaaccugccugg

SEQ ID NO: 2609136 - RNA, 12 nt, Human
cacaaacuguaa

SEQ ID NO: 2609137 - RNA, 17 nt, Human
cacaaacgggcucagca

SEQ ID NO: 2609138 - RNA, 11 nt, Human
caauuuuguaa

SEQ ID NO: 2609139 - RNA, 18 nt, Human
caauuuugcaugcucgau

SEQ ID NO: 2609140 - RNA, 20 nt, Human
caauuuucuggaauacauga

SEQ ID NO: 2609141 - RNA, 13 nt, Human
caauuauuuuuac

SEQ ID NO: 2609142 - RNA, 12 nt, Human
caauuuuguaac

SEQ ID NO: 2609143 - RNA, 15 nt, Human
caauuauguuaaacu

SEQ ID NO: 2609144 - RNA, 13 nt, Human
caauuauguuaaa

SEQ ID NO: 2609145 - RNA, 23 nt, Human
caauuauaucaguccucuuucaa

SEQ ID NO: 2609146 - RNA, 16 nt, Human
caauuagggccuagcc

SEQ ID NO: 2609147 - RNA, 20 nt, Human
caaugguuugcaaggaagcc

SEQ ID NO: 2609148 - RNA, 19 nt, Human
caaugguuugcaaggaagc

SEQ ID NO: 2609149 - RNA, 22 nt, Human
caaugcacacaaaacaacccua

SEQ ID NO: 2609150 - RNA, 16 nt, Human
caaugcacacaaaaca

SEQ ID NO: 2609151 - RNA, 14 nt, Human
caaugcacuuuguu

SEQ ID NO: 2609152 - RNA, 18 nt, Human
caaugguuuucuugugug

SEQ ID NO: 2609153 - RNA, 18 nt, Human
caaugguuugcaaggaag

SEQ ID NO: 2609154 - RNA, 17 nt, Human
caaugguuugcaaggaa

SEQ ID NO: 2609155 - RNA, 16 nt, Human
caaugguuugcaagga

SEQ ID NO: 2609156 - RNA, 13 nt, Human
caaugguuugcaa

SEQ ID NO: 2609157 - RNA, 19 nt, Human
cacaaucucggcucacugc

SEQ ID NO: 2609158 - RNA, 20 nt, Human
cacaauccuaacacauuauc

SEQ ID NO: 2609159 - RNA, 22 nt, Human
cacaauccuaacacauuaucgg

SEQ ID NO: 2609160 - RNA, 23 nt, Human
cacaauccuaacacauuaucggg

SEQ ID NO: 2609161 - RNA, 22 nt, Human
cacaagugccacugcccgagcu

SEQ ID NO: 2609162 - RNA, 16 nt, Human
cacaaggcuguugcau

SEQ ID NO: 2609163 - RNA, 17 nt, Human
cacaaggugcaaaucaa

SEQ ID NO: 2609164 - RNA, 13 nt, Human
cacaaguaaacau

SEQ ID NO: 2609165 - RNA, 20 nt, Human
cacaaguccugugaauuucu

SEQ ID NO: 2609166 - RNA, 16 nt, Human
cacaaguccugugaau

SEQ ID NO: 2609167 - RNA, 21 nt, Human
cacaaggcugaccaagagaga

SEQ ID NO: 2609168 - RNA, 12 nt, Human
cacaagugaaaa

SEQ ID NO: 2609169 - RNA, 16 nt, Human
cacaagugaaaaacau

SEQ ID NO: 2609170 - RNA, 20 nt, Human
cacaagaaauuugauuucua

SEQ ID NO: 2609171 - RNA, 14 nt, Human
cacaagaaauuuga

SEQ ID NO: 2609172 - RNA, 12 nt, Human
cacaagaaauuu

SEQ ID NO: 2609173 - RNA, 19 nt, Human
cacaagaagaccagacugu

SEQ ID NO: 2609174 - RNA, 23 nt, Human
cacaagaaaugaaagcagggacu

SEQ ID NO: 2609175 - RNA, 23 nt, Human
cacaagacccaaaaggcagaagc

SEQ ID NO: 2609176 - RNA, 15 nt, Human
cacaaggccaucugg

SEQ ID NO: 2609177 - RNA, 14 nt, Human
cacaaggcugacca

SEQ ID NO: 2609178 - RNA, 18 nt, Human
cacaaggcugaccaagag

SEQ ID NO: 2609179 - RNA, 19 nt, Human
cacaaggcugaccaagaga

SEQ ID NO: 2609180 - RNA, 12 nt, Human
cacaacuuguuu

SEQ ID NO: 2609181 - RNA, 20 nt, Human
cacaacuuguuuuugguuuu

SEQ ID NO: 2609182 - RNA, 15 nt, Human
cacaagaaaugaaag

SEQ ID NO: 2609183 - RNA, 13 nt, Human
cacaagaaaugaa

SEQ ID NO: 2609184 - RNA, 23 nt, Human
cacaaauauuuauuuucuuucug

SEQ ID NO: 2609185 - RNA, 13 nt, Human
cacaaauauuuau

SEQ ID NO: 2609186 - RNA, 21 nt, Human
cacaaauauuuauuuucuuuc

SEQ ID NO: 2609187 - RNA, 17 nt, Human
cacaaagguagcuuuuc

SEQ ID NO: 2609188 - RNA, 13 nt, Human
cacaaacuguaaa

SEQ ID NO: 2609189 - RNA, 16 nt, Human
cacaaagguauaauuu

SEQ ID NO: 2609190 - RNA, 10 nt, Human
cacaaauaaa

SEQ ID NO: 2609191 - RNA, 12 nt, Human
cacaaauaaaau

SEQ ID NO: 2609192 - RNA, 13 nt, Human
caaugcacuuugu

SEQ ID NO: 2609193 - RNA, 14 nt, Human
caaugcacugacau

SEQ ID NO: 2609194 - RNA, 23 nt, Human
caaugcaaaccaucauugaaauc

SEQ ID NO: 2609195 - RNA, 22 nt, Human
caaugauuguuaauuuacagcu

SEQ ID NO: 2609196 - RNA, 20 nt, Human
caaugcaaaccaucauugaa

SEQ ID NO: 2609197 - RNA, 22 nt, Human
caaugcaaaccaucauugaaau

SEQ ID NO: 2609198 - RNA, 21 nt, Human
caaugcaaaccaucauugaaa

SEQ ID NO: 2609199 - RNA, 14 nt, Human
caaugauggucacc

SEQ ID NO: 2609200 - RNA, 14 nt, Human
caaugcaaaccauc

SEQ ID NO: 2609201 - RNA, 14 nt, Human
caaugauguccaga

SEQ ID NO: 2609202 - RNA, 15 nt, Human
caaugauuguuaauu

SEQ ID NO: 2609203 - RNA, 14 nt, Human
caaugaccuuucaa

SEQ ID NO: 2609204 - RNA, 23 nt, Human
caaugaaauacacaaguaaacau

SEQ ID NO: 2609205 - RNA, 22 nt, Human
caaugaaauacacaaguaaaca

SEQ ID NO: 2609206 - RNA, 11 nt, Human
caaugaaauga

SEQ ID NO: 2609207 - RNA, 13 nt, Human
caaugaccuuuca

SEQ ID NO: 2609208 - RNA, 15 nt, Human
caaugaaaaaaugua

SEQ ID NO: 2609209 - RNA, 17 nt, Human
caaugaaaguuugcacu

SEQ ID NO: 2609210 - RNA, 16 nt, Human
caaugaccuuucaaua

SEQ ID NO: 2609211 - RNA, 15 nt, Human
caaugaccuuucaau

SEQ ID NO: 2609212 - RNA, 13 nt, Human
caaugaaaugaau

SEQ ID NO: 2609213 - RNA, 24 nt, Human
caaugauggcaauuuuguaacgaa

SEQ ID NO: 2609214 - RNA, 21 nt, Human
caaugauggcaauuuuguaac

SEQ ID NO: 2609215 - RNA, 13 nt, Human
caaugauggucac

SEQ ID NO: 2609216 - RNA, 18 nt, Human
caaucucggcucacugca

SEQ ID NO: 2609217 - RNA, 17 nt, Human
caaucucccgcugcugc

SEQ ID NO: 2609218 - RNA, 20 nt, Human
caaucgacuggguuuauguc

SEQ ID NO: 2609219 - RNA, 19 nt, Human
caaucgacuggguuuaugu

SEQ ID NO: 2609220 - RNA, 14 nt, Human
caauccuuguucag

SEQ ID NO: 2609221 - RNA, 20 nt, Human
caaucuauuaauagcugccu

SEQ ID NO: 2609222 - RNA, 20 nt, Human
caaucuaaccacaucaauau

SEQ ID NO: 2609223 - RNA, 15 nt, Human
caaucuaaccacauc

SEQ ID NO: 2609224 - RNA, 22 nt, Human
caaucuauuaauagcugccuua

SEQ ID NO: 2609225 - RNA, 21 nt, Human
caaucucaaauucucaaccua

SEQ ID NO: 2609226 - RNA, 20 nt, Human
caaucucaaauucucaaccu

SEQ ID NO: 2609227 - RNA, 13 nt, Human
caauauuccugaa

SEQ ID NO: 2609228 - RNA, 17 nt, Human
caauccugucuuucuga

SEQ ID NO: 2609229 - RNA, 18 nt, Human
caauccugugggugaaga

SEQ ID NO: 2609230 - RNA, 22 nt, Human
caauauuauaauuuuuuucaau

SEQ ID NO: 2609231 - RNA, 14 nt, Human
caauauuauaauuu

SEQ ID NO: 2609232 - RNA, 14 nt, Human
caauauuauacuaa

SEQ ID NO: 2609233 - RNA, 18 nt, Human
caauauuauacuaagaaa

SEQ ID NO: 2609234 - RNA, 19 nt, Human
caauauuauacuaagaaaa

SEQ ID NO: 2609235 - RNA, 21 nt, Human
caauauuauacuaagaaaaga

SEQ ID NO: 2609236 - RNA, 15 nt, Human
caauauucaaaugcg

SEQ ID NO: 2609237 - RNA, 13 nt, Human
caauauucaaaug

SEQ ID NO: 2609238 - RNA, 22 nt, Human
caauauuauacuaagaaaagau

SEQ ID NO: 2609239 - RNA, 23 nt, Human
caauauuauacuaagaaaagaua

SEQ ID NO: 2609240 - RNA, 20 nt, Human
caauaucaguuauuuuuuga

SEQ ID NO: 2609241 - RNA, 14 nt, Human
caauauuaaaucug

SEQ ID NO: 2609242 - RNA, 23 nt, Human
caauauuaaauacagacacuaag

SEQ ID NO: 2609243 - RNA, 15 nt, Human
caauauuaaaucugc

SEQ ID NO: 2609244 - RNA, 23 nt, Human
caauauuaaugccuuuaaaguau

SEQ ID NO: 2609245 - RNA, 17 nt, Human
caauauuaaugccuuua

SEQ ID NO: 2609246 - RNA, 13 nt, Human
caauauuauaauu

SEQ ID NO: 2609247 - RNA, 12 nt, Human
caagugcuggca

SEQ ID NO: 2609248 - RNA, 13 nt, Human
caagugccuuaau

SEQ ID NO: 2609249 - RNA, 18 nt, Human
caagugcugaacagugga

SEQ ID NO: 2609250 - RNA, 20 nt, Human
caagugcugaacaguggagg

SEQ ID NO: 2609251 - RNA, 17 nt, Human
caagugcugaacagugg

SEQ ID NO: 2609252 - RNA, 16 nt, Human
caagugcugaacagug

SEQ ID NO: 2609253 - RNA, 14 nt, Human
caagugcugaacag

SEQ ID NO: 2609254 - RNA, 16 nt, Human
caagugccugcuuuua

SEQ ID NO: 2609255 - RNA, 13 nt, Human
caauaucagugcu

SEQ ID NO: 2609256 - RNA, 21 nt, Human
caagugcuggcaccaccaggc

SEQ ID NO: 2609257 - RNA, 14 nt, Human
caauaucagacuuu

SEQ ID NO: 2609258 - RNA, 13 nt, Human
uuuuuucuuacug

SEQ ID NO: 2609259 - RNA, 11 nt, Human
uuuuuucugau

SEQ ID NO: 2609260 - RNA, 12 nt, Human
uuuuuugaaaac

SEQ ID NO: 2609261 - RNA, 17 nt, Human
ccaaacucaccugcccc

SEQ ID NO: 2609262 - RNA, 19 nt, Human
ccaaacauccuacaagaca

SEQ ID NO: 2609263 - RNA, 20 nt, Human
ccaaacauccuacaagacac

SEQ ID NO: 2609264 - RNA, 21 nt, Human
cauuuuuccuucccuucucca

SEQ ID NO: 2609265 - RNA, 22 nt, Human
ccaaacaccuuccagcuccugu

SEQ ID NO: 2609266 - RNA, 18 nt, Human
cauuuuuccuucccuucu

SEQ ID NO: 2609267 - RNA, 16 nt, Human
cauuuuuccuucccuu

SEQ ID NO: 2609268 - RNA, 16 nt, Human
ccaaacagccacacug

SEQ ID NO: 2609269 - RNA, 20 nt, Human
ccaaacaccuuccagcuccu

SEQ ID NO: 2609270 - RNA, 18 nt, Human
cauuuuuccuaacaggau

SEQ ID NO: 2609271 - RNA, 13 nt, Human
cauuuuuccuaac

SEQ ID NO: 2609272 - RNA, 20 nt, Human
cauuuuucagauauaaaaga

SEQ ID NO: 2609273 - RNA, 18 nt, Human
cauuuuucagauauaaaa

SEQ ID NO: 2609274 - RNA, 14 nt, Human
cauuuuaguucuuu

SEQ ID NO: 2609275 - RNA, 17 nt, Human
cauuuuagucacuuuuu

SEQ ID NO: 2609276 - RNA, 16 nt, Human
cauuuuagucacuuuu

SEQ ID NO: 2609277 - RNA, 15 nt, Human
cauuuuagucacuuu

SEQ ID NO: 2609278 - RNA, 11 nt, Human
cauuuuauaaa

SEQ ID NO: 2609279 - RNA, 13 nt, Human
cauuuuauaaauc

SEQ ID NO: 2609280 - RNA, 17 nt, Human
cauuuuauaaaucgcuu

SEQ ID NO: 2609281 - RNA, 18 nt, Human
cauuuuauaaaucgcuuu

SEQ ID NO: 2609282 - RNA, 21 nt, Human
cauuuuauaaaucgcuuuuga

SEQ ID NO: 2609283 - RNA, 18 nt, Human
cauuuuaaaaaugaaauu

SEQ ID NO: 2609284 - RNA, 20 nt, Human
cauuuuaaaaaaaaaggcau

SEQ ID NO: 2609285 - RNA, 12 nt, Human
cauuuugugaau

SEQ ID NO: 2609286 - RNA, 20 nt, Human
cauuuuguauaauuguaucg

SEQ ID NO: 2609287 - RNA, 18 nt, Human
cauuuuguauaauuguau

SEQ ID NO: 2609288 - RNA, 17 nt, Human
cauuuuguauaauugua

SEQ ID NO: 2609289 - RNA, 21 nt, Human
cauuuuguauaauuguaucgu

SEQ ID NO: 2609290 - RNA, 16 nt, Human
cauuuugugaauggau

SEQ ID NO: 2609291 - RNA, 15 nt, Human
cauuuugugaaugga

SEQ ID NO: 2609292 - RNA, 14 nt, Human
cauuuugugaaugg

SEQ ID NO: 2609293 - RNA, 13 nt, Human
cauuuugugaaug

SEQ ID NO: 2609294 - RNA, 21 nt, Human
cauuuugugaauggauuggau

SEQ ID NO: 2609295 - RNA, 18 nt, Human
cauuuugugaauggauug

SEQ ID NO: 2609296 - RNA, 22 nt, Human
cauuuuguggucauuaagcauu

SEQ ID NO: 2609297 - RNA, 14 nt, Human
cauuuuguauaauu

SEQ ID NO: 2609298 - RNA, 15 nt, Human
cauuuuguauaauug

SEQ ID NO: 2609299 - RNA, 23 nt, Human
cauuuuauaaaucgcuuuugaua

SEQ ID NO: 2609300 - RNA, 14 nt, Human
cauuuuauauguca

SEQ ID NO: 2609301 - RNA, 22 nt, Human
cauuugaaaauuuugauguuuu

SEQ ID NO: 2609302 - RNA, 20 nt, Human
cauuugaaaauuuugauguu

SEQ ID NO: 2609303 - RNA, 15 nt, Human
cauuugaaagaaagg

SEQ ID NO: 2609304 - RNA, 14 nt, Human
cauuugaaagaaag

SEQ ID NO: 2609305 - RNA, 11 nt, Human
cauuugaaaga

SEQ ID NO: 2609306 - RNA, 11 nt, Human
cauuugaaugc

SEQ ID NO: 2609307 - RNA, 10 nt, Human
cauuugaaug

SEQ ID NO: 2609308 - RNA, 19 nt, Human
cauuugaaagaaaggacuc

SEQ ID NO: 2609309 - RNA, 21 nt, Human
cauuugaauaaagccugcuuu

SEQ ID NO: 2609310 - RNA, 18 nt, Human
cauuugcucauggaauug

SEQ ID NO: 2609311 - RNA, 13 nt, Human
cauuugcucaugg

SEQ ID NO: 2609312 - RNA, 14 nt, Human
cauuugcuccuuuc

SEQ ID NO: 2609313 - RNA, 13 nt, Human
cauuugcuccuuu

SEQ ID NO: 2609314 - RNA, 20 nt, Human
cauuuguuugaacugauaaa

SEQ ID NO: 2609315 - RNA, 22 nt, Human
cauuuguuugaacugauaaaga

SEQ ID NO: 2609316 - RNA, 17 nt, Human
cauuuguuugaacugau

SEQ ID NO: 2609317 - RNA, 19 nt, Human
cauuugcucuuucaucucu

SEQ ID NO: 2609318 - RNA, 22 nt, Human
cauuugcguuccaugaugcugg

SEQ ID NO: 2609319 - RNA, 18 nt, Human
cauuugagcagggcucag

SEQ ID NO: 2609320 - RNA, 17 nt, Human
cauuugagcagggcuca

SEQ ID NO: 2609321 - RNA, 14 nt, Human
cauuugccuauucc

SEQ ID NO: 2609322 - RNA, 12 nt, Human
cauuugccuauu

SEQ ID NO: 2609323 - RNA, 18 nt, Human
cauuugaaagaaaggacu

SEQ ID NO: 2609324 - RNA, 20 nt, Human
cauuugagcagggcucagcg

SEQ ID NO: 2609325 - RNA, 14 nt, Human
cauuugccuugcug

SEQ ID NO: 2609326 - RNA, 18 nt, Human
cauuugccuauucccaca

SEQ ID NO: 2609327 - RNA, 17 nt, Human
cauuugccuauucccac

SEQ ID NO: 2609328 - RNA, 15 nt, Human
cauuugccuauuccc

SEQ ID NO: 2609329 - RNA, 19 nt, Human
cauuugccuauucccacac

SEQ ID NO: 2609330 - RNA, 21 nt, Human
cauuugcgaaugguuccauuc

SEQ ID NO: 2609331 - RNA, 21 nt, Human
cauuugcguuccaugaugcug

SEQ ID NO: 2609332 - RNA, 20 nt, Human
cauuugcuaacuagcuugga

SEQ ID NO: 2609333 - RNA, 18 nt, Human
cauuuagccaccaucuuu

SEQ ID NO: 2609334 - RNA, 20 nt, Human
cauuuagauugaaaacuuuu

SEQ ID NO: 2609335 - RNA, 22 nt, Human
cauuuagccaccaucuuugcag

SEQ ID NO: 2609336 - RNA, 17 nt, Human
cauuuagccaccaucuu

SEQ ID NO: 2609337 - RNA, 19 nt, Human
cauuuagauugaaaacuuu

SEQ ID NO: 2609338 - RNA, 20 nt, Human
cauuuagagaggaaaaguaa

SEQ ID NO: 2609339 - RNA, 21 nt, Human
cauuuagagaggaaaaguaac

SEQ ID NO: 2609340 - RNA, 22 nt, Human
cauuuagcuaaacggauuccaa

SEQ ID NO: 2609341 - RNA, 17 nt, Human
cauuuaggccaugggac

SEQ ID NO: 2609342 - RNA, 20 nt, Human
cauuuccugcccuuccucag

SEQ ID NO: 2609343 - RNA, 19 nt, Human
cauuuccugcccuuccuca

SEQ ID NO: 2609344 - RNA, 17 nt, Human
cauuuccugcccuuccu

SEQ ID NO: 2609345 - RNA, 13 nt, Human
cauuuccugcccu

SEQ ID NO: 2609346 - RNA, 12 nt, Human
cauuuccugccc

SEQ ID NO: 2609347 - RNA, 11 nt, Human
cauuuccugcc

SEQ ID NO: 2609348 - RNA, 19 nt, Human
cauuuccugagaccacaga

SEQ ID NO: 2609349 - RNA, 20 nt, Human
cauuuccugacagaaggacu

SEQ ID NO: 2609350 - RNA, 13 nt, Human
cauuuccugacag

SEQ ID NO: 2609351 - RNA, 15 nt, Human
cauuuccuaaauaua

SEQ ID NO: 2609352 - RNA, 23 nt, Human
cauuuccuaucaccuauuuccau

SEQ ID NO: 2609353 - RNA, 17 nt, Human
cauuuaggggccacuuu

SEQ ID NO: 2609354 - RNA, 17 nt, Human
cauuuccuauguaacug

SEQ ID NO: 2609355 - RNA, 19 nt, Human
cauuuccuauguaacugca

SEQ ID NO: 2609356 - RNA, 16 nt, Human
cauuguuuuaaaaaga

SEQ ID NO: 2609357 - RNA, 22 nt, Human
cauuuaauaauauacuugugga

SEQ ID NO: 2609358 - RNA, 15 nt, Human
cauuuaaaagauaca

SEQ ID NO: 2609359 - RNA, 16 nt, Human
cauuuaaaagauacag

SEQ ID NO: 2609360 - RNA, 12 nt, Human
cauuuaaaagau

SEQ ID NO: 2609361 - RNA, 13 nt, Human
cauuguuuuaaaa

SEQ ID NO: 2609362 - RNA, 22 nt, Human
cauuguuugucugucuucauag

SEQ ID NO: 2609363 - RNA, 18 nt, Human
cauuguuugucugucuuc

SEQ ID NO: 2609364 - RNA, 13 nt, Human
cauuuccuguguc

SEQ ID NO: 2609365 - RNA, 12 nt, Human
cauuuccugugu

SEQ ID NO: 2609366 - RNA, 16 nt, Human
cauuuccuucaaggca

SEQ ID NO: 2609367 - RNA, 23 nt, Human
cauuuccugcccuuccucaguuu

SEQ ID NO: 2609368 - RNA, 21 nt, Human
cauuuccugcccuuccucagu

SEQ ID NO: 2609369 - RNA, 21 nt, Human
cauuucgguggcuagucaagc

SEQ ID NO: 2609370 - RNA, 17 nt, Human
cauuucgccccucauuu

SEQ ID NO: 2609371 - RNA, 21 nt, Human
cauuucgccccucauuuaucc

SEQ ID NO: 2609372 - RNA, 17 nt, Human
cauuucuacucucccau

SEQ ID NO: 2609373 - RNA, 15 nt, Human
cauuucgguggcuag

SEQ ID NO: 2609374 - RNA, 17 nt, Human
cauuucuaaaggccucu

SEQ ID NO: 2609375 - RNA, 18 nt, Human
cauuucuaaaggccucuu

SEQ ID NO: 2609376 - RNA, 23 nt, Human
cauuucuaaaggccucuuccuug

SEQ ID NO: 2609377 - RNA, 18 nt, Human
cauuucuauuuauuuacu

SEQ ID NO: 2609378 - RNA, 14 nt, Human
cauuucuauuuauu

SEQ ID NO: 2609379 - RNA, 13 nt, Human
cauuucuauuuau

SEQ ID NO: 2609380 - RNA, 20 nt, Human
cauuucuacucuuaaguuuc

SEQ ID NO: 2609381 - RNA, 22 nt, Human
cauuucuacucucccauggcuu

SEQ ID NO: 2609382 - RNA, 21 nt, Human
cauuucuacucucccauggcu

SEQ ID NO: 2609383 - RNA, 20 nt, Human
cauuucuacucucccauggc

SEQ ID NO: 2609384 - RNA, 23 nt, Human
cauuucuacucuuaaguuucuca

SEQ ID NO: 2609385 - RNA, 21 nt, Human
cauuucuacucuuaaguuucu

SEQ ID NO: 2609386 - RNA, 18 nt, Human
cauuucuacugugacuga

SEQ ID NO: 2609387 - RNA, 23 nt, Human
cauuucuagaacaucccugccag

SEQ ID NO: 2609388 - RNA, 21 nt, Human
cauuguagagcuucuggcacu

SEQ ID NO: 2609389 - RNA, 19 nt, Human
cauuguagagcuucuggca

SEQ ID NO: 2609390 - RNA, 17 nt, Human
cauuguagagcuucugg

SEQ ID NO: 2609391 - RNA, 16 nt, Human
cauuguagagcuucug

SEQ ID NO: 2609392 - RNA, 17 nt, Human
cauuguauauaugugug

SEQ ID NO: 2609393 - RNA, 16 nt, Human
cauuguauauaugugu

SEQ ID NO: 2609394 - RNA, 15 nt, Human
cauuguauauaugug

SEQ ID NO: 2609395 - RNA, 14 nt, Human
cauuguauauaugu

SEQ ID NO: 2609396 - RNA, 22 nt, Human
cauuguauaguuggaaucauau

SEQ ID NO: 2609397 - RNA, 16 nt, Human
cauuguauaaaaauag

SEQ ID NO: 2609398 - RNA, 15 nt, Human
cauuguauaaaaaua

SEQ ID NO: 2609399 - RNA, 20 nt, Human
cauugccauucccugccugg

SEQ ID NO: 2609400 - RNA, 19 nt, Human
cauugccauucccugccug

SEQ ID NO: 2609401 - RNA, 18 nt, Human
cauugccauucccugccu

SEQ ID NO: 2609402 - RNA, 17 nt, Human
cauugccauucccugcc

SEQ ID NO: 2609403 - RNA, 16 nt, Human
cauugccauucccugc

SEQ ID NO: 2609404 - RNA, 17 nt, Human
cauugccaccaggagaa

SEQ ID NO: 2609405 - RNA, 20 nt, Human
cauugccaccaggagaacca

SEQ ID NO: 2609406 - RNA, 15 nt, Human
cauugccauucccug

SEQ ID NO: 2609407 - RNA, 20 nt, Human
cauugccuauuucaguggca

SEQ ID NO: 2609408 - RNA, 13 nt, Human
cauugccuauuuc

SEQ ID NO: 2609409 - RNA, 18 nt, Human
cauugcccccagggcacu

SEQ ID NO: 2609410 - RNA, 17 nt, Human
cauugcccccagggcac

SEQ ID NO: 2609411 - RNA, 12 nt, Human
cauugcccuggu

SEQ ID NO: 2609412 - RNA, 18 nt, Human
cauugccuccuccuuccc

SEQ ID NO: 2609413 - RNA, 14 nt, Human
cauuguagaaaagc

SEQ ID NO: 2609414 - RNA, 15 nt, Human
cauuguagagcuucu

SEQ ID NO: 2609415 - RNA, 15 nt, Human
cacccaagggccugg

SEQ ID NO: 2609416 - RNA, 14 nt, Human
cacccaagggccug

SEQ ID NO: 2609417 - RNA, 15 nt, Human
cauugccaagggcuu

SEQ ID NO: 2609418 - RNA, 13 nt, Human
cauugccaccagg

SEQ ID NO: 2609419 - RNA, 14 nt, Human
cauugccaccagga

SEQ ID NO: 2609420 - RNA, 15 nt, Human
cauugccaccaggag

SEQ ID NO: 2609421 - RNA, 16 nt, Human
cauugccaccaggaga

SEQ ID NO: 2609422 - RNA, 17 nt, Human
cauuguuggccaaagcc

SEQ ID NO: 2609423 - RNA, 13 nt, Human
cauuguugagcua

SEQ ID NO: 2609424 - RNA, 20 nt, Human
cauuguugagcuauugcugu

SEQ ID NO: 2609425 - RNA, 16 nt, Human
cauuguugaggugguc

SEQ ID NO: 2609426 - RNA, 21 nt, Human
cauuguugagguggucugaau

SEQ ID NO: 2609427 - RNA, 13 nt, Human
cauugugcuucuu

SEQ ID NO: 2609428 - RNA, 17 nt, Human
cauuguggcacauucuu

SEQ ID NO: 2609429 - RNA, 17 nt, Human
cauugugcuucuuucuu

SEQ ID NO: 2609430 - RNA, 18 nt, Human
cauuguucaauuagaaua

SEQ ID NO: 2609431 - RNA, 16 nt, Human
cauuguggcuccuauc

SEQ ID NO: 2609432 - RNA, 13 nt, Human
cauuguggcuccu

SEQ ID NO: 2609433 - RNA, 19 nt, Human
cauuguggcugucagcagg

SEQ ID NO: 2609434 - RNA, 21 nt, Human
cauuguggcugucagcaggaa

SEQ ID NO: 2609435 - RNA, 18 nt, Human
cauuguuuagaaagaaua

SEQ ID NO: 2609436 - RNA, 18 nt, Human
cauuguugagguggucug

SEQ ID NO: 2609437 - RNA, 13 nt, Human
cauuguuggcagc

SEQ ID NO: 2609438 - RNA, 17 nt, Human
cauuguuuauuaacaaa

SEQ ID NO: 2609439 - RNA, 18 nt, Human
cauuguuggccaaagcca

SEQ ID NO: 2609440 - RNA, 20 nt, Human
cauuguuugaaacaaagaag

SEQ ID NO: 2609441 - RNA, 19 nt, Human
cauuguuugaaacaaagaa

SEQ ID NO: 2609442 - RNA, 18 nt, Human
cauuguuugaaacaaaga

SEQ ID NO: 2609443 - RNA, 14 nt, Human
cauuguuugaaaca

SEQ ID NO: 2609444 - RNA, 22 nt, Human
cauuguuugaaacaaagaaggu

SEQ ID NO: 2609445 - RNA, 21 nt, Human
cauuguuugaaacaaagaagg

SEQ ID NO: 2609446 - RNA, 14 nt, Human
cauuguuugcuuau

SEQ ID NO: 2609447 - RNA, 17 nt, Human
cauuguuugcuuauugu

SEQ ID NO: 2609448 - RNA, 18 nt, Human
cauuguuugcuuauuguu

SEQ ID NO: 2609449 - RNA, 19 nt, Human
cauuguuugcuuauuguuc

SEQ ID NO: 2609450 - RNA, 20 nt, Human
cauuguuugcuuauuguucc

SEQ ID NO: 2609451 - RNA, 17 nt, Human
cauuguuuggagacauu

SEQ ID NO: 2609452 - RNA, 15 nt, Human
cauuguuuggagaca

SEQ ID NO: 2609453 - RNA, 21 nt, Human
cauuguuugcuuauuguucca

SEQ ID NO: 2609454 - RNA, 22 nt, Human
cauuguuugcuuauuguuccaa

SEQ ID NO: 2609455 - RNA, 13 nt, Human
cauugucccucug

SEQ ID NO: 2609456 - RNA, 14 nt, Human
cauugucccucugc

SEQ ID NO: 2609457 - RNA, 15 nt, Human
cauugucccucugcc

SEQ ID NO: 2609458 - RNA, 18 nt, Human
cauugucccucugcccca

SEQ ID NO: 2609459 - RNA, 19 nt, Human
cauugucccucugccccau

SEQ ID NO: 2609460 - RNA, 21 nt, Human
cauugucccucugccccaucc

SEQ ID NO: 2609461 - RNA, 19 nt, Human
cauugucccugaagagaag

SEQ ID NO: 2609462 - RNA, 18 nt, Human
cauugugaacugacaggc

SEQ ID NO: 2609463 - RNA, 17 nt, Human
cauugugaacugacagg

SEQ ID NO: 2609464 - RNA, 15 nt, Human
cauugucuuguucug

SEQ ID NO: 2609465 - RNA, 13 nt, Human
cauugucuuguuc

SEQ ID NO: 2609466 - RNA, 23 nt, Human
cauugucuucggaaaccuuggug

SEQ ID NO: 2609467 - RNA, 13 nt, Human
cauugucuucgga

SEQ ID NO: 2609468 - RNA, 22 nt, Human
cauuguauggauaguaaaauuc

SEQ ID NO: 2609469 - RNA, 22 nt, Human
cauuguaugauguguugugaua

SEQ ID NO: 2609470 - RNA, 20 nt, Human
cauuguaugauguguuguga

SEQ ID NO: 2609471 - RNA, 18 nt, Human
cauuguaugauguguugu

SEQ ID NO: 2609472 - RNA, 17 nt, Human
cauuguaugauguguug

SEQ ID NO: 2609473 - RNA, 16 nt, Human
cauuguaugauguguu

SEQ ID NO: 2609474 - RNA, 22 nt, Human
cauuguaucgauguuauguaaa

SEQ ID NO: 2609475 - RNA, 22 nt, Human
cauuguauauauguguguuuaa

SEQ ID NO: 2609476 - RNA, 20 nt, Human
cauuguauauauguguguuu

SEQ ID NO: 2609477 - RNA, 16 nt, Human
cauuguaucgauguua

SEQ ID NO: 2609478 - RNA, 17 nt, Human
cauuguaucgauguuau

SEQ ID NO: 2609479 - RNA, 21 nt, Human
cauuguaucgauguuauguaa

SEQ ID NO: 2609480 - RNA, 15 nt, Human
cauuguaugaugugu

SEQ ID NO: 2609481 - RNA, 23 nt, Human
cauuguauucagaguugaugguu

SEQ ID NO: 2609482 - RNA, 21 nt, Human
cauuguccaauccuauguuuu

SEQ ID NO: 2609483 - RNA, 19 nt, Human
cauuguccaauccuauguu

SEQ ID NO: 2609484 - RNA, 12 nt, Human
ccaacccucauc

SEQ ID NO: 2609485 - RNA, 15 nt, Human
ccaagaagcccagga

SEQ ID NO: 2609486 - RNA, 15 nt, Human
ccaacccucagagcc

SEQ ID NO: 2609487 - RNA, 14 nt, Human
ccaacccucagagc

SEQ ID NO: 2609488 - RNA, 21 nt, Human
ccaaccccccagcacugagga

SEQ ID NO: 2609489 - RNA, 18 nt, Human
ccaaccccugaggaagau

SEQ ID NO: 2609490 - RNA, 12 nt, Human
ccaaccccugug

SEQ ID NO: 2609491 - RNA, 15 nt, Human
ccaacccgaggcccg

SEQ ID NO: 2609492 - RNA, 15 nt, Human
ccaaccccuguggag

SEQ ID NO: 2609493 - RNA, 17 nt, Human
ccaacccgaggcccgca

SEQ ID NO: 2609494 - RNA, 20 nt, Human
ccaaccccccagcacugagg

SEQ ID NO: 2609495 - RNA, 19 nt, Human
ccaaccccccagcacugag

SEQ ID NO: 2609496 - RNA, 18 nt, Human
ccaaccccccagcacuga

SEQ ID NO: 2609497 - RNA, 17 nt, Human
ccaaccccccagcacug

SEQ ID NO: 2609498 - RNA, 15 nt, Human
ccaaccccccagcac

SEQ ID NO: 2609499 - RNA, 14 nt, Human
ccaaccccccagca

SEQ ID NO: 2609500 - RNA, 13 nt, Human
ccaaccccccagc

SEQ ID NO: 2609501 - RNA, 18 nt, Human
ccaaccccccaccugcca

SEQ ID NO: 2609502 - RNA, 12 nt, Human
ccaagaaugcug

SEQ ID NO: 2609503 - RNA, 12 nt, Human
ccaagaaucuau

SEQ ID NO: 2609504 - RNA, 17 nt, Human
ccaagaaguuuaaggaa

SEQ ID NO: 2609505 - RNA, 20 nt, Human
ccaagaauagaugcugacug

SEQ ID NO: 2609506 - RNA, 19 nt, Human
ccaagacagaugccccaga

SEQ ID NO: 2609507 - RNA, 21 nt, Human
ccaagacagaugccccagagc

SEQ ID NO: 2609508 - RNA, 15 nt, Human
ccaagaaugcugaaa

SEQ ID NO: 2609509 - RNA, 14 nt, Human
ccaagaaugcugaa

SEQ ID NO: 2609510 - RNA, 13 nt, Human
ccaagaaugcuga

SEQ ID NO: 2609511 - RNA, 18 nt, Human
ccaagacagaugccccag

SEQ ID NO: 2609512 - RNA, 20 nt, Human
ccaagaagcccaggaaaggc

SEQ ID NO: 2609513 - RNA, 19 nt, Human
ccaagaagcccaggaaagg

SEQ ID NO: 2609514 - RNA, 13 nt, Human
ccaagaaguugga

SEQ ID NO: 2609515 - RNA, 22 nt, Human
ccaagaagggcuagaaccugga

SEQ ID NO: 2609516 - RNA, 13 nt, Human
ccaagaagggcua

SEQ ID NO: 2609517 - RNA, 19 nt, Human
ccaagaauagaugcugacu

SEQ ID NO: 2609518 - RNA, 12 nt, Human
ccaagaagggcu

SEQ ID NO: 2609519 - RNA, 20 nt, Human
ccaagacuugguguccuuuc

SEQ ID NO: 2609520 - RNA, 21 nt, Human
ccaagacuugguguccuuucc

SEQ ID NO: 2609521 - RNA, 20 nt, Human
ccaagacuuggcaacagaag

SEQ ID NO: 2609522 - RNA, 18 nt, Human
ccaagacuuggcaacaga

SEQ ID NO: 2609523 - RNA, 22 nt, Human
ccaagacuuggcaacagaagca

SEQ ID NO: 2609524 - RNA, 19 nt, Human
ccaagacuugguguccuuu

SEQ ID NO: 2609525 - RNA, 14 nt, Human
ccaagaggcugcag

SEQ ID NO: 2609526 - RNA, 15 nt, Human
ccaagaggcugcagc

SEQ ID NO: 2609527 - RNA, 22 nt, Human
ccaagacuugguguccuuuccc

SEQ ID NO: 2609528 - RNA, 20 nt, Human
ccaagagacaugcugacuuu

SEQ ID NO: 2609529 - RNA, 24 nt, Human
ccaagagacuccuugagagaccag

SEQ ID NO: 2609530 - RNA, 12 nt, Human
ccaagagagaaa

SEQ ID NO: 2609531 - RNA, 13 nt, Human
ccaagagagaaag

SEQ ID NO: 2609532 - RNA, 14 nt, Human
ccaagagagaaaga

SEQ ID NO: 2609533 - RNA, 16 nt, Human
ccaagaucgcgccacu

SEQ ID NO: 2609534 - RNA, 16 nt, Human
ccaagagucugaugau

SEQ ID NO: 2609535 - RNA, 19 nt, Human
ccaagaggguccuuuagua

SEQ ID NO: 2609536 - RNA, 21 nt, Human
ccaagaggcuguucccaccag

SEQ ID NO: 2609537 - RNA, 16 nt, Human
ccaagaggcugcagcc

SEQ ID NO: 2609538 - RNA, 15 nt, Human
ccaagagagaaagaa

SEQ ID NO: 2609539 - RNA, 22 nt, Human
ccaaacugacucuuaagaagac

SEQ ID NO: 2609540 - RNA, 19 nt, Human
ccaaagcagugcaugcugu

SEQ ID NO: 2609541 - RNA, 23 nt, Human
ccaaagcagugcaugcugucccu

SEQ ID NO: 2609542 - RNA, 19 nt, Human
ccaaagccaaagcuaggcc

SEQ ID NO: 2609543 - RNA, 17 nt, Human
ccaaagccuccuccagc

SEQ ID NO: 2609544 - RNA, 22 nt, Human
ccaaagccuccuccagccgcca

SEQ ID NO: 2609545 - RNA, 21 nt, Human
ccaaagccaauaacacacagc

SEQ ID NO: 2609546 - RNA, 20 nt, Human
ccaaagccaauaacacacag

SEQ ID NO: 2609547 - RNA, 14 nt, Human
ccaaagccaaugug

SEQ ID NO: 2609548 - RNA, 13 nt, Human
ccaaagccaccag

SEQ ID NO: 2609549 - RNA, 22 nt, Human
ccaaagccaccagacugacaaa

SEQ ID NO: 2609550 - RNA, 20 nt, Human
ccaaacucaccugccccuca

SEQ ID NO: 2609551 - RNA, 13 nt, Human
ccaaacagugaca

SEQ ID NO: 2609552 - RNA, 13 nt, Human
ccaaacucugcca

SEQ ID NO: 2609553 - RNA, 12 nt, Human
ccaaacugccua

SEQ ID NO: 2609554 - RNA, 15 nt, Human
ccaaagcuaggccug

SEQ ID NO: 2609555 - RNA, 17 nt, Human
ccaaagcgaauuuuaaa

SEQ ID NO: 2609556 - RNA, 15 nt, Human
ccaaagccagaacca

SEQ ID NO: 2609557 - RNA, 23 nt, Human
ccaaagccccuugcucuccccug

SEQ ID NO: 2609558 - RNA, 17 nt, Human
ccaaagcuaggccuggc

SEQ ID NO: 2609559 - RNA, 16 nt, Human
ccaaagcuaggccugg

SEQ ID NO: 2609560 - RNA, 21 nt, Human
ccaaagcuaggccuggccaga

SEQ ID NO: 2609561 - RNA, 18 nt, Human
ccaaagcuaggguggccc

SEQ ID NO: 2609562 - RNA, 19 nt, Human
ccaaagcuaggguggcccu

SEQ ID NO: 2609563 - RNA, 15 nt, Human
ccaaagcuuuccugc

SEQ ID NO: 2609564 - RNA, 14 nt, Human
ccaaagcuuuccug

SEQ ID NO: 2609565 - RNA, 13 nt, Human
ccaaagcuuuccu

SEQ ID NO: 2609566 - RNA, 16 nt, Human
ccaaagcuuucaugua

SEQ ID NO: 2609567 - RNA, 23 nt, Human
ccaaagcuaggguggcccuugca

SEQ ID NO: 2609568 - RNA, 15 nt, Human
ccaaagccagacagc

SEQ ID NO: 2609569 - RNA, 20 nt, Human
ccaaagcuuuccugccccag

SEQ ID NO: 2609570 - RNA, 19 nt, Human
ccaaagcuuuccugcccca

SEQ ID NO: 2609571 - RNA, 17 nt, Human
ccaaagcuuuccugccc

SEQ ID NO: 2609572 - RNA, 16 nt, Human
ccaaagcuuuccugcc

SEQ ID NO: 2609573 - RNA, 15 nt, Human
ccaaaggaagcacau

SEQ ID NO: 2609574 - RNA, 23 nt, Human
ccaaaggaagcacaugccucucu

SEQ ID NO: 2609575 - RNA, 23 nt, Human
ccaaaggaaaaagcacaagaagc

SEQ ID NO: 2609576 - RNA, 18 nt, Human
ccaaaggaagucuaggag

SEQ ID NO: 2609577 - RNA, 22 nt, Human
ccaaaggaaaaagcacaagaag

SEQ ID NO: 2609578 - RNA, 17 nt, Human
ccaaaggaaaaagcaca

SEQ ID NO: 2609579 - RNA, 12 nt, Human
ccaaaggaaaaa

SEQ ID NO: 2609580 - RNA, 21 nt, Human
ccaaagcuguuggucuguccc

SEQ ID NO: 2609581 - RNA, 20 nt, Human
ccaaaggccauggagagcug

SEQ ID NO: 2609582 - RNA, 19 nt, Human
ccaaaggccauggagagcu

SEQ ID NO: 2609583 - RNA, 22 nt, Human
ccaaaggcauuuuauugcuuga

SEQ ID NO: 2609584 - RNA, 21 nt, Human
ccaaaggacuccacccauccu

SEQ ID NO: 2609585 - RNA, 19 nt, Human
ccaaaggaugugauauaua

SEQ ID NO: 2609586 - RNA, 16 nt, Human
ccaaaggaugugauau

SEQ ID NO: 2609587 - RNA, 16 nt, Human
ccaaaggcucucuccu

SEQ ID NO: 2609588 - RNA, 17 nt, Human
ccaaaggacuccaccca

SEQ ID NO: 2609589 - RNA, 12 nt, Human
ccaaaggaggcu

SEQ ID NO: 2609590 - RNA, 15 nt, Human
ccaaaggaggcuggc

SEQ ID NO: 2609591 - RNA, 16 nt, Human
ccaaaggaggcuggca

SEQ ID NO: 2609592 - RNA, 17 nt, Human
ccaaaggaggcuggcag

SEQ ID NO: 2609593 - RNA, 18 nt, Human
ccaaaggaggcuggcagg

SEQ ID NO: 2609594 - RNA, 12 nt, Human
ccaacccagccg

SEQ ID NO: 2609595 - RNA, 21 nt, Human
ccaacccagccgcugcccggc

SEQ ID NO: 2609596 - RNA, 19 nt, Human
ccaacccagccgcugcccg

SEQ ID NO: 2609597 - RNA, 16 nt, Human
ccaacccagccgcugc

SEQ ID NO: 2609598 - RNA, 13 nt, Human
ccaacccagccgc

SEQ ID NO: 2609599 - RNA, 13 nt, Human
ccaaccccagccg

SEQ ID NO: 2609600 - RNA, 14 nt, Human
ccaaccccaacucc

SEQ ID NO: 2609601 - RNA, 12 nt, Human
ccaacccaucag

SEQ ID NO: 2609602 - RNA, 14 nt, Human
ccaacccaucagaa

SEQ ID NO: 2609603 - RNA, 13 nt, Human
ccaacccccaccc

SEQ ID NO: 2609604 - RNA, 16 nt, Human
ccaacccccaccccac

SEQ ID NO: 2609605 - RNA, 17 nt, Human
ccaacccccaccccaca

SEQ ID NO: 2609606 - RNA, 18 nt, Human
ccaacccccaccccacac

SEQ ID NO: 2609607 - RNA, 21 nt, Human
ccaacccccagcacccgggcu

SEQ ID NO: 2609608 - RNA, 15 nt, Human
ccaacccccagcacc

SEQ ID NO: 2609609 - RNA, 14 nt, Human
ccaacccccagcac

SEQ ID NO: 2609610 - RNA, 13 nt, Human
ccaacccccagca

SEQ ID NO: 2609611 - RNA, 19 nt, Human
ccaacccccaccccacacu

SEQ ID NO: 2609612 - RNA, 20 nt, Human
ccaacccccaccccacacuu

SEQ ID NO: 2609613 - RNA, 22 nt, Human
ccaacauacucccaucugugaa

SEQ ID NO: 2609614 - RNA, 21 nt, Human
ccaacauacucccaucuguga

SEQ ID NO: 2609615 - RNA, 15 nt, Human
ccaacagguggcagg

SEQ ID NO: 2609616 - RNA, 14 nt, Human
ccaacagguggcag

SEQ ID NO: 2609617 - RNA, 20 nt, Human
ccaacauugccuauuucagu

SEQ ID NO: 2609618 - RNA, 20 nt, Human
ccaaccaaguggcucccaca

SEQ ID NO: 2609619 - RNA, 20 nt, Human
ccaacaggaggacaauucau

SEQ ID NO: 2609620 - RNA, 19 nt, Human
ccaacaggaggacaauuca

SEQ ID NO: 2609621 - RNA, 13 nt, Human
ccaacaucaacau

SEQ ID NO: 2609622 - RNA, 20 nt, Human
ccaacauacucccaucugug

SEQ ID NO: 2609623 - RNA, 19 nt, Human
ccaacauacucccaucugu

SEQ ID NO: 2609624 - RNA, 18 nt, Human
ccaacauacucccaucug

SEQ ID NO: 2609625 - RNA, 17 nt, Human
ccaacauacucccaucu

SEQ ID NO: 2609626 - RNA, 23 nt, Human
ccaacagcgacauagcccauccc

SEQ ID NO: 2609627 - RNA, 22 nt, Human
ccaacagcgacauagcccaucc

SEQ ID NO: 2609628 - RNA, 19 nt, Human
ccaacacugugcccuggug

SEQ ID NO: 2609629 - RNA, 18 nt, Human
ccaacacugugcccuggu

SEQ ID NO: 2609630 - RNA, 19 nt, Human
ccaacagaagaacuguguu

SEQ ID NO: 2609631 - RNA, 22 nt, Human
ccaacagaugcuuuucugucuc

SEQ ID NO: 2609632 - RNA, 17 nt, Human
ccaacagaugcuuuucu

SEQ ID NO: 2609633 - RNA, 16 nt, Human
ccaacauacucccauc

SEQ ID NO: 2609634 - RNA, 18 nt, Human
ccaacaggaggacaauuc

SEQ ID NO: 2609635 - RNA, 17 nt, Human
ccaacaggaggacaauu

SEQ ID NO: 2609636 - RNA, 16 nt, Human
ccaacaggaggacaau

SEQ ID NO: 2609637 - RNA, 15 nt, Human
ccaacaggaggacaa

SEQ ID NO: 2609638 - RNA, 15 nt, Human
ccaacaggagcuggg

SEQ ID NO: 2609639 - RNA, 23 nt, Human
ccaacaggagcugggauccuaag

SEQ ID NO: 2609640 - RNA, 15 nt, Human
ccaaaguacacuguu

SEQ ID NO: 2609641 - RNA, 18 nt, Human
ccaaaguacacuguuuca

SEQ ID NO: 2609642 - RNA, 12 nt, Human
ccaaaggccccc

SEQ ID NO: 2609643 - RNA, 21 nt, Human
ccaaaggccauggagagcugg

SEQ ID NO: 2609644 - RNA, 14 nt, Human
ccaaaggcccccua

SEQ ID NO: 2609645 - RNA, 21 nt, Human
ccaaagggugaagcuauuuau

SEQ ID NO: 2609646 - RNA, 20 nt, Human
ccaaaggugaaggaauauau

SEQ ID NO: 2609647 - RNA, 15 nt, Human
ccaaaggugaaggaa

SEQ ID NO: 2609648 - RNA, 23 nt, Human
ccaaagggugaagcuauuuaucu

SEQ ID NO: 2609649 - RNA, 23 nt, Human
ccaaauuucauaccuaucaucuu

SEQ ID NO: 2609650 - RNA, 20 nt, Human
ccaaaguacacuguuucaaa

SEQ ID NO: 2609651 - RNA, 13 nt, Human
ccaacaaagcugu

SEQ ID NO: 2609652 - RNA, 12 nt, Human
ccaacaaagcug

SEQ ID NO: 2609653 - RNA, 19 nt, Human
ccaacaaagaacacuaacu

SEQ ID NO: 2609654 - RNA, 20 nt, Human
ccaaauuugauugauuugaa

SEQ ID NO: 2609655 - RNA, 21 nt, Human
ccaaauuuuggccaaaguguu

SEQ ID NO: 2609656 - RNA, 22 nt, Human
ccaaaggugaaggaauauaugg

SEQ ID NO: 2609657 - RNA, 15 nt, Human
ccaaauuugauugau

SEQ ID NO: 2609658 - RNA, 17 nt, Human
ccaaauuuucuuuuuau

SEQ ID NO: 2609659 - RNA, 13 nt, Human
ccaacaccaagca

SEQ ID NO: 2609660 - RNA, 16 nt, Human
ccaacaccaagcacag

SEQ ID NO: 2609661 - RNA, 17 nt, Human
ccaacaccaagcacagc

SEQ ID NO: 2609662 - RNA, 19 nt, Human
ccaacaccaagcacagcag

SEQ ID NO: 2609663 - RNA, 17 nt, Human
ccaacaccacagacaca

SEQ ID NO: 2609664 - RNA, 16 nt, Human
ccaacaccacagacac

SEQ ID NO: 2609665 - RNA, 15 nt, Human
ccaacaccacagaca

SEQ ID NO: 2609666 - RNA, 14 nt, Human
ccaacaccacagac

SEQ ID NO: 2609667 - RNA, 22 nt, Human
ccaacaccaagcacagcagccu

SEQ ID NO: 2609668 - RNA, 23 nt, Human
ccaacaccaagcacagcagccug

SEQ ID NO: 2609669 - RNA, 21 nt, Human
ccaacaaaggguuuuaaugua

SEQ ID NO: 2609670 - RNA, 14 nt, Human
ccaacaaagcuguu

SEQ ID NO: 2609671 - RNA, 22 nt, Human
ccaacaaaggguuuuaauguag

SEQ ID NO: 2609672 - RNA, 22 nt, Human
ccaacaauccuagugcuuuccu

SEQ ID NO: 2609673 - RNA, 17 nt, Human
ccaacacugugcccugg

SEQ ID NO: 2609674 - RNA, 16 nt, Human
ccaacacugugcccug

SEQ ID NO: 2609675 - RNA, 15 nt, Human
ccaacacugugcccu

SEQ ID NO: 2609676 - RNA, 14 nt, Human
ccaacacugugccc

SEQ ID NO: 2609677 - RNA, 13 nt, Human
ccaacaccagccc

SEQ ID NO: 2609678 - RNA, 23 nt, Human
ccaacaccacagacacacacacg

SEQ ID NO: 2609679 - RNA, 21 nt, Human
ccaacaccacagacacacaca

SEQ ID NO: 2609680 - RNA, 18 nt, Human
ccaacaccacagacacac

SEQ ID NO: 2609681 - RNA, 20 nt, Human
ccaacacgcaccugccucag

SEQ ID NO: 2609682 - RNA, 21 nt, Human
ccaacacgcaccugccucagg

SEQ ID NO: 2609683 - RNA, 21 nt, Human
ccaacacucaagaagcaggcu

SEQ ID NO: 2609684 - RNA, 17 nt, Human
ccaacacgcaccugccu

SEQ ID NO: 2609685 - RNA, 14 nt, Human
ccaacacucaagaa

SEQ ID NO: 2609686 - RNA, 22 nt, Human
ccaagcacugugcucagggcua

SEQ ID NO: 2609687 - RNA, 21 nt, Human
ccaagcacugugcucagggcu

SEQ ID NO: 2609688 - RNA, 14 nt, Human
ccaagcacugugcu

SEQ ID NO: 2609689 - RNA, 13 nt, Human
ccaagcacagcag

SEQ ID NO: 2609690 - RNA, 14 nt, Human
ccaagcacagcagc

SEQ ID NO: 2609691 - RNA, 15 nt, Human
ccaagcacagcagcc

SEQ ID NO: 2609692 - RNA, 17 nt, Human
ccaagcacagcagccug

SEQ ID NO: 2609693 - RNA, 23 nt, Human
ccaagcacagugguggcagggcc

SEQ ID NO: 2609694 - RNA, 22 nt, Human
ccaagcacagugguggcagggc

SEQ ID NO: 2609695 - RNA, 21 nt, Human
ccaagcacagugguggcaggg

SEQ ID NO: 2609696 - RNA, 20 nt, Human
ccaagcacagugguggcagg

SEQ ID NO: 2609697 - RNA, 19 nt, Human
ccaagcacagugguggcag

SEQ ID NO: 2609698 - RNA, 16 nt, Human
ccaagcacaguggugg

SEQ ID NO: 2609699 - RNA, 18 nt, Human
ccaagcacagcagccugg

SEQ ID NO: 2609700 - RNA, 21 nt, Human
ccaagauucacaccugacucu

SEQ ID NO: 2609701 - RNA, 17 nt, Human
ccaagcaaaaucaugga

SEQ ID NO: 2609702 - RNA, 21 nt, Human
ccaagauugcgccauugcacu

SEQ ID NO: 2609703 - RNA, 14 nt, Human
ccaagcaaguauua

SEQ ID NO: 2609704 - RNA, 23 nt, Human
ccaagcaaccuggguccaaauaa

SEQ ID NO: 2609705 - RNA, 18 nt, Human
ccaagcaaccugggucca

SEQ ID NO: 2609706 - RNA, 20 nt, Human
ccaagcaaaggugaagagac

SEQ ID NO: 2609707 - RNA, 17 nt, Human
ccaagcaaccugggucc

SEQ ID NO: 2609708 - RNA, 12 nt, Human
ccaagcacagca

SEQ ID NO: 2609709 - RNA, 20 nt, Human
ccaaguccugaagaggcggg

SEQ ID NO: 2609710 - RNA, 19 nt, Human
ccaaguccugaagaggcgg

SEQ ID NO: 2609711 - RNA, 16 nt, Human
ccaaguccugaagagg

SEQ ID NO: 2609712 - RNA, 23 nt, Human
ccaagucccuguuuucugagccc

SEQ ID NO: 2609713 - RNA, 22 nt, Human
ccaagucccuguuuucugagcc

SEQ ID NO: 2609714 - RNA, 15 nt, Human
ccaaguccugaagag

SEQ ID NO: 2609715 - RNA, 15 nt, Human
ccaagucccuguuuu

SEQ ID NO: 2609716 - RNA, 13 nt, Human
ccaagucccuguu

SEQ ID NO: 2609717 - RNA, 12 nt, Human
ccaagucccugu

SEQ ID NO: 2609718 - RNA, 22 nt, Human
ccaaguugauuuaguguuuuua

SEQ ID NO: 2609719 - RNA, 17 nt, Human
ccaaguuuacucaaccc

SEQ ID NO: 2609720 - RNA, 22 nt, Human
ccaaguuguggugcugacaaag

SEQ ID NO: 2609721 - RNA, 18 nt, Human
ccaaguuguggugcugac

SEQ ID NO: 2609722 - RNA, 22 nt, Human
ccaaguuauaaaucaaugucac

SEQ ID NO: 2609723 - RNA, 14 nt, Human
ccaagucucagugg

SEQ ID NO: 2609724 - RNA, 17 nt, Human
ccaagucuacagaguga

SEQ ID NO: 2609725 - RNA, 14 nt, Human
ccaagucuacagag

SEQ ID NO: 2609726 - RNA, 15 nt, Human
ccaaguucucaccuc

SEQ ID NO: 2609727 - RNA, 19 nt, Human
ccaaguuccgucaguccaa

SEQ ID NO: 2609728 - RNA, 21 nt, Human
ccaaguuuacucaacccucuc

SEQ ID NO: 2609729 - RNA, 14 nt, Human
ccaaguuuauauac

SEQ ID NO: 2609730 - RNA, 23 nt, Human
ccaauaaaagcaauuccaaccuu

SEQ ID NO: 2609731 - RNA, 22 nt, Human
ccaauaaaagcaauuccaaccu

SEQ ID NO: 2609732 - RNA, 13 nt, Human
ccaauaaacagga

SEQ ID NO: 2609733 - RNA, 13 nt, Human
ccaauaaaccagg

SEQ ID NO: 2609734 - RNA, 16 nt, Human
ccaauaacacacagcu

SEQ ID NO: 2609735 - RNA, 14 nt, Human
ccaauaaaccaggu

SEQ ID NO: 2609736 - RNA, 22 nt, Human
ccaauaaaugugaaauucuguc

SEQ ID NO: 2609737 - RNA, 14 nt, Human
ccaauaacacacag

SEQ ID NO: 2609738 - RNA, 18 nt, Human
ccaauagauuccccauug

SEQ ID NO: 2609739 - RNA, 22 nt, Human
ccaauaguuguugauuggcagg

SEQ ID NO: 2609740 - RNA, 18 nt, Human
ccaauagggcugagcucu

SEQ ID NO: 2609741 - RNA, 20 nt, Human
ccaagucaagugaaaaagga

SEQ ID NO: 2609742 - RNA, 14 nt, Human
ccaaguauuuauua

SEQ ID NO: 2609743 - RNA, 20 nt, Human
ccaagucagcuuugccuucc

SEQ ID NO: 2609744 - RNA, 13 nt, Human
ccaaguccagauu

SEQ ID NO: 2609745 - RNA, 23 nt, Human
ccaaguccaaauguuuacaggga

SEQ ID NO: 2609746 - RNA, 14 nt, Human
ccaaguccaaaugu

SEQ ID NO: 2609747 - RNA, 21 nt, Human
ccaagucagcuuugccuucca

SEQ ID NO: 2609748 - RNA, 20 nt, Human
ccaaguagcugggauuacag

SEQ ID NO: 2609749 - RNA, 16 nt, Human
ccaagguggcacggug

SEQ ID NO: 2609750 - RNA, 21 nt, Human
ccaagguuuuauaaggcugau

SEQ ID NO: 2609751 - RNA, 20 nt, Human
ccaagguuuuauaaggcuga

SEQ ID NO: 2609752 - RNA, 15 nt, Human
ccaagguggcacggu

SEQ ID NO: 2609753 - RNA, 19 nt, Human
ccaaggucuucagccauca

SEQ ID NO: 2609754 - RNA, 19 nt, Human
ccaagguuuuauaaggcug

SEQ ID NO: 2609755 - RNA, 23 nt, Human
ccaagguuuggggaagaacgaag

SEQ ID NO: 2609756 - RNA, 17 nt, Human
ccaaggucuucagccau

SEQ ID NO: 2609757 - RNA, 18 nt, Human
ccaaggggugggccacag

SEQ ID NO: 2609758 - RNA, 18 nt, Human
ccaaggugggaggauugc

SEQ ID NO: 2609759 - RNA, 13 nt, Human
ccaaggugggagg

SEQ ID NO: 2609760 - RNA, 18 nt, Human
ccaagggccuggccugag

SEQ ID NO: 2609761 - RNA, 16 nt, Human
ccaagggccuggccug

SEQ ID NO: 2609762 - RNA, 23 nt, Human
ccaagggcuucugcacccuccac

SEQ ID NO: 2609763 - RNA, 22 nt, Human
ccaagggcuucugcacccucca

SEQ ID NO: 2609764 - RNA, 21 nt, Human
ccaagggcuucugcacccucc

SEQ ID NO: 2609765 - RNA, 20 nt, Human
ccaagggcuucugcacccuc

SEQ ID NO: 2609766 - RNA, 19 nt, Human
ccaagggcuucugcacccu

SEQ ID NO: 2609767 - RNA, 17 nt, Human
ccaagggcuucugcacc

SEQ ID NO: 2609768 - RNA, 14 nt, Human
ccaagggcuucugc

SEQ ID NO: 2609769 - RNA, 19 nt, Human
ccaagggccuggccugagc

SEQ ID NO: 2609770 - RNA, 20 nt, Human
ccaaggguucagagacucag

SEQ ID NO: 2609771 - RNA, 23 nt, Human
ccaaggguucagagacucagggc

SEQ ID NO: 2609772 - RNA, 20 nt, Human
ccaaggggcagucuggaggg

SEQ ID NO: 2609773 - RNA, 22 nt, Human
ccaaggggaauguuugccucug

SEQ ID NO: 2609774 - RNA, 21 nt, Human
ccaagggcuuuguuuugcaca

SEQ ID NO: 2609775 - RNA, 19 nt, Human
ccaaggggaaucagaacuc

SEQ ID NO: 2609776 - RNA, 15 nt, Human
ccaaggggcagucug

SEQ ID NO: 2609777 - RNA, 16 nt, Human
ccaaggggcagucugg

SEQ ID NO: 2609778 - RNA, 22 nt, Human
ccaagggcaaaauucccaggga

SEQ ID NO: 2609779 - RNA, 20 nt, Human
ccaagggaugaaagagaagg

SEQ ID NO: 2609780 - RNA, 18 nt, Human
ccaagggcaaaauuccca

SEQ ID NO: 2609781 - RNA, 24 nt, Human
ccaagggcaaaauucccagggaag

SEQ ID NO: 2609782 - RNA, 15 nt, Human
ccaagggccuggccu

SEQ ID NO: 2609783 - RNA, 19 nt, Human
ccaagggaaccuguguccg

SEQ ID NO: 2609784 - RNA, 18 nt, Human
ccaagggaaccugugucc

SEQ ID NO: 2609785 - RNA, 17 nt, Human
ccaagggaaccuguguc

SEQ ID NO: 2609786 - RNA, 16 nt, Human
ccaagggaaccugugu

SEQ ID NO: 2609787 - RNA, 13 nt, Human
ccaagggaucugg

SEQ ID NO: 2609788 - RNA, 19 nt, Human
ccaagggaugaaagagaag

SEQ ID NO: 2609789 - RNA, 21 nt, Human
ccaagggaucugguccuaccc

SEQ ID NO: 2609790 - RNA, 24 nt, Human
ccaagggaguuaggcuauucacaa

SEQ ID NO: 2609791 - RNA, 21 nt, Human
ccaaggccaaaggaagcacau

SEQ ID NO: 2609792 - RNA, 18 nt, Human
ccaaggccaaaggaagca

SEQ ID NO: 2609793 - RNA, 22 nt, Human
ccaagggaaaggggugcuuuua

SEQ ID NO: 2609794 - RNA, 21 nt, Human
ccaagggaaaggggugcuuuu

SEQ ID NO: 2609795 - RNA, 17 nt, Human
ccaagggaaaggggugc

SEQ ID NO: 2609796 - RNA, 21 nt, Human
ccaagggaaagaaaaggaagg

SEQ ID NO: 2609797 - RNA, 19 nt, Human
ccaaggccagaguggccug

SEQ ID NO: 2609798 - RNA, 12 nt, Human
ccaagcucagaa

SEQ ID NO: 2609799 - RNA, 19 nt, Human
ccaagcucacaguuccucg

SEQ ID NO: 2609800 - RNA, 22 nt, Human
ccaagcucacaguuccucgccc

SEQ ID NO: 2609801 - RNA, 15 nt, Human
ccaaggccagagugg

SEQ ID NO: 2609802 - RNA, 18 nt, Human
ccaaggccagaguggccu

SEQ ID NO: 2609803 - RNA, 23 nt, Human
ccaagcauuuaauguagccaugg

SEQ ID NO: 2609804 - RNA, 23 nt, Human
ccaagcaucuuggggggguggcc

SEQ ID NO: 2609805 - RNA, 22 nt, Human
ccaagcaucuuggggggguggc

SEQ ID NO: 2609806 - RNA, 13 nt, Human
ccaagcaucuugg

SEQ ID NO: 2609807 - RNA, 17 nt, Human
ccaagcauuuagaugua

SEQ ID NO: 2609808 - RNA, 22 nt, Human
ccaagcauaccaacacgagcag

SEQ ID NO: 2609809 - RNA, 13 nt, Human
ccaagcagggagg

SEQ ID NO: 2609810 - RNA, 17 nt, Human
ccaaggccaaaggaagc

SEQ ID NO: 2609811 - RNA, 22 nt, Human
ccaagcucccaggcauucccca

SEQ ID NO: 2609812 - RNA, 16 nt, Human
ccaagcucccaggcau

SEQ ID NO: 2609813 - RNA, 15 nt, Human
ccaagcucccaggca

SEQ ID NO: 2609814 - RNA, 17 nt, Human
ccaagcuagaauucccu

SEQ ID NO: 2609815 - RNA, 15 nt, Human
ccaagcuagaauucc

SEQ ID NO: 2609816 - RNA, 21 nt, Human
ccaagcgaggucaacagagaa

SEQ ID NO: 2609817 - RNA, 14 nt, Human
ccaagcucccaggc

SEQ ID NO: 2609818 - RNA, 17 nt, Human
ccaagcucaaagcgugg

SEQ ID NO: 2609819 - RNA, 22 nt, Human
ccaagcuagaauucccucucuc

SEQ ID NO: 2609820 - RNA, 16 nt, Human
ccaagcuauccuggcu

SEQ ID NO: 2609821 - RNA, 18 nt, Human
ccaagcucaaagcgugga

SEQ ID NO: 2609822 - RNA, 13 nt, Human
ccaagcucacagu

SEQ ID NO: 2609823 - RNA, 17 nt, Human
ccaagcucacaguuccu

SEQ ID NO: 2609824 - RNA, 18 nt, Human
ccaagcucacaguuccuc

SEQ ID NO: 2609825 - RNA, 15 nt, Human
ccaagccuggcaagg

SEQ ID NO: 2609826 - RNA, 14 nt, Human
ccaagccugcaacu

SEQ ID NO: 2609827 - RNA, 13 nt, Human
ccaagccugacca

SEQ ID NO: 2609828 - RNA, 19 nt, Human
ccaagccuggucagcccaa

SEQ ID NO: 2609829 - RNA, 20 nt, Human
ccaagccuggucagcccaaa

SEQ ID NO: 2609830 - RNA, 19 nt, Human
ccaagccuuggcucuaccc

SEQ ID NO: 2609831 - RNA, 22 nt, Human
ccaagccuuggggauucuucca

SEQ ID NO: 2609832 - RNA, 20 nt, Human
ccaagcgaggucaacagaga

SEQ ID NO: 2609833 - RNA, 22 nt, Human
ccaagccuacuuuugccauuga

SEQ ID NO: 2609834 - RNA, 13 nt, Human
ccaagccguggcu

SEQ ID NO: 2609835 - RNA, 23 nt, Human
ccaagcccuggagccaacugcug

SEQ ID NO: 2609836 - RNA, 22 nt, Human
ccaagcccgacuugcuguuuug

SEQ ID NO: 2609837 - RNA, 18 nt, Human
ccaagcccgacuugcugu

SEQ ID NO: 2609838 - RNA, 17 nt, Human
ccaagcccgacuugcug

SEQ ID NO: 2609839 - RNA, 23 nt, Human
ccaagccaagggaaccugugucc

SEQ ID NO: 2609840 - RNA, 22 nt, Human
ccaagccaagggaaccuguguc

SEQ ID NO: 2609841 - RNA, 20 nt, Human
ccaagccaagggaaccugug

SEQ ID NO: 2609842 - RNA, 18 nt, Human
ccaagccaagggaaccug

SEQ ID NO: 2609843 - RNA, 19 nt, Human
ccaagccagaggcuggguu

SEQ ID NO: 2609844 - RNA, 17 nt, Human
ccaagccagaggcuggg

SEQ ID NO: 2609845 - RNA, 16 nt, Human
ccaagccagaggcugg

SEQ ID NO: 2609846 - RNA, 17 nt, Human
ccacccccacccaaggg

SEQ ID NO: 2609847 - RNA, 16 nt, Human
ccaccauuccuggaaa

SEQ ID NO: 2609848 - RNA, 15 nt, Human
ccaccauuccuggaa

SEQ ID NO: 2609849 - RNA, 21 nt, Human
ccaccauuccuggaaaccaca

SEQ ID NO: 2609850 - RNA, 19 nt, Human
ccaccaugggguccuacca

SEQ ID NO: 2609851 - RNA, 17 nt, Human
ccaccaugcccagucga

SEQ ID NO: 2609852 - RNA, 14 nt, Human
ccaccaugucugcc

SEQ ID NO: 2609853 - RNA, 14 nt, Human
ccaccauuccugga

SEQ ID NO: 2609854 - RNA, 17 nt, Human
ccaccaugucugcccca

SEQ ID NO: 2609855 - RNA, 21 nt, Human
ccacccaggagccccgaggcc

SEQ ID NO: 2609856 - RNA, 14 nt, Human
ccacccaagcuugg

SEQ ID NO: 2609857 - RNA, 12 nt, Human
ccacccaggagg

SEQ ID NO: 2609858 - RNA, 15 nt, Human
ccacccaagcuuggc

SEQ ID NO: 2609859 - RNA, 14 nt, Human
ccacccaggaggga

SEQ ID NO: 2609860 - RNA, 23 nt, Human
ccacccaggagccccgaggccuu

SEQ ID NO: 2609861 - RNA, 17 nt, Human
ccacccaucgcugugug

SEQ ID NO: 2609862 - RNA, 14 nt, Human
ccacccaucgcugu

SEQ ID NO: 2609863 - RNA, 12 nt, Human
ccaccccaacau

SEQ ID NO: 2609864 - RNA, 21 nt, Human
ccacccauccuaccaaugcau

SEQ ID NO: 2609865 - RNA, 23 nt, Human
ccacccaggagggagggggcuau

SEQ ID NO: 2609866 - RNA, 17 nt, Human
ccacccaggagggaggg

SEQ ID NO: 2609867 - RNA, 18 nt, Human
ccacccaggagggagggg

SEQ ID NO: 2609868 - RNA, 16 nt, Human
ccaauauucauagcag

SEQ ID NO: 2609869 - RNA, 16 nt, Human
ccacaggacauuucuc

SEQ ID NO: 2609870 - RNA, 21 nt, Human
ccacaggacauuucucuaaga

SEQ ID NO: 2609871 - RNA, 23 nt, Human
ccacaggaagccugcaguccugg

SEQ ID NO: 2609872 - RNA, 17 nt, Human
ccacaggaagugaagaa

SEQ ID NO: 2609873 - RNA, 16 nt, Human
ccacaggacacaguca

SEQ ID NO: 2609874 - RNA, 16 nt, Human
ccacaggaucagucug

SEQ ID NO: 2609875 - RNA, 20 nt, Human
ccacaggagugggaaaacac

SEQ ID NO: 2609876 - RNA, 17 nt, Human
ccacaggacacagucag

SEQ ID NO: 2609877 - RNA, 13 nt, Human
ccacaggcagcuu

SEQ ID NO: 2609878 - RNA, 12 nt, Human
ccacaggcagcu

SEQ ID NO: 2609879 - RNA, 14 nt, Human
ccacaggcagcuuu

SEQ ID NO: 2609880 - RNA, 16 nt, Human
ccacaggcccuuccuc

SEQ ID NO: 2609881 - RNA, 15 nt, Human
ccacaggcccuuccu

SEQ ID NO: 2609882 - RNA, 22 nt, Human
ccacaggcccuuccucuccacu

SEQ ID NO: 2609883 - RNA, 19 nt, Human
ccacaggcccuuccucucc

SEQ ID NO: 2609884 - RNA, 18 nt, Human
ccacaggcccuuccucuc

SEQ ID NO: 2609885 - RNA, 17 nt, Human
ccacaggcccuuccucu

SEQ ID NO: 2609886 - RNA, 22 nt, Human
ccacaggcccuuuccucaggca

SEQ ID NO: 2609887 - RNA, 21 nt, Human
ccacaggcccuuuccucaggc

SEQ ID NO: 2609888 - RNA, 16 nt, Human
ccacaggccgcccugc

SEQ ID NO: 2609889 - RNA, 12 nt, Human
ccacaggccucc

SEQ ID NO: 2609890 - RNA, 23 nt, Human
ccacaggcccuuuccucaggcaa

SEQ ID NO: 2609891 - RNA, 17 nt, Human
ccacaggccgcccugcg

SEQ ID NO: 2609892 - RNA, 16 nt, Human
ccacaggcccacagua

SEQ ID NO: 2609893 - RNA, 19 nt, Human
ccacaggcccuuuccucag

SEQ ID NO: 2609894 - RNA, 23 nt, Human
ccacaggcccuuccucuccacug

SEQ ID NO: 2609895 - RNA, 22 nt, Human
ccacaggaagccugcaguccug

SEQ ID NO: 2609896 - RNA, 19 nt, Human
ccacaggaagccugcaguc

SEQ ID NO: 2609897 - RNA, 22 nt, Human
ccacagcuuuuuaccaaguuuc

SEQ ID NO: 2609898 - RNA, 20 nt, Human
ccacaggaaccacaagacug

SEQ ID NO: 2609899 - RNA, 14 nt, Human
ccacacucagcaca

SEQ ID NO: 2609900 - RNA, 14 nt, Human
ccacagcugcucaa

SEQ ID NO: 2609901 - RNA, 12 nt, Human
ccacacuccagc

SEQ ID NO: 2609902 - RNA, 14 nt, Human
ccacagcugcugga

SEQ ID NO: 2609903 - RNA, 13 nt, Human
ccacagcugcugg

SEQ ID NO: 2609904 - RNA, 12 nt, Human
ccacagcugcug

SEQ ID NO: 2609905 - RNA, 16 nt, Human
ccacagcugcuggaga

SEQ ID NO: 2609906 - RNA, 17 nt, Human
ccacagcuuccccucuc

SEQ ID NO: 2609907 - RNA, 22 nt, Human
ccacacguaaugaaacuuggau

SEQ ID NO: 2609908 - RNA, 19 nt, Human
ccacaccuggcacugcugu

SEQ ID NO: 2609909 - RNA, 18 nt, Human
ccacaccuggcacugcug

SEQ ID NO: 2609910 - RNA, 16 nt, Human
ccacacccuguacugu

SEQ ID NO: 2609911 - RNA, 21 nt, Human
ccacacccucccccgccacuc

SEQ ID NO: 2609912 - RNA, 15 nt, Human
ccacacccucuccca

SEQ ID NO: 2609913 - RNA, 19 nt, Human
ccacacccuguacuguucu

SEQ ID NO: 2609914 - RNA, 14 nt, Human
ccacaccuggcacu

SEQ ID NO: 2609915 - RNA, 17 nt, Human
ccacaccuggcacugcu

SEQ ID NO: 2609916 - RNA, 18 nt, Human
ccacacccucucccagga

SEQ ID NO: 2609917 - RNA, 17 nt, Human
ccacacucacuccugag

SEQ ID NO: 2609918 - RNA, 20 nt, Human
ccacacuauuaccaugagaa

SEQ ID NO: 2609919 - RNA, 18 nt, Human
ccacacuauuaccaugag

SEQ ID NO: 2609920 - RNA, 17 nt, Human
ccacacuauuaccauga

SEQ ID NO: 2609921 - RNA, 24 nt, Human
ccacacucacuccugagaccccug

SEQ ID NO: 2609922 - RNA, 19 nt, Human
ccacacgcuccucccucug

SEQ ID NO: 2609923 - RNA, 16 nt, Human
ccacacuaaccugggu

SEQ ID NO: 2609924 - RNA, 22 nt, Human
ccacacuaaccuggguucccuu

SEQ ID NO: 2609925 - RNA, 23 nt, Human
ccacacuaaccuggguucccuuu

SEQ ID NO: 2609926 - RNA, 16 nt, Human
ccacacccagcucagc

SEQ ID NO: 2609927 - RNA, 19 nt, Human
ccacacccagccucagucc

SEQ ID NO: 2609928 - RNA, 17 nt, Human
ccacacccagccucagu

SEQ ID NO: 2609929 - RNA, 16 nt, Human
ccacacccagccucag

SEQ ID NO: 2609930 - RNA, 15 nt, Human
ccacacccagccuca

SEQ ID NO: 2609931 - RNA, 14 nt, Human
ccacacccagccuc

SEQ ID NO: 2609932 - RNA, 13 nt, Human
ccacacccagccu

SEQ ID NO: 2609933 - RNA, 11 nt, Human
ccacacccucc

SEQ ID NO: 2609934 - RNA, 20 nt, Human
ccacacccccaccccuugcu

SEQ ID NO: 2609935 - RNA, 15 nt, Human
ccacacccccacccc

SEQ ID NO: 2609936 - RNA, 13 nt, Human
ccacacccccacc

SEQ ID NO: 2609937 - RNA, 16 nt, Human
ccacacccucacugcu

SEQ ID NO: 2609938 - RNA, 22 nt, Human
ccacacccagcccacuucugcc

SEQ ID NO: 2609939 - RNA, 21 nt, Human
ccacacccagcccacuucugc

SEQ ID NO: 2609940 - RNA, 14 nt, Human
ccacaccaagcugu

SEQ ID NO: 2609941 - RNA, 13 nt, Human
ccacaccaagcug

SEQ ID NO: 2609942 - RNA, 12 nt, Human
ccacaccaagcu

SEQ ID NO: 2609943 - RNA, 14 nt, Human
ccacaccaagcagc

SEQ ID NO: 2609944 - RNA, 20 nt, Human
ccacaccaagcugugccacc

SEQ ID NO: 2609945 - RNA, 18 nt, Human
ccacaccaagcugugcca

SEQ ID NO: 2609946 - RNA, 23 nt, Human
ccacaccaagcugugccacccug

SEQ ID NO: 2609947 - RNA, 13 nt, Human
ccacaccacaucu

SEQ ID NO: 2609948 - RNA, 14 nt, Human
ccacaccaggccgu

SEQ ID NO: 2609949 - RNA, 15 nt, Human
ccacacccagcccac

SEQ ID NO: 2609950 - RNA, 20 nt, Human
ccacacccagcccacuucug

SEQ ID NO: 2609951 - RNA, 20 nt, Human
ccacacagacuugggcaggg

SEQ ID NO: 2609952 - RNA, 18 nt, Human
ccaauauuaaaucugcug

SEQ ID NO: 2609953 - RNA, 12 nt, Human
ccaauauuauaa

SEQ ID NO: 2609954 - RNA, 22 nt, Human
ccaauauguauuguaaacaugu

SEQ ID NO: 2609955 - RNA, 16 nt, Human
ccaauauguauuguaa

SEQ ID NO: 2609956 - RNA, 15 nt, Human
ccaauauuaaaucug

SEQ ID NO: 2609957 - RNA, 22 nt, Human
ccaauagggcugagcucucugu

SEQ ID NO: 2609958 - RNA, 15 nt, Human
ccaauauguauugua

SEQ ID NO: 2609959 - RNA, 15 nt, Human
ccacaccaaaccucu

SEQ ID NO: 2609960 - RNA, 13 nt, Human
ccaauauuauaau

SEQ ID NO: 2609961 - RNA, 13 nt, Human
ccacacagagugg

SEQ ID NO: 2609962 - RNA, 17 nt, Human
ccacauggcuuccuccu

SEQ ID NO: 2609963 - RNA, 21 nt, Human
ccacauggcuuccuccugcgc

SEQ ID NO: 2609964 - RNA, 16 nt, Human
ccacaugggaggcuca

SEQ ID NO: 2609965 - RNA, 14 nt, Human
ccacaugucaccgu

SEQ ID NO: 2609966 - RNA, 21 nt, Human
ccacauggggcugggcagcua

SEQ ID NO: 2609967 - RNA, 20 nt, Human
ccacauggggcugggcagcu

SEQ ID NO: 2609968 - RNA, 19 nt, Human
ccacauggggcugggcagc

SEQ ID NO: 2609969 - RNA, 19 nt, Human
ccacaugugacacauaugc

SEQ ID NO: 2609970 - RNA, 15 nt, Human
ccacaugugacacau

SEQ ID NO: 2609971 - RNA, 16 nt, Human
ccacauuccugaugcu

SEQ ID NO: 2609972 - RNA, 16 nt, Human
ccacaugugcacaugc

SEQ ID NO: 2609973 - RNA, 17 nt, Human
ccacaucuugcucugcu

SEQ ID NO: 2609974 - RNA, 18 nt, Human
ccacaucuugcucugcug

SEQ ID NO: 2609975 - RNA, 19 nt, Human
ccacaucuugcucugcuga

SEQ ID NO: 2609976 - RNA, 17 nt, Human
ccacaugcggagaacaa

SEQ ID NO: 2609977 - RNA, 15 nt, Human
ccaccaacccucaga

SEQ ID NO: 2609978 - RNA, 15 nt, Human
ccaccaacaucccau

SEQ ID NO: 2609979 - RNA, 12 nt, Human
ccaccaacccau

SEQ ID NO: 2609980 - RNA, 14 nt, Human
ccaccaacucuugc

SEQ ID NO: 2609981 - RNA, 21 nt, Human
ccaccaacccaucagaaggag

SEQ ID NO: 2609982 - RNA, 21 nt, Human
ccaccaagagggacgccuggg

SEQ ID NO: 2609983 - RNA, 17 nt, Human
ccaccaagagggacgcc

SEQ ID NO: 2609984 - RNA, 17 nt, Human
ccaccaagacuuguuuu

SEQ ID NO: 2609985 - RNA, 15 nt, Human
ccaccaacucuugca

SEQ ID NO: 2609986 - RNA, 22 nt, Human
ccaccaugcccagcucagaggg

SEQ ID NO: 2609987 - RNA, 16 nt, Human
ccaccauggccagcca

SEQ ID NO: 2609988 - RNA, 17 nt, Human
ccaccauggccagccaa

SEQ ID NO: 2609989 - RNA, 21 nt, Human
ccaccauggccagccaacuuu

SEQ ID NO: 2609990 - RNA, 22 nt, Human
ccacauuuggaauacuuuuugu

SEQ ID NO: 2609991 - RNA, 16 nt, Human
ccacauuuuauauuua

SEQ ID NO: 2609992 - RNA, 19 nt, Human
ccacauuuggaauacuuuu

SEQ ID NO: 2609993 - RNA, 21 nt, Human
ccaccaacauacucccaucug

SEQ ID NO: 2609994 - RNA, 16 nt, Human
ccacauuguuuuaaaa

SEQ ID NO: 2609995 - RNA, 14 nt, Human
ccacauuguuuuaa

SEQ ID NO: 2609996 - RNA, 13 nt, Human
ccacauuuggaau

SEQ ID NO: 2609997 - RNA, 22 nt, Human
ccacauugggcagcgcccuucc

SEQ ID NO: 2609998 - RNA, 20 nt, Human
ccacaucccgggacgcagca

SEQ ID NO: 2609999 - RNA, 18 nt, Human
ccacaucccaggcuucac

SEQ ID NO: 2610000 - RNA, 15 nt, Human
ccacaucccaggcuu

SEQ ID NO: 2610001 - RNA, 13 nt, Human
ccacaucccaggc

SEQ ID NO: 2610002 - RNA, 17 nt, Human
ccacaucccuuugaaac

SEQ ID NO: 2610003 - RNA, 13 nt, Human
ccacauccuccac

SEQ ID NO: 2610004 - RNA, 15 nt, Human
ccacaucuaagccug

SEQ ID NO: 2610005 - RNA, 22 nt, Human
ccacaucuaagccugaaggggc

SEQ ID NO: 2610006 - RNA, 23 nt, Human
ccacaucuaagccugaaggggcg

SEQ ID NO: 2610007 - RNA, 19 nt, Human
ccacauccuccguccagcc

SEQ ID NO: 2610008 - RNA, 20 nt, Human
ccacauccuccguccagccg

SEQ ID NO: 2610009 - RNA, 20 nt, Human
ccacaguuuccucaucuguc

SEQ ID NO: 2610010 - RNA, 22 nt, Human
ccacaguuuccucaucugucca

SEQ ID NO: 2610011 - RNA, 22 nt, Human
ccacauccacacacgcaggaac

SEQ ID NO: 2610012 - RNA, 12 nt, Human
ccacaucccagg

SEQ ID NO: 2610013 - RNA, 22 nt, Human
ccacaguucaguggcagggcuc

SEQ ID NO: 2610014 - RNA, 15 nt, Human
ccacaguucaguggc

SEQ ID NO: 2610015 - RNA, 23 nt, Human
ccacaguguuggcgagaggaggg

SEQ ID NO: 2610016 - RNA, 22 nt, Human
ccacaguguuggcgagaggagg

SEQ ID NO: 2610017 - RNA, 21 nt, Human
ccacaguguuggcgagaggag

SEQ ID NO: 2610018 - RNA, 12 nt, Human
ccacagugucug

SEQ ID NO: 2610019 - RNA, 21 nt, Human
ccacagugacucgggcuccug

SEQ ID NO: 2610020 - RNA, 16 nt, Human
ccacagucaaagaagg

SEQ ID NO: 2610021 - RNA, 23 nt, Human
ccacagugacucgggcuccugug

SEQ ID NO: 2610022 - RNA, 22 nt, Human
ccacagugacucgggcuccugu

SEQ ID NO: 2610023 - RNA, 12 nt, Human
ccacagugcugu

SEQ ID NO: 2610024 - RNA, 14 nt, Human
ccacagugcugucu

SEQ ID NO: 2610025 - RNA, 16 nt, Human
ccacagggaacccugc

SEQ ID NO: 2610026 - RNA, 18 nt, Human
ccacaggccucccuguuu

SEQ ID NO: 2610027 - RNA, 16 nt, Human
ccacaggccucccugu

SEQ ID NO: 2610028 - RNA, 15 nt, Human
ccacaggccucccug

SEQ ID NO: 2610029 - RNA, 13 nt, Human
ccacaggccuccc

SEQ ID NO: 2610030 - RNA, 12 nt, Human
ccacaggccuga

SEQ ID NO: 2610031 - RNA, 11 nt, Human
ccacaggccug

SEQ ID NO: 2610032 - RNA, 19 nt, Human
ccacaggccugagauuuca

SEQ ID NO: 2610033 - RNA, 14 nt, Human
ccacaggccugaga

SEQ ID NO: 2610034 - RNA, 22 nt, Human
ccacaggccugagauuucaucu

SEQ ID NO: 2610035 - RNA, 16 nt, Human
ccacaguaaguuccua

SEQ ID NO: 2610036 - RNA, 15 nt, Human
ccacaguagucuuga

SEQ ID NO: 2610037 - RNA, 14 nt, Human
ccacagucaaagaa

SEQ ID NO: 2610038 - RNA, 17 nt, Human
ccacaggugggaggagu

SEQ ID NO: 2610039 - RNA, 17 nt, Human
ccacaguagucuugaug

SEQ ID NO: 2610040 - RNA, 23 nt, Human
ccacagguguuuauacagcucag

SEQ ID NO: 2610041 - RNA, 22 nt, Human
ccacagguucaugccaccaugg

SEQ ID NO: 2610042 - RNA, 11 nt, Human
ccacagggucu

SEQ ID NO: 2610043 - RNA, 18 nt, Human
ccacaggguucaaaaugu

SEQ ID NO: 2610044 - RNA, 22 nt, Human
ccacaggguucaaaaugucugu

SEQ ID NO: 2610045 - RNA, 20 nt, Human
ccacagggcuaagagcuagc

SEQ ID NO: 2610046 - RNA, 14 nt, Human
ccacagggcuaaga

SEQ ID NO: 2610047 - RNA, 17 nt, Human
ccacagggcuaagagcu

SEQ ID NO: 2610048 - RNA, 18 nt, Human
ccacuaagcagaggaggg

SEQ ID NO: 2610049 - RNA, 16 nt, Human
ccacguccugucagug

SEQ ID NO: 2610050 - RNA, 19 nt, Human
ccacuaagcagaggagggg

SEQ ID NO: 2610051 - RNA, 21 nt, Human
ccacuaagcagaggaggggcc

SEQ ID NO: 2610052 - RNA, 14 nt, Human
ccacuacaccuggc

SEQ ID NO: 2610053 - RNA, 13 nt, Human
ccacuacaccugg

SEQ ID NO: 2610054 - RNA, 22 nt, Human
ccacuaagcagaggaggggccg

SEQ ID NO: 2610055 - RNA, 16 nt, Human
ccacuacaccuggcug

SEQ ID NO: 2610056 - RNA, 15 nt, Human
ccacuacaccuggcu

SEQ ID NO: 2610057 - RNA, 14 nt, Human
ccacuacacuccag

SEQ ID NO: 2610058 - RNA, 18 nt, Human
ccacuacacuccagccug

SEQ ID NO: 2610059 - RNA, 19 nt, Human
ccacuacacuccagccuga

SEQ ID NO: 2610060 - RNA, 15 nt, Human
ccacguccugucagu

SEQ ID NO: 2610061 - RNA, 22 nt, Human
ccacgucccccuggggcuucuc

SEQ ID NO: 2610062 - RNA, 15 nt, Human
ccacgucccccuggg

SEQ ID NO: 2610063 - RNA, 17 nt, Human
ccacgguggucacugga

SEQ ID NO: 2610064 - RNA, 21 nt, Human
ccacggucuguucuugaagca

SEQ ID NO: 2610065 - RNA, 18 nt, Human
ccacggcucuaggugggg

SEQ ID NO: 2610066 - RNA, 15 nt, Human
ccaccccacacacgc

SEQ ID NO: 2610067 - RNA, 12 nt, Human
ccaccccacacu

SEQ ID NO: 2610068 - RNA, 14 nt, Human
ccaccccacccccu

SEQ ID NO: 2610069 - RNA, 13 nt, Human
ccaccccacacuu

SEQ ID NO: 2610070 - RNA, 12 nt, Human
ccaccccagccu

SEQ ID NO: 2610071 - RNA, 14 nt, Human
ccaccccagccuaa

SEQ ID NO: 2610072 - RNA, 13 nt, Human
ccaccccagcugc

SEQ ID NO: 2610073 - RNA, 17 nt, Human
ccaccccacccccuuca

SEQ ID NO: 2610074 - RNA, 19 nt, Human
ccaccccagaaauggugaa

SEQ ID NO: 2610075 - RNA, 18 nt, Human
ccaccccagcugcucccc

SEQ ID NO: 2610076 - RNA, 17 nt, Human
ccaccccagugcaccca

SEQ ID NO: 2610077 - RNA, 19 nt, Human
ccaccccagugcacccacu

SEQ ID NO: 2610078 - RNA, 18 nt, Human
ccacggccaggccagagg

SEQ ID NO: 2610079 - RNA, 16 nt, Human
ccacggccaggccaga

SEQ ID NO: 2610080 - RNA, 19 nt, Human
ccacgcuggagugcaguga

SEQ ID NO: 2610081 - RNA, 18 nt, Human
ccacgcuggagugcagug

SEQ ID NO: 2610082 - RNA, 14 nt, Human
ccacgguguucugu

SEQ ID NO: 2610083 - RNA, 18 nt, Human
ccacgggaaguuuagaga

SEQ ID NO: 2610084 - RNA, 17 nt, Human
ccacggucuguucuuga

SEQ ID NO: 2610085 - RNA, 20 nt, Human
ccacggccgcuccaggggug

SEQ ID NO: 2610086 - RNA, 23 nt, Human
ccacggccaggccagagggagug

SEQ ID NO: 2610087 - RNA, 18 nt, Human
ccacggccgcuccagggg

SEQ ID NO: 2610088 - RNA, 16 nt, Human
ccacggccgcuccagg

SEQ ID NO: 2610089 - RNA, 15 nt, Human
ccacggccgcuccag

SEQ ID NO: 2610090 - RNA, 22 nt, Human
ccaccugucaaacaaagccaga

SEQ ID NO: 2610091 - RNA, 13 nt, Human
ccacgcuggagug

SEQ ID NO: 2610092 - RNA, 16 nt, Human
ccacgcuggagugcag

SEQ ID NO: 2610093 - RNA, 20 nt, Human
ccaccugucucagccuccca

SEQ ID NO: 2610094 - RNA, 23 nt, Human
ccaccugucucagccucccagag

SEQ ID NO: 2610095 - RNA, 12 nt, Human
ccaccugucuca

SEQ ID NO: 2610096 - RNA, 15 nt, Human
ccaccugucucagcc

SEQ ID NO: 2610097 - RNA, 16 nt, Human
ccaccugucucagccu

SEQ ID NO: 2610098 - RNA, 18 nt, Human
ccaccugucucagccucc

SEQ ID NO: 2610099 - RNA, 15 nt, Human
ccacccccacccaag

SEQ ID NO: 2610100 - RNA, 12 nt, Human
ccacccccacac

SEQ ID NO: 2610101 - RNA, 18 nt, Human
ccaccccauuuucugugg

SEQ ID NO: 2610102 - RNA, 18 nt, Human
ccaccccauccaguucau

SEQ ID NO: 2610103 - RNA, 22 nt, Human
ccaccccagugcacccacucug

SEQ ID NO: 2610104 - RNA, 12 nt, Human
ccacccccacca

SEQ ID NO: 2610105 - RNA, 14 nt, Human
ccacccccacaccu

SEQ ID NO: 2610106 - RNA, 13 nt, Human
ccacccccacacc

SEQ ID NO: 2610107 - RNA, 23 nt, Human
ccaccccaugucaccggauccug

SEQ ID NO: 2610108 - RNA, 21 nt, Human
ccacccccaccaagggcgcaa

SEQ ID NO: 2610109 - RNA, 15 nt, Human
ccacccccaccaagg

SEQ ID NO: 2610110 - RNA, 15 nt, Human
ccaccugguggccuc

SEQ ID NO: 2610111 - RNA, 17 nt, Human
ccaccugguggccucug

SEQ ID NO: 2610112 - RNA, 11 nt, Human
ccaccugucuc

SEQ ID NO: 2610113 - RNA, 19 nt, Human
ccaccugucaaacaaagcc

SEQ ID NO: 2610114 - RNA, 20 nt, Human
ccaccugucaaacaaagcca

SEQ ID NO: 2610115 - RNA, 21 nt, Human
ccaccugguuccggaauccug

SEQ ID NO: 2610116 - RNA, 15 nt, Human
ccacuacauucuguu

SEQ ID NO: 2610117 - RNA, 14 nt, Human
ccacuacauucugu

SEQ ID NO: 2610118 - RNA, 11 nt, Human
ccacuacauuc

SEQ ID NO: 2610119 - RNA, 20 nt, Human
ccacuacacuccagccugag

SEQ ID NO: 2610120 - RNA, 21 nt, Human
ccacuacacuccagccugagc

SEQ ID NO: 2610121 - RNA, 22 nt, Human
ccacuacacuccagccugagca

SEQ ID NO: 2610122 - RNA, 22 nt, Human
ccacuacaugcagcccaugccc

SEQ ID NO: 2610123 - RNA, 16 nt, Human
ccacuacauucuguua

SEQ ID NO: 2610124 - RNA, 17 nt, Human
ccacuacauucuguuaa

SEQ ID NO: 2610125 - RNA, 15 nt, Human
ccacuagacccacug

SEQ ID NO: 2610126 - RNA, 17 nt, Human
ccacuagacccacugga

SEQ ID NO: 2610127 - RNA, 21 nt, Human
ccacuagaacucuccaucuua

SEQ ID NO: 2610128 - RNA, 17 nt, Human
ccacuacaccuggcuga

SEQ ID NO: 2610129 - RNA, 16 nt, Human
ccacuaggacucugag

SEQ ID NO: 2610130 - RNA, 18 nt, Human
ccacuaggacucugaggc

SEQ ID NO: 2610131 - RNA, 22 nt, Human
ccacuccagaccccuggcuuuu

SEQ ID NO: 2610132 - RNA, 21 nt, Human
ccacuccagaccccuggcuuu

SEQ ID NO: 2610133 - RNA, 20 nt, Human
ccacuccagaccccuggcuu

SEQ ID NO: 2610134 - RNA, 18 nt, Human
ccacucaggcauuugacu

SEQ ID NO: 2610135 - RNA, 14 nt, Human
ccacucagcuuccu

SEQ ID NO: 2610136 - RNA, 20 nt, Human
ccacucaggaggcugaggca

SEQ ID NO: 2610137 - RNA, 13 nt, Human
ccacucaggccaa

SEQ ID NO: 2610138 - RNA, 20 nt, Human
ccacucaggccaacaagcca

SEQ ID NO: 2610139 - RNA, 11 nt, Human
ccacucagcuc

SEQ ID NO: 2610140 - RNA, 15 nt, Human
ccacucagcuccgug

SEQ ID NO: 2610141 - RNA, 13 nt, Human
ccacucagcuucc

SEQ ID NO: 2610142 - RNA, 13 nt, Human
ccacucaggaggc

SEQ ID NO: 2610143 - RNA, 19 nt, Human
ccacuaggacucugaggcu

SEQ ID NO: 2610144 - RNA, 20 nt, Human
ccacuaggacucugaggcuc

SEQ ID NO: 2610145 - RNA, 17 nt, Human
ccacuagugcaaaucau

SEQ ID NO: 2610146 - RNA, 16 nt, Human
ccacuagugcaaauca

SEQ ID NO: 2610147 - RNA, 14 nt, Human
ccacuagugcaaau

SEQ ID NO: 2610148 - RNA, 14 nt, Human
ccacuaucugggug

SEQ ID NO: 2610149 - RNA, 21 nt, Human
ccacuauggucaucuuuuucu

SEQ ID NO: 2610150 - RNA, 21 nt, Human
ccagacaccuugacagggcac

SEQ ID NO: 2610151 - RNA, 21 nt, Human
ccagaauuucccaaagcagug

SEQ ID NO: 2610152 - RNA, 18 nt, Human
ccagaauuucccaaagca

SEQ ID NO: 2610153 - RNA, 19 nt, Human
ccagaauuucccaaagcag

SEQ ID NO: 2610154 - RNA, 12 nt, Human
ccagaauuuccc

SEQ ID NO: 2610155 - RNA, 13 nt, Human
ccagaauuucaaa

SEQ ID NO: 2610156 - RNA, 21 nt, Human
ccagaaugcuguacaucuauu

SEQ ID NO: 2610157 - RNA, 16 nt, Human
ccagaaugcuuuagga

SEQ ID NO: 2610158 - RNA, 23 nt, Human
ccagaauggucuuucuaaugugu

SEQ ID NO: 2610159 - RNA, 17 nt, Human
ccagaccccuggcuuuu

SEQ ID NO: 2610160 - RNA, 14 nt, Human
ccagagcagaugca

SEQ ID NO: 2610161 - RNA, 22 nt, Human
ccagagcacuggguugcagggg

SEQ ID NO: 2610162 - RNA, 16 nt, Human
ccagaccccuggcuuu

SEQ ID NO: 2610163 - RNA, 15 nt, Human
ccagaccccuggcuu

SEQ ID NO: 2610164 - RNA, 23 nt, Human
ccagagcaggaggccccuggccc

SEQ ID NO: 2610165 - RNA, 21 nt, Human
ccagagcaggaggccccuggc

SEQ ID NO: 2610166 - RNA, 19 nt, Human
ccagagcaggaggccccug

SEQ ID NO: 2610167 - RNA, 15 nt, Human
ccagagcaggaggcc

SEQ ID NO: 2610168 - RNA, 14 nt, Human
ccagagcaggaggc

SEQ ID NO: 2610169 - RNA, 12 nt, Human
ccagagcaggag

SEQ ID NO: 2610170 - RNA, 15 nt, Human
ccagagcaggaagca

SEQ ID NO: 2610171 - RNA, 14 nt, Human
ccagagcaggaagc

SEQ ID NO: 2610172 - RNA, 23 nt, Human
ccagagcagaugcagagagccau

SEQ ID NO: 2610173 - RNA, 22 nt, Human
ccagagcagaugcagagagcca

SEQ ID NO: 2610174 - RNA, 20 nt, Human
ccagagcagaugcagagagc

SEQ ID NO: 2610175 - RNA, 18 nt, Human
ccagagcagaugcagaga

SEQ ID NO: 2610176 - RNA, 17 nt, Human
ccagagcagaugcagag

SEQ ID NO: 2610177 - RNA, 16 nt, Human
ccagagcagaugcaga

SEQ ID NO: 2610178 - RNA, 15 nt, Human
ccagagcagaugcag

SEQ ID NO: 2610179 - RNA, 24 nt, Human
ccagaccccucuggccaggaugga

SEQ ID NO: 2610180 - RNA, 14 nt, Human
ccagaccccuggcu

SEQ ID NO: 2610181 - RNA, 20 nt, Human
ccagaccccucuggccagga

SEQ ID NO: 2610182 - RNA, 21 nt, Human
ccagaccccucuggccaggau

SEQ ID NO: 2610183 - RNA, 22 nt, Human
ccagaccccucuggccaggaug

SEQ ID NO: 2610184 - RNA, 23 nt, Human
ccagaccccucuggccaggaugg

SEQ ID NO: 2610185 - RNA, 18 nt, Human
ccagacagacaucucugc

SEQ ID NO: 2610186 - RNA, 19 nt, Human
ccagacagacaucucugca

SEQ ID NO: 2610187 - RNA, 21 nt, Human
ccagacagcaacggggaggcc

SEQ ID NO: 2610188 - RNA, 13 nt, Human
ccagacagccugu

SEQ ID NO: 2610189 - RNA, 12 nt, Human
ccagacagccug

SEQ ID NO: 2610190 - RNA, 14 nt, Human
ccagacagccugua

SEQ ID NO: 2610191 - RNA, 18 nt, Human
ccagaccccucuggccag

SEQ ID NO: 2610192 - RNA, 19 nt, Human
ccagaccccucuggccagg

SEQ ID NO: 2610193 - RNA, 13 nt, Human
ccagacacucugc

SEQ ID NO: 2610194 - RNA, 18 nt, Human
ccagacacagaagaggcu

SEQ ID NO: 2610195 - RNA, 14 nt, Human
ccagacacaggccc

SEQ ID NO: 2610196 - RNA, 15 nt, Human
ccagacacucugcuc

SEQ ID NO: 2610197 - RNA, 23 nt, Human
ccagacacugaccauccacucua

SEQ ID NO: 2610198 - RNA, 22 nt, Human
ccagacagacaucucugcaccc

SEQ ID NO: 2610199 - RNA, 17 nt, Human
ccagacagacaacacug

SEQ ID NO: 2610200 - RNA, 23 nt, Human
ccagaaguuugagaucagccugg

SEQ ID NO: 2610201 - RNA, 12 nt, Human
ccagaaguguga

SEQ ID NO: 2610202 - RNA, 22 nt, Human
ccagaauaaacuggcagcucag

SEQ ID NO: 2610203 - RNA, 16 nt, Human
ccagaauaaacccagc

SEQ ID NO: 2610204 - RNA, 20 nt, Human
ccagaaguuugucaagucaa

SEQ ID NO: 2610205 - RNA, 14 nt, Human
ccagaagcccagaa

SEQ ID NO: 2610206 - RNA, 20 nt, Human
ccagaagucaagcccagcca

SEQ ID NO: 2610207 - RNA, 22 nt, Human
ccagaaguuugagaucagccug

SEQ ID NO: 2610208 - RNA, 12 nt, Human
ccagaagcccag

SEQ ID NO: 2610209 - RNA, 13 nt, Human
ccagaagcccaga

SEQ ID NO: 2610210 - RNA, 16 nt, Human
ccagaagccaaagacu

SEQ ID NO: 2610211 - RNA, 22 nt, Human
ccagaacacacuccaucagcuu

SEQ ID NO: 2610212 - RNA, 18 nt, Human
ccagaagaauauucagga

SEQ ID NO: 2610213 - RNA, 17 nt, Human
ccagaagaauauucagg

SEQ ID NO: 2610214 - RNA, 16 nt, Human
ccagaagaauauucag

SEQ ID NO: 2610215 - RNA, 19 nt, Human
ccagaacacacuccaucag

SEQ ID NO: 2610216 - RNA, 20 nt, Human
ccagaagaauauucaggacu

SEQ ID NO: 2610217 - RNA, 19 nt, Human
ccagaagaauauucaggac

SEQ ID NO: 2610218 - RNA, 22 nt, Human
ccagaagauagcuucaccccaa

SEQ ID NO: 2610219 - RNA, 22 nt, Human
ccagaagauccccucaggacug

SEQ ID NO: 2610220 - RNA, 18 nt, Human
ccagaagauccccucagg

SEQ ID NO: 2610221 - RNA, 24 nt, Human
ccagaagauccccucaggacugca

SEQ ID NO: 2610222 - RNA, 13 nt, Human
ccacugcagaaga

SEQ ID NO: 2610223 - RNA, 18 nt, Human
ccacugcagaagacagua

SEQ ID NO: 2610224 - RNA, 12 nt, Human
ccacucccacuu

SEQ ID NO: 2610225 - RNA, 11 nt, Human
ccacucccacu

SEQ ID NO: 2610226 - RNA, 20 nt, Human
ccacuccagcuccuucgcuu

SEQ ID NO: 2610227 - RNA, 23 nt, Human
ccacucccacuucccugacacug

SEQ ID NO: 2610228 - RNA, 22 nt, Human
ccacucccacuucccugacacu

SEQ ID NO: 2610229 - RNA, 21 nt, Human
ccacucccacuucccugacac

SEQ ID NO: 2610230 - RNA, 17 nt, Human
ccacucccacuucccug

SEQ ID NO: 2610231 - RNA, 15 nt, Human
ccacucccaggcagc

SEQ ID NO: 2610232 - RNA, 13 nt, Human
ccacucccaggca

SEQ ID NO: 2610233 - RNA, 19 nt, Human
ccacuuagaaauugcauuu

SEQ ID NO: 2610234 - RNA, 13 nt, Human
ccacuuaccuuca

SEQ ID NO: 2610235 - RNA, 14 nt, Human
ccacuuaccuucaa

SEQ ID NO: 2610236 - RNA, 19 nt, Human
ccacuuaccuucaauaaag

SEQ ID NO: 2610237 - RNA, 12 nt, Human
ccacuuaccuag

SEQ ID NO: 2610238 - RNA, 13 nt, Human
ccacuuaaaaugu

SEQ ID NO: 2610239 - RNA, 21 nt, Human
ccacuuaaaaaauguccauga

SEQ ID NO: 2610240 - RNA, 14 nt, Human
ccacugcaggcccc

SEQ ID NO: 2610241 - RNA, 16 nt, Human
ccacuuaaaaaauguc

SEQ ID NO: 2610242 - RNA, 17 nt, Human
ccacuuaaaaaaugucc

SEQ ID NO: 2610243 - RNA, 19 nt, Human
ccacuuaaaaaauguccau

SEQ ID NO: 2610244 - RNA, 23 nt, Human
ccacugcacuccagccuggguga

SEQ ID NO: 2610245 - RNA, 14 nt, Human
ccacucccagugcu

SEQ ID NO: 2610246 - RNA, 14 nt, Human
ccacucccaggcag

SEQ ID NO: 2610247 - RNA, 13 nt, Human
ccacugcaggccc

SEQ ID NO: 2610248 - RNA, 17 nt, Human
ccacuuaucccucucca

SEQ ID NO: 2610249 - RNA, 22 nt, Human
ccacuuauuccccauucuuccu

SEQ ID NO: 2610250 - RNA, 17 nt, Human
ccacuucaagugaccac

SEQ ID NO: 2610251 - RNA, 21 nt, Human
ccacuuaccuucaauaaagua

SEQ ID NO: 2610252 - RNA, 22 nt, Human
ccacuuaccuucaauaaaguau

SEQ ID NO: 2610253 - RNA, 21 nt, Human
ccacuuagaaauugcauuucc

SEQ ID NO: 2610254 - RNA, 13 nt, Human
ccacuucagcuga

SEQ ID NO: 2610255 - RNA, 14 nt, Human
ccacuucagcugac

SEQ ID NO: 2610256 - RNA, 17 nt, Human
ccagaaauuagaaaccu

SEQ ID NO: 2610257 - RNA, 22 nt, Human
ccagaaaugucuaaaugcugaa

SEQ ID NO: 2610258 - RNA, 13 nt, Human
ccagaaauuagaa

SEQ ID NO: 2610259 - RNA, 22 nt, Human
ccagaacaagguucccucugag

SEQ ID NO: 2610260 - RNA, 17 nt, Human
ccagaacacacuccauc

SEQ ID NO: 2610261 - RNA, 22 nt, Human
ccagaaauccaucuaaauaccu

SEQ ID NO: 2610262 - RNA, 16 nt, Human
ccagaaaucauuuuac

SEQ ID NO: 2610263 - RNA, 21 nt, Human
ccagaaauaaaguuggugaca

SEQ ID NO: 2610264 - RNA, 23 nt, Human
ccagaaauaaaguuggugacaga

SEQ ID NO: 2610265 - RNA, 14 nt, Human
ccagaaaggagacu

SEQ ID NO: 2610266 - RNA, 16 nt, Human
ccagaaaggagacuag

SEQ ID NO: 2610267 - RNA, 13 nt, Human
ccacuucaauaga

SEQ ID NO: 2610268 - RNA, 21 nt, Human
ccacuucaggguucuccucuc

SEQ ID NO: 2610269 - RNA, 12 nt, Human
ccagaaagaaaa

SEQ ID NO: 2610270 - RNA, 24 nt, Human
ccagaaacuguucccaccugcugg

SEQ ID NO: 2610271 - RNA, 20 nt, Human
ccaggacggggccggccagg

SEQ ID NO: 2610272 - RNA, 14 nt, Human
ccaggacaggcccg

SEQ ID NO: 2610273 - RNA, 15 nt, Human
ccaggacaggcccgg

SEQ ID NO: 2610274 - RNA, 17 nt, Human
ccaggacaggcccggcg

SEQ ID NO: 2610275 - RNA, 13 nt, Human
ccaggacaggccc

SEQ ID NO: 2610276 - RNA, 21 nt, Human
ccaggacaccacacccagccu

SEQ ID NO: 2610277 - RNA, 20 nt, Human
ccaggacaccacacccagcc

SEQ ID NO: 2610278 - RNA, 19 nt, Human
ccaggacaccacacccagc

SEQ ID NO: 2610279 - RNA, 18 nt, Human
ccaggacaccacacccag

SEQ ID NO: 2610280 - RNA, 17 nt, Human
ccaggacaccacaccca

SEQ ID NO: 2610281 - RNA, 14 nt, Human
ccaggacaggacca

SEQ ID NO: 2610282 - RNA, 23 nt, Human
ccaggacaccacacccagccuca

SEQ ID NO: 2610283 - RNA, 22 nt, Human
ccaggacaccacacccagccuc

SEQ ID NO: 2610284 - RNA, 13 nt, Human
ccaggacaggacc

SEQ ID NO: 2610285 - RNA, 19 nt, Human
ccaggacuauagcccaggu

SEQ ID NO: 2610286 - RNA, 18 nt, Human
ccaggacuauagcccagg

SEQ ID NO: 2610287 - RNA, 23 nt, Human
ccaggacggggccggccaggugg

SEQ ID NO: 2610288 - RNA, 21 nt, Human
ccaggacggggccggccaggu

SEQ ID NO: 2610289 - RNA, 22 nt, Human
ccaggacuauagcccagguccu

SEQ ID NO: 2610290 - RNA, 20 nt, Human
ccaggacuauagcccagguc

SEQ ID NO: 2610291 - RNA, 20 nt, Human
ccaggacuauauuugggccu

SEQ ID NO: 2610292 - RNA, 17 nt, Human
ccaggacuccccaggcc

SEQ ID NO: 2610293 - RNA, 15 nt, Human
ccaggacuccccagg

SEQ ID NO: 2610294 - RNA, 21 nt, Human
ccaggacuauauuugggccug

SEQ ID NO: 2610295 - RNA, 21 nt, Human
ccaggacuccccaggccaggc

SEQ ID NO: 2610296 - RNA, 19 nt, Human
ccaggacuccccaggccag

SEQ ID NO: 2610297 - RNA, 14 nt, Human
ccaggacucccucc

SEQ ID NO: 2610298 - RNA, 22 nt, Human
ccaggacuccccaggccaggcc

SEQ ID NO: 2610299 - RNA, 23 nt, Human
ccaggacucccuccucaccucug

SEQ ID NO: 2610300 - RNA, 16 nt, Human
ccaggacucccuccuc

SEQ ID NO: 2610301 - RNA, 17 nt, Human
ccaggacucccuccuca

SEQ ID NO: 2610302 - RNA, 18 nt, Human
ccaggacucccuccucac

SEQ ID NO: 2610303 - RNA, 22 nt, Human
ccaggacucccuccucaccucu

SEQ ID NO: 2610304 - RNA, 23 nt, Human
ccagcuggggccaggcugggucg

SEQ ID NO: 2610305 - RNA, 22 nt, Human
ccagcuggggccaggcuggguc

SEQ ID NO: 2610306 - RNA, 21 nt, Human
ccagcuggggccaggcugggu

SEQ ID NO: 2610307 - RNA, 20 nt, Human
ccagcuggggccaggcuggg

SEQ ID NO: 2610308 - RNA, 19 nt, Human
ccagcuggggccaggcugg

SEQ ID NO: 2610309 - RNA, 18 nt, Human
ccagcuggggccaggcug

SEQ ID NO: 2610310 - RNA, 17 nt, Human
ccagcuggggccaggcu

SEQ ID NO: 2610311 - RNA, 23 nt, Human
ccagcugggcucugccacccuac

SEQ ID NO: 2610312 - RNA, 22 nt, Human
ccagcugggcucugccacccua

SEQ ID NO: 2610313 - RNA, 21 nt, Human
ccagcugggcucugccacccu

SEQ ID NO: 2610314 - RNA, 17 nt, Human
ccagcugggcucugcca

SEQ ID NO: 2610315 - RNA, 19 nt, Human
ccagcugggcucugcaauu

SEQ ID NO: 2610316 - RNA, 16 nt, Human
ccagcugggcucugcc

SEQ ID NO: 2610317 - RNA, 16 nt, Human
ccagcuggcagcagag

SEQ ID NO: 2610318 - RNA, 21 nt, Human
ccaggaaggggguccacccag

SEQ ID NO: 2610319 - RNA, 22 nt, Human
ccaggaaggggguccacccagc

SEQ ID NO: 2610320 - RNA, 15 nt, Human
ccaggaaggcggggc

SEQ ID NO: 2610321 - RNA, 18 nt, Human
ccaggaaggcggggcuuc

SEQ ID NO: 2610322 - RNA, 20 nt, Human
ccaggaagccgugcccugcc

SEQ ID NO: 2610323 - RNA, 15 nt, Human
ccaggaagccgugcc

SEQ ID NO: 2610324 - RNA, 22 nt, Human
ccaggaagccagcaggcucuca

SEQ ID NO: 2610325 - RNA, 20 nt, Human
ccaggaagccagcaggcucu

SEQ ID NO: 2610326 - RNA, 19 nt, Human
ccagcuggggcguggggag

SEQ ID NO: 2610327 - RNA, 16 nt, Human
ccagcuggggcguggg

SEQ ID NO: 2610328 - RNA, 11 nt, Human
ccaggaagccg

SEQ ID NO: 2610329 - RNA, 16 nt, Human
ccaggaauuucccagg

SEQ ID NO: 2610330 - RNA, 17 nt, Human
ccaggaauuucccagga

SEQ ID NO: 2610331 - RNA, 14 nt, Human
ccaggaauuuccca

SEQ ID NO: 2610332 - RNA, 19 nt, Human
ccaggaaugccuccucccu

SEQ ID NO: 2610333 - RNA, 18 nt, Human
ccaggaauuucccaggac

SEQ ID NO: 2610334 - RNA, 19 nt, Human
ccaggaauuucccaggacc

SEQ ID NO: 2610335 - RNA, 20 nt, Human
ccaggaauuucccaggaccc

SEQ ID NO: 2610336 - RNA, 21 nt, Human
ccaggaauuucccaggacccu

SEQ ID NO: 2610337 - RNA, 23 nt, Human
ccaggaauuucccaggacccuga

SEQ ID NO: 2610338 - RNA, 22 nt, Human
ccaggaauuucccaggacccug

SEQ ID NO: 2610339 - RNA, 20 nt, Human
ccaggaauguuaaagucagu

SEQ ID NO: 2610340 - RNA, 16 nt, Human
ccagcgagcccuggug

SEQ ID NO: 2610341 - RNA, 15 nt, Human
ccagcgagcccuggu

SEQ ID NO: 2610342 - RNA, 22 nt, Human
ccagccuugaccauucuccacc

SEQ ID NO: 2610343 - RNA, 14 nt, Human
ccagcgagcccugg

SEQ ID NO: 2610344 - RNA, 13 nt, Human
ccagcucuggucc

SEQ ID NO: 2610345 - RNA, 12 nt, Human
ccagcucugguc

SEQ ID NO: 2610346 - RNA, 11 nt, Human
ccagcucuggu

SEQ ID NO: 2610347 - RNA, 19 nt, Human
ccagcucuggaggggaggg

SEQ ID NO: 2610348 - RNA, 14 nt, Human
ccagcucuggaggg

SEQ ID NO: 2610349 - RNA, 12 nt, Human
ccagcucuggcu

SEQ ID NO: 2610350 - RNA, 14 nt, Human
ccagcucuggcuuc

SEQ ID NO: 2610351 - RNA, 19 nt, Human
ccagccuucuuugcuugcc

SEQ ID NO: 2610352 - RNA, 18 nt, Human
ccagccuucuuugcuugc

SEQ ID NO: 2610353 - RNA, 22 nt, Human
ccagccuucuuccaucccagga

SEQ ID NO: 2610354 - RNA, 19 nt, Human
ccagccuucuuccauccca

SEQ ID NO: 2610355 - RNA, 18 nt, Human
ccagccuucuuccauccc

SEQ ID NO: 2610356 - RNA, 22 nt, Human
ccagccuuccucugcagcugac

SEQ ID NO: 2610357 - RNA, 21 nt, Human
ccagccuuccucugcagcuga

SEQ ID NO: 2610358 - RNA, 20 nt, Human
ccagccuuccucugcagcug

SEQ ID NO: 2610359 - RNA, 12 nt, Human
ccagagcccagc

SEQ ID NO: 2610360 - RNA, 13 nt, Human
ccagagcccagcu

SEQ ID NO: 2610361 - RNA, 14 nt, Human
ccagagcccagcuc

SEQ ID NO: 2610362 - RNA, 15 nt, Human
ccagagcccagcucc

SEQ ID NO: 2610363 - RNA, 20 nt, Human
ccagccuugaccauucucca

SEQ ID NO: 2610364 - RNA, 19 nt, Human
ccagccuugaccauucucc

SEQ ID NO: 2610365 - RNA, 21 nt, Human
ccagagcauuacgugagccag

SEQ ID NO: 2610366 - RNA, 20 nt, Human
ccagagcauuacgugagcca

SEQ ID NO: 2610367 - RNA, 14 nt, Human
ccagagcagggugu

SEQ ID NO: 2610368 - RNA, 12 nt, Human
ccagagcagggu

SEQ ID NO: 2610369 - RNA, 23 nt, Human
ccagagcauuacgugagccaggu

SEQ ID NO: 2610370 - RNA, 22 nt, Human
ccagagcauuacgugagccagg

SEQ ID NO: 2610371 - RNA, 16 nt, Human
ccagagcccaccuugg

SEQ ID NO: 2610372 - RNA, 11 nt, Human
ccagagcccag

SEQ ID NO: 2610373 - RNA, 20 nt, Human
ccagagcauuuccaacacca

SEQ ID NO: 2610374 - RNA, 18 nt, Human
ccagagcauuuccaacac

SEQ ID NO: 2610375 - RNA, 22 nt, Human
ccagagcccaccuuggcucaag

SEQ ID NO: 2610376 - RNA, 20 nt, Human
ccagcugcuugggcuucauc

SEQ ID NO: 2610377 - RNA, 20 nt, Human
ccagcugcgcuugcuuuucu

SEQ ID NO: 2610378 - RNA, 19 nt, Human
ccagcugcgcuugcuuuuc

SEQ ID NO: 2610379 - RNA, 21 nt, Human
ccagcugcgcuugcuuuucug

SEQ ID NO: 2610380 - RNA, 12 nt, Human
ccagcugcuccc

SEQ ID NO: 2610381 - RNA, 14 nt, Human
ccagcugcucccca

SEQ ID NO: 2610382 - RNA, 14 nt, Human
ccagcugcuccccu

SEQ ID NO: 2610383 - RNA, 16 nt, Human
ccagcugcuccccucc

SEQ ID NO: 2610384 - RNA, 17 nt, Human
ccagcugcuccccuccc

SEQ ID NO: 2610385 - RNA, 19 nt, Human
ccagcugcuccccucccuc

SEQ ID NO: 2610386 - RNA, 21 nt, Human
ccagcugcuccccucccuccu

SEQ ID NO: 2610387 - RNA, 13 nt, Human
ccagcuggcagca

SEQ ID NO: 2610388 - RNA, 18 nt, Human
ccagcugggcucugcaau

SEQ ID NO: 2610389 - RNA, 16 nt, Human
ccagcugggcucugca

SEQ ID NO: 2610390 - RNA, 14 nt, Human
ccagcuggcagcag

SEQ ID NO: 2610391 - RNA, 15 nt, Human
ccagcuggcagcaga

SEQ ID NO: 2610392 - RNA, 20 nt, Human
ccagcuggcagcagagugug

SEQ ID NO: 2610393 - RNA, 15 nt, Human
ccagcugggcucugc

SEQ ID NO: 2610394 - RNA, 23 nt, Human
ccagcugcuugggcuucauccuc

SEQ ID NO: 2610395 - RNA, 24 nt, Human
ccagcuggagaaauaugguacuca

SEQ ID NO: 2610396 - RNA, 22 nt, Human
ccagcucugguccauagagagc

SEQ ID NO: 2610397 - RNA, 21 nt, Human
ccagcucugguccauagagag

SEQ ID NO: 2610398 - RNA, 17 nt, Human
ccagcucugguccauag

SEQ ID NO: 2610399 - RNA, 14 nt, Human
ccagcucuggucca

SEQ ID NO: 2610400 - RNA, 14 nt, Human
ccagcugcacugau

SEQ ID NO: 2610401 - RNA, 18 nt, Human
ccagcugcacugaugcug

SEQ ID NO: 2610402 - RNA, 19 nt, Human
ccagcugcacugaugcugc

SEQ ID NO: 2610403 - RNA, 18 nt, Human
ccagcugccccagccaga

SEQ ID NO: 2610404 - RNA, 16 nt, Human
ccagcugccccagcca

SEQ ID NO: 2610405 - RNA, 19 nt, Human
ccagcugccgaccagagcc

SEQ ID NO: 2610406 - RNA, 20 nt, Human
ccagcugccgaccagagccc

SEQ ID NO: 2610407 - RNA, 18 nt, Human
ccagcugccgaccagagc

SEQ ID NO: 2610408 - RNA, 18 nt, Human
ccagcugcgcuugcuuuu

SEQ ID NO: 2610409 - RNA, 17 nt, Human
ccagcugcgcuugcuuu

SEQ ID NO: 2610410 - RNA, 16 nt, Human
ccagcugcgcuugcuu

SEQ ID NO: 2610411 - RNA, 13 nt, Human
ccagcugccucuu

SEQ ID NO: 2610412 - RNA, 10 nt, Human
ccagcugccu

SEQ ID NO: 2610413 - RNA, 12 nt, Human
ccagcugccucc

SEQ ID NO: 2610414 - RNA, 22 nt, Human
ccaggcauuccccaggaggcca

SEQ ID NO: 2610415 - RNA, 23 nt, Human
ccaggcauuccccaggaggccag

SEQ ID NO: 2610416 - RNA, 16 nt, Human
ccaggcauugccaagg

SEQ ID NO: 2610417 - RNA, 15 nt, Human
ccaggccccaggaag

SEQ ID NO: 2610418 - RNA, 24 nt, Human
ccaggcauuccccaggaggccagc

SEQ ID NO: 2610419 - RNA, 24 nt, Human
ccaggcagucgggggcuggccuag

SEQ ID NO: 2610420 - RNA, 20 nt, Human
ccaggcauccuccacaauag

SEQ ID NO: 2610421 - RNA, 14 nt, Human
ccaggcauucccca

SEQ ID NO: 2610422 - RNA, 23 nt, Human
ccaggcagucgggggcuggccua

SEQ ID NO: 2610423 - RNA, 22 nt, Human
ccaggcagucgggggcuggccu

SEQ ID NO: 2610424 - RNA, 21 nt, Human
ccaggcagucgggggcuggcc

SEQ ID NO: 2610425 - RNA, 20 nt, Human
ccaggcagucgggggcuggc

SEQ ID NO: 2610426 - RNA, 19 nt, Human
ccaggcagucgggggcugg

SEQ ID NO: 2610427 - RNA, 17 nt, Human
ccaggcagucgggggcu

SEQ ID NO: 2610428 - RNA, 12 nt, Human
ccaggcagucgg

SEQ ID NO: 2610429 - RNA, 13 nt, Human
ccaggcauggugg

SEQ ID NO: 2610430 - RNA, 14 nt, Human
ccaggagccuccug

SEQ ID NO: 2610431 - RNA, 13 nt, Human
ccaggagccuccu

SEQ ID NO: 2610432 - RNA, 18 nt, Human
ccaggagccuccugcccu

SEQ ID NO: 2610433 - RNA, 19 nt, Human
ccaggagccuccugcccuu

SEQ ID NO: 2610434 - RNA, 23 nt, Human
ccaggagcugggcagaaggccaa

SEQ ID NO: 2610435 - RNA, 12 nt, Human
ccaggaggccag

SEQ ID NO: 2610436 - RNA, 13 nt, Human
ccaggaggccagc

SEQ ID NO: 2610437 - RNA, 14 nt, Human
ccaggaggccagcc

SEQ ID NO: 2610438 - RNA, 19 nt, Human
ccaggcaggugccuggaca

SEQ ID NO: 2610439 - RNA, 14 nt, Human
ccaggaggacugcc

SEQ ID NO: 2610440 - RNA, 16 nt, Human
ccaggagcagccacau

SEQ ID NO: 2610441 - RNA, 15 nt, Human
ccaggagcagccaca

SEQ ID NO: 2610442 - RNA, 23 nt, Human
ccaggagcauccaccuccuucuc

SEQ ID NO: 2610443 - RNA, 20 nt, Human
ccaggagcauccaccuccuu

SEQ ID NO: 2610444 - RNA, 18 nt, Human
ccaggagcauccaccucc

SEQ ID NO: 2610445 - RNA, 15 nt, Human
ccaggagccccgagg

SEQ ID NO: 2610446 - RNA, 20 nt, Human
ccaguaacgcgucuuccuga

SEQ ID NO: 2610447 - RNA, 19 nt, Human
ccaguaacgcgucuuccug

SEQ ID NO: 2610448 - RNA, 18 nt, Human
ccaguaagggaaauagaa

SEQ ID NO: 2610449 - RNA, 21 nt, Human
ccaguaacgcgucuuccugag

SEQ ID NO: 2610450 - RNA, 15 nt, Human
ccaguaacucaucug

SEQ ID NO: 2610451 - RNA, 16 nt, Human
ccaguaacucaucugu

SEQ ID NO: 2610452 - RNA, 23 nt, Human
ccagguggggugaggcagugggu

SEQ ID NO: 2610453 - RNA, 13 nt, Human
ccaggugccuugg

SEQ ID NO: 2610454 - RNA, 22 nt, Human
ccaggugcuacacccuuuucca

SEQ ID NO: 2610455 - RNA, 20 nt, Human
ccagguggggugaggcagug

SEQ ID NO: 2610456 - RNA, 23 nt, Human
ccaggugugcacguggcaugugg

SEQ ID NO: 2610457 - RNA, 16 nt, Human
ccaggugugcacgugg

SEQ ID NO: 2610458 - RNA, 22 nt, Human
ccagguguguccaccugggcau

SEQ ID NO: 2610459 - RNA, 14 nt, Human
ccagguucagcuug

SEQ ID NO: 2610460 - RNA, 17 nt, Human
ccagguguuacuguaau

SEQ ID NO: 2610461 - RNA, 21 nt, Human
ccagguguuacuguaauuccu

SEQ ID NO: 2610462 - RNA, 16 nt, Human
ccagguuaucugggca

SEQ ID NO: 2610463 - RNA, 20 nt, Human
ccagugaauucuugaaggaa

SEQ ID NO: 2610464 - RNA, 16 nt, Human
ccagugaauucuugaa

SEQ ID NO: 2610465 - RNA, 20 nt, Human
ccagugaaaucaguuacucu

SEQ ID NO: 2610466 - RNA, 22 nt, Human
ccagucuuccugacacuuuaau

SEQ ID NO: 2610467 - RNA, 15 nt, Human
ccagugaaccaaaga

SEQ ID NO: 2610468 - RNA, 21 nt, Human
ccagucuguggaucagagaug

SEQ ID NO: 2610469 - RNA, 18 nt, Human
ccaguaucuauauaugug

SEQ ID NO: 2610470 - RNA, 16 nt, Human
ccagucuguuccccau

SEQ ID NO: 2610471 - RNA, 17 nt, Human
ccagucuuccugacacu

SEQ ID NO: 2610472 - RNA, 12 nt, Human
ccagucuugugu

SEQ ID NO: 2610473 - RNA, 22 nt, Human
ccaguaccuccugucucuggcc

SEQ ID NO: 2610474 - RNA, 20 nt, Human
ccaguaccuccugucucugg

SEQ ID NO: 2610475 - RNA, 18 nt, Human
ccaguaccuccugucucu

SEQ ID NO: 2610476 - RNA, 16 nt, Human
ccaguaccuuugucac

SEQ ID NO: 2610477 - RNA, 22 nt, Human
ccaguagaccuuguuacuucug

SEQ ID NO: 2610478 - RNA, 17 nt, Human
ccaguaccuuugucaca

SEQ ID NO: 2610479 - RNA, 16 nt, Human
ccaguacgugcuaaca

SEQ ID NO: 2610480 - RNA, 13 nt, Human
ccaguaucgcuca

SEQ ID NO: 2610481 - RNA, 14 nt, Human
ccaguaucuauaua

SEQ ID NO: 2610482 - RNA, 21 nt, Human
ccaguagcuugggacaaauca

SEQ ID NO: 2610483 - RNA, 15 nt, Human
ccagguccagcucug

SEQ ID NO: 2610484 - RNA, 14 nt, Human
ccagguccagcucu

SEQ ID NO: 2610485 - RNA, 13 nt, Human
ccagguccagcuc

SEQ ID NO: 2610486 - RNA, 16 nt, Human
ccagguccacggucug

SEQ ID NO: 2610487 - RNA, 20 nt, Human
ccaggucacccuuugcugug

SEQ ID NO: 2610488 - RNA, 20 nt, Human
ccagggcuaugggagcagcu

SEQ ID NO: 2610489 - RNA, 19 nt, Human
ccagguccagcucuggagg

SEQ ID NO: 2610490 - RNA, 17 nt, Human
ccagguccagcucugga

SEQ ID NO: 2610491 - RNA, 16 nt, Human
ccagguccagcucugg

SEQ ID NO: 2610492 - RNA, 18 nt, Human
ccagguccagcucuggag

SEQ ID NO: 2610493 - RNA, 20 nt, Human
ccagggccuggaagacagag

SEQ ID NO: 2610494 - RNA, 19 nt, Human
ccagggccuggaagacaga

SEQ ID NO: 2610495 - RNA, 17 nt, Human
ccagggccuggaagaca

SEQ ID NO: 2610496 - RNA, 16 nt, Human
ccagggccuggaagac

SEQ ID NO: 2610497 - RNA, 16 nt, Human
ccagggcuagugacuu

SEQ ID NO: 2610498 - RNA, 17 nt, Human
ccagggcuauagcucag

SEQ ID NO: 2610499 - RNA, 21 nt, Human
ccagggccuggaagacagaga

SEQ ID NO: 2610500 - RNA, 19 nt, Human
ccagggcuagugacuugug

SEQ ID NO: 2610501 - RNA, 19 nt, Human
ccagggcuaugggagcagc

SEQ ID NO: 2610502 - RNA, 21 nt, Human
ccagggcuauagcucaggacc

SEQ ID NO: 2610503 - RNA, 11 nt, Human
ccagggcucag

SEQ ID NO: 2610504 - RNA, 16 nt, Human
ccagggcucagccugg

SEQ ID NO: 2610505 - RNA, 20 nt, Human
ccagggcucagccugguggg

SEQ ID NO: 2610506 - RNA, 12 nt, Human
ccagggcucagc

SEQ ID NO: 2610507 - RNA, 13 nt, Human
ccagggcucagcc

SEQ ID NO: 2610508 - RNA, 14 nt, Human
ccagggcucagccu

SEQ ID NO: 2610509 - RNA, 15 nt, Human
ccagggcucagccug

SEQ ID NO: 2610510 - RNA, 19 nt, Human
ccaggucuuggagcugagc

SEQ ID NO: 2610511 - RNA, 21 nt, Human
ccaggucuccuccaccgccau

SEQ ID NO: 2610512 - RNA, 19 nt, Human
ccaggucuccuccaccgcc

SEQ ID NO: 2610513 - RNA, 16 nt, Human
ccaggucuccuccacc

SEQ ID NO: 2610514 - RNA, 15 nt, Human
ccaggucuccuccac

SEQ ID NO: 2610515 - RNA, 14 nt, Human
ccaggucuccucca

SEQ ID NO: 2610516 - RNA, 23 nt, Human
ccaggucuuggagcugagccucu

SEQ ID NO: 2610517 - RNA, 22 nt, Human
ccaggucuuggagcugagccuc

SEQ ID NO: 2610518 - RNA, 21 nt, Human
ccaggucuuggagcugagccu

SEQ ID NO: 2610519 - RNA, 20 nt, Human
ccaggucuuggagcugagcc

SEQ ID NO: 2610520 - RNA, 14 nt, Human
ccagguccucugau

SEQ ID NO: 2610521 - RNA, 13 nt, Human
ccagguccucuga

SEQ ID NO: 2610522 - RNA, 22 nt, Human
ccagguccucugauacccagag

SEQ ID NO: 2610523 - RNA, 23 nt, Human
ccaggucucacgggcaugggcac

SEQ ID NO: 2610524 - RNA, 16 nt, Human
ccaggucucacgggca

SEQ ID NO: 2610525 - RNA, 15 nt, Human
ccaggucucacgggc

SEQ ID NO: 2610526 - RNA, 19 nt, Human
ccaggugcuaggaacacuc

SEQ ID NO: 2610527 - RNA, 13 nt, Human
ccaggugcccagc

SEQ ID NO: 2610528 - RNA, 15 nt, Human
ccaggugcccagcua

SEQ ID NO: 2610529 - RNA, 14 nt, Human
ccaggugccuugga

SEQ ID NO: 2610530 - RNA, 12 nt, Human
ccaggugccuug

SEQ ID NO: 2610531 - RNA, 17 nt, Human
ccaggugccaguuaugg

SEQ ID NO: 2610532 - RNA, 12 nt, Human
ccagggaagggg

SEQ ID NO: 2610533 - RNA, 20 nt, Human
ccaggccccgaggacccaga

SEQ ID NO: 2610534 - RNA, 19 nt, Human
ccaggccccgaggacccag

SEQ ID NO: 2610535 - RNA, 22 nt, Human
ccaggccccgaggacccagacc

SEQ ID NO: 2610536 - RNA, 21 nt, Human
ccaggccccgaggacccagac

SEQ ID NO: 2610537 - RNA, 23 nt, Human
ccaggccccgaggacccagaccc

SEQ ID NO: 2610538 - RNA, 13 nt, Human
ccaggccccugcc

SEQ ID NO: 2610539 - RNA, 16 nt, Human
ccaggccccaggaagc

SEQ ID NO: 2610540 - RNA, 17 nt, Human
ccaggccccaggaagcc

SEQ ID NO: 2610541 - RNA, 19 nt, Human
ccaggcccccaagccugca

SEQ ID NO: 2610542 - RNA, 20 nt, Human
ccaggcccccaagccugcag

SEQ ID NO: 2610543 - RNA, 21 nt, Human
ccaggcuggucucgaacuccu

SEQ ID NO: 2610544 - RNA, 19 nt, Human
ccaggcuggucucaaacuc

SEQ ID NO: 2610545 - RNA, 20 nt, Human
ccaggcuguaucccaugagc

SEQ ID NO: 2610546 - RNA, 17 nt, Human
ccaggcuugccugcagg

SEQ ID NO: 2610547 - RNA, 14 nt, Human
ccagggcagggcca

SEQ ID NO: 2610548 - RNA, 13 nt, Human
ccagggcagggcc

SEQ ID NO: 2610549 - RNA, 13 nt, Human
ccagggccacgug

SEQ ID NO: 2610550 - RNA, 17 nt, Human
ccagggccacgugccag

SEQ ID NO: 2610551 - RNA, 19 nt, Human
ccagggccacgugccaggc

SEQ ID NO: 2610552 - RNA, 21 nt, Human
ccagggccacgugccaggccc

SEQ ID NO: 2610553 - RNA, 22 nt, Human
ccagggccacgugccaggcccg

SEQ ID NO: 2610554 - RNA, 17 nt, Human
ccagggccacucugccu

SEQ ID NO: 2610555 - RNA, 19 nt, Human
ccagggccacucugccucu

SEQ ID NO: 2610556 - RNA, 20 nt, Human
ccagggccacucugccucug

SEQ ID NO: 2610557 - RNA, 17 nt, Human
ccagggaagagaaagug

SEQ ID NO: 2610558 - RNA, 17 nt, Human
ccagggaagcuggccga

SEQ ID NO: 2610559 - RNA, 18 nt, Human
ccagggaagcuggccgag

SEQ ID NO: 2610560 - RNA, 19 nt, Human
ccagggcacuucacagagu

SEQ ID NO: 2610561 - RNA, 17 nt, Human
ccagggaagcugucccu

SEQ ID NO: 2610562 - RNA, 19 nt, Human
ccaggcuuuuuuaucaugu

SEQ ID NO: 2610563 - RNA, 18 nt, Human
ccaggcuugccugcaggc

SEQ ID NO: 2610564 - RNA, 21 nt, Human
ccaggcugguuucgaacuccu

SEQ ID NO: 2610565 - RNA, 21 nt, Human
cccacaaaggagagcuagcag

SEQ ID NO: 2610566 - RNA, 18 nt, Human
ccauucugccugcccagg

SEQ ID NO: 2610567 - RNA, 17 nt, Human
ccauucugccugcccag

SEQ ID NO: 2610568 - RNA, 17 nt, Human
ccauucuccaccugcca

SEQ ID NO: 2610569 - RNA, 16 nt, Human
ccauucugccugccca

SEQ ID NO: 2610570 - RNA, 20 nt, Human
ccauucugccugcccaggcc

SEQ ID NO: 2610571 - RNA, 19 nt, Human
ccauucugccugcccaggc

SEQ ID NO: 2610572 - RNA, 14 nt, Human
ccauucuccaccug

SEQ ID NO: 2610573 - RNA, 21 nt, Human
ccauucugccugcccaggccc

SEQ ID NO: 2610574 - RNA, 16 nt, Human
ccauucuccaccugcc

SEQ ID NO: 2610575 - RNA, 15 nt, Human
ccauucuccaccugc

SEQ ID NO: 2610576 - RNA, 14 nt, Human
ccauggacuuuguu

SEQ ID NO: 2610577 - RNA, 13 nt, Human
ccauggacuuugu

SEQ ID NO: 2610578 - RNA, 20 nt, Human
ccaugcuguugauugcuaaa

SEQ ID NO: 2610579 - RNA, 22 nt, Human
ccaugcuguugauugcuaaaug

SEQ ID NO: 2610580 - RNA, 21 nt, Human
ccaugcuguugauugcuaaau

SEQ ID NO: 2610581 - RNA, 24 nt, Human
ccaugcuguugauugcuaaaugua

SEQ ID NO: 2610582 - RNA, 21 nt, Human
ccaugcugggaagacgccuga

SEQ ID NO: 2610583 - RNA, 24 nt, Human
ccaugcuggagccuguguaacagc

SEQ ID NO: 2610584 - RNA, 16 nt, Human
ccaugcuuagucacug

SEQ ID NO: 2610585 - RNA, 16 nt, Human
ccauggacaggcuggc

SEQ ID NO: 2610586 - RNA, 18 nt, Human
ccauggacaggcuggcuc

SEQ ID NO: 2610587 - RNA, 19 nt, Human
ccauggacaggcuggcucc

SEQ ID NO: 2610588 - RNA, 23 nt, Human
ccauggacuucacauaagcucag

SEQ ID NO: 2610589 - RNA, 22 nt, Human
ccauggacucuacacugugaac

SEQ ID NO: 2610590 - RNA, 17 nt, Human
ccaugcuuagucacugc

SEQ ID NO: 2610591 - RNA, 15 nt, Human
ccauggacaggcugg

SEQ ID NO: 2610592 - RNA, 15 nt, Human
ccauggacucuacac

SEQ ID NO: 2610593 - RNA, 13 nt, Human
cccaaaaggcaga

SEQ ID NO: 2610594 - RNA, 18 nt, Human
cccaaaaggcagaagcaa

SEQ ID NO: 2610595 - RNA, 20 nt, Human
cccaaacaaauaugcaaaag

SEQ ID NO: 2610596 - RNA, 22 nt, Human
cccaaaagucaaaaggugccug

SEQ ID NO: 2610597 - RNA, 23 nt, Human
cccaaaagucaaaaggugccugu

SEQ ID NO: 2610598 - RNA, 17 nt, Human
cccaaacaaauaugcaa

SEQ ID NO: 2610599 - RNA, 23 nt, Human
ccauuuuggauucuuauggacaa

SEQ ID NO: 2610600 - RNA, 20 nt, Human
ccauuuugggguacccacug

SEQ ID NO: 2610601 - RNA, 12 nt, Human
ccauucuggaag

SEQ ID NO: 2610602 - RNA, 15 nt, Human
ccauucuggaaguga

SEQ ID NO: 2610603 - RNA, 22 nt, Human
ccauuuugggguacccacugcu

SEQ ID NO: 2610604 - RNA, 15 nt, Human
cccaaagaugcagcc

SEQ ID NO: 2610605 - RNA, 12 nt, Human
cccaaagaugca

SEQ ID NO: 2610606 - RNA, 16 nt, Human
cccaaagcagugcaug

SEQ ID NO: 2610607 - RNA, 19 nt, Human
cccaaagagccuggagaag

SEQ ID NO: 2610608 - RNA, 18 nt, Human
cccaaagagccuggagaa

SEQ ID NO: 2610609 - RNA, 21 nt, Human
cccaaagaauguuuauagcaa

SEQ ID NO: 2610610 - RNA, 22 nt, Human
cccaaacaccuuccagcuccug

SEQ ID NO: 2610611 - RNA, 21 nt, Human
cccaaacaccuuccagcuccu

SEQ ID NO: 2610612 - RNA, 19 nt, Human
cccaaacaccuuccagcuc

SEQ ID NO: 2610613 - RNA, 16 nt, Human
cccaaacaccuuccag

SEQ ID NO: 2610614 - RNA, 17 nt, Human
cccaaaccaccagaagc

SEQ ID NO: 2610615 - RNA, 18 nt, Human
cccaaaccaccagaagcc

SEQ ID NO: 2610616 - RNA, 22 nt, Human
cccaaaccaccagaagcccaga

SEQ ID NO: 2610617 - RNA, 12 nt, Human
cccaaaccucca

SEQ ID NO: 2610618 - RNA, 23 nt, Human
cccaaacuguugauuauuagcca

SEQ ID NO: 2610619 - RNA, 12 nt, Human
cccaaagaagga

SEQ ID NO: 2610620 - RNA, 20 nt, Human
ccauccucuguacagagccc

SEQ ID NO: 2610621 - RNA, 12 nt, Human
ccauccagaggc

SEQ ID NO: 2610622 - RNA, 19 nt, Human
ccauccacucuacccuccc

SEQ ID NO: 2610623 - RNA, 22 nt, Human
ccauccacucuacccucccacc

SEQ ID NO: 2610624 - RNA, 13 nt, Human
ccauccaggcagu

SEQ ID NO: 2610625 - RNA, 12 nt, Human
ccauccaggcag

SEQ ID NO: 2610626 - RNA, 15 nt, Human
ccauccuccccuucc

SEQ ID NO: 2610627 - RNA, 21 nt, Human
ccauccagggaugccaucugu

SEQ ID NO: 2610628 - RNA, 17 nt, Human
ccauccuccccuucccu

SEQ ID NO: 2610629 - RNA, 18 nt, Human
ccauccuccccuucccug

SEQ ID NO: 2610630 - RNA, 21 nt, Human
ccauccuccccuucccugcaa

SEQ ID NO: 2610631 - RNA, 16 nt, Human
ccaucaucaugugugu

SEQ ID NO: 2610632 - RNA, 16 nt, Human
ccaucaguuagagcug

SEQ ID NO: 2610633 - RNA, 15 nt, Human
ccaucauaggaaggg

SEQ ID NO: 2610634 - RNA, 15 nt, Human
ccauccaaggccagg

SEQ ID NO: 2610635 - RNA, 20 nt, Human
ccauccaaauaagaaaccua

SEQ ID NO: 2610636 - RNA, 17 nt, Human
ccauccacaugggagcc

SEQ ID NO: 2610637 - RNA, 16 nt, Human
ccauccacucuacccu

SEQ ID NO: 2610638 - RNA, 23 nt, Human
ccaucaguguacccccgcccagg

SEQ ID NO: 2610639 - RNA, 22 nt, Human
ccaucaguguacccccgcccag

SEQ ID NO: 2610640 - RNA, 18 nt, Human
ccaucaguguacccccgc

SEQ ID NO: 2610641 - RNA, 17 nt, Human
ccaucagguuccauccc

SEQ ID NO: 2610642 - RNA, 12 nt, Human
ccaucagugcuc

SEQ ID NO: 2610643 - RNA, 17 nt, Human
ccaucagugcucccuca

SEQ ID NO: 2610644 - RNA, 22 nt, Human
ccaucauugaaaucuuuuugcu

SEQ ID NO: 2610645 - RNA, 19 nt, Human
ccaucagcuguaagaagag

SEQ ID NO: 2610646 - RNA, 24 nt, Human
ccaucagcuguaagaagagacugg

SEQ ID NO: 2610647 - RNA, 17 nt, Human
ccaucaggacucuugug

SEQ ID NO: 2610648 - RNA, 21 nt, Human
ccaucagcuuaggggcugcug

SEQ ID NO: 2610649 - RNA, 23 nt, Human
ccaucagaaacacccucacacug

SEQ ID NO: 2610650 - RNA, 15 nt, Human
ccaucacaugaccac

SEQ ID NO: 2610651 - RNA, 18 nt, Human
ccaucuccuuucagggaa

SEQ ID NO: 2610652 - RNA, 14 nt, Human
ccaucucgccaccc

SEQ ID NO: 2610653 - RNA, 20 nt, Human
ccaucucgccaccccuccuu

SEQ ID NO: 2610654 - RNA, 22 nt, Human
ccaucucgccaccccuccuucc

SEQ ID NO: 2610655 - RNA, 23 nt, Human
ccaucucgccaccccuccuuccu

SEQ ID NO: 2610656 - RNA, 16 nt, Human
ccaucuccuuucaggg

SEQ ID NO: 2610657 - RNA, 17 nt, Human
ccaucuccuuucaggga

SEQ ID NO: 2610658 - RNA, 23 nt, Human
ccaucugcgugacaauaaaacau

SEQ ID NO: 2610659 - RNA, 22 nt, Human
ccaucugcgugacaauaaaaca

SEQ ID NO: 2610660 - RNA, 19 nt, Human
ccauccucuguacagagcc

SEQ ID NO: 2610661 - RNA, 12 nt, Human
ccauccucugua

SEQ ID NO: 2610662 - RNA, 13 nt, Human
ccaucaccagaca

SEQ ID NO: 2610663 - RNA, 22 nt, Human
ccaucagaaacacccucacacu

SEQ ID NO: 2610664 - RNA, 20 nt, Human
ccaucacaggguugggccca

SEQ ID NO: 2610665 - RNA, 13 nt, Human
ccaucacaggguu

SEQ ID NO: 2610666 - RNA, 19 nt, Human
ccauaugaccucaugcauc

SEQ ID NO: 2610667 - RNA, 18 nt, Human
ccauaugaccucaugcau

SEQ ID NO: 2610668 - RNA, 16 nt, Human
ccauauaaguuugaag

SEQ ID NO: 2610669 - RNA, 15 nt, Human
ccauauaaguuugaa

SEQ ID NO: 2610670 - RNA, 22 nt, Human
ccauauaaguuugaaggaaaca

SEQ ID NO: 2610671 - RNA, 19 nt, Human
ccauauaaguuugaaggaa

SEQ ID NO: 2610672 - RNA, 23 nt, Human
ccauauaaguuugaaggaaacag

SEQ ID NO: 2610673 - RNA, 18 nt, Human
ccaucaaggguacacugc

SEQ ID NO: 2610674 - RNA, 13 nt, Human
ccauauccugccu

SEQ ID NO: 2610675 - RNA, 18 nt, Human
ccauauccccucuccccc

SEQ ID NO: 2610676 - RNA, 18 nt, Human
ccauauccuuacccuccu

SEQ ID NO: 2610677 - RNA, 19 nt, Human
ccagugaggcucugcccuu

SEQ ID NO: 2610678 - RNA, 18 nt, Human
ccagugaggcucugcccu

SEQ ID NO: 2610679 - RNA, 16 nt, Human
ccagugaaccaaagag

SEQ ID NO: 2610680 - RNA, 17 nt, Human
ccagugaggcucugccc

SEQ ID NO: 2610681 - RNA, 20 nt, Human
ccagugaggcucugcccuug

SEQ ID NO: 2610682 - RNA, 23 nt, Human
ccauaccuuccuucccugggcug

SEQ ID NO: 2610683 - RNA, 22 nt, Human
ccauaccacccaaugcugaugu

SEQ ID NO: 2610684 - RNA, 12 nt, Human
ccauacuaauua

SEQ ID NO: 2610685 - RNA, 13 nt, Human
ccauacuaauuau

SEQ ID NO: 2610686 - RNA, 23 nt, Human
ccauacuaauuauacccccugca

SEQ ID NO: 2610687 - RNA, 17 nt, Human
ccauacuuaucucucug

SEQ ID NO: 2610688 - RNA, 22 nt, Human
ccauacuggccucgccuggccu

SEQ ID NO: 2610689 - RNA, 21 nt, Human
ccauacuggccucgccuggcc

SEQ ID NO: 2610690 - RNA, 20 nt, Human
ccauacuggccucgccuggc

SEQ ID NO: 2610691 - RNA, 19 nt, Human
ccauacuuugucugaaaaa

SEQ ID NO: 2610692 - RNA, 18 nt, Human
ccauacuggccucgccug

SEQ ID NO: 2610693 - RNA, 17 nt, Human
ccauacuggccucgccu

SEQ ID NO: 2610694 - RNA, 14 nt, Human
ccauacuggccucg

SEQ ID NO: 2610695 - RNA, 24 nt, Human
ccauaccuuccuucccugggcugu

SEQ ID NO: 2610696 - RNA, 13 nt, Human
ccauacuggccuc

SEQ ID NO: 2610697 - RNA, 20 nt, Human
ccaugcucaucugcuggucc

SEQ ID NO: 2610698 - RNA, 18 nt, Human
ccaugcucaucugcuggu

SEQ ID NO: 2610699 - RNA, 17 nt, Human
ccaugcucaucugcugg

SEQ ID NO: 2610700 - RNA, 13 nt, Human
ccaugcugcccug

SEQ ID NO: 2610701 - RNA, 11 nt, Human
ccaugcugccc

SEQ ID NO: 2610702 - RNA, 20 nt, Human
ccaugcuggagccuguguaa

SEQ ID NO: 2610703 - RNA, 19 nt, Human
ccaugcuggagccugugua

SEQ ID NO: 2610704 - RNA, 18 nt, Human
ccaugcuggagccugugu

SEQ ID NO: 2610705 - RNA, 17 nt, Human
ccaugcuggagccugug

SEQ ID NO: 2610706 - RNA, 22 nt, Human
ccaugcuggagccuguguaaca

SEQ ID NO: 2610707 - RNA, 21 nt, Human
ccaugcuggagccuguguaac

SEQ ID NO: 2610708 - RNA, 16 nt, Human
ccaugcugggaagacg

SEQ ID NO: 2610709 - RNA, 16 nt, Human
ccaugcuggagccugu

SEQ ID NO: 2610710 - RNA, 15 nt, Human
ccaugcuggagccug

SEQ ID NO: 2610711 - RNA, 14 nt, Human
ccaugcuggagccu

SEQ ID NO: 2610712 - RNA, 13 nt, Human
ccaugcuggagcc

SEQ ID NO: 2610713 - RNA, 12 nt, Human
ccaugcuggagc

SEQ ID NO: 2610714 - RNA, 19 nt, Human
ccaugcugaggccugggcc

SEQ ID NO: 2610715 - RNA, 18 nt, Human
ccaugcugaggccugggc

SEQ ID NO: 2610716 - RNA, 20 nt, Human
ccaugcugaggccugggccg

SEQ ID NO: 2610717 - RNA, 14 nt, Human
ccaugcugcccugu

SEQ ID NO: 2610718 - RNA, 13 nt, Human
ccaugcccaccug

SEQ ID NO: 2610719 - RNA, 15 nt, Human
ccaugcccaccugcc

SEQ ID NO: 2610720 - RNA, 16 nt, Human
ccaugcccaccugccc

SEQ ID NO: 2610721 - RNA, 17 nt, Human
ccaugcccaccugccca

SEQ ID NO: 2610722 - RNA, 18 nt, Human
ccaugcccaccugcccau

SEQ ID NO: 2610723 - RNA, 21 nt, Human
ccaugcccaccugcccaucac

SEQ ID NO: 2610724 - RNA, 21 nt, Human
ccaugcacugugaaggacccu

SEQ ID NO: 2610725 - RNA, 19 nt, Human
ccaugcacugugaaggacc

SEQ ID NO: 2610726 - RNA, 20 nt, Human
ccaugcacugugaaggaccc

SEQ ID NO: 2610727 - RNA, 12 nt, Human
ccaugcagagcg

SEQ ID NO: 2610728 - RNA, 20 nt, Human
ccaugccaaagcuagggugg

SEQ ID NO: 2610729 - RNA, 16 nt, Human
ccaugcgcucagggcc

SEQ ID NO: 2610730 - RNA, 15 nt, Human
ccaugcgcucagggc

SEQ ID NO: 2610731 - RNA, 13 nt, Human
ccaugcgcucagg

SEQ ID NO: 2610732 - RNA, 22 nt, Human
ccaugcgcccccuccgcccugc

SEQ ID NO: 2610733 - RNA, 16 nt, Human
ccaugcucaucugcug

SEQ ID NO: 2610734 - RNA, 13 nt, Human
ccaugcucaucug

SEQ ID NO: 2610735 - RNA, 22 nt, Human
ccaugcgcucagggccaugcug

SEQ ID NO: 2610736 - RNA, 20 nt, Human
ccaugcguguuucugacucu

SEQ ID NO: 2610737 - RNA, 18 nt, Human
ccaugcccagcucagagg

SEQ ID NO: 2610738 - RNA, 14 nt, Human
ccaugccucagccc

SEQ ID NO: 2610739 - RNA, 12 nt, Human
ccaugccucagc

SEQ ID NO: 2610740 - RNA, 16 nt, Human
ccaugccucagcccug

SEQ ID NO: 2610741 - RNA, 15 nt, Human
ccaugccucagcccu

SEQ ID NO: 2610742 - RNA, 21 nt, Human
ccaugccucagcccugacccu

SEQ ID NO: 2610743 - RNA, 16 nt, Human
ccaugauguuuagaaa

SEQ ID NO: 2610744 - RNA, 18 nt, Human
ccaugauguuuuccauga

SEQ ID NO: 2610745 - RNA, 19 nt, Human
ccaugauuaaccacuucag

SEQ ID NO: 2610746 - RNA, 21 nt, Human
ccaugauuaaccacuucagcu

SEQ ID NO: 2610747 - RNA, 13 nt, Human
ccaugcacuguga

SEQ ID NO: 2610748 - RNA, 15 nt, Human
ccaugcacugugaag

SEQ ID NO: 2610749 - RNA, 16 nt, Human
ccaugcacugugaagg

SEQ ID NO: 2610750 - RNA, 17 nt, Human
ccaugcacugugaagga

SEQ ID NO: 2610751 - RNA, 11 nt, Human
ccaugcacugu

SEQ ID NO: 2610752 - RNA, 19 nt, Human
ccaugcaauauuuccucau

SEQ ID NO: 2610753 - RNA, 18 nt, Human
ccaugcaauauuuccuca

SEQ ID NO: 2610754 - RNA, 15 nt, Human
ccaugauguggagug

SEQ ID NO: 2610755 - RNA, 18 nt, Human
ccaugauguagugccucu

SEQ ID NO: 2610756 - RNA, 22 nt, Human
ccaugauggugcugaccucugg

SEQ ID NO: 2610757 - RNA, 19 nt, Human
ccaugauggugcugaccuc

SEQ ID NO: 2610758 - RNA, 22 nt, Human
ccaugauguggaguggggcagu

SEQ ID NO: 2610759 - RNA, 17 nt, Human
ccaugauguggaguggg

SEQ ID NO: 2610760 - RNA, 23 nt, Human
ccaugauucuauuuauauguaca

SEQ ID NO: 2610761 - RNA, 14 nt, Human
ccaugauucgccca

SEQ ID NO: 2610762 - RNA, 15 nt, Human
ccaugauggcaacag

SEQ ID NO: 2610763 - RNA, 16 nt, Human
ccaugauggcaacaga

SEQ ID NO: 2610764 - RNA, 19 nt, Human
ccaugauggcaacagaucu

SEQ ID NO: 2610765 - RNA, 21 nt, Human
ccaugauggcaacagaucugg

SEQ ID NO: 2610766 - RNA, 14 nt, Human
ccaugauggcaaca

SEQ ID NO: 2610767 - RNA, 12 nt, Human
ccaugaugcugg

SEQ ID NO: 2610768 - RNA, 14 nt, Human
ccaugaagauguag

SEQ ID NO: 2610769 - RNA, 15 nt, Human
ccaugaagacaggau

SEQ ID NO: 2610770 - RNA, 14 nt, Human
ccaugaagacagga

SEQ ID NO: 2610771 - RNA, 18 nt, Human
ccaugaagagauuuuuca

SEQ ID NO: 2610772 - RNA, 22 nt, Human
ccaugaagagauuuuucaugau

SEQ ID NO: 2610773 - RNA, 22 nt, Human
ccaucugggcuccuaaccuucc

SEQ ID NO: 2610774 - RNA, 22 nt, Human
ccaucugggaguccccuuuucu

SEQ ID NO: 2610775 - RNA, 12 nt, Human
ccaucugggcuc

SEQ ID NO: 2610776 - RNA, 18 nt, Human
ccaucuggguccuugcac

SEQ ID NO: 2610777 - RNA, 17 nt, Human
ccaucuggguccuugca

SEQ ID NO: 2610778 - RNA, 16 nt, Human
ccaucugggcuccucc

SEQ ID NO: 2610779 - RNA, 17 nt, Human
ccaucugggaguccccu

SEQ ID NO: 2610780 - RNA, 16 nt, Human
ccaucugggagucccc

SEQ ID NO: 2610781 - RNA, 14 nt, Human
ccaucuggcagggu

SEQ ID NO: 2610782 - RNA, 16 nt, Human
ccaucuggcagggugg

SEQ ID NO: 2610783 - RNA, 13 nt, Human
ccaugaagacagg

SEQ ID NO: 2610784 - RNA, 16 nt, Human
ccaugaagacaggaca

SEQ ID NO: 2610785 - RNA, 17 nt, Human
ccaugaagacaggacag

SEQ ID NO: 2610786 - RNA, 19 nt, Human
ccaugaagacaggacagug

SEQ ID NO: 2610787 - RNA, 12 nt, Human
ccaugaagacag

SEQ ID NO: 2610788 - RNA, 23 nt, Human
ccaucuggguccuugcaccccuc

SEQ ID NO: 2610789 - RNA, 22 nt, Human
ccaucuggguccuugcaccccu

SEQ ID NO: 2610790 - RNA, 18 nt, Human
cccagcaagugagagcug

SEQ ID NO: 2610791 - RNA, 16 nt, Human
cccagcaagugagagc

SEQ ID NO: 2610792 - RNA, 22 nt, Human
cccagauugcaacaggcugggc

SEQ ID NO: 2610793 - RNA, 21 nt, Human
cccagauugcaacaggcuggg

SEQ ID NO: 2610794 - RNA, 18 nt, Human
cccagauaccagccccug

SEQ ID NO: 2610795 - RNA, 14 nt, Human
cccagauaccagcc

SEQ ID NO: 2610796 - RNA, 21 nt, Human
cccagaguuuuuauguagcag

SEQ ID NO: 2610797 - RNA, 14 nt, Human
cccagaguuuuuau

SEQ ID NO: 2610798 - RNA, 16 nt, Human
cccagaucagcuccua

SEQ ID NO: 2610799 - RNA, 14 nt, Human
cccagaucccagaa

SEQ ID NO: 2610800 - RNA, 12 nt, Human
cccagauccuca

SEQ ID NO: 2610801 - RNA, 16 nt, Human
cccagaucccagaagg

SEQ ID NO: 2610802 - RNA, 18 nt, Human
cccagaucuggucccuug

SEQ ID NO: 2610803 - RNA, 19 nt, Human
cccagaucuggucccuugc

SEQ ID NO: 2610804 - RNA, 21 nt, Human
cccagauguuuuacgucuggg

SEQ ID NO: 2610805 - RNA, 19 nt, Human
cccagauguuuuacgucug

SEQ ID NO: 2610806 - RNA, 22 nt, Human
cccagauguuuuacgucuggga

SEQ ID NO: 2610807 - RNA, 21 nt, Human
cccagaugggggaaagcacag

SEQ ID NO: 2610808 - RNA, 20 nt, Human
cccagaucuggucccuugca

SEQ ID NO: 2610809 - RNA, 20 nt, Human
cccagauugcaacaggcugg

SEQ ID NO: 2610810 - RNA, 23 nt, Human
cccagagguaacagaacagcuuc

SEQ ID NO: 2610811 - RNA, 20 nt, Human
cccagagguaacagaacagc

SEQ ID NO: 2610812 - RNA, 18 nt, Human
cccagagguaacagaaca

SEQ ID NO: 2610813 - RNA, 13 nt, Human
cccagagguaaca

SEQ ID NO: 2610814 - RNA, 22 nt, Human
cccagagguaacagaacagcuu

SEQ ID NO: 2610815 - RNA, 15 nt, Human
cccagagugugaaac

SEQ ID NO: 2610816 - RNA, 17 nt, Human
cccagagugugaaacuu

SEQ ID NO: 2610817 - RNA, 16 nt, Human
cccagagugugggaag

SEQ ID NO: 2610818 - RNA, 23 nt, Human
cccagaguugcugggagcugaaa

SEQ ID NO: 2610819 - RNA, 23 nt, Human
cccagagugugggaagggagagc

SEQ ID NO: 2610820 - RNA, 16 nt, Human
cccacacucacuccug

SEQ ID NO: 2610821 - RNA, 14 nt, Human
cccacacucacucc

SEQ ID NO: 2610822 - RNA, 13 nt, Human
cccacacucacuc

SEQ ID NO: 2610823 - RNA, 14 nt, Human
cccacacuaaccug

SEQ ID NO: 2610824 - RNA, 18 nt, Human
cccagagggccugcaagg

SEQ ID NO: 2610825 - RNA, 20 nt, Human
cccagagggccugcaaggga

SEQ ID NO: 2610826 - RNA, 24 nt, Human
cccacaccuccacaguucaguggc

SEQ ID NO: 2610827 - RNA, 15 nt, Human
cccacaccuccacag

SEQ ID NO: 2610828 - RNA, 15 nt, Human
cccacaccguguaaa

SEQ ID NO: 2610829 - RNA, 13 nt, Human
cccacaccucagu

SEQ ID NO: 2610830 - RNA, 22 nt, Human
cccacaccucaguucccuuggc

SEQ ID NO: 2610831 - RNA, 22 nt, Human
cccacacggaggcaucugcacc

SEQ ID NO: 2610832 - RNA, 15 nt, Human
cccacaccucugcca

SEQ ID NO: 2610833 - RNA, 19 nt, Human
cccacaccuccacaguuca

SEQ ID NO: 2610834 - RNA, 16 nt, Human
cccacaccucugccag

SEQ ID NO: 2610835 - RNA, 23 nt, Human
cccacacggaggcaucugcaccc

SEQ ID NO: 2610836 - RNA, 15 nt, Human
cccacacacucgccc

SEQ ID NO: 2610837 - RNA, 20 nt, Human
cccacaccaggccguccucc

SEQ ID NO: 2610838 - RNA, 14 nt, Human
cccacacccagcua

SEQ ID NO: 2610839 - RNA, 12 nt, Human
cccacacccugg

SEQ ID NO: 2610840 - RNA, 18 nt, Human
cccaauuuugcagggagc

SEQ ID NO: 2610841 - RNA, 13 nt, Human
cccacaaagccuu

SEQ ID NO: 2610842 - RNA, 19 nt, Human
cccaauuaggaaguguaac

SEQ ID NO: 2610843 - RNA, 13 nt, Human
cccacacacucgc

SEQ ID NO: 2610844 - RNA, 22 nt, Human
cccacaaagccuuaucaagugu

SEQ ID NO: 2610845 - RNA, 14 nt, Human
cccacacaccccaa

SEQ ID NO: 2610846 - RNA, 14 nt, Human
cccaauuggaggaa

SEQ ID NO: 2610847 - RNA, 15 nt, Human
cccaauuucagacuc

SEQ ID NO: 2610848 - RNA, 21 nt, Human
cccaauucuuacaaacaugug

SEQ ID NO: 2610849 - RNA, 16 nt, Human
cccaauguaggagcug

SEQ ID NO: 2610850 - RNA, 14 nt, Human
cccaauuaggaagu

SEQ ID NO: 2610851 - RNA, 15 nt, Human
cccaauuaggaagug

SEQ ID NO: 2610852 - RNA, 15 nt, Human
cccaaugcugauguc

SEQ ID NO: 2610853 - RNA, 20 nt, Human
cccaaucccagcuaccucaa

SEQ ID NO: 2610854 - RNA, 16 nt, Human
cccaagugugaacaaa

SEQ ID NO: 2610855 - RNA, 23 nt, Human
cccaaguuuuaggacaaacagcu

SEQ ID NO: 2610856 - RNA, 22 nt, Human
cccaaguuuuaggacaaacagc

SEQ ID NO: 2610857 - RNA, 21 nt, Human
cccaauaaacauuaagauuga

SEQ ID NO: 2610858 - RNA, 11 nt, Human
cccaauauuau

SEQ ID NO: 2610859 - RNA, 17 nt, Human
cccaauauuauaauuuu

SEQ ID NO: 2610860 - RNA, 15 nt, Human
cccaauauuauaauu

SEQ ID NO: 2610861 - RNA, 12 nt, Human
cccaauauuaua

SEQ ID NO: 2610862 - RNA, 23 nt, Human
cccaaugcacuuuguucuggcuc

SEQ ID NO: 2610863 - RNA, 19 nt, Human
cccaaucccagcuaccuca

SEQ ID NO: 2610864 - RNA, 23 nt, Human
cccaaauggaaaugggcagagca

SEQ ID NO: 2610865 - RNA, 19 nt, Human
cccaaauuugauugauuug

SEQ ID NO: 2610866 - RNA, 17 nt, Human
cccaagggccuggccug

SEQ ID NO: 2610867 - RNA, 16 nt, Human
cccaaauuugauugau

SEQ ID NO: 2610868 - RNA, 20 nt, Human
cccaacaccagccccugccc

SEQ ID NO: 2610869 - RNA, 17 nt, Human
cccaacaccagccccug

SEQ ID NO: 2610870 - RNA, 16 nt, Human
cccaacaccagccccu

SEQ ID NO: 2610871 - RNA, 19 nt, Human
cccaagggccuggccugag

SEQ ID NO: 2610872 - RNA, 18 nt, Human
cccaagggccuggccuga

SEQ ID NO: 2610873 - RNA, 23 nt, Human
cccaagggccuggccugagcugg

SEQ ID NO: 2610874 - RNA, 15 nt, Human
cccaaguggugccua

SEQ ID NO: 2610875 - RNA, 15 nt, Human
cccaagugugaacaa

SEQ ID NO: 2610876 - RNA, 23 nt, Human
cccaagugggggcagagggcaga

SEQ ID NO: 2610877 - RNA, 19 nt, Human
cccagccccuagcccagga

SEQ ID NO: 2610878 - RNA, 18 nt, Human
cccagccccuagcccagg

SEQ ID NO: 2610879 - RNA, 17 nt, Human
cccagccccuagcccag

SEQ ID NO: 2610880 - RNA, 14 nt, Human
cccagccccuagcc

SEQ ID NO: 2610881 - RNA, 15 nt, Human
cccagccccggggug

SEQ ID NO: 2610882 - RNA, 13 nt, Human
cccagccccuagc

SEQ ID NO: 2610883 - RNA, 11 nt, Human
cccagccccuu

SEQ ID NO: 2610884 - RNA, 23 nt, Human
cccagcaagugagagcugggugu

SEQ ID NO: 2610885 - RNA, 22 nt, Human
cccagcaagugagagcugggug

SEQ ID NO: 2610886 - RNA, 21 nt, Human
cccagcaagugagagcugggu

SEQ ID NO: 2610887 - RNA, 20 nt, Human
cccagcaagugagagcuggg

SEQ ID NO: 2610888 - RNA, 19 nt, Human
cccagcaagugagagcugg

SEQ ID NO: 2610889 - RNA, 21 nt, Human
cccagccggccucucuggccu

SEQ ID NO: 2610890 - RNA, 20 nt, Human
cccagccggccucucuggcc

SEQ ID NO: 2610891 - RNA, 19 nt, Human
cccagccggccucucuggc

SEQ ID NO: 2610892 - RNA, 18 nt, Human
cccagccggccucucugg

SEQ ID NO: 2610893 - RNA, 23 nt, Human
cccagccggccucucuggccucc

SEQ ID NO: 2610894 - RNA, 22 nt, Human
cccagccggccucucuggccuc

SEQ ID NO: 2610895 - RNA, 10 nt, Human
cccagccugg

SEQ ID NO: 2610896 - RNA, 12 nt, Human
cccagccugcua

SEQ ID NO: 2610897 - RNA, 17 nt, Human
cccagccggccucucug

SEQ ID NO: 2610898 - RNA, 16 nt, Human
cccagccggccucucu

SEQ ID NO: 2610899 - RNA, 15 nt, Human
cccagccggccucuc

SEQ ID NO: 2610900 - RNA, 14 nt, Human
cccagccggccucu

SEQ ID NO: 2610901 - RNA, 17 nt, Human
cccagccgcugcccggc

SEQ ID NO: 2610902 - RNA, 14 nt, Human
cccagccgcugccc

SEQ ID NO: 2610903 - RNA, 16 nt, Human
cccagcccuguggaag

SEQ ID NO: 2610904 - RNA, 21 nt, Human
cccagcccuggucucagcagc

SEQ ID NO: 2610905 - RNA, 15 nt, Human
cccagcccuguggaa

SEQ ID NO: 2610906 - RNA, 14 nt, Human
cccagccgcucgga

SEQ ID NO: 2610907 - RNA, 21 nt, Human
cccagcccuuugggaggcuga

SEQ ID NO: 2610908 - RNA, 22 nt, Human
cccagcccuuugggaggcugag

SEQ ID NO: 2610909 - RNA, 19 nt, Human
cccagcccuggucucagca

SEQ ID NO: 2610910 - RNA, 18 nt, Human
cccagcccuggucucagc

SEQ ID NO: 2610911 - RNA, 14 nt, Human
cccagcccuggucu

SEQ ID NO: 2610912 - RNA, 18 nt, Human
cccagcccuggcucugca

SEQ ID NO: 2610913 - RNA, 16 nt, Human
cccagcccuggcucug

SEQ ID NO: 2610914 - RNA, 15 nt, Human
cccagcccuggcucu

SEQ ID NO: 2610915 - RNA, 14 nt, Human
cccagcccuggcuc

SEQ ID NO: 2610916 - RNA, 20 nt, Human
cccagccccuagcccaggag

SEQ ID NO: 2610917 - RNA, 18 nt, Human
cccagccccuucugaccc

SEQ ID NO: 2610918 - RNA, 22 nt, Human
cccagccccuagcccaggagag

SEQ ID NO: 2610919 - RNA, 21 nt, Human
cccagcuacucagaagccuga

SEQ ID NO: 2610920 - RNA, 22 nt, Human
cccagcuacucagaagccugag

SEQ ID NO: 2610921 - RNA, 23 nt, Human
cccagcuacucagaagccugagg

SEQ ID NO: 2610922 - RNA, 21 nt, Human
cccagcuacucaagaggcuga

SEQ ID NO: 2610923 - RNA, 16 nt, Human
cccagcucccccggga

SEQ ID NO: 2610924 - RNA, 15 nt, Human
cccagcuccccaaga

SEQ ID NO: 2610925 - RNA, 17 nt, Human
cccagcuccggccuguc

SEQ ID NO: 2610926 - RNA, 15 nt, Human
cccagcucccuagga

SEQ ID NO: 2610927 - RNA, 19 nt, Human
cccagcucccccgggaggg

SEQ ID NO: 2610928 - RNA, 14 nt, Human
cccagcucuagaca

SEQ ID NO: 2610929 - RNA, 23 nt, Human
cccagcucuagacaacccugcaa

SEQ ID NO: 2610930 - RNA, 17 nt, Human
cccagcuaagaaccugg

SEQ ID NO: 2610931 - RNA, 18 nt, Human
cccagcuaagaaccugga

SEQ ID NO: 2610932 - RNA, 19 nt, Human
cccagcuaagaaccuggaa

SEQ ID NO: 2610933 - RNA, 20 nt, Human
cccagcuaagaaccuggaac

SEQ ID NO: 2610934 - RNA, 16 nt, Human
cccagcuaagaaccug

SEQ ID NO: 2610935 - RNA, 20 nt, Human
cccagcggccccucccacac

SEQ ID NO: 2610936 - RNA, 19 nt, Human
cccagcggccccucccaca

SEQ ID NO: 2610937 - RNA, 18 nt, Human
cccagcggccccucccac

SEQ ID NO: 2610938 - RNA, 14 nt, Human
cccagcuaauuuuu

SEQ ID NO: 2610939 - RNA, 23 nt, Human
cccagcuaaucuguagggcugga

SEQ ID NO: 2610940 - RNA, 20 nt, Human
cccagcuaaucuguagggcu

SEQ ID NO: 2610941 - RNA, 19 nt, Human
cccagcuaaucuguagggc

SEQ ID NO: 2610942 - RNA, 18 nt, Human
cccagcuaaucuguaggg

SEQ ID NO: 2610943 - RNA, 22 nt, Human
cccagcuaagaaccuggaacuu

SEQ ID NO: 2610944 - RNA, 17 nt, Human
cccagcuacucagaagc

SEQ ID NO: 2610945 - RNA, 22 nt, Human
cccagcuaccucaaccaaugcc

SEQ ID NO: 2610946 - RNA, 22 nt, Human
cccagcuacccuuuuucuccag

SEQ ID NO: 2610947 - RNA, 14 nt, Human
cccagcuaccucaa

SEQ ID NO: 2610948 - RNA, 14 nt, Human
cccagccuggccca

SEQ ID NO: 2610949 - RNA, 13 nt, Human
cccagccuggccc

SEQ ID NO: 2610950 - RNA, 12 nt, Human
cccagccuggcc

SEQ ID NO: 2610951 - RNA, 15 nt, Human
cccagcgagcccugg

SEQ ID NO: 2610952 - RNA, 18 nt, Human
cccagcgagcccuggugg

SEQ ID NO: 2610953 - RNA, 17 nt, Human
cccagcgagcccuggug

SEQ ID NO: 2610954 - RNA, 23 nt, Human
cccagcgagcccugguggcagug

SEQ ID NO: 2610955 - RNA, 19 nt, Human
cccagcgagcccugguggc

SEQ ID NO: 2610956 - RNA, 16 nt, Human
cccagccuggcccagc

SEQ ID NO: 2610957 - RNA, 15 nt, Human
cccagccuggcccag

SEQ ID NO: 2610958 - RNA, 14 nt, Human
cccagcggccccuc

SEQ ID NO: 2610959 - RNA, 15 nt, Human
cccagcggccccucc

SEQ ID NO: 2610960 - RNA, 23 nt, Human
cccagggucuucccuaccucagg

SEQ ID NO: 2610961 - RNA, 16 nt, Human
cccagggucuucccua

SEQ ID NO: 2610962 - RNA, 18 nt, Human
cccagggucuucccuacc

SEQ ID NO: 2610963 - RNA, 23 nt, Human
cccaggguagcccgccugccagu

SEQ ID NO: 2610964 - RNA, 22 nt, Human
cccaggguagcccgccugccag

SEQ ID NO: 2610965 - RNA, 21 nt, Human
cccaggguagcccgccugcca

SEQ ID NO: 2610966 - RNA, 19 nt, Human
cccaggguagcccgccugc

SEQ ID NO: 2610967 - RNA, 15 nt, Human
cccagggucuucccu

SEQ ID NO: 2610968 - RNA, 17 nt, Human
cccaggguagcccgccu

SEQ ID NO: 2610969 - RNA, 16 nt, Human
cccaggguagcccgcc

SEQ ID NO: 2610970 - RNA, 15 nt, Human
cccaggguagcccgc

SEQ ID NO: 2610971 - RNA, 13 nt, Human
cccaggguagccc

SEQ ID NO: 2610972 - RNA, 23 nt, Human
cccaggggugcccccuccucucc

SEQ ID NO: 2610973 - RNA, 22 nt, Human
cccaggggugcccccuccucuc

SEQ ID NO: 2610974 - RNA, 21 nt, Human
cccaggggugcccccuccucu

SEQ ID NO: 2610975 - RNA, 19 nt, Human
cccaggggugcccccuccu

SEQ ID NO: 2610976 - RNA, 18 nt, Human
cccaggggugcccccucc

SEQ ID NO: 2610977 - RNA, 17 nt, Human
cccaggggugcccccuc

SEQ ID NO: 2610978 - RNA, 20 nt, Human
cccaggggucccagccaccc

SEQ ID NO: 2610979 - RNA, 18 nt, Human
cccaggggcccacaggga

SEQ ID NO: 2610980 - RNA, 21 nt, Human
cccaggggcuggcuucaggag

SEQ ID NO: 2610981 - RNA, 15 nt, Human
cccaggggucccagc

SEQ ID NO: 2610982 - RNA, 16 nt, Human
cccaggggucccagcc

SEQ ID NO: 2610983 - RNA, 18 nt, Human
cccaggggucccagccac

SEQ ID NO: 2610984 - RNA, 19 nt, Human
cccaggggucccagccacc

SEQ ID NO: 2610985 - RNA, 19 nt, Human
cccaggggagcccuccacg

SEQ ID NO: 2610986 - RNA, 22 nt, Human
cccaggggcauguauuggccug

SEQ ID NO: 2610987 - RNA, 17 nt, Human
cccaggggcccacaggg

SEQ ID NO: 2610988 - RNA, 23 nt, Human
cccaggggcauguauuggccugg

SEQ ID NO: 2610989 - RNA, 15 nt, Human
cccaggggagagggu

SEQ ID NO: 2610990 - RNA, 21 nt, Human
cccaggggagagggucuggag

SEQ ID NO: 2610991 - RNA, 22 nt, Human
cccaggggagagggucuggaga

SEQ ID NO: 2610992 - RNA, 23 nt, Human
cccaggggagagggucuggagaa

SEQ ID NO: 2610993 - RNA, 16 nt, Human
cccaggggagcccucc

SEQ ID NO: 2610994 - RNA, 15 nt, Human
cccaggggagcccuc

SEQ ID NO: 2610995 - RNA, 14 nt, Human
cccaggggagcccu

SEQ ID NO: 2610996 - RNA, 24 nt, Human
cccaggggagagggucuggagaag

SEQ ID NO: 2610997 - RNA, 23 nt, Human
cccaggcgggagcgguggcccug

SEQ ID NO: 2610998 - RNA, 22 nt, Human
cccaggcgggagcgguggcccu

SEQ ID NO: 2610999 - RNA, 13 nt, Human
cccaggcgggagc

SEQ ID NO: 2611000 - RNA, 14 nt, Human
cccaggcugagccu

SEQ ID NO: 2611001 - RNA, 17 nt, Human
cccaggggaccacaccu

SEQ ID NO: 2611002 - RNA, 13 nt, Human
cccaggggagagg

SEQ ID NO: 2611003 - RNA, 18 nt, Human
cccaggcgccccuucccc

SEQ ID NO: 2611004 - RNA, 16 nt, Human
cccaggccugccuguu

SEQ ID NO: 2611005 - RNA, 15 nt, Human
cccaggccugccugu

SEQ ID NO: 2611006 - RNA, 13 nt, Human
cccaggccucugu

SEQ ID NO: 2611007 - RNA, 18 nt, Human
cccaggccuccuacagcu

SEQ ID NO: 2611008 - RNA, 17 nt, Human
cccaggccuccuacagc

SEQ ID NO: 2611009 - RNA, 23 nt, Human
cccaggccccgaggacccagacc

SEQ ID NO: 2611010 - RNA, 22 nt, Human
cccaggccccgaggacccagac

SEQ ID NO: 2611011 - RNA, 14 nt, Human
cccaggccgcagcu

SEQ ID NO: 2611012 - RNA, 13 nt, Human
cccaggccgcagc

SEQ ID NO: 2611013 - RNA, 18 nt, Human
cccaggccgagaagccag

SEQ ID NO: 2611014 - RNA, 21 nt, Human
cccaggccgcagcucuugccc

SEQ ID NO: 2611015 - RNA, 17 nt, Human
cccaggccgcagcucuu

SEQ ID NO: 2611016 - RNA, 16 nt, Human
cccaggccgcagcucu

SEQ ID NO: 2611017 - RNA, 21 nt, Human
cccaggccgggguggagcaug

SEQ ID NO: 2611018 - RNA, 18 nt, Human
cccaggccgcagcucuug

SEQ ID NO: 2611019 - RNA, 15 nt, Human
cccaggccguggcug

SEQ ID NO: 2611020 - RNA, 18 nt, Human
cccaguccccaccccugc

SEQ ID NO: 2611021 - RNA, 15 nt, Human
cccaguccccacccc

SEQ ID NO: 2611022 - RNA, 14 nt, Human
cccaguccccaccc

SEQ ID NO: 2611023 - RNA, 13 nt, Human
cccaguccccacc

SEQ ID NO: 2611024 - RNA, 22 nt, Human
cccagucagccucucucccagu

SEQ ID NO: 2611025 - RNA, 23 nt, Human
cccaguccaaauguccuccagaa

SEQ ID NO: 2611026 - RNA, 21 nt, Human
cccagucagccucucucccag

SEQ ID NO: 2611027 - RNA, 20 nt, Human
cccagucagccucucuccca

SEQ ID NO: 2611028 - RNA, 19 nt, Human
cccaguccaaauguccucc

SEQ ID NO: 2611029 - RNA, 19 nt, Human
cccagucagccucucuccc

SEQ ID NO: 2611030 - RNA, 18 nt, Human
cccagucagccucucucc

SEQ ID NO: 2611031 - RNA, 17 nt, Human
cccagucagccucucuc

SEQ ID NO: 2611032 - RNA, 16 nt, Human
cccagucagccucucu

SEQ ID NO: 2611033 - RNA, 15 nt, Human
cccagucagccucuc

SEQ ID NO: 2611034 - RNA, 14 nt, Human
cccagucagccucu

SEQ ID NO: 2611035 - RNA, 13 nt, Human
cccagucagccuc

SEQ ID NO: 2611036 - RNA, 16 nt, Human
cccaguagaccuuguu

SEQ ID NO: 2611037 - RNA, 23 nt, Human
cccaguauucuagguagugcccu

SEQ ID NO: 2611038 - RNA, 20 nt, Human
cccagucuggaaugcagugg

SEQ ID NO: 2611039 - RNA, 20 nt, Human
cccaguccccaccccugccc

SEQ ID NO: 2611040 - RNA, 19 nt, Human
cccaguccccaccccugcc

SEQ ID NO: 2611041 - RNA, 17 nt, Human
cccagucuguuccccau

SEQ ID NO: 2611042 - RNA, 12 nt, Human
cccagugacacu

SEQ ID NO: 2611043 - RNA, 13 nt, Human
cccagugacacuu

SEQ ID NO: 2611044 - RNA, 18 nt, Human
cccagugacacuucagag

SEQ ID NO: 2611045 - RNA, 13 nt, Human
cccagugcccaca

SEQ ID NO: 2611046 - RNA, 21 nt, Human
cccagugagcacucccaaguc

SEQ ID NO: 2611047 - RNA, 19 nt, Human
cccagugagcacucccaag

SEQ ID NO: 2611048 - RNA, 19 nt, Human
cccagugagauuacagagg

SEQ ID NO: 2611049 - RNA, 19 nt, Human
cccagugacacuucagaga

SEQ ID NO: 2611050 - RNA, 22 nt, Human
cccagugacacuucagagagcu

SEQ ID NO: 2611051 - RNA, 23 nt, Human
cccaggugcuaggaacacuccuu

SEQ ID NO: 2611052 - RNA, 18 nt, Human
cccagguggcugacccag

SEQ ID NO: 2611053 - RNA, 19 nt, Human
cccagguggcugacccagu

SEQ ID NO: 2611054 - RNA, 22 nt, Human
cccagguggcugacccaguccc

SEQ ID NO: 2611055 - RNA, 23 nt, Human
cccagguggcugacccagucccu

SEQ ID NO: 2611056 - RNA, 16 nt, Human
cccagguggcugaccc

SEQ ID NO: 2611057 - RNA, 13 nt, Human
cccaggugccagu

SEQ ID NO: 2611058 - RNA, 22 nt, Human
cccaggugcuaggaacacuccu

SEQ ID NO: 2611059 - RNA, 22 nt, Human
cccaggguggacuuagaaagca

SEQ ID NO: 2611060 - RNA, 17 nt, Human
cccagguccagcucugg

SEQ ID NO: 2611061 - RNA, 18 nt, Human
cccagguccagcucugga

SEQ ID NO: 2611062 - RNA, 13 nt, Human
cccagguccucac

SEQ ID NO: 2611063 - RNA, 20 nt, Human
cccagguccucugauaccca

SEQ ID NO: 2611064 - RNA, 15 nt, Human
cccagguccucugau

SEQ ID NO: 2611065 - RNA, 22 nt, Human
cccaggccccugccacccuggg

SEQ ID NO: 2611066 - RNA, 21 nt, Human
cccaggccccugccacccugg

SEQ ID NO: 2611067 - RNA, 18 nt, Human
cccaggccccugccaccc

SEQ ID NO: 2611068 - RNA, 16 nt, Human
cccaggccccugccac

SEQ ID NO: 2611069 - RNA, 11 nt, Human
cccaggccccu

SEQ ID NO: 2611070 - RNA, 13 nt, Human
cccaggccccagg

SEQ ID NO: 2611071 - RNA, 17 nt, Human
cccaggccccaggaagc

SEQ ID NO: 2611072 - RNA, 18 nt, Human
cccaggccccaggaagcc

SEQ ID NO: 2611073 - RNA, 21 nt, Human
cccaggccaucuuccaggugg

SEQ ID NO: 2611074 - RNA, 20 nt, Human
cccaggccaucuuccaggug

SEQ ID NO: 2611075 - RNA, 18 nt, Human
cccaggccaucuuccagg

SEQ ID NO: 2611076 - RNA, 14 nt, Human
cccaggccaucuuc

SEQ ID NO: 2611077 - RNA, 22 nt, Human
cccaggccaucuuccagguggg

SEQ ID NO: 2611078 - RNA, 20 nt, Human
cccaggccaggccaccagga

SEQ ID NO: 2611079 - RNA, 17 nt, Human
cccaggccaggccacca

SEQ ID NO: 2611080 - RNA, 22 nt, Human
cccaggccaggccaccaggaug

SEQ ID NO: 2611081 - RNA, 18 nt, Human
cccaggccaggcuccuuc

SEQ ID NO: 2611082 - RNA, 19 nt, Human
cccaggccaggcuccuucc

SEQ ID NO: 2611083 - RNA, 21 nt, Human
cccaggccaggcuccuuccug

SEQ ID NO: 2611084 - RNA, 14 nt, Human
cccaggccaguaag

SEQ ID NO: 2611085 - RNA, 23 nt, Human
cccaggccaggcuccuuccuguc

SEQ ID NO: 2611086 - RNA, 13 nt, Human
cccaggccaggcc

SEQ ID NO: 2611087 - RNA, 14 nt, Human
cccaggcauugcca

SEQ ID NO: 2611088 - RNA, 21 nt, Human
cccaggcauugccaagggcuu

SEQ ID NO: 2611089 - RNA, 23 nt, Human
cccaggcauuccccaggaggcca

SEQ ID NO: 2611090 - RNA, 22 nt, Human
cccaggcauuccccaggaggcc

SEQ ID NO: 2611091 - RNA, 21 nt, Human
cccaggcauuccccaggaggc

SEQ ID NO: 2611092 - RNA, 20 nt, Human
cccaggcauuccccaggagg

SEQ ID NO: 2611093 - RNA, 17 nt, Human
cccaggcaggucuugaa

SEQ ID NO: 2611094 - RNA, 23 nt, Human
cccaggcagggccaacccuucuc

SEQ ID NO: 2611095 - RNA, 15 nt, Human
cccaggcagggccaa

SEQ ID NO: 2611096 - RNA, 18 nt, Human
cccaggcauuccccagga

SEQ ID NO: 2611097 - RNA, 20 nt, Human
cccaggcaaaucaguuacua

SEQ ID NO: 2611098 - RNA, 23 nt, Human
cccaggaucagauugcaugugac

SEQ ID NO: 2611099 - RNA, 14 nt, Human
cccaggcaggccac

SEQ ID NO: 2611100 - RNA, 13 nt, Human
cccaggcaggcug

SEQ ID NO: 2611101 - RNA, 13 nt, Human
cccaggcaggucu

SEQ ID NO: 2611102 - RNA, 11 nt, Human
cccaggcaggu

SEQ ID NO: 2611103 - RNA, 22 nt, Human
cccaggaguuugaggcugcagc

SEQ ID NO: 2611104 - RNA, 23 nt, Human
cccaggaguuugaggcugcagcg

SEQ ID NO: 2611105 - RNA, 18 nt, Human
cccaggagccccgaggcc

SEQ ID NO: 2611106 - RNA, 12 nt, Human
cccagcucuccc

SEQ ID NO: 2611107 - RNA, 13 nt, Human
cccagcucucccu

SEQ ID NO: 2611108 - RNA, 14 nt, Human
cccagcucucccuc

SEQ ID NO: 2611109 - RNA, 15 nt, Human
cccagcucucccucu

SEQ ID NO: 2611110 - RNA, 16 nt, Human
cccagcucucccucug

SEQ ID NO: 2611111 - RNA, 17 nt, Human
cccagcucucccucugg

SEQ ID NO: 2611112 - RNA, 18 nt, Human
cccagcucucccucuggc

SEQ ID NO: 2611113 - RNA, 19 nt, Human
cccagcucucccucuggcc

SEQ ID NO: 2611114 - RNA, 17 nt, Human
cccaggagcugcccaga

SEQ ID NO: 2611115 - RNA, 21 nt, Human
cccaggagccccgaggccuuc

SEQ ID NO: 2611116 - RNA, 22 nt, Human
cccaggaggccagccuugacca

SEQ ID NO: 2611117 - RNA, 13 nt, Human
cccaggaggccag

SEQ ID NO: 2611118 - RNA, 14 nt, Human
cccaggagggaggg

SEQ ID NO: 2611119 - RNA, 18 nt, Human
cccaggagggagggggcu

SEQ ID NO: 2611120 - RNA, 22 nt, Human
cccaggaguggaggaggccugg

SEQ ID NO: 2611121 - RNA, 23 nt, Human
cccaggagguggagguugcagug

SEQ ID NO: 2611122 - RNA, 24 nt, Human
cccaggaguucgaggcugcaguca

SEQ ID NO: 2611123 - RNA, 22 nt, Human
ccccucagggucccugguggca

SEQ ID NO: 2611124 - RNA, 17 nt, Human
ccccaggaggccagccu

SEQ ID NO: 2611125 - RNA, 14 nt, Human
cccaguggcugcug

SEQ ID NO: 2611126 - RNA, 20 nt, Human
cccagugcccacaggaucag

SEQ ID NO: 2611127 - RNA, 15 nt, Human
cccagugcccacagg

SEQ ID NO: 2611128 - RNA, 18 nt, Human
cccagugccgagaaggaa

SEQ ID NO: 2611129 - RNA, 17 nt, Human
cccagugccgagaagga

SEQ ID NO: 2611130 - RNA, 16 nt, Human
cccaugcugcccugug

SEQ ID NO: 2611131 - RNA, 15 nt, Human
cccaugcugcccugu

SEQ ID NO: 2611132 - RNA, 16 nt, Human
cccaguggccacucag

SEQ ID NO: 2611133 - RNA, 22 nt, Human
cccagugccaagcacagugccu

SEQ ID NO: 2611134 - RNA, 14 nt, Human
cccagugcacccac

SEQ ID NO: 2611135 - RNA, 15 nt, Human
cccagugcacccacu

SEQ ID NO: 2611136 - RNA, 18 nt, Human
cccaugcugcccugugag

SEQ ID NO: 2611137 - RNA, 17 nt, Human
cccaugcugcccuguga

SEQ ID NO: 2611138 - RNA, 13 nt, Human
cccauggagccag

SEQ ID NO: 2611139 - RNA, 14 nt, Human
cccauggagcccca

SEQ ID NO: 2611140 - RNA, 13 nt, Human
cccauggagcccc

SEQ ID NO: 2611141 - RNA, 19 nt, Human
cccauggagccagcucccu

SEQ ID NO: 2611142 - RNA, 19 nt, Human
cccaguggccucaacccuc

SEQ ID NO: 2611143 - RNA, 21 nt, Human
cccaguggccucaacccuccc

SEQ ID NO: 2611144 - RNA, 22 nt, Human
cccaguggccacucagcuuccu

SEQ ID NO: 2611145 - RNA, 17 nt, Human
cccaguggccacucagc

SEQ ID NO: 2611146 - RNA, 13 nt, Human
cccaguggccuca

SEQ ID NO: 2611147 - RNA, 18 nt, Human
cccaguggccucaacccu

SEQ ID NO: 2611148 - RNA, 14 nt, Human
cccauuccugggaa

SEQ ID NO: 2611149 - RNA, 19 nt, Human
cccauucuacacagagcag

SEQ ID NO: 2611150 - RNA, 18 nt, Human
cccauucuacacagagca

SEQ ID NO: 2611151 - RNA, 18 nt, Human
cccauuccugaagaacca

SEQ ID NO: 2611152 - RNA, 21 nt, Human
cccauucgguguggugcagug

SEQ ID NO: 2611153 - RNA, 20 nt, Human
cccaugggcacugcugggug

SEQ ID NO: 2611154 - RNA, 18 nt, Human
cccaugggcacugcuggg

SEQ ID NO: 2611155 - RNA, 17 nt, Human
cccaugggcacugcugg

SEQ ID NO: 2611156 - RNA, 16 nt, Human
cccaugggcacugcug

SEQ ID NO: 2611157 - RNA, 21 nt, Human
cccaugggcacugcugggugg

SEQ ID NO: 2611158 - RNA, 14 nt, Human
cccaugggcucuga

SEQ ID NO: 2611159 - RNA, 21 nt, Human
cccaugggaagacgaggcccu

SEQ ID NO: 2611160 - RNA, 17 nt, Human
cccauggcuuaaugcuu

SEQ ID NO: 2611161 - RNA, 21 nt, Human
cccauggagccccagcccccu

SEQ ID NO: 2611162 - RNA, 15 nt, Human
cccaugggcacugcu

SEQ ID NO: 2611163 - RNA, 22 nt, Human
cccaugggaagacgaggcccuc

SEQ ID NO: 2611164 - RNA, 17 nt, Human
cccauggcccucccagu

SEQ ID NO: 2611165 - RNA, 16 nt, Human
cccauggagccccagc

SEQ ID NO: 2611166 - RNA, 15 nt, Human
cccauggagccccag

SEQ ID NO: 2611167 - RNA, 13 nt, Human
ccccaaggcugcg

SEQ ID NO: 2611168 - RNA, 17 nt, Human
ccccaagcuguuuucuu

SEQ ID NO: 2611169 - RNA, 15 nt, Human
ccccaaggagggaga

SEQ ID NO: 2611170 - RNA, 13 nt, Human
ccccaagccuggc

SEQ ID NO: 2611171 - RNA, 14 nt, Human
ccccaagccuggca

SEQ ID NO: 2611172 - RNA, 14 nt, Human
ccccaagcuguuuu

SEQ ID NO: 2611173 - RNA, 16 nt, Human
ccccaagcuguuuucu

SEQ ID NO: 2611174 - RNA, 16 nt, Human
ccccaagaaagccuca

SEQ ID NO: 2611175 - RNA, 23 nt, Human
ccccaagacuugguguccuuucc

SEQ ID NO: 2611176 - RNA, 20 nt, Human
ccccacccaagggccuggcc

SEQ ID NO: 2611177 - RNA, 14 nt, Human
ccccacccaagggc

SEQ ID NO: 2611178 - RNA, 20 nt, Human
ccccacccaagcuuggcagc

SEQ ID NO: 2611179 - RNA, 19 nt, Human
ccccacccaagcuuggcag

SEQ ID NO: 2611180 - RNA, 18 nt, Human
ccccacccaagcuuggca

SEQ ID NO: 2611181 - RNA, 16 nt, Human
ccccacccaagcuugg

SEQ ID NO: 2611182 - RNA, 17 nt, Human
ccccacccccuccccag

SEQ ID NO: 2611183 - RNA, 23 nt, Human
ccccacccccuccccaggggaga

SEQ ID NO: 2611184 - RNA, 12 nt, Human
ccccacccccuu

SEQ ID NO: 2611185 - RNA, 17 nt, Human
ccccacccccuucagug

SEQ ID NO: 2611186 - RNA, 23 nt, Human
ccccaccccggggacccugugac

SEQ ID NO: 2611187 - RNA, 19 nt, Human
ccccaccccggggacccug

SEQ ID NO: 2611188 - RNA, 21 nt, Human
ccccacccccuucagugccca

SEQ ID NO: 2611189 - RNA, 12 nt, Human
ccccaacagugu

SEQ ID NO: 2611190 - RNA, 19 nt, Human
ccccaacaucucccuccca

SEQ ID NO: 2611191 - RNA, 22 nt, Human
ccccaacaucucccucccacau

SEQ ID NO: 2611192 - RNA, 20 nt, Human
ccccaacagcgacauagccc

SEQ ID NO: 2611193 - RNA, 22 nt, Human
ccccaacacugugcccuggugg

SEQ ID NO: 2611194 - RNA, 22 nt, Human
ccccaacagcgacauagcccau

SEQ ID NO: 2611195 - RNA, 21 nt, Human
ccccaacacugugcccuggug

SEQ ID NO: 2611196 - RNA, 20 nt, Human
ccccaacacugugcccuggu

SEQ ID NO: 2611197 - RNA, 19 nt, Human
ccccaacacugugcccugg

SEQ ID NO: 2611198 - RNA, 18 nt, Human
ccccaacacugugcccug

SEQ ID NO: 2611199 - RNA, 17 nt, Human
ccccaacacugugcccu

SEQ ID NO: 2611200 - RNA, 16 nt, Human
ccccaacacugugccc

SEQ ID NO: 2611201 - RNA, 19 nt, Human
cccauucucucuccugucc

SEQ ID NO: 2611202 - RNA, 21 nt, Human
cccauucugccuccauucuga

SEQ ID NO: 2611203 - RNA, 22 nt, Human
ccccaaauggaaaugggcagag

SEQ ID NO: 2611204 - RNA, 13 nt, Human
cccauucugccug

SEQ ID NO: 2611205 - RNA, 17 nt, Human
cccauucucucuccugu

SEQ ID NO: 2611206 - RNA, 18 nt, Human
cccauucucucuccuguc

SEQ ID NO: 2611207 - RNA, 20 nt, Human
cccauucucucuccugucca

SEQ ID NO: 2611208 - RNA, 16 nt, Human
cggccuccauccugag

SEQ ID NO: 2611209 - RNA, 17 nt, Human
cggccuccauccugagg

SEQ ID NO: 2611210 - RNA, 22 nt, Human
cggccccugcauccccuuggcu

SEQ ID NO: 2611211 - RNA, 15 nt, Human
cggccccucccgccc

SEQ ID NO: 2611212 - RNA, 17 nt, Human
cggccccgucuguggcu

SEQ ID NO: 2611213 - RNA, 19 nt, Human
cggccccggccccagccag

SEQ ID NO: 2611214 - RNA, 15 nt, Human
cggccccggccccag

SEQ ID NO: 2611215 - RNA, 14 nt, Human
cggccccggcccca

SEQ ID NO: 2611216 - RNA, 18 nt, Human
cggcccccuggucucugg

SEQ ID NO: 2611217 - RNA, 17 nt, Human
cggcccccuccaucggg

SEQ ID NO: 2611218 - RNA, 15 nt, Human
cggcccccuggucuc

SEQ ID NO: 2611219 - RNA, 20 nt, Human
cggcccccgcgcgcgucccc

SEQ ID NO: 2611220 - RNA, 22 nt, Human
cggccccagccagaguuccugc

SEQ ID NO: 2611221 - RNA, 16 nt, Human
cggccccagccagagu

SEQ ID NO: 2611222 - RNA, 14 nt, Human
cggccccagccaga

SEQ ID NO: 2611223 - RNA, 12 nt, Human
cggccccagcca

SEQ ID NO: 2611224 - RNA, 21 nt, Human
cggcccccagagcgccccucc

SEQ ID NO: 2611225 - RNA, 18 nt, Human
cggcccccagagcgcccc

SEQ ID NO: 2611226 - RNA, 17 nt, Human
cggcccaggauggcuuu

SEQ ID NO: 2611227 - RNA, 19 nt, Human
cggcaggggccuggagauc

SEQ ID NO: 2611228 - RNA, 18 nt, Human
cggcaggggccuggagau

SEQ ID NO: 2611229 - RNA, 17 nt, Human
cggcaggggccuggaga

SEQ ID NO: 2611230 - RNA, 15 nt, Human
cggcaggggccugga

SEQ ID NO: 2611231 - RNA, 20 nt, Human
cggcccauccccaggcaccu

SEQ ID NO: 2611232 - RNA, 20 nt, Human
cggcagguucacaggcgagg

SEQ ID NO: 2611233 - RNA, 17 nt, Human
cggcagguucacaggcg

SEQ ID NO: 2611234 - RNA, 16 nt, Human
cggcaguucugggugc

SEQ ID NO: 2611235 - RNA, 20 nt, Human
cggcaguucugggugcuccc

SEQ ID NO: 2611236 - RNA, 18 nt, Human
cggcuggccuggccccuc

SEQ ID NO: 2611237 - RNA, 14 nt, Human
cggcuggccuggcc

SEQ ID NO: 2611238 - RNA, 16 nt, Human
cggcuggccuggcccc

SEQ ID NO: 2611239 - RNA, 15 nt, Human
cggcuggccuggccc

SEQ ID NO: 2611240 - RNA, 13 nt, Human
cggccuggcuccu

SEQ ID NO: 2611241 - RNA, 19 nt, Human
cggccugcucccagcagcc

SEQ ID NO: 2611242 - RNA, 18 nt, Human
cggccugcucccagcagc

SEQ ID NO: 2611243 - RNA, 15 nt, Human
cggccugcucccagc

SEQ ID NO: 2611244 - RNA, 12 nt, Human
cggccuguccuc

SEQ ID NO: 2611245 - RNA, 15 nt, Human
cggccuguccuccaa

SEQ ID NO: 2611246 - RNA, 15 nt, Human
cggccuuuggcuuca

SEQ ID NO: 2611247 - RNA, 21 nt, Human
cggccuguccuccaacaccaa

SEQ ID NO: 2611248 - RNA, 15 nt, Human
cggccugguguucug

SEQ ID NO: 2611249 - RNA, 19 nt, Human
cggccuucaacugaaaaga

SEQ ID NO: 2611250 - RNA, 13 nt, Human
cggccugcuccca

SEQ ID NO: 2611251 - RNA, 14 nt, Human
cggccugcucccag

SEQ ID NO: 2611252 - RNA, 17 nt, Human
cggccugaugcucccuc

SEQ ID NO: 2611253 - RNA, 19 nt, Human
cggccugaugcucccuccc

SEQ ID NO: 2611254 - RNA, 23 nt, Human
cggccugaugcucccuccccugc

SEQ ID NO: 2611255 - RNA, 14 nt, Human
cggccucccaaagu

SEQ ID NO: 2611256 - RNA, 22 nt, Human
cgggagccugaucaccugcccu

SEQ ID NO: 2611257 - RNA, 21 nt, Human
cgggagccugaucaccugccc

SEQ ID NO: 2611258 - RNA, 20 nt, Human
cgggaggauguucugggaca

SEQ ID NO: 2611259 - RNA, 22 nt, Human
cgggaggcggagcuugcaguga

SEQ ID NO: 2611260 - RNA, 19 nt, Human
cgggaggcugagacaggag

SEQ ID NO: 2611261 - RNA, 18 nt, Human
cgggaggcugagacagga

SEQ ID NO: 2611262 - RNA, 17 nt, Human
cgggaggcugagacagg

SEQ ID NO: 2611263 - RNA, 16 nt, Human
cgggaggcugagacag

SEQ ID NO: 2611264 - RNA, 20 nt, Human
cgggagcgguggcccugucc

SEQ ID NO: 2611265 - RNA, 17 nt, Human
cgggagcgguggcccug

SEQ ID NO: 2611266 - RNA, 13 nt, Human
cgggaggcugaga

SEQ ID NO: 2611267 - RNA, 16 nt, Human
cggcugucucagacuc

SEQ ID NO: 2611268 - RNA, 23 nt, Human
cggcugguuuuguaagaugcugg

SEQ ID NO: 2611269 - RNA, 22 nt, Human
cggcugguuuuguaagaugcug

SEQ ID NO: 2611270 - RNA, 17 nt, Human
cggcugguuuuguaaga

SEQ ID NO: 2611271 - RNA, 17 nt, Human
cggcugggcacacgccu

SEQ ID NO: 2611272 - RNA, 16 nt, Human
cggcugggcacacgcc

SEQ ID NO: 2611273 - RNA, 20 nt, Human
cggcugggcacacgccuccc

SEQ ID NO: 2611274 - RNA, 12 nt, Human
cggcugggcaca

SEQ ID NO: 2611275 - RNA, 15 nt, Human
cgggcagcacagcaa

SEQ ID NO: 2611276 - RNA, 19 nt, Human
cgggaggggcccgcuugcc

SEQ ID NO: 2611277 - RNA, 17 nt, Human
cgggaggucgaggcagg

SEQ ID NO: 2611278 - RNA, 16 nt, Human
cgggaggucgaggcag

SEQ ID NO: 2611279 - RNA, 20 nt, Human
cgggaggcugagacaggaga

SEQ ID NO: 2611280 - RNA, 23 nt, Human
cgggaggcugagacaggagaauc

SEQ ID NO: 2611281 - RNA, 15 nt, Human
cgggaggggcccgcu

SEQ ID NO: 2611282 - RNA, 14 nt, Human
cgggaggggcccgc

SEQ ID NO: 2611283 - RNA, 12 nt, Human
cgggcaugacac

SEQ ID NO: 2611284 - RNA, 15 nt, Human
cgggcaugacacgaa

SEQ ID NO: 2611285 - RNA, 15 nt, Human
cgggcaugggcacuc

SEQ ID NO: 2611286 - RNA, 15 nt, Human
cggggagggugacag

SEQ ID NO: 2611287 - RNA, 17 nt, Human
cggggaguuucuuuccu

SEQ ID NO: 2611288 - RNA, 23 nt, Human
cggggaggccaagugcaggcugg

SEQ ID NO: 2611289 - RNA, 22 nt, Human
cggggagggugacaguggccgc

SEQ ID NO: 2611290 - RNA, 13 nt, Human
cggaccccagcug

SEQ ID NO: 2611291 - RNA, 12 nt, Human
cggaccccagcu

SEQ ID NO: 2611292 - RNA, 15 nt, Human
cggacacuccuagag

SEQ ID NO: 2611293 - RNA, 14 nt, Human
cggacacuccuaga

SEQ ID NO: 2611294 - RNA, 16 nt, Human
cggacacuccuagaga

SEQ ID NO: 2611295 - RNA, 14 nt, Human
cggaccuuucagcu

SEQ ID NO: 2611296 - RNA, 22 nt, Human
cggaccccagcugugagccuug

SEQ ID NO: 2611297 - RNA, 21 nt, Human
cggaccuuggcagcccaggcc

SEQ ID NO: 2611298 - RNA, 20 nt, Human
cggaccccagcugugagccu

SEQ ID NO: 2611299 - RNA, 14 nt, Human
cggaccccagcugu

SEQ ID NO: 2611300 - RNA, 16 nt, Human
cggacguuuccaucag

SEQ ID NO: 2611301 - RNA, 15 nt, Human
cggacguuuccauca

SEQ ID NO: 2611302 - RNA, 16 nt, Human
cggacguuccagccgg

SEQ ID NO: 2611303 - RNA, 15 nt, Human
cggacguuccagccg

SEQ ID NO: 2611304 - RNA, 14 nt, Human
cggacguuccagcc

SEQ ID NO: 2611305 - RNA, 15 nt, Human
cggaucuguugcaaa

SEQ ID NO: 2611306 - RNA, 16 nt, Human
cggaucugagaaucuu

SEQ ID NO: 2611307 - RNA, 14 nt, Human
cggaucugagaauc

SEQ ID NO: 2611308 - RNA, 19 nt, Human
cggaucuuuggacagaagc

SEQ ID NO: 2611309 - RNA, 21 nt, Human
cggacuaagccuaccugcucu

SEQ ID NO: 2611310 - RNA, 20 nt, Human
cggacuaagccuaccugcuc

SEQ ID NO: 2611311 - RNA, 18 nt, Human
cggacguuuccaucaggu

SEQ ID NO: 2611312 - RNA, 16 nt, Human
cggaucuuuggacaga

SEQ ID NO: 2611313 - RNA, 14 nt, Human
cggauccugggugg

SEQ ID NO: 2611314 - RNA, 23 nt, Human
cggcaaccccaguucugcuccuc

SEQ ID NO: 2611315 - RNA, 22 nt, Human
cggcaaccccaguucugcuccu

SEQ ID NO: 2611316 - RNA, 21 nt, Human
cggcaaccccaguucugcucc

SEQ ID NO: 2611317 - RNA, 20 nt, Human
cggcaaccccaguucugcuc

SEQ ID NO: 2611318 - RNA, 19 nt, Human
cggcaaccccaguucugcu

SEQ ID NO: 2611319 - RNA, 17 nt, Human
cggcaaccccaguucug

SEQ ID NO: 2611320 - RNA, 16 nt, Human
cggauuuauuuuucca

SEQ ID NO: 2611321 - RNA, 15 nt, Human
cggauuuggggugga

SEQ ID NO: 2611322 - RNA, 12 nt, Human
cggcaacaucaa

SEQ ID NO: 2611323 - RNA, 22 nt, Human
cggauuauuuuuucagaccgaa

SEQ ID NO: 2611324 - RNA, 20 nt, Human
cggauuauuuuuucagaccg

SEQ ID NO: 2611325 - RNA, 19 nt, Human
cggauuauuuuuucagacc

SEQ ID NO: 2611326 - RNA, 18 nt, Human
cggauuauuuuuucagac

SEQ ID NO: 2611327 - RNA, 17 nt, Human
cggauuauuuuuucaga

SEQ ID NO: 2611328 - RNA, 16 nt, Human
cggauuauuuuuucag

SEQ ID NO: 2611329 - RNA, 14 nt, Human
cggauuauuuuuuc

SEQ ID NO: 2611330 - RNA, 13 nt, Human
cggaugugcuuuu

SEQ ID NO: 2611331 - RNA, 24 nt, Human
cggauuccaaagaguagaauugca

SEQ ID NO: 2611332 - RNA, 23 nt, Human
cggauuggcuuguguguuucacu

SEQ ID NO: 2611333 - RNA, 23 nt, Human
cggauuauuuuuucagaccgaaa

SEQ ID NO: 2611334 - RNA, 14 nt, Human
cggcaggggccugg

SEQ ID NO: 2611335 - RNA, 22 nt, Human
cggcaggcucacugccaggcca

SEQ ID NO: 2611336 - RNA, 20 nt, Human
cggcaggcucacugccaggc

SEQ ID NO: 2611337 - RNA, 23 nt, Human
cggcaggcucacugccaggccag

SEQ ID NO: 2611338 - RNA, 19 nt, Human
cggcaggcucacugccagg

SEQ ID NO: 2611339 - RNA, 18 nt, Human
cggcaggcucacugccag

SEQ ID NO: 2611340 - RNA, 17 nt, Human
cggcaggcucacugcca

SEQ ID NO: 2611341 - RNA, 14 nt, Human
cggcaggcucacug

SEQ ID NO: 2611342 - RNA, 22 nt, Human
cggcaggacaacgaggaagccc

SEQ ID NO: 2611343 - RNA, 18 nt, Human
cggcacagggucugcucu

SEQ ID NO: 2611344 - RNA, 14 nt, Human
cggcacagggucug

SEQ ID NO: 2611345 - RNA, 16 nt, Human
cggcaauuuccggcca

SEQ ID NO: 2611346 - RNA, 20 nt, Human
cggaaugaaccacaucuugc

SEQ ID NO: 2611347 - RNA, 17 nt, Human
cggaacugcaugcugcu

SEQ ID NO: 2611348 - RNA, 18 nt, Human
cggaacugcaugcugcug

SEQ ID NO: 2611349 - RNA, 16 nt, Human
cggaacugcaugcugc

SEQ ID NO: 2611350 - RNA, 20 nt, Human
cggaaagcagcucaaaggca

SEQ ID NO: 2611351 - RNA, 20 nt, Human
cggaagaccugaagaguggu

SEQ ID NO: 2611352 - RNA, 21 nt, Human
cggaauccuguccucagcuuc

SEQ ID NO: 2611353 - RNA, 18 nt, Human
cggaauccuguccucagc

SEQ ID NO: 2611354 - RNA, 18 nt, Human
cggacagccacggccagg

SEQ ID NO: 2611355 - RNA, 16 nt, Human
cggacagccacggcca

SEQ ID NO: 2611356 - RNA, 15 nt, Human
cggacagccacggcc

SEQ ID NO: 2611357 - RNA, 13 nt, Human
cggacaaguuuua

SEQ ID NO: 2611358 - RNA, 14 nt, Human
cggacacccccucg

SEQ ID NO: 2611359 - RNA, 12 nt, Human
cggacacccccu

SEQ ID NO: 2611360 - RNA, 20 nt, Human
cggaaccgcccaggaucaga

SEQ ID NO: 2611361 - RNA, 19 nt, Human
cggaacccaagcuuagaac

SEQ ID NO: 2611362 - RNA, 17 nt, Human
cggaacccaagcuuaga

SEQ ID NO: 2611363 - RNA, 15 nt, Human
cggaacaagccuaaa

SEQ ID NO: 2611364 - RNA, 12 nt, Human
cggaaagcagcu

SEQ ID NO: 2611365 - RNA, 13 nt, Human
cggaaagcagcuc

SEQ ID NO: 2611366 - RNA, 20 nt, Human
cgcucggaggccccaaagga

SEQ ID NO: 2611367 - RNA, 19 nt, Human
cgcucggaggccccaaagg

SEQ ID NO: 2611368 - RNA, 16 nt, Human
cgcucggaggccccaa

SEQ ID NO: 2611369 - RNA, 15 nt, Human
cgcucggaggcccca

SEQ ID NO: 2611370 - RNA, 14 nt, Human
cgcucggaggcccc

SEQ ID NO: 2611371 - RNA, 12 nt, Human
cgcucggaggcc

SEQ ID NO: 2611372 - RNA, 21 nt, Human
cgcucgcuuccgcauccuagu

SEQ ID NO: 2611373 - RNA, 17 nt, Human
cggaaaccuugguguag

SEQ ID NO: 2611374 - RNA, 17 nt, Human
cgcucuccuuucuuucu

SEQ ID NO: 2611375 - RNA, 21 nt, Human
cgcuccugucugccagccagc

SEQ ID NO: 2611376 - RNA, 17 nt, Human
cgcuccugucugccagc

SEQ ID NO: 2611377 - RNA, 20 nt, Human
cgcuccugucugccagccag

SEQ ID NO: 2611378 - RNA, 13 nt, Human
cgcuccugugucu

SEQ ID NO: 2611379 - RNA, 17 nt, Human
cgcuauugucaccaggg

SEQ ID NO: 2611380 - RNA, 16 nt, Human
cgcuccugucugccag

SEQ ID NO: 2611381 - RNA, 18 nt, Human
cgcucagcaugcauccuu

SEQ ID NO: 2611382 - RNA, 13 nt, Human
cgcagaagcagac

SEQ ID NO: 2611383 - RNA, 17 nt, Human
cgcacuuuccuccuggc

SEQ ID NO: 2611384 - RNA, 13 nt, Human
cgcacacacacaa

SEQ ID NO: 2611385 - RNA, 13 nt, Human
cgcacacacacac

SEQ ID NO: 2611386 - RNA, 11 nt, Human
cgcaaugugac

SEQ ID NO: 2611387 - RNA, 16 nt, Human
cgcacaaggcugacca

SEQ ID NO: 2611388 - RNA, 21 nt, Human
cgcacaaggcugaccaagaga

SEQ ID NO: 2611389 - RNA, 22 nt, Human
cgcacaauaguaaccuggguaa

SEQ ID NO: 2611390 - RNA, 10 nt, Human
cgcacacaca

SEQ ID NO: 2611391 - RNA, 20 nt, Human
cgcaaugugcccccagacgc

SEQ ID NO: 2611392 - RNA, 18 nt, Human
cgcaaugugcccccagac

SEQ ID NO: 2611393 - RNA, 12 nt, Human
cgauuucuguuu

SEQ ID NO: 2611394 - RNA, 23 nt, Human
cgauugcaggagucccugccauc

SEQ ID NO: 2611395 - RNA, 13 nt, Human
cgauuggcuuuaa

SEQ ID NO: 2611396 - RNA, 15 nt, Human
cgcaagucugcagcc

SEQ ID NO: 2611397 - RNA, 14 nt, Human
cgcaagucugcagc

SEQ ID NO: 2611398 - RNA, 20 nt, Human
cgcaagccuguaaucccagc

SEQ ID NO: 2611399 - RNA, 21 nt, Human
cgcaagccuguaaucccagcu

SEQ ID NO: 2611400 - RNA, 18 nt, Human
cgauuuaauucucuugaa

SEQ ID NO: 2611401 - RNA, 15 nt, Human
cgauuuaauucucuu

SEQ ID NO: 2611402 - RNA, 14 nt, Human
cgauuuaauucucu

SEQ ID NO: 2611403 - RNA, 15 nt, Human
cgauuggcuuuaaac

SEQ ID NO: 2611404 - RNA, 19 nt, Human
cgauucuucugcuucagcc

SEQ ID NO: 2611405 - RNA, 13 nt, Human
cgauucuucugcu

SEQ ID NO: 2611406 - RNA, 11 nt, Human
cgauucuggau

SEQ ID NO: 2611407 - RNA, 21 nt, Human
cgauugcaggagucccugcca

SEQ ID NO: 2611408 - RNA, 21 nt, Human
cgauucuucugcuucagccuc

SEQ ID NO: 2611409 - RNA, 19 nt, Human
cgaucuggguucacugcaa

SEQ ID NO: 2611410 - RNA, 17 nt, Human
cgaucucuuauuuuaca

SEQ ID NO: 2611411 - RNA, 21 nt, Human
cgaugaauuuggagacucugu

SEQ ID NO: 2611412 - RNA, 19 nt, Human
cgaucggggcacugcaggg

SEQ ID NO: 2611413 - RNA, 13 nt, Human
cgauccuuccucc

SEQ ID NO: 2611414 - RNA, 22 nt, Human
cgauccaccugucucagccucc

SEQ ID NO: 2611415 - RNA, 19 nt, Human
cgaucgcggcggagcuggc

SEQ ID NO: 2611416 - RNA, 20 nt, Human
cgagcucguguauccugggg

SEQ ID NO: 2611417 - RNA, 19 nt, Human
cgagcucguguauccuggg

SEQ ID NO: 2611418 - RNA, 18 nt, Human
cgagcucguguauccugg

SEQ ID NO: 2611419 - RNA, 23 nt, Human
cgagcgcuuucuggaaaagagga

SEQ ID NO: 2611420 - RNA, 17 nt, Human
cgagcucguguauccug

SEQ ID NO: 2611421 - RNA, 18 nt, Human
cgagcgcuuucuggaaaa

SEQ ID NO: 2611422 - RNA, 19 nt, Human
ccuuuguauauuauuucua

SEQ ID NO: 2611423 - RNA, 14 nt, Human
ccuuuguauauuau

SEQ ID NO: 2611424 - RNA, 12 nt, Human
ccuuuguauauu

SEQ ID NO: 2611425 - RNA, 22 nt, Human
cgagcucguguauccuggggcu

SEQ ID NO: 2611426 - RNA, 21 nt, Human
cgagcucguguauccuggggc

SEQ ID NO: 2611427 - RNA, 15 nt, Human
cgagcuggauguccc

SEQ ID NO: 2611428 - RNA, 12 nt, Human
cgagcugggggc

SEQ ID NO: 2611429 - RNA, 13 nt, Human
cgagcugggggcc

SEQ ID NO: 2611430 - RNA, 15 nt, Human
cgagcugggggccau

SEQ ID NO: 2611431 - RNA, 16 nt, Human
cgagcugggggccaug

SEQ ID NO: 2611432 - RNA, 20 nt, Human
cgagcugggggccaugagcu

SEQ ID NO: 2611433 - RNA, 23 nt, Human
cgagcugggggccaugagcucca

SEQ ID NO: 2611434 - RNA, 13 nt, Human
cgagcuggugcau

SEQ ID NO: 2611435 - RNA, 14 nt, Human
cgagcuggugcauu

SEQ ID NO: 2611436 - RNA, 15 nt, Human
cgagcuggugcauua

SEQ ID NO: 2611437 - RNA, 21 nt, Human
cgagcuggugcauuacagaga

SEQ ID NO: 2611438 - RNA, 23 nt, Human
cgagcuggugcauuacagagagg

SEQ ID NO: 2611439 - RNA, 18 nt, Human
ccuuuguauucucuccug

SEQ ID NO: 2611440 - RNA, 20 nt, Human
ccuuuguauucucuccugua

SEQ ID NO: 2611441 - RNA, 15 nt, Human
ccuuuguauucucuc

SEQ ID NO: 2611442 - RNA, 19 nt, Human
ccuuuggcucuggagacag

SEQ ID NO: 2611443 - RNA, 16 nt, Human
ccuuuggcucuggaga

SEQ ID NO: 2611444 - RNA, 15 nt, Human
ccuuuggcucuggag

SEQ ID NO: 2611445 - RNA, 14 nt, Human
ccuuuggcucugga

SEQ ID NO: 2611446 - RNA, 23 nt, Human
ccuuuguaaauugucagaugcug

SEQ ID NO: 2611447 - RNA, 12 nt, Human
cgaggacaggga

SEQ ID NO: 2611448 - RNA, 14 nt, Human
cgaggaaacucaga

SEQ ID NO: 2611449 - RNA, 14 nt, Human
cgagcuuuucuaaa

SEQ ID NO: 2611450 - RNA, 22 nt, Human
cgagcuggugcauuacagagag

SEQ ID NO: 2611451 - RNA, 14 nt, Human
cgaggaaccagagc

SEQ ID NO: 2611452 - RNA, 15 nt, Human
cgaggaaccagagcc

SEQ ID NO: 2611453 - RNA, 16 nt, Human
cgaggaaccagagcca

SEQ ID NO: 2611454 - RNA, 13 nt, Human
cgaggacagggag

SEQ ID NO: 2611455 - RNA, 19 nt, Human
cgaggaaccagagccaugg

SEQ ID NO: 2611456 - RNA, 11 nt, Human
cgaggaagccc

SEQ ID NO: 2611457 - RNA, 19 nt, Human
cgaggccuucucugaagga

SEQ ID NO: 2611458 - RNA, 18 nt, Human
cgaggccuucucugaagg

SEQ ID NO: 2611459 - RNA, 22 nt, Human
cgaggcugcccacuauggucau

SEQ ID NO: 2611460 - RNA, 13 nt, Human
cgagggaugaugc

SEQ ID NO: 2611461 - RNA, 15 nt, Human
cgaggcuggagcugg

SEQ ID NO: 2611462 - RNA, 16 nt, Human
cgaggcuggagcuggc

SEQ ID NO: 2611463 - RNA, 20 nt, Human
cgauccaccugucucagccu

SEQ ID NO: 2611464 - RNA, 23 nt, Human
ccuuugaagaggaaaaugaauaa

SEQ ID NO: 2611465 - RNA, 14 nt, Human
ccuuugaagaggaa

SEQ ID NO: 2611466 - RNA, 13 nt, Human
ccuuugaagagga

SEQ ID NO: 2611467 - RNA, 14 nt, Human
ccuuugaauccucu

SEQ ID NO: 2611468 - RNA, 16 nt, Human
ccuuugaauccucucu

SEQ ID NO: 2611469 - RNA, 12 nt, Human
ccuuugaagagg

SEQ ID NO: 2611470 - RNA, 23 nt, Human
ccuuucuuuuucuucuucccucc

SEQ ID NO: 2611471 - RNA, 17 nt, Human
ccuuucuuuuucuucuu

SEQ ID NO: 2611472 - RNA, 16 nt, Human
ccuuucuuuuucuucu

SEQ ID NO: 2611473 - RNA, 15 nt, Human
ccuuucuuuuucuuc

SEQ ID NO: 2611474 - RNA, 18 nt, Human
ccuuucuugguucauaaa

SEQ ID NO: 2611475 - RNA, 13 nt, Human
ccuuucuugguuc

SEQ ID NO: 2611476 - RNA, 13 nt, Human
ccuuucuuggcca

SEQ ID NO: 2611477 - RNA, 15 nt, Human
ccuuucuuggccagu

SEQ ID NO: 2611478 - RNA, 14 nt, Human
ccuuugacaaaggu

SEQ ID NO: 2611479 - RNA, 23 nt, Human
ccuuugacgccaucccagcccca

SEQ ID NO: 2611480 - RNA, 22 nt, Human
ccuuugagcccacaaagccuua

SEQ ID NO: 2611481 - RNA, 19 nt, Human
ccuuugagacaguuucuua

SEQ ID NO: 2611482 - RNA, 17 nt, Human
ccuuugagacaguuucu

SEQ ID NO: 2611483 - RNA, 15 nt, Human
ccuuugagacaguuu

SEQ ID NO: 2611484 - RNA, 13 nt, Human
ccuuugagacagu

SEQ ID NO: 2611485 - RNA, 20 nt, Human
ccuuugaauccucucucugu

SEQ ID NO: 2611486 - RNA, 19 nt, Human
ccuuugagugcaguccuga

SEQ ID NO: 2611487 - RNA, 22 nt, Human
ccuuugagugcaguccugauca

SEQ ID NO: 2611488 - RNA, 21 nt, Human
ccuuugauuaaagacuccagu

SEQ ID NO: 2611489 - RNA, 17 nt, Human
ccuuugauaaaauaaau

SEQ ID NO: 2611490 - RNA, 22 nt, Human
ccuuugaguuuccucaggcugc

SEQ ID NO: 2611491 - RNA, 19 nt, Human
ccuuugcugaggccuccag

SEQ ID NO: 2611492 - RNA, 16 nt, Human
ccuuugcccagaaaga

SEQ ID NO: 2611493 - RNA, 21 nt, Human
ccuuugccccaccuuuauuaa

SEQ ID NO: 2611494 - RNA, 13 nt, Human
ccuuugcaggcau

SEQ ID NO: 2611495 - RNA, 15 nt, Human
ccuuugcauggagug

SEQ ID NO: 2611496 - RNA, 12 nt, Human
ccuuugcaggca

SEQ ID NO: 2611497 - RNA, 18 nt, Human
ccuuugcacugagggcca

SEQ ID NO: 2611498 - RNA, 17 nt, Human
ccuuugcacugagggcc

SEQ ID NO: 2611499 - RNA, 19 nt, Human
ccuuugcacugagggccac

SEQ ID NO: 2611500 - RNA, 16 nt, Human
ccuuugcacugagggc

SEQ ID NO: 2611501 - RNA, 14 nt, Human
ccuuugcacugagg

SEQ ID NO: 2611502 - RNA, 13 nt, Human
ccuuugcacugag

SEQ ID NO: 2611503 - RNA, 23 nt, Human
ccuuugcugugaggcuguccugu

SEQ ID NO: 2611504 - RNA, 22 nt, Human
ccuuugcugugaggcuguccug

SEQ ID NO: 2611505 - RNA, 17 nt, Human
ccuuugcugugaggcug

SEQ ID NO: 2611506 - RNA, 13 nt, Human
ccuuugcugugag

SEQ ID NO: 2611507 - RNA, 16 nt, Human
ccuuugcuugaaagaa

SEQ ID NO: 2611508 - RNA, 19 nt, Human
ccuuuggcaggugcagccc

SEQ ID NO: 2611509 - RNA, 20 nt, Human
ccuuuggcaggugcagcccc

SEQ ID NO: 2611510 - RNA, 12 nt, Human
ccuuuggcucug

SEQ ID NO: 2611511 - RNA, 19 nt, Human
ccuuuggaugaccagaaca

SEQ ID NO: 2611512 - RNA, 15 nt, Human
ccuuuggccauucca

SEQ ID NO: 2611513 - RNA, 14 nt, Human
ccuuuggagaccau

SEQ ID NO: 2611514 - RNA, 16 nt, Human
ccuuuggaugaccaga

SEQ ID NO: 2611515 - RNA, 18 nt, Human
ccuuuggcaggugcagcc

SEQ ID NO: 2611516 - RNA, 15 nt, Human
ccuuuggcagaguuc

SEQ ID NO: 2611517 - RNA, 19 nt, Human
ccuuguggucccaccccac

SEQ ID NO: 2611518 - RNA, 16 nt, Human
ccuuguggucccaccc

SEQ ID NO: 2611519 - RNA, 20 nt, Human
ccuuguggucccaccccaca

SEQ ID NO: 2611520 - RNA, 23 nt, Human
ccuugugucuacagagaaccugg

SEQ ID NO: 2611521 - RNA, 19 nt, Human
ccuuggcucccauucacuc

SEQ ID NO: 2611522 - RNA, 13 nt, Human
ccuuggcugcagg

SEQ ID NO: 2611523 - RNA, 12 nt, Human
ccuuggcugcag

SEQ ID NO: 2611524 - RNA, 12 nt, Human
ccuuggcucaga

SEQ ID NO: 2611525 - RNA, 15 nt, Human
ccuuggcucagacau

SEQ ID NO: 2611526 - RNA, 18 nt, Human
ccuuggcucaauccucua

SEQ ID NO: 2611527 - RNA, 22 nt, Human
ccuuggcucaauccucuaagcu

SEQ ID NO: 2611528 - RNA, 17 nt, Human
ccuuggcaugccuucca

SEQ ID NO: 2611529 - RNA, 20 nt, Human
ccuuggcaugccuuccagca

SEQ ID NO: 2611530 - RNA, 18 nt, Human
ccuuggccagaagucaag

SEQ ID NO: 2611531 - RNA, 21 nt, Human
ccuuggcaugccuuccagcac

SEQ ID NO: 2611532 - RNA, 13 nt, Human
ccuuuaagagaaa

SEQ ID NO: 2611533 - RNA, 23 nt, Human
ccuuuaaaguaugaaucuaugcc

SEQ ID NO: 2611534 - RNA, 22 nt, Human
ccuuuaaaguaugaaucuaugc

SEQ ID NO: 2611535 - RNA, 18 nt, Human
ccuuuaaaguaugaaucu

SEQ ID NO: 2611536 - RNA, 20 nt, Human
ccuuuaaaaaaauuuaagug

SEQ ID NO: 2611537 - RNA, 12 nt, Human
ccuuuaaaauuu

SEQ ID NO: 2611538 - RNA, 21 nt, Human
ccuuuaaaauuuuuuuagaaa

SEQ ID NO: 2611539 - RNA, 20 nt, Human
ccuuuaaaauuuuuuuagaa

SEQ ID NO: 2611540 - RNA, 17 nt, Human
ccuuguguguaugugua

SEQ ID NO: 2611541 - RNA, 15 nt, Human
ccuuguguguaugug

SEQ ID NO: 2611542 - RNA, 15 nt, Human
ccuuguuacuucuga

SEQ ID NO: 2611543 - RNA, 17 nt, Human
ccuuucucuucucuguu

SEQ ID NO: 2611544 - RNA, 14 nt, Human
ccuuucuggcucuc

SEQ ID NO: 2611545 - RNA, 13 nt, Human
ccuuucugugugc

SEQ ID NO: 2611546 - RNA, 11 nt, Human
ccuuucugugu

SEQ ID NO: 2611547 - RNA, 20 nt, Human
ccuuucuccccugcccccag

SEQ ID NO: 2611548 - RNA, 14 nt, Human
ccuuucuccuuugu

SEQ ID NO: 2611549 - RNA, 17 nt, Human
ccuuucucgauuuuauc

SEQ ID NO: 2611550 - RNA, 15 nt, Human
ccuuucuccuuugua

SEQ ID NO: 2611551 - RNA, 14 nt, Human
cgcagacaggacca

SEQ ID NO: 2611552 - RNA, 13 nt, Human
cgcagacaggacc

SEQ ID NO: 2611553 - RNA, 17 nt, Human
cgcagacaccuuggaca

SEQ ID NO: 2611554 - RNA, 15 nt, Human
cgcccagcugcaccu

SEQ ID NO: 2611555 - RNA, 11 nt, Human
cgcccaggaga

SEQ ID NO: 2611556 - RNA, 23 nt, Human
cgcccagcugcaccugccagccu

SEQ ID NO: 2611557 - RNA, 18 nt, Human
cgcccagcugcaccugcc

SEQ ID NO: 2611558 - RNA, 20 nt, Human
cgcccagcugcaccugccag

SEQ ID NO: 2611559 - RNA, 19 nt, Human
cgcccaggcuggagugcaa

SEQ ID NO: 2611560 - RNA, 20 nt, Human
cgcccaggcuggagugcaau

SEQ ID NO: 2611561 - RNA, 12 nt, Human
cgcccaggcugg

SEQ ID NO: 2611562 - RNA, 17 nt, Human
cgcccaggaucagauug

SEQ ID NO: 2611563 - RNA, 15 nt, Human
cgcccaggagacauc

SEQ ID NO: 2611564 - RNA, 15 nt, Human
cgcccccacugguga

SEQ ID NO: 2611565 - RNA, 12 nt, Human
cgccccagccuc

SEQ ID NO: 2611566 - RNA, 23 nt, Human
cgcccaggaucagauugcaugug

SEQ ID NO: 2611567 - RNA, 14 nt, Human
cgccccagccucug

SEQ ID NO: 2611568 - RNA, 14 nt, Human
cgcccccaccucca

SEQ ID NO: 2611569 - RNA, 12 nt, Human
cgcccccaccuc

SEQ ID NO: 2611570 - RNA, 17 nt, Human
cgcgacaaugcaaacca

SEQ ID NO: 2611571 - RNA, 16 nt, Human
cgcgacaaugcaaacc

SEQ ID NO: 2611572 - RNA, 14 nt, Human
cgcccugccacuca

SEQ ID NO: 2611573 - RNA, 11 nt, Human
cgcccugccac

SEQ ID NO: 2611574 - RNA, 17 nt, Human
cgcccucuguccugacu

SEQ ID NO: 2611575 - RNA, 16 nt, Human
cgcccucuguccugac

SEQ ID NO: 2611576 - RNA, 14 nt, Human
cgcccucuguccug

SEQ ID NO: 2611577 - RNA, 17 nt, Human
cgcccccuccgcccugc

SEQ ID NO: 2611578 - RNA, 23 nt, Human
cgcccccggguuuggcgggccaa

SEQ ID NO: 2611579 - RNA, 22 nt, Human
cgcccccaguccccaccccugc

SEQ ID NO: 2611580 - RNA, 18 nt, Human
cgcccccaguccccaccc

SEQ ID NO: 2611581 - RNA, 20 nt, Human
cgcccccuccgcccugccac

SEQ ID NO: 2611582 - RNA, 19 nt, Human
cgcccccuccgcccugcca

SEQ ID NO: 2611583 - RNA, 14 nt, Human
cgcccccuccucua

SEQ ID NO: 2611584 - RNA, 12 nt, Human
cgcccccugccc

SEQ ID NO: 2611585 - RNA, 20 nt, Human
cgcccuccccuccccugcug

SEQ ID NO: 2611586 - RNA, 18 nt, Human
cgcccuccccuccccugc

SEQ ID NO: 2611587 - RNA, 16 nt, Human
cgcccuccccuccccu

SEQ ID NO: 2611588 - RNA, 14 nt, Human
cgcccuccccuccc

SEQ ID NO: 2611589 - RNA, 22 nt, Human
cgcccuccccuccccugcugca

SEQ ID NO: 2611590 - RNA, 17 nt, Human
cgcccguccugccugug

SEQ ID NO: 2611591 - RNA, 12 nt, Human
cgcccucccagg

SEQ ID NO: 2611592 - RNA, 13 nt, Human
cgcccucccaggc

SEQ ID NO: 2611593 - RNA, 14 nt, Human
cgcuaagagggagg

SEQ ID NO: 2611594 - RNA, 16 nt, Human
cgcuaagagggaggga

SEQ ID NO: 2611595 - RNA, 15 nt, Human
cgcuaagagggaggg

SEQ ID NO: 2611596 - RNA, 21 nt, Human
cgcuaagagggagggagggcu

SEQ ID NO: 2611597 - RNA, 23 nt, Human
cgcguguguggguggauauaaau

SEQ ID NO: 2611598 - RNA, 23 nt, Human
cgcuagaugggcauggggugggc

SEQ ID NO: 2611599 - RNA, 20 nt, Human
cgcuagaugggcauggggug

SEQ ID NO: 2611600 - RNA, 17 nt, Human
cgcuagaggccugagga

SEQ ID NO: 2611601 - RNA, 15 nt, Human
cgcuagaggccugag

SEQ ID NO: 2611602 - RNA, 14 nt, Human
cgcuagaggccuga

SEQ ID NO: 2611603 - RNA, 13 nt, Human
cgcuagaggccug

SEQ ID NO: 2611604 - RNA, 20 nt, Human
cgcgugcacacaccagagcc

SEQ ID NO: 2611605 - RNA, 19 nt, Human
cgcgugcccucgcugcuuc

SEQ ID NO: 2611606 - RNA, 21 nt, Human
cgcgucuccuguuuuucuggg

SEQ ID NO: 2611607 - RNA, 19 nt, Human
cgcgugcacguggagagcu

SEQ ID NO: 2611608 - RNA, 19 nt, Human
cgcgugcacacaccagagc

SEQ ID NO: 2611609 - RNA, 16 nt, Human
cgcgugcacacaccag

SEQ ID NO: 2611610 - RNA, 15 nt, Human
cgcgacuaauuucaa

SEQ ID NO: 2611611 - RNA, 12 nt, Human
cgcccugccacu

SEQ ID NO: 2611612 - RNA, 22 nt, Human
cgcgacuaauuucaaaaugcuu

SEQ ID NO: 2611613 - RNA, 16 nt, Human
cgcgucuuccugagug

SEQ ID NO: 2611614 - RNA, 14 nt, Human
cgcgucuuccugag

SEQ ID NO: 2611615 - RNA, 13 nt, Human
cgcgucuuccuga

SEQ ID NO: 2611616 - RNA, 12 nt, Human
cgcgucuuccug

SEQ ID NO: 2611617 - RNA, 13 nt, Human
cgcgucuccuguu

SEQ ID NO: 2611618 - RNA, 12 nt, Human
cgcgucuccugu

SEQ ID NO: 2611619 - RNA, 21 nt, Human
cgcgucgcccucccaggcucu

SEQ ID NO: 2611620 - RNA, 14 nt, Human
cgugcauaccacuu

SEQ ID NO: 2611621 - RNA, 18 nt, Human
cgugcauaccacuuuugu

SEQ ID NO: 2611622 - RNA, 22 nt, Human
cgugcacacaccagagcccacc

SEQ ID NO: 2611623 - RNA, 17 nt, Human
cgugaaguauacuguau

SEQ ID NO: 2611624 - RNA, 15 nt, Human
cgugcaccuguacuc

SEQ ID NO: 2611625 - RNA, 22 nt, Human
cgugcaguggugcgaucugggu

SEQ ID NO: 2611626 - RNA, 19 nt, Human
cgugcauaccacuuuuguu

SEQ ID NO: 2611627 - RNA, 21 nt, Human
cgugccagucgcgcugccugu

SEQ ID NO: 2611628 - RNA, 19 nt, Human
cgugcccaggggcccacag

SEQ ID NO: 2611629 - RNA, 22 nt, Human
cgugccagucgcgcugccugug

SEQ ID NO: 2611630 - RNA, 17 nt, Human
cgugccccgccuccccg

SEQ ID NO: 2611631 - RNA, 20 nt, Human
cgugcccaguggcugcuccu

SEQ ID NO: 2611632 - RNA, 16 nt, Human
cgugcccaguggcugc

SEQ ID NO: 2611633 - RNA, 21 nt, Human
cgugccuccaccaccacuggc

SEQ ID NO: 2611634 - RNA, 20 nt, Human
cgugccuccaccaccacugg

SEQ ID NO: 2611635 - RNA, 18 nt, Human
cgugccuccaccaccacu

SEQ ID NO: 2611636 - RNA, 17 nt, Human
cgugccuccaccaccac

SEQ ID NO: 2611637 - RNA, 14 nt, Human
cgugccuccaccac

SEQ ID NO: 2611638 - RNA, 13 nt, Human
cgugccuccacca

SEQ ID NO: 2611639 - RNA, 17 nt, Human
cgugccguuacucucca

SEQ ID NO: 2611640 - RNA, 19 nt, Human
cgugccguuacucuccaac

SEQ ID NO: 2611641 - RNA, 21 nt, Human
cgugcacacaccagagcccac

SEQ ID NO: 2611642 - RNA, 20 nt, Human
cgugcacacaccagagccca

SEQ ID NO: 2611643 - RNA, 13 nt, Human
cgugaaacccugu

SEQ ID NO: 2611644 - RNA, 13 nt, Human
cgugaagggauuu

SEQ ID NO: 2611645 - RNA, 19 nt, Human
cgugaaggccgagaagcaa

SEQ ID NO: 2611646 - RNA, 12 nt, Human
cgugacaacacu

SEQ ID NO: 2611647 - RNA, 19 nt, Human
cgucuguggcuuucagccu

SEQ ID NO: 2611648 - RNA, 14 nt, Human
cgucuguucccccu

SEQ ID NO: 2611649 - RNA, 18 nt, Human
cgucugucuucacagcuc

SEQ ID NO: 2611650 - RNA, 17 nt, Human
cgucuguuuauaaacau

SEQ ID NO: 2611651 - RNA, 12 nt, Human
cgugaaacacac

SEQ ID NO: 2611652 - RNA, 15 nt, Human
cgugaaacacaccag

SEQ ID NO: 2611653 - RNA, 16 nt, Human
cgugaaagcagaugag

SEQ ID NO: 2611654 - RNA, 16 nt, Human
cgugaaacacaccagg

SEQ ID NO: 2611655 - RNA, 20 nt, Human
cgugaaacacaccaggcugu

SEQ ID NO: 2611656 - RNA, 22 nt, Human
cgugaaacacaccaggcugugg

SEQ ID NO: 2611657 - RNA, 24 nt, Human
cgugaaacacaccaggcugugggc

SEQ ID NO: 2611658 - RNA, 21 nt, Human
cgucuguggcuuucagccucu

SEQ ID NO: 2611659 - RNA, 15 nt, Human
cgucuguauauuuug

SEQ ID NO: 2611660 - RNA, 22 nt, Human
cgucugggagaaauugacagau

SEQ ID NO: 2611661 - RNA, 21 nt, Human
cgucugggagaaauugacaga

SEQ ID NO: 2611662 - RNA, 14 nt, Human
cgucugggagaaau

SEQ ID NO: 2611663 - RNA, 24 nt, Human
cgucuggaggggccccugcuucuc

SEQ ID NO: 2611664 - RNA, 17 nt, Human
cgucugggguucagccc

SEQ ID NO: 2611665 - RNA, 18 nt, Human
cgucugggguucagcccc

SEQ ID NO: 2611666 - RNA, 19 nt, Human
cgucugggguucagccccu

SEQ ID NO: 2611667 - RNA, 23 nt, Human
cgucugggguucagccccuccuc

SEQ ID NO: 2611668 - RNA, 14 nt, Human
cgucugacaggcaa

SEQ ID NO: 2611669 - RNA, 13 nt, Human
cgucugacaggca

SEQ ID NO: 2611670 - RNA, 23 nt, Human
cgucuggaggggccccugcuucu

SEQ ID NO: 2611671 - RNA, 20 nt, Human
cgucuggaggggccccugcu

SEQ ID NO: 2611672 - RNA, 18 nt, Human
cgucuggaggggccccug

SEQ ID NO: 2611673 - RNA, 14 nt, Human
cgucuggaggggcc

SEQ ID NO: 2611674 - RNA, 15 nt, Human
cgucuggaaguccaa

SEQ ID NO: 2611675 - RNA, 23 nt, Human
cgucucucucccauggagcccca

SEQ ID NO: 2611676 - RNA, 16 nt, Human
cgucugacccucucca

SEQ ID NO: 2611677 - RNA, 23 nt, Human
cgucugcuaacuuggagccccag

SEQ ID NO: 2611678 - RNA, 18 nt, Human
cgucucucucccauggag

SEQ ID NO: 2611679 - RNA, 14 nt, Human
cgucucucucccau

SEQ ID NO: 2611680 - RNA, 13 nt, Human
cgucucucuccca

SEQ ID NO: 2611681 - RNA, 22 nt, Human
cgucucucccucccuuugaaau

SEQ ID NO: 2611682 - RNA, 14 nt, Human
cgucuaccugaggg

SEQ ID NO: 2611683 - RNA, 19 nt, Human
cgucuaagucaugagcuga

SEQ ID NO: 2611684 - RNA, 14 nt, Human
cguccccugucccc

SEQ ID NO: 2611685 - RNA, 15 nt, Human
cguccgcccugcucc

SEQ ID NO: 2611686 - RNA, 12 nt, Human
cguccgcccugc

SEQ ID NO: 2611687 - RNA, 14 nt, Human
cgucccugcccaug

SEQ ID NO: 2611688 - RNA, 13 nt, Human
cgucccugcccau

SEQ ID NO: 2611689 - RNA, 11 nt, Human
cguccccuguc

SEQ ID NO: 2611690 - RNA, 13 nt, Human
cgucccccugggg

SEQ ID NO: 2611691 - RNA, 15 nt, Human
cgucccauauccugc

SEQ ID NO: 2611692 - RNA, 17 nt, Human
cgucccauauccugccu

SEQ ID NO: 2611693 - RNA, 22 nt, Human
cgucccccucuggcuccagcug

SEQ ID NO: 2611694 - RNA, 20 nt, Human
cguccucaccccuguccuca

SEQ ID NO: 2611695 - RNA, 17 nt, Human
cguccucaccccugucc

SEQ ID NO: 2611696 - RNA, 14 nt, Human
cguccucaccccug

SEQ ID NO: 2611697 - RNA, 15 nt, Human
cguccgcgcgccagc

SEQ ID NO: 2611698 - RNA, 22 nt, Human
cguccgcccugcuccucccugg

SEQ ID NO: 2611699 - RNA, 19 nt, Human
cguccgcccugcuccuccc

SEQ ID NO: 2611700 - RNA, 20 nt, Human
cguccggcaguucugggugc

SEQ ID NO: 2611701 - RNA, 22 nt, Human
cguccucaccccuguccucacu

SEQ ID NO: 2611702 - RNA, 13 nt, Human
cguccucccccug

SEQ ID NO: 2611703 - RNA, 15 nt, Human
cguccucccccugcc

SEQ ID NO: 2611704 - RNA, 16 nt, Human
cguccucccccugcca

SEQ ID NO: 2611705 - RNA, 16 nt, Human
cguccucccgggcccu

SEQ ID NO: 2611706 - RNA, 14 nt, Human
cguccucccgggcc

SEQ ID NO: 2611707 - RNA, 17 nt, Human
cguccucccccugccag

SEQ ID NO: 2611708 - RNA, 22 nt, Human
cguccucccccugccagugccu

SEQ ID NO: 2611709 - RNA, 18 nt, Human
cguccucccgggcccucc

SEQ ID NO: 2611710 - RNA, 17 nt, Human
cguccucccgggcccuc

SEQ ID NO: 2611711 - RNA, 17 nt, Human
cguccuccucaccucau

SEQ ID NO: 2611712 - RNA, 17 nt, Human
cgucgaggggcucucag

SEQ ID NO: 2611713 - RNA, 21 nt, Human
cguccuccucaccucaugccc

SEQ ID NO: 2611714 - RNA, 16 nt, Human
cgucgaggggcucuca

SEQ ID NO: 2611715 - RNA, 18 nt, Human
cgucggggggacagcucc

SEQ ID NO: 2611716 - RNA, 16 nt, Human
cgucgcccucccaggc

SEQ ID NO: 2611717 - RNA, 16 nt, Human
cgucgcacagucucuc

SEQ ID NO: 2611718 - RNA, 13 nt, Human
cgucgcacagucu

SEQ ID NO: 2611719 - RNA, 15 nt, Human
cgucgcccucccagg

SEQ ID NO: 2611720 - RNA, 18 nt, Human
cgucagccuccagccucu

SEQ ID NO: 2611721 - RNA, 17 nt, Human
cgucagccuccagccuc

SEQ ID NO: 2611722 - RNA, 16 nt, Human
cgucagccuccagccu

SEQ ID NO: 2611723 - RNA, 15 nt, Human
cgucagccuccagcc

SEQ ID NO: 2611724 - RNA, 20 nt, Human
cgucagggcccaagucccug

SEQ ID NO: 2611725 - RNA, 20 nt, Human
cgucagccuccagccucugu

SEQ ID NO: 2611726 - RNA, 19 nt, Human
cgucagcuggcacugucuc

SEQ ID NO: 2611727 - RNA, 15 nt, Human
cgucaguauuuuccc

SEQ ID NO: 2611728 - RNA, 15 nt, Human
cgucagugccuaccc

SEQ ID NO: 2611729 - RNA, 17 nt, Human
cgucaguaucaggccug

SEQ ID NO: 2611730 - RNA, 14 nt, Human
cgucaucuaguuuu

SEQ ID NO: 2611731 - RNA, 20 nt, Human
cgucaucauuuuuccuuccc

SEQ ID NO: 2611732 - RNA, 17 nt, Human
cgucaucuaguuuuaaa

SEQ ID NO: 2611733 - RNA, 19 nt, Human
cgucaucacuuuucaguga

SEQ ID NO: 2611734 - RNA, 16 nt, Human
cguccacggcucuagg

SEQ ID NO: 2611735 - RNA, 22 nt, Human
cguccaccaugggguccuacca

SEQ ID NO: 2611736 - RNA, 22 nt, Human
cguccacggcucuagguggggc

SEQ ID NO: 2611737 - RNA, 19 nt, Human
cguccaggagccugugccu

SEQ ID NO: 2611738 - RNA, 21 nt, Human
cguccagccgccauugccacc

SEQ ID NO: 2611739 - RNA, 19 nt, Human
cgucauggcuuaauguuua

SEQ ID NO: 2611740 - RNA, 15 nt, Human
cgucaugcuuguguu

SEQ ID NO: 2611741 - RNA, 20 nt, Human
cgucauggcuuaauguuuau

SEQ ID NO: 2611742 - RNA, 15 nt, Human
cgucauguuccucaa

SEQ ID NO: 2611743 - RNA, 14 nt, Human
cgucccccucuggc

SEQ ID NO: 2611744 - RNA, 21 nt, Human
cgucccccucuggcuccagcu

SEQ ID NO: 2611745 - RNA, 11 nt, Human
cguccagggag

SEQ ID NO: 2611746 - RNA, 14 nt, Human
cgucagccuccagc

SEQ ID NO: 2611747 - RNA, 13 nt, Human
cgucagccuccag

SEQ ID NO: 2611748 - RNA, 12 nt, Human
cgucagccucca

SEQ ID NO: 2611749 - RNA, 17 nt, Human
cgucagaagcacccagg

SEQ ID NO: 2611750 - RNA, 12 nt, Human
cgucaccucaga

SEQ ID NO: 2611751 - RNA, 20 nt, Human
cgucaccaucucaggccacc

SEQ ID NO: 2611752 - RNA, 21 nt, Human
cgucaccaucucaggccaccu

SEQ ID NO: 2611753 - RNA, 16 nt, Human
cgucaccaucucaggc

SEQ ID NO: 2611754 - RNA, 14 nt, Human
cgucaccaccucuc

SEQ ID NO: 2611755 - RNA, 18 nt, Human
cgucaccaucucaggcca

SEQ ID NO: 2611756 - RNA, 17 nt, Human
cgucaacgugcauuuua

SEQ ID NO: 2611757 - RNA, 16 nt, Human
cguauagcuguauuga

SEQ ID NO: 2611758 - RNA, 15 nt, Human
cguauagcuguauug

SEQ ID NO: 2611759 - RNA, 12 nt, Human
cguauagcugua

SEQ ID NO: 2611760 - RNA, 22 nt, Human
cguaguucccugaaaacccaga

SEQ ID NO: 2611761 - RNA, 22 nt, Human
cguauaugucucaggucccugc

SEQ ID NO: 2611762 - RNA, 20 nt, Human
cguaugucuguuaccauguc

SEQ ID NO: 2611763 - RNA, 15 nt, Human
cguauugguccagcu

SEQ ID NO: 2611764 - RNA, 16 nt, Human
cguaugucuguuacca

SEQ ID NO: 2611765 - RNA, 15 nt, Human
cguauguaaauguau

SEQ ID NO: 2611766 - RNA, 13 nt, Human
cguaugcauguga

SEQ ID NO: 2611767 - RNA, 22 nt, Human
cguauaaaagccuguuuaagag

SEQ ID NO: 2611768 - RNA, 21 nt, Human
cguauaaaagccuguuuaaga

SEQ ID NO: 2611769 - RNA, 17 nt, Human
cguauaaaagccuguuu

SEQ ID NO: 2611770 - RNA, 16 nt, Human
cguauaaaagccuguu

SEQ ID NO: 2611771 - RNA, 22 nt, Human
cguagcuucuaccaugaacaga

SEQ ID NO: 2611772 - RNA, 16 nt, Human
cguagcugcaaaggac

SEQ ID NO: 2611773 - RNA, 19 nt, Human
cguagccagcugcucccca

SEQ ID NO: 2611774 - RNA, 16 nt, Human
cguagccagcugcucc

SEQ ID NO: 2611775 - RNA, 21 nt, Human
cguagauucccaucauacacu

SEQ ID NO: 2611776 - RNA, 20 nt, Human
cguagccaaggugggcugag

SEQ ID NO: 2611777 - RNA, 23 nt, Human
cguaggggagggguugccacagg

SEQ ID NO: 2611778 - RNA, 14 nt, Human
cguaguucccugaa

SEQ ID NO: 2611779 - RNA, 13 nt, Human
cguaguucccuga

SEQ ID NO: 2611780 - RNA, 14 nt, Human
cguaggggaggggu

SEQ ID NO: 2611781 - RNA, 17 nt, Human
cguaggggagggguugc

SEQ ID NO: 2611782 - RNA, 17 nt, Human
cguaguagggucaggcc

SEQ ID NO: 2611783 - RNA, 23 nt, Human
cggugcuaucucccccagcccca

SEQ ID NO: 2611784 - RNA, 14 nt, Human
cggggccccagggc

SEQ ID NO: 2611785 - RNA, 19 nt, Human
cggggcagcugccagagaa

SEQ ID NO: 2611786 - RNA, 16 nt, Human
cggggcaugcuggggc

SEQ ID NO: 2611787 - RNA, 17 nt, Human
cggggcaugcuggggca

SEQ ID NO: 2611788 - RNA, 19 nt, Human
cggggcaugcuggggcaag

SEQ ID NO: 2611789 - RNA, 19 nt, Human
cggggaguuucuuuccugc

SEQ ID NO: 2611790 - RNA, 18 nt, Human
cggggaguuucuuuccug

SEQ ID NO: 2611791 - RNA, 15 nt, Human
cggggcacugcaggg

SEQ ID NO: 2611792 - RNA, 14 nt, Human
cggggcagcugcca

SEQ ID NO: 2611793 - RNA, 18 nt, Human
cguagaucaccagaauaa

SEQ ID NO: 2611794 - RNA, 19 nt, Human
cguagaucaccagaauaaa

SEQ ID NO: 2611795 - RNA, 16 nt, Human
cgguggcccugucccu

SEQ ID NO: 2611796 - RNA, 14 nt, Human
cgguggcccugucc

SEQ ID NO: 2611797 - RNA, 11 nt, Human
cgguggccucu

SEQ ID NO: 2611798 - RNA, 15 nt, Human
cgguggaggccaggg

SEQ ID NO: 2611799 - RNA, 14 nt, Human
cgguggaggccagg

SEQ ID NO: 2611800 - RNA, 13 nt, Human
cgguggaggccag

SEQ ID NO: 2611801 - RNA, 22 nt, Human
cggugcuguccucagguggcca

SEQ ID NO: 2611802 - RNA, 15 nt, Human
cggugcuccaggcag

SEQ ID NO: 2611803 - RNA, 14 nt, Human
cggugcuccaggca

SEQ ID NO: 2611804 - RNA, 13 nt, Human
cggugcuccaggc

SEQ ID NO: 2611805 - RNA, 17 nt, Human
cggggccucgggaccuc

SEQ ID NO: 2611806 - RNA, 15 nt, Human
cggggccccagggcu

SEQ ID NO: 2611807 - RNA, 21 nt, Human
cggugcuguccucagguggcc

SEQ ID NO: 2611808 - RNA, 17 nt, Human
cggugcuguccucaggu

SEQ ID NO: 2611809 - RNA, 16 nt, Human
cggugcuccaggcagg

SEQ ID NO: 2611810 - RNA, 16 nt, Human
cggugcuguccucagg

SEQ ID NO: 2611811 - RNA, 17 nt, Human
cuaaaaaaaaaaaagua

SEQ ID NO: 2611812 - RNA, 20 nt, Human
cgugccuccuuccaccuccc

SEQ ID NO: 2611813 - RNA, 19 nt, Human
cgugccuccuuccaccucc

SEQ ID NO: 2611814 - RNA, 23 nt, Human
cgugccuccaccaccacuggcca

SEQ ID NO: 2611815 - RNA, 22 nt, Human
cgugccuccaccaccacuggcc

SEQ ID NO: 2611816 - RNA, 12 nt, Human
cgugccuggcca

SEQ ID NO: 2611817 - RNA, 14 nt, Human
cgugccugugucca

SEQ ID NO: 2611818 - RNA, 12 nt, Human
cgugccuguguc

SEQ ID NO: 2611819 - RNA, 16 nt, Human
cgugccuggccacgcc

SEQ ID NO: 2611820 - RNA, 18 nt, Human
cgugccuucagcucuaca

SEQ ID NO: 2611821 - RNA, 16 nt, Human
cgugccuucagcucua

SEQ ID NO: 2611822 - RNA, 15 nt, Human
cgugccuucagcucu

SEQ ID NO: 2611823 - RNA, 13 nt, Human
cgugccuucagcu

SEQ ID NO: 2611824 - RNA, 23 nt, Human
cguggccccagccuggcccagcu

SEQ ID NO: 2611825 - RNA, 22 nt, Human
cguggccccagccuggcccagc

SEQ ID NO: 2611826 - RNA, 20 nt, Human
cgugccuuuugcaccccucc

SEQ ID NO: 2611827 - RNA, 19 nt, Human
cgugccuuuugcaccccuc

SEQ ID NO: 2611828 - RNA, 17 nt, Human
cgugccuuuugcacccc

SEQ ID NO: 2611829 - RNA, 16 nt, Human
cgugccuuuugcaccc

SEQ ID NO: 2611830 - RNA, 23 nt, Human
cgugccuccuuccaccucccucc

SEQ ID NO: 2611831 - RNA, 15 nt, Human
cgugccuguguccau

SEQ ID NO: 2611832 - RNA, 15 nt, Human
cguggcucagccagc

SEQ ID NO: 2611833 - RNA, 18 nt, Human
cguggcucagccagcacu

SEQ ID NO: 2611834 - RNA, 14 nt, Human
cguggcucagccag

SEQ ID NO: 2611835 - RNA, 22 nt, Human
cguggcuaagaguguccuagga

SEQ ID NO: 2611836 - RNA, 16 nt, Human
cguggccucuugagca

SEQ ID NO: 2611837 - RNA, 15 nt, Human
cguggccucuugagc

SEQ ID NO: 2611838 - RNA, 23 nt, Human
cguggccucuugagcaguggcug

SEQ ID NO: 2611839 - RNA, 20 nt, Human
cguggccuuccccagccucu

SEQ ID NO: 2611840 - RNA, 11 nt, Human
cguuccagccg

SEQ ID NO: 2611841 - RNA, 10 nt, Human
cguuccagcc

SEQ ID NO: 2611842 - RNA, 21 nt, Human
cguuccagccggcauggcugg

SEQ ID NO: 2611843 - RNA, 13 nt, Human
cguuccaguuccc

SEQ ID NO: 2611844 - RNA, 17 nt, Human
cguggcugcuucaagga

SEQ ID NO: 2611845 - RNA, 19 nt, Human
cguggcugcggcacccuug

SEQ ID NO: 2611846 - RNA, 15 nt, Human
cguggcugcuucaag

SEQ ID NO: 2611847 - RNA, 14 nt, Human
cguggcugcuucaa

SEQ ID NO: 2611848 - RNA, 12 nt, Human
cguggcugcuuc

SEQ ID NO: 2611849 - RNA, 15 nt, Human
cguggcucugcuggc

SEQ ID NO: 2611850 - RNA, 14 nt, Human
cguggcucugcugg

SEQ ID NO: 2611851 - RNA, 13 nt, Human
cguggcucugcug

SEQ ID NO: 2611852 - RNA, 21 nt, Human
cguggcugcccacacacccca

SEQ ID NO: 2611853 - RNA, 12 nt, Human
cguucuguuuac

SEQ ID NO: 2611854 - RNA, 20 nt, Human
cguuuacuuaucuuaugcca

SEQ ID NO: 2611855 - RNA, 20 nt, Human
cguuuacuaugccugugucu

SEQ ID NO: 2611856 - RNA, 14 nt, Human
cguuuauuuucaag

SEQ ID NO: 2611857 - RNA, 15 nt, Human
cguuuauuuucaaga

SEQ ID NO: 2611858 - RNA, 13 nt, Human
cguuucaaaaaca

SEQ ID NO: 2611859 - RNA, 23 nt, Human
cguuucagugucaaauaaacacu

SEQ ID NO: 2611860 - RNA, 15 nt, Human
cguuucaaaaacaca

SEQ ID NO: 2611861 - RNA, 22 nt, Human
cguuucauuuagucaugugacc

SEQ ID NO: 2611862 - RNA, 22 nt, Human
cguuucagcgacuccguuggcc

SEQ ID NO: 2611863 - RNA, 22 nt, Human
cguuucagugucaaauaaacac

SEQ ID NO: 2611864 - RNA, 20 nt, Human
cguuccaugaugcugggauu

SEQ ID NO: 2611865 - RNA, 17 nt, Human
cguuccuauugucauua

SEQ ID NO: 2611866 - RNA, 22 nt, Human
cguuccuucaaagcaaaugucu

SEQ ID NO: 2611867 - RNA, 20 nt, Human
cguuccuauugucauuaaag

SEQ ID NO: 2611868 - RNA, 14 nt, Human
cguucucacaccca

SEQ ID NO: 2611869 - RNA, 18 nt, Human
cguucucacacccaccgu

SEQ ID NO: 2611870 - RNA, 16 nt, Human
cguucucacacccacc

SEQ ID NO: 2611871 - RNA, 15 nt, Human
cguucucacacccac

SEQ ID NO: 2611872 - RNA, 18 nt, Human
cguuccuuacugcagaau

SEQ ID NO: 2611873 - RNA, 18 nt, Human
cguucugcuggccuggau

SEQ ID NO: 2611874 - RNA, 17 nt, Human
cguucugcuggccugga

SEQ ID NO: 2611875 - RNA, 20 nt, Human
cguucuguuuacaucaguuu

SEQ ID NO: 2611876 - RNA, 12 nt, Human
cguucugugcac

SEQ ID NO: 2611877 - RNA, 12 nt, Human
cguucucugccu

SEQ ID NO: 2611878 - RNA, 14 nt, Human
cguucugcucauca

SEQ ID NO: 2611879 - RNA, 19 nt, Human
cguuucuaaaggcuaccuu

SEQ ID NO: 2611880 - RNA, 21 nt, Human
cguuucuaaaggcuaccuuug

SEQ ID NO: 2611881 - RNA, 20 nt, Human
cguuucuaugacacaugcaa

SEQ ID NO: 2611882 - RNA, 22 nt, Human
cguuucuccaccuagacuguaa

SEQ ID NO: 2611883 - RNA, 18 nt, Human
cguuucuccaccuagacu

SEQ ID NO: 2611884 - RNA, 20 nt, Human
cguuuccugagaagugucua

SEQ ID NO: 2611885 - RNA, 22 nt, Human
cguuuccaucagguuccauccc

SEQ ID NO: 2611886 - RNA, 11 nt, Human
cguuuccauca

SEQ ID NO: 2611887 - RNA, 15 nt, Human
cguuuucuguuugga

SEQ ID NO: 2611888 - RNA, 13 nt, Human
cguuuugaagcua

SEQ ID NO: 2611889 - RNA, 20 nt, Human
cguuuugaagcuacugugug

SEQ ID NO: 2611890 - RNA, 15 nt, Human
cguuuuggaagcucu

SEQ ID NO: 2611891 - RNA, 23 nt, Human
cguuuugugugguggcaccuccu

SEQ ID NO: 2611892 - RNA, 23 nt, Human
cguuuuuauaaaaaauggugccu

SEQ ID NO: 2611893 - RNA, 13 nt, Human
cguuucuucccug

SEQ ID NO: 2611894 - RNA, 12 nt, Human
cguuucuucccu

SEQ ID NO: 2611895 - RNA, 17 nt, Human
cguuugaccuuuuaugu

SEQ ID NO: 2611896 - RNA, 16 nt, Human
cguuugagaagaaaac

SEQ ID NO: 2611897 - RNA, 17 nt, Human
ccuugaaugaugccaug

SEQ ID NO: 2611898 - RNA, 17 nt, Human
ccuugaacuuugaccuc

SEQ ID NO: 2611899 - RNA, 16 nt, Human
ccuugaacuggguacu

SEQ ID NO: 2611900 - RNA, 21 nt, Human
ccuugaaaacacuguucucug

SEQ ID NO: 2611901 - RNA, 19 nt, Human
ccuugaaaacacuguucuc

SEQ ID NO: 2611902 - RNA, 22 nt, Human
ccuugaaaacacuguucucugc

SEQ ID NO: 2611903 - RNA, 14 nt, Human
ccuugaacugggua

SEQ ID NO: 2611904 - RNA, 18 nt, Human
ccuucgcuccugugucuu

SEQ ID NO: 2611905 - RNA, 15 nt, Human
ccuucgcuccugugu

SEQ ID NO: 2611906 - RNA, 14 nt, Human
ccuucgcuccugug

SEQ ID NO: 2611907 - RNA, 13 nt, Human
ccuucgcuccugu

SEQ ID NO: 2611908 - RNA, 21 nt, Human
ccuucuuugauaauguuaaau

SEQ ID NO: 2611909 - RNA, 20 nt, Human
ccuucuuugauaauguuaaa

SEQ ID NO: 2611910 - RNA, 19 nt, Human
ccuucuuugauaauguuaa

SEQ ID NO: 2611911 - RNA, 18 nt, Human
ccuucuuugauaauguua

SEQ ID NO: 2611912 - RNA, 18 nt, Human
ccuucuuugcuugccucu

SEQ ID NO: 2611913 - RNA, 20 nt, Human
ccuucgcgguggaaggcccg

SEQ ID NO: 2611914 - RNA, 17 nt, Human
ccuucgcgguggaaggc

SEQ ID NO: 2611915 - RNA, 13 nt, Human
ccuucuuugauaa

SEQ ID NO: 2611916 - RNA, 15 nt, Human
ccuugaaaacacugu

SEQ ID NO: 2611917 - RNA, 16 nt, Human
ccuucuuuuucuucuu

SEQ ID NO: 2611918 - RNA, 14 nt, Human
ccuucuuuuucuuc

SEQ ID NO: 2611919 - RNA, 20 nt, Human
ccuugaccauucuccaccug

SEQ ID NO: 2611920 - RNA, 19 nt, Human
ccuugaccauucuccaccu

SEQ ID NO: 2611921 - RNA, 17 nt, Human
ccuugacagggcacacc

SEQ ID NO: 2611922 - RNA, 15 nt, Human
ccuugacagggcaca

SEQ ID NO: 2611923 - RNA, 21 nt, Human
ccuugacaaagucaagccaca

SEQ ID NO: 2611924 - RNA, 12 nt, Human
ccuugaaugugg

SEQ ID NO: 2611925 - RNA, 23 nt, Human
ccuugacaaagucaagccacaug

SEQ ID NO: 2611926 - RNA, 14 nt, Human
ccuugacaccugcu

SEQ ID NO: 2611927 - RNA, 13 nt, Human
ccuugacagggca

SEQ ID NO: 2611928 - RNA, 14 nt, Human
ccuugacagggcac

SEQ ID NO: 2611929 - RNA, 21 nt, Human
ccuugaccauucuccaccugc

SEQ ID NO: 2611930 - RNA, 16 nt, Human
ccuugaccaggccugg

SEQ ID NO: 2611931 - RNA, 15 nt, Human
ccuugaccaggccug

SEQ ID NO: 2611932 - RNA, 22 nt, Human
ccuugaguugauucagcucugc

SEQ ID NO: 2611933 - RNA, 23 nt, Human
ccuugaguugauucagcucugca

SEQ ID NO: 2611934 - RNA, 19 nt, Human
ccuuggauuguccccgacc

SEQ ID NO: 2611935 - RNA, 14 nt, Human
ccuugaucuguaua

SEQ ID NO: 2611936 - RNA, 15 nt, Human
ccuuggcaccagaca

SEQ ID NO: 2611937 - RNA, 20 nt, Human
ccuuggcaccagacacccag

SEQ ID NO: 2611938 - RNA, 21 nt, Human
ccuuggcaccagacacccagg

SEQ ID NO: 2611939 - RNA, 22 nt, Human
ccuuggcaccagacacccagga

SEQ ID NO: 2611940 - RNA, 23 nt, Human
ccuuggcaccagacacccaggac

SEQ ID NO: 2611941 - RNA, 19 nt, Human
ccuuggcaucacagggcag

SEQ ID NO: 2611942 - RNA, 18 nt, Human
ccuuggcaucuagagcuu

SEQ ID NO: 2611943 - RNA, 15 nt, Human
ccuuggcaugccuuc

SEQ ID NO: 2611944 - RNA, 11 nt, Human
ccuuuggcuuc

SEQ ID NO: 2611945 - RNA, 19 nt, Human
ccuucagugccuuauggaa

SEQ ID NO: 2611946 - RNA, 23 nt, Human
ccuucaagaucauguaccccaau

SEQ ID NO: 2611947 - RNA, 22 nt, Human
ccuucaagaccuucaccaaaca

SEQ ID NO: 2611948 - RNA, 13 nt, Human
ccuucaacugaaa

SEQ ID NO: 2611949 - RNA, 24 nt, Human
ccuucaacugaaaagacucagugu

SEQ ID NO: 2611950 - RNA, 18 nt, Human
ccuucaagaccuucacca

SEQ ID NO: 2611951 - RNA, 13 nt, Human
ccuucaagaccuu

SEQ ID NO: 2611952 - RNA, 19 nt, Human
ccuucaagaacucugggcu

SEQ ID NO: 2611953 - RNA, 14 nt, Human
ccuucaaccauucc

SEQ ID NO: 2611954 - RNA, 19 nt, Human
ccuucaaagcaaaugucuu

SEQ ID NO: 2611955 - RNA, 15 nt, Human
ccuuauuuuuuccca

SEQ ID NO: 2611956 - RNA, 16 nt, Human
ccuuauuuuuucccaa

SEQ ID NO: 2611957 - RNA, 14 nt, Human
ccuuauuuucaaga

SEQ ID NO: 2611958 - RNA, 18 nt, Human
ccuuauuuucaagaaacu

SEQ ID NO: 2611959 - RNA, 15 nt, Human
ccuucaaagcaaaug

SEQ ID NO: 2611960 - RNA, 21 nt, Human
ccuuagauuagcucuggacca

SEQ ID NO: 2611961 - RNA, 18 nt, Human
ccuuagauuagcucugga

SEQ ID NO: 2611962 - RNA, 16 nt, Human
ccuuauuguaccucuc

SEQ ID NO: 2611963 - RNA, 15 nt, Human
ccuuauuguaccucu

SEQ ID NO: 2611964 - RNA, 18 nt, Human
ccuuagagccaggcacac

SEQ ID NO: 2611965 - RNA, 17 nt, Human
ccuuagagccaggcaca

SEQ ID NO: 2611966 - RNA, 16 nt, Human
ccuuagagccaggcac

SEQ ID NO: 2611967 - RNA, 16 nt, Human
ccuuagauuagcucug

SEQ ID NO: 2611968 - RNA, 16 nt, Human
ccuuagaccuuccaua

SEQ ID NO: 2611969 - RNA, 15 nt, Human
ccuuagagccaggca

SEQ ID NO: 2611970 - RNA, 16 nt, Human
ccuuagagacaucaaa

SEQ ID NO: 2611971 - RNA, 19 nt, Human
ccuuagacagucccugcca

SEQ ID NO: 2611972 - RNA, 18 nt, Human
ccuuagacagucccugcc

SEQ ID NO: 2611973 - RNA, 20 nt, Human
ccuuagaacauuuuaauuca

SEQ ID NO: 2611974 - RNA, 21 nt, Human
ccuuagacagucccugccaau

SEQ ID NO: 2611975 - RNA, 17 nt, Human
ccuuagacagucccugc

SEQ ID NO: 2611976 - RNA, 16 nt, Human
ccuuagacagucccug

SEQ ID NO: 2611977 - RNA, 18 nt, Human
ccuuagaaccuuucuuac

SEQ ID NO: 2611978 - RNA, 16 nt, Human
ccuuagaaccuuucuu

SEQ ID NO: 2611979 - RNA, 15 nt, Human
ccuuagaaccuuucu

SEQ ID NO: 2611980 - RNA, 14 nt, Human
ccuuagaaccuuuc

SEQ ID NO: 2611981 - RNA, 16 nt, Human
ccuuaccagcagagca

SEQ ID NO: 2611982 - RNA, 15 nt, Human
ccuuaccagcagagc

SEQ ID NO: 2611983 - RNA, 17 nt, Human
ccuuacccuccuuggga

SEQ ID NO: 2611984 - RNA, 17 nt, Human
ccuuaccagcagagcac

SEQ ID NO: 2611985 - RNA, 20 nt, Human
ccuuaccucggugccuuccu

SEQ ID NO: 2611986 - RNA, 13 nt, Human
ccuuaccuccugc

SEQ ID NO: 2611987 - RNA, 14 nt, Human
ccuuaccuccugcc

SEQ ID NO: 2611988 - RNA, 16 nt, Human
ccuuaccuccugccca

SEQ ID NO: 2611989 - RNA, 17 nt, Human
ccuuaccuccugcccag

SEQ ID NO: 2611990 - RNA, 18 nt, Human
ccuuaccuccugcccagg

SEQ ID NO: 2611991 - RNA, 20 nt, Human
ccuuaccuccugcccaggag

SEQ ID NO: 2611992 - RNA, 14 nt, Human
ccuuaccucuuccg

SEQ ID NO: 2611993 - RNA, 14 nt, Human
ccuuaccugccagg

SEQ ID NO: 2611994 - RNA, 23 nt, Human
ccugugcugguguccugaccacc

SEQ ID NO: 2611995 - RNA, 22 nt, Human
ccugugcugguguccugaccac

SEQ ID NO: 2611996 - RNA, 22 nt, Human
ccugugcuucgggcccuuccca

SEQ ID NO: 2611997 - RNA, 21 nt, Human
ccugugcugguguccugacca

SEQ ID NO: 2611998 - RNA, 18 nt, Human
ccugugcugguguccuga

SEQ ID NO: 2611999 - RNA, 17 nt, Human
ccugugcugguguccug

SEQ ID NO: 2612000 - RNA, 14 nt, Human
ccugugcugguguc

SEQ ID NO: 2612001 - RNA, 12 nt, Human
ccugugcuggug

SEQ ID NO: 2612002 - RNA, 21 nt, Human
ccugugcugcccgucuucagc

SEQ ID NO: 2612003 - RNA, 23 nt, Human
ccugugcugcccgucuucagccu

SEQ ID NO: 2612004 - RNA, 24 nt, Human
ccugugcugguguccugaccaccc

SEQ ID NO: 2612005 - RNA, 16 nt, Human
ccuguggaagggacua

SEQ ID NO: 2612006 - RNA, 19 nt, Human
ccuguggaagggacuagga

SEQ ID NO: 2612007 - RNA, 20 nt, Human
ccuguggaagggacuaggag

SEQ ID NO: 2612008 - RNA, 18 nt, Human
ccuguggcaggcagcgcc

SEQ ID NO: 2612009 - RNA, 15 nt, Human
ccuguggcaggcagc

SEQ ID NO: 2612010 - RNA, 14 nt, Human
ccuguggcaggcag

SEQ ID NO: 2612011 - RNA, 24 nt, Human
ccuguggaagggacuaggagcacu

SEQ ID NO: 2612012 - RNA, 22 nt, Human
ccuguggcaggcagcgccaagc

SEQ ID NO: 2612013 - RNA, 19 nt, Human
ccuguggcaggcagcgcca

SEQ ID NO: 2612014 - RNA, 22 nt, Human
ccuguggccccacccugggccc

SEQ ID NO: 2612015 - RNA, 20 nt, Human
ccuguggccccacccugggc

SEQ ID NO: 2612016 - RNA, 18 nt, Human
ccuguggccccacccugg

SEQ ID NO: 2612017 - RNA, 14 nt, Human
ccuuaccagcagag

SEQ ID NO: 2612018 - RNA, 17 nt, Human
ccuguggccccacccug

SEQ ID NO: 2612019 - RNA, 16 nt, Human
ccuguggccccacccu

SEQ ID NO: 2612020 - RNA, 15 nt, Human
ccuguggccccaccc

SEQ ID NO: 2612021 - RNA, 18 nt, Human
ccuguggcaucuuugccu

SEQ ID NO: 2612022 - RNA, 23 nt, Human
ccuguggcaucuuugccuugggc

SEQ ID NO: 2612023 - RNA, 20 nt, Human
ccuguggccaaguucuuagu

SEQ ID NO: 2612024 - RNA, 13 nt, Human
ccuucgccaccug

SEQ ID NO: 2612025 - RNA, 23 nt, Human
ccuucgauacaccgggccuggag

SEQ ID NO: 2612026 - RNA, 22 nt, Human
ccuucgauacaccgggccugga

SEQ ID NO: 2612027 - RNA, 20 nt, Human
ccuucgauacaccgggccug

SEQ ID NO: 2612028 - RNA, 16 nt, Human
ccuuccugccaccagu

SEQ ID NO: 2612029 - RNA, 17 nt, Human
ccuuccugccaccaguc

SEQ ID NO: 2612030 - RNA, 17 nt, Human
ccuuccugccaccugcu

SEQ ID NO: 2612031 - RNA, 11 nt, Human
ccuuccugccc

SEQ ID NO: 2612032 - RNA, 18 nt, Human
ccuuccugccaccugcug

SEQ ID NO: 2612033 - RNA, 15 nt, Human
ccuucgauacaccgg

SEQ ID NO: 2612034 - RNA, 21 nt, Human
ccuucccaaaggacuccaccc

SEQ ID NO: 2612035 - RNA, 18 nt, Human
ccuucccaaaggacucca

SEQ ID NO: 2612036 - RNA, 15 nt, Human
ccuuccucugcagcu

SEQ ID NO: 2612037 - RNA, 12 nt, Human
ccuuccucugca

SEQ ID NO: 2612038 - RNA, 14 nt, Human
ccuuccucugaggc

SEQ ID NO: 2612039 - RNA, 16 nt, Human
ccuuccauguggagaa

SEQ ID NO: 2612040 - RNA, 19 nt, Human
ccuuccaugucggccucua

SEQ ID NO: 2612041 - RNA, 16 nt, Human
ccuucccaaaggacuc

SEQ ID NO: 2612042 - RNA, 20 nt, Human
ccuuccaugucggccucuaa

SEQ ID NO: 2612043 - RNA, 14 nt, Human
ccuuccugccacca

SEQ ID NO: 2612044 - RNA, 17 nt, Human
ccuuccucugcagcuga

SEQ ID NO: 2612045 - RNA, 16 nt, Human
ccuuccucugcagcug

SEQ ID NO: 2612046 - RNA, 18 nt, Human
ccuuccucugcagcugac

SEQ ID NO: 2612047 - RNA, 14 nt, Human
ccuuccucuuucca

SEQ ID NO: 2612048 - RNA, 16 nt, Human
ccuuccagggguggga

SEQ ID NO: 2612049 - RNA, 15 nt, Human
ccuuccagggguggg

SEQ ID NO: 2612050 - RNA, 15 nt, Human
ccuuccacugagggc

SEQ ID NO: 2612051 - RNA, 17 nt, Human
ccuuccacugagggcag

SEQ ID NO: 2612052 - RNA, 18 nt, Human
ccuuccacgcugucucca

SEQ ID NO: 2612053 - RNA, 19 nt, Human
ccuuccacgcugucuccag

SEQ ID NO: 2612054 - RNA, 20 nt, Human
ccuuccacggauccauguag

SEQ ID NO: 2612055 - RNA, 20 nt, Human
ccuuccacgcugucuccaga

SEQ ID NO: 2612056 - RNA, 21 nt, Human
ccuuccacggauccauguagc

SEQ ID NO: 2612057 - RNA, 22 nt, Human
ccuuccaggggugggacacccu

SEQ ID NO: 2612058 - RNA, 18 nt, Human
ccuuccaggggugggaca

SEQ ID NO: 2612059 - RNA, 23 nt, Human
ccuuccaugucgccucugcauuc

SEQ ID NO: 2612060 - RNA, 21 nt, Human
ccuuccaugucgccucugcau

SEQ ID NO: 2612061 - RNA, 20 nt, Human
ccuuccaugucgccucugca

SEQ ID NO: 2612062 - RNA, 19 nt, Human
ccuuccaugucgccucugc

SEQ ID NO: 2612063 - RNA, 17 nt, Human
ccuucaucuccagggag

SEQ ID NO: 2612064 - RNA, 14 nt, Human
ccuucaucuggaac

SEQ ID NO: 2612065 - RNA, 15 nt, Human
ccuucaucuccaggg

SEQ ID NO: 2612066 - RNA, 13 nt, Human
ccuucaucuggaa

SEQ ID NO: 2612067 - RNA, 14 nt, Human
ccuucaucuccagg

SEQ ID NO: 2612068 - RNA, 18 nt, Human
ccuuccacacccccaccc

SEQ ID NO: 2612069 - RNA, 15 nt, Human
ccuuccacaccccca

SEQ ID NO: 2612070 - RNA, 16 nt, Human
ccuuccaccucccucc

SEQ ID NO: 2612071 - RNA, 20 nt, Human
ccuucagugccuuauggaac

SEQ ID NO: 2612072 - RNA, 18 nt, Human
ccuucaguuaugauuuuu

SEQ ID NO: 2612073 - RNA, 21 nt, Human
ccuucagucuugaauuucuaa

SEQ ID NO: 2612074 - RNA, 15 nt, Human
ccuucagugccuuau

SEQ ID NO: 2612075 - RNA, 24 nt, Human
ccuucaguacccucucagcuccag

SEQ ID NO: 2612076 - RNA, 20 nt, Human
ccuucagucuugaauuucua

SEQ ID NO: 2612077 - RNA, 23 nt, Human
ccuucaguacccucucagcucca

SEQ ID NO: 2612078 - RNA, 20 nt, Human
ccuucaguacccucucagcu

SEQ ID NO: 2612079 - RNA, 19 nt, Human
ccuucaguacccucucagc

SEQ ID NO: 2612080 - RNA, 17 nt, Human
ccuucaguacccucuca

SEQ ID NO: 2612081 - RNA, 14 nt, Human
ccuucagugccuua

SEQ ID NO: 2612082 - RNA, 13 nt, Human
ccuucagugccuu

SEQ ID NO: 2612083 - RNA, 14 nt, Human
ccuucaauaaagua

SEQ ID NO: 2612084 - RNA, 22 nt, Human
ccuucaauaaaugguauagcaa

SEQ ID NO: 2612085 - RNA, 16 nt, Human
ccuucaauaaaguauc

SEQ ID NO: 2612086 - RNA, 17 nt, Human
ccuucaaguuagcucag

SEQ ID NO: 2612087 - RNA, 19 nt, Human
ccuucaaguuagcucagga

SEQ ID NO: 2612088 - RNA, 14 nt, Human
ccuucaauuccugg

SEQ ID NO: 2612089 - RNA, 15 nt, Human
ccuucaauuccuggg

SEQ ID NO: 2612090 - RNA, 16 nt, Human
ccuucaauuccugggc

SEQ ID NO: 2612091 - RNA, 20 nt, Human
ccuucaauuccugggcccca

SEQ ID NO: 2612092 - RNA, 12 nt, Human
ccuucacaaagc

SEQ ID NO: 2612093 - RNA, 18 nt, Human
ccuucacaaagcccaagg

SEQ ID NO: 2612094 - RNA, 20 nt, Human
ccuucagggugaugccaggu

SEQ ID NO: 2612095 - RNA, 19 nt, Human
ccuucagggugaugccagg

SEQ ID NO: 2612096 - RNA, 18 nt, Human
ccuucagggugaugccag

SEQ ID NO: 2612097 - RNA, 12 nt, Human
ccuucaggguga

SEQ ID NO: 2612098 - RNA, 19 nt, Human
ccuguggaaucuggaguga

SEQ ID NO: 2612099 - RNA, 21 nt, Human
ccuguccccucagcuccagac

SEQ ID NO: 2612100 - RNA, 18 nt, Human
ccuguccccucagcucca

SEQ ID NO: 2612101 - RNA, 17 nt, Human
ccuguccccucagcucc

SEQ ID NO: 2612102 - RNA, 16 nt, Human
ccuguccccucagcuc

SEQ ID NO: 2612103 - RNA, 15 nt, Human
ccuguccccucagcu

SEQ ID NO: 2612104 - RNA, 14 nt, Human
ccuguccccucagc

SEQ ID NO: 2612105 - RNA, 18 nt, Human
ccuguccccgcacugggc

SEQ ID NO: 2612106 - RNA, 17 nt, Human
ccugucccccugacaac

SEQ ID NO: 2612107 - RNA, 16 nt, Human
ccugucccccugacaa

SEQ ID NO: 2612108 - RNA, 19 nt, Human
ccuguccagcuccaaccug

SEQ ID NO: 2612109 - RNA, 17 nt, Human
ccuguccaaacugccua

SEQ ID NO: 2612110 - RNA, 19 nt, Human
ccuguccaaacugccuaag

SEQ ID NO: 2612111 - RNA, 23 nt, Human
ccuguccaaacugccuaagcccu

SEQ ID NO: 2612112 - RNA, 12 nt, Human
ccuguccaaccu

SEQ ID NO: 2612113 - RNA, 19 nt, Human
ccuguccaaccuaaccccu

SEQ ID NO: 2612114 - RNA, 21 nt, Human
ccuguccacacccagcucagc

SEQ ID NO: 2612115 - RNA, 19 nt, Human
ccuguccacacccagcuca

SEQ ID NO: 2612116 - RNA, 22 nt, Human
ccuguccacacccagcucagca

SEQ ID NO: 2612117 - RNA, 16 nt, Human
ccuguccacacccagc

SEQ ID NO: 2612118 - RNA, 18 nt, Human
ccuguccacacccagcuc

SEQ ID NO: 2612119 - RNA, 23 nt, Human
ccuguccaaccuaaccccuuucc

SEQ ID NO: 2612120 - RNA, 14 nt, Human
ccuguccagcucca

SEQ ID NO: 2612121 - RNA, 15 nt, Human
ccuguccagcuccaa

SEQ ID NO: 2612122 - RNA, 13 nt, Human
ccuguccagcucc

SEQ ID NO: 2612123 - RNA, 22 nt, Human
ccuguccagccugggcagccag

SEQ ID NO: 2612124 - RNA, 13 nt, Human
ccuguccagagag

SEQ ID NO: 2612125 - RNA, 12 nt, Human
ccuguccagccu

SEQ ID NO: 2612126 - RNA, 14 nt, Human
ccuguccagccugg

SEQ ID NO: 2612127 - RNA, 16 nt, Human
ccuguccagccugggc

SEQ ID NO: 2612128 - RNA, 22 nt, Human
ccugugagcuaggaauuguguu

SEQ ID NO: 2612129 - RNA, 15 nt, Human
ccugugagcccagcu

SEQ ID NO: 2612130 - RNA, 17 nt, Human
ccugugagcccagcugg

SEQ ID NO: 2612131 - RNA, 20 nt, Human
ccugugaguacuacaguccu

SEQ ID NO: 2612132 - RNA, 20 nt, Human
ccugugagcccagcuggguc

SEQ ID NO: 2612133 - RNA, 13 nt, Human
ccugugaggcagg

SEQ ID NO: 2612134 - RNA, 14 nt, Human
ccugugaggcaggg

SEQ ID NO: 2612135 - RNA, 22 nt, Human
ccuguccuccugguggguccag

SEQ ID NO: 2612136 - RNA, 17 nt, Human
ccuguccuccugguggg

SEQ ID NO: 2612137 - RNA, 16 nt, Human
ccuguccuccuggugg

SEQ ID NO: 2612138 - RNA, 14 nt, Human
ccuguccuccuggu

SEQ ID NO: 2612139 - RNA, 18 nt, Human
ccugugacuucagcucug

SEQ ID NO: 2612140 - RNA, 23 nt, Human
ccuguccucccauccccuggacu

SEQ ID NO: 2612141 - RNA, 22 nt, Human
ccuguccucccauccccuggac

SEQ ID NO: 2612142 - RNA, 21 nt, Human
ccuguccucccauccccugga

SEQ ID NO: 2612143 - RNA, 17 nt, Human
ccuguccucccaucccc

SEQ ID NO: 2612144 - RNA, 13 nt, Human
ccuguccuccucg

SEQ ID NO: 2612145 - RNA, 14 nt, Human
ccuguccuccucgg

SEQ ID NO: 2612146 - RNA, 15 nt, Human
ccuguccuccucgga

SEQ ID NO: 2612147 - RNA, 23 nt, Human
ccuguccuccucggaucaccgag

SEQ ID NO: 2612148 - RNA, 22 nt, Human
ccuguccucacugcucccugaa

SEQ ID NO: 2612149 - RNA, 13 nt, Human
ccuguccuccaac

SEQ ID NO: 2612150 - RNA, 15 nt, Human
ccuguccucagcuuc

SEQ ID NO: 2612151 - RNA, 21 nt, Human
ccuguccuccaacaccaagca

SEQ ID NO: 2612152 - RNA, 22 nt, Human
ccuguccuccaacaccaagcac

SEQ ID NO: 2612153 - RNA, 16 nt, Human
ccuguccucccauccc

SEQ ID NO: 2612154 - RNA, 21 nt, Human
ccugugauggggcccugccuc

SEQ ID NO: 2612155 - RNA, 20 nt, Human
ccugugauggggcccugccu

SEQ ID NO: 2612156 - RNA, 22 nt, Human
ccugugauggggcccugccucc

SEQ ID NO: 2612157 - RNA, 19 nt, Human
ccugugauggggcccugcc

SEQ ID NO: 2612158 - RNA, 18 nt, Human
ccugugauggggcccugc

SEQ ID NO: 2612159 - RNA, 17 nt, Human
ccugugauggggcccug

SEQ ID NO: 2612160 - RNA, 23 nt, Human
ccugugaggugcagagugcccag

SEQ ID NO: 2612161 - RNA, 17 nt, Human
ccugugaggcaggggcg

SEQ ID NO: 2612162 - RNA, 19 nt, Human
ccugugaggugcagagugc

SEQ ID NO: 2612163 - RNA, 19 nt, Human
ccugugccucugggacugg

SEQ ID NO: 2612164 - RNA, 20 nt, Human
ccugugccuccucaccccca

SEQ ID NO: 2612165 - RNA, 21 nt, Human
ccugugccuccucacccccag

SEQ ID NO: 2612166 - RNA, 22 nt, Human
ccugugcugcccgucuucagcc

SEQ ID NO: 2612167 - RNA, 15 nt, Human
ccugugccucuggga

SEQ ID NO: 2612168 - RNA, 17 nt, Human
ccugugccucugggacu

SEQ ID NO: 2612169 - RNA, 18 nt, Human
ccugugcagccgcugagc

SEQ ID NO: 2612170 - RNA, 20 nt, Human
ccugugcagccgcugagcga

SEQ ID NO: 2612171 - RNA, 21 nt, Human
ccugugcagccgcugagcgag

SEQ ID NO: 2612172 - RNA, 17 nt, Human
ccugugcauguaugucu

SEQ ID NO: 2612173 - RNA, 14 nt, Human
ccugugcauguaug

SEQ ID NO: 2612174 - RNA, 20 nt, Human
ccugugcauguaugucuugg

SEQ ID NO: 2612175 - RNA, 19 nt, Human
ccugugccacccaccaggg

SEQ ID NO: 2612176 - RNA, 21 nt, Human
ccugugccacccaccagggcg

SEQ ID NO: 2612177 - RNA, 23 nt, Human
ccugugcccacaucccaggcuuc

SEQ ID NO: 2612178 - RNA, 18 nt, Human
ccugugccuaacaccagc

SEQ ID NO: 2612179 - RNA, 15 nt, Human
ccugugccuccucac

SEQ ID NO: 2612180 - RNA, 15 nt, Human
ccugugcccuuauuc

SEQ ID NO: 2612181 - RNA, 15 nt, Human
ccuggugcugccaca

SEQ ID NO: 2612182 - RNA, 21 nt, Human
ccuggugcugccacacuucag

SEQ ID NO: 2612183 - RNA, 18 nt, Human
ccuggugcugccacacuu

SEQ ID NO: 2612184 - RNA, 20 nt, Human
ccuggugcugccucuaccug

SEQ ID NO: 2612185 - RNA, 12 nt, Human
ccuggugcugcu

SEQ ID NO: 2612186 - RNA, 15 nt, Human
ccuggugcugccucu

SEQ ID NO: 2612187 - RNA, 17 nt, Human
ccugggcaccuggggag

SEQ ID NO: 2612188 - RNA, 13 nt, Human
ccugggcagaaag

SEQ ID NO: 2612189 - RNA, 13 nt, Human
ccuggugcugcug

SEQ ID NO: 2612190 - RNA, 13 nt, Human
ccuggugcuggau

SEQ ID NO: 2612191 - RNA, 13 nt, Human
ccugguggcagcu

SEQ ID NO: 2612192 - RNA, 12 nt, Human
ccugguggcagc

SEQ ID NO: 2612193 - RNA, 12 nt, Human
ccugguggacag

SEQ ID NO: 2612194 - RNA, 14 nt, Human
ccugguggacaguc

SEQ ID NO: 2612195 - RNA, 17 nt, Human
ccugguggacaguccug

SEQ ID NO: 2612196 - RNA, 18 nt, Human
ccugguggacaguccugg

SEQ ID NO: 2612197 - RNA, 19 nt, Human
ccugguggacaguccuggg

SEQ ID NO: 2612198 - RNA, 22 nt, Human
ccugguggagaaagcacugacc

SEQ ID NO: 2612199 - RNA, 12 nt, Human
ccugguggagaa

SEQ ID NO: 2612200 - RNA, 20 nt, Human
ccugguggacaguccuggga

SEQ ID NO: 2612201 - RNA, 18 nt, Human
ccugguggcagcucaccu

SEQ ID NO: 2612202 - RNA, 17 nt, Human
ccugguggcagcucacc

SEQ ID NO: 2612203 - RNA, 16 nt, Human
ccugguggcagcucac

SEQ ID NO: 2612204 - RNA, 14 nt, Human
ccugguggcagcuc

SEQ ID NO: 2612205 - RNA, 23 nt, Human
ccuguaauuccuaccucccugca

SEQ ID NO: 2612206 - RNA, 23 nt, Human
ccuguaauuguuguuuguaugua

SEQ ID NO: 2612207 - RNA, 15 nt, Human
ccuguaaucccagcu

SEQ ID NO: 2612208 - RNA, 16 nt, Human
ccuguaaucccagcua

SEQ ID NO: 2612209 - RNA, 18 nt, Human
ccuguaaucccagcuacu

SEQ ID NO: 2612210 - RNA, 23 nt, Human
ccuguaaucccagcuacucagga

SEQ ID NO: 2612211 - RNA, 15 nt, Human
ccuguacaauauuua

SEQ ID NO: 2612212 - RNA, 18 nt, Human
ccuguaauuuuuuucuua

SEQ ID NO: 2612213 - RNA, 21 nt, Human
ccuguacaauauuuaaaauuu

SEQ ID NO: 2612214 - RNA, 20 nt, Human
ccuguaauccuagcacuuug

SEQ ID NO: 2612215 - RNA, 20 nt, Human
ccuguaaucccagcacuugg

SEQ ID NO: 2612216 - RNA, 18 nt, Human
ccuguaaucccagcacuu

SEQ ID NO: 2612217 - RNA, 23 nt, Human
ccuguaaucccagcacuuuggga

SEQ ID NO: 2612218 - RNA, 21 nt, Human
ccuguaaucccagcacuuugg

SEQ ID NO: 2612219 - RNA, 16 nt, Human
ccuguaaucccagcag

SEQ ID NO: 2612220 - RNA, 21 nt, Human
ccuguagagugggagcugagu

SEQ ID NO: 2612221 - RNA, 19 nt, Human
ccuguagagugggagcuga

SEQ ID NO: 2612222 - RNA, 15 nt, Human
ccuguagcacuuacu

SEQ ID NO: 2612223 - RNA, 18 nt, Human
ccuguacuguucuguguc

SEQ ID NO: 2612224 - RNA, 23 nt, Human
ccuguagagugggagcugagugg

SEQ ID NO: 2612225 - RNA, 22 nt, Human
ccuguaccuuuugaggagcccc

SEQ ID NO: 2612226 - RNA, 12 nt, Human
ccuguacacuga

SEQ ID NO: 2612227 - RNA, 23 nt, Human
ccuguaccuuuugaggagcccca

SEQ ID NO: 2612228 - RNA, 13 nt, Human
ccuguacucagga

SEQ ID NO: 2612229 - RNA, 14 nt, Human
ccuguacucaggag

SEQ ID NO: 2612230 - RNA, 15 nt, Human
ccuguacucaggagg

SEQ ID NO: 2612231 - RNA, 21 nt, Human
ccuguacucaggaggcugagg

SEQ ID NO: 2612232 - RNA, 22 nt, Human
ccuguacucaggaggcugaggg

SEQ ID NO: 2612233 - RNA, 17 nt, Human
ccuguacuguucugugu

SEQ ID NO: 2612234 - RNA, 16 nt, Human
ccuguacucuuccgaa

SEQ ID NO: 2612235 - RNA, 15 nt, Human
ccuguacucuuccga

SEQ ID NO: 2612236 - RNA, 20 nt, Human
ccuguacucgcuugugcaga

SEQ ID NO: 2612237 - RNA, 19 nt, Human
ccuguacucgcuugugcag

SEQ ID NO: 2612238 - RNA, 18 nt, Human
ccuguacucgcuugugca

SEQ ID NO: 2612239 - RNA, 17 nt, Human
ccuguacucgcuugugc

SEQ ID NO: 2612240 - RNA, 23 nt, Human
ccuguacucaggaggcugagggg

SEQ ID NO: 2612241 - RNA, 22 nt, Human
ccuguauucucaaacacaguua

SEQ ID NO: 2612242 - RNA, 14 nt, Human
ccuguauguugucc

SEQ ID NO: 2612243 - RNA, 13 nt, Human
ccuguauguuguc

SEQ ID NO: 2612244 - RNA, 17 nt, Human
ccuguaugucuccagua

SEQ ID NO: 2612245 - RNA, 16 nt, Human
ccuguaugucuccagu

SEQ ID NO: 2612246 - RNA, 19 nt, Human
ccuguaguugcguggacuc

SEQ ID NO: 2612247 - RNA, 23 nt, Human
ccugucaaacaaagccagaagcu

SEQ ID NO: 2612248 - RNA, 20 nt, Human
ccugucaaacaaagccagaa

SEQ ID NO: 2612249 - RNA, 22 nt, Human
ccugucaaacaaagccagaagc

SEQ ID NO: 2612250 - RNA, 17 nt, Human
ccuguauuuucuuucuc

SEQ ID NO: 2612251 - RNA, 18 nt, Human
ccugucaaacaaagccag

SEQ ID NO: 2612252 - RNA, 19 nt, Human
ccugucaaacaaagccaga

SEQ ID NO: 2612253 - RNA, 18 nt, Human
ccuguaguugcguggacu

SEQ ID NO: 2612254 - RNA, 23 nt, Human
ccuguaguuaggaaauaaaaccu

SEQ ID NO: 2612255 - RNA, 21 nt, Human
ccuguaguuaggaaauaaaac

SEQ ID NO: 2612256 - RNA, 22 nt, Human
ccuguaguuaggaaauaaaacc

SEQ ID NO: 2612257 - RNA, 16 nt, Human
ccuguaguuaggaaau

SEQ ID NO: 2612258 - RNA, 17 nt, Human
ccuguaguuaggaaaua

SEQ ID NO: 2612259 - RNA, 18 nt, Human
ccuguaguuaggaaauaa

SEQ ID NO: 2612260 - RNA, 19 nt, Human
ccuguaguuaggaaauaaa

SEQ ID NO: 2612261 - RNA, 15 nt, Human
ccuguagucccagcu

SEQ ID NO: 2612262 - RNA, 16 nt, Human
ccuguagucccagcua

SEQ ID NO: 2612263 - RNA, 13 nt, Human
ccuguaguccuag

SEQ ID NO: 2612264 - RNA, 14 nt, Human
ccuguaguuaggaa

SEQ ID NO: 2612265 - RNA, 15 nt, Human
ccuguaguuaggaaa

SEQ ID NO: 2612266 - RNA, 19 nt, Human
ccuguagucccagccacuc

SEQ ID NO: 2612267 - RNA, 18 nt, Human
ccuguagucccagccacu

SEQ ID NO: 2612268 - RNA, 14 nt, Human
ccuguagucccagc

SEQ ID NO: 2612269 - RNA, 13 nt, Human
ccuguagucccag

SEQ ID NO: 2612270 - RNA, 19 nt, Human
ccugcguucuugugacaga

SEQ ID NO: 2612271 - RNA, 22 nt, Human
ccugcguuuuggaagcucugaa

SEQ ID NO: 2612272 - RNA, 17 nt, Human
ccugcguggggacaggg

SEQ ID NO: 2612273 - RNA, 16 nt, Human
ccugcguggggacagg

SEQ ID NO: 2612274 - RNA, 15 nt, Human
ccugcguggggacag

SEQ ID NO: 2612275 - RNA, 13 nt, Human
ccugcguggggac

SEQ ID NO: 2612276 - RNA, 12 nt, Human
ccugcgugggga

SEQ ID NO: 2612277 - RNA, 16 nt, Human
ccugcuccagaccuga

SEQ ID NO: 2612278 - RNA, 22 nt, Human
ccugcuccagaccugauccugg

SEQ ID NO: 2612279 - RNA, 12 nt, Human
ccugcuccagcu

SEQ ID NO: 2612280 - RNA, 13 nt, Human
ccugcuccagcug

SEQ ID NO: 2612281 - RNA, 14 nt, Human
ccugcuccagcugu

SEQ ID NO: 2612282 - RNA, 16 nt, Human
ccugcucccaggccag

SEQ ID NO: 2612283 - RNA, 12 nt, Human
ccugcucccagg

SEQ ID NO: 2612284 - RNA, 23 nt, Human
ccugcucccagcagcccuaagga

SEQ ID NO: 2612285 - RNA, 16 nt, Human
ccugcucccagcagcc

SEQ ID NO: 2612286 - RNA, 15 nt, Human
ccugcucccagcagc

SEQ ID NO: 2612287 - RNA, 14 nt, Human
ccugcucccagcag

SEQ ID NO: 2612288 - RNA, 13 nt, Human
ccugcucccagca

SEQ ID NO: 2612289 - RNA, 12 nt, Human
ccugcucccagc

SEQ ID NO: 2612290 - RNA, 22 nt, Human
ccugcuccagcuguucagcugg

SEQ ID NO: 2612291 - RNA, 16 nt, Human
ccugcaaccugauugu

SEQ ID NO: 2612292 - RNA, 19 nt, Human
ccugcaacaccuuguuucc

SEQ ID NO: 2612293 - RNA, 23 nt, Human
ccugcgucgaagcuuugaaggcc

SEQ ID NO: 2612294 - RNA, 22 nt, Human
ccugcguccuccucaccucaug

SEQ ID NO: 2612295 - RNA, 20 nt, Human
ccugcguccuccucaccuca

SEQ ID NO: 2612296 - RNA, 23 nt, Human
ccugcgucucauacucaccucac

SEQ ID NO: 2612297 - RNA, 18 nt, Human
ccugcaacaccuuguuuc

SEQ ID NO: 2612298 - RNA, 19 nt, Human
ccugcaaagcccagcuuga

SEQ ID NO: 2612299 - RNA, 17 nt, Human
ccugauuugcugggcag

SEQ ID NO: 2612300 - RNA, 22 nt, Human
ccugauuugcugggcaguuuuu

SEQ ID NO: 2612301 - RNA, 20 nt, Human
ccugauuuacaguuucaaaa

SEQ ID NO: 2612302 - RNA, 17 nt, Human
ccugauuuacaguuuca

SEQ ID NO: 2612303 - RNA, 14 nt, Human
ccugauuuacaguu

SEQ ID NO: 2612304 - RNA, 18 nt, Human
ccugauuuaggagaagcc

SEQ ID NO: 2612305 - RNA, 19 nt, Human
ccugauuuaggagaagcca

SEQ ID NO: 2612306 - RNA, 20 nt, Human
ccugauuuaggagaagccag

SEQ ID NO: 2612307 - RNA, 21 nt, Human
ccugauuuaggagaagccagg

SEQ ID NO: 2612308 - RNA, 22 nt, Human
ccugauuuaggagaagccagga

SEQ ID NO: 2612309 - RNA, 20 nt, Human
ccugcuuggguggagaagcc

SEQ ID NO: 2612310 - RNA, 23 nt, Human
ccugcuuggguggagaagccauu

SEQ ID NO: 2612311 - RNA, 22 nt, Human
ccugcuuggguggagaagccau

SEQ ID NO: 2612312 - RNA, 21 nt, Human
ccugcuuggguggagaagcca

SEQ ID NO: 2612313 - RNA, 20 nt, Human
ccugcuuuuuauggccugug

SEQ ID NO: 2612314 - RNA, 16 nt, Human
ccuggaaaccacaguc

SEQ ID NO: 2612315 - RNA, 15 nt, Human
ccuggaaaccacagu

SEQ ID NO: 2612316 - RNA, 12 nt, Human
ccuggaaaccac

SEQ ID NO: 2612317 - RNA, 17 nt, Human
ccuggaaaccacagucc

SEQ ID NO: 2612318 - RNA, 17 nt, Human
ccugcuuugggcugccc

SEQ ID NO: 2612319 - RNA, 18 nt, Human
ccugcuuugggcugcccu

SEQ ID NO: 2612320 - RNA, 18 nt, Human
ccugcuccucccuggcug

SEQ ID NO: 2612321 - RNA, 17 nt, Human
ccugcuccucccuggcu

SEQ ID NO: 2612322 - RNA, 16 nt, Human
ccugcuccucccuggc

SEQ ID NO: 2612323 - RNA, 15 nt, Human
ccugcuccucccugg

SEQ ID NO: 2612324 - RNA, 15 nt, Human
ccugcucccucccau

SEQ ID NO: 2612325 - RNA, 18 nt, Human
ccugcucccccacccccu

SEQ ID NO: 2612326 - RNA, 23 nt, Human
ccugcucccccacccccucccca

SEQ ID NO: 2612327 - RNA, 14 nt, Human
ccugcucccccacc

SEQ ID NO: 2612328 - RNA, 16 nt, Human
ccugcucccccacccc

SEQ ID NO: 2612329 - RNA, 21 nt, Human
ccugcuggguguggcgcagca

SEQ ID NO: 2612330 - RNA, 20 nt, Human
ccugcuccucccuggcugcc

SEQ ID NO: 2612331 - RNA, 19 nt, Human
ccugcuccucccuggcugc

SEQ ID NO: 2612332 - RNA, 17 nt, Human
ccugcuggucacagccu

SEQ ID NO: 2612333 - RNA, 13 nt, Human
ccugcugguucag

SEQ ID NO: 2612334 - RNA, 19 nt, Human
ccugcugguucaggguugg

SEQ ID NO: 2612335 - RNA, 22 nt, Human
ccugcuuccaggaaacuccaca

SEQ ID NO: 2612336 - RNA, 20 nt, Human
ccugcuggucacagccuccu

SEQ ID NO: 2612337 - RNA, 18 nt, Human
ccugcuggucacagccuc

SEQ ID NO: 2612338 - RNA, 22 nt, Human
ccugcuucuccagccuggaccc

SEQ ID NO: 2612339 - RNA, 20 nt, Human
ccugcuucuccagccuggac

SEQ ID NO: 2612340 - RNA, 17 nt, Human
ccugcuucuccagccug

SEQ ID NO: 2612341 - RNA, 16 nt, Human
ccugcuucuccagccu

SEQ ID NO: 2612342 - RNA, 15 nt, Human
ccugcuucuccagcc

SEQ ID NO: 2612343 - RNA, 14 nt, Human
ccugcuucuccagc

SEQ ID NO: 2612344 - RNA, 22 nt, Human
ccugcuuccugucuuugggaga

SEQ ID NO: 2612345 - RNA, 15 nt, Human
ccugcuuccugucuu

SEQ ID NO: 2612346 - RNA, 16 nt, Human
ccuggagccccugggu

SEQ ID NO: 2612347 - RNA, 14 nt, Human
ccuggagccccugg

SEQ ID NO: 2612348 - RNA, 17 nt, Human
ccuggagccccugggug

SEQ ID NO: 2612349 - RNA, 21 nt, Human
ccuggcacugcuuccagugag

SEQ ID NO: 2612350 - RNA, 16 nt, Human
ccuggcagccccuguu

SEQ ID NO: 2612351 - RNA, 14 nt, Human
ccuggcagccccug

SEQ ID NO: 2612352 - RNA, 13 nt, Human
ccuggcagaacug

SEQ ID NO: 2612353 - RNA, 17 nt, Human
ccuggcaugggaaugaa

SEQ ID NO: 2612354 - RNA, 16 nt, Human
ccuggcaugggaauga

SEQ ID NO: 2612355 - RNA, 19 nt, Human
ccuggcagccgugccuuca

SEQ ID NO: 2612356 - RNA, 18 nt, Human
ccuggcagccgugccuuc

SEQ ID NO: 2612357 - RNA, 12 nt, Human
ccuggcagccgu

SEQ ID NO: 2612358 - RNA, 17 nt, Human
ccuggcacugcuuccag

SEQ ID NO: 2612359 - RNA, 20 nt, Human
ccuggcacugcuuccaguga

SEQ ID NO: 2612360 - RNA, 18 nt, Human
ccuggagccaacugcugc

SEQ ID NO: 2612361 - RNA, 15 nt, Human
ccuggagccaacugc

SEQ ID NO: 2612362 - RNA, 19 nt, Human
ccuggagcaggccuugcgc

SEQ ID NO: 2612363 - RNA, 18 nt, Human
ccuggagcaggccuugcg

SEQ ID NO: 2612364 - RNA, 22 nt, Human
ccuggagccagacucuggucuu

SEQ ID NO: 2612365 - RNA, 16 nt, Human
ccuggagccagacucu

SEQ ID NO: 2612366 - RNA, 13 nt, Human
ccuggagcccaga

SEQ ID NO: 2612367 - RNA, 17 nt, Human
ccuggagcccagaggag

SEQ ID NO: 2612368 - RNA, 14 nt, Human
ccuggagcccagag

SEQ ID NO: 2612369 - RNA, 13 nt, Human
ccuggagccccug

SEQ ID NO: 2612370 - RNA, 11 nt, Human
ccuggagcccc

SEQ ID NO: 2612371 - RNA, 12 nt, Human
ccuggagccccu

SEQ ID NO: 2612372 - RNA, 15 nt, Human
ccuggagcaggccuu

SEQ ID NO: 2612373 - RNA, 14 nt, Human
ccuggagcaggccu

SEQ ID NO: 2612374 - RNA, 13 nt, Human
ccuggagcaggcc

SEQ ID NO: 2612375 - RNA, 18 nt, Human
ccuggagcagaccacccc

SEQ ID NO: 2612376 - RNA, 21 nt, Human
ccuggagauccuccugcagac

SEQ ID NO: 2612377 - RNA, 14 nt, Human
ccuggacugggagg

SEQ ID NO: 2612378 - RNA, 13 nt, Human
ccuggacugggag

SEQ ID NO: 2612379 - RNA, 18 nt, Human
ccuggacugggagguaga

SEQ ID NO: 2612380 - RNA, 17 nt, Human
ccuggacugggagguag

SEQ ID NO: 2612381 - RNA, 14 nt, Human
ccuggacuguuuuc

SEQ ID NO: 2612382 - RNA, 19 nt, Human
ccuggagauccuccugcag

SEQ ID NO: 2612383 - RNA, 17 nt, Human
ccuggacccccagcuuu

SEQ ID NO: 2612384 - RNA, 16 nt, Human
ccuggacccccagcuu

SEQ ID NO: 2612385 - RNA, 15 nt, Human
ccuggacccccagcu

SEQ ID NO: 2612386 - RNA, 12 nt, Human
ccuggaccccca

SEQ ID NO: 2612387 - RNA, 20 nt, Human
ccuggacauuuuuucaguca

SEQ ID NO: 2612388 - RNA, 19 nt, Human
ccuggacauuuuuucaguc

SEQ ID NO: 2612389 - RNA, 21 nt, Human
ccuggacaugaagauucuuuc

SEQ ID NO: 2612390 - RNA, 23 nt, Human
ccuggacaugaagauucuuuccc

SEQ ID NO: 2612391 - RNA, 21 nt, Human
ccuggacauuugccuugcugg

SEQ ID NO: 2612392 - RNA, 20 nt, Human
ccuggacauuugccuugcug

SEQ ID NO: 2612393 - RNA, 24 nt, Human
ccuggacaugaagauucuuuccca

SEQ ID NO: 2612394 - RNA, 20 nt, Human
ccuggacauccucuucugcu

SEQ ID NO: 2612395 - RNA, 18 nt, Human
ccuggacauagagaggga

SEQ ID NO: 2612396 - RNA, 23 nt, Human
ccuggaaaggcucagucucagga

SEQ ID NO: 2612397 - RNA, 15 nt, Human
ccuggaaaggcucag

SEQ ID NO: 2612398 - RNA, 17 nt, Human
ccuggaaaggcucaguc

SEQ ID NO: 2612399 - RNA, 20 nt, Human
ccuggaaaggcucagucuca

SEQ ID NO: 2612400 - RNA, 21 nt, Human
ccuggaaaggcucagucucag

SEQ ID NO: 2612401 - RNA, 22 nt, Human
ccuggaaaggcucagucucagg

SEQ ID NO: 2612402 - RNA, 23 nt, Human
ccuggaccugccuccugccugcc

SEQ ID NO: 2612403 - RNA, 22 nt, Human
ccuggaccugccuccugccugc

SEQ ID NO: 2612404 - RNA, 20 nt, Human
ccuggaccugccuccugccu

SEQ ID NO: 2612405 - RNA, 16 nt, Human
ccuggaccugccuccu

SEQ ID NO: 2612406 - RNA, 14 nt, Human
ccuggaccugccuc

SEQ ID NO: 2612407 - RNA, 13 nt, Human
ccuggaccugccu

SEQ ID NO: 2612408 - RNA, 23 nt, Human
ccuggaccugcccugggccacac

SEQ ID NO: 2612409 - RNA, 21 nt, Human
ccuggaccugcccugggccac

SEQ ID NO: 2612410 - RNA, 13 nt, Human
ccuggacccugug

SEQ ID NO: 2612411 - RNA, 14 nt, Human
ccuggacccugugg

SEQ ID NO: 2612412 - RNA, 20 nt, Human
ccuggacugugugcucagga

SEQ ID NO: 2612413 - RNA, 17 nt, Human
ccuggacugugugcuca

SEQ ID NO: 2612414 - RNA, 14 nt, Human
ccuggacuccugca

SEQ ID NO: 2612415 - RNA, 15 nt, Human
ccuggacuagaggga

SEQ ID NO: 2612416 - RNA, 22 nt, Human
ccuggacuagagggaccucucc

SEQ ID NO: 2612417 - RNA, 18 nt, Human
ccuggcaugggaaugaau

SEQ ID NO: 2612418 - RNA, 14 nt, Human
ccuggccaggagcu

SEQ ID NO: 2612419 - RNA, 15 nt, Human
ccuggccaggagcuc

SEQ ID NO: 2612420 - RNA, 16 nt, Human
ccuggccaggagcucu

SEQ ID NO: 2612421 - RNA, 18 nt, Human
ccuggccaggagcucuuc

SEQ ID NO: 2612422 - RNA, 19 nt, Human
ccuggccaggagcucuuca

SEQ ID NO: 2612423 - RNA, 20 nt, Human
ccuggccaggagcucuucag

SEQ ID NO: 2612424 - RNA, 21 nt, Human
ccuggccaggagcucuucagg

SEQ ID NO: 2612425 - RNA, 13 nt, Human
ccuggccaggcac

SEQ ID NO: 2612426 - RNA, 12 nt, Human
ccuggccaggca

SEQ ID NO: 2612427 - RNA, 22 nt, Human
ccuggccaggagcucuucaggc

SEQ ID NO: 2612428 - RNA, 21 nt, Human
ccuggcccccacccucugcca

SEQ ID NO: 2612429 - RNA, 12 nt, Human
ccuggcccccag

SEQ ID NO: 2612430 - RNA, 14 nt, Human
ccuggcccccagcu

SEQ ID NO: 2612431 - RNA, 15 nt, Human
ccuggccccaugucu

SEQ ID NO: 2612432 - RNA, 17 nt, Human
ccuggccccaugucucu

SEQ ID NO: 2612433 - RNA, 18 nt, Human
ccuggccccaugucucuc

SEQ ID NO: 2612434 - RNA, 20 nt, Human
ccuggccccaugucucucag

SEQ ID NO: 2612435 - RNA, 21 nt, Human
ccuggccccaugucucucaga

SEQ ID NO: 2612436 - RNA, 23 nt, Human
ccuggccagggccuggaagacag

SEQ ID NO: 2612437 - RNA, 20 nt, Human
ccuggccagggccuggaaga

SEQ ID NO: 2612438 - RNA, 14 nt, Human
ccuggccaucccac

SEQ ID NO: 2612439 - RNA, 15 nt, Human
ccuggccaucccaca

SEQ ID NO: 2612440 - RNA, 18 nt, Human
ccuggccccauggucagc

SEQ ID NO: 2612441 - RNA, 14 nt, Human
ccuggccccauguc

SEQ ID NO: 2612442 - RNA, 19 nt, Human
ccuggccagggccuggaag

SEQ ID NO: 2612443 - RNA, 15 nt, Human
ccuggccagggccug

SEQ ID NO: 2612444 - RNA, 14 nt, Human
ccuggccagggccu

SEQ ID NO: 2612445 - RNA, 21 nt, Human
ccuggccaggcacccccugga

SEQ ID NO: 2612446 - RNA, 14 nt, Human
ccuggccaggcaga

SEQ ID NO: 2612447 - RNA, 22 nt, Human
ccuggccaggcagaucugugcc

SEQ ID NO: 2612448 - RNA, 15 nt, Human
ccuggccuuucauau

SEQ ID NO: 2612449 - RNA, 14 nt, Human
ccuggccccucagg

SEQ ID NO: 2612450 - RNA, 20 nt, Human
ccuggcgacugccccugccu

SEQ ID NO: 2612451 - RNA, 14 nt, Human
ccuggccuuucaua

SEQ ID NO: 2612452 - RNA, 12 nt, Human
ccuggcggggug

SEQ ID NO: 2612453 - RNA, 17 nt, Human
ccuggcucagagccagu

SEQ ID NO: 2612454 - RNA, 16 nt, Human
ccuggcucagagccag

SEQ ID NO: 2612455 - RNA, 13 nt, Human
ccuggcucagagc

SEQ ID NO: 2612456 - RNA, 20 nt, Human
ccuggcgggaugggccaccg

SEQ ID NO: 2612457 - RNA, 19 nt, Human
ccuggcgggaugggccacc

SEQ ID NO: 2612458 - RNA, 17 nt, Human
ccuggcgggaugggcca

SEQ ID NO: 2612459 - RNA, 13 nt, Human
ccuggcgggaugg

SEQ ID NO: 2612460 - RNA, 21 nt, Human
ccuggcgggaugggccaccgc

SEQ ID NO: 2612461 - RNA, 22 nt, Human
ccuggcucugcaaugggcacug

SEQ ID NO: 2612462 - RNA, 16 nt, Human
ccuggcucucagaagg

SEQ ID NO: 2612463 - RNA, 11 nt, Human
ccuggcucuga

SEQ ID NO: 2612464 - RNA, 20 nt, Human
ccuggcucugaccgaaacag

SEQ ID NO: 2612465 - RNA, 14 nt, Human
ccuggcugaaggac

SEQ ID NO: 2612466 - RNA, 13 nt, Human
ccuggcugaagga

SEQ ID NO: 2612467 - RNA, 20 nt, Human
ccuggcucuugugcuggaug

SEQ ID NO: 2612468 - RNA, 13 nt, Human
ccuggcucuugug

SEQ ID NO: 2612469 - RNA, 12 nt, Human
ccugggcagaag

SEQ ID NO: 2612470 - RNA, 23 nt, Human
ccugggcaaaugaauggcucacu

SEQ ID NO: 2612471 - RNA, 21 nt, Human
ccugggcaaaugaauggcuca

SEQ ID NO: 2612472 - RNA, 23 nt, Human
ccugggauguggcugcagcagcg

SEQ ID NO: 2612473 - RNA, 21 nt, Human
ccugggauguggcugcagcag

SEQ ID NO: 2612474 - RNA, 13 nt, Human
ccugggcaaagcc

SEQ ID NO: 2612475 - RNA, 15 nt, Human
ccugggaucugcucg

SEQ ID NO: 2612476 - RNA, 21 nt, Human
ccugggaugagaguuuuggau

SEQ ID NO: 2612477 - RNA, 20 nt, Human
ccugggauguccacagaugc

SEQ ID NO: 2612478 - RNA, 22 nt, Human
ccugggauguccacagaugccu

SEQ ID NO: 2612479 - RNA, 14 nt, Human
ccugggcagaagga

SEQ ID NO: 2612480 - RNA, 15 nt, Human
ccugggcaccugggg

SEQ ID NO: 2612481 - RNA, 20 nt, Human
ccugggcaccuggggagugg

SEQ ID NO: 2612482 - RNA, 21 nt, Human
ccugggaggcucuggagccca

SEQ ID NO: 2612483 - RNA, 13 nt, Human
ccugggaggcucu

SEQ ID NO: 2612484 - RNA, 16 nt, Human
ccuggcugagguuccu

SEQ ID NO: 2612485 - RNA, 19 nt, Human
ccuggcugagccuggcugg

SEQ ID NO: 2612486 - RNA, 18 nt, Human
ccuggcugagccuggcug

SEQ ID NO: 2612487 - RNA, 23 nt, Human
ccuggcugaccccaaagagccug

SEQ ID NO: 2612488 - RNA, 22 nt, Human
ccuggcugaccccaaagagccu

SEQ ID NO: 2612489 - RNA, 20 nt, Human
ccuggcugaaggacugugac

SEQ ID NO: 2612490 - RNA, 19 nt, Human
ccuggcugaaggacuguga

SEQ ID NO: 2612491 - RNA, 16 nt, Human
ccuggcugaaggacug

SEQ ID NO: 2612492 - RNA, 22 nt, Human
ccuggcugagguuccucugccu

SEQ ID NO: 2612493 - RNA, 21 nt, Human
ccuggcugagguuccucugcc

SEQ ID NO: 2612494 - RNA, 20 nt, Human
ccuggcugagguuccucugc

SEQ ID NO: 2612495 - RNA, 19 nt, Human
ccuggcugagguuccucug

SEQ ID NO: 2612496 - RNA, 13 nt, Human
ccugggaggcagu

SEQ ID NO: 2612497 - RNA, 20 nt, Human
ccugggaucccucauccuca

SEQ ID NO: 2612498 - RNA, 16 nt, Human
ccugggaucccucauc

SEQ ID NO: 2612499 - RNA, 20 nt, Human
ccugggaggucaaggcugca

SEQ ID NO: 2612500 - RNA, 16 nt, Human
ccugggaggcggagag

SEQ ID NO: 2612501 - RNA, 14 nt, Human
ccugggaggcggag

SEQ ID NO: 2612502 - RNA, 23 nt, Human
ccuggcugagguuccucugccug

SEQ ID NO: 2612503 - RNA, 23 nt, Human
ccugggaggcggagaguacagug

SEQ ID NO: 2612504 - RNA, 15 nt, Human
cccuguuuguuucug

SEQ ID NO: 2612505 - RNA, 21 nt, Human
cccuguuuaauauuuaaacag

SEQ ID NO: 2612506 - RNA, 20 nt, Human
cccuguuugaagccugcccu

SEQ ID NO: 2612507 - RNA, 14 nt, Human
cccuguuuccugag

SEQ ID NO: 2612508 - RNA, 15 nt, Human
cccuuacagccucug

SEQ ID NO: 2612509 - RNA, 14 nt, Human
cccuuacacuuacu

SEQ ID NO: 2612510 - RNA, 16 nt, Human
cccuuacacguaccuc

SEQ ID NO: 2612511 - RNA, 15 nt, Human
cccuuacacguaccu

SEQ ID NO: 2612512 - RNA, 18 nt, Human
cccuuacagccucugacu

SEQ ID NO: 2612513 - RNA, 17 nt, Human
cccuuacagccucugac

SEQ ID NO: 2612514 - RNA, 14 nt, Human
cccuuacaguagga

SEQ ID NO: 2612515 - RNA, 16 nt, Human
cccuguuuguuucuga

SEQ ID NO: 2612516 - RNA, 19 nt, Human
cccuguuuaauauuuaaac

SEQ ID NO: 2612517 - RNA, 18 nt, Human
cccuguuuaauauuuaaa

SEQ ID NO: 2612518 - RNA, 17 nt, Human
cccuguuuaauauuuaa

SEQ ID NO: 2612519 - RNA, 16 nt, Human
cccuguuuaauauuua

SEQ ID NO: 2612520 - RNA, 14 nt, Human
cccuguuuaauauu

SEQ ID NO: 2612521 - RNA, 11 nt, Human
cccuguuuaau

SEQ ID NO: 2612522 - RNA, 11 nt, Human
cccuguugcua

SEQ ID NO: 2612523 - RNA, 23 nt, Human
cccuguggggaucucaggggcug

SEQ ID NO: 2612524 - RNA, 20 nt, Human
cccuguggggaucucagggg

SEQ ID NO: 2612525 - RNA, 15 nt, Human
cccuguggggaucuc

SEQ ID NO: 2612526 - RNA, 20 nt, Human
cccuguugacgaagucucuu

SEQ ID NO: 2612527 - RNA, 18 nt, Human
cccugugggcccccaaau

SEQ ID NO: 2612528 - RNA, 14 nt, Human
cccuguggggaucu

SEQ ID NO: 2612529 - RNA, 12 nt, Human
cccuguggggau

SEQ ID NO: 2612530 - RNA, 22 nt, Human
cccugucccucccaccucugug

SEQ ID NO: 2612531 - RNA, 21 nt, Human
cccugucccucccaccucugu

SEQ ID NO: 2612532 - RNA, 13 nt, Human
cccugucccccag

SEQ ID NO: 2612533 - RNA, 18 nt, Human
cccuguacuguucugugu

SEQ ID NO: 2612534 - RNA, 19 nt, Human
cccuguaccuuuugaggag

SEQ ID NO: 2612535 - RNA, 21 nt, Human
cccuguccaaacugccuaagc

SEQ ID NO: 2612536 - RNA, 22 nt, Human
cccugguuuccugcccugggag

SEQ ID NO: 2612537 - RNA, 23 nt, Human
cccugguuuccugcccugggagg

SEQ ID NO: 2612538 - RNA, 17 nt, Human
ccccucccgccccuucc

SEQ ID NO: 2612539 - RNA, 18 nt, Human
ccccuccccugcugcagg

SEQ ID NO: 2612540 - RNA, 17 nt, Human
cccuguacaauauuuaa

SEQ ID NO: 2612541 - RNA, 22 nt, Human
ccccucccgucuacucauuccc

SEQ ID NO: 2612542 - RNA, 18 nt, Human
cccuguacaauauuuaaa

SEQ ID NO: 2612543 - RNA, 15 nt, Human
cccugugggccccca

SEQ ID NO: 2612544 - RNA, 20 nt, Human
cccugucccucccaccucug

SEQ ID NO: 2612545 - RNA, 19 nt, Human
cccugucccucccaccucu

SEQ ID NO: 2612546 - RNA, 18 nt, Human
cccugucccucccaccuc

SEQ ID NO: 2612547 - RNA, 17 nt, Human
cccugucccucccaccu

SEQ ID NO: 2612548 - RNA, 16 nt, Human
cccugugggcccccaa

SEQ ID NO: 2612549 - RNA, 19 nt, Human
cccuguccccucagcucca

SEQ ID NO: 2612550 - RNA, 18 nt, Human
cccuguccccucagcucc

SEQ ID NO: 2612551 - RNA, 13 nt, Human
cccuguccccuca

SEQ ID NO: 2612552 - RNA, 19 nt, Human
cccugucccccagcucugg

SEQ ID NO: 2612553 - RNA, 18 nt, Human
cccugucccccagcucug

SEQ ID NO: 2612554 - RNA, 17 nt, Human
cccugucccccagcucu

SEQ ID NO: 2612555 - RNA, 16 nt, Human
cccugucccccagcuc

SEQ ID NO: 2612556 - RNA, 15 nt, Human
cccugucccccagcu

SEQ ID NO: 2612557 - RNA, 16 nt, Human
cccugucccucccacc

SEQ ID NO: 2612558 - RNA, 15 nt, Human
cccugucccucccac

SEQ ID NO: 2612559 - RNA, 14 nt, Human
cccugucccuccca

SEQ ID NO: 2612560 - RNA, 13 nt, Human
cccugucccuccc

SEQ ID NO: 2612561 - RNA, 12 nt, Human
cccugucccucc

SEQ ID NO: 2612562 - RNA, 10 nt, Human
cccugucccu

SEQ ID NO: 2612563 - RNA, 20 nt, Human
cccuguccccucccccuucc

SEQ ID NO: 2612564 - RNA, 19 nt, Human
cccugguggcagugggagc

SEQ ID NO: 2612565 - RNA, 16 nt, Human
cccugguggcaguggg

SEQ ID NO: 2612566 - RNA, 21 nt, Human
cccugguuuccugcccuggga

SEQ ID NO: 2612567 - RNA, 15 nt, Human
cccugguggcagugg

SEQ ID NO: 2612568 - RNA, 21 nt, Human
cccugguggcagugggagcug

SEQ ID NO: 2612569 - RNA, 13 nt, Human
ccccucccauuag

SEQ ID NO: 2612570 - RNA, 20 nt, Human
ccccuccccauuagcuuuca

SEQ ID NO: 2612571 - RNA, 15 nt, Human
ccccucccccaaccc

SEQ ID NO: 2612572 - RNA, 11 nt, Human
ccccucccauu

SEQ ID NO: 2612573 - RNA, 14 nt, Human
ccccucccaucugg

SEQ ID NO: 2612574 - RNA, 15 nt, Human
ccccuccccagggga

SEQ ID NO: 2612575 - RNA, 17 nt, Human
ccccuagcccaggagag

SEQ ID NO: 2612576 - RNA, 13 nt, Human
ccccuagcccagg

SEQ ID NO: 2612577 - RNA, 13 nt, Human
ccccucccaucug

SEQ ID NO: 2612578 - RNA, 11 nt, Human
ccccucccauc

SEQ ID NO: 2612579 - RNA, 14 nt, Human
ccccucccagggcc

SEQ ID NO: 2612580 - RNA, 21 nt, Human
ccccucccccaacccccaccc

SEQ ID NO: 2612581 - RNA, 16 nt, Human
ccccucccccaacccc

SEQ ID NO: 2612582 - RNA, 18 nt, Human
ccccucccccaaccccca

SEQ ID NO: 2612583 - RNA, 15 nt, Human
ccccuccccugcugc

SEQ ID NO: 2612584 - RNA, 21 nt, Human
ccccuccccggcccuaccagc

SEQ ID NO: 2612585 - RNA, 13 nt, Human
ccccuccccugcu

SEQ ID NO: 2612586 - RNA, 14 nt, Human
ccccucccccuucu

SEQ ID NO: 2612587 - RNA, 19 nt, Human
ccccuccccuaaugccugc

SEQ ID NO: 2612588 - RNA, 14 nt, Human
ccccguuucuggug

SEQ ID NO: 2612589 - RNA, 20 nt, Human
ccccgucugggguucagccc

SEQ ID NO: 2612590 - RNA, 21 nt, Human
ccccgucugggguucagcccc

SEQ ID NO: 2612591 - RNA, 22 nt, Human
ccccgucugggguucagccccu

SEQ ID NO: 2612592 - RNA, 14 nt, Human
ccccgucuguggcu

SEQ ID NO: 2612593 - RNA, 15 nt, Human
ccccgugcagacugg

SEQ ID NO: 2612594 - RNA, 19 nt, Human
ccccgugcagacuggaggg

SEQ ID NO: 2612595 - RNA, 22 nt, Human
ccccuacccccuccucucugcc

SEQ ID NO: 2612596 - RNA, 22 nt, Human
ccccuaccccacaccaggccgu

SEQ ID NO: 2612597 - RNA, 20 nt, Human
ccccuaccccacaccaggcc

SEQ ID NO: 2612598 - RNA, 13 nt, Human
ccccuaccccaca

SEQ ID NO: 2612599 - RNA, 20 nt, Human
ccccuaccacugucuucuuc

SEQ ID NO: 2612600 - RNA, 15 nt, Human
ccccuaccacugucu

SEQ ID NO: 2612601 - RNA, 23 nt, Human
ccccuaaugacaucaccacaguu

SEQ ID NO: 2612602 - RNA, 18 nt, Human
ccccuaaugccugcggag

SEQ ID NO: 2612603 - RNA, 20 nt, Human
ccccucagggucccuggugg

SEQ ID NO: 2612604 - RNA, 18 nt, Human
ccccucagggucccuggu

SEQ ID NO: 2612605 - RNA, 17 nt, Human
ccccucagggucccugg

SEQ ID NO: 2612606 - RNA, 12 nt, Human
ccccuagcccag

SEQ ID NO: 2612607 - RNA, 18 nt, Human
cccccgggaggggcccgc

SEQ ID NO: 2612608 - RNA, 14 nt, Human
cccccuccucuccc

SEQ ID NO: 2612609 - RNA, 15 nt, Human
cccccgggaggggcc

SEQ ID NO: 2612610 - RNA, 15 nt, Human
cccccggcccccugg

SEQ ID NO: 2612611 - RNA, 14 nt, Human
cccccggcccccug

SEQ ID NO: 2612612 - RNA, 23 nt, Human
cccccgcuguaaugaaacaccuu

SEQ ID NO: 2612613 - RNA, 21 nt, Human
cccccgcgcgcgucccccugc

SEQ ID NO: 2612614 - RNA, 13 nt, Human
cccccggcccccu

SEQ ID NO: 2612615 - RNA, 21 nt, Human
cccccgcugucagccauuccu

SEQ ID NO: 2612616 - RNA, 18 nt, Human
cccccucgugccagucgc

SEQ ID NO: 2612617 - RNA, 13 nt, Human
cccccucgugcca

SEQ ID NO: 2612618 - RNA, 22 nt, Human
cccccucgggucuccucacucc

SEQ ID NO: 2612619 - RNA, 16 nt, Human
cccccuccugcugcag

SEQ ID NO: 2612620 - RNA, 13 nt, Human
cccccuccugcug

SEQ ID NO: 2612621 - RNA, 12 nt, Human
cccccuccugcu

SEQ ID NO: 2612622 - RNA, 13 nt, Human
cccccuccucucu

SEQ ID NO: 2612623 - RNA, 22 nt, Human
cccccuccucucccaucccccu

SEQ ID NO: 2612624 - RNA, 15 nt, Human
cccccuccugcugca

SEQ ID NO: 2612625 - RNA, 14 nt, Human
cccccuccugcugc

SEQ ID NO: 2612626 - RNA, 15 nt, Human
cccccuccuugcucu

SEQ ID NO: 2612627 - RNA, 21 nt, Human
cccccgagcugggggccauga

SEQ ID NO: 2612628 - RNA, 12 nt, Human
cccccgccacuc

SEQ ID NO: 2612629 - RNA, 18 nt, Human
cccccgcccaggcuggcc

SEQ ID NO: 2612630 - RNA, 13 nt, Human
cccccgcccaggc

SEQ ID NO: 2612631 - RNA, 12 nt, Human
cccccgcccccu

SEQ ID NO: 2612632 - RNA, 11 nt, Human
cccccgccccg

SEQ ID NO: 2612633 - RNA, 18 nt, Human
cccccgccccgccccaca

SEQ ID NO: 2612634 - RNA, 16 nt, Human
cccccgcccccugccc

SEQ ID NO: 2612635 - RNA, 14 nt, Human
cccccgcccccugc

SEQ ID NO: 2612636 - RNA, 13 nt, Human
cccccgcccccug

SEQ ID NO: 2612637 - RNA, 14 nt, Human
ccccccucaccagg

SEQ ID NO: 2612638 - RNA, 12 nt, Human
ccccccucuguc

SEQ ID NO: 2612639 - RNA, 11 nt, Human
ccccccccucc

SEQ ID NO: 2612640 - RNA, 13 nt, Human
cccccgagcuggg

SEQ ID NO: 2612641 - RNA, 15 nt, Human
cccccgagcuggggg

SEQ ID NO: 2612642 - RNA, 13 nt, Human
ccccccuuccacu

SEQ ID NO: 2612643 - RNA, 12 nt, Human
ccccccuuccac

SEQ ID NO: 2612644 - RNA, 11 nt, Human
ccccccuucca

SEQ ID NO: 2612645 - RNA, 16 nt, Human
ccccgucccccucugg

SEQ ID NO: 2612646 - RNA, 20 nt, Human
ccccgucccccucuggcucc

SEQ ID NO: 2612647 - RNA, 21 nt, Human
ccccgucucugguuccucccc

SEQ ID NO: 2612648 - RNA, 21 nt, Human
ccccgucaccaucucaggcca

SEQ ID NO: 2612649 - RNA, 14 nt, Human
ccccgucucuacua

SEQ ID NO: 2612650 - RNA, 12 nt, Human
cccccuggagag

SEQ ID NO: 2612651 - RNA, 20 nt, Human
cccccugcuggcucuucugc

SEQ ID NO: 2612652 - RNA, 18 nt, Human
cccccugcuggcucuucu

SEQ ID NO: 2612653 - RNA, 15 nt, Human
cccccuggccucugu

SEQ ID NO: 2612654 - RNA, 19 nt, Human
cccccuggccucugugccu

SEQ ID NO: 2612655 - RNA, 22 nt, Human
cccccuggccucugugccuucu

SEQ ID NO: 2612656 - RNA, 10 nt, Human
cccccugggc

SEQ ID NO: 2612657 - RNA, 14 nt, Human
ccccgucacagccu

SEQ ID NO: 2612658 - RNA, 16 nt, Human
ccccgucacagccuca

SEQ ID NO: 2612659 - RNA, 13 nt, Human
cccccucugcccu

SEQ ID NO: 2612660 - RNA, 14 nt, Human
cccccucugcccug

SEQ ID NO: 2612661 - RNA, 22 nt, Human
cccccugccccccagccucugg

SEQ ID NO: 2612662 - RNA, 16 nt, Human
cccccucugcccugcg

SEQ ID NO: 2612663 - RNA, 14 nt, Human
cccccugcccugca

SEQ ID NO: 2612664 - RNA, 13 nt, Human
cccccugcccugc

SEQ ID NO: 2612665 - RNA, 12 nt, Human
cccccugcccug

SEQ ID NO: 2612666 - RNA, 22 nt, Human
cccccugcccucguggccagcc

SEQ ID NO: 2612667 - RNA, 15 nt, Human
cccccugcuggcucu

SEQ ID NO: 2612668 - RNA, 24 nt, Human
cccccugccggccggggcugagac

SEQ ID NO: 2612669 - RNA, 12 nt, Human
cccccugcuggc

SEQ ID NO: 2612670 - RNA, 20 nt, Human
cccccugcccucguggccag

SEQ ID NO: 2612671 - RNA, 19 nt, Human
cccccugcccucguggcca

SEQ ID NO: 2612672 - RNA, 16 nt, Human
cccccugcccucgugg

SEQ ID NO: 2612673 - RNA, 21 nt, Human
cccccugccccccagccucug

SEQ ID NO: 2612674 - RNA, 12 nt, Human
cccccugcccuc

SEQ ID NO: 2612675 - RNA, 13 nt, Human
cccccugcccucc

SEQ ID NO: 2612676 - RNA, 12 nt, Human
cccccagcccca

SEQ ID NO: 2612677 - RNA, 13 nt, Human
cccccagccccgg

SEQ ID NO: 2612678 - RNA, 12 nt, Human
cccccagcccug

SEQ ID NO: 2612679 - RNA, 14 nt, Human
cccccagcccugug

SEQ ID NO: 2612680 - RNA, 13 nt, Human
cccccagcccugu

SEQ ID NO: 2612681 - RNA, 11 nt, Human
cccccagcugu

SEQ ID NO: 2612682 - RNA, 15 nt, Human
cccccaggacugggc

SEQ ID NO: 2612683 - RNA, 13 nt, Human
cccccaggacugg

SEQ ID NO: 2612684 - RNA, 12 nt, Human
cccccaggacug

SEQ ID NO: 2612685 - RNA, 11 nt, Human
cccccaggacu

SEQ ID NO: 2612686 - RNA, 23 nt, Human
cccccagcuuugcuaccaaagca

SEQ ID NO: 2612687 - RNA, 14 nt, Human
cccccagcuguggg

SEQ ID NO: 2612688 - RNA, 21 nt, Human
cccccagcccagggcuccugc

SEQ ID NO: 2612689 - RNA, 14 nt, Human
cccccagcccaggg

SEQ ID NO: 2612690 - RNA, 13 nt, Human
cccccagcccagg

SEQ ID NO: 2612691 - RNA, 18 nt, Human
cccccagcacugaggaag

SEQ ID NO: 2612692 - RNA, 17 nt, Human
cccccagcacugaggaa

SEQ ID NO: 2612693 - RNA, 15 nt, Human
cccccagcacugagg

SEQ ID NO: 2612694 - RNA, 12 nt, Human
cccccacacaca

SEQ ID NO: 2612695 - RNA, 14 nt, Human
cccccacacacaca

SEQ ID NO: 2612696 - RNA, 19 nt, Human
cccccacacacacacacau

SEQ ID NO: 2612697 - RNA, 13 nt, Human
cccccagcacuga

SEQ ID NO: 2612698 - RNA, 11 nt, Human
cccccacacac

SEQ ID NO: 2612699 - RNA, 13 nt, Human
cccccaauccaug

SEQ ID NO: 2612700 - RNA, 16 nt, Human
cccccaaggggcaguc

SEQ ID NO: 2612701 - RNA, 23 nt, Human
cccccaaggggcagucuggaggg

SEQ ID NO: 2612702 - RNA, 17 nt, Human
cccccauccuggcccau

SEQ ID NO: 2612703 - RNA, 18 nt, Human
cccccaugcacugugaag

SEQ ID NO: 2612704 - RNA, 16 nt, Human
cccccaucucuucugg

SEQ ID NO: 2612705 - RNA, 15 nt, Human
cccccauccuggccc

SEQ ID NO: 2612706 - RNA, 13 nt, Human
cccccauccuggc

SEQ ID NO: 2612707 - RNA, 23 nt, Human
cccccauccccauccuccagcuu

SEQ ID NO: 2612708 - RNA, 19 nt, Human
cccccauccuccccuuccc

SEQ ID NO: 2612709 - RNA, 22 nt, Human
cccccaguccccaccccugccc

SEQ ID NO: 2612710 - RNA, 20 nt, Human
cccccaguccccaccccugc

SEQ ID NO: 2612711 - RNA, 22 nt, Human
cccccauccccauccuccagcu

SEQ ID NO: 2612712 - RNA, 15 nt, Human
cccccaguccccacc

SEQ ID NO: 2612713 - RNA, 20 nt, Human
cccccaggggaaagaugagc

SEQ ID NO: 2612714 - RNA, 17 nt, Human
cccccaggacugggcca

SEQ ID NO: 2612715 - RNA, 18 nt, Human
cccccagcuuugcccaac

SEQ ID NO: 2612716 - RNA, 16 nt, Human
cccccaggcugcugga

SEQ ID NO: 2612717 - RNA, 13 nt, Human
ccccccacucugu

SEQ ID NO: 2612718 - RNA, 12 nt, Human
ccccccacucuc

SEQ ID NO: 2612719 - RNA, 12 nt, Human
ccccccagcacu

SEQ ID NO: 2612720 - RNA, 12 nt, Human
ccccccacugca

SEQ ID NO: 2612721 - RNA, 18 nt, Human
ccccccagaaccuguccu

SEQ ID NO: 2612722 - RNA, 14 nt, Human
cccccaugcacugu

SEQ ID NO: 2612723 - RNA, 12 nt, Human
ccccccaccccu

SEQ ID NO: 2612724 - RNA, 13 nt, Human
ccccccaccccug

SEQ ID NO: 2612725 - RNA, 11 nt, Human
ccccccacucu

SEQ ID NO: 2612726 - RNA, 13 nt, Human
ccccccagccucu

SEQ ID NO: 2612727 - RNA, 12 nt, Human
ccccccagccuc

SEQ ID NO: 2612728 - RNA, 14 nt, Human
ccccccagcacuga

SEQ ID NO: 2612729 - RNA, 13 nt, Human
ccccccagcacug

SEQ ID NO: 2612730 - RNA, 14 nt, Human
ccccccaugcacug

SEQ ID NO: 2612731 - RNA, 13 nt, Human
cccccccuuccac

SEQ ID NO: 2612732 - RNA, 12 nt, Human
cccccccuucca

SEQ ID NO: 2612733 - RNA, 13 nt, Human
ccccaggaccagc

SEQ ID NO: 2612734 - RNA, 15 nt, Human
ccccaggaccagcuc

SEQ ID NO: 2612735 - RNA, 13 nt, Human
ccccaggaggcca

SEQ ID NO: 2612736 - RNA, 24 nt, Human
ccccagcuuugcccaacaccagcc

SEQ ID NO: 2612737 - RNA, 14 nt, Human
ccccagcuuugccc

SEQ ID NO: 2612738 - RNA, 13 nt, Human
ccccagcuuugcc

SEQ ID NO: 2612739 - RNA, 11 nt, Human
ccccaggacca

SEQ ID NO: 2612740 - RNA, 12 nt, Human
ccccaggaagcc

SEQ ID NO: 2612741 - RNA, 23 nt, Human
ccccaggaagccgugcccugccc

SEQ ID NO: 2612742 - RNA, 14 nt, Human
ccccagcucaaugg

SEQ ID NO: 2612743 - RNA, 22 nt, Human
ccccagcuacccuuuuucucca

SEQ ID NO: 2612744 - RNA, 11 nt, Human
ccccagcuacc

SEQ ID NO: 2612745 - RNA, 11 nt, Human
ccccagcuccg

SEQ ID NO: 2612746 - RNA, 23 nt, Human
ccccagcgucccagucucuggca

SEQ ID NO: 2612747 - RNA, 21 nt, Human
ccccagcugugagccuuggcu

SEQ ID NO: 2612748 - RNA, 19 nt, Human
ccccagcugugagccuugg

SEQ ID NO: 2612749 - RNA, 16 nt, Human
ccccagcugugagccu

SEQ ID NO: 2612750 - RNA, 15 nt, Human
ccccagcugugagcc

SEQ ID NO: 2612751 - RNA, 14 nt, Human
ccccagcugugagc

SEQ ID NO: 2612752 - RNA, 13 nt, Human
ccccagcuccggc

SEQ ID NO: 2612753 - RNA, 12 nt, Human
ccccagcucugg

SEQ ID NO: 2612754 - RNA, 22 nt, Human
ccccaggaggccagccuugacc

SEQ ID NO: 2612755 - RNA, 21 nt, Human
ccccaggaggccagccuugac

SEQ ID NO: 2612756 - RNA, 15 nt, Human
ccccaggaggccagc

SEQ ID NO: 2612757 - RNA, 14 nt, Human
ccccaggaggccag

SEQ ID NO: 2612758 - RNA, 23 nt, Human
cccccaacacugugcccuggugg

SEQ ID NO: 2612759 - RNA, 22 nt, Human
cccccaacacugugcccuggug

SEQ ID NO: 2612760 - RNA, 14 nt, Human
cccccaaccccagc

SEQ ID NO: 2612761 - RNA, 23 nt, Human
cccccaaccaaguggcucccaca

SEQ ID NO: 2612762 - RNA, 18 nt, Human
cccccaaccccugaggaa

SEQ ID NO: 2612763 - RNA, 16 nt, Human
cccccaaccccugagg

SEQ ID NO: 2612764 - RNA, 14 nt, Human
cccccaaccccuga

SEQ ID NO: 2612765 - RNA, 19 nt, Human
cccccaagcuguuuucuuc

SEQ ID NO: 2612766 - RNA, 13 nt, Human
cccccaagccugc

SEQ ID NO: 2612767 - RNA, 14 nt, Human
cccccaagccugca

SEQ ID NO: 2612768 - RNA, 11 nt, Human
ccccaggcagg

SEQ ID NO: 2612769 - RNA, 22 nt, Human
ccccaggccaggccaccaggau

SEQ ID NO: 2612770 - RNA, 15 nt, Human
ccccaggccaggcca

SEQ ID NO: 2612771 - RNA, 13 nt, Human
ccccaggccaggc

SEQ ID NO: 2612772 - RNA, 14 nt, Human
ccccaggcaggcug

SEQ ID NO: 2612773 - RNA, 18 nt, Human
ccccaggcaggcugugcg

SEQ ID NO: 2612774 - RNA, 12 nt, Human
ccccaggccagg

SEQ ID NO: 2612775 - RNA, 23 nt, Human
ccccaggcaggcugugcgcugac

SEQ ID NO: 2612776 - RNA, 13 nt, Human
ccccacuggugac

SEQ ID NO: 2612777 - RNA, 12 nt, Human
ccccacugguga

SEQ ID NO: 2612778 - RNA, 14 nt, Human
ccccacuggugaca

SEQ ID NO: 2612779 - RNA, 19 nt, Human
ccccagcccuccuuaucaa

SEQ ID NO: 2612780 - RNA, 15 nt, Human
ccccagcccugugga

SEQ ID NO: 2612781 - RNA, 13 nt, Human
ccccagcccugug

SEQ ID NO: 2612782 - RNA, 14 nt, Human
ccccagcccugugg

SEQ ID NO: 2612783 - RNA, 16 nt, Human
ccccagcccuggcucu

SEQ ID NO: 2612784 - RNA, 13 nt, Human
ccccagcccuggc

SEQ ID NO: 2612785 - RNA, 19 nt, Human
ccccagcccuggcucugca

SEQ ID NO: 2612786 - RNA, 12 nt, Human
ccccagcccugu

SEQ ID NO: 2612787 - RNA, 19 nt, Human
ccccagcuaagaaccugga

SEQ ID NO: 2612788 - RNA, 21 nt, Human
ccccagcuaagaaccuggaac

SEQ ID NO: 2612789 - RNA, 17 nt, Human
ccccagcuaagaaccug

SEQ ID NO: 2612790 - RNA, 18 nt, Human
ccccagcgucccagucuc

SEQ ID NO: 2612791 - RNA, 16 nt, Human
ccccagccucuggcau

SEQ ID NO: 2612792 - RNA, 12 nt, Human
ccccagccuucu

SEQ ID NO: 2612793 - RNA, 19 nt, Human
ccccagcgagagucccugc

SEQ ID NO: 2612794 - RNA, 16 nt, Human
ccccagccgcucggag

SEQ ID NO: 2612795 - RNA, 19 nt, Human
ccccagccuaagaugaaga

SEQ ID NO: 2612796 - RNA, 13 nt, Human
ccccagccucccu

SEQ ID NO: 2612797 - RNA, 21 nt, Human
ccccagccuaagaugaagagg

SEQ ID NO: 2612798 - RNA, 15 nt, Human
ccccagccucuggca

SEQ ID NO: 2612799 - RNA, 14 nt, Human
ccccagccucuggc

SEQ ID NO: 2612800 - RNA, 15 nt, Human
ccccagccucccuga

SEQ ID NO: 2612801 - RNA, 12 nt, Human
ccccacucugug

SEQ ID NO: 2612802 - RNA, 13 nt, Human
ccccacccucagc

SEQ ID NO: 2612803 - RNA, 18 nt, Human
ccccaccccuugcucuca

SEQ ID NO: 2612804 - RNA, 14 nt, Human
ccccacugaccaga

SEQ ID NO: 2612805 - RNA, 21 nt, Human
ccccacugacagccucccacc

SEQ ID NO: 2612806 - RNA, 13 nt, Human
ccccacucugugc

SEQ ID NO: 2612807 - RNA, 15 nt, Human
ccccacugacagccu

SEQ ID NO: 2612808 - RNA, 17 nt, Human
ccccaccccugccccca

SEQ ID NO: 2612809 - RNA, 14 nt, Human
ccccaccccugccc

SEQ ID NO: 2612810 - RNA, 13 nt, Human
ccccaccccugcc

SEQ ID NO: 2612811 - RNA, 22 nt, Human
ccccaccccggggacccuguga

SEQ ID NO: 2612812 - RNA, 19 nt, Human
ccccaccccugggggcucu

SEQ ID NO: 2612813 - RNA, 23 nt, Human
ccccaccccugcccccagccccg

SEQ ID NO: 2612814 - RNA, 12 nt, Human
ccccaccccugg

SEQ ID NO: 2612815 - RNA, 20 nt, Human
ccccaccccugggggcucuc

SEQ ID NO: 2612816 - RNA, 13 nt, Human
ccccaccccuucc

SEQ ID NO: 2612817 - RNA, 15 nt, Human
ccccaccccuucccc

SEQ ID NO: 2612818 - RNA, 17 nt, Human
ccccaccccuuccccac

SEQ ID NO: 2612819 - RNA, 15 nt, Human
ccccaccccuugcuc

SEQ ID NO: 2612820 - RNA, 13 nt, Human
ccccaccccuugc

SEQ ID NO: 2612821 - RNA, 18 nt, Human
ccccaccccuuccccacu

SEQ ID NO: 2612822 - RNA, 22 nt, Human
ccccaccccuuccccacugccu

SEQ ID NO: 2612823 - RNA, 15 nt, Human
ccccacugaccagaa

SEQ ID NO: 2612824 - RNA, 12 nt, Human
ccccacugcagg

SEQ ID NO: 2612825 - RNA, 16 nt, Human
ccccacugcaggcccc

SEQ ID NO: 2612826 - RNA, 18 nt, Human
ccccacugcaggccccgc

SEQ ID NO: 2612827 - RNA, 19 nt, Human
ccccacugccuacugcauc

SEQ ID NO: 2612828 - RNA, 16 nt, Human
ccccacugccuacugc

SEQ ID NO: 2612829 - RNA, 12 nt, Human
ccccacugccug

SEQ ID NO: 2612830 - RNA, 15 nt, Human
ccccacugccugccc

SEQ ID NO: 2612831 - RNA, 14 nt, Human
ccccacuggggaaa

SEQ ID NO: 2612832 - RNA, 22 nt, Human
ccccacuggggaaauaacagcu

SEQ ID NO: 2612833 - RNA, 16 nt, Human
ccccacugccugccca

SEQ ID NO: 2612834 - RNA, 17 nt, Human
ccccacugccugcccac

SEQ ID NO: 2612835 - RNA, 17 nt, Human
cccuuugggcccaggga

SEQ ID NO: 2612836 - RNA, 15 nt, Human
cccuuugggcccagg

SEQ ID NO: 2612837 - RNA, 14 nt, Human
cccuuugggcccag

SEQ ID NO: 2612838 - RNA, 18 nt, Human
cccuuugggcccagggac

SEQ ID NO: 2612839 - RNA, 15 nt, Human
cccuuugugcugugg

SEQ ID NO: 2612840 - RNA, 14 nt, Human
cccuuugugcugug

SEQ ID NO: 2612841 - RNA, 20 nt, Human
cccuuugguuuuuuucuucu

SEQ ID NO: 2612842 - RNA, 12 nt, Human
cccuuugagugc

SEQ ID NO: 2612843 - RNA, 14 nt, Human
cccuuugagugcag

SEQ ID NO: 2612844 - RNA, 17 nt, Human
cccuuugcccagaaaga

SEQ ID NO: 2612845 - RNA, 16 nt, Human
cccuuucuuggccagu

SEQ ID NO: 2612846 - RNA, 23 nt, Human
cccuuugcugugaggcuguccug

SEQ ID NO: 2612847 - RNA, 16 nt, Human
cccuuugggaggcuga

SEQ ID NO: 2612848 - RNA, 20 nt, Human
cccuuugggaggcugaggcg

SEQ ID NO: 2612849 - RNA, 22 nt, Human
cccuuucuccccugcccccagg

SEQ ID NO: 2612850 - RNA, 14 nt, Human
cccuuucuccccug

SEQ ID NO: 2612851 - RNA, 14 nt, Human
cccuuucuggcucu

SEQ ID NO: 2612852 - RNA, 12 nt, Human
cccuuucugugu

SEQ ID NO: 2612853 - RNA, 22 nt, Human
cccuuucugggcaccggggccu

SEQ ID NO: 2612854 - RNA, 20 nt, Human
cccuuugacgccaucccagc

SEQ ID NO: 2612855 - RNA, 14 nt, Human
cccuuucuuggcca

SEQ ID NO: 2612856 - RNA, 15 nt, Human
cccuuucuuggccag

SEQ ID NO: 2612857 - RNA, 17 nt, Human
cccuuucuuggccaguu

SEQ ID NO: 2612858 - RNA, 16 nt, Human
cccuuguggucccacc

SEQ ID NO: 2612859 - RNA, 14 nt, Human
cccuugugguccca

SEQ ID NO: 2612860 - RNA, 18 nt, Human
cccuugggcggcugagag

SEQ ID NO: 2612861 - RNA, 18 nt, Human
cccuuggggagcaggcuc

SEQ ID NO: 2612862 - RNA, 18 nt, Human
cccuuguggucccacccc

SEQ ID NO: 2612863 - RNA, 20 nt, Human
cccuuguggucccaccccac

SEQ ID NO: 2612864 - RNA, 15 nt, Human
cccuuggguucugau

SEQ ID NO: 2612865 - RNA, 23 nt, Human
cccuugugcgugggugaagccgc

SEQ ID NO: 2612866 - RNA, 13 nt, Human
cccuuuccuucca

SEQ ID NO: 2612867 - RNA, 15 nt, Human
cccuuuccuuccauc

SEQ ID NO: 2612868 - RNA, 18 nt, Human
cccuuuccuuccaucccu

SEQ ID NO: 2612869 - RNA, 18 nt, Human
cccuuuccuuccuucccu

SEQ ID NO: 2612870 - RNA, 21 nt, Human
cccuuuccuuccuucccuggc

SEQ ID NO: 2612871 - RNA, 14 nt, Human
cccuuuccucaggc

SEQ ID NO: 2612872 - RNA, 17 nt, Human
cccuugugcguggguga

SEQ ID NO: 2612873 - RNA, 13 nt, Human
cccuuuccugcgg

SEQ ID NO: 2612874 - RNA, 16 nt, Human
cccuuggccugucuca

SEQ ID NO: 2612875 - RNA, 21 nt, Human
cccuugcccuugcccugaccu

SEQ ID NO: 2612876 - RNA, 18 nt, Human
cccuugcccuugcccuga

SEQ ID NO: 2612877 - RNA, 17 nt, Human
cccuugcccuugcccug

SEQ ID NO: 2612878 - RNA, 16 nt, Human
cccuugcccuugcccu

SEQ ID NO: 2612879 - RNA, 21 nt, Human
cccuugcccugaccucccagc

SEQ ID NO: 2612880 - RNA, 20 nt, Human
cccuugcccugaccucccag

SEQ ID NO: 2612881 - RNA, 19 nt, Human
cccuugcccugaccuccca

SEQ ID NO: 2612882 - RNA, 22 nt, Human
cccuugccgucuaccugagggg

SEQ ID NO: 2612883 - RNA, 23 nt, Human
cccuuggcugugaggccccugga

SEQ ID NO: 2612884 - RNA, 14 nt, Human
cccuuggcugugag

SEQ ID NO: 2612885 - RNA, 22 nt, Human
cccuuggcugugaggccccugg

SEQ ID NO: 2612886 - RNA, 19 nt, Human
cccuuggccugucucaucc

SEQ ID NO: 2612887 - RNA, 15 nt, Human
cccuuggcucaaucc

SEQ ID NO: 2612888 - RNA, 18 nt, Human
cccuugccgucuaccuga

SEQ ID NO: 2612889 - RNA, 17 nt, Human
cccuugccgucuaccug

SEQ ID NO: 2612890 - RNA, 22 nt, Human
cccuugcacuaaaguauguaaa

SEQ ID NO: 2612891 - RNA, 16 nt, Human
cccuugcagcuaguuu

SEQ ID NO: 2612892 - RNA, 19 nt, Human
cccuugcagcuaguuuucu

SEQ ID NO: 2612893 - RNA, 19 nt, Human
cccuugcaguucagcacca

SEQ ID NO: 2612894 - RNA, 16 nt, Human
cccuugcccugaccuc

SEQ ID NO: 2612895 - RNA, 15 nt, Human
cccuugcccugaccu

SEQ ID NO: 2612896 - RNA, 18 nt, Human
cccuugccaccccacccu

SEQ ID NO: 2612897 - RNA, 13 nt, Human
cccuugccacccc

SEQ ID NO: 2612898 - RNA, 21 nt, Human
cccuugcaguucagcaccacc

SEQ ID NO: 2612899 - RNA, 23 nt, Human
cccuugcaguucagcaccacccu

SEQ ID NO: 2612900 - RNA, 16 nt, Human
cccuugaugaagaagu

SEQ ID NO: 2612901 - RNA, 18 nt, Human
cccuuccucuccacccuc

SEQ ID NO: 2612902 - RNA, 17 nt, Human
cccuuccucuccacccu

SEQ ID NO: 2612903 - RNA, 20 nt, Human
cccuuccucuccacugccuu

SEQ ID NO: 2612904 - RNA, 15 nt, Human
cccuugaugaagaag

SEQ ID NO: 2612905 - RNA, 17 nt, Human
cccuuccucuccacugc

SEQ ID NO: 2612906 - RNA, 16 nt, Human
cccuuccucuccacug

SEQ ID NO: 2612907 - RNA, 15 nt, Human
cccuuccucuccacc

SEQ ID NO: 2612908 - RNA, 13 nt, Human
cccuuccucucca

SEQ ID NO: 2612909 - RNA, 20 nt, Human
cccuuaccaugugccugauc

SEQ ID NO: 2612910 - RNA, 19 nt, Human
cccuuacagccucugacuu

SEQ ID NO: 2612911 - RNA, 17 nt, Human
cccuuaccccuuagccu

SEQ ID NO: 2612912 - RNA, 20 nt, Human
cccuuccuacagauagucaa

SEQ ID NO: 2612913 - RNA, 22 nt, Human
cccuuaccccuuagccucccug

SEQ ID NO: 2612914 - RNA, 17 nt, Human
cccuuaccacugcucug

SEQ ID NO: 2612915 - RNA, 21 nt, Human
cccuuaccacugcucugauga

SEQ ID NO: 2612916 - RNA, 19 nt, Human
cccuuaccucggugccuuc

SEQ ID NO: 2612917 - RNA, 13 nt, Human
ccgauccuuccuc

SEQ ID NO: 2612918 - RNA, 15 nt, Human
ccgaguuuccccaga

SEQ ID NO: 2612919 - RNA, 14 nt, Human
ccgagucugucucu

SEQ ID NO: 2612920 - RNA, 16 nt, Human
ccgagugaaccuaccu

SEQ ID NO: 2612921 - RNA, 17 nt, Human
ccgagucugucucuguc

SEQ ID NO: 2612922 - RNA, 16 nt, Human
ccgaggggcucaggaa

SEQ ID NO: 2612923 - RNA, 18 nt, Human
ccgaggggcucaggaaaa

SEQ ID NO: 2612924 - RNA, 23 nt, Human
ccgaggggcgggacccaggcacc

SEQ ID NO: 2612925 - RNA, 13 nt, Human
ccgaggggcggga

SEQ ID NO: 2612926 - RNA, 22 nt, Human
ccgagucucuucuccacuggau

SEQ ID NO: 2612927 - RNA, 16 nt, Human
ccgaggguccuggcuc

SEQ ID NO: 2612928 - RNA, 21 nt, Human
ccgagucucuucuccacugga

SEQ ID NO: 2612929 - RNA, 14 nt, Human
ccgccccgccccac

SEQ ID NO: 2612930 - RNA, 13 nt, Human
ccgaugcugcuuu

SEQ ID NO: 2612931 - RNA, 11 nt, Human
ccgaugcugcu

SEQ ID NO: 2612932 - RNA, 19 nt, Human
ccgaugcuccagccaaccc

SEQ ID NO: 2612933 - RNA, 22 nt, Human
ccgaugcuccagccaaccccug

SEQ ID NO: 2612934 - RNA, 14 nt, Human
ccgauccuuccucc

SEQ ID NO: 2612935 - RNA, 14 nt, Human
ccgaugcuccagcc

SEQ ID NO: 2612936 - RNA, 15 nt, Human
ccgaugcuccagcca

SEQ ID NO: 2612937 - RNA, 12 nt, Human
ccgcccugccac

SEQ ID NO: 2612938 - RNA, 11 nt, Human
ccgcccugcca

SEQ ID NO: 2612939 - RNA, 17 nt, Human
ccgccccuuccccgagg

SEQ ID NO: 2612940 - RNA, 19 nt, Human
ccgccccuuccccgaggga

SEQ ID NO: 2612941 - RNA, 18 nt, Human
ccgagaucacgccacugc

SEQ ID NO: 2612942 - RNA, 20 nt, Human
ccgagcaaagucuaaaguuu

SEQ ID NO: 2612943 - RNA, 18 nt, Human
ccgagcaaagucuaaagu

SEQ ID NO: 2612944 - RNA, 23 nt, Human
ccgagcaaagaucaaaauaaaaa

SEQ ID NO: 2612945 - RNA, 21 nt, Human
ccgagcaaagaucaaaauaaa

SEQ ID NO: 2612946 - RNA, 16 nt, Human
ccgagccuggcuccaa

SEQ ID NO: 2612947 - RNA, 19 nt, Human
ccgagccgggccuggggcu

SEQ ID NO: 2612948 - RNA, 16 nt, Human
ccgagccgggccuggg

SEQ ID NO: 2612949 - RNA, 18 nt, Human
ccgagcgcuuucuggaaa

SEQ ID NO: 2612950 - RNA, 21 nt, Human
ccgagccucugucacugcagg

SEQ ID NO: 2612951 - RNA, 19 nt, Human
ccgagcgcuuucuggaaaa

SEQ ID NO: 2612952 - RNA, 19 nt, Human
ccgagccuggcuccaaacc

SEQ ID NO: 2612953 - RNA, 19 nt, Human
ccgagcucguguauccugg

SEQ ID NO: 2612954 - RNA, 17 nt, Human
ccgaggccuucucugaa

SEQ ID NO: 2612955 - RNA, 16 nt, Human
ccgagggcgaccccgu

SEQ ID NO: 2612956 - RNA, 15 nt, Human
ccgagggcgaccccg

SEQ ID NO: 2612957 - RNA, 20 nt, Human
ccgagggaugaugccacacc

SEQ ID NO: 2612958 - RNA, 19 nt, Human
ccgagggaugaugccacac

SEQ ID NO: 2612959 - RNA, 16 nt, Human
ccgagggaugaugcca

SEQ ID NO: 2612960 - RNA, 18 nt, Human
ccgagggaugaugccaca

SEQ ID NO: 2612961 - RNA, 17 nt, Human
ccgaggcuggagcuggc

SEQ ID NO: 2612962 - RNA, 21 nt, Human
ccgagcucguguauccugggg

SEQ ID NO: 2612963 - RNA, 20 nt, Human
ccgagcucguguauccuggg

SEQ ID NO: 2612964 - RNA, 14 nt, Human
ccgaggcuggagcu

SEQ ID NO: 2612965 - RNA, 23 nt, Human
cccuuuuugaaguguaggcagac

SEQ ID NO: 2612966 - RNA, 16 nt, Human
cccuuuuucuccagcu

SEQ ID NO: 2612967 - RNA, 20 nt, Human
ccgacuugaauuuucccacu

SEQ ID NO: 2612968 - RNA, 15 nt, Human
cccuuuuugaagugu

SEQ ID NO: 2612969 - RNA, 19 nt, Human
cccuuuuuuggcugcugaa

SEQ ID NO: 2612970 - RNA, 23 nt, Human
ccgacuugaauuuucccacugca

SEQ ID NO: 2612971 - RNA, 22 nt, Human
ccgacuugaauuuucccacugc

SEQ ID NO: 2612972 - RNA, 21 nt, Human
ccgacuugaauuuucccacug

SEQ ID NO: 2612973 - RNA, 23 nt, Human
ccgacuugcuguuuuguucugug

SEQ ID NO: 2612974 - RNA, 16 nt, Human
ccgacuugcuguuuug

SEQ ID NO: 2612975 - RNA, 22 nt, Human
ccgacuuuguaccccccaaccc

SEQ ID NO: 2612976 - RNA, 13 nt, Human
ccgagaagcaaga

SEQ ID NO: 2612977 - RNA, 22 nt, Human
ccgagauagccaaggccaaagg

SEQ ID NO: 2612978 - RNA, 19 nt, Human
ccgagauagccaaggccaa

SEQ ID NO: 2612979 - RNA, 17 nt, Human
ccgagaaggaagccucc

SEQ ID NO: 2612980 - RNA, 18 nt, Human
ccgagauagccaaggcca

SEQ ID NO: 2612981 - RNA, 23 nt, Human
ccgagagagcaccccucucugca

SEQ ID NO: 2612982 - RNA, 14 nt, Human
ccgagaagccagug

SEQ ID NO: 2612983 - RNA, 19 nt, Human
ccgagaagcaagaaagaaa

SEQ ID NO: 2612984 - RNA, 18 nt, Human
cccuuuuuuggcugcuga

SEQ ID NO: 2612985 - RNA, 17 nt, Human
cccuuuuuuggcugcug

SEQ ID NO: 2612986 - RNA, 16 nt, Human
cccuuuuuacuccccu

SEQ ID NO: 2612987 - RNA, 23 nt, Human
cccuuuuuacuccccuugagcug

SEQ ID NO: 2612988 - RNA, 16 nt, Human
cccuuuuuccuugucc

SEQ ID NO: 2612989 - RNA, 15 nt, Human
cccuuuuucuccagc

SEQ ID NO: 2612990 - RNA, 23 nt, Human
cccuuuuuccuuguccccacacu

SEQ ID NO: 2612991 - RNA, 18 nt, Human
cccuuuuuacuccccuug

SEQ ID NO: 2612992 - RNA, 11 nt, Human
cccuuuuccuu

SEQ ID NO: 2612993 - RNA, 16 nt, Human
cccuuuucagcuucug

SEQ ID NO: 2612994 - RNA, 15 nt, Human
cccuuuucagcuucu

SEQ ID NO: 2612995 - RNA, 18 nt, Human
cccuuuucagcuucugcu

SEQ ID NO: 2612996 - RNA, 16 nt, Human
cccuuuucuacaguua

SEQ ID NO: 2612997 - RNA, 13 nt, Human
cccuuuucuguuu

SEQ ID NO: 2612998 - RNA, 22 nt, Human
cccuuuuggcccccgagcuggg

SEQ ID NO: 2612999 - RNA, 14 nt, Human
cccuuuuggccccc

SEQ ID NO: 2613000 - RNA, 20 nt, Human
cccuuuuggcccccgagcug

SEQ ID NO: 2613001 - RNA, 23 nt, Human
cccuuuucuuuucuacccuagcc

SEQ ID NO: 2613002 - RNA, 18 nt, Human
cccuuuucuuuucuaccc

SEQ ID NO: 2613003 - RNA, 21 nt, Human
cccuuuugcggaugggagggg

SEQ ID NO: 2613004 - RNA, 20 nt, Human
ccguggggccgccgccucuu

SEQ ID NO: 2613005 - RNA, 19 nt, Human
ccgccgacuuuguaccccc

SEQ ID NO: 2613006 - RNA, 12 nt, Human
ccggcuggccug

SEQ ID NO: 2613007 - RNA, 12 nt, Human
ccggcugcccuu

SEQ ID NO: 2613008 - RNA, 17 nt, Human
ccggcucuuuccuugcu

SEQ ID NO: 2613009 - RNA, 22 nt, Human
ccggcugcuuuucccuaagcca

SEQ ID NO: 2613010 - RNA, 17 nt, Human
ccggacacuccuagaga

SEQ ID NO: 2613011 - RNA, 16 nt, Human
ccggacacuccuagag

SEQ ID NO: 2613012 - RNA, 15 nt, Human
ccggcugcagaggcc

SEQ ID NO: 2613013 - RNA, 14 nt, Human
ccggcucuuuccuu

SEQ ID NO: 2613014 - RNA, 22 nt, Human
ccgggaggcagagguugcagug

SEQ ID NO: 2613015 - RNA, 13 nt, Human
ccggcuggccugg

SEQ ID NO: 2613016 - RNA, 19 nt, Human
ccgggauauauauucucuc

SEQ ID NO: 2613017 - RNA, 22 nt, Human
ccgggagggugcggcugugcag

SEQ ID NO: 2613018 - RNA, 22 nt, Human
ccgggaggggcccgcuugccuc

SEQ ID NO: 2613019 - RNA, 16 nt, Human
ccgggaggggcccgcu

SEQ ID NO: 2613020 - RNA, 15 nt, Human
ccgggaggggcccgc

SEQ ID NO: 2613021 - RNA, 12 nt, Human
ccggcuggaaau

SEQ ID NO: 2613022 - RNA, 15 nt, Human
ccgggcacucagaag

SEQ ID NO: 2613023 - RNA, 15 nt, Human
ccgcuucugccugca

SEQ ID NO: 2613024 - RNA, 18 nt, Human
ccgcuguucacccacagg

SEQ ID NO: 2613025 - RNA, 19 nt, Human
ccgcuguucacccacaggg

SEQ ID NO: 2613026 - RNA, 21 nt, Human
ccgcuguucacccacagggcu

SEQ ID NO: 2613027 - RNA, 19 nt, Human
ccgcugugagccccugguc

SEQ ID NO: 2613028 - RNA, 18 nt, Human
ccgcugugagccccuggu

SEQ ID NO: 2613029 - RNA, 15 nt, Human
ccgcugugagccccu

SEQ ID NO: 2613030 - RNA, 20 nt, Human
ccgcugugagccccuggucc

SEQ ID NO: 2613031 - RNA, 14 nt, Human
ccgcuguucaccca

SEQ ID NO: 2613032 - RNA, 15 nt, Human
ccgcuguucacccac

SEQ ID NO: 2613033 - RNA, 16 nt, Human
ccgcuguucacccaca

SEQ ID NO: 2613034 - RNA, 15 nt, Human
ccgcccugcuccucc

SEQ ID NO: 2613035 - RNA, 14 nt, Human
ccgcccugcuccuc

SEQ ID NO: 2613036 - RNA, 15 nt, Human
ccgcccugccacuca

SEQ ID NO: 2613037 - RNA, 14 nt, Human
ccgcccugccacuc

SEQ ID NO: 2613038 - RNA, 13 nt, Human
ccgcccugccacu

SEQ ID NO: 2613039 - RNA, 22 nt, Human
ccgcccugcuccucccuggcug

SEQ ID NO: 2613040 - RNA, 21 nt, Human
ccgcccugcuccucccuggcu

SEQ ID NO: 2613041 - RNA, 19 nt, Human
ccgcccugcuccucccugg

SEQ ID NO: 2613042 - RNA, 18 nt, Human
ccgcccugcuccucccug

SEQ ID NO: 2613043 - RNA, 15 nt, Human
ccgccgacuuuguac

SEQ ID NO: 2613044 - RNA, 21 nt, Human
ccgcccuugccgaaccaggag

SEQ ID NO: 2613045 - RNA, 20 nt, Human
ccgcuugccucggcuccugc

SEQ ID NO: 2613046 - RNA, 18 nt, Human
ccgcuugccucggcuccu

SEQ ID NO: 2613047 - RNA, 14 nt, Human
ccgcuugccucggc

SEQ ID NO: 2613048 - RNA, 13 nt, Human
ccgcuugccucgg

SEQ ID NO: 2613049 - RNA, 22 nt, Human
ccgcuugccucggcuccugcug

SEQ ID NO: 2613050 - RNA, 21 nt, Human
ccgcuugccucggcuccugcu

SEQ ID NO: 2613051 - RNA, 15 nt, Human
ccgcuuggagcagag

SEQ ID NO: 2613052 - RNA, 23 nt, Human
ccgcuuucuacccagcgagcccu

SEQ ID NO: 2613053 - RNA, 11 nt, Human
ccggaagccaa

SEQ ID NO: 2613054 - RNA, 17 nt, Human
ccgcuuggagcagaggg

SEQ ID NO: 2613055 - RNA, 18 nt, Human
ccgcuuggagcagagggg

SEQ ID NO: 2613056 - RNA, 22 nt, Human
ccggaauccuguccucagcuuc

SEQ ID NO: 2613057 - RNA, 20 nt, Human
ccggaauccuguccucagcu

SEQ ID NO: 2613058 - RNA, 22 nt, Human
ccggaagccaaaccucugugag

SEQ ID NO: 2613059 - RNA, 19 nt, Human
ccggaauccuguccucagc

SEQ ID NO: 2613060 - RNA, 13 nt, Human
ccuaccugcucuc

SEQ ID NO: 2613061 - RNA, 12 nt, Human
ccuaccugcucu

SEQ ID NO: 2613062 - RNA, 14 nt, Human
ccuaccugugccug

SEQ ID NO: 2613063 - RNA, 15 nt, Human
ccuaccugugccuga

SEQ ID NO: 2613064 - RNA, 16 nt, Human
ccuaccugugccugac

SEQ ID NO: 2613065 - RNA, 12 nt, Human
ccuaccugguaa

SEQ ID NO: 2613066 - RNA, 21 nt, Human
ccuaccugauuggugcaaccc

SEQ ID NO: 2613067 - RNA, 19 nt, Human
ccuagagaacgcagcccua

SEQ ID NO: 2613068 - RNA, 18 nt, Human
ccuagagaacgcagcccu

SEQ ID NO: 2613069 - RNA, 17 nt, Human
ccuagagaacgcagccc

SEQ ID NO: 2613070 - RNA, 20 nt, Human
ccuagagaacgcagcccuag

SEQ ID NO: 2613071 - RNA, 22 nt, Human
ccuaccuguucagugucccggg

SEQ ID NO: 2613072 - RNA, 17 nt, Human
ccuaccuguucaguguc

SEQ ID NO: 2613073 - RNA, 13 nt, Human
ccuaccuguucag

SEQ ID NO: 2613074 - RNA, 16 nt, Human
ccuaccugcucuccaa

SEQ ID NO: 2613075 - RNA, 23 nt, Human
ccuaccuguucagugucccgggc

SEQ ID NO: 2613076 - RNA, 19 nt, Human
ccuaccuucauuucaggag

SEQ ID NO: 2613077 - RNA, 19 nt, Human
ccuaccucagguugcuggu

SEQ ID NO: 2613078 - RNA, 14 nt, Human
ccuaccucagguug

SEQ ID NO: 2613079 - RNA, 13 nt, Human
ccuaccucagguu

SEQ ID NO: 2613080 - RNA, 19 nt, Human
ccuacccucgggcccaccu

SEQ ID NO: 2613081 - RNA, 23 nt, Human
ccuaccucagguugcugguugcu

SEQ ID NO: 2613082 - RNA, 22 nt, Human
ccuaccucagguugcugguugc

SEQ ID NO: 2613083 - RNA, 18 nt, Human
ccuacccucgggcccacc

SEQ ID NO: 2613084 - RNA, 14 nt, Human
ccuacccucgggcc

SEQ ID NO: 2613085 - RNA, 21 nt, Human
ccuaccccucccagcugacag

SEQ ID NO: 2613086 - RNA, 18 nt, Human
ccuaccccucccagcuga

SEQ ID NO: 2613087 - RNA, 17 nt, Human
ccuaccccucccagcug

SEQ ID NO: 2613088 - RNA, 16 nt, Human
ccuaccccucccagcu

SEQ ID NO: 2613089 - RNA, 15 nt, Human
ccuaccccucccagc

SEQ ID NO: 2613090 - RNA, 14 nt, Human
ccuaccccucccag

SEQ ID NO: 2613091 - RNA, 21 nt, Human
ccuaccccgcagacaccuugg

SEQ ID NO: 2613092 - RNA, 17 nt, Human
ccuacccccuccucucu

SEQ ID NO: 2613093 - RNA, 14 nt, Human
ccuaccccaccacg

SEQ ID NO: 2613094 - RNA, 20 nt, Human
ccuaccccgcagacaccuug

SEQ ID NO: 2613095 - RNA, 19 nt, Human
ccuacccccuccucucugc

SEQ ID NO: 2613096 - RNA, 13 nt, Human
ccuaccccaccac

SEQ ID NO: 2613097 - RNA, 14 nt, Human
ccuaauuccacagc

SEQ ID NO: 2613098 - RNA, 15 nt, Human
ccuaauuccacagcu

SEQ ID NO: 2613099 - RNA, 16 nt, Human
ccuaauuccacagcug

SEQ ID NO: 2613100 - RNA, 17 nt, Human
ccuaauuccacagcugc

SEQ ID NO: 2613101 - RNA, 18 nt, Human
ccuaauuucuccucccuu

SEQ ID NO: 2613102 - RNA, 17 nt, Human
ccuaauuucuccucccu

SEQ ID NO: 2613103 - RNA, 16 nt, Human
ccuaauuucuccuccc

SEQ ID NO: 2613104 - RNA, 15 nt, Human
ccuaauuucuccucc

SEQ ID NO: 2613105 - RNA, 14 nt, Human
ccuaauuucuccuc

SEQ ID NO: 2613106 - RNA, 19 nt, Human
ccuaccccacaccaggccg

SEQ ID NO: 2613107 - RNA, 18 nt, Human
ccuaccccacaccaggcc

SEQ ID NO: 2613108 - RNA, 13 nt, Human
ccuaccccacacc

SEQ ID NO: 2613109 - RNA, 12 nt, Human
ccuaccccacac

SEQ ID NO: 2613110 - RNA, 21 nt, Human
ccuaccccacaccaggccguc

SEQ ID NO: 2613111 - RNA, 20 nt, Human
ccuaccccacaccaggccgu

SEQ ID NO: 2613112 - RNA, 23 nt, Human
ccuaccccacaccaggccguccu

SEQ ID NO: 2613113 - RNA, 11 nt, Human
ccuaccccacc

SEQ ID NO: 2613114 - RNA, 12 nt, Human
ccuaaagaaaaa

SEQ ID NO: 2613115 - RNA, 14 nt, Human
ccuaaacuaucuuu

SEQ ID NO: 2613116 - RNA, 18 nt, Human
ccuaaaacaaaagcucau

SEQ ID NO: 2613117 - RNA, 11 nt, Human
ccuaaacugua

SEQ ID NO: 2613118 - RNA, 12 nt, Human
ccuaaagagaua

SEQ ID NO: 2613119 - RNA, 13 nt, Human
ccuaauuccacag

SEQ ID NO: 2613120 - RNA, 19 nt, Human
ccuaaaguagacuucauuu

SEQ ID NO: 2613121 - RNA, 22 nt, Human
ccgugccuccaccaccacuggc

SEQ ID NO: 2613122 - RNA, 17 nt, Human
ccgugccuccaccacca

SEQ ID NO: 2613123 - RNA, 23 nt, Human
ccgugccuccaccaccacuggcc

SEQ ID NO: 2613124 - RNA, 17 nt, Human
ccgugccuucagcucua

SEQ ID NO: 2613125 - RNA, 16 nt, Human
ccgugccuucagcucu

SEQ ID NO: 2613126 - RNA, 19 nt, Human
ccgggcgcggccagccccg

SEQ ID NO: 2613127 - RNA, 17 nt, Human
ccgggcgcggccagccc

SEQ ID NO: 2613128 - RNA, 15 nt, Human
ccgggcgcggccagc

SEQ ID NO: 2613129 - RNA, 14 nt, Human
ccgugccuccacca

SEQ ID NO: 2613130 - RNA, 15 nt, Human
ccgugccuucagcuc

SEQ ID NO: 2613131 - RNA, 14 nt, Human
ccgugccuucagcu

SEQ ID NO: 2613132 - RNA, 17 nt, Human
ccgggcccucccuugga

SEQ ID NO: 2613133 - RNA, 14 nt, Human
ccgggcccucccuu

SEQ ID NO: 2613134 - RNA, 13 nt, Human
ccgggcccucccu

SEQ ID NO: 2613135 - RNA, 23 nt, Human
ccgggccccugggcuuggccugc

SEQ ID NO: 2613136 - RNA, 21 nt, Human
ccgggccccugggcuuggccu

SEQ ID NO: 2613137 - RNA, 19 nt, Human
ccgggccccugggcuuggc

SEQ ID NO: 2613138 - RNA, 16 nt, Human
ccgggccccugggcuu

SEQ ID NO: 2613139 - RNA, 14 nt, Human
ccgggccccugggc

SEQ ID NO: 2613140 - RNA, 13 nt, Human
ccgggccuggggc

SEQ ID NO: 2613141 - RNA, 23 nt, Human
ccgggccgaauccccucccuguc

SEQ ID NO: 2613142 - RNA, 15 nt, Human
ccgggcccugaguaa

SEQ ID NO: 2613143 - RNA, 18 nt, Human
ccgggcccucccuuggaa

SEQ ID NO: 2613144 - RNA, 19 nt, Human
ccgggccuggagaacuaga

SEQ ID NO: 2613145 - RNA, 20 nt, Human
ccgggcacucagaagacacu

SEQ ID NO: 2613146 - RNA, 23 nt, Human
ccguggcuucccgcucagcccuc

SEQ ID NO: 2613147 - RNA, 13 nt, Human
ccgugggccuggg

SEQ ID NO: 2613148 - RNA, 21 nt, Human
ccguggcuucccgcucagccc

SEQ ID NO: 2613149 - RNA, 15 nt, Human
ccguggcuucccgcu

SEQ ID NO: 2613150 - RNA, 14 nt, Human
ccgugggcucccug

SEQ ID NO: 2613151 - RNA, 19 nt, Human
ccgugggcggggccuugcg

SEQ ID NO: 2613152 - RNA, 18 nt, Human
ccgugggcggggccuugc

SEQ ID NO: 2613153 - RNA, 12 nt, Human
ccgugggcgggg

SEQ ID NO: 2613154 - RNA, 20 nt, Human
ccguuguuuacuuaaagauu

SEQ ID NO: 2613155 - RNA, 17 nt, Human
ccguggggccgccgccu

SEQ ID NO: 2613156 - RNA, 23 nt, Human
ccguuucauuuagucaugugacc

SEQ ID NO: 2613157 - RNA, 12 nt, Human
ccguuguuuacu

SEQ ID NO: 2613158 - RNA, 14 nt, Human
ccuaaaaaagauau

SEQ ID NO: 2613159 - RNA, 12 nt, Human
ccuaaaaaagau

SEQ ID NO: 2613160 - RNA, 15 nt, Human
ccguuucuucccugu

SEQ ID NO: 2613161 - RNA, 13 nt, Human
ccguuucuucccu

SEQ ID NO: 2613162 - RNA, 23 nt, Human
ccguuuccuuucauuuacugugg

SEQ ID NO: 2613163 - RNA, 22 nt, Human
ccguuugagaagaaaacaucua

SEQ ID NO: 2613164 - RNA, 13 nt, Human
ccuaaaacaaaag

SEQ ID NO: 2613165 - RNA, 18 nt, Human
ccuaaaaaagauauauua

SEQ ID NO: 2613166 - RNA, 14 nt, Human
ccuaaaaacacaga

SEQ ID NO: 2613167 - RNA, 12 nt, Human
ccuaaaacaaau

SEQ ID NO: 2613168 - RNA, 21 nt, Human
ccuaaaccaaaaacugaaagu

SEQ ID NO: 2613169 - RNA, 17 nt, Human
ccuagagggaggggccu

SEQ ID NO: 2613170 - RNA, 22 nt, Human
ccucaccccacuuaucccucuc

SEQ ID NO: 2613171 - RNA, 23 nt, Human
ccucacccacuuuggccuccguu

SEQ ID NO: 2613172 - RNA, 17 nt, Human
ccucacccccagcuuug

SEQ ID NO: 2613173 - RNA, 19 nt, Human
ccucacccccagcuuugcu

SEQ ID NO: 2613174 - RNA, 15 nt, Human
ccucaccccacugug

SEQ ID NO: 2613175 - RNA, 15 nt, Human
ccucaccccugguuc

SEQ ID NO: 2613176 - RNA, 16 nt, Human
ccucaccccugcccug

SEQ ID NO: 2613177 - RNA, 17 nt, Human
ccucaccccugcccugg

SEQ ID NO: 2613178 - RNA, 17 nt, Human
ccucaccccgucugggg

SEQ ID NO: 2613179 - RNA, 13 nt, Human
ccucaccccugcc

SEQ ID NO: 2613180 - RNA, 14 nt, Human
ccucaccccugccc

SEQ ID NO: 2613181 - RNA, 15 nt, Human
ccucacccccucggg

SEQ ID NO: 2613182 - RNA, 24 nt, Human
ccucaccccacuuaucccucucca

SEQ ID NO: 2613183 - RNA, 16 nt, Human
ccucaccccgucuggg

SEQ ID NO: 2613184 - RNA, 22 nt, Human
ccucacaguccuuaccagcaga

SEQ ID NO: 2613185 - RNA, 20 nt, Human
ccucacaguccuuaccagca

SEQ ID NO: 2613186 - RNA, 12 nt, Human
ccucaccccacu

SEQ ID NO: 2613187 - RNA, 21 nt, Human
ccucacggugccuuuuuucac

SEQ ID NO: 2613188 - RNA, 14 nt, Human
ccucacgcaccucc

SEQ ID NO: 2613189 - RNA, 19 nt, Human
ccucaccuuuucccgggga

SEQ ID NO: 2613190 - RNA, 22 nt, Human
ccucaccuugcaacacacagac

SEQ ID NO: 2613191 - RNA, 17 nt, Human
ccucacgcaccucccau

SEQ ID NO: 2613192 - RNA, 17 nt, Human
ccucaccuuucccaucu

SEQ ID NO: 2613193 - RNA, 16 nt, Human
ccucaccuuggcacca

SEQ ID NO: 2613194 - RNA, 21 nt, Human
ccucaccuuggcaccagacac

SEQ ID NO: 2613195 - RNA, 15 nt, Human
ccucaccuuggcacc

SEQ ID NO: 2613196 - RNA, 19 nt, Human
ccucaccuugcaacacaca

SEQ ID NO: 2613197 - RNA, 21 nt, Human
ccucaccuugcaacacacaga

SEQ ID NO: 2613198 - RNA, 15 nt, Human
ccucaccuguagcag

SEQ ID NO: 2613199 - RNA, 18 nt, Human
ccucaccugggcaccugg

SEQ ID NO: 2613200 - RNA, 19 nt, Human
ccucaccugggcaccuggg

SEQ ID NO: 2613201 - RNA, 22 nt, Human
ccucaccugggcaccuggggag

SEQ ID NO: 2613202 - RNA, 17 nt, Human
ccucaccuugcaacaca

SEQ ID NO: 2613203 - RNA, 18 nt, Human
ccucaccuugcaacacac

SEQ ID NO: 2613204 - RNA, 23 nt, Human
ccucaccccugguucucaucuuu

SEQ ID NO: 2613205 - RNA, 22 nt, Human
ccucaccccugguucucaucuu

SEQ ID NO: 2613206 - RNA, 21 nt, Human
ccucaccccugguucucaucu

SEQ ID NO: 2613207 - RNA, 20 nt, Human
ccucaccccugguucucauc

SEQ ID NO: 2613208 - RNA, 20 nt, Human
ccucaccccuguccucacug

SEQ ID NO: 2613209 - RNA, 19 nt, Human
ccucaccccuguccucacu

SEQ ID NO: 2613210 - RNA, 15 nt, Human
ccucaccccuguccu

SEQ ID NO: 2613211 - RNA, 18 nt, Human
ccucaccccugcccuggg

SEQ ID NO: 2613212 - RNA, 22 nt, Human
ccucaccccuguccucacugcu

SEQ ID NO: 2613213 - RNA, 21 nt, Human
ccucaccccuguccucacugc

SEQ ID NO: 2613214 - RNA, 19 nt, Human
ccucacccgaggcugccca

SEQ ID NO: 2613215 - RNA, 14 nt, Human
ccucaccuccucua

SEQ ID NO: 2613216 - RNA, 12 nt, Human
ccucaccucugg

SEQ ID NO: 2613217 - RNA, 13 nt, Human
ccucaccucugga

SEQ ID NO: 2613218 - RNA, 18 nt, Human
ccucaccucuggacuggc

SEQ ID NO: 2613219 - RNA, 20 nt, Human
ccucaccucuggacuggcua

SEQ ID NO: 2613220 - RNA, 22 nt, Human
ccucaccucuggacuggcuaga

SEQ ID NO: 2613221 - RNA, 16 nt, Human
ccucaccugagagcca

SEQ ID NO: 2613222 - RNA, 14 nt, Human
ccucaccugggcac

SEQ ID NO: 2613223 - RNA, 18 nt, Human
ccucaauaagccuugucg

SEQ ID NO: 2613224 - RNA, 16 nt, Human
ccucaauaagccuugu

SEQ ID NO: 2613225 - RNA, 13 nt, Human
ccucaauccagcu

SEQ ID NO: 2613226 - RNA, 23 nt, Human
ccucaaugccaguaacgcgucuu

SEQ ID NO: 2613227 - RNA, 18 nt, Human
ccucaauccagcuauguu

SEQ ID NO: 2613228 - RNA, 24 nt, Human
ccuauguccuaaggacacacuaau

SEQ ID NO: 2613229 - RNA, 17 nt, Human
ccuaugugauuuuaacu

SEQ ID NO: 2613230 - RNA, 15 nt, Human
ccucaauaagccuug

SEQ ID NO: 2613231 - RNA, 20 nt, Human
ccuaugugauuuuaacucug

SEQ ID NO: 2613232 - RNA, 23 nt, Human
ccuauguccuaaggacacacuaa

SEQ ID NO: 2613233 - RNA, 22 nt, Human
ccuauguccuaaggacacacua

SEQ ID NO: 2613234 - RNA, 21 nt, Human
ccuauguccuaaggacacacu

SEQ ID NO: 2613235 - RNA, 20 nt, Human
ccuauguccuaaggacacac

SEQ ID NO: 2613236 - RNA, 19 nt, Human
ccuauguccuaaggacaca

SEQ ID NO: 2613237 - RNA, 15 nt, Human
ccuauguccuaagga

SEQ ID NO: 2613238 - RNA, 14 nt, Human
ccuauguccuaagg

SEQ ID NO: 2613239 - RNA, 14 nt, Human
ccuauguauuugca

SEQ ID NO: 2613240 - RNA, 18 nt, Human
ccuaugucauuucauuuc

SEQ ID NO: 2613241 - RNA, 16 nt, Human
ccuauguaguccgugc

SEQ ID NO: 2613242 - RNA, 18 nt, Human
ccuauguaguccgugcug

SEQ ID NO: 2613243 - RNA, 18 nt, Human
ccuaugggagucaagugu

SEQ ID NO: 2613244 - RNA, 22 nt, Human
ccuaugguauaaugguugacug

SEQ ID NO: 2613245 - RNA, 16 nt, Human
ccucaaugugaccagg

SEQ ID NO: 2613246 - RNA, 20 nt, Human
ccucaauucccccuggccac

SEQ ID NO: 2613247 - RNA, 20 nt, Human
ccucaaugugaaucagaccc

SEQ ID NO: 2613248 - RNA, 21 nt, Human
ccucaaugugaaucagacccu

SEQ ID NO: 2613249 - RNA, 14 nt, Human
ccucaaugugacca

SEQ ID NO: 2613250 - RNA, 22 nt, Human
ccucaaugugaaucagacccua

SEQ ID NO: 2613251 - RNA, 17 nt, Human
ccucacaguccuuacca

SEQ ID NO: 2613252 - RNA, 15 nt, Human
ccucacaggccccag

SEQ ID NO: 2613253 - RNA, 24 nt, Human
ccuaucagugugccccccauccug

SEQ ID NO: 2613254 - RNA, 22 nt, Human
ccuaucagugugccccccaucc

SEQ ID NO: 2613255 - RNA, 20 nt, Human
ccuaucagugugccccccau

SEQ ID NO: 2613256 - RNA, 18 nt, Human
ccuaucagugugcccccc

SEQ ID NO: 2613257 - RNA, 17 nt, Human
ccuaucagugugccccc

SEQ ID NO: 2613258 - RNA, 16 nt, Human
ccuaucagugugcccc

SEQ ID NO: 2613259 - RNA, 12 nt, Human
ccuaucagugug

SEQ ID NO: 2613260 - RNA, 21 nt, Human
ccuaucagccugucucuucca

SEQ ID NO: 2613261 - RNA, 17 nt, Human
ccuaucagaaguuucuc

SEQ ID NO: 2613262 - RNA, 20 nt, Human
ccuaucagaguugcugcaaa

SEQ ID NO: 2613263 - RNA, 17 nt, Human
ccuaucaccuccccucc

SEQ ID NO: 2613264 - RNA, 18 nt, Human
ccuaucaccuccccuccu

SEQ ID NO: 2613265 - RNA, 19 nt, Human
ccuauggcuggccacugca

SEQ ID NO: 2613266 - RNA, 18 nt, Human
ccuauggcuggccacugc

SEQ ID NO: 2613267 - RNA, 23 nt, Human
ccuauggcuggccacugcacaga

SEQ ID NO: 2613268 - RNA, 21 nt, Human
ccuauggcuggccacugcaca

SEQ ID NO: 2613269 - RNA, 17 nt, Human
ccuauggggauggucca

SEQ ID NO: 2613270 - RNA, 11 nt, Human
ccuauggaugu

SEQ ID NO: 2613271 - RNA, 12 nt, Human
ccuauccaccca

SEQ ID NO: 2613272 - RNA, 24 nt, Human
ccuauauuuacagugaaaauguaa

SEQ ID NO: 2613273 - RNA, 13 nt, Human
ccuauccacccag

SEQ ID NO: 2613274 - RNA, 13 nt, Human
ccuagagggaggg

SEQ ID NO: 2613275 - RNA, 15 nt, Human
ccuagagggaggggc

SEQ ID NO: 2613276 - RNA, 16 nt, Human
ccuagagggaggggcc

SEQ ID NO: 2613277 - RNA, 16 nt, Human
ccuaucaccuauuucc

SEQ ID NO: 2613278 - RNA, 17 nt, Human
ccuaucaccuauuucca

SEQ ID NO: 2613279 - RNA, 15 nt, Human
ccuaucaccuccccu

SEQ ID NO: 2613280 - RNA, 16 nt, Human
ccuaucaccuccccuc

SEQ ID NO: 2613281 - RNA, 21 nt, Human
ccuagagacagaagcaggcug

SEQ ID NO: 2613282 - RNA, 16 nt, Human
ccuagagacagaagca

SEQ ID NO: 2613283 - RNA, 23 nt, Human
ccuagagaagcuaaaaccugagc

SEQ ID NO: 2613284 - RNA, 15 nt, Human
ccuagagcacacugu

SEQ ID NO: 2613285 - RNA, 17 nt, Human
ccuagagccugccugga

SEQ ID NO: 2613286 - RNA, 14 nt, Human
ccuagagccugccu

SEQ ID NO: 2613287 - RNA, 13 nt, Human
ccuagagccugcc

SEQ ID NO: 2613288 - RNA, 19 nt, Human
ccuagagccugccuggagc

SEQ ID NO: 2613289 - RNA, 18 nt, Human
ccuagagccugccuggag

SEQ ID NO: 2613290 - RNA, 22 nt, Human
ccucuguccugacuucaggggc

SEQ ID NO: 2613291 - RNA, 20 nt, Human
ccugaggcccuucucuccag

SEQ ID NO: 2613292 - RNA, 19 nt, Human
ccugaggcccuucucucca

SEQ ID NO: 2613293 - RNA, 17 nt, Human
ccugaggcccuucucuc

SEQ ID NO: 2613294 - RNA, 16 nt, Human
ccugaggcccuucucu

SEQ ID NO: 2613295 - RNA, 22 nt, Human
ccugaggcccuucucuccagcc

SEQ ID NO: 2613296 - RNA, 21 nt, Human
ccugaggcccuucucuccagc

SEQ ID NO: 2613297 - RNA, 19 nt, Human
ccugaggcagguccccaga

SEQ ID NO: 2613298 - RNA, 23 nt, Human
ccugaggcccuucucuccagccc

SEQ ID NO: 2613299 - RNA, 16 nt, Human
ccugacaacacucauu

SEQ ID NO: 2613300 - RNA, 15 nt, Human
ccugacaacacucau

SEQ ID NO: 2613301 - RNA, 14 nt, Human
ccugacaacacuca

SEQ ID NO: 2613302 - RNA, 12 nt, Human
ccugacaacacu

SEQ ID NO: 2613303 - RNA, 14 nt, Human
ccugaggcccagag

SEQ ID NO: 2613304 - RNA, 13 nt, Human
ccugaggcccaga

SEQ ID NO: 2613305 - RNA, 21 nt, Human
ccugaauuuuguugcuguuuu

SEQ ID NO: 2613306 - RNA, 18 nt, Human
ccugaggcagguccccag

SEQ ID NO: 2613307 - RNA, 12 nt, Human
ccugaggcccag

SEQ ID NO: 2613308 - RNA, 21 nt, Human
ccugauggcacuuagcuauca

SEQ ID NO: 2613309 - RNA, 17 nt, Human
ccugauggaccugucac

SEQ ID NO: 2613310 - RNA, 13 nt, Human
ccugaugcugacu

SEQ ID NO: 2613311 - RNA, 23 nt, Human
ccugauggcaggauggccuggcc

SEQ ID NO: 2613312 - RNA, 20 nt, Human
ccugauggcaggauggccug

SEQ ID NO: 2613313 - RNA, 18 nt, Human
ccugaugguacaggaaag

SEQ ID NO: 2613314 - RNA, 23 nt, Human
ccugaugcugacauucaccugcc

SEQ ID NO: 2613315 - RNA, 13 nt, Human
ccugaugcugaca

SEQ ID NO: 2613316 - RNA, 21 nt, Human
ccugaugcugacauucaccug

SEQ ID NO: 2613317 - RNA, 18 nt, Human
ccugaugcuucuucagag

SEQ ID NO: 2613318 - RNA, 17 nt, Human
ccugaugcuucuucaga

SEQ ID NO: 2613319 - RNA, 22 nt, Human
ccugauggucagcucccuucuc

SEQ ID NO: 2613320 - RNA, 21 nt, Human
ccugauggucagcucccuucu

SEQ ID NO: 2613321 - RNA, 20 nt, Human
ccugauggucagcucccuuc

SEQ ID NO: 2613322 - RNA, 18 nt, Human
ccugauggucagcucccu

SEQ ID NO: 2613323 - RNA, 17 nt, Human
ccugauggucagcuccc

SEQ ID NO: 2613324 - RNA, 16 nt, Human
ccugauggucagcucc

SEQ ID NO: 2613325 - RNA, 21 nt, Human
ccugaugguacaggaaagcuc

SEQ ID NO: 2613326 - RNA, 17 nt, Human
ccugauggccaggccag

SEQ ID NO: 2613327 - RNA, 23 nt, Human
ccugauggucagcucccuucucu

SEQ ID NO: 2613328 - RNA, 16 nt, Human
ccugauguuaaaauuc

SEQ ID NO: 2613329 - RNA, 23 nt, Human
ccugauugugucucuugguccug

SEQ ID NO: 2613330 - RNA, 17 nt, Human
ccugauguuaaaauucc

SEQ ID NO: 2613331 - RNA, 14 nt, Human
ccugaugcuucuuc

SEQ ID NO: 2613332 - RNA, 16 nt, Human
ccugaugcucccuccc

SEQ ID NO: 2613333 - RNA, 19 nt, Human
ccugaugcucccuccccug

SEQ ID NO: 2613334 - RNA, 20 nt, Human
ccugaugcucccuccccugc

SEQ ID NO: 2613335 - RNA, 23 nt, Human
ccugaugcucccuccccugcccu

SEQ ID NO: 2613336 - RNA, 13 nt, Human
ccugaugacagag

SEQ ID NO: 2613337 - RNA, 16 nt, Human
ccugaugcucauauca

SEQ ID NO: 2613338 - RNA, 16 nt, Human
ccugaugcagucacgu

SEQ ID NO: 2613339 - RNA, 15 nt, Human
ccugaugcagucacg

SEQ ID NO: 2613340 - RNA, 16 nt, Human
ccugaugacagagcga

SEQ ID NO: 2613341 - RNA, 13 nt, Human
ccugaugcucccu

SEQ ID NO: 2613342 - RNA, 14 nt, Human
ccugaugcucccuc

SEQ ID NO: 2613343 - RNA, 18 nt, Human
ccugaggcuccacuuggu

SEQ ID NO: 2613344 - RNA, 20 nt, Human
ccugaggcuccacuuggucu

SEQ ID NO: 2613345 - RNA, 12 nt, Human
ccugaggcuccu

SEQ ID NO: 2613346 - RNA, 18 nt, Human
ccugaggcuccugugcua

SEQ ID NO: 2613347 - RNA, 17 nt, Human
ccugaggcuccugugcu

SEQ ID NO: 2613348 - RNA, 14 nt, Human
ccugaggcugagac

SEQ ID NO: 2613349 - RNA, 19 nt, Human
ccugaucugacauccccac

SEQ ID NO: 2613350 - RNA, 23 nt, Human
ccugaucgccaaccuuuccccca

SEQ ID NO: 2613351 - RNA, 22 nt, Human
ccucuuuggucuacacugugcu

SEQ ID NO: 2613352 - RNA, 14 nt, Human
ccucuuugucuaaa

SEQ ID NO: 2613353 - RNA, 15 nt, Human
ccucuuugucuaaaa

SEQ ID NO: 2613354 - RNA, 19 nt, Human
ccucuuugucuaaaacaau

SEQ ID NO: 2613355 - RNA, 22 nt, Human
ccucuuugucuaaaacaauaaa

SEQ ID NO: 2613356 - RNA, 13 nt, Human
ccucuuccucuga

SEQ ID NO: 2613357 - RNA, 12 nt, Human
ccucuuccucug

SEQ ID NO: 2613358 - RNA, 11 nt, Human
ccucuuccucu

SEQ ID NO: 2613359 - RNA, 19 nt, Human
ccucuuccucccucauucc

SEQ ID NO: 2613360 - RNA, 16 nt, Human
ccucuuccucccucau

SEQ ID NO: 2613361 - RNA, 15 nt, Human
ccucuuccucccuca

SEQ ID NO: 2613362 - RNA, 17 nt, Human
ccucuuaugggcugggu

SEQ ID NO: 2613363 - RNA, 22 nt, Human
ccucuuagacuucugcuuucca

SEQ ID NO: 2613364 - RNA, 20 nt, Human
ccucuuagacuucugcuuuc

SEQ ID NO: 2613365 - RNA, 21 nt, Human
ccucuuaaagaaaacccaccc

SEQ ID NO: 2613366 - RNA, 17 nt, Human
ccucuuagcugagugga

SEQ ID NO: 2613367 - RNA, 14 nt, Human
ccucuuagcugagu

SEQ ID NO: 2613368 - RNA, 13 nt, Human
ccucuucaaauua

SEQ ID NO: 2613369 - RNA, 17 nt, Human
ccucuucaccccccacu

SEQ ID NO: 2613370 - RNA, 13 nt, Human
ccucuucaccccc

SEQ ID NO: 2613371 - RNA, 17 nt, Human
ccucuuccccuugcccu

SEQ ID NO: 2613372 - RNA, 21 nt, Human
ccucuuccccuugcccuugcc

SEQ ID NO: 2613373 - RNA, 20 nt, Human
ccucuuccggagauguagca

SEQ ID NO: 2613374 - RNA, 18 nt, Human
ccucuuccgugacgucac

SEQ ID NO: 2613375 - RNA, 19 nt, Human
ccucuuccggagauguagc

SEQ ID NO: 2613376 - RNA, 14 nt, Human
ccugaaauuucacc

SEQ ID NO: 2613377 - RNA, 14 nt, Human
ccugaaauuucaga

SEQ ID NO: 2613378 - RNA, 15 nt, Human
ccugaaauuucagau

SEQ ID NO: 2613379 - RNA, 13 nt, Human
ccugaacaagaau

SEQ ID NO: 2613380 - RNA, 15 nt, Human
ccugaacaagaauug

SEQ ID NO: 2613381 - RNA, 16 nt, Human
ccugaacaagaauugg

SEQ ID NO: 2613382 - RNA, 17 nt, Human
ccugaacaagaauugga

SEQ ID NO: 2613383 - RNA, 19 nt, Human
ccugaaagaggcugaggcc

SEQ ID NO: 2613384 - RNA, 15 nt, Human
ccugaaagaggcuga

SEQ ID NO: 2613385 - RNA, 23 nt, Human
ccugaaagaggaaugaaguacuc

SEQ ID NO: 2613386 - RNA, 17 nt, Human
ccugaaaacacugugca

SEQ ID NO: 2613387 - RNA, 18 nt, Human
ccugaaagaggaaugaag

SEQ ID NO: 2613388 - RNA, 23 nt, Human
ccucuuugucuaaaacaauaaaa

SEQ ID NO: 2613389 - RNA, 17 nt, Human
ccugaauccaaacuaau

SEQ ID NO: 2613390 - RNA, 20 nt, Human
ccugaauccaaacuaaucca

SEQ ID NO: 2613391 - RNA, 20 nt, Human
ccugaaucccccuugccacc

SEQ ID NO: 2613392 - RNA, 19 nt, Human
ccugaaucccccuugccac

SEQ ID NO: 2613393 - RNA, 21 nt, Human
ccugaauccaaacuaauccau

SEQ ID NO: 2613394 - RNA, 21 nt, Human
ccugaaggaacauuccuuagu

SEQ ID NO: 2613395 - RNA, 23 nt, Human
ccugaaugguuccaugccugagg

SEQ ID NO: 2613396 - RNA, 22 nt, Human
ccugaaugguuccaugccugag

SEQ ID NO: 2613397 - RNA, 21 nt, Human
ccugaaugguuccaugccuga

SEQ ID NO: 2613398 - RNA, 20 nt, Human
ccugaaugguuccaugccug

SEQ ID NO: 2613399 - RNA, 22 nt, Human
ccugaaucccccuugccacccc

SEQ ID NO: 2613400 - RNA, 13 nt, Human
ccugaaugaaaua

SEQ ID NO: 2613401 - RNA, 19 nt, Human
ccugaauuuauuauuguuc

SEQ ID NO: 2613402 - RNA, 21 nt, Human
ccugaauucuauuugcugggc

SEQ ID NO: 2613403 - RNA, 15 nt, Human
ccugaauucuuuuuc

SEQ ID NO: 2613404 - RNA, 18 nt, Human
ccugaauucuauuugcug

SEQ ID NO: 2613405 - RNA, 14 nt, Human
ccugaauucuauuu

SEQ ID NO: 2613406 - RNA, 23 nt, Human
ccugaauguauugaacuuggaaa

SEQ ID NO: 2613407 - RNA, 17 nt, Human
ccugaagucacacagug

SEQ ID NO: 2613408 - RNA, 16 nt, Human
ccugaagucacacagu

SEQ ID NO: 2613409 - RNA, 13 nt, Human
ccugaaggccccg

SEQ ID NO: 2613410 - RNA, 15 nt, Human
ccugaagucacacag

SEQ ID NO: 2613411 - RNA, 23 nt, Human
ccugaagcuaucguaaaauuaag

SEQ ID NO: 2613412 - RNA, 22 nt, Human
ccugaagcuaucguaaaauuaa

SEQ ID NO: 2613413 - RNA, 17 nt, Human
ccugaagaaccaguccc

SEQ ID NO: 2613414 - RNA, 20 nt, Human
ccugaagcuaucguaaaauu

SEQ ID NO: 2613415 - RNA, 21 nt, Human
ccugaagacucauucuucugu

SEQ ID NO: 2613416 - RNA, 21 nt, Human
ccugaacauccuuccuuccca

SEQ ID NO: 2613417 - RNA, 20 nt, Human
ccugaacauccuuccuuccc

SEQ ID NO: 2613418 - RNA, 18 nt, Human
ccugaacauccuuccuuc

SEQ ID NO: 2613419 - RNA, 21 nt, Human
ccugaacaagaauuggaagcu

SEQ ID NO: 2613420 - RNA, 13 nt, Human
ccugaagaaccag

SEQ ID NO: 2613421 - RNA, 16 nt, Human
ccugaagaaccagucc

SEQ ID NO: 2613422 - RNA, 14 nt, Human
ccugaagaacagua

SEQ ID NO: 2613423 - RNA, 19 nt, Human
ccugaacugggaccuuuag

SEQ ID NO: 2613424 - RNA, 13 nt, Human
ccugaaccuagga

SEQ ID NO: 2613425 - RNA, 22 nt, Human
ccucugucugcccuucacccca

SEQ ID NO: 2613426 - RNA, 16 nt, Human
ccucugucugcccuuc

SEQ ID NO: 2613427 - RNA, 14 nt, Human
ccucugucugcccu

SEQ ID NO: 2613428 - RNA, 22 nt, Human
ccucugucuugugaaggcaggg

SEQ ID NO: 2613429 - RNA, 20 nt, Human
ccucugucuuggcuuucaug

SEQ ID NO: 2613430 - RNA, 18 nt, Human
ccucugugaccaaugucu

SEQ ID NO: 2613431 - RNA, 19 nt, Human
ccucugugaccaaugucuu

SEQ ID NO: 2613432 - RNA, 15 nt, Human
ccucugugaccucag

SEQ ID NO: 2613433 - RNA, 22 nt, Human
ccucugucuuggcuuucauguu

SEQ ID NO: 2613434 - RNA, 21 nt, Human
ccucugugaccaaugucuuga

SEQ ID NO: 2613435 - RNA, 17 nt, Human
ccucugugaccucaggc

SEQ ID NO: 2613436 - RNA, 14 nt, Human
ccucugugccuucu

SEQ ID NO: 2613437 - RNA, 16 nt, Human
ccucugugcugugugu

SEQ ID NO: 2613438 - RNA, 13 nt, Human
ccucugugcugug

SEQ ID NO: 2613439 - RNA, 21 nt, Human
ccucugugccuucuuuugauu

SEQ ID NO: 2613440 - RNA, 20 nt, Human
ccucuguguccuucccugca

SEQ ID NO: 2613441 - RNA, 19 nt, Human
ccucuguguccuucccugc

SEQ ID NO: 2613442 - RNA, 13 nt, Human
ccucuguguccuu

SEQ ID NO: 2613443 - RNA, 23 nt, Human
ccucugugucacuggcugccucc

SEQ ID NO: 2613444 - RNA, 22 nt, Human
ccucugugucacuggcugccuc

SEQ ID NO: 2613445 - RNA, 21 nt, Human
ccucugugucacuggcugccu

SEQ ID NO: 2613446 - RNA, 19 nt, Human
ccucugugucacuggcugc

SEQ ID NO: 2613447 - RNA, 18 nt, Human
ccucugugucacuggcug

SEQ ID NO: 2613448 - RNA, 17 nt, Human
ccucugugucacuggcu

SEQ ID NO: 2613449 - RNA, 16 nt, Human
ccucugugucacuggc

SEQ ID NO: 2613450 - RNA, 14 nt, Human
ccucugugucacug

SEQ ID NO: 2613451 - RNA, 16 nt, Human
ccucugugaccucagg

SEQ ID NO: 2613452 - RNA, 18 nt, Human
ccucuguguauuugcuuu

SEQ ID NO: 2613453 - RNA, 15 nt, Human
ccucugugcugugug

SEQ ID NO: 2613454 - RNA, 16 nt, Human
ccucuguuugacaaac

SEQ ID NO: 2613455 - RNA, 21 nt, Human
ccucuguuucucuuuccuugg

SEQ ID NO: 2613456 - RNA, 23 nt, Human
ccucuguuguccuccccuugggc

SEQ ID NO: 2613457 - RNA, 18 nt, Human
ccucuguuguccuccccu

SEQ ID NO: 2613458 - RNA, 15 nt, Human
ccucuguuguccucc

SEQ ID NO: 2613459 - RNA, 22 nt, Human
ccucuguucaguguaaauaguu

SEQ ID NO: 2613460 - RNA, 16 nt, Human
ccucuguucaguguaa

SEQ ID NO: 2613461 - RNA, 19 nt, Human
ccucugugugcuccuccuu

SEQ ID NO: 2613462 - RNA, 21 nt, Human
ccucuguucugcacacagcac

SEQ ID NO: 2613463 - RNA, 23 nt, Human
ccucuuagaugcaguucugaaga

SEQ ID NO: 2613464 - RNA, 14 nt, Human
ccucuuaugggcug

SEQ ID NO: 2613465 - RNA, 16 nt, Human
ccucuuaugggcuggg

SEQ ID NO: 2613466 - RNA, 15 nt, Human
ccucuuaugggcugg

SEQ ID NO: 2613467 - RNA, 14 nt, Human
ccucuuagaaaaac

SEQ ID NO: 2613468 - RNA, 21 nt, Human
ccucuuaauguaugauuacau

SEQ ID NO: 2613469 - RNA, 23 nt, Human
ccucuuaaagcugccuguaguua

SEQ ID NO: 2613470 - RNA, 21 nt, Human
ccucuguuugacaaaccucua

SEQ ID NO: 2613471 - RNA, 17 nt, Human
ccucuuaaaaaauaaaa

SEQ ID NO: 2613472 - RNA, 18 nt, Human
ccucuuaaaaaauaaaaa

SEQ ID NO: 2613473 - RNA, 19 nt, Human
ccucuuaaaaaauaaaaac

SEQ ID NO: 2613474 - RNA, 20 nt, Human
ccucuuaaagaaaacccacc

SEQ ID NO: 2613475 - RNA, 19 nt, Human
ccucuuaaagaaaacccac

SEQ ID NO: 2613476 - RNA, 17 nt, Human
ccucuuaaagcugccug

SEQ ID NO: 2613477 - RNA, 19 nt, Human
ccucuuaaagcugccugua

SEQ ID NO: 2613478 - RNA, 20 nt, Human
ccucuuaaagcugccuguag

SEQ ID NO: 2613479 - RNA, 21 nt, Human
ccucuuaaagcugccuguagu

SEQ ID NO: 2613480 - RNA, 22 nt, Human
ccucuuaaagcugccuguaguu

SEQ ID NO: 2613481 - RNA, 15 nt, Human
ccucuguccaggcac

SEQ ID NO: 2613482 - RNA, 19 nt, Human
ccucuguccaggcacugag

SEQ ID NO: 2613483 - RNA, 17 nt, Human
ccucuguccaggcacug

SEQ ID NO: 2613484 - RNA, 20 nt, Human
ccucuguccaggcacugaga

SEQ ID NO: 2613485 - RNA, 21 nt, Human
ccucuguccaggcacugagau

SEQ ID NO: 2613486 - RNA, 14 nt, Human
ccucuguccagggc

SEQ ID NO: 2613487 - RNA, 15 nt, Human
ccucuguccagggcc

SEQ ID NO: 2613488 - RNA, 18 nt, Human
ccucugucagucacagcc

SEQ ID NO: 2613489 - RNA, 19 nt, Human
ccucugucagucacagcca

SEQ ID NO: 2613490 - RNA, 21 nt, Human
ccucugucagucacagccacc

SEQ ID NO: 2613491 - RNA, 15 nt, Human
ccucugucagucaca

SEQ ID NO: 2613492 - RNA, 16 nt, Human
ccucugucagucacag

SEQ ID NO: 2613493 - RNA, 19 nt, Human
ccucugucacugcaggcac

SEQ ID NO: 2613494 - RNA, 17 nt, Human
ccucugucacugcaggc

SEQ ID NO: 2613495 - RNA, 13 nt, Human
ccucugucugccc

SEQ ID NO: 2613496 - RNA, 16 nt, Human
ccucuguccugacuuc

SEQ ID NO: 2613497 - RNA, 14 nt, Human
ccucuguccugacu

SEQ ID NO: 2613498 - RNA, 13 nt, Human
ccucuguccugac

SEQ ID NO: 2613499 - RNA, 11 nt, Human
ccucuguccug

SEQ ID NO: 2613500 - RNA, 22 nt, Human
ccucuguccccuucucucaucu

SEQ ID NO: 2613501 - RNA, 21 nt, Human
ccucuguccccuucucucauc

SEQ ID NO: 2613502 - RNA, 19 nt, Human
ccucuguccccuucucuca

SEQ ID NO: 2613503 - RNA, 18 nt, Human
ccucuguccccuucucuc

SEQ ID NO: 2613504 - RNA, 17 nt, Human
ccucuguccccuucucu

SEQ ID NO: 2613505 - RNA, 14 nt, Human
ccucuguccccuuc

SEQ ID NO: 2613506 - RNA, 18 nt, Human
ccucuguccagggcccug

SEQ ID NO: 2613507 - RNA, 20 nt, Human
ccucuguccagggcccugag

SEQ ID NO: 2613508 - RNA, 21 nt, Human
ccucuguccagggcccugagc

SEQ ID NO: 2613509 - RNA, 23 nt, Human
ccucuguccagggcccugagcuc

SEQ ID NO: 2613510 - RNA, 16 nt, Human
ccucuguacagagccc

SEQ ID NO: 2613511 - RNA, 15 nt, Human
ccucuguacagagcc

SEQ ID NO: 2613512 - RNA, 21 nt, Human
ccucuggucgcuccugcccac

SEQ ID NO: 2613513 - RNA, 20 nt, Human
ccucuggucgcuccugccca

SEQ ID NO: 2613514 - RNA, 19 nt, Human
ccucuggucgcuccugccc

SEQ ID NO: 2613515 - RNA, 17 nt, Human
ccucuggucgcuccugc

SEQ ID NO: 2613516 - RNA, 14 nt, Human
ccucuguacagagc

SEQ ID NO: 2613517 - RNA, 18 nt, Human
ccucuguacagagcccac

SEQ ID NO: 2613518 - RNA, 17 nt, Human
ccucuguacagagccca

SEQ ID NO: 2613519 - RNA, 23 nt, Human
ccucuguacagagcccacgcccc

SEQ ID NO: 2613520 - RNA, 23 nt, Human
ccucugguuuggggcgaggcaga

SEQ ID NO: 2613521 - RNA, 21 nt, Human
ccucugguuuggggcgaggca

SEQ ID NO: 2613522 - RNA, 18 nt, Human
ccucugguuuggggcgag

SEQ ID NO: 2613523 - RNA, 16 nt, Human
ccucuggucugggugc

SEQ ID NO: 2613524 - RNA, 16 nt, Human
ccucugguuuggggcg

SEQ ID NO: 2613525 - RNA, 21 nt, Human
ccucugcacuccccugcuggg

SEQ ID NO: 2613526 - RNA, 20 nt, Human
ccucugcacuccccugcugg

SEQ ID NO: 2613527 - RNA, 19 nt, Human
ccucugcacuccccugcug

SEQ ID NO: 2613528 - RNA, 14 nt, Human
ccucugcacucccc

SEQ ID NO: 2613529 - RNA, 16 nt, Human
ccucugcagcugaccu

SEQ ID NO: 2613530 - RNA, 15 nt, Human
ccucugcagcugacc

SEQ ID NO: 2613531 - RNA, 13 nt, Human
ccucugcagcuga

SEQ ID NO: 2613532 - RNA, 12 nt, Human
ccucugcagcug

SEQ ID NO: 2613533 - RNA, 22 nt, Human
ccucugcacuccccugcugggu

SEQ ID NO: 2613534 - RNA, 19 nt, Human
ccucugcagcugaccucug

SEQ ID NO: 2613535 - RNA, 17 nt, Human
ccucugcagcugaccuc

SEQ ID NO: 2613536 - RNA, 16 nt, Human
ccucugcagugccuug

SEQ ID NO: 2613537 - RNA, 19 nt, Human
ccucugccaaaggauguga

SEQ ID NO: 2613538 - RNA, 17 nt, Human
ccucugcagugccuugg

SEQ ID NO: 2613539 - RNA, 22 nt, Human
ccucugcagcugaccucuguug

SEQ ID NO: 2613540 - RNA, 18 nt, Human
ccucugacacacagcucu

SEQ ID NO: 2613541 - RNA, 17 nt, Human
ccucugacacacagcuc

SEQ ID NO: 2613542 - RNA, 11 nt, Human
ccucugcacaa

SEQ ID NO: 2613543 - RNA, 15 nt, Human
ccucugcacaagcug

SEQ ID NO: 2613544 - RNA, 21 nt, Human
ccucugcacuacugacaugug

SEQ ID NO: 2613545 - RNA, 20 nt, Human
ccucugcacuacugacaugu

SEQ ID NO: 2613546 - RNA, 20 nt, Human
ccucugcacaagcugcaccc

SEQ ID NO: 2613547 - RNA, 17 nt, Human
ccucugcacaagcugca

SEQ ID NO: 2613548 - RNA, 19 nt, Human
ccucugcacaagcugcacc

SEQ ID NO: 2613549 - RNA, 16 nt, Human
ccucuggcuccagcug

SEQ ID NO: 2613550 - RNA, 17 nt, Human
ccucuggcuccagcugg

SEQ ID NO: 2613551 - RNA, 17 nt, Human
ccucuggcccugccuuc

SEQ ID NO: 2613552 - RNA, 24 nt, Human
ccucuggcuagaggccagccccac

SEQ ID NO: 2613553 - RNA, 22 nt, Human
ccucuggcuggcuaacuggaag

SEQ ID NO: 2613554 - RNA, 23 nt, Human
ccucuggcuggcuaacuggaagc

SEQ ID NO: 2613555 - RNA, 18 nt, Human
ccucuggauugugggaau

SEQ ID NO: 2613556 - RNA, 12 nt, Human
ccucuggccagg

SEQ ID NO: 2613557 - RNA, 15 nt, Human
ccucuggccaggaug

SEQ ID NO: 2613558 - RNA, 12 nt, Human
ccucuggcccug

SEQ ID NO: 2613559 - RNA, 13 nt, Human
ccucuggcccugc

SEQ ID NO: 2613560 - RNA, 15 nt, Human
ccucuggcccugccu

SEQ ID NO: 2613561 - RNA, 18 nt, Human
ccucuggcccugccuucu

SEQ ID NO: 2613562 - RNA, 12 nt, Human
ccucuggcuaga

SEQ ID NO: 2613563 - RNA, 13 nt, Human
ccucuggcuagag

SEQ ID NO: 2613564 - RNA, 22 nt, Human
ccucuggcuagaggccagcccc

SEQ ID NO: 2613565 - RNA, 23 nt, Human
ccucuggcuagaggccagcccca

SEQ ID NO: 2613566 - RNA, 17 nt, Human
ccucugggucagugguc

SEQ ID NO: 2613567 - RNA, 20 nt, Human
ccucugggucagugguccac

SEQ ID NO: 2613568 - RNA, 16 nt, Human
ccucuggucgcuccug

SEQ ID NO: 2613569 - RNA, 12 nt, Human
ccucugggacug

SEQ ID NO: 2613570 - RNA, 23 nt, Human
ccucugggaaaugagaaggcagc

SEQ ID NO: 2613571 - RNA, 14 nt, Human
ccucugggcacugg

SEQ ID NO: 2613572 - RNA, 16 nt, Human
ccucugggcaggaccu

SEQ ID NO: 2613573 - RNA, 22 nt, Human
ccucuggagggguguggcuccu

SEQ ID NO: 2613574 - RNA, 20 nt, Human
ccucuggagggguguggcuc

SEQ ID NO: 2613575 - RNA, 13 nt, Human
ccucuggaguggc

SEQ ID NO: 2613576 - RNA, 14 nt, Human
ccucuggaguggcc

SEQ ID NO: 2613577 - RNA, 15 nt, Human
ccucuggaguggcca

SEQ ID NO: 2613578 - RNA, 23 nt, Human
ccucuggcauuagaauuauuuaa

SEQ ID NO: 2613579 - RNA, 21 nt, Human
ccucuggcauuagaauuauuu

SEQ ID NO: 2613580 - RNA, 21 nt, Human
ccucuggauggcaccagaggc

SEQ ID NO: 2613581 - RNA, 16 nt, Human
ccucuggauggcacca

SEQ ID NO: 2613582 - RNA, 16 nt, Human
ccucuggaguggccac

SEQ ID NO: 2613583 - RNA, 21 nt, Human
ccucuggaguggccacuaagc

SEQ ID NO: 2613584 - RNA, 18 nt, Human
ccucuggacuggcuagag

SEQ ID NO: 2613585 - RNA, 17 nt, Human
ccucuggaggggugugg

SEQ ID NO: 2613586 - RNA, 14 nt, Human
ccucuggacuggcu

SEQ ID NO: 2613587 - RNA, 15 nt, Human
ccucuggacuggcua

SEQ ID NO: 2613588 - RNA, 16 nt, Human
ccucuggacuggcuag

SEQ ID NO: 2613589 - RNA, 17 nt, Human
ccucuggacuggcuaga

SEQ ID NO: 2613590 - RNA, 22 nt, Human
ccucugccaaaggaugugauau

SEQ ID NO: 2613591 - RNA, 20 nt, Human
ccucugccaaaggaugugau

SEQ ID NO: 2613592 - RNA, 13 nt, Human
ccucugccaccag

SEQ ID NO: 2613593 - RNA, 11 nt, Human
ccucugccacc

SEQ ID NO: 2613594 - RNA, 19 nt, Human
ccucugccaccagagaccg

SEQ ID NO: 2613595 - RNA, 17 nt, Human
ccucugccaccagagac

SEQ ID NO: 2613596 - RNA, 24 nt, Human
ccucugccaccagagaccguccuc

SEQ ID NO: 2613597 - RNA, 23 nt, Human
ccucuggacggcaggcucacugc

SEQ ID NO: 2613598 - RNA, 22 nt, Human
ccucuggacggcaggcucacug

SEQ ID NO: 2613599 - RNA, 21 nt, Human
ccucuggacggcaggcucacu

SEQ ID NO: 2613600 - RNA, 16 nt, Human
ccucuggacggcaggc

SEQ ID NO: 2613601 - RNA, 15 nt, Human
ccucuggacggcagg

SEQ ID NO: 2613602 - RNA, 12 nt, Human
ccucucugcucu

SEQ ID NO: 2613603 - RNA, 15 nt, Human
ccucucugcucugcg

SEQ ID NO: 2613604 - RNA, 22 nt, Human
ccucucugccgcaauacaggaa

SEQ ID NO: 2613605 - RNA, 16 nt, Human
ccucucugcucugcgu

SEQ ID NO: 2613606 - RNA, 15 nt, Human
ccucuccuggaggau

SEQ ID NO: 2613607 - RNA, 14 nt, Human
ccucuccuggagga

SEQ ID NO: 2613608 - RNA, 13 nt, Human
ccucucugcccua

SEQ ID NO: 2613609 - RNA, 13 nt, Human
ccucuccuggagg

SEQ ID NO: 2613610 - RNA, 12 nt, Human
ccucuccuggag

SEQ ID NO: 2613611 - RNA, 11 nt, Human
ccucuccugga

SEQ ID NO: 2613612 - RNA, 17 nt, Human
ccucuccugccuacuca

SEQ ID NO: 2613613 - RNA, 21 nt, Human
ccucuccccagguccagcucu

SEQ ID NO: 2613614 - RNA, 19 nt, Human
ccucucccauugucccucu

SEQ ID NO: 2613615 - RNA, 23 nt, Human
ccucuccccagguccagcucugg

SEQ ID NO: 2613616 - RNA, 19 nt, Human
ccucuccccccccccucca

SEQ ID NO: 2613617 - RNA, 19 nt, Human
ccucuccccauucggugug

SEQ ID NO: 2613618 - RNA, 23 nt, Human
ccucuccccuaccacugucuucu

SEQ ID NO: 2613619 - RNA, 18 nt, Human
ccucuccccuaccacugu

SEQ ID NO: 2613620 - RNA, 20 nt, Human
ccucuccccccccccuccaa

SEQ ID NO: 2613621 - RNA, 16 nt, Human
ccucuccccugauuac

SEQ ID NO: 2613622 - RNA, 13 nt, Human
ccucuccugccua

SEQ ID NO: 2613623 - RNA, 14 nt, Human
ccucuccugccuac

SEQ ID NO: 2613624 - RNA, 15 nt, Human
ccucuccugccuacu

SEQ ID NO: 2613625 - RNA, 16 nt, Human
ccucuccugccuacuc

SEQ ID NO: 2613626 - RNA, 15 nt, Human
ccucugacacacagc

SEQ ID NO: 2613627 - RNA, 16 nt, Human
ccucugacacacagcu

SEQ ID NO: 2613628 - RNA, 20 nt, Human
ccucugaaaacggcccucuu

SEQ ID NO: 2613629 - RNA, 18 nt, Human
ccucugaaaacggcccuc

SEQ ID NO: 2613630 - RNA, 23 nt, Human
ccucucuuuguucucagcucccc

SEQ ID NO: 2613631 - RNA, 22 nt, Human
ccucucuuuguucucagcuccc

SEQ ID NO: 2613632 - RNA, 21 nt, Human
ccucucuuuguucucagcucc

SEQ ID NO: 2613633 - RNA, 20 nt, Human
ccucucuuuguucucagcuc

SEQ ID NO: 2613634 - RNA, 19 nt, Human
ccucucuuuguucucagcu

SEQ ID NO: 2613635 - RNA, 18 nt, Human
ccucucuuuguucucagc

SEQ ID NO: 2613636 - RNA, 23 nt, Human
ccucugaaaaccaauguucucuc

SEQ ID NO: 2613637 - RNA, 18 nt, Human
ccucucuggccucccacc

SEQ ID NO: 2613638 - RNA, 17 nt, Human
ccucucuggccucccac

SEQ ID NO: 2613639 - RNA, 16 nt, Human
ccucucuggccuccca

SEQ ID NO: 2613640 - RNA, 15 nt, Human
ccucucuggccuccc

SEQ ID NO: 2613641 - RNA, 13 nt, Human
ccucucuggccuc

SEQ ID NO: 2613642 - RNA, 22 nt, Human
ccucucuggccucccacccgau

SEQ ID NO: 2613643 - RNA, 10 nt, Human
ccucucuguu

SEQ ID NO: 2613644 - RNA, 19 nt, Human
ccucucuggccucccaccc

SEQ ID NO: 2613645 - RNA, 20 nt, Human
ccucucuuauagaauauuua

SEQ ID NO: 2613646 - RNA, 14 nt, Human
ccucucuugcaccc

SEQ ID NO: 2613647 - RNA, 13 nt, Human
ccucucuugcacc

SEQ ID NO: 2613648 - RNA, 11 nt, Human
ccucucuugca

SEQ ID NO: 2613649 - RNA, 23 nt, Human
ccucucuugcacccgccucuccc

SEQ ID NO: 2613650 - RNA, 21 nt, Human
ccucucuugcacccgccucuc

SEQ ID NO: 2613651 - RNA, 18 nt, Human
ccucucuugcacccgccu

SEQ ID NO: 2613652 - RNA, 17 nt, Human
ccucucuugcacccgcc

SEQ ID NO: 2613653 - RNA, 18 nt, Human
ccucucuugguuuccuuc

SEQ ID NO: 2613654 - RNA, 19 nt, Human
ccucucuugguuuccuucc

SEQ ID NO: 2613655 - RNA, 15 nt, Human
ccucucuuuguucuc

SEQ ID NO: 2613656 - RNA, 21 nt, Human
ccucucuugguuuccuuccuu

SEQ ID NO: 2613657 - RNA, 19 nt, Human
ccucucacugucugagagu

SEQ ID NO: 2613658 - RNA, 15 nt, Human
ccucucacugucuga

SEQ ID NO: 2613659 - RNA, 14 nt, Human
ccucucacugucug

SEQ ID NO: 2613660 - RNA, 13 nt, Human
ccucucacugucu

SEQ ID NO: 2613661 - RNA, 17 nt, Human
ccucucaccuguacucu

SEQ ID NO: 2613662 - RNA, 12 nt, Human
ccucucacuguc

SEQ ID NO: 2613663 - RNA, 23 nt, Human
ccucucagagcuacuugggccau

SEQ ID NO: 2613664 - RNA, 22 nt, Human
ccucucagagcuacuugggcca

SEQ ID NO: 2613665 - RNA, 21 nt, Human
ccucucagagcuacuugggcc

SEQ ID NO: 2613666 - RNA, 15 nt, Human
ccucucagagcuacu

SEQ ID NO: 2613667 - RNA, 14 nt, Human
ccucucagagcuac

SEQ ID NO: 2613668 - RNA, 18 nt, Human
ccucucagcuccaggugg

SEQ ID NO: 2613669 - RNA, 16 nt, Human
ccucucagcuccaggu

SEQ ID NO: 2613670 - RNA, 13 nt, Human
ccucucagcucca

SEQ ID NO: 2613671 - RNA, 14 nt, Human
ccucucaggcaugc

SEQ ID NO: 2613672 - RNA, 20 nt, Human
ccucucaggcaugccugugu

SEQ ID NO: 2613673 - RNA, 21 nt, Human
ccucucaggcaugccugugug

SEQ ID NO: 2613674 - RNA, 23 nt, Human
ccuccuguugcacccagcccugg

SEQ ID NO: 2613675 - RNA, 12 nt, Human
ccuccuucagac

SEQ ID NO: 2613676 - RNA, 16 nt, Human
ccucucacuaaacuuu

SEQ ID NO: 2613677 - RNA, 18 nt, Human
ccuccuuaucaaaggaca

SEQ ID NO: 2613678 - RNA, 20 nt, Human
ccuccuuaucaaaggacacc

SEQ ID NO: 2613679 - RNA, 23 nt, Human
ccuccugugugugcgccuacagg

SEQ ID NO: 2613680 - RNA, 22 nt, Human
ccuccuguugcacccagcccug

SEQ ID NO: 2613681 - RNA, 21 nt, Human
ccuccuguugcacccagcccu

SEQ ID NO: 2613682 - RNA, 19 nt, Human
ccuccuguugcacccagcc

SEQ ID NO: 2613683 - RNA, 18 nt, Human
ccuccuguugcacccagc

SEQ ID NO: 2613684 - RNA, 17 nt, Human
ccuccuguugcacccag

SEQ ID NO: 2613685 - RNA, 16 nt, Human
ccuccuguugcaccca

SEQ ID NO: 2613686 - RNA, 15 nt, Human
ccuccuguugcaccc

SEQ ID NO: 2613687 - RNA, 17 nt, Human
ccuccuguguagcuggg

SEQ ID NO: 2613688 - RNA, 22 nt, Human
ccucucccaucccccugcccuc

SEQ ID NO: 2613689 - RNA, 21 nt, Human
ccucucccaucccccugcccu

SEQ ID NO: 2613690 - RNA, 20 nt, Human
ccucucccaucccccugccc

SEQ ID NO: 2613691 - RNA, 19 nt, Human
ccucucccaucccccugcc

SEQ ID NO: 2613692 - RNA, 18 nt, Human
ccucucccaucccccugc

SEQ ID NO: 2613693 - RNA, 17 nt, Human
ccucucccaucccccug

SEQ ID NO: 2613694 - RNA, 16 nt, Human
ccucucccaucccccu

SEQ ID NO: 2613695 - RNA, 15 nt, Human
ccucucccauccccc

SEQ ID NO: 2613696 - RNA, 18 nt, Human
ccucuccccagcccagag

SEQ ID NO: 2613697 - RNA, 19 nt, Human
ccucuccccagcccagaga

SEQ ID NO: 2613698 - RNA, 20 nt, Human
ccucuccccagcccagagac

SEQ ID NO: 2613699 - RNA, 21 nt, Human
ccucuccccagcccagagaca

SEQ ID NO: 2613700 - RNA, 12 nt, Human
ccucucccauca

SEQ ID NO: 2613701 - RNA, 14 nt, Human
ccucucccaucccc

SEQ ID NO: 2613702 - RNA, 13 nt, Human
ccucucccauccc

SEQ ID NO: 2613703 - RNA, 16 nt, Human
ccucuccacugccuuc

SEQ ID NO: 2613704 - RNA, 14 nt, Human
ccucuccacugccu

SEQ ID NO: 2613705 - RNA, 13 nt, Human
ccucuccacugcc

SEQ ID NO: 2613706 - RNA, 12 nt, Human
ccucuccacugc

SEQ ID NO: 2613707 - RNA, 18 nt, Human
ccucucaggugaccaaaa

SEQ ID NO: 2613708 - RNA, 19 nt, Human
ccucuccacugccuucgau

SEQ ID NO: 2613709 - RNA, 12 nt, Human
ccucucccaggg

SEQ ID NO: 2613710 - RNA, 21 nt, Human
ccuccccucucuugcacccgc

SEQ ID NO: 2613711 - RNA, 14 nt, Human
ccucagucucccuc

SEQ ID NO: 2613712 - RNA, 21 nt, Human
ccucaguccuccccucacagc

SEQ ID NO: 2613713 - RNA, 20 nt, Human
ccucaguccuccccucacag

SEQ ID NO: 2613714 - RNA, 19 nt, Human
ccucaguccuccccucaca

SEQ ID NO: 2613715 - RNA, 18 nt, Human
ccucaguccuccccucac

SEQ ID NO: 2613716 - RNA, 17 nt, Human
ccucaguccuccccuca

SEQ ID NO: 2613717 - RNA, 16 nt, Human
ccucaguccuccccuc

SEQ ID NO: 2613718 - RNA, 12 nt, Human
ccucaguccucc

SEQ ID NO: 2613719 - RNA, 11 nt, Human
ccucaguccuc

SEQ ID NO: 2613720 - RNA, 15 nt, Human
ccucagucuggcccu

SEQ ID NO: 2613721 - RNA, 21 nt, Human
ccucaguaaguaucuggagga

SEQ ID NO: 2613722 - RNA, 15 nt, Human
ccucaguaagacgac

SEQ ID NO: 2613723 - RNA, 18 nt, Human
ccucagguugcugguugc

SEQ ID NO: 2613724 - RNA, 17 nt, Human
ccucagguugcugguug

SEQ ID NO: 2613725 - RNA, 16 nt, Human
ccucagguugcugguu

SEQ ID NO: 2613726 - RNA, 23 nt, Human
ccucagguuccuauggcuggcca

SEQ ID NO: 2613727 - RNA, 22 nt, Human
ccucagguugcugguugcugug

SEQ ID NO: 2613728 - RNA, 21 nt, Human
ccucagguugcugguugcugu

SEQ ID NO: 2613729 - RNA, 23 nt, Human
ccucagguugcugguugcugugu

SEQ ID NO: 2613730 - RNA, 19 nt, Human
ccucagguuugccugaggg

SEQ ID NO: 2613731 - RNA, 21 nt, Human
ccucagguggccagccuggau

SEQ ID NO: 2613732 - RNA, 20 nt, Human
ccucaggucagggugaggau

SEQ ID NO: 2613733 - RNA, 12 nt, Human
ccucagguggcc

SEQ ID NO: 2613734 - RNA, 16 nt, Human
ccucagguggccaugc

SEQ ID NO: 2613735 - RNA, 15 nt, Human
ccucagguggccaug

SEQ ID NO: 2613736 - RNA, 15 nt, Human
ccucagguuccuaug

SEQ ID NO: 2613737 - RNA, 18 nt, Human
ccucaggugggccgcagg

SEQ ID NO: 2613738 - RNA, 15 nt, Human
ccucaggugggccgc

SEQ ID NO: 2613739 - RNA, 23 nt, Human
ccucagguggccagccuggaucu

SEQ ID NO: 2613740 - RNA, 21 nt, Human
ccucagguggccaugccucag

SEQ ID NO: 2613741 - RNA, 18 nt, Human
ccucagguggccaugccu

SEQ ID NO: 2613742 - RNA, 15 nt, Human
ccucagggucccugg

SEQ ID NO: 2613743 - RNA, 21 nt, Human
ccucagguaaucgaccugccu

SEQ ID NO: 2613744 - RNA, 22 nt, Human
ccucagguaaucgaccugccuc

SEQ ID NO: 2613745 - RNA, 23 nt, Human
ccucagguaaucgaccugccucg

SEQ ID NO: 2613746 - RNA, 16 nt, Human
ccucaggugagaagca

SEQ ID NO: 2613747 - RNA, 19 nt, Human
ccucaggugauccacccac

SEQ ID NO: 2613748 - RNA, 17 nt, Human
ccucaggugauccaccc

SEQ ID NO: 2613749 - RNA, 22 nt, Human
ccucaggugauccacccaccuc

SEQ ID NO: 2613750 - RNA, 19 nt, Human
ccucaggucagggugagga

SEQ ID NO: 2613751 - RNA, 11 nt, Human
ccucagguggc

SEQ ID NO: 2613752 - RNA, 21 nt, Human
ccucagaacaaagugagacag

SEQ ID NO: 2613753 - RNA, 21 nt, Human
ccucagaaacacuggggcugg

SEQ ID NO: 2613754 - RNA, 20 nt, Human
ccucagaaacacuggggcug

SEQ ID NO: 2613755 - RNA, 19 nt, Human
ccucagaaacacuggggcu

SEQ ID NO: 2613756 - RNA, 16 nt, Human
ccucagaacccuuggc

SEQ ID NO: 2613757 - RNA, 21 nt, Human
ccucagaacccuuggcuugcc

SEQ ID NO: 2613758 - RNA, 22 nt, Human
ccucacuaucccggcugcccuu

SEQ ID NO: 2613759 - RNA, 18 nt, Human
ccucagaaacacuggggc

SEQ ID NO: 2613760 - RNA, 20 nt, Human
ccucagaaaacaaggaugaa

SEQ ID NO: 2613761 - RNA, 21 nt, Human
ccucacuaggcuucugguuga

SEQ ID NO: 2613762 - RNA, 21 nt, Human
ccucacuaucccggcugcccu

SEQ ID NO: 2613763 - RNA, 14 nt, Human
ccucagcauccugg

SEQ ID NO: 2613764 - RNA, 23 nt, Human
ccucagaacaaagugagacaguc

SEQ ID NO: 2613765 - RNA, 22 nt, Human
ccucagaacccuuggcuugccc

SEQ ID NO: 2613766 - RNA, 17 nt, Human
ccucagcauccuggcac

SEQ ID NO: 2613767 - RNA, 16 nt, Human
ccucagcauccuggca

SEQ ID NO: 2613768 - RNA, 14 nt, Human
ccucagggucccug

SEQ ID NO: 2613769 - RNA, 23 nt, Human
ccucagggauggccguuggccac

SEQ ID NO: 2613770 - RNA, 21 nt, Human
ccucaggccugggggcugggc

SEQ ID NO: 2613771 - RNA, 14 nt, Human
ccucaggccugggg

SEQ ID NO: 2613772 - RNA, 11 nt, Human
ccucaggccug

SEQ ID NO: 2613773 - RNA, 11 nt, Human
ccucagccaga

SEQ ID NO: 2613774 - RNA, 15 nt, Human
ccucagccagagaag

SEQ ID NO: 2613775 - RNA, 16 nt, Human
ccucagccagagaagc

SEQ ID NO: 2613776 - RNA, 16 nt, Human
ccucccucccucuuuc

SEQ ID NO: 2613777 - RNA, 19 nt, Human
ccucccucccggcauggga

SEQ ID NO: 2613778 - RNA, 19 nt, Human
ccucccucacccugagccc

SEQ ID NO: 2613779 - RNA, 14 nt, Human
ccucccucccggca

SEQ ID NO: 2613780 - RNA, 16 nt, Human
ccucccuccucugucc

SEQ ID NO: 2613781 - RNA, 19 nt, Human
ccucccugaagccuuugca

SEQ ID NO: 2613782 - RNA, 20 nt, Human
ccucccugaaccaucccuga

SEQ ID NO: 2613783 - RNA, 20 nt, Human
ccucccugaaaauguuuuuc

SEQ ID NO: 2613784 - RNA, 13 nt, Human
ccucccuccucug

SEQ ID NO: 2613785 - RNA, 13 nt, Human
ccucccugaacca

SEQ ID NO: 2613786 - RNA, 18 nt, Human
ccuccucccuccugccga

SEQ ID NO: 2613787 - RNA, 13 nt, Human
ccuccucccugca

SEQ ID NO: 2613788 - RNA, 14 nt, Human
ccuccucccugcau

SEQ ID NO: 2613789 - RNA, 17 nt, Human
ccuccucccugcaucug

SEQ ID NO: 2613790 - RNA, 12 nt, Human
ccuccucccuua

SEQ ID NO: 2613791 - RNA, 16 nt, Human
ccuccucccugcaucu

SEQ ID NO: 2613792 - RNA, 13 nt, Human
ccuccuccccacu

SEQ ID NO: 2613793 - RNA, 14 nt, Human
ccuccuccccacuu

SEQ ID NO: 2613794 - RNA, 21 nt, Human
ccucccugcaucugaccagca

SEQ ID NO: 2613795 - RNA, 22 nt, Human
ccucccugcaucugaccagcag

SEQ ID NO: 2613796 - RNA, 14 nt, Human
ccucccugcaucug

SEQ ID NO: 2613797 - RNA, 20 nt, Human
ccucccugcaucugaccagc

SEQ ID NO: 2613798 - RNA, 23 nt, Human
ccuccucccacccggcugcagag

SEQ ID NO: 2613799 - RNA, 18 nt, Human
ccucccuagugacccgga

SEQ ID NO: 2613800 - RNA, 21 nt, Human
ccucccuagccagcacuugua

SEQ ID NO: 2613801 - RNA, 20 nt, Human
ccucccgucuacucauuccc

SEQ ID NO: 2613802 - RNA, 21 nt, Human
ccucccgggcccucccuugga

SEQ ID NO: 2613803 - RNA, 14 nt, Human
ccucccucacccug

SEQ ID NO: 2613804 - RNA, 16 nt, Human
ccucccggugcccaag

SEQ ID NO: 2613805 - RNA, 15 nt, Human
ccucccuagccagca

SEQ ID NO: 2613806 - RNA, 13 nt, Human
ccucccucccucu

SEQ ID NO: 2613807 - RNA, 15 nt, Human
ccucccucccucuuu

SEQ ID NO: 2613808 - RNA, 17 nt, Human
ccuccccucuccuuccu

SEQ ID NO: 2613809 - RNA, 23 nt, Human
ccucaguccuccccucacagccu

SEQ ID NO: 2613810 - RNA, 22 nt, Human
ccucaguccuccccucacagcc

SEQ ID NO: 2613811 - RNA, 24 nt, Human
ccucaguccuccccucacagccuc

SEQ ID NO: 2613812 - RNA, 20 nt, Human
ccuccccuccuugccuccug

SEQ ID NO: 2613813 - RNA, 19 nt, Human
ccucccgggcccucccuug

SEQ ID NO: 2613814 - RNA, 17 nt, Human
ccucccgggcccucccu

SEQ ID NO: 2613815 - RNA, 16 nt, Human
ccucccgggcccuccc

SEQ ID NO: 2613816 - RNA, 14 nt, Human
ccucccgggcccuc

SEQ ID NO: 2613817 - RNA, 13 nt, Human
ccucccggugccc

SEQ ID NO: 2613818 - RNA, 17 nt, Human
ccuccccucucuugcac

SEQ ID NO: 2613819 - RNA, 16 nt, Human
ccuccccucucuugca

SEQ ID NO: 2613820 - RNA, 16 nt, Human
ccuccccucucugcac

SEQ ID NO: 2613821 - RNA, 12 nt, Human
ccuccuccugac

SEQ ID NO: 2613822 - RNA, 22 nt, Human
ccuccucccuuuuuccuugucc

SEQ ID NO: 2613823 - RNA, 17 nt, Human
ccuccucccuuuuuccu

SEQ ID NO: 2613824 - RNA, 15 nt, Human
ccuccucccuuuuuc

SEQ ID NO: 2613825 - RNA, 14 nt, Human
ccuccucccuuuuu

SEQ ID NO: 2613826 - RNA, 16 nt, Human
ccuccucccuuagcuc

SEQ ID NO: 2613827 - RNA, 15 nt, Human
ccuccucccuuagcu

SEQ ID NO: 2613828 - RNA, 14 nt, Human
ccuccucccuuagc

SEQ ID NO: 2613829 - RNA, 14 nt, Human
ccuccuccuggacu

SEQ ID NO: 2613830 - RNA, 12 nt, Human
ccuccucugcca

SEQ ID NO: 2613831 - RNA, 13 nt, Human
ccuccucugccac

SEQ ID NO: 2613832 - RNA, 14 nt, Human
ccuccucugccacc

SEQ ID NO: 2613833 - RNA, 15 nt, Human
ccuccucugccaccu

SEQ ID NO: 2613834 - RNA, 18 nt, Human
ccuccucugccaccuccc

SEQ ID NO: 2613835 - RNA, 20 nt, Human
ccuccucugccaccuccccu

SEQ ID NO: 2613836 - RNA, 19 nt, Human
ccuccugcagaccacgccc

SEQ ID NO: 2613837 - RNA, 12 nt, Human
ccuccugcccac

SEQ ID NO: 2613838 - RNA, 14 nt, Human
ccuccugcccaccu

SEQ ID NO: 2613839 - RNA, 17 nt, Human
ccuccugcccaccuguc

SEQ ID NO: 2613840 - RNA, 12 nt, Human
ccuccugcccag

SEQ ID NO: 2613841 - RNA, 13 nt, Human
ccuccugcccagg

SEQ ID NO: 2613842 - RNA, 18 nt, Human
ccuccugaguagcuggga

SEQ ID NO: 2613843 - RNA, 21 nt, Human
ccuccucugccaccuccccua

SEQ ID NO: 2613844 - RNA, 13 nt, Human
ccuccugccucga

SEQ ID NO: 2613845 - RNA, 14 nt, Human
ccuccugcccagga

SEQ ID NO: 2613846 - RNA, 15 nt, Human
ccuccugcccaggag

SEQ ID NO: 2613847 - RNA, 16 nt, Human
ccuccugcccaggaga

SEQ ID NO: 2613848 - RNA, 19 nt, Human
ccuccugcccaggagagcc

SEQ ID NO: 2613849 - RNA, 17 nt, Human
ccuccugcccagucccc

SEQ ID NO: 2613850 - RNA, 15 nt, Human
ccuccugcccagucc

SEQ ID NO: 2613851 - RNA, 21 nt, Human
ccuccugcccaggagagccag

SEQ ID NO: 2613852 - RNA, 23 nt, Human
ccuccugcccaggagagccagcc

SEQ ID NO: 2613853 - RNA, 22 nt, Human
ccuccugugugugcgccuacag

SEQ ID NO: 2613854 - RNA, 15 nt, Human
ccuccugugugugcg

SEQ ID NO: 2613855 - RNA, 18 nt, Human
ccuccugggaucugcucg

SEQ ID NO: 2613856 - RNA, 21 nt, Human
ccuccugggcccucucugcuc

SEQ ID NO: 2613857 - RNA, 14 nt, Human
ccuccugggccccu

SEQ ID NO: 2613858 - RNA, 13 nt, Human
ccuccugugugug

SEQ ID NO: 2613859 - RNA, 17 nt, Human
ccuccugggaaugaagc

SEQ ID NO: 2613860 - RNA, 18 nt, Human
ccuccugccgacuccugg

SEQ ID NO: 2613861 - RNA, 19 nt, Human
ccuccugcccaguccccca

SEQ ID NO: 2613862 - RNA, 12 nt, Human
ccuccugccucc

SEQ ID NO: 2613863 - RNA, 13 nt, Human
ccuccuggacucc

SEQ ID NO: 2613864 - RNA, 13 nt, Human
ccuccugggcuaa

SEQ ID NO: 2613865 - RNA, 17 nt, Human
ccuccugggaucugcuc

SEQ ID NO: 2613866 - RNA, 21 nt, Human
ccuccuggacauuuuuucagu

SEQ ID NO: 2613867 - RNA, 19 nt, Human
ccuccugccgacuccuggg

SEQ ID NO: 2613868 - RNA, 21 nt, Human
cugguccugaggguccccacc

SEQ ID NO: 2613869 - RNA, 14 nt, Human
cugguccugugugc

SEQ ID NO: 2613870 - RNA, 14 nt, Human
cugguccagggcua

SEQ ID NO: 2613871 - RNA, 13 nt, Human
cugguccagggcu

SEQ ID NO: 2613872 - RNA, 15 nt, Human
cuggucgcuccugcc

SEQ ID NO: 2613873 - RNA, 14 nt, Human
cuggucgcuccugc

SEQ ID NO: 2613874 - RNA, 13 nt, Human
cuggucgcuccug

SEQ ID NO: 2613875 - RNA, 19 nt, Human
cugguccuuccaggccccc

SEQ ID NO: 2613876 - RNA, 16 nt, Human
cugguccuuccaggcc

SEQ ID NO: 2613877 - RNA, 17 nt, Human
cugguccuuccaggccc

SEQ ID NO: 2613878 - RNA, 18 nt, Human
cugguccauagagagcaa

SEQ ID NO: 2613879 - RNA, 18 nt, Human
cuggucccacucagucca

SEQ ID NO: 2613880 - RNA, 15 nt, Human
cuggucccacucagu

SEQ ID NO: 2613881 - RNA, 17 nt, Human
cugggucagucuggugg

SEQ ID NO: 2613882 - RNA, 13 nt, Human
cugggucagucug

SEQ ID NO: 2613883 - RNA, 16 nt, Human
cuggguccaaauaaaa

SEQ ID NO: 2613884 - RNA, 15 nt, Human
cuggguccaaauaaa

SEQ ID NO: 2613885 - RNA, 14 nt, Human
cuggguccaaauaa

SEQ ID NO: 2613886 - RNA, 13 nt, Human
cuggguccaaaua

SEQ ID NO: 2613887 - RNA, 21 nt, Human
cugggucagucuggugggagg

SEQ ID NO: 2613888 - RNA, 18 nt, Human
cugggucagucugguggg

SEQ ID NO: 2613889 - RNA, 12 nt, Human
cugggucagugg

SEQ ID NO: 2613890 - RNA, 19 nt, Human
cuggguucuacccaggugc

SEQ ID NO: 2613891 - RNA, 23 nt, Human
cuggguccaaauaaaaacuaaau

SEQ ID NO: 2613892 - RNA, 21 nt, Human
cuggguccaaauaaaaacuaa

SEQ ID NO: 2613893 - RNA, 20 nt, Human
cuggguccaaauaaaaacua

SEQ ID NO: 2613894 - RNA, 19 nt, Human
cuggguccaaauaaaaacu

SEQ ID NO: 2613895 - RNA, 17 nt, Human
cugguccauagagagca

SEQ ID NO: 2613896 - RNA, 15 nt, Human
cugguccauagagag

SEQ ID NO: 2613897 - RNA, 18 nt, Human
cuggguuggaaaacagua

SEQ ID NO: 2613898 - RNA, 13 nt, Human
cuggguuggaaaa

SEQ ID NO: 2613899 - RNA, 13 nt, Human
cuggguuggaggg

SEQ ID NO: 2613900 - RNA, 20 nt, Human
cugguucucaucuuucuuga

SEQ ID NO: 2613901 - RNA, 16 nt, Human
cugguucucaucuuuc

SEQ ID NO: 2613902 - RNA, 15 nt, Human
cugguucucaucuuu

SEQ ID NO: 2613903 - RNA, 14 nt, Human
cugguucucaucuu

SEQ ID NO: 2613904 - RNA, 12 nt, Human
cugguucucauc

SEQ ID NO: 2613905 - RNA, 23 nt, Human
cugguggucuguuggcaggcugg

SEQ ID NO: 2613906 - RNA, 22 nt, Human
cugguggucuguuggcaggcug

SEQ ID NO: 2613907 - RNA, 20 nt, Human
cugguggucuguuggcaggc

SEQ ID NO: 2613908 - RNA, 18 nt, Human
cugguggucuguuggcag

SEQ ID NO: 2613909 - RNA, 22 nt, Human
cugguggguccaggggccccuc

SEQ ID NO: 2613910 - RNA, 17 nt, Human
cugguggguccaggggc

SEQ ID NO: 2613911 - RNA, 16 nt, Human
cugguggguccagggg

SEQ ID NO: 2613912 - RNA, 22 nt, Human
cuggugggguguguuccaacug

SEQ ID NO: 2613913 - RNA, 13 nt, Human
cuggugggccaac

SEQ ID NO: 2613914 - RNA, 12 nt, Human
cuggugggccuc

SEQ ID NO: 2613915 - RNA, 17 nt, Human
cuggugggccuccucug

SEQ ID NO: 2613916 - RNA, 20 nt, Human
cugguggccccguuucuggu

SEQ ID NO: 2613917 - RNA, 13 nt, Human
cugguggcccagg

SEQ ID NO: 2613918 - RNA, 14 nt, Human
cugguggcccagga

SEQ ID NO: 2613919 - RNA, 23 nt, Human
cugguggagaaagcacugaccug

SEQ ID NO: 2613920 - RNA, 22 nt, Human
cugguggagaaagcacugaccu

SEQ ID NO: 2613921 - RNA, 11 nt, Human
cugguggccca

SEQ ID NO: 2613922 - RNA, 12 nt, Human
cugguggcccag

SEQ ID NO: 2613923 - RNA, 22 nt, Human
cugguggccccguuucuggugg

SEQ ID NO: 2613924 - RNA, 21 nt, Human
cugguggccccguuucuggug

SEQ ID NO: 2613925 - RNA, 24 nt, Human
cuggugggaucugugcccagagau

SEQ ID NO: 2613926 - RNA, 23 nt, Human
cuggugggaucugugcccagaga

SEQ ID NO: 2613927 - RNA, 23 nt, Human
cugguggcagugggagcugccug

SEQ ID NO: 2613928 - RNA, 19 nt, Human
cugguggcagugggagcug

SEQ ID NO: 2613929 - RNA, 21 nt, Human
cugguggagaaagcacugacc

SEQ ID NO: 2613930 - RNA, 18 nt, Human
cugguggagaaagcacug

SEQ ID NO: 2613931 - RNA, 15 nt, Human
cugguggagaaagca

SEQ ID NO: 2613932 - RNA, 19 nt, Human
cugguggacaguccuggga

SEQ ID NO: 2613933 - RNA, 21 nt, Human
cugguggacaguccugggaga

SEQ ID NO: 2613934 - RNA, 15 nt, Human
cugguggacaguccu

SEQ ID NO: 2613935 - RNA, 16 nt, Human
cugguggacaguccug

SEQ ID NO: 2613936 - RNA, 17 nt, Human
cugguggacaguccugg

SEQ ID NO: 2613937 - RNA, 18 nt, Human
cugguggacaguccuggg

SEQ ID NO: 2613938 - RNA, 18 nt, Human
cuggugcuguggccaggg

SEQ ID NO: 2613939 - RNA, 17 nt, Human
cuggugcuguggccagg

SEQ ID NO: 2613940 - RNA, 16 nt, Human
cuggugcuguggccag

SEQ ID NO: 2613941 - RNA, 12 nt, Human
cuggugcugugg

SEQ ID NO: 2613942 - RNA, 14 nt, Human
cuggugcugcugcu

SEQ ID NO: 2613943 - RNA, 20 nt, Human
cuggugcuggauauuuucaa

SEQ ID NO: 2613944 - RNA, 20 nt, Human
cuggugcuguggccagggug

SEQ ID NO: 2613945 - RNA, 19 nt, Human
cuggugcuguggccagggu

SEQ ID NO: 2613946 - RNA, 23 nt, Human
cuggugcuguggccagggugaga

SEQ ID NO: 2613947 - RNA, 12 nt, Human
cugguggacagu

SEQ ID NO: 2613948 - RNA, 18 nt, Human
cuggucgcuccugcccac

SEQ ID NO: 2613949 - RNA, 16 nt, Human
cuggucgcuccugccc

SEQ ID NO: 2613950 - RNA, 23 nt, Human
cuggucgcuccugcccacggagu

SEQ ID NO: 2613951 - RNA, 18 nt, Human
cuggucucaaacuccuga

SEQ ID NO: 2613952 - RNA, 19 nt, Human
cugggguggggaccucagg

SEQ ID NO: 2613953 - RNA, 18 nt, Human
cugggguggggaccucag

SEQ ID NO: 2613954 - RNA, 17 nt, Human
cugggguggggaccuca

SEQ ID NO: 2613955 - RNA, 18 nt, Human
cugggggccucagugcca

SEQ ID NO: 2613956 - RNA, 19 nt, Human
cuggggugccgccugcccg

SEQ ID NO: 2613957 - RNA, 18 nt, Human
cuggggugccgccugccc

SEQ ID NO: 2613958 - RNA, 17 nt, Human
cuggggugccgccugcc

SEQ ID NO: 2613959 - RNA, 16 nt, Human
cuggggugccgccugc

SEQ ID NO: 2613960 - RNA, 22 nt, Human
cugggggccaugagcuccagac

SEQ ID NO: 2613961 - RNA, 23 nt, Human
cugggggccaugagcuccagacc

SEQ ID NO: 2613962 - RNA, 17 nt, Human
cugggggccucagugcc

SEQ ID NO: 2613963 - RNA, 13 nt, Human
cugggggccucag

SEQ ID NO: 2613964 - RNA, 22 nt, Human
cugggguggggaccucaggccu

SEQ ID NO: 2613965 - RNA, 21 nt, Human
cugggguggggaccucaggcc

SEQ ID NO: 2613966 - RNA, 23 nt, Human
cugggguggggaccucaggccug

SEQ ID NO: 2613967 - RNA, 20 nt, Human
cuggguacuuguggacacag

SEQ ID NO: 2613968 - RNA, 13 nt, Human
cuggguagcugua

SEQ ID NO: 2613969 - RNA, 14 nt, Human
cuggguagcuguaa

SEQ ID NO: 2613970 - RNA, 15 nt, Human
cuggguagcuguaag

SEQ ID NO: 2613971 - RNA, 23 nt, Human
cuggguacuuguggacacagcuc

SEQ ID NO: 2613972 - RNA, 21 nt, Human
cuggguacuuguggacacagc

SEQ ID NO: 2613973 - RNA, 20 nt, Human
cugggcuuggggaccagagc

SEQ ID NO: 2613974 - RNA, 17 nt, Human
cugggcuuggggaccag

SEQ ID NO: 2613975 - RNA, 21 nt, Human
cugggcuuggggaccagagcu

SEQ ID NO: 2613976 - RNA, 20 nt, Human
cugggggccaugagcuccag

SEQ ID NO: 2613977 - RNA, 13 nt, Human
cugggcucaagca

SEQ ID NO: 2613978 - RNA, 13 nt, Human
cugggcuugggga

SEQ ID NO: 2613979 - RNA, 23 nt, Human
cugggcuucaguggcagcugcuu

SEQ ID NO: 2613980 - RNA, 22 nt, Human
cugggcuucaguggcagcugcu

SEQ ID NO: 2613981 - RNA, 21 nt, Human
cugggcuucaguggcagcugc

SEQ ID NO: 2613982 - RNA, 20 nt, Human
cugggcuucaguggcagcug

SEQ ID NO: 2613983 - RNA, 19 nt, Human
cugggcuucaguggcagcu

SEQ ID NO: 2613984 - RNA, 17 nt, Human
cugggcuucaguggcag

SEQ ID NO: 2613985 - RNA, 18 nt, Human
cugggcuucaguggcagc

SEQ ID NO: 2613986 - RNA, 15 nt, Human
cugggcgcccuggaa

SEQ ID NO: 2613987 - RNA, 14 nt, Human
cugggcgcccugga

SEQ ID NO: 2613988 - RNA, 13 nt, Human
cugggcgacagag

SEQ ID NO: 2613989 - RNA, 18 nt, Human
cugggcgcccuggaagcc

SEQ ID NO: 2613990 - RNA, 16 nt, Human
cugggcgcccuggaag

SEQ ID NO: 2613991 - RNA, 17 nt, Human
cugggcucaagcagucu

SEQ ID NO: 2613992 - RNA, 23 nt, Human
cugggcguaguggcucacaccug

SEQ ID NO: 2613993 - RNA, 19 nt, Human
cuggcucuuccaggcuggg

SEQ ID NO: 2613994 - RNA, 18 nt, Human
cuggcucuuccaggcugg

SEQ ID NO: 2613995 - RNA, 23 nt, Human
cuggcucuugauaccccccucug

SEQ ID NO: 2613996 - RNA, 22 nt, Human
cuggcucuugauaccccccucu

SEQ ID NO: 2613997 - RNA, 21 nt, Human
cuggcucuugauaccccccuc

SEQ ID NO: 2613998 - RNA, 20 nt, Human
cuggcucuugauaccccccu

SEQ ID NO: 2613999 - RNA, 20 nt, Human
cuggcucuuccaggcuggga

SEQ ID NO: 2614000 - RNA, 14 nt, Human
cuggccucugugcc

SEQ ID NO: 2614001 - RNA, 15 nt, Human
cuggccucugugccu

SEQ ID NO: 2614002 - RNA, 16 nt, Human
cuggccucugugccuu

SEQ ID NO: 2614003 - RNA, 20 nt, Human
cuggccucugugccuucuuu

SEQ ID NO: 2614004 - RNA, 13 nt, Human
cuggccugagcug

SEQ ID NO: 2614005 - RNA, 17 nt, Human
cuggcucuuccaggcug

SEQ ID NO: 2614006 - RNA, 19 nt, Human
cuggcugcccuggcccuga

SEQ ID NO: 2614007 - RNA, 18 nt, Human
cuggcugcccuggcccug

SEQ ID NO: 2614008 - RNA, 17 nt, Human
cuggcugcccuggcccu

SEQ ID NO: 2614009 - RNA, 16 nt, Human
cuggcugcccuggccc

SEQ ID NO: 2614010 - RNA, 15 nt, Human
cuggcugcccuggcc

SEQ ID NO: 2614011 - RNA, 14 nt, Human
cuggcugcccuggc

SEQ ID NO: 2614012 - RNA, 13 nt, Human
cuggcugcccugg

SEQ ID NO: 2614013 - RNA, 16 nt, Human
cuggcugagccuggcu

SEQ ID NO: 2614014 - RNA, 14 nt, Human
cuggcugagcccug

SEQ ID NO: 2614015 - RNA, 12 nt, Human
cuggcugagccc

SEQ ID NO: 2614016 - RNA, 23 nt, Human
cuggcugaccccaaagagccugg

SEQ ID NO: 2614017 - RNA, 22 nt, Human
cuggcugaccccaaagagccug

SEQ ID NO: 2614018 - RNA, 19 nt, Human
cuggcugaccccaaagagc

SEQ ID NO: 2614019 - RNA, 17 nt, Human
cuggcugaaggacugug

SEQ ID NO: 2614020 - RNA, 16 nt, Human
cuggcugaaggacugu

SEQ ID NO: 2614021 - RNA, 15 nt, Human
cuggcugaaggacug

SEQ ID NO: 2614022 - RNA, 14 nt, Human
cuggcugaaggacu

SEQ ID NO: 2614023 - RNA, 13 nt, Human
cuggcugaaggac

SEQ ID NO: 2614024 - RNA, 12 nt, Human
cuggcugaagga

SEQ ID NO: 2614025 - RNA, 23 nt, Human
cuggcugaacccugugcuggugu

SEQ ID NO: 2614026 - RNA, 21 nt, Human
cuggcugaacccugugcuggu

SEQ ID NO: 2614027 - RNA, 20 nt, Human
cuggcugaacccugugcugg

SEQ ID NO: 2614028 - RNA, 19 nt, Human
cuggcugaacccugugcug

SEQ ID NO: 2614029 - RNA, 18 nt, Human
cuggcugaacccugugcu

SEQ ID NO: 2614030 - RNA, 17 nt, Human
cuggcugaacccugugc

SEQ ID NO: 2614031 - RNA, 16 nt, Human
cuggcugaacccugug

SEQ ID NO: 2614032 - RNA, 13 nt, Human
cuggcugaacccu

SEQ ID NO: 2614033 - RNA, 22 nt, Human
cuggcucuuuggagaucaagga

SEQ ID NO: 2614034 - RNA, 17 nt, Human
cuggcucuugugcugga

SEQ ID NO: 2614035 - RNA, 20 nt, Human
cuggcucuugugcuggaugg

SEQ ID NO: 2614036 - RNA, 23 nt, Human
cuggcugggacguggcucagcca

SEQ ID NO: 2614037 - RNA, 14 nt, Human
cuggcugcugcccc

SEQ ID NO: 2614038 - RNA, 13 nt, Human
cuggcugcugccc

SEQ ID NO: 2614039 - RNA, 12 nt, Human
cuggcugcugcc

SEQ ID NO: 2614040 - RNA, 14 nt, Human
cuggcugggcaugg

SEQ ID NO: 2614041 - RNA, 15 nt, Human
cuggcugggcaugga

SEQ ID NO: 2614042 - RNA, 17 nt, Human
cuggcugggcauggacg

SEQ ID NO: 2614043 - RNA, 22 nt, Human
cuggcugccuccacucccacuu

SEQ ID NO: 2614044 - RNA, 21 nt, Human
cuggcugccuccacucccacu

SEQ ID NO: 2614045 - RNA, 20 nt, Human
cuggcugccuccacucccac

SEQ ID NO: 2614046 - RNA, 18 nt, Human
cuggcugccuccacuccc

SEQ ID NO: 2614047 - RNA, 16 nt, Human
cuggcugccuccacuc

SEQ ID NO: 2614048 - RNA, 15 nt, Human
cuggcugccuccacu

SEQ ID NO: 2614049 - RNA, 23 nt, Human
cuggcugcccuggcccugaggug

SEQ ID NO: 2614050 - RNA, 20 nt, Human
cuggcugcccuggcccugag

SEQ ID NO: 2614051 - RNA, 19 nt, Human
cuggcugccuuagaaccuu

SEQ ID NO: 2614052 - RNA, 14 nt, Human
cuggcugccuuaga

SEQ ID NO: 2614053 - RNA, 19 nt, Human
cuggcuguuggcugggggc

SEQ ID NO: 2614054 - RNA, 22 nt, Human
cuggcuggguggcaccagcagc

SEQ ID NO: 2614055 - RNA, 21 nt, Human
cuggcuggguggcaccagcag

SEQ ID NO: 2614056 - RNA, 22 nt, Human
cuggcuggggccuaucagugug

SEQ ID NO: 2614057 - RNA, 21 nt, Human
cuggcuggggccuaucagugu

SEQ ID NO: 2614058 - RNA, 18 nt, Human
cuggcuggggccuaucag

SEQ ID NO: 2614059 - RNA, 13 nt, Human
cuggcuggggccu

SEQ ID NO: 2614060 - RNA, 24 nt, Human
cuggcuggggccuaucagugugcc

SEQ ID NO: 2614061 - RNA, 23 nt, Human
cuggcuggggccuaucagugugc

SEQ ID NO: 2614062 - RNA, 22 nt, Human
cuggcuuccagguaucuccagg

SEQ ID NO: 2614063 - RNA, 16 nt, Human
cuggcuuccagguauc

SEQ ID NO: 2614064 - RNA, 23 nt, Human
cuggcuuccagguaucuccagga

SEQ ID NO: 2614065 - RNA, 15 nt, Human
cuggcuuccagguau

SEQ ID NO: 2614066 - RNA, 14 nt, Human
cuggcuuccaggua

SEQ ID NO: 2614067 - RNA, 12 nt, Human
cuggcuuccagg

SEQ ID NO: 2614068 - RNA, 13 nt, Human
cuggcuucaggag

SEQ ID NO: 2614069 - RNA, 14 nt, Human
cuggcuucacagau

SEQ ID NO: 2614070 - RNA, 20 nt, Human
cuggcuguuggcugggggcc

SEQ ID NO: 2614071 - RNA, 22 nt, Human
cuggcuuuucacugcuggcugc

SEQ ID NO: 2614072 - RNA, 20 nt, Human
cuggcuuuucacugcuggcu

SEQ ID NO: 2614073 - RNA, 19 nt, Human
cuggcuuuucacugcuggc

SEQ ID NO: 2614074 - RNA, 17 nt, Human
cuggcuuuucacugcug

SEQ ID NO: 2614075 - RNA, 22 nt, Human
cugggaaaugagaaggcagcca

SEQ ID NO: 2614076 - RNA, 21 nt, Human
cugggaaaugagaaggcagcc

SEQ ID NO: 2614077 - RNA, 23 nt, Human
cugggaaaugagaaggcagccac

SEQ ID NO: 2614078 - RNA, 19 nt, Human
cugggaacaccauagguca

SEQ ID NO: 2614079 - RNA, 20 nt, Human
cugggaaaugagaaggcagc

SEQ ID NO: 2614080 - RNA, 19 nt, Human
cugggaaaugagaaggcag

SEQ ID NO: 2614081 - RNA, 18 nt, Human
cugggaaauauucccuag

SEQ ID NO: 2614082 - RNA, 16 nt, Human
cugggaaauauucccu

SEQ ID NO: 2614083 - RNA, 16 nt, Human
cugggaaauaagagag

SEQ ID NO: 2614084 - RNA, 17 nt, Human
cugggaaauaagagaga

SEQ ID NO: 2614085 - RNA, 16 nt, Human
cuggcuucuccuuugg

SEQ ID NO: 2614086 - RNA, 12 nt, Human
cuggcuucuccu

SEQ ID NO: 2614087 - RNA, 16 nt, Human
cuggcuucgcaaaaug

SEQ ID NO: 2614088 - RNA, 18 nt, Human
cuggcuuccuucucucaa

SEQ ID NO: 2614089 - RNA, 14 nt, Human
cuggcuucuggagc

SEQ ID NO: 2614090 - RNA, 15 nt, Human
cuggcuucuggagcc

SEQ ID NO: 2614091 - RNA, 16 nt, Human
cuggcuucuggagccc

SEQ ID NO: 2614092 - RNA, 20 nt, Human
cuggcuucuggagcccuugg

SEQ ID NO: 2614093 - RNA, 16 nt, Human
cuggcuuuucacugcu

SEQ ID NO: 2614094 - RNA, 15 nt, Human
cuggcuuuucacugc

SEQ ID NO: 2614095 - RNA, 22 nt, Human
cugggaacccaaguccaagcau

SEQ ID NO: 2614096 - RNA, 23 nt, Human
cugggaaauggcuugaagccaag

SEQ ID NO: 2614097 - RNA, 17 nt, Human
cugggaacucaccuggg

SEQ ID NO: 2614098 - RNA, 15 nt, Human
cugggaacugcagac

SEQ ID NO: 2614099 - RNA, 20 nt, Human
cugggaacugcagaccuguc

SEQ ID NO: 2614100 - RNA, 19 nt, Human
cugggaacugcagaccugu

SEQ ID NO: 2614101 - RNA, 18 nt, Human
cugggaacugcagaccug

SEQ ID NO: 2614102 - RNA, 20 nt, Human
cugggaacucaccuggggcu

SEQ ID NO: 2614103 - RNA, 23 nt, Human
cugggaacugcagaccuguccuc

SEQ ID NO: 2614104 - RNA, 21 nt, Human
cugggaacugcagaccugucc

SEQ ID NO: 2614105 - RNA, 19 nt, Human
cugggaagacgccugagcu

SEQ ID NO: 2614106 - RNA, 17 nt, Human
cugggaagauaggcucu

SEQ ID NO: 2614107 - RNA, 23 nt, Human
cugggagcuccacucugcuucuc

SEQ ID NO: 2614108 - RNA, 13 nt, Human
cugggaagggaag

SEQ ID NO: 2614109 - RNA, 13 nt, Human
cugggagcucugc

SEQ ID NO: 2614110 - RNA, 24 nt, Human
cugggaagauaggcucugcacaga

SEQ ID NO: 2614111 - RNA, 18 nt, Human
cugggaagauaggcucug

SEQ ID NO: 2614112 - RNA, 20 nt, Human
cugggaagauaggcucugca

SEQ ID NO: 2614113 - RNA, 21 nt, Human
cugggaagauaggcucugcac

SEQ ID NO: 2614114 - RNA, 22 nt, Human
cugggaagauaggcucugcaca

SEQ ID NO: 2614115 - RNA, 15 nt, Human
cugggagcucugcag

SEQ ID NO: 2614116 - RNA, 14 nt, Human
cugggagcucugca

SEQ ID NO: 2614117 - RNA, 13 nt, Human
cugggaggaaaag

SEQ ID NO: 2614118 - RNA, 22 nt, Human
cugggaggaaaagaaaagaggg

SEQ ID NO: 2614119 - RNA, 16 nt, Human
cugggaggcucuggag

SEQ ID NO: 2614120 - RNA, 15 nt, Human
cugggaggcucugga

SEQ ID NO: 2614121 - RNA, 16 nt, Human
cugggaggcagugaug

SEQ ID NO: 2614122 - RNA, 19 nt, Human
cugggaggcauggcccugg

SEQ ID NO: 2614123 - RNA, 13 nt, Human
cugggaggcaugg

SEQ ID NO: 2614124 - RNA, 14 nt, Human
cugggaggcaguga

SEQ ID NO: 2614125 - RNA, 13 nt, Human
cugggaggaagca

SEQ ID NO: 2614126 - RNA, 14 nt, Human
cugggaggaagcag

SEQ ID NO: 2614127 - RNA, 15 nt, Human
cugggagggcagcag

SEQ ID NO: 2614128 - RNA, 17 nt, Human
cugggagggcagcaggg

SEQ ID NO: 2614129 - RNA, 19 nt, Human
cugggagggcagcagggcu

SEQ ID NO: 2614130 - RNA, 20 nt, Human
cugggagggcagcagggcua

SEQ ID NO: 2614131 - RNA, 18 nt, Human
cugggaggucaaggcugc

SEQ ID NO: 2614132 - RNA, 11 nt, Human
cugggagggca

SEQ ID NO: 2614133 - RNA, 13 nt, Human
cugggagggcagc

SEQ ID NO: 2614134 - RNA, 23 nt, Human
cugggagggauagaggggggcug

SEQ ID NO: 2614135 - RNA, 22 nt, Human
cugggaggcucuggagcccacu

SEQ ID NO: 2614136 - RNA, 22 nt, Human
cugggaggcggagaguacagug

SEQ ID NO: 2614137 - RNA, 22 nt, Human
cugggaggcauggcccuggggu

SEQ ID NO: 2614138 - RNA, 21 nt, Human
cugggauuacaggcuccugcc

SEQ ID NO: 2614139 - RNA, 22 nt, Human
cugggauuacaggcuccugcca

SEQ ID NO: 2614140 - RNA, 19 nt, Human
cugggcaaugauggcaauu

SEQ ID NO: 2614141 - RNA, 23 nt, Human
cugggauuacaggcuccugccac

SEQ ID NO: 2614142 - RNA, 19 nt, Human
cugggauuacaggcuccug

SEQ ID NO: 2614143 - RNA, 20 nt, Human
cugggauuacaggcuccugc

SEQ ID NO: 2614144 - RNA, 21 nt, Human
cugggauuacaggcgugagcc

SEQ ID NO: 2614145 - RNA, 12 nt, Human
cugggagugagc

SEQ ID NO: 2614146 - RNA, 13 nt, Human
cugggagugagcu

SEQ ID NO: 2614147 - RNA, 16 nt, Human
cugggagugagcuggu

SEQ ID NO: 2614148 - RNA, 23 nt, Human
cugggaguugaucgccuuuccca

SEQ ID NO: 2614149 - RNA, 20 nt, Human
cugggagggcccacuucagg

SEQ ID NO: 2614150 - RNA, 22 nt, Human
cugggagggguuuucgaagcuc

SEQ ID NO: 2614151 - RNA, 22 nt, Human
cugggagggcagcagggcuacc

SEQ ID NO: 2614152 - RNA, 13 nt, Human
cugggagggccca

SEQ ID NO: 2614153 - RNA, 17 nt, Human
cugggccccugccucuc

SEQ ID NO: 2614154 - RNA, 16 nt, Human
cugggccccugccucu

SEQ ID NO: 2614155 - RNA, 12 nt, Human
cugggccccugc

SEQ ID NO: 2614156 - RNA, 21 nt, Human
cugggccccucaucugcucag

SEQ ID NO: 2614157 - RNA, 20 nt, Human
cugggccccucaucugcuca

SEQ ID NO: 2614158 - RNA, 10 nt, Human
cugggccccu

SEQ ID NO: 2614159 - RNA, 20 nt, Human
cugggcaaugugauaaaacc

SEQ ID NO: 2614160 - RNA, 23 nt, Human
cugggcacacgccucccacuggg

SEQ ID NO: 2614161 - RNA, 22 nt, Human
cugggcacacgccucccacugg

SEQ ID NO: 2614162 - RNA, 17 nt, Human
cugggcacacgccuccc

SEQ ID NO: 2614163 - RNA, 16 nt, Human
cugggcacacgccucc

SEQ ID NO: 2614164 - RNA, 18 nt, Human
cuggacacucagaccuga

SEQ ID NO: 2614165 - RNA, 21 nt, Human
cuggaauguaaucaauguuuc

SEQ ID NO: 2614166 - RNA, 17 nt, Human
cuggacacucagaccug

SEQ ID NO: 2614167 - RNA, 13 nt, Human
cuggacagcccca

SEQ ID NO: 2614168 - RNA, 14 nt, Human
cuggacagccccac

SEQ ID NO: 2614169 - RNA, 15 nt, Human
cuggacagccccacc

SEQ ID NO: 2614170 - RNA, 16 nt, Human
cuggacagccccaccc

SEQ ID NO: 2614171 - RNA, 18 nt, Human
cuggacagccccacccug

SEQ ID NO: 2614172 - RNA, 19 nt, Human
cuggacagccccacccugg

SEQ ID NO: 2614173 - RNA, 20 nt, Human
cuggaauguaaucaauguuu

SEQ ID NO: 2614174 - RNA, 15 nt, Human
cuggaauguaaucaa

SEQ ID NO: 2614175 - RNA, 20 nt, Human
cuggaauggaaggguucugg

SEQ ID NO: 2614176 - RNA, 14 nt, Human
cuggaauguaauca

SEQ ID NO: 2614177 - RNA, 15 nt, Human
cuggaaugcaguggu

SEQ ID NO: 2614178 - RNA, 14 nt, Human
cuggaaugcagugg

SEQ ID NO: 2614179 - RNA, 14 nt, Human
cuggaauaaguuca

SEQ ID NO: 2614180 - RNA, 17 nt, Human
cuggaaguuuugcauuu

SEQ ID NO: 2614181 - RNA, 20 nt, Human
cuggaaguuuugcauuuaug

SEQ ID NO: 2614182 - RNA, 23 nt, Human
cuggaauaauccuaaacauauga

SEQ ID NO: 2614183 - RNA, 21 nt, Human
cuggaagugcuaauuuugaaa

SEQ ID NO: 2614184 - RNA, 23 nt, Human
cuggaagcauguaggagaaucca

SEQ ID NO: 2614185 - RNA, 12 nt, Human
cuggaagcacau

SEQ ID NO: 2614186 - RNA, 18 nt, Human
cugcuuuucugcccuggc

SEQ ID NO: 2614187 - RNA, 15 nt, Human
cuggaagcacauguu

SEQ ID NO: 2614188 - RNA, 14 nt, Human
cuggaagcacagcu

SEQ ID NO: 2614189 - RNA, 18 nt, Human
cuggaagcacagcuucau

SEQ ID NO: 2614190 - RNA, 15 nt, Human
cuggaagcacagcuu

SEQ ID NO: 2614191 - RNA, 17 nt, Human
cugcuuuucugcccugg

SEQ ID NO: 2614192 - RNA, 16 nt, Human
cugcuuuucugcccug

SEQ ID NO: 2614193 - RNA, 15 nt, Human
cugcuuuucugcccu

SEQ ID NO: 2614194 - RNA, 14 nt, Human
cugcuuuucugccc

SEQ ID NO: 2614195 - RNA, 21 nt, Human
cugcuuuuccuuggggcaggc

SEQ ID NO: 2614196 - RNA, 22 nt, Human
cugcuuuuccuuggggcaggca

SEQ ID NO: 2614197 - RNA, 23 nt, Human
cugcuuuuccuuggggcaggcag

SEQ ID NO: 2614198 - RNA, 15 nt, Human
cugcuuuccaaagcc

SEQ ID NO: 2614199 - RNA, 17 nt, Human
cugcuuuccaaagccaa

SEQ ID NO: 2614200 - RNA, 13 nt, Human
cugcugaaacaac

SEQ ID NO: 2614201 - RNA, 22 nt, Human
cugcucuuucucugccagugac

SEQ ID NO: 2614202 - RNA, 14 nt, Human
cugcucuuguuucu

SEQ ID NO: 2614203 - RNA, 21 nt, Human
cugcucuuucucugccaguga

SEQ ID NO: 2614204 - RNA, 20 nt, Human
cugcucuuucucugccagug

SEQ ID NO: 2614205 - RNA, 19 nt, Human
cugcucuuucucugccagu

SEQ ID NO: 2614206 - RNA, 18 nt, Human
cugcucuuucucugccag

SEQ ID NO: 2614207 - RNA, 17 nt, Human
cugcucuuucucugcca

SEQ ID NO: 2614208 - RNA, 16 nt, Human
cugcucuuucucugcc

SEQ ID NO: 2614209 - RNA, 15 nt, Human
cugcucuuucucugc

SEQ ID NO: 2614210 - RNA, 14 nt, Human
cugcucuuucucug

SEQ ID NO: 2614211 - RNA, 19 nt, Human
cugcucugaggcuuccaga

SEQ ID NO: 2614212 - RNA, 18 nt, Human
cugcucugaggcuuccag

SEQ ID NO: 2614213 - RNA, 13 nt, Human
cugcucugaggcu

SEQ ID NO: 2614214 - RNA, 12 nt, Human
cugcucugauga

SEQ ID NO: 2614215 - RNA, 21 nt, Human
cugcucugaggcuuccagaga

SEQ ID NO: 2614216 - RNA, 20 nt, Human
cugcucugaggcuuccagag

SEQ ID NO: 2614217 - RNA, 22 nt, Human
cugcucugaggcuuccagagag

SEQ ID NO: 2614218 - RNA, 16 nt, Human
cugcuuucuccauugu

SEQ ID NO: 2614219 - RNA, 21 nt, Human
cugcuuuccccuguggggauc

SEQ ID NO: 2614220 - RNA, 20 nt, Human
cugcuuuccccuguggggau

SEQ ID NO: 2614221 - RNA, 19 nt, Human
cugcuuuccccugugggga

SEQ ID NO: 2614222 - RNA, 22 nt, Human
cugcuuucuccauuguaaacca

SEQ ID NO: 2614223 - RNA, 18 nt, Human
cugcuuuccccugugggg

SEQ ID NO: 2614224 - RNA, 17 nt, Human
cugcuuuccccuguggg

SEQ ID NO: 2614225 - RNA, 16 nt, Human
cugcuuuccccugugg

SEQ ID NO: 2614226 - RNA, 15 nt, Human
cugcuuuccccugug

SEQ ID NO: 2614227 - RNA, 14 nt, Human
cugcuuuccccugu

SEQ ID NO: 2614228 - RNA, 12 nt, Human
cugcuuuccaca

SEQ ID NO: 2614229 - RNA, 18 nt, Human
cugcuuugggcugcccug

SEQ ID NO: 2614230 - RNA, 17 nt, Human
cugcuuugggcugcccu

SEQ ID NO: 2614231 - RNA, 20 nt, Human
cugcuuugggcugcccuggu

SEQ ID NO: 2614232 - RNA, 19 nt, Human
cugcuuugggcugcccugg

SEQ ID NO: 2614233 - RNA, 17 nt, Human
cugcuuuuaccaugccc

SEQ ID NO: 2614234 - RNA, 15 nt, Human
cugcuuuucacugcu

SEQ ID NO: 2614235 - RNA, 18 nt, Human
cugcuuuucccuaagcca

SEQ ID NO: 2614236 - RNA, 21 nt, Human
cugcuuuucccuaagccaagg

SEQ ID NO: 2614237 - RNA, 17 nt, Human
cugcuuuucacugcugc

SEQ ID NO: 2614238 - RNA, 14 nt, Human
cugcuuuuaccaug

SEQ ID NO: 2614239 - RNA, 18 nt, Human
cugcuuuucacugcugca

SEQ ID NO: 2614240 - RNA, 15 nt, Human
cugcuuuucccuaag

SEQ ID NO: 2614241 - RNA, 23 nt, Human
cugcuuugggcugcccuggugcu

SEQ ID NO: 2614242 - RNA, 22 nt, Human
cugcuuugggcugcccuggugc

SEQ ID NO: 2614243 - RNA, 21 nt, Human
cugcuuugggcugcccuggug

SEQ ID NO: 2614244 - RNA, 19 nt, Human
cuggagagccagaaccugg

SEQ ID NO: 2614245 - RNA, 17 nt, Human
cuggagagaaguuucug

SEQ ID NO: 2614246 - RNA, 23 nt, Human
cuggagagccagaaccuggaggg

SEQ ID NO: 2614247 - RNA, 22 nt, Human
cuggagagccagaaccuggagg

SEQ ID NO: 2614248 - RNA, 22 nt, Human
cuggagagaaacaauaaagaga

SEQ ID NO: 2614249 - RNA, 14 nt, Human
cuggagagaaacaa

SEQ ID NO: 2614250 - RNA, 12 nt, Human
cuggagagaagu

SEQ ID NO: 2614251 - RNA, 21 nt, Human
cuggagacuuagggcaccagg

SEQ ID NO: 2614252 - RNA, 15 nt, Human
cuggagacuuagggc

SEQ ID NO: 2614253 - RNA, 22 nt, Human
cuggagagcuagaaccuggaga

SEQ ID NO: 2614254 - RNA, 20 nt, Human
cuggagagcuagaaccugga

SEQ ID NO: 2614255 - RNA, 19 nt, Human
cuggagagcuagaaccugg

SEQ ID NO: 2614256 - RNA, 13 nt, Human
cuggagagcuaga

SEQ ID NO: 2614257 - RNA, 23 nt, Human
cuggagagcuagaaccuggaggg

SEQ ID NO: 2614258 - RNA, 22 nt, Human
cuggagagcuagaaccuggagg

SEQ ID NO: 2614259 - RNA, 23 nt, Human
cuggagaggagggaugcugccug

SEQ ID NO: 2614260 - RNA, 22 nt, Human
cuggagaggcccucuggagugg

SEQ ID NO: 2614261 - RNA, 12 nt, Human
cuggagagguua

SEQ ID NO: 2614262 - RNA, 21 nt, Human
cuggagagguuauaggucacu

SEQ ID NO: 2614263 - RNA, 17 nt, Human
cuggagcaucugacuca

SEQ ID NO: 2614264 - RNA, 16 nt, Human
cuggagcaucugacuc

SEQ ID NO: 2614265 - RNA, 12 nt, Human
cuggagcaucug

SEQ ID NO: 2614266 - RNA, 21 nt, Human
cuggagcaggccuugcgcugu

SEQ ID NO: 2614267 - RNA, 16 nt, Human
cuggagcaggccuugc

SEQ ID NO: 2614268 - RNA, 12 nt, Human
cuggagcaggcc

SEQ ID NO: 2614269 - RNA, 22 nt, Human
cuggagcagaccaccccgccug

SEQ ID NO: 2614270 - RNA, 18 nt, Human
cuggagcagaccaccccg

SEQ ID NO: 2614271 - RNA, 15 nt, Human
cuggagcagaccacc

SEQ ID NO: 2614272 - RNA, 13 nt, Human
cuggagcagacca

SEQ ID NO: 2614273 - RNA, 13 nt, Human
cuggagcaccagg

SEQ ID NO: 2614274 - RNA, 20 nt, Human
cuggagaguucaauggcugc

SEQ ID NO: 2614275 - RNA, 23 nt, Human
cuggagaguucaauggcugcuga

SEQ ID NO: 2614276 - RNA, 14 nt, Human
cuggagcaccaggc

SEQ ID NO: 2614277 - RNA, 15 nt, Human
cuggagcaccaggca

SEQ ID NO: 2614278 - RNA, 23 nt, Human
cuggagcaccaggcacgaaccca

SEQ ID NO: 2614279 - RNA, 19 nt, Human
cuggacaguaucacugucu

SEQ ID NO: 2614280 - RNA, 17 nt, Human
cuggacauagagaggga

SEQ ID NO: 2614281 - RNA, 20 nt, Human
cuggacaguaucacugucuu

SEQ ID NO: 2614282 - RNA, 23 nt, Human
cuggacauagagagggagaagaa

SEQ ID NO: 2614283 - RNA, 18 nt, Human
cuggacauagagagggag

SEQ ID NO: 2614284 - RNA, 23 nt, Human
cuggacaugaagauucuuuccca

SEQ ID NO: 2614285 - RNA, 17 nt, Human
cuggacauuuuuucagu

SEQ ID NO: 2614286 - RNA, 18 nt, Human
cuggacauccucuucugc

SEQ ID NO: 2614287 - RNA, 18 nt, Human
cuggacauuugccuugcu

SEQ ID NO: 2614288 - RNA, 14 nt, Human
cuggaccacugggc

SEQ ID NO: 2614289 - RNA, 15 nt, Human
cuggaccacugggca

SEQ ID NO: 2614290 - RNA, 23 nt, Human
cuggaccaacccuguuuccugag

SEQ ID NO: 2614291 - RNA, 22 nt, Human
cuggaccaacccuguuuccuga

SEQ ID NO: 2614292 - RNA, 21 nt, Human
cuggaccaacccuguuuccug

SEQ ID NO: 2614293 - RNA, 15 nt, Human
cuggacggcauuccu

SEQ ID NO: 2614294 - RNA, 17 nt, Human
cuggacggcauuccugc

SEQ ID NO: 2614295 - RNA, 19 nt, Human
cuggacggcauuccugcuu

SEQ ID NO: 2614296 - RNA, 18 nt, Human
cuggacggggacugggga

SEQ ID NO: 2614297 - RNA, 15 nt, Human
cuggacggggacugg

SEQ ID NO: 2614298 - RNA, 20 nt, Human
cuggacggcauuccugcuua

SEQ ID NO: 2614299 - RNA, 16 nt, Human
cuggacucaccucccc

SEQ ID NO: 2614300 - RNA, 13 nt, Human
cuggacucaggau

SEQ ID NO: 2614301 - RNA, 19 nt, Human
cuggacucaggaugcccag

SEQ ID NO: 2614302 - RNA, 20 nt, Human
cuggacucaggaugcccagg

SEQ ID NO: 2614303 - RNA, 22 nt, Human
cuggacucaggaugcccagggc

SEQ ID NO: 2614304 - RNA, 23 nt, Human
cuggacggggacuggggaugugg

SEQ ID NO: 2614305 - RNA, 20 nt, Human
cuggacuagagggaccucuc

SEQ ID NO: 2614306 - RNA, 21 nt, Human
cuggacuagagggaccucucc

SEQ ID NO: 2614307 - RNA, 23 nt, Human
cuggacuagagggaccucuccca

SEQ ID NO: 2614308 - RNA, 22 nt, Human
cuggagccuguguaacagcucc

SEQ ID NO: 2614309 - RNA, 19 nt, Human
cuggagccuguguaacagc

SEQ ID NO: 2614310 - RNA, 18 nt, Human
cuggagccuguguaacag

SEQ ID NO: 2614311 - RNA, 17 nt, Human
cuggagccuguguaaca

SEQ ID NO: 2614312 - RNA, 16 nt, Human
cuggagccuguguaac

SEQ ID NO: 2614313 - RNA, 15 nt, Human
cuggagccuguguaa

SEQ ID NO: 2614314 - RNA, 14 nt, Human
cuggagccugugua

SEQ ID NO: 2614315 - RNA, 13 nt, Human
cuggagccugugu

SEQ ID NO: 2614316 - RNA, 12 nt, Human
cuggagccugug

SEQ ID NO: 2614317 - RNA, 16 nt, Human
cuggagcccagaggag

SEQ ID NO: 2614318 - RNA, 21 nt, Human
cuggagcccacuguacuugcu

SEQ ID NO: 2614319 - RNA, 13 nt, Human
cuggaggagagaa

SEQ ID NO: 2614320 - RNA, 22 nt, Human
cuggaggacuagaaccuggagg

SEQ ID NO: 2614321 - RNA, 21 nt, Human
cuggaggacuagaaccuggag

SEQ ID NO: 2614322 - RNA, 20 nt, Human
cuggaggacuagaaccugga

SEQ ID NO: 2614323 - RNA, 19 nt, Human
cuggaggacuagaaccugg

SEQ ID NO: 2614324 - RNA, 19 nt, Human
cuggaggaaaacugagacu

SEQ ID NO: 2614325 - RNA, 14 nt, Human
cuggaggaaaacug

SEQ ID NO: 2614326 - RNA, 17 nt, Human
cuggaggaaaacugaga

SEQ ID NO: 2614327 - RNA, 19 nt, Human
cuggagcuggcgucugucu

SEQ ID NO: 2614328 - RNA, 11 nt, Human
cuggagcuggc

SEQ ID NO: 2614329 - RNA, 24 nt, Human
cuggagccuguguaacagcuccuu

SEQ ID NO: 2614330 - RNA, 23 nt, Human
cuggagccuguguaacagcuccu

SEQ ID NO: 2614331 - RNA, 20 nt, Human
cuggagcccacuguacuugc

SEQ ID NO: 2614332 - RNA, 17 nt, Human
cuggagcccacuguacu

SEQ ID NO: 2614333 - RNA, 16 nt, Human
cuggagcccacuguac

SEQ ID NO: 2614334 - RNA, 15 nt, Human
cuggagcccacugua

SEQ ID NO: 2614335 - RNA, 16 nt, Human
cuggagccaaguccag

SEQ ID NO: 2614336 - RNA, 15 nt, Human
cuggagccaagucca

SEQ ID NO: 2614337 - RNA, 20 nt, Human
cuggagccaacugcugcuuu

SEQ ID NO: 2614338 - RNA, 18 nt, Human
cuggagccaacugcugcu

SEQ ID NO: 2614339 - RNA, 23 nt, Human
cuggagcaucugacucacaagaa

SEQ ID NO: 2614340 - RNA, 22 nt, Human
cuggagcaucugacucacaaga

SEQ ID NO: 2614341 - RNA, 17 nt, Human
cuggagccaacugcugc

SEQ ID NO: 2614342 - RNA, 18 nt, Human
cuggagccacuaacuaga

SEQ ID NO: 2614343 - RNA, 16 nt, Human
cuggagccacuaacua

SEQ ID NO: 2614344 - RNA, 19 nt, Human
cuggagccaaguccagauu

SEQ ID NO: 2614345 - RNA, 17 nt, Human
cuggagccaaguccaga

SEQ ID NO: 2614346 - RNA, 15 nt, Human
cuggagccacuaacu

SEQ ID NO: 2614347 - RNA, 13 nt, Human
cuggagcccacug

SEQ ID NO: 2614348 - RNA, 21 nt, Human
cuggagccagacucuggucuu

SEQ ID NO: 2614349 - RNA, 16 nt, Human
cuggagccagacucug

SEQ ID NO: 2614350 - RNA, 22 nt, Human
cuggagccagacucuggucuuc

SEQ ID NO: 2614351 - RNA, 17 nt, Human
cuggaggagagaagaau

SEQ ID NO: 2614352 - RNA, 14 nt, Human
cuggaggagagaag

SEQ ID NO: 2614353 - RNA, 14 nt, Human
cuggaggaggagca

SEQ ID NO: 2614354 - RNA, 21 nt, Human
cuggagggaaugaaccuggag

SEQ ID NO: 2614355 - RNA, 19 nt, Human
cuggagggaaugaaccugg

SEQ ID NO: 2614356 - RNA, 21 nt, Human
cuggaggccgggugcucaggg

SEQ ID NO: 2614357 - RNA, 15 nt, Human
cuggauggggcugca

SEQ ID NO: 2614358 - RNA, 23 nt, Human
cuggauggcaccagaggcugcag

SEQ ID NO: 2614359 - RNA, 16 nt, Human
cuggauggcaccagag

SEQ ID NO: 2614360 - RNA, 15 nt, Human
cuggauggcaccaga

SEQ ID NO: 2614361 - RNA, 21 nt, Human
cuggauggauuugaagcaaag

SEQ ID NO: 2614362 - RNA, 20 nt, Human
cuggaugggcugcagcagag

SEQ ID NO: 2614363 - RNA, 18 nt, Human
cuggaugggcugcagcag

SEQ ID NO: 2614364 - RNA, 22 nt, Human
cuggagggcuagaaccuggcag

SEQ ID NO: 2614365 - RNA, 22 nt, Human
cuggagggcuagaaccuggaga

SEQ ID NO: 2614366 - RNA, 21 nt, Human
cuggagggcuagaaccuggag

SEQ ID NO: 2614367 - RNA, 20 nt, Human
cuggagggcuagaaccugga

SEQ ID NO: 2614368 - RNA, 19 nt, Human
cuggagggcuagaaccugg

SEQ ID NO: 2614369 - RNA, 20 nt, Human
cuggagggcuagaaccuaga

SEQ ID NO: 2614370 - RNA, 23 nt, Human
cuggagggaaugaaccuggaggg

SEQ ID NO: 2614371 - RNA, 22 nt, Human
cuggagggaaugaaccuggagg

SEQ ID NO: 2614372 - RNA, 22 nt, Human
cuggagggcuagaaucuggaga

SEQ ID NO: 2614373 - RNA, 20 nt, Human
cuggagggcuagaaucugga

SEQ ID NO: 2614374 - RNA, 19 nt, Human
cuggagggcuagaaucugg

SEQ ID NO: 2614375 - RNA, 21 nt, Human
cuggagggcuagaacuggaga

SEQ ID NO: 2614376 - RNA, 21 nt, Human
cuggauggaggaaaaccaagc

SEQ ID NO: 2614377 - RNA, 13 nt, Human
cuggauuaaacuu

SEQ ID NO: 2614378 - RNA, 23 nt, Human
cuggauuaaacuuaaucuaaaug

SEQ ID NO: 2614379 - RNA, 16 nt, Human
cuggauggggcugcac

SEQ ID NO: 2614380 - RNA, 19 nt, Human
cuggaugguucccagaggg

SEQ ID NO: 2614381 - RNA, 20 nt, Human
cuggaugguucccagagggu

SEQ ID NO: 2614382 - RNA, 17 nt, Human
cuggauuauauuaugaa

SEQ ID NO: 2614383 - RNA, 19 nt, Human
cuggaugucugccaauuuu

SEQ ID NO: 2614384 - RNA, 23 nt, Human
cuggauuauucaaaaugauguau

SEQ ID NO: 2614385 - RNA, 13 nt, Human
cuggauucccagg

SEQ ID NO: 2614386 - RNA, 14 nt, Human
cuggauucccagga

SEQ ID NO: 2614387 - RNA, 19 nt, Human
cuggauucauuuccugccc

SEQ ID NO: 2614388 - RNA, 18 nt, Human
cuggauucauuuccugcc

SEQ ID NO: 2614389 - RNA, 16 nt, Human
cuggauucauuuccug

SEQ ID NO: 2614390 - RNA, 15 nt, Human
cuggaugucugccaa

SEQ ID NO: 2614391 - RNA, 20 nt, Human
cuggauguuuuuucccuguu

SEQ ID NO: 2614392 - RNA, 18 nt, Human
cuggcacaguuuucugag

SEQ ID NO: 2614393 - RNA, 19 nt, Human
cuggcacaguuuucugaga

SEQ ID NO: 2614394 - RNA, 14 nt, Human
cuggcacagugucu

SEQ ID NO: 2614395 - RNA, 12 nt, Human
cuggcacagugu

SEQ ID NO: 2614396 - RNA, 12 nt, Human
cuggcacagucu

SEQ ID NO: 2614397 - RNA, 17 nt, Human
cuggcacagggcagugg

SEQ ID NO: 2614398 - RNA, 16 nt, Human
cuggcacagggcagug

SEQ ID NO: 2614399 - RNA, 14 nt, Human
cuggcacugcuucc

SEQ ID NO: 2614400 - RNA, 13 nt, Human
cuggcacugcuuc

SEQ ID NO: 2614401 - RNA, 21 nt, Human
cuggcacagugucugggcuga

SEQ ID NO: 2614402 - RNA, 20 nt, Human
cuggcacagugucugggcug

SEQ ID NO: 2614403 - RNA, 19 nt, Human
cuggcacagugucugggcu

SEQ ID NO: 2614404 - RNA, 15 nt, Human
cuggcacagugucug

SEQ ID NO: 2614405 - RNA, 23 nt, Human
cuggcacuauaauguaagcucua

SEQ ID NO: 2614406 - RNA, 13 nt, Human
cuggauuuuguca

SEQ ID NO: 2614407 - RNA, 19 nt, Human
cuggcaaaaggaucuuugu

SEQ ID NO: 2614408 - RNA, 22 nt, Human
cuggauugaucggagccuccuc

SEQ ID NO: 2614409 - RNA, 20 nt, Human
cuggauuggguuaugaauau

SEQ ID NO: 2614410 - RNA, 20 nt, Human
cuggcaaaaggaucuuugug

SEQ ID NO: 2614411 - RNA, 23 nt, Human
cuggcaaaaggaucuuuguggcc

SEQ ID NO: 2614412 - RNA, 21 nt, Human
cuggcaaaaggaucuuugugg

SEQ ID NO: 2614413 - RNA, 16 nt, Human
cuggcaaacaugaaaa

SEQ ID NO: 2614414 - RNA, 22 nt, Human
cuggcaaacaugaaaaaucggc

SEQ ID NO: 2614415 - RNA, 19 nt, Human
cuggcaaacuucagacuga

SEQ ID NO: 2614416 - RNA, 21 nt, Human
cuggcaaugaaaaauucucag

SEQ ID NO: 2614417 - RNA, 22 nt, Human
cuggcaaugaaaaauucucagu

SEQ ID NO: 2614418 - RNA, 18 nt, Human
cuggcaaagggagcagaa

SEQ ID NO: 2614419 - RNA, 20 nt, Human
cuggcaauaguguguucuga

SEQ ID NO: 2614420 - RNA, 12 nt, Human
cuggcaaaggcc

SEQ ID NO: 2614421 - RNA, 19 nt, Human
cuggcaaagcuuuuagaaa

SEQ ID NO: 2614422 - RNA, 20 nt, Human
cuggcaaagcuuuuagaaau

SEQ ID NO: 2614423 - RNA, 18 nt, Human
cuggcaaagacagaagcc

SEQ ID NO: 2614424 - RNA, 15 nt, Human
cuggcacagaaaccu

SEQ ID NO: 2614425 - RNA, 21 nt, Human
cuggcacacaguaggugcuca

SEQ ID NO: 2614426 - RNA, 21 nt, Human
cuggcacacaucaggaguuca

SEQ ID NO: 2614427 - RNA, 16 nt, Human
cuggcacagaaaccuc

SEQ ID NO: 2614428 - RNA, 12 nt, Human
cuggcacacauc

SEQ ID NO: 2614429 - RNA, 18 nt, Human
cuggcacaaacucuuggu

SEQ ID NO: 2614430 - RNA, 15 nt, Human
cuggcccagcucccc

SEQ ID NO: 2614431 - RNA, 14 nt, Human
cuggcccagcuccc

SEQ ID NO: 2614432 - RNA, 13 nt, Human
cuggcccagcucc

SEQ ID NO: 2614433 - RNA, 12 nt, Human
cuggcccagcuc

SEQ ID NO: 2614434 - RNA, 19 nt, Human
cuggcccagcggccccucc

SEQ ID NO: 2614435 - RNA, 18 nt, Human
cuggcccagcggccccuc

SEQ ID NO: 2614436 - RNA, 17 nt, Human
cuggcccagcggccccu

SEQ ID NO: 2614437 - RNA, 14 nt, Human
cuggcccagcggcc

SEQ ID NO: 2614438 - RNA, 12 nt, Human
cuggcccagggc

SEQ ID NO: 2614439 - RNA, 22 nt, Human
cuggcccagcucccccgggagg

SEQ ID NO: 2614440 - RNA, 11 nt, Human
cuggcccaggg

SEQ ID NO: 2614441 - RNA, 13 nt, Human
cuggcccagggcc

SEQ ID NO: 2614442 - RNA, 14 nt, Human
cuggcccagggccc

SEQ ID NO: 2614443 - RNA, 15 nt, Human
cuggcccagggccca

SEQ ID NO: 2614444 - RNA, 17 nt, Human
cuggccuagcauacgua

SEQ ID NO: 2614445 - RNA, 13 nt, Human
cuggcccagcggc

SEQ ID NO: 2614446 - RNA, 12 nt, Human
cuggcccagcgg

SEQ ID NO: 2614447 - RNA, 22 nt, Human
cuggcccagccggccucucugg

SEQ ID NO: 2614448 - RNA, 21 nt, Human
cuggcccagccggccucucug

SEQ ID NO: 2614449 - RNA, 23 nt, Human
cuggcccagccggccucucuggc

SEQ ID NO: 2614450 - RNA, 20 nt, Human
cuggcccagccggccucucu

SEQ ID NO: 2614451 - RNA, 19 nt, Human
cuggcccagccggccucuc

SEQ ID NO: 2614452 - RNA, 12 nt, Human
cuggcccacugc

SEQ ID NO: 2614453 - RNA, 13 nt, Human
cuggcccacugca

SEQ ID NO: 2614454 - RNA, 22 nt, Human
cuggccuccggcgucagccucc

SEQ ID NO: 2614455 - RNA, 21 nt, Human
cuggccuccggcgucagccuc

SEQ ID NO: 2614456 - RNA, 20 nt, Human
cuggccuccggcgucagccu

SEQ ID NO: 2614457 - RNA, 21 nt, Human
cuggccuccccugccaccagg

SEQ ID NO: 2614458 - RNA, 18 nt, Human
cuggccuccccugccacc

SEQ ID NO: 2614459 - RNA, 17 nt, Human
cuggccuccccugccac

SEQ ID NO: 2614460 - RNA, 16 nt, Human
cuggccuccccugcca

SEQ ID NO: 2614461 - RNA, 20 nt, Human
cuggccucgccuggccugag

SEQ ID NO: 2614462 - RNA, 19 nt, Human
cuggccucgccuggccuga

SEQ ID NO: 2614463 - RNA, 18 nt, Human
cuggccucgccuggccug

SEQ ID NO: 2614464 - RNA, 17 nt, Human
cuggccucgccuggccu

SEQ ID NO: 2614465 - RNA, 16 nt, Human
cuggccucgccuggcc

SEQ ID NO: 2614466 - RNA, 12 nt, Human
cuggccucgccu

SEQ ID NO: 2614467 - RNA, 11 nt, Human
cuggccucugu

SEQ ID NO: 2614468 - RNA, 13 nt, Human
cuggccucugugc

SEQ ID NO: 2614469 - RNA, 17 nt, Human
cuggccucuggcucuca

SEQ ID NO: 2614470 - RNA, 23 nt, Human
cuggccuagucccuuccacaccc

SEQ ID NO: 2614471 - RNA, 12 nt, Human
cuggccuagucc

SEQ ID NO: 2614472 - RNA, 23 nt, Human
cuggccuaggagauaucugaggg

SEQ ID NO: 2614473 - RNA, 21 nt, Human
cuggccuaggagauaucugag

SEQ ID NO: 2614474 - RNA, 23 nt, Human
cuggccuagcauacguacacauu

SEQ ID NO: 2614475 - RNA, 17 nt, Human
cuggccuagucccuucc

SEQ ID NO: 2614476 - RNA, 17 nt, Human
cuggccucccacagacu

SEQ ID NO: 2614477 - RNA, 23 nt, Human
cuggccucccacccgaugcugcu

SEQ ID NO: 2614478 - RNA, 22 nt, Human
cuggccucccacccgaugcugc

SEQ ID NO: 2614479 - RNA, 17 nt, Human
cuggccucccacccgau

SEQ ID NO: 2614480 - RNA, 15 nt, Human
cuggccucccacccg

SEQ ID NO: 2614481 - RNA, 13 nt, Human
cuggccucccacc

SEQ ID NO: 2614482 - RNA, 19 nt, Human
cuggccucccacagacuca

SEQ ID NO: 2614483 - RNA, 16 nt, Human
cuggcacugcuuccag

SEQ ID NO: 2614484 - RNA, 15 nt, Human
cuggcacugcuucca

SEQ ID NO: 2614485 - RNA, 17 nt, Human
cuggcacugcuuccagu

SEQ ID NO: 2614486 - RNA, 19 nt, Human
cuggcacugaauuaaucau

SEQ ID NO: 2614487 - RNA, 20 nt, Human
cuggcacugacugggcauag

SEQ ID NO: 2614488 - RNA, 19 nt, Human
cuggcauuagaauuauuua

SEQ ID NO: 2614489 - RNA, 19 nt, Human
cuggcauuauguccacugu

SEQ ID NO: 2614490 - RNA, 16 nt, Human
cuggcacugcugugcu

SEQ ID NO: 2614491 - RNA, 22 nt, Human
cuggcauuagaauuauuuaaac

SEQ ID NO: 2614492 - RNA, 14 nt, Human
cuggcacugcugug

SEQ ID NO: 2614493 - RNA, 13 nt, Human
cuggcacugcugu

SEQ ID NO: 2614494 - RNA, 20 nt, Human
cuggcauuagaauuauuuaa

SEQ ID NO: 2614495 - RNA, 17 nt, Human
cuggcauugucccugug

SEQ ID NO: 2614496 - RNA, 16 nt, Human
cuggcauugucccugu

SEQ ID NO: 2614497 - RNA, 21 nt, Human
cuggcauuauguccacugugu

SEQ ID NO: 2614498 - RNA, 19 nt, Human
cuggcauugucccugugcc

SEQ ID NO: 2614499 - RNA, 23 nt, Human
cuggccaacaucgugaaacccug

SEQ ID NO: 2614500 - RNA, 16 nt, Human
cuggccaacgggguga

SEQ ID NO: 2614501 - RNA, 16 nt, Human
cuggccagaugcacca

SEQ ID NO: 2614502 - RNA, 20 nt, Human
cuggccagaugcaccagccc

SEQ ID NO: 2614503 - RNA, 19 nt, Human
cuggccagaugcaccagcc

SEQ ID NO: 2614504 - RNA, 18 nt, Human
cuggccagaugcaccagc

SEQ ID NO: 2614505 - RNA, 17 nt, Human
cuggccagaugcaccag

SEQ ID NO: 2614506 - RNA, 18 nt, Human
cuggcccacagcaggugc

SEQ ID NO: 2614507 - RNA, 21 nt, Human
cuggccagaugcaccagcccu

SEQ ID NO: 2614508 - RNA, 22 nt, Human
cuggccagaugcaccagcccuu

SEQ ID NO: 2614509 - RNA, 17 nt, Human
cuggccaacaugguaaa

SEQ ID NO: 2614510 - RNA, 17 nt, Human
cugccccuggcagcccc

SEQ ID NO: 2614511 - RNA, 16 nt, Human
cugccccuggcagccc

SEQ ID NO: 2614512 - RNA, 15 nt, Human
cugccccuggcagcc

SEQ ID NO: 2614513 - RNA, 14 nt, Human
cugccccuggcagc

SEQ ID NO: 2614514 - RNA, 20 nt, Human
cugcccaggggugcccccuc

SEQ ID NO: 2614515 - RNA, 19 nt, Human
cugcccaggggugcccccu

SEQ ID NO: 2614516 - RNA, 18 nt, Human
cugcccaggggugccccc

SEQ ID NO: 2614517 - RNA, 17 nt, Human
cugcccaggggugcccc

SEQ ID NO: 2614518 - RNA, 16 nt, Human
cugcccaggggugccc

SEQ ID NO: 2614519 - RNA, 15 nt, Human
cugcccaggggugcc

SEQ ID NO: 2614520 - RNA, 14 nt, Human
cugcccaggggugc

SEQ ID NO: 2614521 - RNA, 13 nt, Human
cugcccaggggug

SEQ ID NO: 2614522 - RNA, 14 nt, Human
cugcccaguccccc

SEQ ID NO: 2614523 - RNA, 13 nt, Human
cugcccagucccc

SEQ ID NO: 2614524 - RNA, 22 nt, Human
cugcccaggggugcccccuccu

SEQ ID NO: 2614525 - RNA, 21 nt, Human
cugcccaggggugcccccucc

SEQ ID NO: 2614526 - RNA, 19 nt, Human
cugcccagucccccaaccc

SEQ ID NO: 2614527 - RNA, 18 nt, Human
cugcccagucccccaacc

SEQ ID NO: 2614528 - RNA, 18 nt, Human
cugcccaggccugccugu

SEQ ID NO: 2614529 - RNA, 17 nt, Human
cugcccaggccugccug

SEQ ID NO: 2614530 - RNA, 22 nt, Human
cugcccaggggagcccuccacg

SEQ ID NO: 2614531 - RNA, 18 nt, Human
cugcccaggggagcccuc

SEQ ID NO: 2614532 - RNA, 17 nt, Human
cugcccaggggagcccu

SEQ ID NO: 2614533 - RNA, 16 nt, Human
cugcccaggggagccc

SEQ ID NO: 2614534 - RNA, 19 nt, Human
cugcccaggccugccuguu

SEQ ID NO: 2614535 - RNA, 22 nt, Human
cugcccagcuugggcccagcug

SEQ ID NO: 2614536 - RNA, 21 nt, Human
cugcccagcuugggcccagcu

SEQ ID NO: 2614537 - RNA, 23 nt, Human
cugcccagcuugggcccagcugg

SEQ ID NO: 2614538 - RNA, 20 nt, Human
cugcccaggacggggccggc

SEQ ID NO: 2614539 - RNA, 21 nt, Human
cugcccaggacggggccggcc

SEQ ID NO: 2614540 - RNA, 11 nt, Human
cugcccaggag

SEQ ID NO: 2614541 - RNA, 20 nt, Human
cugcccagcuugggcccagc

SEQ ID NO: 2614542 - RNA, 19 nt, Human
cugcccagcuugggcccag

SEQ ID NO: 2614543 - RNA, 17 nt, Human
cugcccagcuugggccc

SEQ ID NO: 2614544 - RNA, 16 nt, Human
cugcccagcuugggcc

SEQ ID NO: 2614545 - RNA, 15 nt, Human
cugcccagcuugggc

SEQ ID NO: 2614546 - RNA, 13 nt, Human
cugcccaggcccc

SEQ ID NO: 2614547 - RNA, 23 nt, Human
cugcccaggagagccagcccucc

SEQ ID NO: 2614548 - RNA, 21 nt, Human
cugcccaggagagccagcccu

SEQ ID NO: 2614549 - RNA, 22 nt, Human
cugcccaggagagccagcccuc

SEQ ID NO: 2614550 - RNA, 12 nt, Human
cugcccaggaga

SEQ ID NO: 2614551 - RNA, 17 nt, Human
cugcccaggagagccag

SEQ ID NO: 2614552 - RNA, 18 nt, Human
cugcccaggagagccagc

SEQ ID NO: 2614553 - RNA, 19 nt, Human
cugcccaggagagccagcc

SEQ ID NO: 2614554 - RNA, 17 nt, Human
cugcccaacccuucccu

SEQ ID NO: 2614555 - RNA, 20 nt, Human
cugcccaacccuucccucac

SEQ ID NO: 2614556 - RNA, 17 nt, Human
cugcccaaccugcucuc

SEQ ID NO: 2614557 - RNA, 17 nt, Human
cugcccaaaaauauggu

SEQ ID NO: 2614558 - RNA, 22 nt, Human
cugcccaaagugcuuccaaggc

SEQ ID NO: 2614559 - RNA, 20 nt, Human
cugccauuugcacccuccgc

SEQ ID NO: 2614560 - RNA, 21 nt, Human
cugccauuugcacccuccgcc

SEQ ID NO: 2614561 - RNA, 16 nt, Human
cugccauuucugagau

SEQ ID NO: 2614562 - RNA, 17 nt, Human
cugccauggaggcacac

SEQ ID NO: 2614563 - RNA, 19 nt, Human
cugccauuugcacccuccg

SEQ ID NO: 2614564 - RNA, 16 nt, Human
cugcccugcccaccug

SEQ ID NO: 2614565 - RNA, 15 nt, Human
cugcccugcccaccu

SEQ ID NO: 2614566 - RNA, 14 nt, Human
cugcccugcccacc

SEQ ID NO: 2614567 - RNA, 13 nt, Human
cugcccugcccac

SEQ ID NO: 2614568 - RNA, 11 nt, Human
cugcccugccc

SEQ ID NO: 2614569 - RNA, 13 nt, Human
cugcccugccacu

SEQ ID NO: 2614570 - RNA, 20 nt, Human
cugcccugcacgucauggga

SEQ ID NO: 2614571 - RNA, 17 nt, Human
cugcccugcacgucaug

SEQ ID NO: 2614572 - RNA, 17 nt, Human
cugcccucguggccagc

SEQ ID NO: 2614573 - RNA, 19 nt, Human
cugcccuccaagaccuucu

SEQ ID NO: 2614574 - RNA, 15 nt, Human
cugcccggcugcgga

SEQ ID NO: 2614575 - RNA, 21 nt, Human
cugcccggcgcccucuguccu

SEQ ID NO: 2614576 - RNA, 20 nt, Human
cugcccggcgcccucugucc

SEQ ID NO: 2614577 - RNA, 17 nt, Human
cugcccggcgcccucug

SEQ ID NO: 2614578 - RNA, 16 nt, Human
cugcccggcgcccucu

SEQ ID NO: 2614579 - RNA, 15 nt, Human
cugcccggcgcccuc

SEQ ID NO: 2614580 - RNA, 11 nt, Human
cugccccuggc

SEQ ID NO: 2614581 - RNA, 11 nt, Human
cugcccggcug

SEQ ID NO: 2614582 - RNA, 16 nt, Human
cugcccucguggccag

SEQ ID NO: 2614583 - RNA, 18 nt, Human
cugcccuccuuguccacc

SEQ ID NO: 2614584 - RNA, 20 nt, Human
cugcccuccuuguccaccca

SEQ ID NO: 2614585 - RNA, 21 nt, Human
cugcccuccccagagcacugg

SEQ ID NO: 2614586 - RNA, 20 nt, Human
cugcccuccccucucugcac

SEQ ID NO: 2614587 - RNA, 23 nt, Human
cugcccggcgcccucuguccuga

SEQ ID NO: 2614588 - RNA, 22 nt, Human
cugcccggcgcccucuguccug

SEQ ID NO: 2614589 - RNA, 21 nt, Human
cugcccgggaaggucaccagc

SEQ ID NO: 2614590 - RNA, 17 nt, Human
cugcccuccccagagca

SEQ ID NO: 2614591 - RNA, 15 nt, Human
cugcccuccaucccg

SEQ ID NO: 2614592 - RNA, 14 nt, Human
cugcccuccccucu

SEQ ID NO: 2614593 - RNA, 22 nt, Human
cugcccuccagcucuuuccucc

SEQ ID NO: 2614594 - RNA, 14 nt, Human
cugcccuccauccc

SEQ ID NO: 2614595 - RNA, 10 nt, Human
cugcccuccc

SEQ ID NO: 2614596 - RNA, 15 nt, Human
cugccaggagcuuug

SEQ ID NO: 2614597 - RNA, 22 nt, Human
cugccagccuggcuucuggagc

SEQ ID NO: 2614598 - RNA, 23 nt, Human
cugccagccuggcuucuggagcc

SEQ ID NO: 2614599 - RNA, 15 nt, Human
cugccaggcaggggu

SEQ ID NO: 2614600 - RNA, 17 nt, Human
cugccaugccagcuuau

SEQ ID NO: 2614601 - RNA, 12 nt, Human
cugccaggcagg

SEQ ID NO: 2614602 - RNA, 13 nt, Human
cugccaggcaggg

SEQ ID NO: 2614603 - RNA, 19 nt, Human
cugccaugccagcuuaucu

SEQ ID NO: 2614604 - RNA, 19 nt, Human
cugccaggaagccagcagg

SEQ ID NO: 2614605 - RNA, 18 nt, Human
cugccaggaagccagcag

SEQ ID NO: 2614606 - RNA, 16 nt, Human
cugccaggaagccagc

SEQ ID NO: 2614607 - RNA, 15 nt, Human
cugccaggaagccag

SEQ ID NO: 2614608 - RNA, 19 nt, Human
cugccagccgagauagcca

SEQ ID NO: 2614609 - RNA, 20 nt, Human
cugccagccagcagccagcu

SEQ ID NO: 2614610 - RNA, 23 nt, Human
cugccagccagcagccagcucuc

SEQ ID NO: 2614611 - RNA, 12 nt, Human
cugccagccugg

SEQ ID NO: 2614612 - RNA, 13 nt, Human
cugccagccuggc

SEQ ID NO: 2614613 - RNA, 14 nt, Human
cugccagccuggcu

SEQ ID NO: 2614614 - RNA, 15 nt, Human
cugccagccuggcuu

SEQ ID NO: 2614615 - RNA, 16 nt, Human
cugccagccuggcuuc

SEQ ID NO: 2614616 - RNA, 19 nt, Human
cugccagccuggcuucugg

SEQ ID NO: 2614617 - RNA, 20 nt, Human
cugccagccuggcuucugga

SEQ ID NO: 2614618 - RNA, 20 nt, Human
cugccacccuggggagaaag

SEQ ID NO: 2614619 - RNA, 16 nt, Human
cugccacccuggggag

SEQ ID NO: 2614620 - RNA, 17 nt, Human
cugccaccauccugcug

SEQ ID NO: 2614621 - RNA, 14 nt, Human
cugccaccauccug

SEQ ID NO: 2614622 - RNA, 17 nt, Human
cugccaccagucacugu

SEQ ID NO: 2614623 - RNA, 14 nt, Human
cugccaccagucac

SEQ ID NO: 2614624 - RNA, 19 nt, Human
cugccaccauccugcugcu

SEQ ID NO: 2614625 - RNA, 14 nt, Human
cugccacccaccuc

SEQ ID NO: 2614626 - RNA, 15 nt, Human
cugccacccaccucc

SEQ ID NO: 2614627 - RNA, 17 nt, Human
cugccacccaccucccu

SEQ ID NO: 2614628 - RNA, 15 nt, Human
cugccacccugggga

SEQ ID NO: 2614629 - RNA, 18 nt, Human
cugccacccaccucccug

SEQ ID NO: 2614630 - RNA, 12 nt, Human
cugccagccaca

SEQ ID NO: 2614631 - RNA, 12 nt, Human
cugccagccagc

SEQ ID NO: 2614632 - RNA, 13 nt, Human
cugccagccagca

SEQ ID NO: 2614633 - RNA, 14 nt, Human
cugccagccagcag

SEQ ID NO: 2614634 - RNA, 15 nt, Human
cugccagccagcagc

SEQ ID NO: 2614635 - RNA, 16 nt, Human
cugccagccagcagcc

SEQ ID NO: 2614636 - RNA, 18 nt, Human
cugccagccagcagccag

SEQ ID NO: 2614637 - RNA, 19 nt, Human
cugccagccagcagccagc

SEQ ID NO: 2614638 - RNA, 12 nt, Human
cugccaccaguc

SEQ ID NO: 2614639 - RNA, 22 nt, Human
cugccaccagagaccguccuca

SEQ ID NO: 2614640 - RNA, 23 nt, Human
cugccaccaggccaccuccccag

SEQ ID NO: 2614641 - RNA, 18 nt, Human
cugccaccaggccaccuc

SEQ ID NO: 2614642 - RNA, 17 nt, Human
cugccaccaggccaccu

SEQ ID NO: 2614643 - RNA, 15 nt, Human
cugccaccaggccac

SEQ ID NO: 2614644 - RNA, 14 nt, Human
cugccaccaggcca

SEQ ID NO: 2614645 - RNA, 21 nt, Human
cugccaccagagaccguccuc

SEQ ID NO: 2614646 - RNA, 15 nt, Human
cugccaccagagacc

SEQ ID NO: 2614647 - RNA, 13 nt, Human
cugccaccaggcc

SEQ ID NO: 2614648 - RNA, 21 nt, Human
cugccacagccuccccugcca

SEQ ID NO: 2614649 - RNA, 22 nt, Human
cugccacagccuccccugccag

SEQ ID NO: 2614650 - RNA, 15 nt, Human
cugccaccaaaggcc

SEQ ID NO: 2614651 - RNA, 12 nt, Human
cugcaggggcuc

SEQ ID NO: 2614652 - RNA, 23 nt, Human
cugccacagccuccccugccagg

SEQ ID NO: 2614653 - RNA, 14 nt, Human
cugccaccagagac

SEQ ID NO: 2614654 - RNA, 18 nt, Human
cugccaccaccagaaagc

SEQ ID NO: 2614655 - RNA, 22 nt, Human
cugccaccaaaggccaggguca

SEQ ID NO: 2614656 - RNA, 18 nt, Human
cugccaccaaaggccagg

SEQ ID NO: 2614657 - RNA, 19 nt, Human
cugccaccacgcccggcua

SEQ ID NO: 2614658 - RNA, 22 nt, Human
cugccacacuucaggcucuucu

SEQ ID NO: 2614659 - RNA, 17 nt, Human
cugccacacuucaggcu

SEQ ID NO: 2614660 - RNA, 14 nt, Human
cugcaggggcucug

SEQ ID NO: 2614661 - RNA, 24 nt, Human
cugccacacgucugacccucucca

SEQ ID NO: 2614662 - RNA, 13 nt, Human
cugccacacuuca

SEQ ID NO: 2614663 - RNA, 22 nt, Human
cugcagggcccucccuuuuccc

SEQ ID NO: 2614664 - RNA, 21 nt, Human
cugcagggccaggacugagcc

SEQ ID NO: 2614665 - RNA, 17 nt, Human
cugcagggccaggacug

SEQ ID NO: 2614666 - RNA, 16 nt, Human
cugcagggccaggacu

SEQ ID NO: 2614667 - RNA, 15 nt, Human
cugcagggccaggac

SEQ ID NO: 2614668 - RNA, 14 nt, Human
cugcagggccagga

SEQ ID NO: 2614669 - RNA, 11 nt, Human
cugcaggggcu

SEQ ID NO: 2614670 - RNA, 23 nt, Human
cugccugagggccccucugccca

SEQ ID NO: 2614671 - RNA, 22 nt, Human
cugccugagggccccucugccc

SEQ ID NO: 2614672 - RNA, 21 nt, Human
cugccugagggccccucugcc

SEQ ID NO: 2614673 - RNA, 20 nt, Human
cugccugagggccccucugc

SEQ ID NO: 2614674 - RNA, 18 nt, Human
cugccugagggccccucu

SEQ ID NO: 2614675 - RNA, 17 nt, Human
cugccugagggccccuc

SEQ ID NO: 2614676 - RNA, 16 nt, Human
cugccugagggccccu

SEQ ID NO: 2614677 - RNA, 15 nt, Human
cugccugagggcccc

SEQ ID NO: 2614678 - RNA, 20 nt, Human
cugccugacauuuggagugu

SEQ ID NO: 2614679 - RNA, 23 nt, Human
cugccugacauuuggaguguucc

SEQ ID NO: 2614680 - RNA, 12 nt, Human
cugccugagcuu

SEQ ID NO: 2614681 - RNA, 16 nt, Human
cugccugauggaccug

SEQ ID NO: 2614682 - RNA, 16 nt, Human
cugccugcccacacag

SEQ ID NO: 2614683 - RNA, 13 nt, Human
cugccugcccacc

SEQ ID NO: 2614684 - RNA, 14 nt, Human
cugccugcccaccc

SEQ ID NO: 2614685 - RNA, 13 nt, Human
cugccugcccaca

SEQ ID NO: 2614686 - RNA, 15 nt, Human
cugccugcccaggcc

SEQ ID NO: 2614687 - RNA, 20 nt, Human
cugccuuaaagucaguaacu

SEQ ID NO: 2614688 - RNA, 22 nt, Human
cugccuuaaaaccaaagagggc

SEQ ID NO: 2614689 - RNA, 19 nt, Human
cugccuuaaaaccaaagag

SEQ ID NO: 2614690 - RNA, 18 nt, Human
cugccuuaaaaccaaaga

SEQ ID NO: 2614691 - RNA, 17 nt, Human
cugccuuaaaaccaaag

SEQ ID NO: 2614692 - RNA, 16 nt, Human
cugccuuaaaaccaaa

SEQ ID NO: 2614693 - RNA, 15 nt, Human
cugccugcccacccg

SEQ ID NO: 2614694 - RNA, 16 nt, Human
cugccugcccacccgu

SEQ ID NO: 2614695 - RNA, 14 nt, Human
cugccugcccaggc

SEQ ID NO: 2614696 - RNA, 13 nt, Human
cugccugcccagg

SEQ ID NO: 2614697 - RNA, 13 nt, Human
cugccucucugca

SEQ ID NO: 2614698 - RNA, 12 nt, Human
cugccucucugc

SEQ ID NO: 2614699 - RNA, 14 nt, Human
cugccucucugcag

SEQ ID NO: 2614700 - RNA, 18 nt, Human
cugccucucgguggccag

SEQ ID NO: 2614701 - RNA, 12 nt, Human
cugccucuuccu

SEQ ID NO: 2614702 - RNA, 22 nt, Human
cugccucuucccccugcuucca

SEQ ID NO: 2614703 - RNA, 21 nt, Human
cugccucuucccccugcuucc

SEQ ID NO: 2614704 - RNA, 15 nt, Human
cugccucuucccccu

SEQ ID NO: 2614705 - RNA, 23 nt, Human
cugccucuuagacuucugcuuuc

SEQ ID NO: 2614706 - RNA, 22 nt, Human
cugccucuuagacuucugcuuu

SEQ ID NO: 2614707 - RNA, 20 nt, Human
cugccucuguuugacaaacc

SEQ ID NO: 2614708 - RNA, 19 nt, Human
cugccucuuagacuucugc

SEQ ID NO: 2614709 - RNA, 13 nt, Human
cugccucuucucu

SEQ ID NO: 2614710 - RNA, 23 nt, Human
cugccugaagucacacagugagu

SEQ ID NO: 2614711 - RNA, 14 nt, Human
cugccucuucucua

SEQ ID NO: 2614712 - RNA, 15 nt, Human
cugcccugggaggca

SEQ ID NO: 2614713 - RNA, 22 nt, Human
cugcccugggaggcagugaugg

SEQ ID NO: 2614714 - RNA, 20 nt, Human
cugcccuggcugcugccccc

SEQ ID NO: 2614715 - RNA, 18 nt, Human
cugcccuggcugcugccc

SEQ ID NO: 2614716 - RNA, 21 nt, Human
cugcccuggcugcugccccca

SEQ ID NO: 2614717 - RNA, 19 nt, Human
cugcccugggauguccaca

SEQ ID NO: 2614718 - RNA, 12 nt, Human
cugcccugggag

SEQ ID NO: 2614719 - RNA, 13 nt, Human
cugcccugggagg

SEQ ID NO: 2614720 - RNA, 11 nt, Human
cugcccuggga

SEQ ID NO: 2614721 - RNA, 16 nt, Human
cugcccugccacuuug

SEQ ID NO: 2614722 - RNA, 15 nt, Human
cugccuaagugcagc

SEQ ID NO: 2614723 - RNA, 13 nt, Human
cugccuauuuuaa

SEQ ID NO: 2614724 - RNA, 18 nt, Human
cugccuaaguggcugcug

SEQ ID NO: 2614725 - RNA, 21 nt, Human
cugccucaaugugaaucagac

SEQ ID NO: 2614726 - RNA, 15 nt, Human
cugccucacagcugg

SEQ ID NO: 2614727 - RNA, 24 nt, Human
cugccucaaugugaaucagacccu

SEQ ID NO: 2614728 - RNA, 21 nt, Human
cugcccugggauguccacaga

SEQ ID NO: 2614729 - RNA, 14 nt, Human
cugccuaaguggcu

SEQ ID NO: 2614730 - RNA, 15 nt, Human
cugccuaaguggcug

SEQ ID NO: 2614731 - RNA, 16 nt, Human
cugccuaaguggcugc

SEQ ID NO: 2614732 - RNA, 13 nt, Human
cugccucagccuc

SEQ ID NO: 2614733 - RNA, 23 nt, Human
cugccucacagcuggccgucacu

SEQ ID NO: 2614734 - RNA, 14 nt, Human
cugccucacuuccu

SEQ ID NO: 2614735 - RNA, 23 nt, Human
cugccucacuuccuacaagagca

SEQ ID NO: 2614736 - RNA, 12 nt, Human
cugccucagccu

SEQ ID NO: 2614737 - RNA, 12 nt, Human
cugccucaggac

SEQ ID NO: 2614738 - RNA, 14 nt, Human
cugccucagcccgc

SEQ ID NO: 2614739 - RNA, 11 nt, Human
cugccucagga

SEQ ID NO: 2614740 - RNA, 13 nt, Human
cugccucaggacu

SEQ ID NO: 2614741 - RNA, 14 nt, Human
cugccucaggacug

SEQ ID NO: 2614742 - RNA, 14 nt, Human
cugccucagccucc

SEQ ID NO: 2614743 - RNA, 21 nt, Human
cugccuccacccucugagcuu

SEQ ID NO: 2614744 - RNA, 20 nt, Human
cugccuccacccucugagcu

SEQ ID NO: 2614745 - RNA, 18 nt, Human
cugccuccacccucugag

SEQ ID NO: 2614746 - RNA, 17 nt, Human
cugccuccacccucuga

SEQ ID NO: 2614747 - RNA, 16 nt, Human
cugccuccacccucug

SEQ ID NO: 2614748 - RNA, 15 nt, Human
cugccuccacccucu

SEQ ID NO: 2614749 - RNA, 12 nt, Human
cugccuccaccc

SEQ ID NO: 2614750 - RNA, 13 nt, Human
cugccucauuuag

SEQ ID NO: 2614751 - RNA, 16 nt, Human
cugccucucccuggcc

SEQ ID NO: 2614752 - RNA, 15 nt, Human
cugccuccacuccca

SEQ ID NO: 2614753 - RNA, 14 nt, Human
cugccuccacuccc

SEQ ID NO: 2614754 - RNA, 13 nt, Human
cugccuccacucc

SEQ ID NO: 2614755 - RNA, 19 nt, Human
cugccucucccuggcccuc

SEQ ID NO: 2614756 - RNA, 17 nt, Human
cugccucucccuggccc

SEQ ID NO: 2614757 - RNA, 18 nt, Human
cugccucucccuggcccu

SEQ ID NO: 2614758 - RNA, 22 nt, Human
cugccucaggaggcaggaccuu

SEQ ID NO: 2614759 - RNA, 23 nt, Human
cugccucaggaggcaggaccuuc

SEQ ID NO: 2614760 - RNA, 17 nt, Human
cugccucagguuccuau

SEQ ID NO: 2614761 - RNA, 13 nt, Human
cugccucagguuc

SEQ ID NO: 2614762 - RNA, 18 nt, Human
cugccucagguuccuaug

SEQ ID NO: 2614763 - RNA, 12 nt, Human
cugccucauuua

SEQ ID NO: 2614764 - RNA, 12 nt, Human
cugccucagguu

SEQ ID NO: 2614765 - RNA, 18 nt, Human
cugcuaaguauuucccag

SEQ ID NO: 2614766 - RNA, 23 nt, Human
cugcuaacuuggagccccagugc

SEQ ID NO: 2614767 - RNA, 21 nt, Human
cugcuaacuuggagccccagu

SEQ ID NO: 2614768 - RNA, 20 nt, Human
cugcuaacuuggagccccag

SEQ ID NO: 2614769 - RNA, 17 nt, Human
cugcuaaguauuuccca

SEQ ID NO: 2614770 - RNA, 13 nt, Human
cugcuccagaccu

SEQ ID NO: 2614771 - RNA, 14 nt, Human
cugcuccagaccug

SEQ ID NO: 2614772 - RNA, 15 nt, Human
cugcuccagaccuga

SEQ ID NO: 2614773 - RNA, 14 nt, Human
cugcuccagcuguu

SEQ ID NO: 2614774 - RNA, 18 nt, Human
cugcguucuugugacaga

SEQ ID NO: 2614775 - RNA, 20 nt, Human
cugcguuuuggaagcucuga

SEQ ID NO: 2614776 - RNA, 15 nt, Human
cugcuaaauaaaauu

SEQ ID NO: 2614777 - RNA, 12 nt, Human
cugcuaaauaaa

SEQ ID NO: 2614778 - RNA, 23 nt, Human
cugcuaaauaaaauuuguugcau

SEQ ID NO: 2614779 - RNA, 16 nt, Human
cugcgguccacccagg

SEQ ID NO: 2614780 - RNA, 17 nt, Human
cugcgguccacccagga

SEQ ID NO: 2614781 - RNA, 18 nt, Human
cugcguggggacagggcu

SEQ ID NO: 2614782 - RNA, 19 nt, Human
cugcgugucaccugugcuu

SEQ ID NO: 2614783 - RNA, 20 nt, Human
cugcguggggacagggcucg

SEQ ID NO: 2614784 - RNA, 20 nt, Human
cugcggaccccagcugugag

SEQ ID NO: 2614785 - RNA, 16 nt, Human
cugcggaccccagcug

SEQ ID NO: 2614786 - RNA, 15 nt, Human
cugcggaccccagcu

SEQ ID NO: 2614787 - RNA, 14 nt, Human
cugcggaccccagc

SEQ ID NO: 2614788 - RNA, 13 nt, Human
cugcggaccccag

SEQ ID NO: 2614789 - RNA, 14 nt, Human
cugcggaaaaggaa

SEQ ID NO: 2614790 - RNA, 17 nt, Human
cugcgcuugcuuuucug

SEQ ID NO: 2614791 - RNA, 21 nt, Human
cugcggaaugaaccacaucuu

SEQ ID NO: 2614792 - RNA, 13 nt, Human
cugcggguggggc

SEQ ID NO: 2614793 - RNA, 23 nt, Human
cugcggaccccagcugugagccu

SEQ ID NO: 2614794 - RNA, 23 nt, Human
cugcgggugaacaaagcagccac

SEQ ID NO: 2614795 - RNA, 21 nt, Human
cugcggguggggcuuggggcu

SEQ ID NO: 2614796 - RNA, 22 nt, Human
cugcgguagaugggagggaggc

SEQ ID NO: 2614797 - RNA, 15 nt, Human
cugcgguccacccag

SEQ ID NO: 2614798 - RNA, 15 nt, Human
cugccuuaucuugca

SEQ ID NO: 2614799 - RNA, 23 nt, Human
cugccuuagucucaguuugugug

SEQ ID NO: 2614800 - RNA, 20 nt, Human
cugccuuagucucaguuugu

SEQ ID NO: 2614801 - RNA, 16 nt, Human
cugccuuagucucagu

SEQ ID NO: 2614802 - RNA, 19 nt, Human
cugccuuagagccaggcac

SEQ ID NO: 2614803 - RNA, 17 nt, Human
cugccuuagagccaggc

SEQ ID NO: 2614804 - RNA, 15 nt, Human
cugccuuagagccag

SEQ ID NO: 2614805 - RNA, 17 nt, Human
cugccuuaucuugcacc

SEQ ID NO: 2614806 - RNA, 13 nt, Human
cugcgcuugcuuu

SEQ ID NO: 2614807 - RNA, 20 nt, Human
cugcggaaugaaccacaucu

SEQ ID NO: 2614808 - RNA, 18 nt, Human
cugcuccuuccuucaccu

SEQ ID NO: 2614809 - RNA, 15 nt, Human
cugcucgccuuagca

SEQ ID NO: 2614810 - RNA, 20 nt, Human
cugcuccuggagccuuugaa

SEQ ID NO: 2614811 - RNA, 19 nt, Human
cugcuccuggagccuuuga

SEQ ID NO: 2614812 - RNA, 15 nt, Human
cugcuccuggagccu

SEQ ID NO: 2614813 - RNA, 13 nt, Human
cugcuccuggagc

SEQ ID NO: 2614814 - RNA, 18 nt, Human
cugcuccucuccccagca

SEQ ID NO: 2614815 - RNA, 17 nt, Human
cugcucgggcccaggcc

SEQ ID NO: 2614816 - RNA, 16 nt, Human
cugcucgggcccaggc

SEQ ID NO: 2614817 - RNA, 15 nt, Human
cugcucgggcccagg

SEQ ID NO: 2614818 - RNA, 14 nt, Human
cugcucgggcccag

SEQ ID NO: 2614819 - RNA, 13 nt, Human
cugcucgggccca

SEQ ID NO: 2614820 - RNA, 16 nt, Human
cugcucgccuuagcac

SEQ ID NO: 2614821 - RNA, 19 nt, Human
cugcucuccuuccuggagc

SEQ ID NO: 2614822 - RNA, 17 nt, Human
cugcucuccuuccugga

SEQ ID NO: 2614823 - RNA, 22 nt, Human
cugcucgggcccaggccaucuu

SEQ ID NO: 2614824 - RNA, 19 nt, Human
cugcucgggcccaggccau

SEQ ID NO: 2614825 - RNA, 16 nt, Human
cugcucuccuuccugg

SEQ ID NO: 2614826 - RNA, 22 nt, Human
cugcucugaauuaguccuugcu

SEQ ID NO: 2614827 - RNA, 21 nt, Human
cugcucugaauuaguccuugc

SEQ ID NO: 2614828 - RNA, 20 nt, Human
cugcucuccuuccuggagcc

SEQ ID NO: 2614829 - RNA, 22 nt, Human
cugcucccugaagccagccuuc

SEQ ID NO: 2614830 - RNA, 21 nt, Human
cugcucccugaagccagccuu

SEQ ID NO: 2614831 - RNA, 20 nt, Human
cugcucccugaagccagccu

SEQ ID NO: 2614832 - RNA, 19 nt, Human
cugcucccugaagccagcc

SEQ ID NO: 2614833 - RNA, 18 nt, Human
cugcucccugaagccagc

SEQ ID NO: 2614834 - RNA, 17 nt, Human
cugcucccugaagccag

SEQ ID NO: 2614835 - RNA, 16 nt, Human
cugcucccugaagcca

SEQ ID NO: 2614836 - RNA, 15 nt, Human
cugcucccugaagcc

SEQ ID NO: 2614837 - RNA, 17 nt, Human
cugcuccucuccaggca

SEQ ID NO: 2614838 - RNA, 16 nt, Human
cugcuccucuccaggc

SEQ ID NO: 2614839 - RNA, 15 nt, Human
cugcuccucuccagg

SEQ ID NO: 2614840 - RNA, 14 nt, Human
cugcuccucuccag

SEQ ID NO: 2614841 - RNA, 17 nt, Human
cugcuccucuccccagc

SEQ ID NO: 2614842 - RNA, 16 nt, Human
cugcuccucuccccag

SEQ ID NO: 2614843 - RNA, 21 nt, Human
cugcuccagaccugauccugg

SEQ ID NO: 2614844 - RNA, 22 nt, Human
cugcuccagaccugauccugga

SEQ ID NO: 2614845 - RNA, 15 nt, Human
cugcuccagcuguuc

SEQ ID NO: 2614846 - RNA, 14 nt, Human
cugcucccugaagc

SEQ ID NO: 2614847 - RNA, 13 nt, Human
cugcuccccuccc

SEQ ID NO: 2614848 - RNA, 17 nt, Human
cugcuccccucccuccu

SEQ ID NO: 2614849 - RNA, 12 nt, Human
cugcagggaaaa

SEQ ID NO: 2614850 - RNA, 22 nt, Human
cugcagggaaaauuauuugcau

SEQ ID NO: 2614851 - RNA, 17 nt, Human
cugcagggacugccagu

SEQ ID NO: 2614852 - RNA, 15 nt, Human
cugcagggacugcca

SEQ ID NO: 2614853 - RNA, 23 nt, Human
cugcagggaaaauuauuugcaua

SEQ ID NO: 2614854 - RNA, 13 nt, Human
cugcagggccagg

SEQ ID NO: 2614855 - RNA, 16 nt, Human
cugcagggccaagcac

SEQ ID NO: 2614856 - RNA, 22 nt, Human
cugcagggaguccgaaagggac

SEQ ID NO: 2614857 - RNA, 20 nt, Human
cugcagccucaaccuccugg

SEQ ID NO: 2614858 - RNA, 19 nt, Human
cugcagccucaaccuccug

SEQ ID NO: 2614859 - RNA, 21 nt, Human
cugcaggcccuggccuccccu

SEQ ID NO: 2614860 - RNA, 22 nt, Human
cugcagccucaaccuccugggc

SEQ ID NO: 2614861 - RNA, 16 nt, Human
cugcagccaggccacu

SEQ ID NO: 2614862 - RNA, 17 nt, Human
cugcagccaggccacug

SEQ ID NO: 2614863 - RNA, 22 nt, Human
cugcagccaggccacuggcccc

SEQ ID NO: 2614864 - RNA, 23 nt, Human
cugcagccaggccacuggccccu

SEQ ID NO: 2614865 - RNA, 16 nt, Human
cugcagcccagggacc

SEQ ID NO: 2614866 - RNA, 12 nt, Human
cugcagcccagg

SEQ ID NO: 2614867 - RNA, 23 nt, Human
cugcagccagcccagcccagcug

SEQ ID NO: 2614868 - RNA, 24 nt, Human
cugcagcccggcgccaccauccug

SEQ ID NO: 2614869 - RNA, 11 nt, Human
cugcagccuca

SEQ ID NO: 2614870 - RNA, 17 nt, Human
cugcagauuugggcugg

SEQ ID NO: 2614871 - RNA, 15 nt, Human
cugcagccaggccac

SEQ ID NO: 2614872 - RNA, 17 nt, Human
cugcagaguuuccaaaa

SEQ ID NO: 2614873 - RNA, 23 nt, Human
cugcagaggucugugcugaggcc

SEQ ID NO: 2614874 - RNA, 22 nt, Human
cugcagaggucugugcugaggc

SEQ ID NO: 2614875 - RNA, 22 nt, Human
cugcagaggggcaggcccugca

SEQ ID NO: 2614876 - RNA, 21 nt, Human
cugcagaggggcaggcccugc

SEQ ID NO: 2614877 - RNA, 19 nt, Human
cugcagaggggcuuucugg

SEQ ID NO: 2614878 - RNA, 20 nt, Human
cugcagaggggcuuucugga

SEQ ID NO: 2614879 - RNA, 22 nt, Human
cugcagaggggcuuucuggaga

SEQ ID NO: 2614880 - RNA, 21 nt, Human
cugcagaggucugugcugagg

SEQ ID NO: 2614881 - RNA, 19 nt, Human
cugcagaggucugugcuga

SEQ ID NO: 2614882 - RNA, 18 nt, Human
cugcagaggucugugcug

SEQ ID NO: 2614883 - RNA, 17 nt, Human
cugcagaggucugugcu

SEQ ID NO: 2614884 - RNA, 16 nt, Human
cugcagaggucugugc

SEQ ID NO: 2614885 - RNA, 23 nt, Human
cugcagaggggcaggcccugcac

SEQ ID NO: 2614886 - RNA, 23 nt, Human
cugcagaggggcuuucuggagag

SEQ ID NO: 2614887 - RNA, 20 nt, Human
cugcacccuccacccugucc

SEQ ID NO: 2614888 - RNA, 18 nt, Human
cugcacccuccacccugu

SEQ ID NO: 2614889 - RNA, 17 nt, Human
cugcacccuccacccug

SEQ ID NO: 2614890 - RNA, 16 nt, Human
cugcacccuccacccu

SEQ ID NO: 2614891 - RNA, 19 nt, Human
cugcaccggcuggccuggc

SEQ ID NO: 2614892 - RNA, 18 nt, Human
cugcaccggcuggccugg

SEQ ID NO: 2614893 - RNA, 17 nt, Human
cugcaccggcuggccug

SEQ ID NO: 2614894 - RNA, 17 nt, Human
cugcacuugcagacucu

SEQ ID NO: 2614895 - RNA, 16 nt, Human
cugcacuugcagacuc

SEQ ID NO: 2614896 - RNA, 19 nt, Human
cugcacuuauacccaugaa

SEQ ID NO: 2614897 - RNA, 21 nt, Human
cugcacccuccacccuguccc

SEQ ID NO: 2614898 - RNA, 16 nt, Human
cugcacuuacuugcuu

SEQ ID NO: 2614899 - RNA, 17 nt, Human
cugcacccucccuccga

SEQ ID NO: 2614900 - RNA, 15 nt, Human
cugcacuuacuugcu

SEQ ID NO: 2614901 - RNA, 14 nt, Human
cugcacuugcagac

SEQ ID NO: 2614902 - RNA, 12 nt, Human
cugcagagcugc

SEQ ID NO: 2614903 - RNA, 21 nt, Human
cugcagagcugcgggcugggu

SEQ ID NO: 2614904 - RNA, 19 nt, Human
cugcagaggggcaggcccu

SEQ ID NO: 2614905 - RNA, 17 nt, Human
cugcagaggggcaggcc

SEQ ID NO: 2614906 - RNA, 15 nt, Human
cugcagaggggcagg

SEQ ID NO: 2614907 - RNA, 14 nt, Human
cugcagaggggcag

SEQ ID NO: 2614908 - RNA, 13 nt, Human
cugcagaggggca

SEQ ID NO: 2614909 - RNA, 21 nt, Human
cugcagagcagugggccuggc

SEQ ID NO: 2614910 - RNA, 23 nt, Human
cugcagagcagugggccuggcca

SEQ ID NO: 2614911 - RNA, 18 nt, Human
cugcagagcagugggccu

SEQ ID NO: 2614912 - RNA, 20 nt, Human
cugcagagcaggaaacauga

SEQ ID NO: 2614913 - RNA, 13 nt, Human
cugcagaagacag

SEQ ID NO: 2614914 - RNA, 20 nt, Human
cugcagaacguauuggucca

SEQ ID NO: 2614915 - RNA, 21 nt, Human
cugcagaacguauugguccag

SEQ ID NO: 2614916 - RNA, 23 nt, Human
cugcagaacguauugguccagcu

SEQ ID NO: 2614917 - RNA, 23 nt, Human
cugcagaagacaguauggcagcu

SEQ ID NO: 2614918 - RNA, 14 nt, Human
cugcagagagaagc

SEQ ID NO: 2614919 - RNA, 13 nt, Human
cugcagaaggaaa

SEQ ID NO: 2614920 - RNA, 17 nt, Human
cugcagagacagagagg

SEQ ID NO: 2614921 - RNA, 16 nt, Human
cugcaauugcuuagga

SEQ ID NO: 2614922 - RNA, 15 nt, Human
cugcaauugcuuagg

SEQ ID NO: 2614923 - RNA, 20 nt, Human
cugcaauuccccucugcugc

SEQ ID NO: 2614924 - RNA, 17 nt, Human
cugcaauuccccucugc

SEQ ID NO: 2614925 - RNA, 16 nt, Human
cugcaauuccccucug

SEQ ID NO: 2614926 - RNA, 15 nt, Human
cugcaauuccccucu

SEQ ID NO: 2614927 - RNA, 23 nt, Human
cugcaauuaaagugauacugaaa

SEQ ID NO: 2614928 - RNA, 16 nt, Human
cugcaauguuuuccuu

SEQ ID NO: 2614929 - RNA, 15 nt, Human
cugcaauguuuuccu

SEQ ID NO: 2614930 - RNA, 18 nt, Human
cugcaaugugggcagaga

SEQ ID NO: 2614931 - RNA, 21 nt, Human
cugcaaugggcacugggauga

SEQ ID NO: 2614932 - RNA, 17 nt, Human
cugcaaugggcacuggg

SEQ ID NO: 2614933 - RNA, 23 nt, Human
cugcaauccugucuuucugagca

SEQ ID NO: 2614934 - RNA, 22 nt, Human
cugcaaucuucucagaaggcaa

SEQ ID NO: 2614935 - RNA, 18 nt, Human
cugcaaugaagucucuga

SEQ ID NO: 2614936 - RNA, 21 nt, Human
cugcaaugaagucucugaagu

SEQ ID NO: 2614937 - RNA, 18 nt, Human
cugcaauuucauaugcug

SEQ ID NO: 2614938 - RNA, 20 nt, Human
cugcaauuucauaugcugua

SEQ ID NO: 2614939 - RNA, 13 nt, Human
cugcacaaagccc

SEQ ID NO: 2614940 - RNA, 20 nt, Human
cugcacaaagcccuuccaug

SEQ ID NO: 2614941 - RNA, 18 nt, Human
cugcacaaagcccuucca

SEQ ID NO: 2614942 - RNA, 20 nt, Human
cugcaauugcuuaggauguu

SEQ ID NO: 2614943 - RNA, 16 nt, Human
cugcacaaacucacca

SEQ ID NO: 2614944 - RNA, 21 nt, Human
cugcacaaagcccuuccaugu

SEQ ID NO: 2614945 - RNA, 16 nt, Human
cugcaauccugucuuu

SEQ ID NO: 2614946 - RNA, 15 nt, Human
cugcaauccugucuu

SEQ ID NO: 2614947 - RNA, 17 nt, Human
cugcaaacgcugccugc

SEQ ID NO: 2614948 - RNA, 15 nt, Human
cugcaaacgcugccu

SEQ ID NO: 2614949 - RNA, 16 nt, Human
cugcaaacgcugccug

SEQ ID NO: 2614950 - RNA, 20 nt, Human
cugcaaaccugaccccugcu

SEQ ID NO: 2614951 - RNA, 13 nt, Human
cugcaaacgcugc

SEQ ID NO: 2614952 - RNA, 18 nt, Human
cugcaaaccugaccccug

SEQ ID NO: 2614953 - RNA, 23 nt, Human
cugcaaaauuugaugccaggaca

SEQ ID NO: 2614954 - RNA, 23 nt, Human
cugcaaacaugggguuggcuggg

SEQ ID NO: 2614955 - RNA, 22 nt, Human
cugcaaacaccaacauguuggg

SEQ ID NO: 2614956 - RNA, 22 nt, Human
cugcaaaaugaggaauguauau

SEQ ID NO: 2614957 - RNA, 11 nt, Human
cugcaaaauuu

SEQ ID NO: 2614958 - RNA, 13 nt, Human
cugcaaaauuuua

SEQ ID NO: 2614959 - RNA, 21 nt, Human
cugauucucagggucucugcu

SEQ ID NO: 2614960 - RNA, 20 nt, Human
cugauucucagggucucugc

SEQ ID NO: 2614961 - RNA, 18 nt, Human
cugauucucagggucucu

SEQ ID NO: 2614962 - RNA, 17 nt, Human
cugauucucagggucuc

SEQ ID NO: 2614963 - RNA, 15 nt, Human
cugauucucaggguc

SEQ ID NO: 2614964 - RNA, 14 nt, Human
cugauucucagggu

SEQ ID NO: 2614965 - RNA, 23 nt, Human
cugauucggcugucucagacucu

SEQ ID NO: 2614966 - RNA, 17 nt, Human
cugauucggcugucuca

SEQ ID NO: 2614967 - RNA, 17 nt, Human
cugcaaaaggacucuca

SEQ ID NO: 2614968 - RNA, 16 nt, Human
cugauuggcucaccca

SEQ ID NO: 2614969 - RNA, 14 nt, Human
cugauuggcucacc

SEQ ID NO: 2614970 - RNA, 15 nt, Human
cugauuggacauuuu

SEQ ID NO: 2614971 - RNA, 18 nt, Human
cugcaaaaggacucucag

SEQ ID NO: 2614972 - RNA, 21 nt, Human
cugcaaaaugaggaauguaua

SEQ ID NO: 2614973 - RNA, 19 nt, Human
cugcaaaaugaggaaugua

SEQ ID NO: 2614974 - RNA, 12 nt, Human
cugcaaaaugag

SEQ ID NO: 2614975 - RNA, 14 nt, Human
cugcaaaaugagac

SEQ ID NO: 2614976 - RNA, 20 nt, Human
cugcacagggcagcugggcc

SEQ ID NO: 2614977 - RNA, 19 nt, Human
cugcacagggcagcugggc

SEQ ID NO: 2614978 - RNA, 18 nt, Human
cugcacagggcagcuggg

SEQ ID NO: 2614979 - RNA, 17 nt, Human
cugcacagggcagcugg

SEQ ID NO: 2614980 - RNA, 22 nt, Human
cugcacagggcagcugggccca

SEQ ID NO: 2614981 - RNA, 21 nt, Human
cugcacagggcagcugggccc

SEQ ID NO: 2614982 - RNA, 18 nt, Human
cugcacagugcaucucag

SEQ ID NO: 2614983 - RNA, 16 nt, Human
cugcacagggcagcug

SEQ ID NO: 2614984 - RNA, 19 nt, Human
cugcacagcggccccugca

SEQ ID NO: 2614985 - RNA, 13 nt, Human
cugcacagcggcc

SEQ ID NO: 2614986 - RNA, 18 nt, Human
cugcacaagcugcacccu

SEQ ID NO: 2614987 - RNA, 13 nt, Human
cugcacaagcugc

SEQ ID NO: 2614988 - RNA, 14 nt, Human
cugcacaagcugca

SEQ ID NO: 2614989 - RNA, 15 nt, Human
cugcacaagcugcac

SEQ ID NO: 2614990 - RNA, 16 nt, Human
cugcacaagcugcacc

SEQ ID NO: 2614991 - RNA, 17 nt, Human
cugcacccucaggcagg

SEQ ID NO: 2614992 - RNA, 19 nt, Human
cugcacccccuccugcugc

SEQ ID NO: 2614993 - RNA, 18 nt, Human
cugcacccccuccugcug

SEQ ID NO: 2614994 - RNA, 17 nt, Human
cugcacccccuccugcu

SEQ ID NO: 2614995 - RNA, 16 nt, Human
cugcacccccuccugc

SEQ ID NO: 2614996 - RNA, 14 nt, Human
cugcacccccuccu

SEQ ID NO: 2614997 - RNA, 13 nt, Human
cugcacccccucc

SEQ ID NO: 2614998 - RNA, 16 nt, Human
cugcaccccccugggc

SEQ ID NO: 2614999 - RNA, 17 nt, Human
cugcaccccccugggcu

SEQ ID NO: 2615000 - RNA, 15 nt, Human
cugcacccuccaccc

SEQ ID NO: 2615001 - RNA, 14 nt, Human
cugcacccuccacc

SEQ ID NO: 2615002 - RNA, 13 nt, Human
cugcacccuccac

SEQ ID NO: 2615003 - RNA, 12 nt, Human
cugcacccucca

SEQ ID NO: 2615004 - RNA, 16 nt, Human
cugcacccucaggcag

SEQ ID NO: 2615005 - RNA, 18 nt, Human
cugcacccucaggcaggu

SEQ ID NO: 2615006 - RNA, 23 nt, Human
cugcaccaacccagccgcugccc

SEQ ID NO: 2615007 - RNA, 21 nt, Human
cugcaccaacccagccgcugc

SEQ ID NO: 2615008 - RNA, 17 nt, Human
cugcaccaacccagccg

SEQ ID NO: 2615009 - RNA, 16 nt, Human
cugcaccaacccagcc

SEQ ID NO: 2615010 - RNA, 13 nt, Human
cugcaccaaccca

SEQ ID NO: 2615011 - RNA, 21 nt, Human
cugcacauuaaggagaaaucu

SEQ ID NO: 2615012 - RNA, 21 nt, Human
cugcacagugcaucucagccc

SEQ ID NO: 2615013 - RNA, 13 nt, Human
cugcacccagggg

SEQ ID NO: 2615014 - RNA, 12 nt, Human
cugcacccaggg

SEQ ID NO: 2615015 - RNA, 14 nt, Human
cugcaccccccugg

SEQ ID NO: 2615016 - RNA, 15 nt, Human
cugcaccccccuggg

SEQ ID NO: 2615017 - RNA, 11 nt, Human
cugcacccagg

SEQ ID NO: 2615018 - RNA, 17 nt, Human
cugagucguacagaaag

SEQ ID NO: 2615019 - RNA, 18 nt, Human
cugagucguacagaaagc

SEQ ID NO: 2615020 - RNA, 19 nt, Human
cugagucguacagaaagcu

SEQ ID NO: 2615021 - RNA, 20 nt, Human
cugagucguacagaaagcug

SEQ ID NO: 2615022 - RNA, 15 nt, Human
cugagucucccaagg

SEQ ID NO: 2615023 - RNA, 21 nt, Human
cugagucguacagaaagcugc

SEQ ID NO: 2615024 - RNA, 23 nt, Human
cugagucguacagaaagcugccu

SEQ ID NO: 2615025 - RNA, 22 nt, Human
cugaguccuuaaacagggcauc

SEQ ID NO: 2615026 - RNA, 21 nt, Human
cugaguccuuaaacagggcau

SEQ ID NO: 2615027 - RNA, 15 nt, Human
cugaguccuuaaaca

SEQ ID NO: 2615028 - RNA, 16 nt, Human
cugagggcuuccuuug

SEQ ID NO: 2615029 - RNA, 14 nt, Human
cugagggcuuccuu

SEQ ID NO: 2615030 - RNA, 16 nt, Human
cugagggcgaggggag

SEQ ID NO: 2615031 - RNA, 22 nt, Human
cugagggccccucugcccagcu

SEQ ID NO: 2615032 - RNA, 21 nt, Human
cugagggccccucugcccagc

SEQ ID NO: 2615033 - RNA, 20 nt, Human
cugagggccccucugcccag

SEQ ID NO: 2615034 - RNA, 19 nt, Human
cugagggccccucugccca

SEQ ID NO: 2615035 - RNA, 18 nt, Human
cugagggccccucugccc

SEQ ID NO: 2615036 - RNA, 17 nt, Human
cugagggccccucugcc

SEQ ID NO: 2615037 - RNA, 16 nt, Human
cugagggccccucugc

SEQ ID NO: 2615038 - RNA, 15 nt, Human
cugagggccccucug

SEQ ID NO: 2615039 - RNA, 13 nt, Human
cugagggccccuc

SEQ ID NO: 2615040 - RNA, 16 nt, Human
cugagggccacacuau

SEQ ID NO: 2615041 - RNA, 15 nt, Human
cugagggccacacua

SEQ ID NO: 2615042 - RNA, 14 nt, Human
cugagggccacacu

SEQ ID NO: 2615043 - RNA, 13 nt, Human
cugagggccacac

SEQ ID NO: 2615044 - RNA, 23 nt, Human
cugagggcagaaagguucugccc

SEQ ID NO: 2615045 - RNA, 20 nt, Human
cugagggcagaaagguucug

SEQ ID NO: 2615046 - RNA, 21 nt, Human
cugagggauggacugaugcuu

SEQ ID NO: 2615047 - RNA, 16 nt, Human
cugagggcagucgaua

SEQ ID NO: 2615048 - RNA, 19 nt, Human
cugagggaccaacugggcc

SEQ ID NO: 2615049 - RNA, 20 nt, Human
cugagggaccaacugggccc

SEQ ID NO: 2615050 - RNA, 21 nt, Human
cugagggaccaacugggccca

SEQ ID NO: 2615051 - RNA, 13 nt, Human
cugagggaccagc

SEQ ID NO: 2615052 - RNA, 20 nt, Human
cugagggauggacugaugcu

SEQ ID NO: 2615053 - RNA, 14 nt, Human
cugacccagugaga

SEQ ID NO: 2615054 - RNA, 23 nt, Human
cugacccagugcccccacugacc

SEQ ID NO: 2615055 - RNA, 20 nt, Human
cugacccagugcccccacug

SEQ ID NO: 2615056 - RNA, 21 nt, Human
cugacccagugcccccacuga

SEQ ID NO: 2615057 - RNA, 14 nt, Human
cugaggcuuuggau

SEQ ID NO: 2615058 - RNA, 15 nt, Human
cugaggcuuuggauu

SEQ ID NO: 2615059 - RNA, 17 nt, Human
cugaggcuuuggauuug

SEQ ID NO: 2615060 - RNA, 18 nt, Human
cugaggcuuuggauuuga

SEQ ID NO: 2615061 - RNA, 23 nt, Human
cugagggaaagcccagaaaagga

SEQ ID NO: 2615062 - RNA, 19 nt, Human
cugagggaaagcccagaaa

SEQ ID NO: 2615063 - RNA, 21 nt, Human
cugaggcuuuggauuugacau

SEQ ID NO: 2615064 - RNA, 12 nt, Human
cugagggaccaa

SEQ ID NO: 2615065 - RNA, 16 nt, Human
cugagggaccaacugg

SEQ ID NO: 2615066 - RNA, 18 nt, Human
cugagggaccaacugggc

SEQ ID NO: 2615067 - RNA, 13 nt, Human
cugacccagugcc

SEQ ID NO: 2615068 - RNA, 18 nt, Human
cugacccagugcccccac

SEQ ID NO: 2615069 - RNA, 12 nt, Human
cugacccagugc

SEQ ID NO: 2615070 - RNA, 13 nt, Human
cugacccagugag

SEQ ID NO: 2615071 - RNA, 18 nt, Human
cugacccagucccugggg

SEQ ID NO: 2615072 - RNA, 11 nt, Human
cugacccaguc

SEQ ID NO: 2615073 - RNA, 23 nt, Human
cugacccaggccgcagcucuugc

SEQ ID NO: 2615074 - RNA, 12 nt, Human
cugacccagucc

SEQ ID NO: 2615075 - RNA, 13 nt, Human
cugacccaguccc

SEQ ID NO: 2615076 - RNA, 14 nt, Human
cugacccagucccu

SEQ ID NO: 2615077 - RNA, 15 nt, Human
cugacccagucccug

SEQ ID NO: 2615078 - RNA, 16 nt, Human
cugacccagucccugg

SEQ ID NO: 2615079 - RNA, 17 nt, Human
cugacccagucccuggg

SEQ ID NO: 2615080 - RNA, 21 nt, Human
cugaccaugcucaucugcugg

SEQ ID NO: 2615081 - RNA, 20 nt, Human
cugaccaugcucaucugcug

SEQ ID NO: 2615082 - RNA, 17 nt, Human
cugacccaggccgcagc

SEQ ID NO: 2615083 - RNA, 21 nt, Human
cugacccaggccgcagcucuu

SEQ ID NO: 2615084 - RNA, 19 nt, Human
cugacccaggccgcagcuc

SEQ ID NO: 2615085 - RNA, 10 nt, Human
cugacccagu

SEQ ID NO: 2615086 - RNA, 22 nt, Human
cugaccaugcucaucugcuggu

SEQ ID NO: 2615087 - RNA, 18 nt, Human
cugacccaggccgcagcu

SEQ ID NO: 2615088 - RNA, 18 nt, Human
cugaccauuucagggguc

SEQ ID NO: 2615089 - RNA, 16 nt, Human
cugagucugaaggcug

SEQ ID NO: 2615090 - RNA, 15 nt, Human
cugagucugaaggcu

SEQ ID NO: 2615091 - RNA, 14 nt, Human
cugagucugaaggc

SEQ ID NO: 2615092 - RNA, 13 nt, Human
cugagucugaagg

SEQ ID NO: 2615093 - RNA, 14 nt, Human
cugagucuccugug

SEQ ID NO: 2615094 - RNA, 13 nt, Human
cugagucuccugu

SEQ ID NO: 2615095 - RNA, 17 nt, Human
cugagucucccaaggcu

SEQ ID NO: 2615096 - RNA, 16 nt, Human
cugagucucccaaggc

SEQ ID NO: 2615097 - RNA, 17 nt, Human
cugagugaaccuguaua

SEQ ID NO: 2615098 - RNA, 16 nt, Human
cugagucuccugugcc

SEQ ID NO: 2615099 - RNA, 15 nt, Human
cugagucuccugugc

SEQ ID NO: 2615100 - RNA, 18 nt, Human
cugagugaaccuguauaa

SEQ ID NO: 2615101 - RNA, 14 nt, Human
cugagugccuuuug

SEQ ID NO: 2615102 - RNA, 16 nt, Human
cugagugccuggccaa

SEQ ID NO: 2615103 - RNA, 14 nt, Human
cugagugccuggcc

SEQ ID NO: 2615104 - RNA, 13 nt, Human
cugagugccuggc

SEQ ID NO: 2615105 - RNA, 19 nt, Human
cugagugcagccguuugag

SEQ ID NO: 2615106 - RNA, 19 nt, Human
cugauaaaaccauguagaa

SEQ ID NO: 2615107 - RNA, 23 nt, Human
cugauaaaaccauguagaaaauu

SEQ ID NO: 2615108 - RNA, 13 nt, Human
cugauaaagauga

SEQ ID NO: 2615109 - RNA, 22 nt, Human
cugagugggggaucacagccuc

SEQ ID NO: 2615110 - RNA, 18 nt, Human
cugaguggaucuccaagg

SEQ ID NO: 2615111 - RNA, 22 nt, Human
cugaguggacuggaguggagca

SEQ ID NO: 2615112 - RNA, 21 nt, Human
cugaguggacuggaguggagc

SEQ ID NO: 2615113 - RNA, 19 nt, Human
cugagugccuggccaaagg

SEQ ID NO: 2615114 - RNA, 16 nt, Human
cugaguggacuggagu

SEQ ID NO: 2615115 - RNA, 15 nt, Human
cugagugccuuuugg

SEQ ID NO: 2615116 - RNA, 16 nt, Human
cugagugccuuuuggu

SEQ ID NO: 2615117 - RNA, 16 nt, Human
cugaguggcaggggac

SEQ ID NO: 2615118 - RNA, 13 nt, Human
cugaguggcaggg

SEQ ID NO: 2615119 - RNA, 18 nt, Human
cugaguggcaggggacag

SEQ ID NO: 2615120 - RNA, 22 nt, Human
cugaugucaauuucuguguugc

SEQ ID NO: 2615121 - RNA, 20 nt, Human
cugaugucaauuucuguguu

SEQ ID NO: 2615122 - RNA, 19 nt, Human
cugaugucaauuucugugu

SEQ ID NO: 2615123 - RNA, 18 nt, Human
cugaugucaauuucugug

SEQ ID NO: 2615124 - RNA, 22 nt, Human
cugaucuccauggcuuccuccu

SEQ ID NO: 2615125 - RNA, 15 nt, Human
cugauguccucacca

SEQ ID NO: 2615126 - RNA, 13 nt, Human
cugauguguacau

SEQ ID NO: 2615127 - RNA, 15 nt, Human
cugauguucagugua

SEQ ID NO: 2615128 - RNA, 14 nt, Human
cugauguucagugu

SEQ ID NO: 2615129 - RNA, 20 nt, Human
cugauguuacaucacagugu

SEQ ID NO: 2615130 - RNA, 13 nt, Human
cugauguucagug

SEQ ID NO: 2615131 - RNA, 12 nt, Human
cugaucccucua

SEQ ID NO: 2615132 - RNA, 13 nt, Human
cugaucccucuac

SEQ ID NO: 2615133 - RNA, 19 nt, Human
cugauccuggaggcccagu

SEQ ID NO: 2615134 - RNA, 20 nt, Human
cugauccugugaaguaagga

SEQ ID NO: 2615135 - RNA, 21 nt, Human
cugauccuggaggcccaguuc

SEQ ID NO: 2615136 - RNA, 23 nt, Human
cugauccugugaaguaaggaugu

SEQ ID NO: 2615137 - RNA, 20 nt, Human
cugaucgccaaccuuucccc

SEQ ID NO: 2615138 - RNA, 21 nt, Human
cugaucgugacgcugaauaaa

SEQ ID NO: 2615139 - RNA, 14 nt, Human
cugaucgugacgcu

SEQ ID NO: 2615140 - RNA, 22 nt, Human
cugaucgugacgcugaauaaau

SEQ ID NO: 2615141 - RNA, 15 nt, Human
cugaucgugcuaaau

SEQ ID NO: 2615142 - RNA, 17 nt, Human
cugaucgugcuaaauuu

SEQ ID NO: 2615143 - RNA, 19 nt, Human
cugaucgugcuaaauuuuc

SEQ ID NO: 2615144 - RNA, 20 nt, Human
cugaucuccauggcuuccuc

SEQ ID NO: 2615145 - RNA, 14 nt, Human
cugaucuccauggc

SEQ ID NO: 2615146 - RNA, 13 nt, Human
cugaucuccaugg

SEQ ID NO: 2615147 - RNA, 21 nt, Human
cugaucgugcuaaauuuucag

SEQ ID NO: 2615148 - RNA, 19 nt, Human
cugauagggauacaugcuc

SEQ ID NO: 2615149 - RNA, 17 nt, Human
cugauagggauacaugc

SEQ ID NO: 2615150 - RNA, 17 nt, Human
cugauaggccaaguuug

SEQ ID NO: 2615151 - RNA, 22 nt, Human
cugauagcucuuuggcagucua

SEQ ID NO: 2615152 - RNA, 15 nt, Human
cugauaguuacuguu

SEQ ID NO: 2615153 - RNA, 15 nt, Human
cugauagcucuuugg

SEQ ID NO: 2615154 - RNA, 21 nt, Human
cugauaaagaugagugagcau

SEQ ID NO: 2615155 - RNA, 14 nt, Human
cugauaaagaaaga

SEQ ID NO: 2615156 - RNA, 15 nt, Human
cugauacccagagca

SEQ ID NO: 2615157 - RNA, 12 nt, Human
cugauaccucaa

SEQ ID NO: 2615158 - RNA, 20 nt, Human
cugauccagcccugaguucc

SEQ ID NO: 2615159 - RNA, 21 nt, Human
cugauccagagcacagaucug

SEQ ID NO: 2615160 - RNA, 15 nt, Human
cugauccagagcaca

SEQ ID NO: 2615161 - RNA, 13 nt, Human
cugauccagagca

SEQ ID NO: 2615162 - RNA, 16 nt, Human
cugaucaugcauuguu

SEQ ID NO: 2615163 - RNA, 18 nt, Human
cugauccagccucucccc

SEQ ID NO: 2615164 - RNA, 22 nt, Human
cugauaguuacuguugugaccu

SEQ ID NO: 2615165 - RNA, 21 nt, Human
cugauaguuacuguugugacc

SEQ ID NO: 2615166 - RNA, 19 nt, Human
cugauaguuacuguuguga

SEQ ID NO: 2615167 - RNA, 18 nt, Human
cugauaguuacuguugug

SEQ ID NO: 2615168 - RNA, 17 nt, Human
cugauaguuacuguugu

SEQ ID NO: 2615169 - RNA, 16 nt, Human
cugauaguuacuguug

SEQ ID NO: 2615170 - RNA, 22 nt, Human
cugaucagugggccuccaagga

SEQ ID NO: 2615171 - RNA, 19 nt, Human
cugaucagucuaagauggg

SEQ ID NO: 2615172 - RNA, 12 nt, Human
cugaucaugcau

SEQ ID NO: 2615173 - RNA, 14 nt, Human
cugaucaugcauug

SEQ ID NO: 2615174 - RNA, 15 nt, Human
cugaucaugcauugu

SEQ ID NO: 2615175 - RNA, 17 nt, Human
cugaucaugcauuguug

SEQ ID NO: 2615176 - RNA, 13 nt, Human
cugauucacugca

SEQ ID NO: 2615177 - RNA, 18 nt, Human
cugauucaacuaaaaaaa

SEQ ID NO: 2615178 - RNA, 15 nt, Human
cugauucaacuaaaa

SEQ ID NO: 2615179 - RNA, 17 nt, Human
cugauucaacuaaaaaa

SEQ ID NO: 2615180 - RNA, 15 nt, Human
cugauucccaagcuc

SEQ ID NO: 2615181 - RNA, 18 nt, Human
cugauucccaagcucugc

SEQ ID NO: 2615182 - RNA, 17 nt, Human
cugauucccaagcucug

SEQ ID NO: 2615183 - RNA, 20 nt, Human
cugauucccaagcucugcuc

SEQ ID NO: 2615184 - RNA, 19 nt, Human
cugauucccaagcucugcu

SEQ ID NO: 2615185 - RNA, 22 nt, Human
cugauucccaagcucugcuccu

SEQ ID NO: 2615186 - RNA, 16 nt, Human
cugauucggcugucuc

SEQ ID NO: 2615187 - RNA, 18 nt, Human
cugauucacugcauggcu

SEQ ID NO: 2615188 - RNA, 15 nt, Human
cugauucacugcaug

SEQ ID NO: 2615189 - RNA, 20 nt, Human
cugauucacugcauggcucc

SEQ ID NO: 2615190 - RNA, 22 nt, Human
cugauucauaauaaauaucugu

SEQ ID NO: 2615191 - RNA, 13 nt, Human
cugauguuccuag

SEQ ID NO: 2615192 - RNA, 18 nt, Human
cugauguuccuagugaaa

SEQ ID NO: 2615193 - RNA, 20 nt, Human
cugauguuccuagugaaaga

SEQ ID NO: 2615194 - RNA, 21 nt, Human
cugauguuccuagugaaagag

SEQ ID NO: 2615195 - RNA, 19 nt, Human
cugauuagaaaugaccaau

SEQ ID NO: 2615196 - RNA, 14 nt, Human
cugauuacaccagc

SEQ ID NO: 2615197 - RNA, 13 nt, Human
cugauuagaaaug

SEQ ID NO: 2615198 - RNA, 14 nt, Human
cugauucaacuaaa

SEQ ID NO: 2615199 - RNA, 11 nt, Human
cugauuagaaa

SEQ ID NO: 2615200 - RNA, 23 nt, Human
cugauuagaaaugaccaauauua

SEQ ID NO: 2615201 - RNA, 15 nt, Human
cugauguuggaagag

SEQ ID NO: 2615202 - RNA, 21 nt, Human
cugauuaaguugucuaaacaa

SEQ ID NO: 2615203 - RNA, 16 nt, Human
cugauuacacaaaaca

SEQ ID NO: 2615204 - RNA, 21 nt, Human
cugauguucaguguaauuucu

SEQ ID NO: 2615205 - RNA, 19 nt, Human
cugauguucaguguaauuu

SEQ ID NO: 2615206 - RNA, 17 nt, Human
cugauguucaguguaau

SEQ ID NO: 2615207 - RNA, 16 nt, Human
cugauguucaguguaa

SEQ ID NO: 2615208 - RNA, 22 nt, Human
cugauguugagggaacagacag

SEQ ID NO: 2615209 - RNA, 16 nt, Human
cuccugacccaguccc

SEQ ID NO: 2615210 - RNA, 17 nt, Human
cuccucuuuccucucuu

SEQ ID NO: 2615211 - RNA, 15 nt, Human
cuccucuuuccucuc

SEQ ID NO: 2615212 - RNA, 23 nt, Human
cuccugacccaguccccgugccc

SEQ ID NO: 2615213 - RNA, 14 nt, Human
cuccugaccucagg

SEQ ID NO: 2615214 - RNA, 14 nt, Human
cuccugaccugagg

SEQ ID NO: 2615215 - RNA, 15 nt, Human
cuccugaccugaggc

SEQ ID NO: 2615216 - RNA, 14 nt, Human
cuccugaccuuagg

SEQ ID NO: 2615217 - RNA, 22 nt, Human
cuccugagaccccuggccuccg

SEQ ID NO: 2615218 - RNA, 21 nt, Human
cuccugagaccccuggccucc

SEQ ID NO: 2615219 - RNA, 20 nt, Human
cuccugagaccccuggccuc

SEQ ID NO: 2615220 - RNA, 19 nt, Human
cuccugagaccccuggccu

SEQ ID NO: 2615221 - RNA, 23 nt, Human
cuccugagaccccuggccuccgg

SEQ ID NO: 2615222 - RNA, 18 nt, Human
cuccugagaccccuggcc

SEQ ID NO: 2615223 - RNA, 17 nt, Human
cuccugagaccccuggc

SEQ ID NO: 2615224 - RNA, 15 nt, Human
cuccugagaccccug

SEQ ID NO: 2615225 - RNA, 20 nt, Human
cuccugagaaaaaagguucc

SEQ ID NO: 2615226 - RNA, 16 nt, Human
cuccugaccugaggcu

SEQ ID NO: 2615227 - RNA, 16 nt, Human
cuccugaccugucacc

SEQ ID NO: 2615228 - RNA, 17 nt, Human
cuccugaggacagcugu

SEQ ID NO: 2615229 - RNA, 16 nt, Human
cuccugaggacagcug

SEQ ID NO: 2615230 - RNA, 15 nt, Human
cuccugaggacagcu

SEQ ID NO: 2615231 - RNA, 14 nt, Human
cuccugaggacagc

SEQ ID NO: 2615232 - RNA, 19 nt, Human
cuccugaggacagcugucc

SEQ ID NO: 2615233 - RNA, 18 nt, Human
cuccugaggacagcuguc

SEQ ID NO: 2615234 - RNA, 21 nt, Human
cuccugaggacagcuguccuc

SEQ ID NO: 2615235 - RNA, 17 nt, Human
cuccugaggcuuuggau

SEQ ID NO: 2615236 - RNA, 16 nt, Human
cuccugaggcuuugga

SEQ ID NO: 2615237 - RNA, 16 nt, Human
cuccugaggggcaucu

SEQ ID NO: 2615238 - RNA, 19 nt, Human
cuccugaggggcaucugcc

SEQ ID NO: 2615239 - RNA, 20 nt, Human
cuccugaggggcaucugccc

SEQ ID NO: 2615240 - RNA, 21 nt, Human
cuccugaggggcaucugcccc

SEQ ID NO: 2615241 - RNA, 22 nt, Human
cuccugaggggcaucugccccu

SEQ ID NO: 2615242 - RNA, 14 nt, Human
cuccugcaggcagc

SEQ ID NO: 2615243 - RNA, 13 nt, Human
cuccugcaggcag

SEQ ID NO: 2615244 - RNA, 12 nt, Human
cuccugcaggca

SEQ ID NO: 2615245 - RNA, 22 nt, Human
cuccugaguagcugggauuaca

SEQ ID NO: 2615246 - RNA, 17 nt, Human
cuccugaguagcuggga

SEQ ID NO: 2615247 - RNA, 21 nt, Human
cuccugaguagcuggauuaca

SEQ ID NO: 2615248 - RNA, 18 nt, Human
cuccucuagcuguggggg

SEQ ID NO: 2615249 - RNA, 17 nt, Human
cuccucuagcugugggg

SEQ ID NO: 2615250 - RNA, 19 nt, Human
cuccucuagcugugggggu

SEQ ID NO: 2615251 - RNA, 13 nt, Human
cuccucuaagcca

SEQ ID NO: 2615252 - RNA, 18 nt, Human
cuccucggccuggcuccu

SEQ ID NO: 2615253 - RNA, 16 nt, Human
cuccucggccuggcuc

SEQ ID NO: 2615254 - RNA, 15 nt, Human
cuccucggccuggcu

SEQ ID NO: 2615255 - RNA, 14 nt, Human
cuccucggccuggc

SEQ ID NO: 2615256 - RNA, 20 nt, Human
cuccucggcccccuccaucg

SEQ ID NO: 2615257 - RNA, 19 nt, Human
cuccucggcccccuccauc

SEQ ID NO: 2615258 - RNA, 18 nt, Human
cuccucggcccccuccau

SEQ ID NO: 2615259 - RNA, 17 nt, Human
cuccucgcaagcugggu

SEQ ID NO: 2615260 - RNA, 21 nt, Human
cuccucccuuccuuuucccug

SEQ ID NO: 2615261 - RNA, 15 nt, Human
cuccucccuuccuuu

SEQ ID NO: 2615262 - RNA, 14 nt, Human
cuccucccuuccuu

SEQ ID NO: 2615263 - RNA, 13 nt, Human
cuccucccuuccu

SEQ ID NO: 2615264 - RNA, 22 nt, Human
cuccucccuuccuuuucccugc

SEQ ID NO: 2615265 - RNA, 19 nt, Human
cuccucgcaagcuggguaa

SEQ ID NO: 2615266 - RNA, 13 nt, Human
cuccucucaguac

SEQ ID NO: 2615267 - RNA, 13 nt, Human
cuccucucagccc

SEQ ID NO: 2615268 - RNA, 18 nt, Human
cuccucuugccacugccu

SEQ ID NO: 2615269 - RNA, 11 nt, Human
cuccucuccag

SEQ ID NO: 2615270 - RNA, 19 nt, Human
cuccucuugccacugccuc

SEQ ID NO: 2615271 - RNA, 22 nt, Human
cuccucuuuccucucuuuguuc

SEQ ID NO: 2615272 - RNA, 21 nt, Human
cuccucuuguaaauaaagccc

SEQ ID NO: 2615273 - RNA, 20 nt, Human
cuccucuuguaaauaaagcc

SEQ ID NO: 2615274 - RNA, 14 nt, Human
cuccucuuguaaau

SEQ ID NO: 2615275 - RNA, 13 nt, Human
cuccucuuguaaa

SEQ ID NO: 2615276 - RNA, 12 nt, Human
cuccucuuguaa

SEQ ID NO: 2615277 - RNA, 20 nt, Human
cuccucccuuagcucccugu

SEQ ID NO: 2615278 - RNA, 15 nt, Human
cuccucccuuagcuc

SEQ ID NO: 2615279 - RNA, 14 nt, Human
cuccucccuuagcu

SEQ ID NO: 2615280 - RNA, 21 nt, Human
cuccucccuggcugcccuggc

SEQ ID NO: 2615281 - RNA, 22 nt, Human
cuccucccuggcugcccuggcc

SEQ ID NO: 2615282 - RNA, 20 nt, Human
cuccucccuggcugcccugg

SEQ ID NO: 2615283 - RNA, 19 nt, Human
cuccucccuggcugcccug

SEQ ID NO: 2615284 - RNA, 18 nt, Human
cuccucccuggcugcccu

SEQ ID NO: 2615285 - RNA, 17 nt, Human
cuccucccuggcugccc

SEQ ID NO: 2615286 - RNA, 14 nt, Human
cuccucccuggcug

SEQ ID NO: 2615287 - RNA, 13 nt, Human
cuccucccuggcu

SEQ ID NO: 2615288 - RNA, 16 nt, Human
cuccucccugcaucug

SEQ ID NO: 2615289 - RNA, 18 nt, Human
cuccucccugcaucugac

SEQ ID NO: 2615290 - RNA, 12 nt, Human
cuccucccuggc

SEQ ID NO: 2615291 - RNA, 23 nt, Human
cuccucccugcaucugaccagca

SEQ ID NO: 2615292 - RNA, 14 nt, Human
cuccucagaucuuc

SEQ ID NO: 2615293 - RNA, 14 nt, Human
cuccucccugcauc

SEQ ID NO: 2615294 - RNA, 15 nt, Human
cuccucccugcaucu

SEQ ID NO: 2615295 - RNA, 13 nt, Human
cuccucccugcau

SEQ ID NO: 2615296 - RNA, 15 nt, Human
cuccucccucugagg

SEQ ID NO: 2615297 - RNA, 14 nt, Human
cuccucccucugag

SEQ ID NO: 2615298 - RNA, 14 nt, Human
cuccucccuccugc

SEQ ID NO: 2615299 - RNA, 12 nt, Human
cuccucagaucu

SEQ ID NO: 2615300 - RNA, 20 nt, Human
cuccucacuggccaucccuc

SEQ ID NO: 2615301 - RNA, 18 nt, Human
cuccucacuggccauccc

SEQ ID NO: 2615302 - RNA, 14 nt, Human
cuccucacuggcca

SEQ ID NO: 2615303 - RNA, 16 nt, Human
cuccucacucccuucu

SEQ ID NO: 2615304 - RNA, 19 nt, Human
cuccuaucaccuccccucc

SEQ ID NO: 2615305 - RNA, 21 nt, Human
cuccucacucccuucccauaa

SEQ ID NO: 2615306 - RNA, 14 nt, Human
cuccucacucccuu

SEQ ID NO: 2615307 - RNA, 21 nt, Human
cucccuuggaaaccugcccug

SEQ ID NO: 2615308 - RNA, 20 nt, Human
cucccuuggaaaccugcccu

SEQ ID NO: 2615309 - RNA, 19 nt, Human
cucccuuggaaaccugccc

SEQ ID NO: 2615310 - RNA, 18 nt, Human
cucccuuggaaaccugcc

SEQ ID NO: 2615311 - RNA, 13 nt, Human
cucccuucugcua

SEQ ID NO: 2615312 - RNA, 14 nt, Human
cucccuucugcuac

SEQ ID NO: 2615313 - RNA, 15 nt, Human
cucccuucugcuacu

SEQ ID NO: 2615314 - RNA, 16 nt, Human
cucccuucugcuacug

SEQ ID NO: 2615315 - RNA, 16 nt, Human
cucccuucucuucaca

SEQ ID NO: 2615316 - RNA, 18 nt, Human
cucccuucuaccugccac

SEQ ID NO: 2615317 - RNA, 17 nt, Human
cucccuucuaccugcca

SEQ ID NO: 2615318 - RNA, 21 nt, Human
cucccuucuaccugccacuca

SEQ ID NO: 2615319 - RNA, 14 nt, Human
cucccuucucccau

SEQ ID NO: 2615320 - RNA, 14 nt, Human
cucccuuccucuuu

SEQ ID NO: 2615321 - RNA, 20 nt, Human
cucccuuccuuuucccugcu

SEQ ID NO: 2615322 - RNA, 15 nt, Human
cucccuucuaccugc

SEQ ID NO: 2615323 - RNA, 19 nt, Human
cucccuuccuuuucccugc

SEQ ID NO: 2615324 - RNA, 12 nt, Human
cucccuuccuuu

SEQ ID NO: 2615325 - RNA, 17 nt, Human
cucccuuagcucccugu

SEQ ID NO: 2615326 - RNA, 13 nt, Human
cucccuuccucuu

SEQ ID NO: 2615327 - RNA, 23 nt, Human
cucccuguuugaagccugcccuu

SEQ ID NO: 2615328 - RNA, 22 nt, Human
cucccuguuugaagccugcccu

SEQ ID NO: 2615329 - RNA, 17 nt, Human
cucccuucccauaagcu

SEQ ID NO: 2615330 - RNA, 15 nt, Human
cucccuuucccuucu

SEQ ID NO: 2615331 - RNA, 14 nt, Human
cucccuuucccuuc

SEQ ID NO: 2615332 - RNA, 22 nt, Human
cucccuuggaaaccugcccugc

SEQ ID NO: 2615333 - RNA, 14 nt, Human
cucccuuucucccc

SEQ ID NO: 2615334 - RNA, 12 nt, Human
cucccuuucucc

SEQ ID NO: 2615335 - RNA, 13 nt, Human
cucccuuucaaca

SEQ ID NO: 2615336 - RNA, 12 nt, Human
cucccuuucaac

SEQ ID NO: 2615337 - RNA, 17 nt, Human
cucccuuggauuguccc

SEQ ID NO: 2615338 - RNA, 22 nt, Human
cuccuaguacuaacuccuagga

SEQ ID NO: 2615339 - RNA, 17 nt, Human
cuccuaucaccuccccu

SEQ ID NO: 2615340 - RNA, 18 nt, Human
cuccuaucaccuccccuc

SEQ ID NO: 2615341 - RNA, 23 nt, Human
cucccuuucuccccugcccccag

SEQ ID NO: 2615342 - RNA, 15 nt, Human
cucccuuucuccccu

SEQ ID NO: 2615343 - RNA, 15 nt, Human
cuccuaggaaaauac

SEQ ID NO: 2615344 - RNA, 20 nt, Human
cuccuagggaaaaguucaua

SEQ ID NO: 2615345 - RNA, 20 nt, Human
cucccuucaaccauucccca

SEQ ID NO: 2615346 - RNA, 19 nt, Human
cucccuucaaccauucccc

SEQ ID NO: 2615347 - RNA, 18 nt, Human
cucccuucaaccauuccc

SEQ ID NO: 2615348 - RNA, 12 nt, Human
cucccuucaacc

SEQ ID NO: 2615349 - RNA, 23 nt, Human
cucccuucccaccucucucacuc

SEQ ID NO: 2615350 - RNA, 10 nt, Human
cucccuuccu

SEQ ID NO: 2615351 - RNA, 14 nt, Human
cucccuggguucag

SEQ ID NO: 2615352 - RNA, 11 nt, Human
cucccuggguu

SEQ ID NO: 2615353 - RNA, 22 nt, Human
cucccuggcugcccuggcccug

SEQ ID NO: 2615354 - RNA, 21 nt, Human
cucccuggcugcccuggcccu

SEQ ID NO: 2615355 - RNA, 21 nt, Human
cucccuguuugaagccugccc

SEQ ID NO: 2615356 - RNA, 12 nt, Human
cucccuguuuga

SEQ ID NO: 2615357 - RNA, 22 nt, Human
cucccuguugacgaagucucuu

SEQ ID NO: 2615358 - RNA, 21 nt, Human
cucccuguugacgaagucucu

SEQ ID NO: 2615359 - RNA, 17 nt, Human
cucccuguucuugggua

SEQ ID NO: 2615360 - RNA, 19 nt, Human
cucccuguuccccagagaa

SEQ ID NO: 2615361 - RNA, 19 nt, Human
cucccuguugacgaagucu

SEQ ID NO: 2615362 - RNA, 19 nt, Human
cucccuguugaagcucugg

SEQ ID NO: 2615363 - RNA, 14 nt, Human
cucccuggcuccca

SEQ ID NO: 2615364 - RNA, 15 nt, Human
cucccuggcucccau

SEQ ID NO: 2615365 - RNA, 15 nt, Human
cucccuggcucucag

SEQ ID NO: 2615366 - RNA, 16 nt, Human
cucccuggcucucaga

SEQ ID NO: 2615367 - RNA, 18 nt, Human
cucccuggcucucagaag

SEQ ID NO: 2615368 - RNA, 20 nt, Human
cucccuggcugcccuggccc

SEQ ID NO: 2615369 - RNA, 19 nt, Human
cucccuggcugcccuggcc

SEQ ID NO: 2615370 - RNA, 18 nt, Human
cucccuggcugcccuggc

SEQ ID NO: 2615371 - RNA, 17 nt, Human
cucccuggcugcccugg

SEQ ID NO: 2615372 - RNA, 15 nt, Human
cucccuggcugcccu

SEQ ID NO: 2615373 - RNA, 14 nt, Human
cucccuggcugccc

SEQ ID NO: 2615374 - RNA, 13 nt, Human
cucccuggcugcc

SEQ ID NO: 2615375 - RNA, 20 nt, Human
cucccuggcucucagaaggu

SEQ ID NO: 2615376 - RNA, 18 nt, Human
cucccaucucacacauga

SEQ ID NO: 2615377 - RNA, 15 nt, Human
cucccaucucacaca

SEQ ID NO: 2615378 - RNA, 15 nt, Human
cucccuggccuguuc

SEQ ID NO: 2615379 - RNA, 16 nt, Human
cucccuggccuguucu

SEQ ID NO: 2615380 - RNA, 19 nt, Human
cucccuggccuguucuguu

SEQ ID NO: 2615381 - RNA, 21 nt, Human
cucccuggccuguucuguuuu

SEQ ID NO: 2615382 - RNA, 11 nt, Human
cucccuggcuc

SEQ ID NO: 2615383 - RNA, 12 nt, Human
cucccuggcucc

SEQ ID NO: 2615384 - RNA, 13 nt, Human
cucccuggccugu

SEQ ID NO: 2615385 - RNA, 14 nt, Human
cucccaucucacac

SEQ ID NO: 2615386 - RNA, 20 nt, Human
cucccauaaccgcugauucu

SEQ ID NO: 2615387 - RNA, 17 nt, Human
cucccauaaccgcugau

SEQ ID NO: 2615388 - RNA, 23 nt, Human
cucccauccccuggacugggagg

SEQ ID NO: 2615389 - RNA, 21 nt, Human
cucccagugucuuccuguggg

SEQ ID NO: 2615390 - RNA, 20 nt, Human
cucccagugucuuccugugg

SEQ ID NO: 2615391 - RNA, 19 nt, Human
cucccagugucuuccugug

SEQ ID NO: 2615392 - RNA, 17 nt, Human
cucccagugucuuccug

SEQ ID NO: 2615393 - RNA, 12 nt, Human
cucccagugucu

SEQ ID NO: 2615394 - RNA, 19 nt, Human
cucccagucuacccagaga

SEQ ID NO: 2615395 - RNA, 18 nt, Human
cucccagucuacccagag

SEQ ID NO: 2615396 - RNA, 16 nt, Human
cucccagucuacccag

SEQ ID NO: 2615397 - RNA, 22 nt, Human
cucccagucaccuuguggcaag

SEQ ID NO: 2615398 - RNA, 16 nt, Human
cucccaguaccuccug

SEQ ID NO: 2615399 - RNA, 20 nt, Human
cucccaguccaaauguccuc

SEQ ID NO: 2615400 - RNA, 20 nt, Human
cuccuucuguccuacucugu

SEQ ID NO: 2615401 - RNA, 15 nt, Human
cuccuucuguccuac

SEQ ID NO: 2615402 - RNA, 14 nt, Human
cuccuucuguccua

SEQ ID NO: 2615403 - RNA, 20 nt, Human
cuccuucucugucucaugug

SEQ ID NO: 2615404 - RNA, 16 nt, Human
cuccuucucugucuca

SEQ ID NO: 2615405 - RNA, 21 nt, Human
cuccuucucugucucaugugu

SEQ ID NO: 2615406 - RNA, 18 nt, Human
cuccuuccaccucccucc

SEQ ID NO: 2615407 - RNA, 13 nt, Human
cuccuucucccuu

SEQ ID NO: 2615408 - RNA, 13 nt, Human
cuccuucagcccu

SEQ ID NO: 2615409 - RNA, 19 nt, Human
cuccuucagacacccucaa

SEQ ID NO: 2615410 - RNA, 13 nt, Human
cuccuucagacac

SEQ ID NO: 2615411 - RNA, 14 nt, Human
cuccuucagacacc

SEQ ID NO: 2615412 - RNA, 12 nt, Human
cuccuucagaca

SEQ ID NO: 2615413 - RNA, 20 nt, Human
cuccuucagcccucaccccu

SEQ ID NO: 2615414 - RNA, 17 nt, Human
cuccuucagcccucacc

SEQ ID NO: 2615415 - RNA, 15 nt, Human
cuccuucagcccuca

SEQ ID NO: 2615416 - RNA, 14 nt, Human
cuccuucagcccuc

SEQ ID NO: 2615417 - RNA, 16 nt, Human
cuccuuccaccucccu

SEQ ID NO: 2615418 - RNA, 18 nt, Human
cuccuuccaacaggagcu

SEQ ID NO: 2615419 - RNA, 14 nt, Human
cuccuuccaacagg

SEQ ID NO: 2615420 - RNA, 15 nt, Human
cuccuuccaccuccc

SEQ ID NO: 2615421 - RNA, 17 nt, Human
cuccuugggaggaagca

SEQ ID NO: 2615422 - RNA, 14 nt, Human
cuccuugggaggaa

SEQ ID NO: 2615423 - RNA, 13 nt, Human
cuccuugggagga

SEQ ID NO: 2615424 - RNA, 17 nt, Human
cuccuugcucugcaggc

SEQ ID NO: 2615425 - RNA, 13 nt, Human
cuccuuggaaauc

SEQ ID NO: 2615426 - RNA, 17 nt, Human
cuccuugccuccugugu

SEQ ID NO: 2615427 - RNA, 14 nt, Human
cuccuugcucugca

SEQ ID NO: 2615428 - RNA, 13 nt, Human
cuccuugcucugc

SEQ ID NO: 2615429 - RNA, 17 nt, Human
cuccuugcuacccagaa

SEQ ID NO: 2615430 - RNA, 18 nt, Human
cuccuugccuccugugua

SEQ ID NO: 2615431 - RNA, 16 nt, Human
cucgaacuggcugcaa

SEQ ID NO: 2615432 - RNA, 21 nt, Human
cuccuugggaggaagcagaau

SEQ ID NO: 2615433 - RNA, 20 nt, Human
cuccuugggaggaagcagaa

SEQ ID NO: 2615434 - RNA, 19 nt, Human
cuccuugggaggaagcaga

SEQ ID NO: 2615435 - RNA, 18 nt, Human
cuccuugggaggaagcag

SEQ ID NO: 2615436 - RNA, 23 nt, Human
cuccuugggaggaagcagaauaa

SEQ ID NO: 2615437 - RNA, 22 nt, Human
cuccuugggaggaagcagaaua

SEQ ID NO: 2615438 - RNA, 13 nt, Human
cuccuugggaggc

SEQ ID NO: 2615439 - RNA, 16 nt, Human
cuccuugggaggcccc

SEQ ID NO: 2615440 - RNA, 21 nt, Human
cuccuugaaaacacuguucuc

SEQ ID NO: 2615441 - RNA, 11 nt, Human
cuccuucuucc

SEQ ID NO: 2615442 - RNA, 19 nt, Human
cuccuugacuccuuguggu

SEQ ID NO: 2615443 - RNA, 21 nt, Human
cuccuugauuuuagccuucuc

SEQ ID NO: 2615444 - RNA, 20 nt, Human
cuccuugagagaccaggcaa

SEQ ID NO: 2615445 - RNA, 17 nt, Human
cuccuugagagaccagg

SEQ ID NO: 2615446 - RNA, 11 nt, Human
cuccugugugu

SEQ ID NO: 2615447 - RNA, 23 nt, Human
cuccugugucuugcaauggcagc

SEQ ID NO: 2615448 - RNA, 11 nt, Human
cuccugccacc

SEQ ID NO: 2615449 - RNA, 13 nt, Human
cuccugcccacgg

SEQ ID NO: 2615450 - RNA, 18 nt, Human
cuccugccaguguggaac

SEQ ID NO: 2615451 - RNA, 14 nt, Human
cuccugcccaccug

SEQ ID NO: 2615452 - RNA, 15 nt, Human
cuccugugucuugca

SEQ ID NO: 2615453 - RNA, 21 nt, Human
cuccugcaggcagccaggcca

SEQ ID NO: 2615454 - RNA, 15 nt, Human
cuccugcaggcagcc

SEQ ID NO: 2615455 - RNA, 22 nt, Human
cuccugcaggcagccaggccac

SEQ ID NO: 2615456 - RNA, 14 nt, Human
cuccugccaaggag

SEQ ID NO: 2615457 - RNA, 23 nt, Human
cuccugaggggcaucugccccuc

SEQ ID NO: 2615458 - RNA, 21 nt, Human
cuccuucaccuuuguccccac

SEQ ID NO: 2615459 - RNA, 19 nt, Human
cuccuucaccuuugucccc

SEQ ID NO: 2615460 - RNA, 16 nt, Human
cuccuucaccuuuguc

SEQ ID NO: 2615461 - RNA, 14 nt, Human
cuccuucaccuuug

SEQ ID NO: 2615462 - RNA, 20 nt, Human
cuccuuaacacugagcuguc

SEQ ID NO: 2615463 - RNA, 17 nt, Human
cuccuuaacacugagcu

SEQ ID NO: 2615464 - RNA, 22 nt, Human
cuccuguugcacccagcccugg

SEQ ID NO: 2615465 - RNA, 21 nt, Human
cuccuguugcacccagcccug

SEQ ID NO: 2615466 - RNA, 20 nt, Human
cuccuguugcacccagcccu

SEQ ID NO: 2615467 - RNA, 19 nt, Human
cuccuguugcacccagccc

SEQ ID NO: 2615468 - RNA, 23 nt, Human
cuccuguugcacccagcccuggu

SEQ ID NO: 2615469 - RNA, 17 nt, Human
cuccuguugcacccagc

SEQ ID NO: 2615470 - RNA, 11 nt, Human
cuccugcccag

SEQ ID NO: 2615471 - RNA, 17 nt, Human
cuccugcccacggaguc

SEQ ID NO: 2615472 - RNA, 20 nt, Human
cucgaguuacagacaaagcg

SEQ ID NO: 2615473 - RNA, 16 nt, Human
cucgaguuacagacaa

SEQ ID NO: 2615474 - RNA, 14 nt, Human
cucgaaucucugug

SEQ ID NO: 2615475 - RNA, 13 nt, Human
cucgaaucucugu

SEQ ID NO: 2615476 - RNA, 17 nt, Human
cucgaagcgcgccacuc

SEQ ID NO: 2615477 - RNA, 20 nt, Human
cucgaagcgcgccacucgcu

SEQ ID NO: 2615478 - RNA, 17 nt, Human
cuccuugggaggcccca

SEQ ID NO: 2615479 - RNA, 21 nt, Human
cuccuugggaggccccacugg

SEQ ID NO: 2615480 - RNA, 15 nt, Human
cuccuugggcacuuu

SEQ ID NO: 2615481 - RNA, 22 nt, Human
cuccuugggaggccccacuggg

SEQ ID NO: 2615482 - RNA, 12 nt, Human
cucgaagcgcgc

SEQ ID NO: 2615483 - RNA, 13 nt, Human
cucgaagcgcgcc

SEQ ID NO: 2615484 - RNA, 18 nt, Human
cucgaaucucugugccuu

SEQ ID NO: 2615485 - RNA, 17 nt, Human
cucgaaucucugugccu

SEQ ID NO: 2615486 - RNA, 16 nt, Human
cucgaaucucugugcc

SEQ ID NO: 2615487 - RNA, 15 nt, Human
cucgaaucucugugc

SEQ ID NO: 2615488 - RNA, 23 nt, Human
cucgacguuuacaagcccccccu

SEQ ID NO: 2615489 - RNA, 15 nt, Human
cucgcgacaaugcaa

SEQ ID NO: 2615490 - RNA, 21 nt, Human
cucgcccgcccacuguccugg

SEQ ID NO: 2615491 - RNA, 19 nt, Human
cucgcuauugucaccaggg

SEQ ID NO: 2615492 - RNA, 20 nt, Human
cucgcccgcccacuguccug

SEQ ID NO: 2615493 - RNA, 16 nt, Human
cucgcccgcccacugu

SEQ ID NO: 2615494 - RNA, 15 nt, Human
cucgcccgcccacug

SEQ ID NO: 2615495 - RNA, 14 nt, Human
cucgcccgcccacu

SEQ ID NO: 2615496 - RNA, 12 nt, Human
cucgcccgccca

SEQ ID NO: 2615497 - RNA, 13 nt, Human
cucgcgacaaugc

SEQ ID NO: 2615498 - RNA, 14 nt, Human
cucgccccagcagg

SEQ ID NO: 2615499 - RNA, 18 nt, Human
cucgcccaccgcaugccc

SEQ ID NO: 2615500 - RNA, 17 nt, Human
cucgccaugccgggggu

SEQ ID NO: 2615501 - RNA, 13 nt, Human
cucgccaugccgg

SEQ ID NO: 2615502 - RNA, 12 nt, Human
cucgccaugccg

SEQ ID NO: 2615503 - RNA, 23 nt, Human
cucgcccaccgcaugcccccucg

SEQ ID NO: 2615504 - RNA, 22 nt, Human
cucgcccaccgcaugcccccuc

SEQ ID NO: 2615505 - RNA, 22 nt, Human
cucgcauaggaccuuuccacca

SEQ ID NO: 2615506 - RNA, 19 nt, Human
cucgcauaggaccuuucca

SEQ ID NO: 2615507 - RNA, 19 nt, Human
cucgccaccccuccuuccu

SEQ ID NO: 2615508 - RNA, 22 nt, Human
cucgcauuugucaaugacaguu

SEQ ID NO: 2615509 - RNA, 21 nt, Human
cucgcauuugucaaugacagu

SEQ ID NO: 2615510 - RNA, 13 nt, Human
cucggagaagagc

SEQ ID NO: 2615511 - RNA, 20 nt, Human
cucggagaagagcuguucac

SEQ ID NO: 2615512 - RNA, 12 nt, Human
cucggagaagag

SEQ ID NO: 2615513 - RNA, 18 nt, Human
cucggacuuagcugggag

SEQ ID NO: 2615514 - RNA, 19 nt, Human
cucggacuuagcugggaga

SEQ ID NO: 2615515 - RNA, 19 nt, Human
cucggaacugcaugcugcu

SEQ ID NO: 2615516 - RNA, 21 nt, Human
cucggaacugcaugcugcugg

SEQ ID NO: 2615517 - RNA, 19 nt, Human
cucgcuuucuauguaguuu

SEQ ID NO: 2615518 - RNA, 17 nt, Human
cucgcuuuguugcccag

SEQ ID NO: 2615519 - RNA, 22 nt, Human
cucggaacugcaugcugcugga

SEQ ID NO: 2615520 - RNA, 16 nt, Human
cucggaaggcuggcug

SEQ ID NO: 2615521 - RNA, 20 nt, Human
cucggaaggcuggcugggca

SEQ ID NO: 2615522 - RNA, 21 nt, Human
cucgcuauugucaccagggcu

SEQ ID NO: 2615523 - RNA, 22 nt, Human
cucgcuugugcagaaaacauug

SEQ ID NO: 2615524 - RNA, 14 nt, Human
cucgcuugugcaga

SEQ ID NO: 2615525 - RNA, 22 nt, Human
cucgcuuggacggcugggcaca

SEQ ID NO: 2615526 - RNA, 18 nt, Human
cucggccucccaaagugc

SEQ ID NO: 2615527 - RNA, 20 nt, Human
cucggccucccaaagugcug

SEQ ID NO: 2615528 - RNA, 22 nt, Human
cucggccucccaaagugcuggg

SEQ ID NO: 2615529 - RNA, 23 nt, Human
cucggccucccaaagugcuggga

SEQ ID NO: 2615530 - RNA, 15 nt, Human
cucggccuggcuccu

SEQ ID NO: 2615531 - RNA, 21 nt, Human
cucggccgucuucacucgccc

SEQ ID NO: 2615532 - RNA, 16 nt, Human
cucggcccccuccauc

SEQ ID NO: 2615533 - RNA, 15 nt, Human
cucggccucccaaag

SEQ ID NO: 2615534 - RNA, 17 nt, Human
cucggcccccuccaucg

SEQ ID NO: 2615535 - RNA, 13 nt, Human
cucggacucugcu

SEQ ID NO: 2615536 - RNA, 22 nt, Human
cucggacuaagccuaccugcuc

SEQ ID NO: 2615537 - RNA, 18 nt, Human
cucggacuaagccuaccu

SEQ ID NO: 2615538 - RNA, 12 nt, Human
cucggagccuca

SEQ ID NO: 2615539 - RNA, 22 nt, Human
cucuaaaugaggggccucaggu

SEQ ID NO: 2615540 - RNA, 23 nt, Human
cucuaaagcaauaauggucccau

SEQ ID NO: 2615541 - RNA, 18 nt, Human
cucuaacagcucaggauc

SEQ ID NO: 2615542 - RNA, 22 nt, Human
cucuaacagcucaggaucucuu

SEQ ID NO: 2615543 - RNA, 13 nt, Human
cucuaagccacuc

SEQ ID NO: 2615544 - RNA, 14 nt, Human
cucuaacagcucag

SEQ ID NO: 2615545 - RNA, 16 nt, Human
cucuaacagcucagga

SEQ ID NO: 2615546 - RNA, 18 nt, Human
cucuaaaugggaaaguau

SEQ ID NO: 2615547 - RNA, 19 nt, Human
cucauaguaugguggcugg

SEQ ID NO: 2615548 - RNA, 18 nt, Human
cucauaguaugguggcug

SEQ ID NO: 2615549 - RNA, 20 nt, Human
cucauaguaugguggcuggg

SEQ ID NO: 2615550 - RNA, 13 nt, Human
cucauauggccca

SEQ ID NO: 2615551 - RNA, 19 nt, Human
cucauagggaagaccugcu

SEQ ID NO: 2615552 - RNA, 15 nt, Human
cucauaaugugaagu

SEQ ID NO: 2615553 - RNA, 23 nt, Human
cucauaggaaaaguacauuuaau

SEQ ID NO: 2615554 - RNA, 14 nt, Human
cucauagggaagac

SEQ ID NO: 2615555 - RNA, 21 nt, Human
cucauaggaaaaguacauuua

SEQ ID NO: 2615556 - RNA, 21 nt, Human
cucauaacggaucagaaauac

SEQ ID NO: 2615557 - RNA, 19 nt, Human
cucauaacggaucagaaau

SEQ ID NO: 2615558 - RNA, 21 nt, Human
cucaguucagaaucacuucug

SEQ ID NO: 2615559 - RNA, 16 nt, Human
cuaaaagauauaagug

SEQ ID NO: 2615560 - RNA, 17 nt, Human
cucauaacggaucagaa

SEQ ID NO: 2615561 - RNA, 17 nt, Human
cucauaaugugaagugu

SEQ ID NO: 2615562 - RNA, 14 nt, Human
cucauaaugugaag

SEQ ID NO: 2615563 - RNA, 13 nt, Human
cucauaaugugaa

SEQ ID NO: 2615564 - RNA, 18 nt, Human
cucauaauagacuuccca

SEQ ID NO: 2615565 - RNA, 19 nt, Human
cucaggugucccugcacuu

SEQ ID NO: 2615566 - RNA, 20 nt, Human
cucagugucuggcugcagag

SEQ ID NO: 2615567 - RNA, 14 nt, Human
cucaggugagaagc

SEQ ID NO: 2615568 - RNA, 18 nt, Human
cucaggugucccugcacu

SEQ ID NO: 2615569 - RNA, 17 nt, Human
cucaggugucccugcac

SEQ ID NO: 2615570 - RNA, 21 nt, Human
cucagugucuggcugcagagc

SEQ ID NO: 2615571 - RNA, 22 nt, Human
cucagugucuggcugcagagca

SEQ ID NO: 2615572 - RNA, 16 nt, Human
cucagugugacuccuc

SEQ ID NO: 2615573 - RNA, 15 nt, Human
cucaguucagaauca

SEQ ID NO: 2615574 - RNA, 23 nt, Human
cucaguuacacaaaggaccucag

SEQ ID NO: 2615575 - RNA, 20 nt, Human
cucaguucauccauucuauu

SEQ ID NO: 2615576 - RNA, 18 nt, Human
cucaguucauccauucua

SEQ ID NO: 2615577 - RNA, 14 nt, Human
cucaguucccuugg

SEQ ID NO: 2615578 - RNA, 15 nt, Human
cucaguucccuuggc

SEQ ID NO: 2615579 - RNA, 16 nt, Human
cucaguucccuuggcc

SEQ ID NO: 2615580 - RNA, 17 nt, Human
cucaguucccuuggccu

SEQ ID NO: 2615581 - RNA, 18 nt, Human
cucaguucccuuggccuc

SEQ ID NO: 2615582 - RNA, 19 nt, Human
cucaguucccuuggccuca

SEQ ID NO: 2615583 - RNA, 23 nt, Human
cucagguggggucacucuggcag

SEQ ID NO: 2615584 - RNA, 22 nt, Human
cucagguggggucacucuggca

SEQ ID NO: 2615585 - RNA, 16 nt, Human
cucaggugucccugca

SEQ ID NO: 2615586 - RNA, 15 nt, Human
cucaggugucccugc

SEQ ID NO: 2615587 - RNA, 19 nt, Human
cucaggggcuguuugagga

SEQ ID NO: 2615588 - RNA, 14 nt, Human
cucagggucccugg

SEQ ID NO: 2615589 - RNA, 16 nt, Human
cucaggggugugccug

SEQ ID NO: 2615590 - RNA, 18 nt, Human
cucaggucccugcagggc

SEQ ID NO: 2615591 - RNA, 17 nt, Human
cucaggucccugcaggg

SEQ ID NO: 2615592 - RNA, 20 nt, Human
cucaggucccuggggcuagg

SEQ ID NO: 2615593 - RNA, 19 nt, Human
cucaggucagggugaggau

SEQ ID NO: 2615594 - RNA, 20 nt, Human
cucaggucagggugaggaug

SEQ ID NO: 2615595 - RNA, 13 nt, Human
cucaggugaccaa

SEQ ID NO: 2615596 - RNA, 17 nt, Human
cucaggggccagaggaa

SEQ ID NO: 2615597 - RNA, 13 nt, Human
cucaggggccaga

SEQ ID NO: 2615598 - RNA, 13 nt, Human
cuaaaagucuucg

SEQ ID NO: 2615599 - RNA, 15 nt, Human
cuaaaaguaaacauu

SEQ ID NO: 2615600 - RNA, 19 nt, Human
cuaaaagugggcuugauuc

SEQ ID NO: 2615601 - RNA, 14 nt, Human
cuaaaaguaaacau

SEQ ID NO: 2615602 - RNA, 13 nt, Human
cuaaaaguaaaca

SEQ ID NO: 2615603 - RNA, 16 nt, Human
cuaaaagguucaggga

SEQ ID NO: 2615604 - RNA, 12 nt, Human
cucagggucccu

SEQ ID NO: 2615605 - RNA, 16 nt, Human
cucaggggcuguuuga

SEQ ID NO: 2615606 - RNA, 15 nt, Human
cucaggggcuguuug

SEQ ID NO: 2615607 - RNA, 14 nt, Human
cucaggggcuguuu

SEQ ID NO: 2615608 - RNA, 20 nt, Human
cucaggggccagaggaacug

SEQ ID NO: 2615609 - RNA, 18 nt, Human
cucaggggccagaggaac

SEQ ID NO: 2615610 - RNA, 17 nt, Human
cucaggggcguguggcu

SEQ ID NO: 2615611 - RNA, 21 nt, Human
cuaaaagauauaagugcugua

SEQ ID NO: 2615612 - RNA, 20 nt, Human
cuaaaagauauaagugcugu

SEQ ID NO: 2615613 - RNA, 17 nt, Human
cuaaaagauauaagugc

SEQ ID NO: 2615614 - RNA, 16 nt, Human
cuaaaaaaaaaaaagu

SEQ ID NO: 2615615 - RNA, 16 nt, Human
cguuuuugguggaguc

SEQ ID NO: 2615616 - RNA, 13 nt, Human
cguuuuuccuuua

SEQ ID NO: 2615617 - RNA, 23 nt, Human
cuaaaagguaugcaaucaaaucu

SEQ ID NO: 2615618 - RNA, 20 nt, Human
cuaaaagauccuuuuuaaau

SEQ ID NO: 2615619 - RNA, 15 nt, Human
cuaaaagauccuuuu

SEQ ID NO: 2615620 - RNA, 13 nt, Human
cuaaaagauccuu

SEQ ID NO: 2615621 - RNA, 12 nt, Human
cuaaaagcacac

SEQ ID NO: 2615622 - RNA, 21 nt, Human
cucauauuuuguauauaucug

SEQ ID NO: 2615623 - RNA, 13 nt, Human
cucauauuuugua

SEQ ID NO: 2615624 - RNA, 12 nt, Human
cucauauuuugu

SEQ ID NO: 2615625 - RNA, 16 nt, Human
cucauauuuuguauau

SEQ ID NO: 2615626 - RNA, 23 nt, Human
cucaucauucucugucucaucca

SEQ ID NO: 2615627 - RNA, 19 nt, Human
cucauauugugauucugcc

SEQ ID NO: 2615628 - RNA, 21 nt, Human
cucauauugugauucugccuu

SEQ ID NO: 2615629 - RNA, 13 nt, Human
cucauauuuaaag

SEQ ID NO: 2615630 - RNA, 12 nt, Human
cucauauuuaaa

SEQ ID NO: 2615631 - RNA, 15 nt, Human
cucauauuuaaagac

SEQ ID NO: 2615632 - RNA, 13 nt, Human
cucauauugugau

SEQ ID NO: 2615633 - RNA, 22 nt, Human
cucauauuccugcagccuggag

SEQ ID NO: 2615634 - RNA, 24 nt, Human
cucauauuccugcagccuggaggc

SEQ ID NO: 2615635 - RNA, 19 nt, Human
cucauauggcccaguguca

SEQ ID NO: 2615636 - RNA, 18 nt, Human
cucauauggcccaguguc

SEQ ID NO: 2615637 - RNA, 15 nt, Human
cucauauuccugcag

SEQ ID NO: 2615638 - RNA, 20 nt, Human
cucauauuccugcagccugg

SEQ ID NO: 2615639 - RNA, 19 nt, Human
cucauccaccccaucccuc

SEQ ID NO: 2615640 - RNA, 16 nt, Human
cucauccaccccaucc

SEQ ID NO: 2615641 - RNA, 15 nt, Human
cucauccaccccauc

SEQ ID NO: 2615642 - RNA, 13 nt, Human
cucauccacccca

SEQ ID NO: 2615643 - RNA, 15 nt, Human
cucauccagggcucu

SEQ ID NO: 2615644 - RNA, 24 nt, Human
cucauccaccccaucccuccccag

SEQ ID NO: 2615645 - RNA, 16 nt, Human
cucauccaucaucaug

SEQ ID NO: 2615646 - RNA, 19 nt, Human
cucauccaucaucaugugu

SEQ ID NO: 2615647 - RNA, 10 nt, Human
cucaucccau

SEQ ID NO: 2615648 - RNA, 14 nt, Human
cucaucccacgcac

SEQ ID NO: 2615649 - RNA, 16 nt, Human
cucauccagggcucug

SEQ ID NO: 2615650 - RNA, 13 nt, Human
cucauccccaggg

SEQ ID NO: 2615651 - RNA, 14 nt, Human
cucauccccagggg

SEQ ID NO: 2615652 - RNA, 22 nt, Human
cucauccccaggggucccagcc

SEQ ID NO: 2615653 - RNA, 19 nt, Human
cucaucccacgcacuccau

SEQ ID NO: 2615654 - RNA, 13 nt, Human
cucauccugcagg

SEQ ID NO: 2615655 - RNA, 17 nt, Human
cucauuaggauggcuag

SEQ ID NO: 2615656 - RNA, 18 nt, Human
cucauuaggauggcuagu

SEQ ID NO: 2615657 - RNA, 18 nt, Human
cucaucuaucucaauccu

SEQ ID NO: 2615658 - RNA, 14 nt, Human
cucaucuaucucaa

SEQ ID NO: 2615659 - RNA, 19 nt, Human
cucauucaaaaguugaaau

SEQ ID NO: 2615660 - RNA, 15 nt, Human
cucauucaaaaguug

SEQ ID NO: 2615661 - RNA, 17 nt, Human
cucaucuccccaucauu

SEQ ID NO: 2615662 - RNA, 21 nt, Human
cucauuagcauuuugcuaaau

SEQ ID NO: 2615663 - RNA, 21 nt, Human
cucaucuagguaaauuacagu

SEQ ID NO: 2615664 - RNA, 14 nt, Human
cucauccugcaggc

SEQ ID NO: 2615665 - RNA, 16 nt, Human
cucauccuuguauaaa

SEQ ID NO: 2615666 - RNA, 16 nt, Human
cucaucgcguccuccu

SEQ ID NO: 2615667 - RNA, 18 nt, Human
cucauuccuccaccugcc

SEQ ID NO: 2615668 - RNA, 23 nt, Human
cucauuccccggggcguuucuuu

SEQ ID NO: 2615669 - RNA, 14 nt, Human
cucauuccccgggg

SEQ ID NO: 2615670 - RNA, 13 nt, Human
cucauuccccggg

SEQ ID NO: 2615671 - RNA, 14 nt, Human
cucauuccccaggu

SEQ ID NO: 2615672 - RNA, 21 nt, Human
cucauuccuccaccugccgug

SEQ ID NO: 2615673 - RNA, 12 nt, Human
cucauuccugcc

SEQ ID NO: 2615674 - RNA, 13 nt, Human
cucauuccugccu

SEQ ID NO: 2615675 - RNA, 16 nt, Human
cucauuccugccuguc

SEQ ID NO: 2615676 - RNA, 12 nt, Human
cucauucuucug

SEQ ID NO: 2615677 - RNA, 14 nt, Human
cucauucuucugua

SEQ ID NO: 2615678 - RNA, 13 nt, Human
cucauucuucugu

SEQ ID NO: 2615679 - RNA, 22 nt, Human
cucauucaggaaaacugacaga

SEQ ID NO: 2615680 - RNA, 18 nt, Human
cucauuccaacagugagu

SEQ ID NO: 2615681 - RNA, 17 nt, Human
cucauuccaacagugag

SEQ ID NO: 2615682 - RNA, 18 nt, Human
cucauuccaccuucccau

SEQ ID NO: 2615683 - RNA, 15 nt, Human
cucauuccagaggaa

SEQ ID NO: 2615684 - RNA, 21 nt, Human
cucauuccaccuucccaugcc

SEQ ID NO: 2615685 - RNA, 17 nt, Human
cucauuccagaggaagg

SEQ ID NO: 2615686 - RNA, 13 nt, Human
cucauuccccagg

SEQ ID NO: 2615687 - RNA, 12 nt, Human
cucauuccccag

SEQ ID NO: 2615688 - RNA, 19 nt, Human
cucauugcuuacaagccua

SEQ ID NO: 2615689 - RNA, 20 nt, Human
cucauugcugagccucugcu

SEQ ID NO: 2615690 - RNA, 18 nt, Human
cucauugcugagccucug

SEQ ID NO: 2615691 - RNA, 19 nt, Human
cucauugcugagccucugc

SEQ ID NO: 2615692 - RNA, 16 nt, Human
cucauugaccugaggc

SEQ ID NO: 2615693 - RNA, 20 nt, Human
cucauugcuuggaauucagc

SEQ ID NO: 2615694 - RNA, 18 nt, Human
cucauugacaagaacuga

SEQ ID NO: 2615695 - RNA, 13 nt, Human
cucauuggacccu

SEQ ID NO: 2615696 - RNA, 17 nt, Human
cucauuggacccuucca

SEQ ID NO: 2615697 - RNA, 18 nt, Human
cucauuggacccuuccau

SEQ ID NO: 2615698 - RNA, 15 nt, Human
cucauugaccugagg

SEQ ID NO: 2615699 - RNA, 13 nt, Human
cucauugaccuga

SEQ ID NO: 2615700 - RNA, 23 nt, Human
cucauucuucuguacgucugaca

SEQ ID NO: 2615701 - RNA, 17 nt, Human
cucauuccugccugucu

SEQ ID NO: 2615702 - RNA, 18 nt, Human
cucauuccugccugucuc

SEQ ID NO: 2615703 - RNA, 17 nt, Human
cucauugacaagaacug

SEQ ID NO: 2615704 - RNA, 21 nt, Human
cuccauccugaggcuccacuu

SEQ ID NO: 2615705 - RNA, 20 nt, Human
cuccauccugaggcuccacu

SEQ ID NO: 2615706 - RNA, 18 nt, Human
cuccaggcgccggcgggc

SEQ ID NO: 2615707 - RNA, 14 nt, Human
cuccaggcgccggc

SEQ ID NO: 2615708 - RNA, 13 nt, Human
cuccaggcgccgg

SEQ ID NO: 2615709 - RNA, 11 nt, Human
cuccaggcucc

SEQ ID NO: 2615710 - RNA, 9 nt, Human
cuccaucuc

SEQ ID NO: 2615711 - RNA, 22 nt, Human
cuccauccuuucugccucucaa

SEQ ID NO: 2615712 - RNA, 21 nt, Human
cuccauccuuucugccucuca

SEQ ID NO: 2615713 - RNA, 19 nt, Human
cuccauccuuucugccucu

SEQ ID NO: 2615714 - RNA, 18 nt, Human
cuccaucuaaacugcccc

SEQ ID NO: 2615715 - RNA, 21 nt, Human
cuccaucuccaagaaugcuga

SEQ ID NO: 2615716 - RNA, 18 nt, Human
cuccaucuccaagaaugc

SEQ ID NO: 2615717 - RNA, 23 nt, Human
cuccaucucauguaucaucugga

SEQ ID NO: 2615718 - RNA, 14 nt, Human
cuccaucucaugua

SEQ ID NO: 2615719 - RNA, 13 nt, Human
cuccaucuccacu

SEQ ID NO: 2615720 - RNA, 23 nt, Human
cuccauccugaggcuccacuugg

SEQ ID NO: 2615721 - RNA, 17 nt, Human
cuccaucuaaacugccc

SEQ ID NO: 2615722 - RNA, 20 nt, Human
cuccaucgcugucaucucag

SEQ ID NO: 2615723 - RNA, 15 nt, Human
cuccaggcaggcuaa

SEQ ID NO: 2615724 - RNA, 13 nt, Human
cuccaggcaggcu

SEQ ID NO: 2615725 - RNA, 20 nt, Human
cuccaggccacauggggcug

SEQ ID NO: 2615726 - RNA, 18 nt, Human
cuccagcuguucagcugg

SEQ ID NO: 2615727 - RNA, 19 nt, Human
cuccagcuguucagcuggu

SEQ ID NO: 2615728 - RNA, 21 nt, Human
cuccagcuccaagaccuguug

SEQ ID NO: 2615729 - RNA, 14 nt, Human
cuccagcuccaaga

SEQ ID NO: 2615730 - RNA, 19 nt, Human
cuccagccuggacccccag

SEQ ID NO: 2615731 - RNA, 13 nt, Human
cuccagcuccaag

SEQ ID NO: 2615732 - RNA, 19 nt, Human
cuccagccugccuggcagg

SEQ ID NO: 2615733 - RNA, 17 nt, Human
cuccagccugccuggca

SEQ ID NO: 2615734 - RNA, 14 nt, Human
cuccagccugagca

SEQ ID NO: 2615735 - RNA, 11 nt, Human
cuccagcuccu

SEQ ID NO: 2615736 - RNA, 19 nt, Human
cuccagcuggguuggaaaa

SEQ ID NO: 2615737 - RNA, 13 nt, Human
cuccagcuguuca

SEQ ID NO: 2615738 - RNA, 21 nt, Human
cucccaggcauuccccaggag

SEQ ID NO: 2615739 - RNA, 20 nt, Human
cucccaggcauuccccagga

SEQ ID NO: 2615740 - RNA, 19 nt, Human
cucccaggcauuccccagg

SEQ ID NO: 2615741 - RNA, 17 nt, Human
cucccaggcauucccca

SEQ ID NO: 2615742 - RNA, 17 nt, Human
cucccagucauuuaaua

SEQ ID NO: 2615743 - RNA, 21 nt, Human
cucccaggccgagaagccagu

SEQ ID NO: 2615744 - RNA, 14 nt, Human
cucccaggcgcccc

SEQ ID NO: 2615745 - RNA, 22 nt, Human
cucccaggcauuccccaggagg

SEQ ID NO: 2615746 - RNA, 22 nt, Human
cucccaggccaguaagggaaau

SEQ ID NO: 2615747 - RNA, 22 nt, Human
cucccaggccaggcuccuuccu

SEQ ID NO: 2615748 - RNA, 18 nt, Human
cucccaaguggugccuaa

SEQ ID NO: 2615749 - RNA, 17 nt, Human
cucccaaguggugccua

SEQ ID NO: 2615750 - RNA, 17 nt, Human
cucccaggccaggcucc

SEQ ID NO: 2615751 - RNA, 21 nt, Human
cucccaggccaggcuccuucc

SEQ ID NO: 2615752 - RNA, 16 nt, Human
cucccaaguggugccu

SEQ ID NO: 2615753 - RNA, 13 nt, Human
cucccaaguggug

SEQ ID NO: 2615754 - RNA, 17 nt, Human
cucccaagucuacagag

SEQ ID NO: 2615755 - RNA, 15 nt, Human
cucccaggcauuccc

SEQ ID NO: 2615756 - RNA, 22 nt, Human
cucccaaguagcugggauuaca

SEQ ID NO: 2615757 - RNA, 18 nt, Human
cucccaagggauggugcc

SEQ ID NO: 2615758 - RNA, 14 nt, Human
cucccaagggaugg

SEQ ID NO: 2615759 - RNA, 23 nt, Human
cucccaaggcugcgucuggaggg

SEQ ID NO: 2615760 - RNA, 22 nt, Human
cucccaaggcugcgucuggagg

SEQ ID NO: 2615761 - RNA, 21 nt, Human
cucccaaggggcccaaauucu

SEQ ID NO: 2615762 - RNA, 22 nt, Human
cucccaaggggcccaaauucuu

SEQ ID NO: 2615763 - RNA, 17 nt, Human
cuccauugguguugaca

SEQ ID NO: 2615764 - RNA, 15 nt, Human
cuccauuccagucuc

SEQ ID NO: 2615765 - RNA, 22 nt, Human
cuccaucuccaagaaugcugaa

SEQ ID NO: 2615766 - RNA, 14 nt, Human
cuccauucugacca

SEQ ID NO: 2615767 - RNA, 20 nt, Human
cuccauucugaccauuucag

SEQ ID NO: 2615768 - RNA, 14 nt, Human
cuccaugugggcua

SEQ ID NO: 2615769 - RNA, 22 nt, Human
cuccauuaggauuugccccuuc

SEQ ID NO: 2615770 - RNA, 24 nt, Human
cuccauucccguggaacguuuuuc

SEQ ID NO: 2615771 - RNA, 23 nt, Human
cuccagccccuucucagaaucua

SEQ ID NO: 2615772 - RNA, 21 nt, Human
cuccagccccuucucagaauc

SEQ ID NO: 2615773 - RNA, 19 nt, Human
cuccagccccuucucagaa

SEQ ID NO: 2615774 - RNA, 20 nt, Human
cuccagccagccagcucauu

SEQ ID NO: 2615775 - RNA, 24 nt, Human
cuccagccagcaaugauguccaga

SEQ ID NO: 2615776 - RNA, 23 nt, Human
cuccagccagcaaugauguccag

SEQ ID NO: 2615777 - RNA, 18 nt, Human
cuccagcaccauccgcca

SEQ ID NO: 2615778 - RNA, 13 nt, Human
cuccagccaaccc

SEQ ID NO: 2615779 - RNA, 14 nt, Human
cuccagccaacccc

SEQ ID NO: 2615780 - RNA, 17 nt, Human
cuccagccaaccccugu

SEQ ID NO: 2615781 - RNA, 16 nt, Human
cuccagccagcaauga

SEQ ID NO: 2615782 - RNA, 13 nt, Human
cuccagccagcaa

SEQ ID NO: 2615783 - RNA, 12 nt, Human
cuccagccagca

SEQ ID NO: 2615784 - RNA, 11 nt, Human
cuccagccagc

SEQ ID NO: 2615785 - RNA, 18 nt, Human
cuccagccaaccccugug

SEQ ID NO: 2615786 - RNA, 19 nt, Human
cuccagccaaccccugugg

SEQ ID NO: 2615787 - RNA, 20 nt, Human
cuccagccaaccccugugga

SEQ ID NO: 2615788 - RNA, 21 nt, Human
cuccagccaaccccuguggag

SEQ ID NO: 2615789 - RNA, 20 nt, Human
cuccagcucaccagccccag

SEQ ID NO: 2615790 - RNA, 19 nt, Human
cuccagcucaccagcccca

SEQ ID NO: 2615791 - RNA, 11 nt, Human
cuccagccucu

SEQ ID NO: 2615792 - RNA, 13 nt, Human
cuccagccucugu

SEQ ID NO: 2615793 - RNA, 22 nt, Human
cuccagccccuucucagaaucu

SEQ ID NO: 2615794 - RNA, 17 nt, Human
cuccagccucuguuccc

SEQ ID NO: 2615795 - RNA, 13 nt, Human
cuccagccugagc

SEQ ID NO: 2615796 - RNA, 20 nt, Human
cuccagaccccuggcuuuuc

SEQ ID NO: 2615797 - RNA, 19 nt, Human
cuccagaccccuggcuuuu

SEQ ID NO: 2615798 - RNA, 19 nt, Human
cuccacucugacuggcaca

SEQ ID NO: 2615799 - RNA, 18 nt, Human
cuccagaccccuggcuuu

SEQ ID NO: 2615800 - RNA, 17 nt, Human
cuccagaccccuggcuu

SEQ ID NO: 2615801 - RNA, 15 nt, Human
cuccagaccccuggc

SEQ ID NO: 2615802 - RNA, 14 nt, Human
cuccagaccccugg

SEQ ID NO: 2615803 - RNA, 21 nt, Human
cuccacucugcuucucugacu

SEQ ID NO: 2615804 - RNA, 20 nt, Human
cuccacucugcuucucugac

SEQ ID NO: 2615805 - RNA, 17 nt, Human
cuccacucugcuucucu

SEQ ID NO: 2615806 - RNA, 16 nt, Human
cuccacucugcuucuc

SEQ ID NO: 2615807 - RNA, 11 nt, Human
cuccacugccu

SEQ ID NO: 2615808 - RNA, 15 nt, Human
cuccacucugcuucu

SEQ ID NO: 2615809 - RNA, 14 nt, Human
cuccacucugcuuc

SEQ ID NO: 2615810 - RNA, 13 nt, Human
cuccacucugcuu

SEQ ID NO: 2615811 - RNA, 12 nt, Human
cuccacucugcu

SEQ ID NO: 2615812 - RNA, 21 nt, Human
cuccacucuccucuuccaggc

SEQ ID NO: 2615813 - RNA, 17 nt, Human
cuccaccugcucccagg

SEQ ID NO: 2615814 - RNA, 18 nt, Human
cuccaccucagccuugga

SEQ ID NO: 2615815 - RNA, 12 nt, Human
cuccacccugcu

SEQ ID NO: 2615816 - RNA, 14 nt, Human
cuccacccucugag

SEQ ID NO: 2615817 - RNA, 13 nt, Human
cuccacccucuga

SEQ ID NO: 2615818 - RNA, 18 nt, Human
cuccacccucccagaccu

SEQ ID NO: 2615819 - RNA, 14 nt, Human
cuccacccucccag

SEQ ID NO: 2615820 - RNA, 17 nt, Human
cuccacccucugagcuu

SEQ ID NO: 2615821 - RNA, 16 nt, Human
cuccacccucugagcu

SEQ ID NO: 2615822 - RNA, 19 nt, Human
cuccacccucugagcuuug

SEQ ID NO: 2615823 - RNA, 15 nt, Human
cuccaccucagccuu

SEQ ID NO: 2615824 - RNA, 21 nt, Human
cuccaccugccagggacagag

SEQ ID NO: 2615825 - RNA, 18 nt, Human
cuccaccugccagggaca

SEQ ID NO: 2615826 - RNA, 17 nt, Human
cuccaccugccagggac

SEQ ID NO: 2615827 - RNA, 15 nt, Human
cuccaccugccaggg

SEQ ID NO: 2615828 - RNA, 16 nt, Human
cuccaccucagccuug

SEQ ID NO: 2615829 - RNA, 17 nt, Human
cuccaccucagccuugg

SEQ ID NO: 2615830 - RNA, 13 nt, Human
cuccacaguguug

SEQ ID NO: 2615831 - RNA, 21 nt, Human
cuccacaguucgaccugcggc

SEQ ID NO: 2615832 - RNA, 23 nt, Human
cuccacaguucaguggcagggcu

SEQ ID NO: 2615833 - RNA, 17 nt, Human
cuccacaguucaguggc

SEQ ID NO: 2615834 - RNA, 15 nt, Human
cuccacaguucagug

SEQ ID NO: 2615835 - RNA, 15 nt, Human
cuccacagcuaccuc

SEQ ID NO: 2615836 - RNA, 11 nt, Human
cuccacccugc

SEQ ID NO: 2615837 - RNA, 22 nt, Human
cuccacaguucgaccugcggcu

SEQ ID NO: 2615838 - RNA, 19 nt, Human
cuccacccccagcugcuug

SEQ ID NO: 2615839 - RNA, 22 nt, Human
cuccacccccagcugcuugugu

SEQ ID NO: 2615840 - RNA, 16 nt, Human
cuccaccccccagaac

SEQ ID NO: 2615841 - RNA, 21 nt, Human
cuccaccccccagaaccuguc

SEQ ID NO: 2615842 - RNA, 22 nt, Human
cuccaccccccagaaccugucc

SEQ ID NO: 2615843 - RNA, 23 nt, Human
cuccaccccccagaaccuguccu

SEQ ID NO: 2615844 - RNA, 16 nt, Human
cuccacagcaacccca

SEQ ID NO: 2615845 - RNA, 23 nt, Human
cuccacagccaucccagccuugg

SEQ ID NO: 2615846 - RNA, 16 nt, Human
cuccacagccauccca

SEQ ID NO: 2615847 - RNA, 19 nt, Human
cuccacagcaaccccaggc

SEQ ID NO: 2615848 - RNA, 14 nt, Human
cuccacagccgcag

SEQ ID NO: 2615849 - RNA, 15 nt, Human
cuccacagccgcagc

SEQ ID NO: 2615850 - RNA, 19 nt, Human
cucauugucuguguagagu

SEQ ID NO: 2615851 - RNA, 20 nt, Human
cucuccagauguuuccagac

SEQ ID NO: 2615852 - RNA, 13 nt, Human
cucuccaggcacc

SEQ ID NO: 2615853 - RNA, 13 nt, Human
cucuccagccccu

SEQ ID NO: 2615854 - RNA, 12 nt, Human
cucuccagcccc

SEQ ID NO: 2615855 - RNA, 20 nt, Human
cucuccaccucagccuugga

SEQ ID NO: 2615856 - RNA, 15 nt, Human
cucuccacugccuuc

SEQ ID NO: 2615857 - RNA, 16 nt, Human
cucuccaucuucagcu

SEQ ID NO: 2615858 - RNA, 19 nt, Human
cucuccaggcacccuucuu

SEQ ID NO: 2615859 - RNA, 18 nt, Human
cucuccaggcacccuucu

SEQ ID NO: 2615860 - RNA, 17 nt, Human
cucuccaggcgccggcg

SEQ ID NO: 2615861 - RNA, 15 nt, Human
cucuccaucuucagc

SEQ ID NO: 2615862 - RNA, 18 nt, Human
cucuccauaaccccaccc

SEQ ID NO: 2615863 - RNA, 16 nt, Human
cucuccauaaccccac

SEQ ID NO: 2615864 - RNA, 13 nt, Human
cucuccauaaccc

SEQ ID NO: 2615865 - RNA, 21 nt, Human
cucuccauucccguggaacgu

SEQ ID NO: 2615866 - RNA, 20 nt, Human
cucucccaucacuucccuac

SEQ ID NO: 2615867 - RNA, 20 nt, Human
cucucccaucccccugcccu

SEQ ID NO: 2615868 - RNA, 18 nt, Human
cucucccaucccccugcc

SEQ ID NO: 2615869 - RNA, 16 nt, Human
cucucccaucccccug

SEQ ID NO: 2615870 - RNA, 13 nt, Human
cucucccaucccc

SEQ ID NO: 2615871 - RNA, 22 nt, Human
cucucccagucuacccagagaa

SEQ ID NO: 2615872 - RNA, 21 nt, Human
cucucccagucuacccagaga

SEQ ID NO: 2615873 - RNA, 12 nt, Human
cucucccauccc

SEQ ID NO: 2615874 - RNA, 14 nt, Human
cucucccaucacuu

SEQ ID NO: 2615875 - RNA, 18 nt, Human
cucucccaucacuucccu

SEQ ID NO: 2615876 - RNA, 12 nt, Human
cucucccaggac

SEQ ID NO: 2615877 - RNA, 13 nt, Human
cucucccaggacc

SEQ ID NO: 2615878 - RNA, 13 nt, Human
cucucccaucacu

SEQ ID NO: 2615879 - RNA, 20 nt, Human
cucucccagucuacccagag

SEQ ID NO: 2615880 - RNA, 13 nt, Human
cucucccaggggc

SEQ ID NO: 2615881 - RNA, 11 nt, Human
cucucccaggg

SEQ ID NO: 2615882 - RNA, 14 nt, Human
cucucagucucuga

SEQ ID NO: 2615883 - RNA, 15 nt, Human
cucucagucucugag

SEQ ID NO: 2615884 - RNA, 16 nt, Human
cucucagucucugagc

SEQ ID NO: 2615885 - RNA, 17 nt, Human
cucucagucucugagca

SEQ ID NO: 2615886 - RNA, 15 nt, Human
cucucaggugaccaa

SEQ ID NO: 2615887 - RNA, 13 nt, Human
cucucagucucug

SEQ ID NO: 2615888 - RNA, 18 nt, Human
cucucaguacuuuggagg

SEQ ID NO: 2615889 - RNA, 19 nt, Human
cucucaguacuuuggaggc

SEQ ID NO: 2615890 - RNA, 23 nt, Human
cucucaggccagcugcuugggcu

SEQ ID NO: 2615891 - RNA, 22 nt, Human
cucucaggccagcugcuugggc

SEQ ID NO: 2615892 - RNA, 21 nt, Human
cucuaaguuccacugagcucc

SEQ ID NO: 2615893 - RNA, 20 nt, Human
cucuaaguuccacugagcuc

SEQ ID NO: 2615894 - RNA, 19 nt, Human
cucuaaguuccacugagcu

SEQ ID NO: 2615895 - RNA, 18 nt, Human
cucuaaguuccacugagc

SEQ ID NO: 2615896 - RNA, 16 nt, Human
cucuaaguuccacuga

SEQ ID NO: 2615897 - RNA, 23 nt, Human
cucuaaggccgaagaaggguccu

SEQ ID NO: 2615898 - RNA, 14 nt, Human
cucuaagguugggc

SEQ ID NO: 2615899 - RNA, 19 nt, Human
cucuaagccacucuuccaa

SEQ ID NO: 2615900 - RNA, 15 nt, Human
cucuaauaucagcaa

SEQ ID NO: 2615901 - RNA, 16 nt, Human
cucuccacugccuucg

SEQ ID NO: 2615902 - RNA, 23 nt, Human
cucuccaccuaguggcuguccag

SEQ ID NO: 2615903 - RNA, 12 nt, Human
cucuccaccuca

SEQ ID NO: 2615904 - RNA, 13 nt, Human
cucuccaccucag

SEQ ID NO: 2615905 - RNA, 14 nt, Human
cucuccaccucagc

SEQ ID NO: 2615906 - RNA, 15 nt, Human
cucuccaccucagcc

SEQ ID NO: 2615907 - RNA, 16 nt, Human
cucuccaccucagccu

SEQ ID NO: 2615908 - RNA, 17 nt, Human
cucuccaccucagccuu

SEQ ID NO: 2615909 - RNA, 18 nt, Human
cucuccaccucagccuug

SEQ ID NO: 2615910 - RNA, 19 nt, Human
cucuccaagugccagaggu

SEQ ID NO: 2615911 - RNA, 16 nt, Human
cucuccaagugccaga

SEQ ID NO: 2615912 - RNA, 15 nt, Human
cucuccaagugccag

SEQ ID NO: 2615913 - RNA, 14 nt, Human
cucuccaagugcca

SEQ ID NO: 2615914 - RNA, 22 nt, Human
cucuccaagugccagagguggg

SEQ ID NO: 2615915 - RNA, 20 nt, Human
cucuccaagugccagaggug

SEQ ID NO: 2615916 - RNA, 22 nt, Human
cucuccaccuaguggcugucca

SEQ ID NO: 2615917 - RNA, 20 nt, Human
cucuccaccuaguggcuguc

SEQ ID NO: 2615918 - RNA, 17 nt, Human
cucuccaccuaguggcu

SEQ ID NO: 2615919 - RNA, 14 nt, Human
cucuccaccuagug

SEQ ID NO: 2615920 - RNA, 10 nt, Human
cucuccaccu

SEQ ID NO: 2615921 - RNA, 18 nt, Human
cucucagucucugagcag

SEQ ID NO: 2615922 - RNA, 16 nt, Human
cucucaucaacugaau

SEQ ID NO: 2615923 - RNA, 12 nt, Human
cucucaguuuuu

SEQ ID NO: 2615924 - RNA, 17 nt, Human
cucucaucaacugaaug

SEQ ID NO: 2615925 - RNA, 18 nt, Human
cucucaucaacugaauga

SEQ ID NO: 2615926 - RNA, 22 nt, Human
cucucaucaguguccucuugcu

SEQ ID NO: 2615927 - RNA, 21 nt, Human
cucucaguuccgauuucccag

SEQ ID NO: 2615928 - RNA, 13 nt, Human
cucucaugaaccu

SEQ ID NO: 2615929 - RNA, 17 nt, Human
cucucaucucuuagcuc

SEQ ID NO: 2615930 - RNA, 20 nt, Human
cucuccaagucucaguggcu

SEQ ID NO: 2615931 - RNA, 23 nt, Human
cucuccaagucucaguggcuuca

SEQ ID NO: 2615932 - RNA, 21 nt, Human
cucucccauugucccucugcc

SEQ ID NO: 2615933 - RNA, 13 nt, Human
cucuccccacacu

SEQ ID NO: 2615934 - RNA, 14 nt, Human
cucuccccacacua

SEQ ID NO: 2615935 - RNA, 15 nt, Human
cucuccccacacuaa

SEQ ID NO: 2615936 - RNA, 23 nt, Human
cucucccauggagccccagcccc

SEQ ID NO: 2615937 - RNA, 22 nt, Human
cucucccauggagccccagccc

SEQ ID NO: 2615938 - RNA, 21 nt, Human
cucucccauggagccccagcc

SEQ ID NO: 2615939 - RNA, 19 nt, Human
cucucccauggagccccag

SEQ ID NO: 2615940 - RNA, 18 nt, Human
cucucccauggagcccca

SEQ ID NO: 2615941 - RNA, 16 nt, Human
cucucccauggagccc

SEQ ID NO: 2615942 - RNA, 14 nt, Human
cucucccauggagc

SEQ ID NO: 2615943 - RNA, 13 nt, Human
cucucccauggag

SEQ ID NO: 2615944 - RNA, 13 nt, Human
cucucccauggcu

SEQ ID NO: 2615945 - RNA, 16 nt, Human
cucucccauugucccu

SEQ ID NO: 2615946 - RNA, 18 nt, Human
cucucccauugucccucu

SEQ ID NO: 2615947 - RNA, 19 nt, Human
cucucccauugucccucug

SEQ ID NO: 2615948 - RNA, 14 nt, Human
cucucccauuuccu

SEQ ID NO: 2615949 - RNA, 12 nt, Human
cucuccccacac

SEQ ID NO: 2615950 - RNA, 14 nt, Human
cucuccuguaccuc

SEQ ID NO: 2615951 - RNA, 15 nt, Human
cucuccuguaccucu

SEQ ID NO: 2615952 - RNA, 13 nt, Human
cucuccuguaccu

SEQ ID NO: 2615953 - RNA, 17 nt, Human
cucuccuguaccucuug

SEQ ID NO: 2615954 - RNA, 18 nt, Human
cucuccuguaccucuuga

SEQ ID NO: 2615955 - RNA, 22 nt, Human
cucuccuguaccucuugagccu

SEQ ID NO: 2615956 - RNA, 11 nt, Human
cucuccccagc

SEQ ID NO: 2615957 - RNA, 18 nt, Human
cucuccuguacuuuuucc

SEQ ID NO: 2615958 - RNA, 23 nt, Human
cucuccuuucuuuuucuucuucc

SEQ ID NO: 2615959 - RNA, 12 nt, Human
cucuccugucca

SEQ ID NO: 2615960 - RNA, 19 nt, Human
cucuccuuuggccauucca

SEQ ID NO: 2615961 - RNA, 19 nt, Human
cucucgcaccuuuccaaag

SEQ ID NO: 2615962 - RNA, 22 nt, Human
cucuccuuuguauauuauuucu

SEQ ID NO: 2615963 - RNA, 20 nt, Human
cucuccuuuguauauuauuu

SEQ ID NO: 2615964 - RNA, 17 nt, Human
cucucgcaccuuuccaa

SEQ ID NO: 2615965 - RNA, 18 nt, Human
cucuccuuuguauauuau

SEQ ID NO: 2615966 - RNA, 15 nt, Human
cucuccuuuguauau

SEQ ID NO: 2615967 - RNA, 14 nt, Human
cucuccuuuguaua

SEQ ID NO: 2615968 - RNA, 13 nt, Human
cucuccuuuguau

SEQ ID NO: 2615969 - RNA, 18 nt, Human
cucucgcaccuuuccaaa

SEQ ID NO: 2615970 - RNA, 12 nt, Human
cucucggaacug

SEQ ID NO: 2615971 - RNA, 16 nt, Human
cucucggaacugcaug

SEQ ID NO: 2615972 - RNA, 19 nt, Human
cucucggaacugcaugcug

SEQ ID NO: 2615973 - RNA, 20 nt, Human
cucucggaacugcaugcugc

SEQ ID NO: 2615974 - RNA, 21 nt, Human
cucucggaacugcaugcugcu

SEQ ID NO: 2615975 - RNA, 23 nt, Human
cucucggaacugcaugcugcugg

SEQ ID NO: 2615976 - RNA, 16 nt, Human
cucucggaaggcuggc

SEQ ID NO: 2615977 - RNA, 18 nt, Human
cucucggaaggcuggcug

SEQ ID NO: 2615978 - RNA, 19 nt, Human
cucucggaaggcuggcugg

SEQ ID NO: 2615979 - RNA, 22 nt, Human
cucucggaaggcuggcugggca

SEQ ID NO: 2615980 - RNA, 12 nt, Human
cucucucaggcc

SEQ ID NO: 2615981 - RNA, 14 nt, Human
cucucugacucuca

SEQ ID NO: 2615982 - RNA, 16 nt, Human
cucucucacuccuuga

SEQ ID NO: 2615983 - RNA, 15 nt, Human
cucucucacuccuug

SEQ ID NO: 2615984 - RNA, 14 nt, Human
cucucucacuccuu

SEQ ID NO: 2615985 - RNA, 19 nt, Human
cucucuacaaacucccacu

SEQ ID NO: 2615986 - RNA, 17 nt, Human
cucucguaacugguuuc

SEQ ID NO: 2615987 - RNA, 16 nt, Human
cucucguaacugguuu

SEQ ID NO: 2615988 - RNA, 18 nt, Human
cucucggcuccccaugug

SEQ ID NO: 2615989 - RNA, 17 nt, Human
cucucggcuccccaugu

SEQ ID NO: 2615990 - RNA, 21 nt, Human
cucucgguuccacgucccccu

SEQ ID NO: 2615991 - RNA, 19 nt, Human
cucucggguucaagcaauu

SEQ ID NO: 2615992 - RNA, 19 nt, Human
cucucggguugugugucug

SEQ ID NO: 2615993 - RNA, 16 nt, Human
cucucggcuccccaug

SEQ ID NO: 2615994 - RNA, 15 nt, Human
cucucggcuccccau

SEQ ID NO: 2615995 - RNA, 14 nt, Human
cucucggcucccca

SEQ ID NO: 2615996 - RNA, 19 nt, Human
cucucggaguaucugggaa

SEQ ID NO: 2615997 - RNA, 20 nt, Human
cucucggaguaucugggaac

SEQ ID NO: 2615998 - RNA, 22 nt, Human
cucucugcaggucccuaauaaa

SEQ ID NO: 2615999 - RNA, 19 nt, Human
cucucugcaggucccuaau

SEQ ID NO: 2616000 - RNA, 17 nt, Human
cucucugcaggucccua

SEQ ID NO: 2616001 - RNA, 16 nt, Human
cucucugcaggucccu

SEQ ID NO: 2616002 - RNA, 14 nt, Human
cucucugcaggucc

SEQ ID NO: 2616003 - RNA, 13 nt, Human
cucucugcagguc

SEQ ID NO: 2616004 - RNA, 12 nt, Human
cucucugcaggu

SEQ ID NO: 2616005 - RNA, 17 nt, Human
cucucugcagccagccc

SEQ ID NO: 2616006 - RNA, 18 nt, Human
cucucugcagccagccca

SEQ ID NO: 2616007 - RNA, 19 nt, Human
cucucugcagccagcccag

SEQ ID NO: 2616008 - RNA, 20 nt, Human
cucucugcagccagcccagc

SEQ ID NO: 2616009 - RNA, 16 nt, Human
cucucugcagccagcc

SEQ ID NO: 2616010 - RNA, 18 nt, Human
cucucugcaccguacugu

SEQ ID NO: 2616011 - RNA, 23 nt, Human
cucugcaggucccuaauaaagcu

SEQ ID NO: 2616012 - RNA, 23 nt, Human
cucugcaauuccccucugcugcu

SEQ ID NO: 2616013 - RNA, 22 nt, Human
cucugcaauuccccucugcugc

SEQ ID NO: 2616014 - RNA, 15 nt, Human
cucugcagugccuug

SEQ ID NO: 2616015 - RNA, 14 nt, Human
cucugcagugccuu

SEQ ID NO: 2616016 - RNA, 13 nt, Human
cucugcagugccu

SEQ ID NO: 2616017 - RNA, 19 nt, Human
cucugccaacuucuucaga

SEQ ID NO: 2616018 - RNA, 16 nt, Human
cucugcagugccuugg

SEQ ID NO: 2616019 - RNA, 23 nt, Human
cucugcauacucauuaggauggc

SEQ ID NO: 2616020 - RNA, 17 nt, Human
cucugcaauuccccucu

SEQ ID NO: 2616021 - RNA, 16 nt, Human
cucugcaauuccccuc

SEQ ID NO: 2616022 - RNA, 23 nt, Human
cucugcaaugggcacugggauga

SEQ ID NO: 2616023 - RNA, 18 nt, Human
cucugcaaugggcacugg

SEQ ID NO: 2616024 - RNA, 15 nt, Human
cucugcaauuccccu

SEQ ID NO: 2616025 - RNA, 17 nt, Human
cucugcaaugggcacug

SEQ ID NO: 2616026 - RNA, 18 nt, Human
cucugcaaucuucucaga

SEQ ID NO: 2616027 - RNA, 17 nt, Human
cucugcaaucuucucag

SEQ ID NO: 2616028 - RNA, 16 nt, Human
cucugcaaaggaaaua

SEQ ID NO: 2616029 - RNA, 21 nt, Human
cucugcaauuccccucugcug

SEQ ID NO: 2616030 - RNA, 20 nt, Human
cucugcaauuccccucugcu

SEQ ID NO: 2616031 - RNA, 19 nt, Human
cucugcaauuccccucugc

SEQ ID NO: 2616032 - RNA, 18 nt, Human
cucugcaauuccccucug

SEQ ID NO: 2616033 - RNA, 22 nt, Human
cucugcaggucccuaauaaagc

SEQ ID NO: 2616034 - RNA, 12 nt, Human
cucugaucccuc

SEQ ID NO: 2616035 - RNA, 21 nt, Human
cucugaucccucuacagagcu

SEQ ID NO: 2616036 - RNA, 17 nt, Human
cucugauccuucuuccu

SEQ ID NO: 2616037 - RNA, 22 nt, Human
cucugaucccucuacagagcuu

SEQ ID NO: 2616038 - RNA, 22 nt, Human
cucugaucuccauggcuuccuc

SEQ ID NO: 2616039 - RNA, 15 nt, Human
cucugaucuccaugg

SEQ ID NO: 2616040 - RNA, 17 nt, Human
cucugaugaagaggagu

SEQ ID NO: 2616041 - RNA, 18 nt, Human
cucugagggcuuccuuug

SEQ ID NO: 2616042 - RNA, 15 nt, Human
cucugauaggccaag

SEQ ID NO: 2616043 - RNA, 19 nt, Human
cucugauauuccaugaaug

SEQ ID NO: 2616044 - RNA, 20 nt, Human
cucugauauuccaugaaugu

SEQ ID NO: 2616045 - RNA, 23 nt, Human
cucugauauuccaugaauguauc

SEQ ID NO: 2616046 - RNA, 15 nt, Human
cucugaucaaguauu

SEQ ID NO: 2616047 - RNA, 18 nt, Human
cucugauuuucaaagcuu

SEQ ID NO: 2616048 - RNA, 19 nt, Human
cucugauuuucaaagcuuu

SEQ ID NO: 2616049 - RNA, 15 nt, Human
cucugauuuucaaag

SEQ ID NO: 2616050 - RNA, 14 nt, Human
cucugauuugcaaa

SEQ ID NO: 2616051 - RNA, 22 nt, Human
cucugauuuucaaagcuuuuuc

SEQ ID NO: 2616052 - RNA, 20 nt, Human
cucugauuuucaaagcuuuu

SEQ ID NO: 2616053 - RNA, 18 nt, Human
cucugauuugcaaaaaaa

SEQ ID NO: 2616054 - RNA, 22 nt, Human
cucugcaagaauugaagcagga

SEQ ID NO: 2616055 - RNA, 13 nt, Human
cucugagcgccuc

SEQ ID NO: 2616056 - RNA, 15 nt, Human
cucugagccuuggga

SEQ ID NO: 2616057 - RNA, 15 nt, Human
cucugagcugugcag

SEQ ID NO: 2616058 - RNA, 13 nt, Human
cucugagccccug

SEQ ID NO: 2616059 - RNA, 22 nt, Human
cucugagccccugggacugcug

SEQ ID NO: 2616060 - RNA, 22 nt, Human
cucugagaucuaaggaugucac

SEQ ID NO: 2616061 - RNA, 21 nt, Human
cucugagaucuaaggauguca

SEQ ID NO: 2616062 - RNA, 13 nt, Human
cucugagcaguga

SEQ ID NO: 2616063 - RNA, 18 nt, Human
cucugagccaguucagua

SEQ ID NO: 2616064 - RNA, 16 nt, Human
cucugagcaaaugugg

SEQ ID NO: 2616065 - RNA, 17 nt, Human
cucugagggcuuccuuu

SEQ ID NO: 2616066 - RNA, 13 nt, Human
cucugagggcuuc

SEQ ID NO: 2616067 - RNA, 12 nt, Human
cucugagggcuu

SEQ ID NO: 2616068 - RNA, 19 nt, Human
cucugagggaaagcccaga

SEQ ID NO: 2616069 - RNA, 21 nt, Human
cucugaggcuuccagagaguc

SEQ ID NO: 2616070 - RNA, 19 nt, Human
cucugaggcuuccagagag

SEQ ID NO: 2616071 - RNA, 18 nt, Human
cucugaggcuuccagaga

SEQ ID NO: 2616072 - RNA, 16 nt, Human
cucugaggcuuccaga

SEQ ID NO: 2616073 - RNA, 15 nt, Human
cucugaggcuuccag

SEQ ID NO: 2616074 - RNA, 13 nt, Human
cucugaggcugua

SEQ ID NO: 2616075 - RNA, 21 nt, Human
cucugaggcuggauccuagcc

SEQ ID NO: 2616076 - RNA, 19 nt, Human
cucugaggcucuuucuggg

SEQ ID NO: 2616077 - RNA, 20 nt, Human
cucugaggcucuuucugggc

SEQ ID NO: 2616078 - RNA, 13 nt, Human
cucucugcccuaa

SEQ ID NO: 2616079 - RNA, 21 nt, Human
cucucugcccuaaugcgcagg

SEQ ID NO: 2616080 - RNA, 12 nt, Human
cucucugcccua

SEQ ID NO: 2616081 - RNA, 21 nt, Human
cucucugcagccagcccagcc

SEQ ID NO: 2616082 - RNA, 14 nt, Human
cucucugcucugcg

SEQ ID NO: 2616083 - RNA, 22 nt, Human
cucucugcucugcgugucaccu

SEQ ID NO: 2616084 - RNA, 13 nt, Human
cucucugcuguac

SEQ ID NO: 2616085 - RNA, 18 nt, Human
cucugacuggcacagucu

SEQ ID NO: 2616086 - RNA, 12 nt, Human
cucucugccacu

SEQ ID NO: 2616087 - RNA, 16 nt, Human
cucucugcaucugacc

SEQ ID NO: 2616088 - RNA, 12 nt, Human
cucucugcucug

SEQ ID NO: 2616089 - RNA, 21 nt, Human
cucugacuucugccuggagac

SEQ ID NO: 2616090 - RNA, 19 nt, Human
cucugacuucugccuggag

SEQ ID NO: 2616091 - RNA, 18 nt, Human
cucugacuucugccugga

SEQ ID NO: 2616092 - RNA, 17 nt, Human
cucugacuucugccugg

SEQ ID NO: 2616093 - RNA, 16 nt, Human
cucugacuucugccug

SEQ ID NO: 2616094 - RNA, 15 nt, Human
cucugacuucugccu

SEQ ID NO: 2616095 - RNA, 14 nt, Human
cucugacuucugcc

SEQ ID NO: 2616096 - RNA, 13 nt, Human
cucugacuucugc

SEQ ID NO: 2616097 - RNA, 21 nt, Human
cucugagaauuccaaggaguu

SEQ ID NO: 2616098 - RNA, 19 nt, Human
cucugagaauuccaaggag

SEQ ID NO: 2616099 - RNA, 18 nt, Human
cucugagaauuccaagga

SEQ ID NO: 2616100 - RNA, 22 nt, Human
cucugccccagaggccucucuc

SEQ ID NO: 2616101 - RNA, 22 nt, Human
cucugcccuaaugcgcaggcug

SEQ ID NO: 2616102 - RNA, 19 nt, Human
cucugccccagcucuggcu

SEQ ID NO: 2616103 - RNA, 21 nt, Human
cucugccccagcucuggcuuc

SEQ ID NO: 2616104 - RNA, 13 nt, Human
cucugccccagcu

SEQ ID NO: 2616105 - RNA, 16 nt, Human
cucugccccagcucug

SEQ ID NO: 2616106 - RNA, 17 nt, Human
cucugccccagcucugg

SEQ ID NO: 2616107 - RNA, 18 nt, Human
cucugccccagcucuggc

SEQ ID NO: 2616108 - RNA, 16 nt, Human
cucugccccagaggcc

SEQ ID NO: 2616109 - RNA, 15 nt, Human
cucugccccagaggc

SEQ ID NO: 2616110 - RNA, 20 nt, Human
cucugccccagaggccucuc

SEQ ID NO: 2616111 - RNA, 18 nt, Human
cucugccccagaggccuc

SEQ ID NO: 2616112 - RNA, 12 nt, Human
cucugccccagc

SEQ ID NO: 2616113 - RNA, 17 nt, Human
cucugcccagcuugggc

SEQ ID NO: 2616114 - RNA, 15 nt, Human
cucugcccagcuugg

SEQ ID NO: 2616115 - RNA, 18 nt, Human
cucugcccagcuugggcc

SEQ ID NO: 2616116 - RNA, 14 nt, Human
cucugccccagagg

SEQ ID NO: 2616117 - RNA, 14 nt, Human
cucugcccagcuug

SEQ ID NO: 2616118 - RNA, 13 nt, Human
cucugcccagcuu

SEQ ID NO: 2616119 - RNA, 23 nt, Human
cucugccagaagauccccucagg

SEQ ID NO: 2616120 - RNA, 17 nt, Human
cucugccagaagauccc

SEQ ID NO: 2616121 - RNA, 22 nt, Human
cucugccagaagauccccucag

SEQ ID NO: 2616122 - RNA, 18 nt, Human
cucugccaccuccccuau

SEQ ID NO: 2616123 - RNA, 14 nt, Human
cucugccagccaca

SEQ ID NO: 2616124 - RNA, 18 nt, Human
cucugccaccagagaccg

SEQ ID NO: 2616125 - RNA, 17 nt, Human
cucugccaccagagacc

SEQ ID NO: 2616126 - RNA, 16 nt, Human
cucugccaccagagac

SEQ ID NO: 2616127 - RNA, 14 nt, Human
cucugccaccagag

SEQ ID NO: 2616128 - RNA, 23 nt, Human
cucugccaacuucuucagagcug

SEQ ID NO: 2616129 - RNA, 11 nt, Human
cucugccacca

SEQ ID NO: 2616130 - RNA, 10 nt, Human
cucugccacc

SEQ ID NO: 2616131 - RNA, 20 nt, Human
cucugccacccuaccuguuc

SEQ ID NO: 2616132 - RNA, 18 nt, Human
cucugccacccuaccugu

SEQ ID NO: 2616133 - RNA, 17 nt, Human
cucugccacccuaccug

SEQ ID NO: 2616134 - RNA, 23 nt, Human
cucugccaccagagaccguccuc

SEQ ID NO: 2616135 - RNA, 22 nt, Human
cucugccacccuaccuguucag

SEQ ID NO: 2616136 - RNA, 12 nt, Human
cucugccaccuc

SEQ ID NO: 2616137 - RNA, 13 nt, Human
cucugccaccucc

SEQ ID NO: 2616138 - RNA, 14 nt, Human
cucugccaccuccc

SEQ ID NO: 2616139 - RNA, 23 nt, Human
cucugcccuccaagaccuucucc

SEQ ID NO: 2616140 - RNA, 16 nt, Human
cucugcccuccaagac

SEQ ID NO: 2616141 - RNA, 15 nt, Human
cucugcccuccaaga

SEQ ID NO: 2616142 - RNA, 14 nt, Human
cucugcccuccaag

SEQ ID NO: 2616143 - RNA, 23 nt, Human
cucugcccuaaugcgcaggcugg

SEQ ID NO: 2616144 - RNA, 11 nt, Human
cucugcccugc

SEQ ID NO: 2616145 - RNA, 15 nt, Human
cucugcccugcccua

SEQ ID NO: 2616146 - RNA, 16 nt, Human
cucugcccugcccuag

SEQ ID NO: 2616147 - RNA, 21 nt, Human
cucugccaaaggaugugauau

SEQ ID NO: 2616148 - RNA, 17 nt, Human
cucugcccugcccuagc

SEQ ID NO: 2616149 - RNA, 19 nt, Human
cucugcccugcccuagcuc

SEQ ID NO: 2616150 - RNA, 20 nt, Human
cucugcccugcccuagcucc

SEQ ID NO: 2616151 - RNA, 23 nt, Human
cucugcccugcccuagcuccaca

SEQ ID NO: 2616152 - RNA, 12 nt, Human
cucugcccugcg

SEQ ID NO: 2616153 - RNA, 14 nt, Human
cucugccucccuca

SEQ ID NO: 2616154 - RNA, 21 nt, Human
cucugccucccucacccugag

SEQ ID NO: 2616155 - RNA, 20 nt, Human
cucugccucccucacccuga

SEQ ID NO: 2616156 - RNA, 14 nt, Human
cucugccuccucuu

SEQ ID NO: 2616157 - RNA, 13 nt, Human
cucuggagagaaa

SEQ ID NO: 2616158 - RNA, 12 nt, Human
cucuggagagaa

SEQ ID NO: 2616159 - RNA, 24 nt, Human
cucuggagacagccccagagcagg

SEQ ID NO: 2616160 - RNA, 20 nt, Human
cucuggagacagccccagag

SEQ ID NO: 2616161 - RNA, 19 nt, Human
cucuggagccaaguccaga

SEQ ID NO: 2616162 - RNA, 15 nt, Human
cucuggagagaaaca

SEQ ID NO: 2616163 - RNA, 12 nt, Human
cucuggagccca

SEQ ID NO: 2616164 - RNA, 14 nt, Human
cucuggacuggcua

SEQ ID NO: 2616165 - RNA, 15 nt, Human
cucuggacuggcuag

SEQ ID NO: 2616166 - RNA, 16 nt, Human
cucuggacuggcuaga

SEQ ID NO: 2616167 - RNA, 19 nt, Human
cucuggacuggcuagaguc

SEQ ID NO: 2616168 - RNA, 19 nt, Human
cucuggagacagccccaga

SEQ ID NO: 2616169 - RNA, 18 nt, Human
cucuggagacagccccag

SEQ ID NO: 2616170 - RNA, 17 nt, Human
cucuggagacagcccca

SEQ ID NO: 2616171 - RNA, 16 nt, Human
cucuggagacagcccc

SEQ ID NO: 2616172 - RNA, 15 nt, Human
cucuggagacagccc

SEQ ID NO: 2616173 - RNA, 16 nt, Human
cucuggaccaacccug

SEQ ID NO: 2616174 - RNA, 20 nt, Human
cucuggaauuugcaagucau

SEQ ID NO: 2616175 - RNA, 18 nt, Human
cucuggacagccccaccc

SEQ ID NO: 2616176 - RNA, 15 nt, Human
cucuggacagcccca

SEQ ID NO: 2616177 - RNA, 16 nt, Human
cucuggacaaagcguu

SEQ ID NO: 2616178 - RNA, 22 nt, Human
cucuggaaaggggggagcuggg

SEQ ID NO: 2616179 - RNA, 21 nt, Human
cucuggaaaggggggagcugg

SEQ ID NO: 2616180 - RNA, 21 nt, Human
cucuggaagagaggaaugccu

SEQ ID NO: 2616181 - RNA, 23 nt, Human
cucuggacggcaggcucacugcc

SEQ ID NO: 2616182 - RNA, 13 nt, Human
cucuggacuggcu

SEQ ID NO: 2616183 - RNA, 18 nt, Human
cucuggacggcaggcuca

SEQ ID NO: 2616184 - RNA, 17 nt, Human
cucuggacggcaggcuc

SEQ ID NO: 2616185 - RNA, 16 nt, Human
cucuggacggcaggcu

SEQ ID NO: 2616186 - RNA, 20 nt, Human
cucuggaccagccuguugga

SEQ ID NO: 2616187 - RNA, 14 nt, Human
cucuggaccagccu

SEQ ID NO: 2616188 - RNA, 13 nt, Human
cucuggaccagcc

SEQ ID NO: 2616189 - RNA, 22 nt, Human
cucuggaccaacccuguuuccu

SEQ ID NO: 2616190 - RNA, 15 nt, Human
cucuggacggcaggc

SEQ ID NO: 2616191 - RNA, 20 nt, Human
cucugccugccccgccccca

SEQ ID NO: 2616192 - RNA, 13 nt, Human
cucugccuguccc

SEQ ID NO: 2616193 - RNA, 14 nt, Human
cucugccugucccu

SEQ ID NO: 2616194 - RNA, 15 nt, Human
cucugccugccccgc

SEQ ID NO: 2616195 - RNA, 16 nt, Human
cucugccugucccucu

SEQ ID NO: 2616196 - RNA, 18 nt, Human
cucugccugucccucuca

SEQ ID NO: 2616197 - RNA, 19 nt, Human
cucugccugucccucucag

SEQ ID NO: 2616198 - RNA, 20 nt, Human
cucugccugucccucucagg

SEQ ID NO: 2616199 - RNA, 16 nt, Human
cucugccuccucuuca

SEQ ID NO: 2616200 - RNA, 15 nt, Human
cucugccuccucuuc

SEQ ID NO: 2616201 - RNA, 14 nt, Human
cucugccucugaca

SEQ ID NO: 2616202 - RNA, 20 nt, Human
cucugcggaccccagcugug

SEQ ID NO: 2616203 - RNA, 19 nt, Human
cucugcggaccccagcugu

SEQ ID NO: 2616204 - RNA, 17 nt, Human
cucugcggaccccagcu

SEQ ID NO: 2616205 - RNA, 16 nt, Human
cucugcggaccccagc

SEQ ID NO: 2616206 - RNA, 15 nt, Human
cucugcggaccccag

SEQ ID NO: 2616207 - RNA, 14 nt, Human
cucugcggacccca

SEQ ID NO: 2616208 - RNA, 21 nt, Human
cucugccugucccucucaggc

SEQ ID NO: 2616209 - RNA, 14 nt, Human
cucuggaauuugaa

SEQ ID NO: 2616210 - RNA, 15 nt, Human
cucugcuuuggaaau

SEQ ID NO: 2616211 - RNA, 20 nt, Human
cucuggaaaaugugacccag

SEQ ID NO: 2616212 - RNA, 19 nt, Human
cucuggaaaaugugaccca

SEQ ID NO: 2616213 - RNA, 21 nt, Human
cucuggaaaaugugacccaga

SEQ ID NO: 2616214 - RNA, 15 nt, Human
cucuugggcugagac

SEQ ID NO: 2616215 - RNA, 16 nt, Human
cucuugggcugagacu

SEQ ID NO: 2616216 - RNA, 21 nt, Human
cucuugggaacugaacucacu

SEQ ID NO: 2616217 - RNA, 19 nt, Human
cucuugggaaauaugucaa

SEQ ID NO: 2616218 - RNA, 22 nt, Human
cucuuggagccugcagagcugc

SEQ ID NO: 2616219 - RNA, 20 nt, Human
cucuugagaucuugguccug

SEQ ID NO: 2616220 - RNA, 14 nt, Human
cucuuggcuccacu

SEQ ID NO: 2616221 - RNA, 16 nt, Human
cucuuggccugaucag

SEQ ID NO: 2616222 - RNA, 19 nt, Human
cucuugguccugcugcagu

SEQ ID NO: 2616223 - RNA, 18 nt, Human
cucuugguccugcugcag

SEQ ID NO: 2616224 - RNA, 18 nt, Human
cucuugggcugagacugg

SEQ ID NO: 2616225 - RNA, 15 nt, Human
cucuuggucuuccca

SEQ ID NO: 2616226 - RNA, 17 nt, Human
cucuugggcugagacug

SEQ ID NO: 2616227 - RNA, 18 nt, Human
cucuuggucuucccaggc

SEQ ID NO: 2616228 - RNA, 20 nt, Human
cucuugguuuccuuccuugg

SEQ ID NO: 2616229 - RNA, 14 nt, Human
cucuuguaaauaaa

SEQ ID NO: 2616230 - RNA, 12 nt, Human
cucuuguaaaua

SEQ ID NO: 2616231 - RNA, 15 nt, Human
cucuugaccucaggu

SEQ ID NO: 2616232 - RNA, 13 nt, Human
cucuugaccucag

SEQ ID NO: 2616233 - RNA, 22 nt, Human
cucuugagcaguggcuggucca

SEQ ID NO: 2616234 - RNA, 18 nt, Human
cucuugagcaguggcugg

SEQ ID NO: 2616235 - RNA, 15 nt, Human
cucuugagcaguggc

SEQ ID NO: 2616236 - RNA, 16 nt, Human
cucuugaccucaggug

SEQ ID NO: 2616237 - RNA, 16 nt, Human
cucuugaacugagcuu

SEQ ID NO: 2616238 - RNA, 17 nt, Human
cucuugaacugagcuug

SEQ ID NO: 2616239 - RNA, 18 nt, Human
cucuugaacuccugaccu

SEQ ID NO: 2616240 - RNA, 20 nt, Human
cucuugaagaugcugaaaca

SEQ ID NO: 2616241 - RNA, 19 nt, Human
cucuugaacugagcuugga

SEQ ID NO: 2616242 - RNA, 20 nt, Human
cucuugaagacacugaaaua

SEQ ID NO: 2616243 - RNA, 21 nt, Human
cucuugaagacacugaaauau

SEQ ID NO: 2616244 - RNA, 18 nt, Human
cucuuucucugccaguga

SEQ ID NO: 2616245 - RNA, 17 nt, Human
cucuuucucugccagug

SEQ ID NO: 2616246 - RNA, 16 nt, Human
cucuuucucugccagu

SEQ ID NO: 2616247 - RNA, 15 nt, Human
cucuuucucugccag

SEQ ID NO: 2616248 - RNA, 13 nt, Human
cucuuucucugcc

SEQ ID NO: 2616249 - RNA, 19 nt, Human
cucuuucucuccuuucuuu

SEQ ID NO: 2616250 - RNA, 12 nt, Human
cucuuucucugc

SEQ ID NO: 2616251 - RNA, 17 nt, Human
cucuuucuauuguuucu

SEQ ID NO: 2616252 - RNA, 18 nt, Human
cucuuucuccuuagucuu

SEQ ID NO: 2616253 - RNA, 15 nt, Human
cucuuuggacacuca

SEQ ID NO: 2616254 - RNA, 18 nt, Human
cucuuuggacacucacac

SEQ ID NO: 2616255 - RNA, 12 nt, Human
cucuuugcuuug

SEQ ID NO: 2616256 - RNA, 15 nt, Human
cucuuucucuccuuu

SEQ ID NO: 2616257 - RNA, 13 nt, Human
cucuuugcuuugc

SEQ ID NO: 2616258 - RNA, 14 nt, Human
cucuuugcuuugcu

SEQ ID NO: 2616259 - RNA, 15 nt, Human
cucuuugcuuugcuu

SEQ ID NO: 2616260 - RNA, 16 nt, Human
cucuuugcuuugcuuu

SEQ ID NO: 2616261 - RNA, 18 nt, Human
cucuuugcuuugcuuucu

SEQ ID NO: 2616262 - RNA, 11 nt, Human
cucuuucugua

SEQ ID NO: 2616263 - RNA, 13 nt, Human
cucuuucuguaua

SEQ ID NO: 2616264 - RNA, 12 nt, Human
cucuuucugggc

SEQ ID NO: 2616265 - RNA, 14 nt, Human
cucuugugcuggau

SEQ ID NO: 2616266 - RNA, 12 nt, Human
cucuuucaaaac

SEQ ID NO: 2616267 - RNA, 23 nt, Human
cucuugugcuggauggagcccag

SEQ ID NO: 2616268 - RNA, 22 nt, Human
cucuuucaagcagucgugccug

SEQ ID NO: 2616269 - RNA, 11 nt, Human
cucuuucaaag

SEQ ID NO: 2616270 - RNA, 13 nt, Human
cucuuucauccac

SEQ ID NO: 2616271 - RNA, 12 nt, Human
cucuuucaucca

SEQ ID NO: 2616272 - RNA, 17 nt, Human
cucuuuccaucuacccu

SEQ ID NO: 2616273 - RNA, 23 nt, Human
cucuuguaaugauauagccagaa

SEQ ID NO: 2616274 - RNA, 16 nt, Human
cucuuggucuucccag

SEQ ID NO: 2616275 - RNA, 21 nt, Human
cucuuguaauccgaaucucuu

SEQ ID NO: 2616276 - RNA, 15 nt, Human
cucuuguauuaaacu

SEQ ID NO: 2616277 - RNA, 20 nt, Human
cucuugugaggaaagucauu

SEQ ID NO: 2616278 - RNA, 24 nt, Human
cucuuguaaauaaagcccugggau

SEQ ID NO: 2616279 - RNA, 23 nt, Human
cucuuguaaauaaagcccuggga

SEQ ID NO: 2616280 - RNA, 20 nt, Human
cucuuguaaauaaagcccug

SEQ ID NO: 2616281 - RNA, 19 nt, Human
cucuuguaaauaaagcccu

SEQ ID NO: 2616282 - RNA, 18 nt, Human
cucuuguaaauaaagccc

SEQ ID NO: 2616283 - RNA, 17 nt, Human
cucuuguaaauaaagcc

SEQ ID NO: 2616284 - RNA, 21 nt, Human
cucuuccaggcugggagagcc

SEQ ID NO: 2616285 - RNA, 22 nt, Human
cucuuccaggcugggagagccu

SEQ ID NO: 2616286 - RNA, 23 nt, Human
cucuuccaggcugggagagccuu

SEQ ID NO: 2616287 - RNA, 13 nt, Human
cucuucauacuuu

SEQ ID NO: 2616288 - RNA, 15 nt, Human
cucuucauaauucua

SEQ ID NO: 2616289 - RNA, 19 nt, Human
cucuuccagucuuccugac

SEQ ID NO: 2616290 - RNA, 19 nt, Human
cucuucauacuuuuuuuca

SEQ ID NO: 2616291 - RNA, 22 nt, Human
cucuuccagucuuccugacacu

SEQ ID NO: 2616292 - RNA, 23 nt, Human
cucuuccagucuuccugacacuu

SEQ ID NO: 2616293 - RNA, 14 nt, Human
cucuucuccacugg

SEQ ID NO: 2616294 - RNA, 17 nt, Human
cucuucuccacuggaug

SEQ ID NO: 2616295 - RNA, 15 nt, Human
cucuucuccacugga

SEQ ID NO: 2616296 - RNA, 16 nt, Human
cucuucuccccagagu

SEQ ID NO: 2616297 - RNA, 19 nt, Human
cucuucuccacuggaugga

SEQ ID NO: 2616298 - RNA, 12 nt, Human
cucuucuccagg

SEQ ID NO: 2616299 - RNA, 16 nt, Human
cucuucuccuuucaca

SEQ ID NO: 2616300 - RNA, 15 nt, Human
cucuucuccuuucac

SEQ ID NO: 2616301 - RNA, 13 nt, Human
cucuucuccuuuc

SEQ ID NO: 2616302 - RNA, 21 nt, Human
cucuucugggagggcagcagg

SEQ ID NO: 2616303 - RNA, 22 nt, Human
cucuucugggagggcagcaggg

SEQ ID NO: 2616304 - RNA, 11 nt, Human
cucuucuggcu

SEQ ID NO: 2616305 - RNA, 14 nt, Human
cucuucuggcucaa

SEQ ID NO: 2616306 - RNA, 20 nt, Human
cucuucugcuuaggagagac

SEQ ID NO: 2616307 - RNA, 13 nt, Human
cucuucugcucca

SEQ ID NO: 2616308 - RNA, 21 nt, Human
cucuucugcuccacccuuggc

SEQ ID NO: 2616309 - RNA, 19 nt, Human
cucuucugcuccacccuug

SEQ ID NO: 2616310 - RNA, 20 nt, Human
cucuucugcuccacccuugg

SEQ ID NO: 2616311 - RNA, 14 nt, Human
cucuucugcuccac

SEQ ID NO: 2616312 - RNA, 15 nt, Human
cucuucugcuccacc

SEQ ID NO: 2616313 - RNA, 16 nt, Human
cucuucugcuccaccc

SEQ ID NO: 2616314 - RNA, 18 nt, Human
cucuucugcuccacccuu

SEQ ID NO: 2616315 - RNA, 18 nt, Human
cucuggcagcucagagag

SEQ ID NO: 2616316 - RNA, 17 nt, Human
cucuggcagcucagaga

SEQ ID NO: 2616317 - RNA, 15 nt, Human
cucuggagcccacug

SEQ ID NO: 2616318 - RNA, 20 nt, Human
cucuguucugcacacagcac

SEQ ID NO: 2616319 - RNA, 21 nt, Human
cucuguucugcacacagcacg

SEQ ID NO: 2616320 - RNA, 19 nt, Human
cucuguucugcacacagca

SEQ ID NO: 2616321 - RNA, 23 nt, Human
cucuguuccccuaguaagugccu

SEQ ID NO: 2616322 - RNA, 22 nt, Human
cucuguuccuucacauccugug

SEQ ID NO: 2616323 - RNA, 19 nt, Human
cucuggcagcucagagagg

SEQ ID NO: 2616324 - RNA, 20 nt, Human
cucuggcagcucagagaggg

SEQ ID NO: 2616325 - RNA, 14 nt, Human
cucuguuccccuag

SEQ ID NO: 2616326 - RNA, 16 nt, Human
cucuguuccuucacau

SEQ ID NO: 2616327 - RNA, 13 nt, Human
cucuuaaaaccca

SEQ ID NO: 2616328 - RNA, 24 nt, Human
cucuuaaaacccaagugccuuagc

SEQ ID NO: 2616329 - RNA, 20 nt, Human
cucuguugcaagugcaauaa

SEQ ID NO: 2616330 - RNA, 20 nt, Human
cucuuaaagaaaacccaccc

SEQ ID NO: 2616331 - RNA, 20 nt, Human
cucuuaaagcugccuguagu

SEQ ID NO: 2616332 - RNA, 13 nt, Human
cucuuaagaagac

SEQ ID NO: 2616333 - RNA, 17 nt, Human
cucuuaacaauuucugu

SEQ ID NO: 2616334 - RNA, 22 nt, Human
cucuuaaagaaaacccaccccg

SEQ ID NO: 2616335 - RNA, 18 nt, Human
cucuucaggccucccucu

SEQ ID NO: 2616336 - RNA, 19 nt, Human
cucuucaggccucccucuc

SEQ ID NO: 2616337 - RNA, 20 nt, Human
cucuucaggccucccucucu

SEQ ID NO: 2616338 - RNA, 20 nt, Human
cucuucaguuaagccuuugg

SEQ ID NO: 2616339 - RNA, 23 nt, Human
cucuucaguuaagccuuuggaaa

SEQ ID NO: 2616340 - RNA, 19 nt, Human
cucuucaguuaagccuuug

SEQ ID NO: 2616341 - RNA, 14 nt, Human
cucuucagguucuu

SEQ ID NO: 2616342 - RNA, 15 nt, Human
cucuucagguucuua

SEQ ID NO: 2616343 - RNA, 22 nt, Human
cucuucagguucuuagugucac

SEQ ID NO: 2616344 - RNA, 17 nt, Human
cugaaguagugugcagu

SEQ ID NO: 2616345 - RNA, 16 nt, Human
cugaagucacacagug

SEQ ID NO: 2616346 - RNA, 15 nt, Human
cugaagucacacagu

SEQ ID NO: 2616347 - RNA, 19 nt, Human
cugaagguaaaauugaaag

SEQ ID NO: 2616348 - RNA, 19 nt, Human
cugaagaggcgggccagcc

SEQ ID NO: 2616349 - RNA, 18 nt, Human
cugaagaggcgggccagc

SEQ ID NO: 2616350 - RNA, 15 nt, Human
cugaagguugaagag

SEQ ID NO: 2616351 - RNA, 20 nt, Human
cugaagaggcgggccagcca

SEQ ID NO: 2616352 - RNA, 14 nt, Human
cugaagucacacag

SEQ ID NO: 2616353 - RNA, 24 nt, Human
cugaagucuuuguacagacaacaa

SEQ ID NO: 2616354 - RNA, 22 nt, Human
cugaagucacugcacagugcau

SEQ ID NO: 2616355 - RNA, 16 nt, Human
cugaagucacugcaca

SEQ ID NO: 2616356 - RNA, 17 nt, Human
cugaagucacugcacag

SEQ ID NO: 2616357 - RNA, 15 nt, Human
cugaauaaaugucuu

SEQ ID NO: 2616358 - RNA, 13 nt, Human
cugaauaaauguc

SEQ ID NO: 2616359 - RNA, 12 nt, Human
cugaauaaaugu

SEQ ID NO: 2616360 - RNA, 17 nt, Human
cugaauaaaugguagua

SEQ ID NO: 2616361 - RNA, 14 nt, Human
cugaauaaauggua

SEQ ID NO: 2616362 - RNA, 12 nt, Human
cugaauaaaugg

SEQ ID NO: 2616363 - RNA, 23 nt, Human
cugaaguggacucuuugguggcu

SEQ ID NO: 2616364 - RNA, 15 nt, Human
cugaaguggacucuu

SEQ ID NO: 2616365 - RNA, 18 nt, Human
cugaagugcauccaaagg

SEQ ID NO: 2616366 - RNA, 17 nt, Human
cugaagugcauccaaag

SEQ ID NO: 2616367 - RNA, 16 nt, Human
cugaagugcauccaaa

SEQ ID NO: 2616368 - RNA, 14 nt, Human
cugaagugcaucca

SEQ ID NO: 2616369 - RNA, 22 nt, Human
cugaagugcauccaaaggugcu

SEQ ID NO: 2616370 - RNA, 19 nt, Human
cugaagugcauccaaaggu

SEQ ID NO: 2616371 - RNA, 16 nt, Human
cugaagugcuuagugu

SEQ ID NO: 2616372 - RNA, 13 nt, Human
cugaagugaaacu

SEQ ID NO: 2616373 - RNA, 17 nt, Human
cugaagugaaacugcuu

SEQ ID NO: 2616374 - RNA, 21 nt, Human
cugaagugagcacagccuagg

SEQ ID NO: 2616375 - RNA, 19 nt, Human
cugaagugagcacagccua

SEQ ID NO: 2616376 - RNA, 18 nt, Human
cugaagugagcacagccu

SEQ ID NO: 2616377 - RNA, 19 nt, Human
cugaagugaaacugcuugu

SEQ ID NO: 2616378 - RNA, 16 nt, Human
cugaauacaaagugau

SEQ ID NO: 2616379 - RNA, 16 nt, Human
cugaauaauuucuuac

SEQ ID NO: 2616380 - RNA, 15 nt, Human
cugaauaauuucuua

SEQ ID NO: 2616381 - RNA, 13 nt, Human
cugaauaauuucu

SEQ ID NO: 2616382 - RNA, 16 nt, Human
cugaauacauucugcu

SEQ ID NO: 2616383 - RNA, 18 nt, Human
cugaauacauucugcuuu

SEQ ID NO: 2616384 - RNA, 20 nt, Human
cugaauaacauuuguguggu

SEQ ID NO: 2616385 - RNA, 15 nt, Human
cugaauaacauuugu

SEQ ID NO: 2616386 - RNA, 11 nt, Human
cugaauaauaa

SEQ ID NO: 2616387 - RNA, 16 nt, Human
cugaauacagaggcaa

SEQ ID NO: 2616388 - RNA, 21 nt, Human
cugaagacucauucuucugua

SEQ ID NO: 2616389 - RNA, 19 nt, Human
cugaagacucauucuucug

SEQ ID NO: 2616390 - RNA, 16 nt, Human
cugaaccuuccaucuc

SEQ ID NO: 2616391 - RNA, 22 nt, Human
cugaacuucaggauaauaaagu

SEQ ID NO: 2616392 - RNA, 21 nt, Human
cugaagagaagggcagggcug

SEQ ID NO: 2616393 - RNA, 16 nt, Human
cugaagaggcgggcca

SEQ ID NO: 2616394 - RNA, 15 nt, Human
cugaagaggcgggcc

SEQ ID NO: 2616395 - RNA, 14 nt, Human
cugaagaggcgggc

SEQ ID NO: 2616396 - RNA, 15 nt, Human
cugaacccugugcug

SEQ ID NO: 2616397 - RNA, 20 nt, Human
cugaagagcuauuauauaaa

SEQ ID NO: 2616398 - RNA, 21 nt, Human
cugaacuuggcgcugccccug

SEQ ID NO: 2616399 - RNA, 16 nt, Human
cugaacuuggcgcugc

SEQ ID NO: 2616400 - RNA, 15 nt, Human
cugaacuuggcgcug

SEQ ID NO: 2616401 - RNA, 14 nt, Human
cugaaccuuccauc

SEQ ID NO: 2616402 - RNA, 21 nt, Human
cucuuuggucuacacugugcu

SEQ ID NO: 2616403 - RNA, 19 nt, Human
cucuuuggucuacacugug

SEQ ID NO: 2616404 - RNA, 18 nt, Human
cucuuuggcuccccugua

SEQ ID NO: 2616405 - RNA, 15 nt, Human
cucuuuggcagucua

SEQ ID NO: 2616406 - RNA, 20 nt, Human
cucuuugcuuugcuuucugc

SEQ ID NO: 2616407 - RNA, 22 nt, Human
cucuuugcuuugcuuucugcuc

SEQ ID NO: 2616408 - RNA, 18 nt, Human
cucuuugggccuggcucc

SEQ ID NO: 2616409 - RNA, 20 nt, Human
cugaacccugugcugguguc

SEQ ID NO: 2616410 - RNA, 23 nt, Human
cugaacccugugcugguguccug

SEQ ID NO: 2616411 - RNA, 18 nt, Human
cugaacccugugcuggug

SEQ ID NO: 2616412 - RNA, 17 nt, Human
cugaacccugugcuggu

SEQ ID NO: 2616413 - RNA, 20 nt, Human
cucuuuggggucagccaggg

SEQ ID NO: 2616414 - RNA, 19 nt, Human
cucuuuggggucagccagg

SEQ ID NO: 2616415 - RNA, 17 nt, Human
cucuuuggggucagcca

SEQ ID NO: 2616416 - RNA, 21 nt, Human
cucuuugggaauguuugucuc

SEQ ID NO: 2616417 - RNA, 20 nt, Human
cucuuugggaauguuugucu

SEQ ID NO: 2616418 - RNA, 15 nt, Human
cucuuugggaauguu

SEQ ID NO: 2616419 - RNA, 17 nt, Human
cugaaccggcuuuacca

SEQ ID NO: 2616420 - RNA, 14 nt, Human
cugaaccugaugcu

SEQ ID NO: 2616421 - RNA, 17 nt, Human
cugaaccugaugcugac

SEQ ID NO: 2616422 - RNA, 20 nt, Human
cugaaccggcuuuaccaaac

SEQ ID NO: 2616423 - RNA, 21 nt, Human
cugaaccuggguaacuaggga

SEQ ID NO: 2616424 - RNA, 11 nt, Human
cugacccacug

SEQ ID NO: 2616425 - RNA, 15 nt, Human
cugaccaugcucauc

SEQ ID NO: 2616426 - RNA, 23 nt, Human
cugaccauccacucuacccuccc

SEQ ID NO: 2616427 - RNA, 19 nt, Human
cugaccauccacucuaccc

SEQ ID NO: 2616428 - RNA, 22 nt, Human
cugaccauccacucuacccucc

SEQ ID NO: 2616429 - RNA, 13 nt, Human
cugaccagaacua

SEQ ID NO: 2616430 - RNA, 13 nt, Human
cugaccagcagcg

SEQ ID NO: 2616431 - RNA, 14 nt, Human
cugaccagcagcgc

SEQ ID NO: 2616432 - RNA, 15 nt, Human
cugaccagcagcgcc

SEQ ID NO: 2616433 - RNA, 15 nt, Human
cugaccauccacucu

SEQ ID NO: 2616434 - RNA, 16 nt, Human
cugaccauccacucua

SEQ ID NO: 2616435 - RNA, 17 nt, Human
cugaccacccuccccuc

SEQ ID NO: 2616436 - RNA, 16 nt, Human
cugaccacccuccccu

SEQ ID NO: 2616437 - RNA, 14 nt, Human
cugaccacccuccc

SEQ ID NO: 2616438 - RNA, 13 nt, Human
cugaccacccucc

SEQ ID NO: 2616439 - RNA, 12 nt, Human
cugaccacccuc

SEQ ID NO: 2616440 - RNA, 20 nt, Human
cugacauuguggcacauucu

SEQ ID NO: 2616441 - RNA, 18 nt, Human
cugaccacagcacagcca

SEQ ID NO: 2616442 - RNA, 23 nt, Human
cugaccacggacguuuccaucag

SEQ ID NO: 2616443 - RNA, 22 nt, Human
cugaccacggacguuuccauca

SEQ ID NO: 2616444 - RNA, 22 nt, Human
cugaccacgcuuucuagcuguu

SEQ ID NO: 2616445 - RNA, 16 nt, Human
cugacauuggagccug

SEQ ID NO: 2616446 - RNA, 15 nt, Human
cugacauuggagccu

SEQ ID NO: 2616447 - RNA, 12 nt, Human
cugaccacagca

SEQ ID NO: 2616448 - RNA, 14 nt, Human
cugaccacagcaca

SEQ ID NO: 2616449 - RNA, 15 nt, Human
cugaccacagcacag

SEQ ID NO: 2616450 - RNA, 19 nt, Human
cugacauucucaggaagcc

SEQ ID NO: 2616451 - RNA, 14 nt, Human
cugacauuggagcc

SEQ ID NO: 2616452 - RNA, 21 nt, Human
cugaccacacuuccuguccag

SEQ ID NO: 2616453 - RNA, 19 nt, Human
cugacaggcaaugcuggcu

SEQ ID NO: 2616454 - RNA, 18 nt, Human
cugacaggcaaugcuggc

SEQ ID NO: 2616455 - RNA, 17 nt, Human
cugacaggcaaugcugg

SEQ ID NO: 2616456 - RNA, 16 nt, Human
cugacaggcaaugcug

SEQ ID NO: 2616457 - RNA, 20 nt, Human
cugacaggcaaugcuggcug

SEQ ID NO: 2616458 - RNA, 21 nt, Human
cugacauuaacaguuuuccau

SEQ ID NO: 2616459 - RNA, 16 nt, Human
cugacauucaccugcc

SEQ ID NO: 2616460 - RNA, 22 nt, Human
cugacagcugcuccuagaggga

SEQ ID NO: 2616461 - RNA, 23 nt, Human
cugacauuaacaguuuuccauga

SEQ ID NO: 2616462 - RNA, 17 nt, Human
cugacauucaccugccc

SEQ ID NO: 2616463 - RNA, 23 nt, Human
cugacauucaccugccccaacuc

SEQ ID NO: 2616464 - RNA, 17 nt, Human
cugacauuguuggccaa

SEQ ID NO: 2616465 - RNA, 17 nt, Human
cugacagacagcccucc

SEQ ID NO: 2616466 - RNA, 19 nt, Human
cugacagacagcccuccau

SEQ ID NO: 2616467 - RNA, 21 nt, Human
cugacagacacaggcccggcu

SEQ ID NO: 2616468 - RNA, 11 nt, Human
cugacaggcaa

SEQ ID NO: 2616469 - RNA, 19 nt, Human
cugacagcugcuccuagag

SEQ ID NO: 2616470 - RNA, 23 nt, Human
cugacagcugcuccuagagggag

SEQ ID NO: 2616471 - RNA, 12 nt, Human
cugacagaggag

SEQ ID NO: 2616472 - RNA, 19 nt, Human
cugacagacacaggcccgg

SEQ ID NO: 2616473 - RNA, 16 nt, Human
cugaauuguccccagu

SEQ ID NO: 2616474 - RNA, 23 nt, Human
cugaauucuauuugcugggcuuu

SEQ ID NO: 2616475 - RNA, 17 nt, Human
cugaauucuauuugcug

SEQ ID NO: 2616476 - RNA, 15 nt, Human
cugaauuguccccag

SEQ ID NO: 2616477 - RNA, 19 nt, Human
cugaauccaaacuaaucca

SEQ ID NO: 2616478 - RNA, 20 nt, Human
cugaauccaaacuaauccau

SEQ ID NO: 2616479 - RNA, 22 nt, Human
cugaaucauucucgauuuaacu

SEQ ID NO: 2616480 - RNA, 19 nt, Human
cugaauaugaggcauuugg

SEQ ID NO: 2616481 - RNA, 21 nt, Human
cugaauaugaacggugagcau

SEQ ID NO: 2616482 - RNA, 16 nt, Human
cugaauauuuauauuu

SEQ ID NO: 2616483 - RNA, 20 nt, Human
cugaauauuuauauuucacu

SEQ ID NO: 2616484 - RNA, 21 nt, Human
cugaauauuuauauuucacua

SEQ ID NO: 2616485 - RNA, 23 nt, Human
cugaauaggcgaucacaacgugc

SEQ ID NO: 2616486 - RNA, 21 nt, Human
cugaauaggcgaucacaacgu

SEQ ID NO: 2616487 - RNA, 17 nt, Human
cugaauauacagcaggu

SEQ ID NO: 2616488 - RNA, 18 nt, Human
cugaauaggcgaucacaa

SEQ ID NO: 2616489 - RNA, 15 nt, Human
cugaauagcagaagg

SEQ ID NO: 2616490 - RNA, 22 nt, Human
cugaaucccccuugccacccca

SEQ ID NO: 2616491 - RNA, 21 nt, Human
cugaaucccccuugccacccc

SEQ ID NO: 2616492 - RNA, 20 nt, Human
cugaaucccccuugccaccc

SEQ ID NO: 2616493 - RNA, 19 nt, Human
cugaaucccccuugccacc

SEQ ID NO: 2616494 - RNA, 17 nt, Human
cugaaugaaacccccac

SEQ ID NO: 2616495 - RNA, 18 nt, Human
cugaaugaaacccccaca

SEQ ID NO: 2616496 - RNA, 19 nt, Human
cugaaugaaacccccacac

SEQ ID NO: 2616497 - RNA, 20 nt, Human
cugaaugaaacccccacaca

SEQ ID NO: 2616498 - RNA, 21 nt, Human
cugaaugaaacccccacacac

SEQ ID NO: 2616499 - RNA, 22 nt, Human
cugaaugaaacccccacacaca

SEQ ID NO: 2616500 - RNA, 23 nt, Human
cugaaugaaacccccacacacac

SEQ ID NO: 2616501 - RNA, 17 nt, Human
cugaaugaaauaucaga

SEQ ID NO: 2616502 - RNA, 16 nt, Human
cugaauucuauuugcu

SEQ ID NO: 2616503 - RNA, 22 nt, Human
cugaaugaaccuucuggccucc

SEQ ID NO: 2616504 - RNA, 16 nt, Human
cuuagacagucccugc

SEQ ID NO: 2616505 - RNA, 15 nt, Human
cuuagacagucccug

SEQ ID NO: 2616506 - RNA, 14 nt, Human
cuuagacagucccu

SEQ ID NO: 2616507 - RNA, 15 nt, Human
cuuagaagucacaca

SEQ ID NO: 2616508 - RNA, 14 nt, Human
cuuagaaauuuauu

SEQ ID NO: 2616509 - RNA, 17 nt, Human
cuuagaaauugcauuuc

SEQ ID NO: 2616510 - RNA, 15 nt, Human
cuuagaaauuuauuu

SEQ ID NO: 2616511 - RNA, 12 nt, Human
cuuagaacauuu

SEQ ID NO: 2616512 - RNA, 15 nt, Human
cuuagaacauuuuaa

SEQ ID NO: 2616513 - RNA, 16 nt, Human
cuuagaacauuuuaau

SEQ ID NO: 2616514 - RNA, 19 nt, Human
cuuagaacauuuuaauuca

SEQ ID NO: 2616515 - RNA, 15 nt, Human
cuuagaaccuuucuu

SEQ ID NO: 2616516 - RNA, 18 nt, Human
cuuagacagucccugcca

SEQ ID NO: 2616517 - RNA, 17 nt, Human
cuuagacagucccugcc

SEQ ID NO: 2616518 - RNA, 19 nt, Human
cuuagacagucccugccaa

SEQ ID NO: 2616519 - RNA, 16 nt, Human
cuuagacauaacaaaa

SEQ ID NO: 2616520 - RNA, 11 nt, Human
cuuagacaguc

SEQ ID NO: 2616521 - RNA, 19 nt, Human
cuuagaugcaguucugaag

SEQ ID NO: 2616522 - RNA, 23 nt, Human
cuuacuuuccuuuccccagccca

SEQ ID NO: 2616523 - RNA, 22 nt, Human
cuuacuuuccuuuccccagccc

SEQ ID NO: 2616524 - RNA, 21 nt, Human
cuuacuuuccuuuccccagcc

SEQ ID NO: 2616525 - RNA, 20 nt, Human
cuuacuuuccuuuccccagc

SEQ ID NO: 2616526 - RNA, 15 nt, Human
cuuacuguuucuguc

SEQ ID NO: 2616527 - RNA, 14 nt, Human
cuuacuguuucugu

SEQ ID NO: 2616528 - RNA, 13 nt, Human
cuuacuguuucug

SEQ ID NO: 2616529 - RNA, 19 nt, Human
cuuacuguggaggaaggau

SEQ ID NO: 2616530 - RNA, 19 nt, Human
cuuacuguuucugucagga

SEQ ID NO: 2616531 - RNA, 16 nt, Human
cuuacuguuucuguca

SEQ ID NO: 2616532 - RNA, 14 nt, Human
cuuacuuacccuca

SEQ ID NO: 2616533 - RNA, 21 nt, Human
cuuacuguuucugucaggaga

SEQ ID NO: 2616534 - RNA, 14 nt, Human
cuuacuuaguguua

SEQ ID NO: 2616535 - RNA, 23 nt, Human
cuuacuguaccuguuccuuagac

SEQ ID NO: 2616536 - RNA, 18 nt, Human
cuuacuguaccuguuccu

SEQ ID NO: 2616537 - RNA, 15 nt, Human
cuuacuguaccuguu

SEQ ID NO: 2616538 - RNA, 18 nt, Human
cuuacuguggaggaagga

SEQ ID NO: 2616539 - RNA, 17 nt, Human
cuuacuguggaggaagg

SEQ ID NO: 2616540 - RNA, 16 nt, Human
cuuacuguggaggaag

SEQ ID NO: 2616541 - RNA, 16 nt, Human
cuuacuguacaugaaa

SEQ ID NO: 2616542 - RNA, 13 nt, Human
cuuacuguacaug

SEQ ID NO: 2616543 - RNA, 20 nt, Human
cuuacuacaugugggagcuu

SEQ ID NO: 2616544 - RNA, 14 nt, Human
cuuacuccaggaga

SEQ ID NO: 2616545 - RNA, 23 nt, Human
cuuacuaagcuuugccagcugcu

SEQ ID NO: 2616546 - RNA, 21 nt, Human
cuuacuaagcuuugccagcug

SEQ ID NO: 2616547 - RNA, 22 nt, Human
cuuacuaaacauuuuguuauug

SEQ ID NO: 2616548 - RNA, 21 nt, Human
cuuacuaaacauuuuguuauu

SEQ ID NO: 2616549 - RNA, 15 nt, Human
cuuacgugaguccug

SEQ ID NO: 2616550 - RNA, 19 nt, Human
cuuacuaguuucccuugca

SEQ ID NO: 2616551 - RNA, 24 nt, Human
cuuacuaagcuuugccagcugcug

SEQ ID NO: 2616552 - RNA, 18 nt, Human
cuuacuacaugugggagc

SEQ ID NO: 2616553 - RNA, 15 nt, Human
cuuaaugcuucuuuc

SEQ ID NO: 2616554 - RNA, 21 nt, Human
cuuaaugauccguuccauugc

SEQ ID NO: 2616555 - RNA, 19 nt, Human
cuuaccuuuuuauuugcau

SEQ ID NO: 2616556 - RNA, 23 nt, Human
cuuacgaauacuuuugcccuuug

SEQ ID NO: 2616557 - RNA, 19 nt, Human
cuuacgcccaacccuuccc

SEQ ID NO: 2616558 - RNA, 20 nt, Human
cuuaccuuuuuauuugcaug

SEQ ID NO: 2616559 - RNA, 18 nt, Human
cuuacgauggcacccagu

SEQ ID NO: 2616560 - RNA, 21 nt, Human
cuuaugacaucacuuguacaa

SEQ ID NO: 2616561 - RNA, 13 nt, Human
cuuaugagauggg

SEQ ID NO: 2616562 - RNA, 22 nt, Human
cuuaugacaucacuuguacaaa

SEQ ID NO: 2616563 - RNA, 15 nt, Human
cuuaugauugcagau

SEQ ID NO: 2616564 - RNA, 14 nt, Human
cuuaugccacggga

SEQ ID NO: 2616565 - RNA, 23 nt, Human
cuuaugauucagauuguuaucua

SEQ ID NO: 2616566 - RNA, 12 nt, Human
cuuauuguucca

SEQ ID NO: 2616567 - RNA, 13 nt, Human
cuuauuguuccaa

SEQ ID NO: 2616568 - RNA, 14 nt, Human
cuuauuguuccaag

SEQ ID NO: 2616569 - RNA, 15 nt, Human
cuuauuguuccaaga

SEQ ID NO: 2616570 - RNA, 17 nt, Human
cuuauuguuccaagaca

SEQ ID NO: 2616571 - RNA, 15 nt, Human
cuuauuuaaugaaag

SEQ ID NO: 2616572 - RNA, 22 nt, Human
cuuauuguuccaagacauuguc

SEQ ID NO: 2616573 - RNA, 19 nt, Human
cuuauuguuccaagacauu

SEQ ID NO: 2616574 - RNA, 20 nt, Human
cuuauuguuccaagacauug

SEQ ID NO: 2616575 - RNA, 14 nt, Human
cuuauuuucaagaa

SEQ ID NO: 2616576 - RNA, 15 nt, Human
cuuauuuucaagaaa

SEQ ID NO: 2616577 - RNA, 18 nt, Human
cuuauuuucaagaaacug

SEQ ID NO: 2616578 - RNA, 19 nt, Human
cuuauuuucaagaaacuga

SEQ ID NO: 2616579 - RNA, 12 nt, Human
cuuauuuucaag

SEQ ID NO: 2616580 - RNA, 14 nt, Human
cuuaucugugcuca

SEQ ID NO: 2616581 - RNA, 16 nt, Human
cuuaucugugcucagg

SEQ ID NO: 2616582 - RNA, 15 nt, Human
cuuaucucucugugc

SEQ ID NO: 2616583 - RNA, 19 nt, Human
cuuaucugugcgugaaaca

SEQ ID NO: 2616584 - RNA, 20 nt, Human
cuuaucugugcgugaaacac

SEQ ID NO: 2616585 - RNA, 21 nt, Human
cuuaucugugcgugaaacaca

SEQ ID NO: 2616586 - RNA, 14 nt, Human
cuuaucuuaugcca

SEQ ID NO: 2616587 - RNA, 22 nt, Human
cuuaucugugcucaggacucag

SEQ ID NO: 2616588 - RNA, 21 nt, Human
cuuaucucucugugcugugga

SEQ ID NO: 2616589 - RNA, 14 nt, Human
cuuaucucucugug

SEQ ID NO: 2616590 - RNA, 13 nt, Human
cuuaucucucugu

SEQ ID NO: 2616591 - RNA, 17 nt, Human
cuuaucugugcgugaaa

SEQ ID NO: 2616592 - RNA, 12 nt, Human
cuuaucucucug

SEQ ID NO: 2616593 - RNA, 16 nt, Human
cuuaucuccaagacca

SEQ ID NO: 2616594 - RNA, 13 nt, Human
cuuaucuccaaga

SEQ ID NO: 2616595 - RNA, 14 nt, Human
cuuaucuccaagac

SEQ ID NO: 2616596 - RNA, 14 nt, Human
cuuaucaaaggaca

SEQ ID NO: 2616597 - RNA, 18 nt, Human
cuuauauuguaagaaaua

SEQ ID NO: 2616598 - RNA, 14 nt, Human
cuuauauuguaaga

SEQ ID NO: 2616599 - RNA, 17 nt, Human
cuuauauuguaagaaau

SEQ ID NO: 2616600 - RNA, 23 nt, Human
cuuaucucagucaugcauaaaua

SEQ ID NO: 2616601 - RNA, 22 nt, Human
cuuaucucagucaugcauaaau

SEQ ID NO: 2616602 - RNA, 21 nt, Human
cuuaucucagucaugcauaaa

SEQ ID NO: 2616603 - RNA, 16 nt, Human
cuuaucaagugucuuc

SEQ ID NO: 2616604 - RNA, 15 nt, Human
cuuaucaagugucuu

SEQ ID NO: 2616605 - RNA, 14 nt, Human
cuuaucaagugucu

SEQ ID NO: 2616606 - RNA, 12 nt, Human
cuuaucaagugu

SEQ ID NO: 2616607 - RNA, 11 nt, Human
cuuaucaagug

SEQ ID NO: 2616608 - RNA, 16 nt, Human
cuuaucaaaggacacc

SEQ ID NO: 2616609 - RNA, 14 nt, Human
cuuauaauuuaaaa

SEQ ID NO: 2616610 - RNA, 19 nt, Human
cuuauaggaauugacccac

SEQ ID NO: 2616611 - RNA, 15 nt, Human
cuuauacauuugaua

SEQ ID NO: 2616612 - RNA, 13 nt, Human
cuuauagguggcc

SEQ ID NO: 2616613 - RNA, 23 nt, Human
cuuauagucaauguuucuuuuau

SEQ ID NO: 2616614 - RNA, 13 nt, Human
cuuauaaauauga

SEQ ID NO: 2616615 - RNA, 17 nt, Human
cuuauaaauaugaagcu

SEQ ID NO: 2616616 - RNA, 13 nt, Human
cuuauaauuuaaa

SEQ ID NO: 2616617 - RNA, 21 nt, Human
cuuaggguuaugauuaaguaa

SEQ ID NO: 2616618 - RNA, 20 nt, Human
cuuaggugauccacucgccu

SEQ ID NO: 2616619 - RNA, 21 nt, Human
cuuagguggcaagcugugacu

SEQ ID NO: 2616620 - RNA, 18 nt, Human
cuuagguacuuauuccag

SEQ ID NO: 2616621 - RNA, 17 nt, Human
cuuagguuggcaaaaag

SEQ ID NO: 2616622 - RNA, 12 nt, Human
cuuauaaauaug

SEQ ID NO: 2616623 - RNA, 16 nt, Human
cuuaacggcuccagga

SEQ ID NO: 2616624 - RNA, 15 nt, Human
cuuaacggcuccagg

SEQ ID NO: 2616625 - RNA, 14 nt, Human
cuuaacggcuccag

SEQ ID NO: 2616626 - RNA, 15 nt, Human
cuuaaauucauuuua

SEQ ID NO: 2616627 - RNA, 16 nt, Human
cuuaaauuuuaauuua

SEQ ID NO: 2616628 - RNA, 12 nt, Human
cuuaaccaucuu

SEQ ID NO: 2616629 - RNA, 20 nt, Human
cuuaaccccaguaagccacu

SEQ ID NO: 2616630 - RNA, 17 nt, Human
cuuaaaaaaaugacaga

SEQ ID NO: 2616631 - RNA, 12 nt, Human
cuuaaaaaacuu

SEQ ID NO: 2616632 - RNA, 18 nt, Human
cuuaaaaaacuuguaaau

SEQ ID NO: 2616633 - RNA, 17 nt, Human
cuguuuuuuccugagcu

SEQ ID NO: 2616634 - RNA, 18 nt, Human
cuguuuuuuccugagcuu

SEQ ID NO: 2616635 - RNA, 15 nt, Human
cuuaaaaaaaugaca

SEQ ID NO: 2616636 - RNA, 14 nt, Human
cuguuuuuguagug

SEQ ID NO: 2616637 - RNA, 13 nt, Human
cuguuuuuuaguu

SEQ ID NO: 2616638 - RNA, 16 nt, Human
cuuaaaugagaaggaa

SEQ ID NO: 2616639 - RNA, 17 nt, Human
cuuaaaaaauaaaaacu

SEQ ID NO: 2616640 - RNA, 13 nt, Human
cuuaaaaaauguc

SEQ ID NO: 2616641 - RNA, 21 nt, Human
cuuaaaugaaagcauguggca

SEQ ID NO: 2616642 - RNA, 15 nt, Human
cuuaacuucacauau

SEQ ID NO: 2616643 - RNA, 16 nt, Human
cuuaacuucacauauu

SEQ ID NO: 2616644 - RNA, 17 nt, Human
cuuaacuucacauauug

SEQ ID NO: 2616645 - RNA, 22 nt, Human
cuuaacuucacauauugauuuc

SEQ ID NO: 2616646 - RNA, 12 nt, Human
cuuaacuucaca

SEQ ID NO: 2616647 - RNA, 14 nt, Human
cuuaacuucacaua

SEQ ID NO: 2616648 - RNA, 16 nt, Human
cuuaacuggagcccca

SEQ ID NO: 2616649 - RNA, 17 nt, Human
cuuaacuccuuccagug

SEQ ID NO: 2616650 - RNA, 22 nt, Human
cuuaacuuaaauuuuaauuuau

SEQ ID NO: 2616651 - RNA, 11 nt, Human
cuuaacuauuc

SEQ ID NO: 2616652 - RNA, 19 nt, Human
cuuaacugcauuuuuagac

SEQ ID NO: 2616653 - RNA, 19 nt, Human
cuuaagccaucuugguaaa

SEQ ID NO: 2616654 - RNA, 17 nt, Human
cuuaagccaucuuggua

SEQ ID NO: 2616655 - RNA, 16 nt, Human
cuuaagccaucuuggu

SEQ ID NO: 2616656 - RNA, 15 nt, Human
cuuaagccaucuugg

SEQ ID NO: 2616657 - RNA, 18 nt, Human
cuuaagcagaagcauuaa

SEQ ID NO: 2616658 - RNA, 14 nt, Human
cuuaagcagaagca

SEQ ID NO: 2616659 - RNA, 22 nt, Human
cuuaagccaucuugguaaauuu

SEQ ID NO: 2616660 - RNA, 20 nt, Human
cuuaagccaucuugguaaau

SEQ ID NO: 2616661 - RNA, 23 nt, Human
cuuaagccaucuugguaaauuuc

SEQ ID NO: 2616662 - RNA, 20 nt, Human
cuuaagccuuuugcucacaa

SEQ ID NO: 2616663 - RNA, 23 nt, Human
cuuaagagaauauuuuaaguauu

SEQ ID NO: 2616664 - RNA, 18 nt, Human
cuuaagagaauauuuuaa

SEQ ID NO: 2616665 - RNA, 14 nt, Human
cuuaagagaauauu

SEQ ID NO: 2616666 - RNA, 13 nt, Human
cuuaagagaauau

SEQ ID NO: 2616667 - RNA, 17 nt, Human
cuuaagagaugccucau

SEQ ID NO: 2616668 - RNA, 16 nt, Human
cuuaagaacugcuuuc

SEQ ID NO: 2616669 - RNA, 14 nt, Human
cuuaaucuaaaugg

SEQ ID NO: 2616670 - RNA, 16 nt, Human
cuuaaucuaaauggaa

SEQ ID NO: 2616671 - RNA, 18 nt, Human
cuuaaugccacuaaauug

SEQ ID NO: 2616672 - RNA, 18 nt, Human
cuuaauccagcugaugag

SEQ ID NO: 2616673 - RNA, 14 nt, Human
cuuaaugagauagu

SEQ ID NO: 2616674 - RNA, 12 nt, Human
cuuaaugagaua

SEQ ID NO: 2616675 - RNA, 16 nt, Human
cuuaaguuuauacucu

SEQ ID NO: 2616676 - RNA, 20 nt, Human
cuuaaguuucucagcuccca

SEQ ID NO: 2616677 - RNA, 16 nt, Human
cuuaaguuucucagcu

SEQ ID NO: 2616678 - RNA, 15 nt, Human
cuuaaguuucucagc

SEQ ID NO: 2616679 - RNA, 17 nt, Human
cuuaaguuucucagcuc

SEQ ID NO: 2616680 - RNA, 12 nt, Human
cuuaauaaauuc

SEQ ID NO: 2616681 - RNA, 18 nt, Human
cuuaaucaauuaauuuuu

SEQ ID NO: 2616682 - RNA, 20 nt, Human
cuuaaucagguccucagaga

SEQ ID NO: 2616683 - RNA, 22 nt, Human
cuuaaucagguccucagagaau

SEQ ID NO: 2616684 - RNA, 17 nt, Human
cuuaauaaauucagaua

SEQ ID NO: 2616685 - RNA, 18 nt, Human
cuuaauaaauucagauau

SEQ ID NO: 2616686 - RNA, 12 nt, Human
cuguuuuaugac

SEQ ID NO: 2616687 - RNA, 13 nt, Human
cuguuuuaugacu

SEQ ID NO: 2616688 - RNA, 14 nt, Human
cuguuuuaugacuu

SEQ ID NO: 2616689 - RNA, 15 nt, Human
cuguuuuaugacuuc

SEQ ID NO: 2616690 - RNA, 21 nt, Human
cuguuuuauuuuaauucaguu

SEQ ID NO: 2616691 - RNA, 13 nt, Human
cuguuuucucuug

SEQ ID NO: 2616692 - RNA, 14 nt, Human
cuguuuucucuuga

SEQ ID NO: 2616693 - RNA, 23 nt, Human
cuguuuguuucugaaagggacgc

SEQ ID NO: 2616694 - RNA, 21 nt, Human
cuguuuguuucugaaagggac

SEQ ID NO: 2616695 - RNA, 19 nt, Human
cuguuuuauaauuuuguga

SEQ ID NO: 2616696 - RNA, 12 nt, Human
cuguuuuaaauu

SEQ ID NO: 2616697 - RNA, 14 nt, Human
cuguuuuaaguucu

SEQ ID NO: 2616698 - RNA, 22 nt, Human
cuguuuuaaauuuauuucaaaa

SEQ ID NO: 2616699 - RNA, 17 nt, Human
cuguuucugcuugcucu

SEQ ID NO: 2616700 - RNA, 20 nt, Human
cuguuuguuugacaaagaaa

SEQ ID NO: 2616701 - RNA, 17 nt, Human
cuguuuucucuugagag

SEQ ID NO: 2616702 - RNA, 20 nt, Human
cuguuuucugagcccgggcu

SEQ ID NO: 2616703 - RNA, 19 nt, Human
cuguuuucugagcccgggc

SEQ ID NO: 2616704 - RNA, 17 nt, Human
cuguuuucugagcccgg

SEQ ID NO: 2616705 - RNA, 15 nt, Human
cuguuuucugagccc

SEQ ID NO: 2616706 - RNA, 16 nt, Human
cuguuuuaugacuuca

SEQ ID NO: 2616707 - RNA, 13 nt, Human
cuguuuucugagc

SEQ ID NO: 2616708 - RNA, 14 nt, Human
cuguuuuauacugu

SEQ ID NO: 2616709 - RNA, 12 nt, Human
cuguuuucuucu

SEQ ID NO: 2616710 - RNA, 18 nt, Human
cuguuuucuucuauucca

SEQ ID NO: 2616711 - RNA, 14 nt, Human
cuguuuucuguuuc

SEQ ID NO: 2616712 - RNA, 17 nt, Human
cuguuuugaaggcaaaa

SEQ ID NO: 2616713 - RNA, 12 nt, Human
cuguuuugaauu

SEQ ID NO: 2616714 - RNA, 22 nt, Human
cuguuuugccugaaguuggagu

SEQ ID NO: 2616715 - RNA, 15 nt, Human
cuguuuuucugggug

SEQ ID NO: 2616716 - RNA, 21 nt, Human
cuguuuuucuggguggccucg

SEQ ID NO: 2616717 - RNA, 21 nt, Human
cuguuuuucagggagguggcu

SEQ ID NO: 2616718 - RNA, 14 nt, Human
cuguuuuguucugu

SEQ ID NO: 2616719 - RNA, 20 nt, Human
cuguuuuguggucagcugua

SEQ ID NO: 2616720 - RNA, 15 nt, Human
cuguuuauagaauaa

SEQ ID NO: 2616721 - RNA, 13 nt, Human
cuguuuauggccu

SEQ ID NO: 2616722 - RNA, 14 nt, Human
cuguuuauggccuc

SEQ ID NO: 2616723 - RNA, 15 nt, Human
cuguuuauggccuca

SEQ ID NO: 2616724 - RNA, 16 nt, Human
cuguuuauggccucag

SEQ ID NO: 2616725 - RNA, 12 nt, Human
cuguuuagauaa

SEQ ID NO: 2616726 - RNA, 18 nt, Human
cuguuuacaagaaaaaau

SEQ ID NO: 2616727 - RNA, 20 nt, Human
cuguuuacaagaaaaaauga

SEQ ID NO: 2616728 - RNA, 17 nt, Human
cugguugaugccuguga

SEQ ID NO: 2616729 - RNA, 23 nt, Human
cugguucugaugaugugccuggg

SEQ ID NO: 2616730 - RNA, 23 nt, Human
cugguuggagagcuagaaccugg

SEQ ID NO: 2616731 - RNA, 17 nt, Human
cugguuggagagcuaga

SEQ ID NO: 2616732 - RNA, 18 nt, Human
cugguugcugugugguuu

SEQ ID NO: 2616733 - RNA, 15 nt, Human
cugguugcugugugg

SEQ ID NO: 2616734 - RNA, 14 nt, Human
cugguugcugugug

SEQ ID NO: 2616735 - RNA, 13 nt, Human
cugguugcugugu

SEQ ID NO: 2616736 - RNA, 13 nt, Human
cuguuuacagugu

SEQ ID NO: 2616737 - RNA, 15 nt, Human
cuguuuacaguguuc

SEQ ID NO: 2616738 - RNA, 21 nt, Human
cuguuuaauauuuaaacagca

SEQ ID NO: 2616739 - RNA, 14 nt, Human
cuguuuacaagaaa

SEQ ID NO: 2616740 - RNA, 15 nt, Human
cuguuuacaagaaaa

SEQ ID NO: 2616741 - RNA, 16 nt, Human
cuguuuacaagaaaaa

SEQ ID NO: 2616742 - RNA, 17 nt, Human
cuguuuacaagaaaaaa

SEQ ID NO: 2616743 - RNA, 20 nt, Human
cuguuucucuuuccuuggcu

SEQ ID NO: 2616744 - RNA, 19 nt, Human
cuguuucucuuuccuuggc

SEQ ID NO: 2616745 - RNA, 16 nt, Human
cuguuucucuuuccuu

SEQ ID NO: 2616746 - RNA, 18 nt, Human
cuguuuguuucugaaagg

SEQ ID NO: 2616747 - RNA, 13 nt, Human
cuguuuccuuuua

SEQ ID NO: 2616748 - RNA, 15 nt, Human
cuguuuccuuuuaug

SEQ ID NO: 2616749 - RNA, 13 nt, Human
cuguuucucugcu

SEQ ID NO: 2616750 - RNA, 14 nt, Human
cuguuucucugcug

SEQ ID NO: 2616751 - RNA, 21 nt, Human
cuguuucccagcaguggacuc

SEQ ID NO: 2616752 - RNA, 15 nt, Human
cuguuucccagcagu

SEQ ID NO: 2616753 - RNA, 12 nt, Human
cuguuucccagc

SEQ ID NO: 2616754 - RNA, 17 nt, Human
cuguuuauggccucagc

SEQ ID NO: 2616755 - RNA, 18 nt, Human
cuguuuauggccucagcu

SEQ ID NO: 2616756 - RNA, 19 nt, Human
cuguuuauggccucagcug

SEQ ID NO: 2616757 - RNA, 21 nt, Human
cuguuuauggccucagcugcc

SEQ ID NO: 2616758 - RNA, 22 nt, Human
cuguuuauggccucagcugccu

SEQ ID NO: 2616759 - RNA, 18 nt, Human
cuucaggcucuucuccuu

SEQ ID NO: 2616760 - RNA, 17 nt, Human
cuucaggcucuucuccu

SEQ ID NO: 2616761 - RNA, 16 nt, Human
cuucaggcucuucucc

SEQ ID NO: 2616762 - RNA, 15 nt, Human
cuucaggcucuucuc

SEQ ID NO: 2616763 - RNA, 22 nt, Human
cuucaggggcugcccgcuccca

SEQ ID NO: 2616764 - RNA, 20 nt, Human
cuucaggggcugcccgcucc

SEQ ID NO: 2616765 - RNA, 19 nt, Human
cuucaggggcugcccgcuc

SEQ ID NO: 2616766 - RNA, 18 nt, Human
cuucaggggcugcccgcu

SEQ ID NO: 2616767 - RNA, 17 nt, Human
cuucaggggcugcccgc

SEQ ID NO: 2616768 - RNA, 16 nt, Human
cuucaggggcugcccg

SEQ ID NO: 2616769 - RNA, 15 nt, Human
cuucaggggcugccc

SEQ ID NO: 2616770 - RNA, 14 nt, Human
cuucaggggcugcc

SEQ ID NO: 2616771 - RNA, 20 nt, Human
cuucaggccucccucucucu

SEQ ID NO: 2616772 - RNA, 21 nt, Human
cuucaggggagucccgucagg

SEQ ID NO: 2616773 - RNA, 19 nt, Human
cuucaggggcacuucauug

SEQ ID NO: 2616774 - RNA, 17 nt, Human
cuucaggggcacuucau

SEQ ID NO: 2616775 - RNA, 22 nt, Human
cuucaggggagucccgucagga

SEQ ID NO: 2616776 - RNA, 23 nt, Human
cuucaggggagucccgucaggac

SEQ ID NO: 2616777 - RNA, 14 nt, Human
cuucaggcucuucu

SEQ ID NO: 2616778 - RNA, 12 nt, Human
cuucaggccucc

SEQ ID NO: 2616779 - RNA, 15 nt, Human
cuucaggccucccuc

SEQ ID NO: 2616780 - RNA, 11 nt, Human
cuucagcugac

SEQ ID NO: 2616781 - RNA, 23 nt, Human
cuucagccuagccgaccucagcc

SEQ ID NO: 2616782 - RNA, 20 nt, Human
cuuauuuuuuucugauugua

SEQ ID NO: 2616783 - RNA, 19 nt, Human
cuuauuuuuuucugauugu

SEQ ID NO: 2616784 - RNA, 18 nt, Human
cuuauuuuuuucugauug

SEQ ID NO: 2616785 - RNA, 17 nt, Human
cuuauuuuuuucugauu

SEQ ID NO: 2616786 - RNA, 17 nt, Human
cuucagccaggagcugg

SEQ ID NO: 2616787 - RNA, 15 nt, Human
cuucagccaggagcu

SEQ ID NO: 2616788 - RNA, 15 nt, Human
cuucagccaccucuc

SEQ ID NO: 2616789 - RNA, 17 nt, Human
cuucagccaccucucuu

SEQ ID NO: 2616790 - RNA, 16 nt, Human
cuuauuuuuuucugau

SEQ ID NO: 2616791 - RNA, 19 nt, Human
cuuauuuuuucccaaagcc

SEQ ID NO: 2616792 - RNA, 15 nt, Human
cuuauuuuuucccaa

SEQ ID NO: 2616793 - RNA, 14 nt, Human
cuuauuuuuuccca

SEQ ID NO: 2616794 - RNA, 21 nt, Human
cuuauuuuuaaaauuuuaaua

SEQ ID NO: 2616795 - RNA, 17 nt, Human
cuuauuuuugacagugu

SEQ ID NO: 2616796 - RNA, 15 nt, Human
cuuauuuucucugug

SEQ ID NO: 2616797 - RNA, 16 nt, Human
cuuauuuucauguaua

SEQ ID NO: 2616798 - RNA, 14 nt, Human
cuuauuuucucugu

SEQ ID NO: 2616799 - RNA, 21 nt, Human
cuuauuguuccaagacauugu

SEQ ID NO: 2616800 - RNA, 19 nt, Human
cuucagcccucaccccugg

SEQ ID NO: 2616801 - RNA, 17 nt, Human
cuucagcccucaccccu

SEQ ID NO: 2616802 - RNA, 16 nt, Human
cuucagcccucacccc

SEQ ID NO: 2616803 - RNA, 15 nt, Human
cuucagcccucaccc

SEQ ID NO: 2616804 - RNA, 14 nt, Human
cuucagccaucaac

SEQ ID NO: 2616805 - RNA, 19 nt, Human
cuucagccaggagcugggc

SEQ ID NO: 2616806 - RNA, 18 nt, Human
cuucagccaggagcuggg

SEQ ID NO: 2616807 - RNA, 18 nt, Human
cuucagcgguuuauauaa

SEQ ID NO: 2616808 - RNA, 13 nt, Human
cuucagccuagcc

SEQ ID NO: 2616809 - RNA, 20 nt, Human
cuucagccuagccgaccuca

SEQ ID NO: 2616810 - RNA, 21 nt, Human
cuucagccuagccgaccucag

SEQ ID NO: 2616811 - RNA, 22 nt, Human
cuucagccuagccgaccucagc

SEQ ID NO: 2616812 - RNA, 16 nt, Human
cuuccaaauccccuaa

SEQ ID NO: 2616813 - RNA, 14 nt, Human
cuucauuuggagau

SEQ ID NO: 2616814 - RNA, 13 nt, Human
cuucauuuggaga

SEQ ID NO: 2616815 - RNA, 19 nt, Human
cuuccaaauccccuaagca

SEQ ID NO: 2616816 - RNA, 20 nt, Human
cuuccaaauccccuaagcag

SEQ ID NO: 2616817 - RNA, 19 nt, Human
cuuccaacccauuagccau

SEQ ID NO: 2616818 - RNA, 18 nt, Human
cuuccaacaggagcuggg

SEQ ID NO: 2616819 - RNA, 14 nt, Human
cuuccaagagccug

SEQ ID NO: 2616820 - RNA, 23 nt, Human
cuuccacacccccaccccuugcu

SEQ ID NO: 2616821 - RNA, 21 nt, Human
cuuccaagguggucugcucgg

SEQ ID NO: 2616822 - RNA, 20 nt, Human
cuuccaagguggucugcucg

SEQ ID NO: 2616823 - RNA, 14 nt, Human
cuuccacaccccca

SEQ ID NO: 2616824 - RNA, 23 nt, Human
cuuccacaagagcccaggccucc

SEQ ID NO: 2616825 - RNA, 22 nt, Human
cuuccacaagagcccaggccuc

SEQ ID NO: 2616826 - RNA, 15 nt, Human
cuuccaagagccuga

SEQ ID NO: 2616827 - RNA, 18 nt, Human
cuuccaagguggucugcu

SEQ ID NO: 2616828 - RNA, 16 nt, Human
cuuccaagguggucug

SEQ ID NO: 2616829 - RNA, 15 nt, Human
cuuccaagguggucu

SEQ ID NO: 2616830 - RNA, 16 nt, Human
cuuccaagcaaaggug

SEQ ID NO: 2616831 - RNA, 14 nt, Human
cuucagugccuuau

SEQ ID NO: 2616832 - RNA, 13 nt, Human
cuucagugccuua

SEQ ID NO: 2616833 - RNA, 17 nt, Human
cuucauuucauuguaug

SEQ ID NO: 2616834 - RNA, 16 nt, Human
cuucauuucauuguau

SEQ ID NO: 2616835 - RNA, 15 nt, Human
cuucauuucauugua

SEQ ID NO: 2616836 - RNA, 14 nt, Human
cuucauuucauugu

SEQ ID NO: 2616837 - RNA, 19 nt, Human
cuucauuucauuguaugau

SEQ ID NO: 2616838 - RNA, 18 nt, Human
cuucauuucauuguauga

SEQ ID NO: 2616839 - RNA, 14 nt, Human
cuucauuuccuccg

SEQ ID NO: 2616840 - RNA, 18 nt, Human
cuucauuuccugugucuu

SEQ ID NO: 2616841 - RNA, 12 nt, Human
cuucagugccuu

SEQ ID NO: 2616842 - RNA, 11 nt, Human
cuucagugccu

SEQ ID NO: 2616843 - RNA, 17 nt, Human
cuucagugcccaccaac

SEQ ID NO: 2616844 - RNA, 23 nt, Human
cuucaggguucuccucuccccuc

SEQ ID NO: 2616845 - RNA, 14 nt, Human
cuucaggguucucc

SEQ ID NO: 2616846 - RNA, 18 nt, Human
cuucaggguucuccucuc

SEQ ID NO: 2616847 - RNA, 20 nt, Human
cuucaggguucuccucuccc

SEQ ID NO: 2616848 - RNA, 21 nt, Human
cuucaggguucuccucucccc

SEQ ID NO: 2616849 - RNA, 18 nt, Human
cuucagggugaugccagg

SEQ ID NO: 2616850 - RNA, 23 nt, Human
cuucaggggcugcccgcucccag

SEQ ID NO: 2616851 - RNA, 23 nt, Human
cuucagggggccaggugcacaga

SEQ ID NO: 2616852 - RNA, 15 nt, Human
cuucagggggccagg

SEQ ID NO: 2616853 - RNA, 14 nt, Human
cuucagggggccag

SEQ ID NO: 2616854 - RNA, 22 nt, Human
cuuccuacccacaccucugcca

SEQ ID NO: 2616855 - RNA, 19 nt, Human
cuuccuacccacaccucug

SEQ ID NO: 2616856 - RNA, 18 nt, Human
cuuccuacccacaccucu

SEQ ID NO: 2616857 - RNA, 16 nt, Human
cuuccuacccacaccu

SEQ ID NO: 2616858 - RNA, 21 nt, Human
cuuccuacaagagcagccugu

SEQ ID NO: 2616859 - RNA, 22 nt, Human
cuuccuacaagagcagccugug

SEQ ID NO: 2616860 - RNA, 23 nt, Human
cuuccuacacccuuggacuugag

SEQ ID NO: 2616861 - RNA, 18 nt, Human
cuuccggcuccugugcuu

SEQ ID NO: 2616862 - RNA, 24 nt, Human
cuuccuacaagagcagccuguggc

SEQ ID NO: 2616863 - RNA, 18 nt, Human
cuuccuacaagagcagcc

SEQ ID NO: 2616864 - RNA, 15 nt, Human
cuuccggcuccugug

SEQ ID NO: 2616865 - RNA, 15 nt, Human
cuuccggagauguag

SEQ ID NO: 2616866 - RNA, 14 nt, Human
cuuccggagaugua

SEQ ID NO: 2616867 - RNA, 17 nt, Human
cuuccgcauccuagucu

SEQ ID NO: 2616868 - RNA, 15 nt, Human
cuuccgcauccuagu

SEQ ID NO: 2616869 - RNA, 18 nt, Human
cuuccgcauccuagucuc

SEQ ID NO: 2616870 - RNA, 23 nt, Human
cuuccgaaaaauccucuuccucu

SEQ ID NO: 2616871 - RNA, 22 nt, Human
cuuccgaaaaauccucuuccuc

SEQ ID NO: 2616872 - RNA, 21 nt, Human
cuuccgaaaaauccucuuccu

SEQ ID NO: 2616873 - RNA, 20 nt, Human
cuuccgaaaaauccucuucc

SEQ ID NO: 2616874 - RNA, 21 nt, Human
cuucccucuguuucucuuucc

SEQ ID NO: 2616875 - RNA, 17 nt, Human
cuucccucuguuucucu

SEQ ID NO: 2616876 - RNA, 16 nt, Human
cuucccucuguuucuc

SEQ ID NO: 2616877 - RNA, 14 nt, Human
cuucccuuuuacau

SEQ ID NO: 2616878 - RNA, 11 nt, Human
cuucccucugc

SEQ ID NO: 2616879 - RNA, 13 nt, Human
cuucccucugccu

SEQ ID NO: 2616880 - RNA, 15 nt, Human
cuucccucugccugu

SEQ ID NO: 2616881 - RNA, 16 nt, Human
cuucccucugccuguc

SEQ ID NO: 2616882 - RNA, 17 nt, Human
cuucccucugccugucc

SEQ ID NO: 2616883 - RNA, 18 nt, Human
cuucccucugccuguccc

SEQ ID NO: 2616884 - RNA, 19 nt, Human
cuucccucugccugucccu

SEQ ID NO: 2616885 - RNA, 16 nt, Human
cuuccccuugcccagg

SEQ ID NO: 2616886 - RNA, 14 nt, Human
cuucccaguggcug

SEQ ID NO: 2616887 - RNA, 21 nt, Human
cuucccagguaagcaggagga

SEQ ID NO: 2616888 - RNA, 21 nt, Human
cuucccaggguagcccgccug

SEQ ID NO: 2616889 - RNA, 19 nt, Human
cuucccaggguagcccgcc

SEQ ID NO: 2616890 - RNA, 11 nt, Human
cuucccagggu

SEQ ID NO: 2616891 - RNA, 19 nt, Human
cuucccaggaguggaggag

SEQ ID NO: 2616892 - RNA, 22 nt, Human
cuucccaggcuggggcugaccu

SEQ ID NO: 2616893 - RNA, 18 nt, Human
cuucccaggcuggggcug

SEQ ID NO: 2616894 - RNA, 21 nt, Human
cuucccagcucucccucuggc

SEQ ID NO: 2616895 - RNA, 22 nt, Human
cuucccagcucucccucuggcc

SEQ ID NO: 2616896 - RNA, 13 nt, Human
cuuccccuuuccc

SEQ ID NO: 2616897 - RNA, 15 nt, Human
cuucccgcucagccc

SEQ ID NO: 2616898 - RNA, 23 nt, Human
cuuccccuugcccuugcccugac

SEQ ID NO: 2616899 - RNA, 22 nt, Human
cuuccccuugcccuugcccuga

SEQ ID NO: 2616900 - RNA, 17 nt, Human
cuuccccuugcccuugc

SEQ ID NO: 2616901 - RNA, 14 nt, Human
cuuccccuugcccu

SEQ ID NO: 2616902 - RNA, 19 nt, Human
cuuccccuugcccagggcu

SEQ ID NO: 2616903 - RNA, 23 nt, Human
cuuccccuugcccagggcucagc

SEQ ID NO: 2616904 - RNA, 17 nt, Human
cuucccgcucagcccuc

SEQ ID NO: 2616905 - RNA, 16 nt, Human
cuucccgcucagcccu

SEQ ID NO: 2616906 - RNA, 15 nt, Human
cuucccucacaccgc

SEQ ID NO: 2616907 - RNA, 23 nt, Human
cuucccuaucuuugccacccuca

SEQ ID NO: 2616908 - RNA, 17 nt, Human
cuucccucaucucuccu

SEQ ID NO: 2616909 - RNA, 16 nt, Human
cuucccucaucucucc

SEQ ID NO: 2616910 - RNA, 17 nt, Human
cuucccucaccuuggca

SEQ ID NO: 2616911 - RNA, 15 nt, Human
cuucccucccuaucu

SEQ ID NO: 2616912 - RNA, 16 nt, Human
cuucccucuccccaag

SEQ ID NO: 2616913 - RNA, 19 nt, Human
cuuccagguaucuccagga

SEQ ID NO: 2616914 - RNA, 18 nt, Human
cuuccagguaucuccagg

SEQ ID NO: 2616915 - RNA, 14 nt, Human
cuuccagcuccugu

SEQ ID NO: 2616916 - RNA, 16 nt, Human
cuuccaggugcccagc

SEQ ID NO: 2616917 - RNA, 19 nt, Human
cuuccaggugcccagcuau

SEQ ID NO: 2616918 - RNA, 16 nt, Human
cuuccagguguuacug

SEQ ID NO: 2616919 - RNA, 19 nt, Human
cuuccagguguuacuguaa

SEQ ID NO: 2616920 - RNA, 20 nt, Human
cuuccagguguuacuguaau

SEQ ID NO: 2616921 - RNA, 22 nt, Human
cuuccagguguuacuguaauuc

SEQ ID NO: 2616922 - RNA, 14 nt, Human
cuuccagugaggcu

SEQ ID NO: 2616923 - RNA, 20 nt, Human
cuuccagucuuccugacacu

SEQ ID NO: 2616924 - RNA, 21 nt, Human
cuuccagucuuccugacacuu

SEQ ID NO: 2616925 - RNA, 17 nt, Human
cuuccaguccaaucuca

SEQ ID NO: 2616926 - RNA, 13 nt, Human
cuuccagucagga

SEQ ID NO: 2616927 - RNA, 20 nt, Human
cuuccagguaucuccaggau

SEQ ID NO: 2616928 - RNA, 22 nt, Human
cuucccacucuagggcagugga

SEQ ID NO: 2616929 - RNA, 20 nt, Human
cuucccacucuagggcagug

SEQ ID NO: 2616930 - RNA, 19 nt, Human
cuucccacucuagggcagu

SEQ ID NO: 2616931 - RNA, 20 nt, Human
cuuccaguccaaucucaugg

SEQ ID NO: 2616932 - RNA, 22 nt, Human
cuuccagucuuccugacacuuu

SEQ ID NO: 2616933 - RNA, 18 nt, Human
cuucccacucuagggcag

SEQ ID NO: 2616934 - RNA, 15 nt, Human
cuuccagugaggcuc

SEQ ID NO: 2616935 - RNA, 15 nt, Human
cuucccacuggaggu

SEQ ID NO: 2616936 - RNA, 14 nt, Human
cuucccacuggagg

SEQ ID NO: 2616937 - RNA, 21 nt, Human
cuucccagcagggccacuccc

SEQ ID NO: 2616938 - RNA, 14 nt, Human
cuucccagcucucc

SEQ ID NO: 2616939 - RNA, 15 nt, Human
cuucccagcucuccc

SEQ ID NO: 2616940 - RNA, 18 nt, Human
cuucccagcucucccucu

SEQ ID NO: 2616941 - RNA, 20 nt, Human
cuucccagcucucccucugg

SEQ ID NO: 2616942 - RNA, 24 nt, Human
cuuccaggggugggacacccugug

SEQ ID NO: 2616943 - RNA, 22 nt, Human
cuuccaggggugggacacccug

SEQ ID NO: 2616944 - RNA, 13 nt, Human
cuuccagcuccug

SEQ ID NO: 2616945 - RNA, 12 nt, Human
cuuccagcuccu

SEQ ID NO: 2616946 - RNA, 15 nt, Human
cuuccagcuccugua

SEQ ID NO: 2616947 - RNA, 19 nt, Human
cuuccagauccuggaaauc

SEQ ID NO: 2616948 - RNA, 12 nt, Human
cuuccaccagcc

SEQ ID NO: 2616949 - RNA, 13 nt, Human
cuuccaccagccu

SEQ ID NO: 2616950 - RNA, 14 nt, Human
cuuccaccagccug

SEQ ID NO: 2616951 - RNA, 15 nt, Human
cuuccaccagccugc

SEQ ID NO: 2616952 - RNA, 16 nt, Human
cuuccaccagccugca

SEQ ID NO: 2616953 - RNA, 14 nt, Human
cuuccagcacccug

SEQ ID NO: 2616954 - RNA, 15 nt, Human
cuuccagcacccugc

SEQ ID NO: 2616955 - RNA, 16 nt, Human
cuuccagcacccugca

SEQ ID NO: 2616956 - RNA, 17 nt, Human
cuucuccuuucacaacc

SEQ ID NO: 2616957 - RNA, 14 nt, Human
cuucuccuuucaca

SEQ ID NO: 2616958 - RNA, 22 nt, Human
cuucuccuuucacaaccuucug

SEQ ID NO: 2616959 - RNA, 20 nt, Human
cuucuccuuucacaaccuuc

SEQ ID NO: 2616960 - RNA, 13 nt, Human
cuucucuacagac

SEQ ID NO: 2616961 - RNA, 11 nt, Human
cuucucuacag

SEQ ID NO: 2616962 - RNA, 21 nt, Human
cuucucgaccacgggaagcau

SEQ ID NO: 2616963 - RNA, 20 nt, Human
cuucucuaaaugaggggccu

SEQ ID NO: 2616964 - RNA, 12 nt, Human
cuucuccccaga

SEQ ID NO: 2616965 - RNA, 16 nt, Human
cuucuccccagaguuc

SEQ ID NO: 2616966 - RNA, 13 nt, Human
cuucucccaugag

SEQ ID NO: 2616967 - RNA, 22 nt, Human
cuucuccuucaccuuugucccc

SEQ ID NO: 2616968 - RNA, 18 nt, Human
cuucucccacuuggccaa

SEQ ID NO: 2616969 - RNA, 16 nt, Human
cuucucccacacugcu

SEQ ID NO: 2616970 - RNA, 17 nt, Human
cuucuccaucuggcagg

SEQ ID NO: 2616971 - RNA, 14 nt, Human
cuucucccacacug

SEQ ID NO: 2616972 - RNA, 15 nt, Human
cuucuccacccugcu

SEQ ID NO: 2616973 - RNA, 14 nt, Human
cuucuccacccugc

SEQ ID NO: 2616974 - RNA, 14 nt, Human
cuucuccaggcugu

SEQ ID NO: 2616975 - RNA, 16 nt, Human
cuucuccacccugcuc

SEQ ID NO: 2616976 - RNA, 20 nt, Human
cuucuccaggucucacgggc

SEQ ID NO: 2616977 - RNA, 19 nt, Human
cuucuccaggguccacagg

SEQ ID NO: 2616978 - RNA, 14 nt, Human
cuucuccauccaca

SEQ ID NO: 2616979 - RNA, 13 nt, Human
cuucuccaggguc

SEQ ID NO: 2616980 - RNA, 19 nt, Human
cuucuccaauucugcccaa

SEQ ID NO: 2616981 - RNA, 22 nt, Human
cuucucauuucaccccucccuu

SEQ ID NO: 2616982 - RNA, 17 nt, Human
cuucuccaggcuguauc

SEQ ID NO: 2616983 - RNA, 19 nt, Human
cuucuccaucucucuggcc

SEQ ID NO: 2616984 - RNA, 18 nt, Human
cuucuccaucucucuggc

SEQ ID NO: 2616985 - RNA, 13 nt, Human
cuucuccaucucu

SEQ ID NO: 2616986 - RNA, 11 nt, Human
cuucuccaucu

SEQ ID NO: 2616987 - RNA, 22 nt, Human
cuucuccauccuuucugccucu

SEQ ID NO: 2616988 - RNA, 20 nt, Human
cuucuccauccuuucugccu

SEQ ID NO: 2616989 - RNA, 16 nt, Human
cuucuccauccacaug

SEQ ID NO: 2616990 - RNA, 13 nt, Human
cuucucccacacu

SEQ ID NO: 2616991 - RNA, 21 nt, Human
cuucuccaucucucuggcccu

SEQ ID NO: 2616992 - RNA, 14 nt, Human
cuucuccaucuggc

SEQ ID NO: 2616993 - RNA, 17 nt, Human
cuucugcuucagccucc

SEQ ID NO: 2616994 - RNA, 16 nt, Human
cuucugcuucagccuc

SEQ ID NO: 2616995 - RNA, 14 nt, Human
cuucugcucagcuc

SEQ ID NO: 2616996 - RNA, 15 nt, Human
cuucugcucagcucu

SEQ ID NO: 2616997 - RNA, 16 nt, Human
cuucugcucagcucug

SEQ ID NO: 2616998 - RNA, 18 nt, Human
cuucugcucagcucuggg

SEQ ID NO: 2616999 - RNA, 10 nt, Human
cuucugcucc

SEQ ID NO: 2617000 - RNA, 12 nt, Human
cuucugcuccac

SEQ ID NO: 2617001 - RNA, 14 nt, Human
cuucugcuccaccc

SEQ ID NO: 2617002 - RNA, 18 nt, Human
cuucugcuucagccuccc

SEQ ID NO: 2617003 - RNA, 20 nt, Human
cuucugcuacuggcaaaagg

SEQ ID NO: 2617004 - RNA, 13 nt, Human
cuucugcuccacc

SEQ ID NO: 2617005 - RNA, 22 nt, Human
cuucugcuuuucugcccuggcu

SEQ ID NO: 2617006 - RNA, 21 nt, Human
cuucugcuuuucugcccuggc

SEQ ID NO: 2617007 - RNA, 20 nt, Human
cuucugcuuuucugcccugg

SEQ ID NO: 2617008 - RNA, 19 nt, Human
cuucugcuuuucugcccug

SEQ ID NO: 2617009 - RNA, 18 nt, Human
cuucugcuuuucugcccu

SEQ ID NO: 2617010 - RNA, 17 nt, Human
cuucugcuuuucugccc

SEQ ID NO: 2617011 - RNA, 16 nt, Human
cuucugcuuuucugcc

SEQ ID NO: 2617012 - RNA, 14 nt, Human
cuucugcuuuucug

SEQ ID NO: 2617013 - RNA, 23 nt, Human
cuucugcuuuucugcccuggcug

SEQ ID NO: 2617014 - RNA, 11 nt, Human
cuucuggagcc

SEQ ID NO: 2617015 - RNA, 13 nt, Human
cuucuggagcccu

SEQ ID NO: 2617016 - RNA, 20 nt, Human
cuucugccuuagucucaguu

SEQ ID NO: 2617017 - RNA, 19 nt, Human
cuucugccuuagucucagu

SEQ ID NO: 2617018 - RNA, 21 nt, Human
cuucugccuuagucucaguuu

SEQ ID NO: 2617019 - RNA, 14 nt, Human
cuucugccuucuca

SEQ ID NO: 2617020 - RNA, 13 nt, Human
cuucugccuuuuu

SEQ ID NO: 2617021 - RNA, 16 nt, Human
cuucugccuucucaug

SEQ ID NO: 2617022 - RNA, 20 nt, Human
cuucucucagacuuacuuua

SEQ ID NO: 2617023 - RNA, 11 nt, Human
cuucugcuacu

SEQ ID NO: 2617024 - RNA, 13 nt, Human
cuucugcuacugg

SEQ ID NO: 2617025 - RNA, 19 nt, Human
cuucugcuacuggcaaaag

SEQ ID NO: 2617026 - RNA, 21 nt, Human
cuucugccauauucuguuggc

SEQ ID NO: 2617027 - RNA, 16 nt, Human
cuucucucaucucuua

SEQ ID NO: 2617028 - RNA, 14 nt, Human
cuucucucaucucu

SEQ ID NO: 2617029 - RNA, 17 nt, Human
cuucugccauauucugu

SEQ ID NO: 2617030 - RNA, 15 nt, Human
cuucugccauauucu

SEQ ID NO: 2617031 - RNA, 18 nt, Human
cuucucucaccuccuaaa

SEQ ID NO: 2617032 - RNA, 16 nt, Human
cuucucucaccuccua

SEQ ID NO: 2617033 - RNA, 15 nt, Human
cuucucucaccuccu

SEQ ID NO: 2617034 - RNA, 17 nt, Human
cuucucuagcugguggu

SEQ ID NO: 2617035 - RNA, 15 nt, Human
cuucucuagcuggug

SEQ ID NO: 2617036 - RNA, 15 nt, Human
cuucucuacagacuu

SEQ ID NO: 2617037 - RNA, 14 nt, Human
cuucucucaccucc

SEQ ID NO: 2617038 - RNA, 23 nt, Human
cuuccuacccacaccucugccag

SEQ ID NO: 2617039 - RNA, 22 nt, Human
cuuccuagaaguuacugaaugc

SEQ ID NO: 2617040 - RNA, 21 nt, Human
cuuccuagaaguuacugaaug

SEQ ID NO: 2617041 - RNA, 14 nt, Human
cuuccuucccuggc

SEQ ID NO: 2617042 - RNA, 13 nt, Human
cuuccuucccugg

SEQ ID NO: 2617043 - RNA, 18 nt, Human
cuuccuucccugggcugu

SEQ ID NO: 2617044 - RNA, 16 nt, Human
cuuccuucccugggcu

SEQ ID NO: 2617045 - RNA, 15 nt, Human
cuuccuucccuggcu

SEQ ID NO: 2617046 - RNA, 17 nt, Human
cuuccuucccuggcuug

SEQ ID NO: 2617047 - RNA, 21 nt, Human
cuuccuugaagaacugcaggc

SEQ ID NO: 2617048 - RNA, 18 nt, Human
cuuccuucugccugagcu

SEQ ID NO: 2617049 - RNA, 11 nt, Human
cuuccuucugc

SEQ ID NO: 2617050 - RNA, 21 nt, Human
cuuccuucccugggcugugcu

SEQ ID NO: 2617051 - RNA, 22 nt, Human
cuuccuugaagaacugcaggcc

SEQ ID NO: 2617052 - RNA, 14 nt, Human
cuuccuugaccagc

SEQ ID NO: 2617053 - RNA, 15 nt, Human
cuuccuugaccagca

SEQ ID NO: 2617054 - RNA, 16 nt, Human
cuuccuugaccagcag

SEQ ID NO: 2617055 - RNA, 18 nt, Human
cuuccuugagacacggag

SEQ ID NO: 2617056 - RNA, 20 nt, Human
cuuccuugagacacggagcc

SEQ ID NO: 2617057 - RNA, 23 nt, Human
cuuccuugagacacggagcccag

SEQ ID NO: 2617058 - RNA, 22 nt, Human
cuuccuugaccagcagauccca

SEQ ID NO: 2617059 - RNA, 15 nt, Human
cuuccuugcucugca

SEQ ID NO: 2617060 - RNA, 15 nt, Human
cuuccuugcucuccc

SEQ ID NO: 2617061 - RNA, 14 nt, Human
cuuccuugcucucc

SEQ ID NO: 2617062 - RNA, 19 nt, Human
cuuccuugcuaaugcacca

SEQ ID NO: 2617063 - RNA, 17 nt, Human
cuuccuugcucugcacc

SEQ ID NO: 2617064 - RNA, 16 nt, Human
cuuccuugcucugcac

SEQ ID NO: 2617065 - RNA, 17 nt, Human
cuuccuugcuguccuag

SEQ ID NO: 2617066 - RNA, 22 nt, Human
cuuccuuuucccugcuuccagg

SEQ ID NO: 2617067 - RNA, 20 nt, Human
cuucgaaagcaucauuauuu

SEQ ID NO: 2617068 - RNA, 19 nt, Human
cuuccuuuucccugcuucc

SEQ ID NO: 2617069 - RNA, 17 nt, Human
cuuccuuuucccugcuu

SEQ ID NO: 2617070 - RNA, 16 nt, Human
cuuccuuuucccugcu

SEQ ID NO: 2617071 - RNA, 15 nt, Human
cuuccuuuucccugc

SEQ ID NO: 2617072 - RNA, 15 nt, Human
cuucgaaaccuggga

SEQ ID NO: 2617073 - RNA, 15 nt, Human
cuuccuuuugaggga

SEQ ID NO: 2617074 - RNA, 19 nt, Human
cuuccuuggacucauuuua

SEQ ID NO: 2617075 - RNA, 19 nt, Human
cuuccuugcuguccuaggc

SEQ ID NO: 2617076 - RNA, 20 nt, Human
cuuccuugcuguccuaggcc

SEQ ID NO: 2617077 - RNA, 20 nt, Human
cuuccuuggacucauuuuaa

SEQ ID NO: 2617078 - RNA, 17 nt, Human
cuuccuugcuuaaggua

SEQ ID NO: 2617079 - RNA, 15 nt, Human
cuucgcuccuguguc

SEQ ID NO: 2617080 - RNA, 14 nt, Human
cuucgcuccugugu

SEQ ID NO: 2617081 - RNA, 13 nt, Human
cuucgcuccugug

SEQ ID NO: 2617082 - RNA, 18 nt, Human
cuucgacucaggauccag

SEQ ID NO: 2617083 - RNA, 13 nt, Human
cuucgacugugac

SEQ ID NO: 2617084 - RNA, 16 nt, Human
cuucgacucaggaucc

SEQ ID NO: 2617085 - RNA, 15 nt, Human
cuucgacucaggauc

SEQ ID NO: 2617086 - RNA, 14 nt, Human
cuucgacucaggau

SEQ ID NO: 2617087 - RNA, 18 nt, Human
cuucggccuccauccuga

SEQ ID NO: 2617088 - RNA, 19 nt, Human
cuucggccuccauccugag

SEQ ID NO: 2617089 - RNA, 17 nt, Human
cuucggccuccauccug

SEQ ID NO: 2617090 - RNA, 17 nt, Human
cuucgagcacuguccag

SEQ ID NO: 2617091 - RNA, 23 nt, Human
cuucgagguggaucacagaggcu

SEQ ID NO: 2617092 - RNA, 16 nt, Human
cuucgggcccuuccca

SEQ ID NO: 2617093 - RNA, 17 nt, Human
cuucgggcccuucccac

SEQ ID NO: 2617094 - RNA, 14 nt, Human
cuucgggcugugcc

SEQ ID NO: 2617095 - RNA, 15 nt, Human
cuucgggcugugccc

SEQ ID NO: 2617096 - RNA, 20 nt, Human
cuucgggaggucgaggcagg

SEQ ID NO: 2617097 - RNA, 21 nt, Human
cuucgggaggucgaggcagga

SEQ ID NO: 2617098 - RNA, 21 nt, Human
cuucucauuucaccccucccu

SEQ ID NO: 2617099 - RNA, 22 nt, Human
cuucucauagcauuaacuaauc

SEQ ID NO: 2617100 - RNA, 16 nt, Human
cuucucauacguccac

SEQ ID NO: 2617101 - RNA, 22 nt, Human
cuucucaggcucugcccugccc

SEQ ID NO: 2617102 - RNA, 13 nt, Human
cuucucauagcau

SEQ ID NO: 2617103 - RNA, 15 nt, Human
cuucucauagcauua

SEQ ID NO: 2617104 - RNA, 22 nt, Human
cuucucaggcaugaacauguac

SEQ ID NO: 2617105 - RNA, 13 nt, Human
cuucucaggcucu

SEQ ID NO: 2617106 - RNA, 15 nt, Human
cuucucaggcucugc

SEQ ID NO: 2617107 - RNA, 16 nt, Human
cuucucaggcucugcc

SEQ ID NO: 2617108 - RNA, 19 nt, Human
cuucucaggcucugcccug

SEQ ID NO: 2617109 - RNA, 20 nt, Human
cuucucaggcucugcccugc

SEQ ID NO: 2617110 - RNA, 21 nt, Human
cuucucaggcucugcccugcc

SEQ ID NO: 2617111 - RNA, 18 nt, Human
cuucucagaaucuaccca

SEQ ID NO: 2617112 - RNA, 14 nt, Human
cuucucagaaucua

SEQ ID NO: 2617113 - RNA, 14 nt, Human
cuucucagcuccca

SEQ ID NO: 2617114 - RNA, 19 nt, Human
cuucuaaacuuccccaucu

SEQ ID NO: 2617115 - RNA, 22 nt, Human
cuucuaaacuuccccaucuucu

SEQ ID NO: 2617116 - RNA, 21 nt, Human
cuucuaaagguguugucccuu

SEQ ID NO: 2617117 - RNA, 22 nt, Human
cuucuaaagguguugucccuuc

SEQ ID NO: 2617118 - RNA, 15 nt, Human
cuucuaaagguguug

SEQ ID NO: 2617119 - RNA, 19 nt, Human
cuucuaaacccaauccaaa

SEQ ID NO: 2617120 - RNA, 18 nt, Human
cuucuaaacuuccccauc

SEQ ID NO: 2617121 - RNA, 15 nt, Human
cuucguuuauuuuca

SEQ ID NO: 2617122 - RNA, 16 nt, Human
cuucguuuauuuucaa

SEQ ID NO: 2617123 - RNA, 18 nt, Human
cuucguuuauuuucaaga

SEQ ID NO: 2617124 - RNA, 19 nt, Human
cuucguuuacuaugccugu

SEQ ID NO: 2617125 - RNA, 21 nt, Human
cuucguuuacuaugccugugu

SEQ ID NO: 2617126 - RNA, 18 nt, Human
cuucguuuacuaugccug

SEQ ID NO: 2617127 - RNA, 13 nt, Human
cuuuccucgccug

SEQ ID NO: 2617128 - RNA, 14 nt, Human
cuuuccucuucccc

SEQ ID NO: 2617129 - RNA, 13 nt, Human
cuuuccucuuccc

SEQ ID NO: 2617130 - RNA, 16 nt, Human
cuuuccuccuggcaga

SEQ ID NO: 2617131 - RNA, 16 nt, Human
cuuuccuccuuccaug

SEQ ID NO: 2617132 - RNA, 13 nt, Human
cuuuccuccuucc

SEQ ID NO: 2617133 - RNA, 14 nt, Human
cuuuccuccuucca

SEQ ID NO: 2617134 - RNA, 16 nt, Human
cuuuccucuuuggucu

SEQ ID NO: 2617135 - RNA, 13 nt, Human
cuuucugaaauaa

SEQ ID NO: 2617136 - RNA, 20 nt, Human
cuuucugagcacacuuuagu

SEQ ID NO: 2617137 - RNA, 17 nt, Human
cuuucugagcacacuuu

SEQ ID NO: 2617138 - RNA, 21 nt, Human
cuuucugagcacacuuuagug

SEQ ID NO: 2617139 - RNA, 23 nt, Human
cuuucugauaacuagauggugcu

SEQ ID NO: 2617140 - RNA, 21 nt, Human
cuuucugauaacuagauggug

SEQ ID NO: 2617141 - RNA, 20 nt, Human
cuuucugaagccucacuuau

SEQ ID NO: 2617142 - RNA, 19 nt, Human
cuuuccucuuccccuugcc

SEQ ID NO: 2617143 - RNA, 23 nt, Human
cuuuaggcauuaaauuuuagcaa

SEQ ID NO: 2617144 - RNA, 23 nt, Human
cuuuagggacucaauuucucccc

SEQ ID NO: 2617145 - RNA, 21 nt, Human
cuuuagggacucaauuucucc

SEQ ID NO: 2617146 - RNA, 15 nt, Human
cuuuaggcauuaaau

SEQ ID NO: 2617147 - RNA, 16 nt, Human
cuuuagggcagcuugc

SEQ ID NO: 2617148 - RNA, 15 nt, Human
cuuuagggcagcuug

SEQ ID NO: 2617149 - RNA, 14 nt, Human
cuuuagggcagcuu

SEQ ID NO: 2617150 - RNA, 13 nt, Human
cuuuagggcagcu

SEQ ID NO: 2617151 - RNA, 19 nt, Human
cuuuccucaaaacuucaga

SEQ ID NO: 2617152 - RNA, 22 nt, Human
cuuuaguaccugaaaaguaacu

SEQ ID NO: 2617153 - RNA, 17 nt, Human
cuuuaguaccugaaaag

SEQ ID NO: 2617154 - RNA, 18 nt, Human
cuuuagggcagcuugccc

SEQ ID NO: 2617155 - RNA, 21 nt, Human
cuuuccucaggcaaggucugg

SEQ ID NO: 2617156 - RNA, 19 nt, Human
cuuuaguaccugaaaagua

SEQ ID NO: 2617157 - RNA, 15 nt, Human
cuuuagucgcugagg

SEQ ID NO: 2617158 - RNA, 18 nt, Human
cuuuagagcauugccauu

SEQ ID NO: 2617159 - RNA, 17 nt, Human
cuuuagagcauugccau

SEQ ID NO: 2617160 - RNA, 22 nt, Human
cuuuagagaaguauacauaagu

SEQ ID NO: 2617161 - RNA, 23 nt, Human
cuuuagagcauugccauucccug

SEQ ID NO: 2617162 - RNA, 19 nt, Human
cuuuagagcauugccauuc

SEQ ID NO: 2617163 - RNA, 14 nt, Human
cuuuagaguuagac

SEQ ID NO: 2617164 - RNA, 19 nt, Human
cuuuagagaaguauacaua

SEQ ID NO: 2617165 - RNA, 21 nt, Human
cuuuaggagggaguuaucuaa

SEQ ID NO: 2617166 - RNA, 18 nt, Human
cuuuaggcagcagcuuuu

SEQ ID NO: 2617167 - RNA, 17 nt, Human
cuuuagaguuagacugu

SEQ ID NO: 2617168 - RNA, 13 nt, Human
cuuuagaguagca

SEQ ID NO: 2617169 - RNA, 16 nt, Human
cuuucuuccucugcug

SEQ ID NO: 2617170 - RNA, 15 nt, Human
cuuucuucuauuuua

SEQ ID NO: 2617171 - RNA, 15 nt, Human
cuuucugugugcacc

SEQ ID NO: 2617172 - RNA, 12 nt, Human
cuuucugugugc

SEQ ID NO: 2617173 - RNA, 21 nt, Human
cuuucugugugcaccuuacca

SEQ ID NO: 2617174 - RNA, 14 nt, Human
cuuucugucucucu

SEQ ID NO: 2617175 - RNA, 16 nt, Human
cuuucuguauugagua

SEQ ID NO: 2617176 - RNA, 19 nt, Human
cuuucuguccuuuuggcac

SEQ ID NO: 2617177 - RNA, 18 nt, Human
cuuucugucccuucuguc

SEQ ID NO: 2617178 - RNA, 23 nt, Human
cuuucugucccuucugucccuca

SEQ ID NO: 2617179 - RNA, 19 nt, Human
cuuucuguauauacuuuuu

SEQ ID NO: 2617180 - RNA, 20 nt, Human
cuuucuguauauacuuuuuu

SEQ ID NO: 2617181 - RNA, 15 nt, Human
cuuucugccuggagu

SEQ ID NO: 2617182 - RNA, 13 nt, Human
cuuucugcucagc

SEQ ID NO: 2617183 - RNA, 14 nt, Human
cuuucugcucagcu

SEQ ID NO: 2617184 - RNA, 16 nt, Human
cuuucugcucagcuuc

SEQ ID NO: 2617185 - RNA, 18 nt, Human
cuuucuguauauacuuuu

SEQ ID NO: 2617186 - RNA, 14 nt, Human
cuuucugccuggag

SEQ ID NO: 2617187 - RNA, 12 nt, Human
cuuucugccugg

SEQ ID NO: 2617188 - RNA, 15 nt, Human
cuuucugccucucaa

SEQ ID NO: 2617189 - RNA, 14 nt, Human
cuuucugccucuca

SEQ ID NO: 2617190 - RNA, 11 nt, Human
cuuucugccug

SEQ ID NO: 2617191 - RNA, 15 nt, Human
cuuucugcagaaaca

SEQ ID NO: 2617192 - RNA, 22 nt, Human
cuuucuuuucuggaauguaauc

SEQ ID NO: 2617193 - RNA, 22 nt, Human
cuuucuugguucauaaaugaau

SEQ ID NO: 2617194 - RNA, 18 nt, Human
cuuucuuuugauucuucc

SEQ ID NO: 2617195 - RNA, 16 nt, Human
cuuucuuuuucuucuu

SEQ ID NO: 2617196 - RNA, 15 nt, Human
cuuucuuuuucuucu

SEQ ID NO: 2617197 - RNA, 14 nt, Human
cuuucuuuuucuuc

SEQ ID NO: 2617198 - RNA, 21 nt, Human
cuuucuugguucauaaaugaa

SEQ ID NO: 2617199 - RNA, 20 nt, Human
cuuucuugguucauaaauga

SEQ ID NO: 2617200 - RNA, 16 nt, Human
cuuucuugcugguugu

SEQ ID NO: 2617201 - RNA, 21 nt, Human
cuuucuugcugguugucauuu

SEQ ID NO: 2617202 - RNA, 13 nt, Human
cuuucuuggccag

SEQ ID NO: 2617203 - RNA, 14 nt, Human
cuuucuuggccagu

SEQ ID NO: 2617204 - RNA, 22 nt, Human
cuuucuugaucaacaucuuuuc

SEQ ID NO: 2617205 - RNA, 21 nt, Human
cuuucuugaucaacaucuuuu

SEQ ID NO: 2617206 - RNA, 14 nt, Human
cuuucuucucugcu

SEQ ID NO: 2617207 - RNA, 16 nt, Human
cuuucuucuauuuuau

SEQ ID NO: 2617208 - RNA, 20 nt, Human
cuuucuuuuucuucuucccu

SEQ ID NO: 2617209 - RNA, 19 nt, Human
cuuucuuuuuuuuuuuuga

SEQ ID NO: 2617210 - RNA, 17 nt, Human
cuuugacaaagguaaau

SEQ ID NO: 2617211 - RNA, 22 nt, Human
cuuugaaacaagauaacugaga

SEQ ID NO: 2617212 - RNA, 14 nt, Human
cuuuguggccaagg

SEQ ID NO: 2617213 - RNA, 15 nt, Human
cuuuguggccaagga

SEQ ID NO: 2617214 - RNA, 16 nt, Human
cuuuguggccaaggag

SEQ ID NO: 2617215 - RNA, 18 nt, Human
cuuuguggccaaggagcu

SEQ ID NO: 2617216 - RNA, 20 nt, Human
cuuuguggccaaggagcugc

SEQ ID NO: 2617217 - RNA, 21 nt, Human
cuuuguggccaaggagcugcu

SEQ ID NO: 2617218 - RNA, 18 nt, Human
cuuuguguagcuuugcuc

SEQ ID NO: 2617219 - RNA, 16 nt, Human
cuuuguguagcuuugc

SEQ ID NO: 2617220 - RNA, 22 nt, Human
cuuuguggccaaggagcugcua

SEQ ID NO: 2617221 - RNA, 21 nt, Human
cuuuguucuggcucuuccagg

SEQ ID NO: 2617222 - RNA, 16 nt, Human
cuuuguucuggcucuu

SEQ ID NO: 2617223 - RNA, 17 nt, Human
cuuugugauuauuucac

SEQ ID NO: 2617224 - RNA, 19 nt, Human
cuuugugaggaagccgcug

SEQ ID NO: 2617225 - RNA, 12 nt, Human
cuuugugauuuu

SEQ ID NO: 2617226 - RNA, 22 nt, Human
cuuugugauucaaucuguaaac

SEQ ID NO: 2617227 - RNA, 23 nt, Human
cuuugugauucaaucuguaaacu

SEQ ID NO: 2617228 - RNA, 18 nt, Human
cuuugugauuauuucacu

SEQ ID NO: 2617229 - RNA, 11 nt, Human
cuuuguggcca

SEQ ID NO: 2617230 - RNA, 12 nt, Human
cuuuguggccaa

SEQ ID NO: 2617231 - RNA, 13 nt, Human
cuuuguggccaag

SEQ ID NO: 2617232 - RNA, 13 nt, Human
cuuuguggcuucc

SEQ ID NO: 2617233 - RNA, 23 nt, Human
cuuugugaggaagccgcuggggc

SEQ ID NO: 2617234 - RNA, 23 nt, Human
cuuugggcccagggacaccagcc

SEQ ID NO: 2617235 - RNA, 22 nt, Human
cuuugggcccagggacaccagc

SEQ ID NO: 2617236 - RNA, 16 nt, Human
cuuugggcccagggac

SEQ ID NO: 2617237 - RNA, 12 nt, Human
cuuugggccaga

SEQ ID NO: 2617238 - RNA, 13 nt, Human
cuuugggccagac

SEQ ID NO: 2617239 - RNA, 15 nt, Human
cuuugggcccaggga

SEQ ID NO: 2617240 - RNA, 13 nt, Human
cuuugggcccagg

SEQ ID NO: 2617241 - RNA, 21 nt, Human
cuuugggccagacaugccaca

SEQ ID NO: 2617242 - RNA, 14 nt, Human
cuuugggaggcuga

SEQ ID NO: 2617243 - RNA, 17 nt, Human
cuuugggaggcugaggc

SEQ ID NO: 2617244 - RNA, 18 nt, Human
cuuugggaggcugaggcg

SEQ ID NO: 2617245 - RNA, 16 nt, Human
cuuuggauuugacauu

SEQ ID NO: 2617246 - RNA, 17 nt, Human
cuuuggauuugacauug

SEQ ID NO: 2617247 - RNA, 17 nt, Human
cuuuggcacuggggcac

SEQ ID NO: 2617248 - RNA, 12 nt, Human
cuuuggcacugg

SEQ ID NO: 2617249 - RNA, 17 nt, Human
cuuuggaaacaggacca

SEQ ID NO: 2617250 - RNA, 13 nt, Human
cuuuggauuugac

SEQ ID NO: 2617251 - RNA, 15 nt, Human
cuuuggauuugacau

SEQ ID NO: 2617252 - RNA, 20 nt, Human
cuuuggaaaaugcauuguau

SEQ ID NO: 2617253 - RNA, 21 nt, Human
cuuuggaaaaugcauuguauc

SEQ ID NO: 2617254 - RNA, 23 nt, Human
cuuugggaggccaaggugggagg

SEQ ID NO: 2617255 - RNA, 24 nt, Human
cuuuggcaggugcagcccccacug

SEQ ID NO: 2617256 - RNA, 18 nt, Human
cuuuggcacuggggcacu

SEQ ID NO: 2617257 - RNA, 13 nt, Human
cuuuggcaggugc

SEQ ID NO: 2617258 - RNA, 14 nt, Human
cuuuggcagaguuc

SEQ ID NO: 2617259 - RNA, 23 nt, Human
cuuuggaaagacuuuuccaaccc

SEQ ID NO: 2617260 - RNA, 16 nt, Human
cuuugcuuugcccagc

SEQ ID NO: 2617261 - RNA, 19 nt, Human
cuuuggaaaaugcauugua

SEQ ID NO: 2617262 - RNA, 17 nt, Human
cuuugcuuugcuuucug

SEQ ID NO: 2617263 - RNA, 17 nt, Human
cuuugcuuucugcucag

SEQ ID NO: 2617264 - RNA, 19 nt, Human
cuuugcuuucugcucagcu

SEQ ID NO: 2617265 - RNA, 21 nt, Human
cuuugcuuucugcucagcuuc

SEQ ID NO: 2617266 - RNA, 11 nt, Human
cuuugcuuugc

SEQ ID NO: 2617267 - RNA, 12 nt, Human
cuuuggaaagac

SEQ ID NO: 2617268 - RNA, 20 nt, Human
cuuugcuugccucucuguuu

SEQ ID NO: 2617269 - RNA, 17 nt, Human
cuuugcuugccucucug

SEQ ID NO: 2617270 - RNA, 12 nt, Human
cuuugcuuucug

SEQ ID NO: 2617271 - RNA, 13 nt, Human
cuuugcuuucugc

SEQ ID NO: 2617272 - RNA, 14 nt, Human
cuuugcuuucugcu

SEQ ID NO: 2617273 - RNA, 15 nt, Human
cuuugcuuucugcuc

SEQ ID NO: 2617274 - RNA, 16 nt, Human
cuuugcuuucugcuca

SEQ ID NO: 2617275 - RNA, 14 nt, Human
cuuugcuugaaaga

SEQ ID NO: 2617276 - RNA, 15 nt, Human
cuuugcuucccauug

SEQ ID NO: 2617277 - RNA, 19 nt, Human
cuuugcuugcaguagauuu

SEQ ID NO: 2617278 - RNA, 20 nt, Human
cuuugcuucaaauccaucca

SEQ ID NO: 2617279 - RNA, 14 nt, Human
cuuugcuugcagua

SEQ ID NO: 2617280 - RNA, 22 nt, Human
cuuugcauaacguauaaaagcc

SEQ ID NO: 2617281 - RNA, 17 nt, Human
cuuugaccucaaccugu

SEQ ID NO: 2617282 - RNA, 18 nt, Human
cuuugaccucaaccugug

SEQ ID NO: 2617283 - RNA, 19 nt, Human
cuuugacaaagguaaauca

SEQ ID NO: 2617284 - RNA, 17 nt, Human
cuuugaauuuucugugu

SEQ ID NO: 2617285 - RNA, 12 nt, Human
cuuugcauuuua

SEQ ID NO: 2617286 - RNA, 22 nt, Human
cuuugcauguuccacuaacccc

SEQ ID NO: 2617287 - RNA, 20 nt, Human
cuuugcauguuccacuaacc

SEQ ID NO: 2617288 - RNA, 21 nt, Human
cuuugcauggaauuuguaagu

SEQ ID NO: 2617289 - RNA, 21 nt, Human
cuuugcauggagacuugagga

SEQ ID NO: 2617290 - RNA, 21 nt, Human
cuuugaccucaaccugugaug

SEQ ID NO: 2617291 - RNA, 16 nt, Human
cuuugccacccucaug

SEQ ID NO: 2617292 - RNA, 17 nt, Human
cuuugccacccucaugc

SEQ ID NO: 2617293 - RNA, 18 nt, Human
cuuugccacccucaugcu

SEQ ID NO: 2617294 - RNA, 22 nt, Human
cuuugcauuuuaaaaaugaaau

SEQ ID NO: 2617295 - RNA, 19 nt, Human
cuuugcauuuuaaaaauga

SEQ ID NO: 2617296 - RNA, 14 nt, Human
cuuugcauuuugga

SEQ ID NO: 2617297 - RNA, 21 nt, Human
gaaaacacuguucucugcccu

SEQ ID NO: 2617298 - RNA, 20 nt, Human
gaaaacacuguucucugccc

SEQ ID NO: 2617299 - RNA, 16 nt, Human
gaaaacaugcuacaca

SEQ ID NO: 2617300 - RNA, 18 nt, Human
gaaaacaugcuacacacu

SEQ ID NO: 2617301 - RNA, 14 nt, Human
gaaaacaaggauga

SEQ ID NO: 2617302 - RNA, 19 nt, Human
gaaaaauuuaagcauuguu

SEQ ID NO: 2617303 - RNA, 20 nt, Human
gaaaaauuuaagcauuguuu

SEQ ID NO: 2617304 - RNA, 22 nt, Human
gaaaaauuuaagcauuguuugc

SEQ ID NO: 2617305 - RNA, 19 nt, Human
gaaaacacuguucucugcc

SEQ ID NO: 2617306 - RNA, 12 nt, Human
gaaaacaaggaa

SEQ ID NO: 2617307 - RNA, 19 nt, Human
gaaaaaucacauccuggcc

SEQ ID NO: 2617308 - RNA, 13 nt, Human
gaaaaauauuuaa

SEQ ID NO: 2617309 - RNA, 14 nt, Human
gaaaaauauuuaag

SEQ ID NO: 2617310 - RNA, 15 nt, Human
gaaaaauaugauauu

SEQ ID NO: 2617311 - RNA, 20 nt, Human
gaaaaauccucuuccucuga

SEQ ID NO: 2617312 - RNA, 11 nt, Human
gaaaaauuccu

SEQ ID NO: 2617313 - RNA, 18 nt, Human
gaaaaauccucuuccucu

SEQ ID NO: 2617314 - RNA, 13 nt, Human
gaaaaauccucuu

SEQ ID NO: 2617315 - RNA, 17 nt, Human
gaaaaauccagaaagaa

SEQ ID NO: 2617316 - RNA, 18 nt, Human
gaaaaauccagaaagaaa

SEQ ID NO: 2617317 - RNA, 20 nt, Human
gaaaaauuccuauugugauu

SEQ ID NO: 2617318 - RNA, 15 nt, Human
gaaaaauuccuauug

SEQ ID NO: 2617319 - RNA, 16 nt, Human
gaaaaauuuaagcauu

SEQ ID NO: 2617320 - RNA, 17 nt, Human
gaaaaauuuaagcauug

SEQ ID NO: 2617321 - RNA, 18 nt, Human
gaaaaauuuaagcauugu

SEQ ID NO: 2617322 - RNA, 15 nt, Human
cuuuuuuauacacau

SEQ ID NO: 2617323 - RNA, 19 nt, Human
gaaaaauaacuucaagcaa

SEQ ID NO: 2617324 - RNA, 14 nt, Human
cuuuuuuauacaca

SEQ ID NO: 2617325 - RNA, 10 nt, Human
gaaaaauaug

SEQ ID NO: 2617326 - RNA, 11 nt, Human
gaaaaauauga

SEQ ID NO: 2617327 - RNA, 16 nt, Human
cuuuuuuagaguugau

SEQ ID NO: 2617328 - RNA, 21 nt, Human
cuuuuuuaagauuuuucucaa

SEQ ID NO: 2617329 - RNA, 20 nt, Human
cuuuuuuaagauuuuucuca

SEQ ID NO: 2617330 - RNA, 15 nt, Human
cuuuuuuacacaaau

SEQ ID NO: 2617331 - RNA, 19 nt, Human
gaaaauaacaauaaaagac

SEQ ID NO: 2617332 - RNA, 15 nt, Human
gaaaauaaaaaguua

SEQ ID NO: 2617333 - RNA, 16 nt, Human
gaaaauaaaaaguuaa

SEQ ID NO: 2617334 - RNA, 14 nt, Human
gaaaagucaaacug

SEQ ID NO: 2617335 - RNA, 13 nt, Human
gaaaagucaaacu

SEQ ID NO: 2617336 - RNA, 22 nt, Human
gaaaagucaaggguaggguggg

SEQ ID NO: 2617337 - RNA, 14 nt, Human
gaaaaguauguuag

SEQ ID NO: 2617338 - RNA, 14 nt, Human
gaaaagguuuuauu

SEQ ID NO: 2617339 - RNA, 18 nt, Human
gaaaagguuuuauuuugu

SEQ ID NO: 2617340 - RNA, 17 nt, Human
gaaaagguuuuauuuug

SEQ ID NO: 2617341 - RNA, 21 nt, Human
gaaaaguaaggugcaguuccc

SEQ ID NO: 2617342 - RNA, 20 nt, Human
gaaaaguauguuagugcaaa

SEQ ID NO: 2617343 - RNA, 16 nt, Human
gaaaaguacauuuaau

SEQ ID NO: 2617344 - RNA, 14 nt, Human
gaaaaguacauuua

SEQ ID NO: 2617345 - RNA, 21 nt, Human
gaaaaccuaaguccuuuaugu

SEQ ID NO: 2617346 - RNA, 13 nt, Human
gaaaacccagaga

SEQ ID NO: 2617347 - RNA, 14 nt, Human
gaaaacccagagag

SEQ ID NO: 2617348 - RNA, 15 nt, Human
gaaaacccagagagg

SEQ ID NO: 2617349 - RNA, 22 nt, Human
gaaaacccagagaggaaucaga

SEQ ID NO: 2617350 - RNA, 14 nt, Human
gaaaaccccagcau

SEQ ID NO: 2617351 - RNA, 19 nt, Human
gaaaacaugcuacacacug

SEQ ID NO: 2617352 - RNA, 14 nt, Human
gaaaacaaggaagu

SEQ ID NO: 2617353 - RNA, 13 nt, Human
gaaaacauuccau

SEQ ID NO: 2617354 - RNA, 15 nt, Human
gaaaacauguaauaa

SEQ ID NO: 2617355 - RNA, 21 nt, Human
gaaaagggucuugggaaauau

SEQ ID NO: 2617356 - RNA, 19 nt, Human
gaaaacgucuugcuuggga

SEQ ID NO: 2617357 - RNA, 17 nt, Human
gaaaagguaaggugaag

SEQ ID NO: 2617358 - RNA, 19 nt, Human
gaaaagggaaguugugccu

SEQ ID NO: 2617359 - RNA, 21 nt, Human
gaaaagggagauucagacugu

SEQ ID NO: 2617360 - RNA, 17 nt, Human
gaaaacgguuaaaacug

SEQ ID NO: 2617361 - RNA, 18 nt, Human
gaaaagggaacugaacau

SEQ ID NO: 2617362 - RNA, 13 nt, Human
gaaaacggagcug

SEQ ID NO: 2617363 - RNA, 14 nt, Human
gaaaacggagcuga

SEQ ID NO: 2617364 - RNA, 14 nt, Human
gaaaacguggcugc

SEQ ID NO: 2617365 - RNA, 13 nt, Human
gaaaaccucuccu

SEQ ID NO: 2617366 - RNA, 13 nt, Human
cuuuuuauuugca

SEQ ID NO: 2617367 - RNA, 14 nt, Human
cuuuuuauuugcau

SEQ ID NO: 2617368 - RNA, 13 nt, Human
cuuuuuauuucug

SEQ ID NO: 2617369 - RNA, 16 nt, Human
cuuuuuauuucugcau

SEQ ID NO: 2617370 - RNA, 15 nt, Human
cuuuuuauuugcaug

SEQ ID NO: 2617371 - RNA, 19 nt, Human
cuuuuuaaaaauagacacu

SEQ ID NO: 2617372 - RNA, 17 nt, Human
cuuuugacaaaggcaag

SEQ ID NO: 2617373 - RNA, 20 nt, Human
cuuuuguucuugguuuguaa

SEQ ID NO: 2617374 - RNA, 22 nt, Human
cuuuuguucuugguuuguaaau

SEQ ID NO: 2617375 - RNA, 22 nt, Human
cuuuugaaguaguuuguauaac

SEQ ID NO: 2617376 - RNA, 21 nt, Human
cuuuugaauaaaaacuuugcu

SEQ ID NO: 2617377 - RNA, 13 nt, Human
cuuuugaauauuc

SEQ ID NO: 2617378 - RNA, 19 nt, Human
cuuuugaauccaugcuugg

SEQ ID NO: 2617379 - RNA, 20 nt, Human
cuuuugaauccaugcuuggg

SEQ ID NO: 2617380 - RNA, 21 nt, Human
cuuuugaauccaugcuugggu

SEQ ID NO: 2617381 - RNA, 23 nt, Human
cuuuugaauccaugcuugggugu

SEQ ID NO: 2617382 - RNA, 20 nt, Human
cuuuugaaguaguuuguaua

SEQ ID NO: 2617383 - RNA, 21 nt, Human
cuuuugaacgcccccccccac

SEQ ID NO: 2617384 - RNA, 18 nt, Human
cuuuugaacccaggaguu

SEQ ID NO: 2617385 - RNA, 20 nt, Human
cuuuugaacccaggaguuca

SEQ ID NO: 2617386 - RNA, 17 nt, Human
cuuuuucauauguugcu

SEQ ID NO: 2617387 - RNA, 22 nt, Human
cuuuuugaaguguaggcagaca

SEQ ID NO: 2617388 - RNA, 21 nt, Human
cuuuuugaaguguaggcagac

SEQ ID NO: 2617389 - RNA, 13 nt, Human
cuuuuugaagugu

SEQ ID NO: 2617390 - RNA, 16 nt, Human
cuuuuuaaaguguuuc

SEQ ID NO: 2617391 - RNA, 12 nt, Human
cuuuuugaagug

SEQ ID NO: 2617392 - RNA, 23 nt, Human
cuuuuugaaguguaggcagacac

SEQ ID NO: 2617393 - RNA, 19 nt, Human
cuuuuugaauguuauuugu

SEQ ID NO: 2617394 - RNA, 11 nt, Human
cuuuuugaaug

SEQ ID NO: 2617395 - RNA, 15 nt, Human
cuuuuuggaggugcu

SEQ ID NO: 2617396 - RNA, 18 nt, Human
cuuuuuuaaaugaagaaa

SEQ ID NO: 2617397 - RNA, 13 nt, Human
cuuuuugcuuucg

SEQ ID NO: 2617398 - RNA, 18 nt, Human
cuuuuugagguggcacuu

SEQ ID NO: 2617399 - RNA, 20 nt, Human
cuuuuugagguggcacuuuu

SEQ ID NO: 2617400 - RNA, 19 nt, Human
cuuuguuuugauguuugug

SEQ ID NO: 2617401 - RNA, 23 nt, Human
cuuuguuuugauguuuguggccu

SEQ ID NO: 2617402 - RNA, 23 nt, Human
cuuuguuuugcacacuuugccau

SEQ ID NO: 2617403 - RNA, 19 nt, Human
cuuuguuuugcacacuuug

SEQ ID NO: 2617404 - RNA, 24 nt, Human
cuuuguuuugauguuuguggccuc

SEQ ID NO: 2617405 - RNA, 20 nt, Human
cuuuguucuuuaggagauuu

SEQ ID NO: 2617406 - RNA, 17 nt, Human
cuuuguguagcuuugcu

SEQ ID NO: 2617407 - RNA, 16 nt, Human
cuuuguugcccaggcu

SEQ ID NO: 2617408 - RNA, 21 nt, Human
cuuuguugcaaguacugcugu

SEQ ID NO: 2617409 - RNA, 17 nt, Human
cuuuguuuuacugucuu

SEQ ID NO: 2617410 - RNA, 21 nt, Human
cuuuguuuguugucagcugaa

SEQ ID NO: 2617411 - RNA, 21 nt, Human
cuuuucugucucugccucccu

SEQ ID NO: 2617412 - RNA, 18 nt, Human
cuuuucugucucugccuc

SEQ ID NO: 2617413 - RNA, 17 nt, Human
cuuuucugucucugccu

SEQ ID NO: 2617414 - RNA, 16 nt, Human
cuuuucugucucugcc

SEQ ID NO: 2617415 - RNA, 17 nt, Human
cuuuucugcccuggcug

SEQ ID NO: 2617416 - RNA, 15 nt, Human
cuuuucugcccuggc

SEQ ID NO: 2617417 - RNA, 14 nt, Human
cuuuucugcccugg

SEQ ID NO: 2617418 - RNA, 15 nt, Human
cuuuucuguuugcua

SEQ ID NO: 2617419 - RNA, 12 nt, Human
cuuuucugcaga

SEQ ID NO: 2617420 - RNA, 15 nt, Human
cuuuucugcagaggg

SEQ ID NO: 2617421 - RNA, 13 nt, Human
cuuuucugcccug

SEQ ID NO: 2617422 - RNA, 20 nt, Human
cuuuucugcauuuugcuauu

SEQ ID NO: 2617423 - RNA, 14 nt, Human
cuuuucugcauuuu

SEQ ID NO: 2617424 - RNA, 13 nt, Human
cuuuucugcauuu

SEQ ID NO: 2617425 - RNA, 16 nt, Human
cuuuucuuaaaccuuc

SEQ ID NO: 2617426 - RNA, 15 nt, Human
cuuuucuuaaaccuu

SEQ ID NO: 2617427 - RNA, 14 nt, Human
cuuuugaaaucugu

SEQ ID NO: 2617428 - RNA, 16 nt, Human
cuuuugaaacaauacu

SEQ ID NO: 2617429 - RNA, 13 nt, Human
cuuuugaaacaau

SEQ ID NO: 2617430 - RNA, 14 nt, Human
cuuuucuuuuucuc

SEQ ID NO: 2617431 - RNA, 13 nt, Human
cuuuugaacccag

SEQ ID NO: 2617432 - RNA, 14 nt, Human
cuuuugaacccagg

SEQ ID NO: 2617433 - RNA, 17 nt, Human
cuugcaauuucuaccua

SEQ ID NO: 2617434 - RNA, 23 nt, Human
cuugcacacuccccugcacugga

SEQ ID NO: 2617435 - RNA, 19 nt, Human
cuugcacacuccccugcac

SEQ ID NO: 2617436 - RNA, 22 nt, Human
cuugcacacuccccugcacugg

SEQ ID NO: 2617437 - RNA, 18 nt, Human
cuugcaccccucacucug

SEQ ID NO: 2617438 - RNA, 16 nt, Human
cuugcaccccucacuc

SEQ ID NO: 2617439 - RNA, 14 nt, Human
cuugcaccccucac

SEQ ID NO: 2617440 - RNA, 23 nt, Human
cuugcaccccaaagcuuuccugc

SEQ ID NO: 2617441 - RNA, 22 nt, Human
cuugcaccccaaagcuuuccug

SEQ ID NO: 2617442 - RNA, 20 nt, Human
cuugcagacucuacagaggc

SEQ ID NO: 2617443 - RNA, 21 nt, Human
cuugcagacucuacagaggcc

SEQ ID NO: 2617444 - RNA, 17 nt, Human
cuugcacccgccucucc

SEQ ID NO: 2617445 - RNA, 16 nt, Human
cuugcacccgccucuc

SEQ ID NO: 2617446 - RNA, 15 nt, Human
cuugcacccgccucu

SEQ ID NO: 2617447 - RNA, 20 nt, Human
cuugcaccccucacucuggc

SEQ ID NO: 2617448 - RNA, 19 nt, Human
cuugcagcacucacacagg

SEQ ID NO: 2617449 - RNA, 18 nt, Human
cuugcacccgccucuccc

SEQ ID NO: 2617450 - RNA, 18 nt, Human
cuugcagcacucacacag

SEQ ID NO: 2617451 - RNA, 19 nt, Human
cuugcauccaacuccagga

SEQ ID NO: 2617452 - RNA, 23 nt, Human
cuugcagcaggaucuagaggggg

SEQ ID NO: 2617453 - RNA, 13 nt, Human
cuugcagcaggau

SEQ ID NO: 2617454 - RNA, 12 nt, Human
cuugcagcagga

SEQ ID NO: 2617455 - RNA, 23 nt, Human
cuugcagcacucacacaggaccc

SEQ ID NO: 2617456 - RNA, 22 nt, Human
cuugcagcacucacacaggacc

SEQ ID NO: 2617457 - RNA, 18 nt, Human
cuugcaauggcagccuug

SEQ ID NO: 2617458 - RNA, 17 nt, Human
cuugcaauggcagccuu

SEQ ID NO: 2617459 - RNA, 16 nt, Human
cuugcaauggcagccu

SEQ ID NO: 2617460 - RNA, 15 nt, Human
cuugcaauggcagcc

SEQ ID NO: 2617461 - RNA, 21 nt, Human
cuugaguugauucagcucugc

SEQ ID NO: 2617462 - RNA, 20 nt, Human
cuugaguugauucagcucug

SEQ ID NO: 2617463 - RNA, 18 nt, Human
cuugaguugauucagcuc

SEQ ID NO: 2617464 - RNA, 19 nt, Human
cuugaguugauucagcucu

SEQ ID NO: 2617465 - RNA, 19 nt, Human
cuugagccgggccccuggg

SEQ ID NO: 2617466 - RNA, 17 nt, Human
cuugagccgggccccug

SEQ ID NO: 2617467 - RNA, 20 nt, Human
cuugagccgggccccugggc

SEQ ID NO: 2617468 - RNA, 17 nt, Human
cuugaggguugggcugg

SEQ ID NO: 2617469 - RNA, 15 nt, Human
cuugaggguugggcu

SEQ ID NO: 2617470 - RNA, 12 nt, Human
cuugagccuggg

SEQ ID NO: 2617471 - RNA, 15 nt, Human
cuugagccugggagg

SEQ ID NO: 2617472 - RNA, 16 nt, Human
cuugagagaccaggca

SEQ ID NO: 2617473 - RNA, 13 nt, Human
cuugagcccagga

SEQ ID NO: 2617474 - RNA, 18 nt, Human
cuugagaccucagccaug

SEQ ID NO: 2617475 - RNA, 17 nt, Human
cuugagacuguuuugaa

SEQ ID NO: 2617476 - RNA, 14 nt, Human
cuugagagaccagg

SEQ ID NO: 2617477 - RNA, 22 nt, Human
cuugagacuguuuugaauuugg

SEQ ID NO: 2617478 - RNA, 15 nt, Human
cuugagcccaggagu

SEQ ID NO: 2617479 - RNA, 14 nt, Human
cuugagcccaggag

SEQ ID NO: 2617480 - RNA, 14 nt, Human
cuucuggcuuccuu

SEQ ID NO: 2617481 - RNA, 20 nt, Human
cuucuggcuuccuucucuca

SEQ ID NO: 2617482 - RNA, 15 nt, Human
cuucugggagggcag

SEQ ID NO: 2617483 - RNA, 13 nt, Human
cuugagaaaccuu

SEQ ID NO: 2617484 - RNA, 12 nt, Human
cuugagaaaccu

SEQ ID NO: 2617485 - RNA, 11 nt, Human
cuugagaaacc

SEQ ID NO: 2617486 - RNA, 17 nt, Human
cuugagacacggagccc

SEQ ID NO: 2617487 - RNA, 22 nt, Human
cuugagacacggagcccagccc

SEQ ID NO: 2617488 - RNA, 13 nt, Human
cuugagacagcuu

SEQ ID NO: 2617489 - RNA, 14 nt, Human
cuugagaccucagc

SEQ ID NO: 2617490 - RNA, 15 nt, Human
cuugagaccucagcc

SEQ ID NO: 2617491 - RNA, 16 nt, Human
cuugagaccucagcca

SEQ ID NO: 2617492 - RNA, 22 nt, Human
cuugagaaauauggacacuuaa

SEQ ID NO: 2617493 - RNA, 23 nt, Human
cuugagaagaccucaccuagaaa

SEQ ID NO: 2617494 - RNA, 17 nt, Human
cuucuggauucuuggcc

SEQ ID NO: 2617495 - RNA, 16 nt, Human
cuucuggauucuuggc

SEQ ID NO: 2617496 - RNA, 18 nt, Human
cuucuggauucuuggccc

SEQ ID NO: 2617497 - RNA, 17 nt, Human
cuucuggcacuuggaga

SEQ ID NO: 2617498 - RNA, 20 nt, Human
cuucuggagucuccaguggu

SEQ ID NO: 2617499 - RNA, 15 nt, Human
cuucuggauucuugg

SEQ ID NO: 2617500 - RNA, 18 nt, Human
cuucuggagucuccagug

SEQ ID NO: 2617501 - RNA, 16 nt, Human
cuucuggagucuccag

SEQ ID NO: 2617502 - RNA, 14 nt, Human
cuucuggagcccuu

SEQ ID NO: 2617503 - RNA, 12 nt, Human
cuucuggcucaa

SEQ ID NO: 2617504 - RNA, 16 nt, Human
cuucuggccucccaca

SEQ ID NO: 2617505 - RNA, 19 nt, Human
cuucuggccucccacagac

SEQ ID NO: 2617506 - RNA, 15 nt, Human
cuucuggccucccac

SEQ ID NO: 2617507 - RNA, 14 nt, Human
cuucuggccuccca

SEQ ID NO: 2617508 - RNA, 14 nt, Human
cuugcaugaggcua

SEQ ID NO: 2617509 - RNA, 13 nt, Human
cuugcaugaggcu

SEQ ID NO: 2617510 - RNA, 23 nt, Human
cuugccaaccuguaauaaauaug

SEQ ID NO: 2617511 - RNA, 22 nt, Human
cuugccaaccuguaauaaauau

SEQ ID NO: 2617512 - RNA, 21 nt, Human
cuugccaaccuguaauaaaua

SEQ ID NO: 2617513 - RNA, 20 nt, Human
cuugcaucguggagacaggg

SEQ ID NO: 2617514 - RNA, 20 nt, Human
cuugccaaccuguaauaaau

SEQ ID NO: 2617515 - RNA, 18 nt, Human
cuugcaucucauugcucu

SEQ ID NO: 2617516 - RNA, 17 nt, Human
cuugcaucguggagaca

SEQ ID NO: 2617517 - RNA, 15 nt, Human
cuugcauccaacucc

SEQ ID NO: 2617518 - RNA, 17 nt, Human
cuugcaugaggcuagug

SEQ ID NO: 2617519 - RNA, 23 nt, Human
cuugccaccccacccucccugga

SEQ ID NO: 2617520 - RNA, 22 nt, Human
cuugccaccccacccucccugg

SEQ ID NO: 2617521 - RNA, 21 nt, Human
cuugccaccccacccucccug

SEQ ID NO: 2617522 - RNA, 23 nt, Human
cuugccaggguuucgagaagcug

SEQ ID NO: 2617523 - RNA, 17 nt, Human
cuugccacuagggcucu

SEQ ID NO: 2617524 - RNA, 14 nt, Human
cuugccacagcucu

SEQ ID NO: 2617525 - RNA, 20 nt, Human
cuugccaccccacccucccu

SEQ ID NO: 2617526 - RNA, 18 nt, Human
cuugccaccccacccucc

SEQ ID NO: 2617527 - RNA, 13 nt, Human
cuugccaccccac

SEQ ID NO: 2617528 - RNA, 20 nt, Human
cuugccacagcucuugagga

SEQ ID NO: 2617529 - RNA, 22 nt, Human
cuugccaaugaggucugaaaug

SEQ ID NO: 2617530 - RNA, 23 nt, Human
cuugccaaugaggucugaaaugg

SEQ ID NO: 2617531 - RNA, 14 nt, Human
cuugcccuguuaaa

SEQ ID NO: 2617532 - RNA, 18 nt, Human
cuugcccuggugccucac

SEQ ID NO: 2617533 - RNA, 18 nt, Human
cuugccccaacccccagc

SEQ ID NO: 2617534 - RNA, 17 nt, Human
cuugccccaacccccag

SEQ ID NO: 2617535 - RNA, 14 nt, Human
cuugccccaacccc

SEQ ID NO: 2617536 - RNA, 13 nt, Human
cuugccccaaccc

SEQ ID NO: 2617537 - RNA, 20 nt, Human
cuugcccaguuucagggcua

SEQ ID NO: 2617538 - RNA, 20 nt, Human
cuugcccagggcucagccug

SEQ ID NO: 2617539 - RNA, 21 nt, Human
cuugcccagggcucagccugg

SEQ ID NO: 2617540 - RNA, 14 nt, Human
cuugcccaguuuca

SEQ ID NO: 2617541 - RNA, 23 nt, Human
cuugcccagggcucagccuggug

SEQ ID NO: 2617542 - RNA, 13 nt, Human
cuugcccagggcu

SEQ ID NO: 2617543 - RNA, 14 nt, Human
cuugcccagggcuc

SEQ ID NO: 2617544 - RNA, 15 nt, Human
cuugcccagggcuca

SEQ ID NO: 2617545 - RNA, 16 nt, Human
cuugcccagggcucag

SEQ ID NO: 2617546 - RNA, 18 nt, Human
cuugcccagggcucagcc

SEQ ID NO: 2617547 - RNA, 19 nt, Human
cuugcccagggcucagccu

SEQ ID NO: 2617548 - RNA, 20 nt, Human
cuugcuugauuguauggugg

SEQ ID NO: 2617549 - RNA, 14 nt, Human
cuuggaagcuccgc

SEQ ID NO: 2617550 - RNA, 20 nt, Human
cuuggaagcuccgcuuucua

SEQ ID NO: 2617551 - RNA, 17 nt, Human
cuugcuucccuaaucua

SEQ ID NO: 2617552 - RNA, 13 nt, Human
cuugcuucccuaa

SEQ ID NO: 2617553 - RNA, 20 nt, Human
cuugcugcccugugcuccuc

SEQ ID NO: 2617554 - RNA, 23 nt, Human
cuugcugcccuaggcuccgucag

SEQ ID NO: 2617555 - RNA, 21 nt, Human
cuugcugcaguaugaaaauaa

SEQ ID NO: 2617556 - RNA, 19 nt, Human
cuugcugagaggggcuguc

SEQ ID NO: 2617557 - RNA, 17 nt, Human
cuugcugagaggggcug

SEQ ID NO: 2617558 - RNA, 18 nt, Human
cuugcucuugaugccugg

SEQ ID NO: 2617559 - RNA, 17 nt, Human
cuugcucuugaugccug

SEQ ID NO: 2617560 - RNA, 19 nt, Human
cuugcucuugaugccuggc

SEQ ID NO: 2617561 - RNA, 22 nt, Human
cuugcucuuucuacucugaacu

SEQ ID NO: 2617562 - RNA, 20 nt, Human
cuugcucuuucuacucugaa

SEQ ID NO: 2617563 - RNA, 19 nt, Human
cuugcucuuucuacucuga

SEQ ID NO: 2617564 - RNA, 15 nt, Human
cuugcucuguaaucu

SEQ ID NO: 2617565 - RNA, 19 nt, Human
cuugcucuucagugggaga

SEQ ID NO: 2617566 - RNA, 14 nt, Human
cuugcucuguaauc

SEQ ID NO: 2617567 - RNA, 17 nt, Human
cuugcccuucccugucc

SEQ ID NO: 2617568 - RNA, 16 nt, Human
cuugcccuucccuguc

SEQ ID NO: 2617569 - RNA, 15 nt, Human
cuugcccuucccugu

SEQ ID NO: 2617570 - RNA, 14 nt, Human
cuugcccuucccug

SEQ ID NO: 2617571 - RNA, 12 nt, Human
cuugcccuuccc

SEQ ID NO: 2617572 - RNA, 21 nt, Human
cuugccccaacccccagcacc

SEQ ID NO: 2617573 - RNA, 20 nt, Human
cuugccccaacccccagcac

SEQ ID NO: 2617574 - RNA, 19 nt, Human
cuugccccaacccccagca

SEQ ID NO: 2617575 - RNA, 22 nt, Human
cuugcccuguuaaaagaugaaa

SEQ ID NO: 2617576 - RNA, 22 nt, Human
cuugcucugcugacagacacag

SEQ ID NO: 2617577 - RNA, 19 nt, Human
cuugcccuucccugucccu

SEQ ID NO: 2617578 - RNA, 23 nt, Human
cuugcucugcuugacaacaucug

SEQ ID NO: 2617579 - RNA, 14 nt, Human
cuuguuggagccug

SEQ ID NO: 2617580 - RNA, 22 nt, Human
cuuguugcuguugauguuuugu

SEQ ID NO: 2617581 - RNA, 19 nt, Human
cuuguugcaugauguauuu

SEQ ID NO: 2617582 - RNA, 20 nt, Human
cuuguugcucaaaaaaugag

SEQ ID NO: 2617583 - RNA, 19 nt, Human
cuuuaaaaaaauuuaagug

SEQ ID NO: 2617584 - RNA, 18 nt, Human
cuuuaaaaaaauuuaagu

SEQ ID NO: 2617585 - RNA, 17 nt, Human
cuuuaaaaaaauuuaag

SEQ ID NO: 2617586 - RNA, 20 nt, Human
cuuguuugcucaccuggggu

SEQ ID NO: 2617587 - RNA, 18 nt, Human
cuuguuugcucaccuggg

SEQ ID NO: 2617588 - RNA, 19 nt, Human
cuuguuugcucaccugggg

SEQ ID NO: 2617589 - RNA, 20 nt, Human
cuuguuugauuuuagcugca

SEQ ID NO: 2617590 - RNA, 22 nt, Human
cuuguuugauuuuagcugcaga

SEQ ID NO: 2617591 - RNA, 23 nt, Human
cuuguuugauuuuagcugcagaa

SEQ ID NO: 2617592 - RNA, 16 nt, Human
cuuguuugcucaccug

SEQ ID NO: 2617593 - RNA, 15 nt, Human
cuuguuuccaauguu

SEQ ID NO: 2617594 - RNA, 22 nt, Human
cuuguuucaauuccaccugcaa

SEQ ID NO: 2617595 - RNA, 14 nt, Human
cuuguuucuuuuca

SEQ ID NO: 2617596 - RNA, 12 nt, Human
cuuguuucaauu

SEQ ID NO: 2617597 - RNA, 20 nt, Human
cuuuaaaagacaaaucaaag

SEQ ID NO: 2617598 - RNA, 12 nt, Human
cuuuaaaagaau

SEQ ID NO: 2617599 - RNA, 17 nt, Human
cuuuaccuuuuuuauac

SEQ ID NO: 2617600 - RNA, 22 nt, Human
cuuuaaaaaauuaaucugggcc

SEQ ID NO: 2617601 - RNA, 19 nt, Human
cuuuaaaaacuauuuaacu

SEQ ID NO: 2617602 - RNA, 14 nt, Human
cuuuaaaaacuauu

SEQ ID NO: 2617603 - RNA, 21 nt, Human
cuuuaaaaagcuccaaaugca

SEQ ID NO: 2617604 - RNA, 23 nt, Human
cuuuaaaaacuauuuaacuugag

SEQ ID NO: 2617605 - RNA, 19 nt, Human
cuuuaccuuuuuuauacau

SEQ ID NO: 2617606 - RNA, 20 nt, Human
cuuuaccuuuuuuauacaua

SEQ ID NO: 2617607 - RNA, 23 nt, Human
cuuuagacccugggugggcucug

SEQ ID NO: 2617608 - RNA, 16 nt, Human
cuuuagacccugggug

SEQ ID NO: 2617609 - RNA, 14 nt, Human
cuuuagacccuggg

SEQ ID NO: 2617610 - RNA, 13 nt, Human
cuuuaccugagac

SEQ ID NO: 2617611 - RNA, 16 nt, Human
cuuuaccugagaccag

SEQ ID NO: 2617612 - RNA, 22 nt, Human
cuuuagaaugagagugugaaau

SEQ ID NO: 2617613 - RNA, 18 nt, Human
cuuuagaaugagagugug

SEQ ID NO: 2617614 - RNA, 15 nt, Human
cuuguggucccaccc

SEQ ID NO: 2617615 - RNA, 18 nt, Human
cuuguccuagcuugggag

SEQ ID NO: 2617616 - RNA, 14 nt, Human
cuuguccuuucccu

SEQ ID NO: 2617617 - RNA, 15 nt, Human
cuuguccuuucccuu

SEQ ID NO: 2617618 - RNA, 23 nt, Human
cuuguccuuuuguaccauggugu

SEQ ID NO: 2617619 - RNA, 16 nt, Human
cuuguccccacacucc

SEQ ID NO: 2617620 - RNA, 14 nt, Human
cuuguccccacacu

SEQ ID NO: 2617621 - RNA, 13 nt, Human
cuuguccccacac

SEQ ID NO: 2617622 - RNA, 21 nt, Human
cuuguccccugccugugccug

SEQ ID NO: 2617623 - RNA, 17 nt, Human
cuuguccccugccugug

SEQ ID NO: 2617624 - RNA, 20 nt, Human
cuuguccccacacuccuaca

SEQ ID NO: 2617625 - RNA, 18 nt, Human
cuuguccccacacuccua

SEQ ID NO: 2617626 - RNA, 20 nt, Human
cuuguccccuccucacuccc

SEQ ID NO: 2617627 - RNA, 21 nt, Human
cuuguccccuccucacucccu

SEQ ID NO: 2617628 - RNA, 19 nt, Human
cuuguggucccaccccaca

SEQ ID NO: 2617629 - RNA, 16 nt, Human
cuuguggucccacccc

SEQ ID NO: 2617630 - RNA, 16 nt, Human
cuuguuaagauaguua

SEQ ID NO: 2617631 - RNA, 21 nt, Human
cuuguucugugaugaggggag

SEQ ID NO: 2617632 - RNA, 20 nt, Human
cuuguucugugaugagggga

SEQ ID NO: 2617633 - RNA, 17 nt, Human
cuuguuacuucugaggu

SEQ ID NO: 2617634 - RNA, 15 nt, Human
cuuguuacuucugag

SEQ ID NO: 2617635 - RNA, 14 nt, Human
cuuguuacuucuga

SEQ ID NO: 2617636 - RNA, 21 nt, Human
cuuguguuucuuuaguuuuug

SEQ ID NO: 2617637 - RNA, 12 nt, Human
cuuguccccaca

SEQ ID NO: 2617638 - RNA, 22 nt, Human
cuuguguuuuuaacucaauauu

SEQ ID NO: 2617639 - RNA, 14 nt, Human
cuugguuuguaaau

SEQ ID NO: 2617640 - RNA, 15 nt, Human
cuugguuuguaaauu

SEQ ID NO: 2617641 - RNA, 22 nt, Human
cuuguaaugauauagccagaaa

SEQ ID NO: 2617642 - RNA, 21 nt, Human
cuuguaaugauauagccagaa

SEQ ID NO: 2617643 - RNA, 15 nt, Human
cuuguaauucuaaau

SEQ ID NO: 2617644 - RNA, 13 nt, Human
cuuguaauucuaa

SEQ ID NO: 2617645 - RNA, 22 nt, Human
cuuguaauuuuuuuaauuuaca

SEQ ID NO: 2617646 - RNA, 23 nt, Human
cuuguaauuuaaacaggcccagc

SEQ ID NO: 2617647 - RNA, 13 nt, Human
cuuguacaaaaua

SEQ ID NO: 2617648 - RNA, 22 nt, Human
cuuguaauuuaaacaggcccag

SEQ ID NO: 2617649 - RNA, 21 nt, Human
cuuguaauuuaaacaggccca

SEQ ID NO: 2617650 - RNA, 12 nt, Human
cuuguaauuuaa

SEQ ID NO: 2617651 - RNA, 23 nt, Human
cuuguaauucuaaaugaauguuu

SEQ ID NO: 2617652 - RNA, 16 nt, Human
cuuguaauucuaaaug

SEQ ID NO: 2617653 - RNA, 17 nt, Human
cuuguacuuuauuuucu

SEQ ID NO: 2617654 - RNA, 12 nt, Human
cuuguacaaaau

SEQ ID NO: 2617655 - RNA, 18 nt, Human
cuugguugucuccacaca

SEQ ID NO: 2617656 - RNA, 14 nt, Human
cuugguugucucca

SEQ ID NO: 2617657 - RNA, 17 nt, Human
cuugguuuccaaaggca

SEQ ID NO: 2617658 - RNA, 22 nt, Human
cuugguuucuucaacaggagaa

SEQ ID NO: 2617659 - RNA, 21 nt, Human
cuuggggcuugacuuuuguau

SEQ ID NO: 2617660 - RNA, 20 nt, Human
cuuggggcuugacuuuugua

SEQ ID NO: 2617661 - RNA, 14 nt, Human
cuugggcugcuccu

SEQ ID NO: 2617662 - RNA, 15 nt, Human
cuugguuggcuggcc

SEQ ID NO: 2617663 - RNA, 16 nt, Human
cuugguuggcuggccu

SEQ ID NO: 2617664 - RNA, 17 nt, Human
cuugguuggguccucac

SEQ ID NO: 2617665 - RNA, 18 nt, Human
cuuggggcugaugcaguu

SEQ ID NO: 2617666 - RNA, 15 nt, Human
cuuggggccuaugca

SEQ ID NO: 2617667 - RNA, 18 nt, Human
cuuggggcucacacaccu

SEQ ID NO: 2617668 - RNA, 14 nt, Human
cuuggggcuuccua

SEQ ID NO: 2617669 - RNA, 16 nt, Human
cuuggggcugaugcag

SEQ ID NO: 2617670 - RNA, 14 nt, Human
cuugggcugagacu

SEQ ID NO: 2617671 - RNA, 17 nt, Human
cuugggcugagacugga

SEQ ID NO: 2617672 - RNA, 21 nt, Human
cuugggcucccuguaaccucu

SEQ ID NO: 2617673 - RNA, 22 nt, Human
cuugggcggcugagagccccag

SEQ ID NO: 2617674 - RNA, 13 nt, Human
cuugggcucccug

SEQ ID NO: 2617675 - RNA, 18 nt, Human
cuugggcggcugagagcc

SEQ ID NO: 2617676 - RNA, 15 nt, Human
cuugggcggcugaga

SEQ ID NO: 2617677 - RNA, 14 nt, Human
cuugggcggcugag

SEQ ID NO: 2617678 - RNA, 12 nt, Human
cuugggcggcug

SEQ ID NO: 2617679 - RNA, 22 nt, Human
cuuggacuucuucucccccgcg

SEQ ID NO: 2617680 - RNA, 18 nt, Human
cuuggacucuugcucuuu

SEQ ID NO: 2617681 - RNA, 15 nt, Human
cuuggacucuugcuc

SEQ ID NO: 2617682 - RNA, 14 nt, Human
cuuggacucuugcu

SEQ ID NO: 2617683 - RNA, 13 nt, Human
cuuggacuugagg

SEQ ID NO: 2617684 - RNA, 22 nt, Human
cuuggagccaauggagacuguc

SEQ ID NO: 2617685 - RNA, 20 nt, Human
cuugggaggaagcagaauaa

SEQ ID NO: 2617686 - RNA, 21 nt, Human
cuugggaggaagcagaauaaa

SEQ ID NO: 2617687 - RNA, 13 nt, Human
cuuggagccccag

SEQ ID NO: 2617688 - RNA, 23 nt, Human
cuugggaggaagcagaauaaagc

SEQ ID NO: 2617689 - RNA, 22 nt, Human
cuugggaggaagcagaauaaag

SEQ ID NO: 2617690 - RNA, 14 nt, Human
cuugggaggcccca

SEQ ID NO: 2617691 - RNA, 15 nt, Human
cuugggaggccccac

SEQ ID NO: 2617692 - RNA, 19 nt, Human
cuugggaggccccacuggg

SEQ ID NO: 2617693 - RNA, 21 nt, Human
cuugggaggccccacugggga

SEQ ID NO: 2617694 - RNA, 22 nt, Human
cuugggaggccccacuggggaa

SEQ ID NO: 2617695 - RNA, 15 nt, Human
cuugggaggcuuccc

SEQ ID NO: 2617696 - RNA, 16 nt, Human
cuugggaggcuucccc

SEQ ID NO: 2617697 - RNA, 15 nt, Human
cuuggaagcuucugg

SEQ ID NO: 2617698 - RNA, 16 nt, Human
cuugcugcccuaggcu

SEQ ID NO: 2617699 - RNA, 22 nt, Human
cuuggaauuuguaaccucagcu

SEQ ID NO: 2617700 - RNA, 20 nt, Human
cuuggaauuuguaaccucag

SEQ ID NO: 2617701 - RNA, 13 nt, Human
cuuggacacugua

SEQ ID NO: 2617702 - RNA, 18 nt, Human
cuuggaaguugcauggca

SEQ ID NO: 2617703 - RNA, 21 nt, Human
cuuggaaguuucauauauugu

SEQ ID NO: 2617704 - RNA, 16 nt, Human
cuuggacucauuuuaa

SEQ ID NO: 2617705 - RNA, 19 nt, Human
cuuggaccucugcucugag

SEQ ID NO: 2617706 - RNA, 22 nt, Human
cuuggacuauuauaauuuaaug

SEQ ID NO: 2617707 - RNA, 17 nt, Human
cuuggaccucugcucug

SEQ ID NO: 2617708 - RNA, 14 nt, Human
cuuggacuauuaua

SEQ ID NO: 2617709 - RNA, 20 nt, Human
cuugggaugaugccucauga

SEQ ID NO: 2617710 - RNA, 18 nt, Human
cuugggccacugugaaga

SEQ ID NO: 2617711 - RNA, 20 nt, Human
cuugggccacugugaagaga

SEQ ID NO: 2617712 - RNA, 18 nt, Human
cuugggcccagcugggcu

SEQ ID NO: 2617713 - RNA, 16 nt, Human
cuugggcccagcuggg

SEQ ID NO: 2617714 - RNA, 15 nt, Human
cuugggcccagcugg

SEQ ID NO: 2617715 - RNA, 14 nt, Human
cuugggcccagcug

SEQ ID NO: 2617716 - RNA, 17 nt, Human
cuugggccauagcuccu

SEQ ID NO: 2617717 - RNA, 16 nt, Human
cuugggccauagcucc

SEQ ID NO: 2617718 - RNA, 13 nt, Human
cuugggcagagcu

SEQ ID NO: 2617719 - RNA, 22 nt, Human
cuugggcacuuuuuaauucacc

SEQ ID NO: 2617720 - RNA, 14 nt, Human
cuugggcccuuuga

SEQ ID NO: 2617721 - RNA, 16 nt, Human
cuugggcccuuugagu

SEQ ID NO: 2617722 - RNA, 17 nt, Human
cuugggcccuuugagug

SEQ ID NO: 2617723 - RNA, 19 nt, Human
cuugggcccuuugagugca

SEQ ID NO: 2617724 - RNA, 21 nt, Human
cuugggcccagcugggcucug

SEQ ID NO: 2617725 - RNA, 20 nt, Human
cuugggcccagcugggcucu

SEQ ID NO: 2617726 - RNA, 22 nt, Human
cuugggcccagcugggcucugc

SEQ ID NO: 2617727 - RNA, 12 nt, Human
cuugggcccucc

SEQ ID NO: 2617728 - RNA, 13 nt, Human
cuugggcccuccu

SEQ ID NO: 2617729 - RNA, 14 nt, Human
cuugggcccuccug

SEQ ID NO: 2617730 - RNA, 15 nt, Human
cuugggcccuucccu

SEQ ID NO: 2617731 - RNA, 16 nt, Human
gaccacacuccagcug

SEQ ID NO: 2617732 - RNA, 22 nt, Human
gaccacacuccagcugggauca

SEQ ID NO: 2617733 - RNA, 14 nt, Human
gaccacacuccagc

SEQ ID NO: 2617734 - RNA, 17 nt, Human
gaccacaccucccugaa

SEQ ID NO: 2617735 - RNA, 20 nt, Human
gaccacaccucccugaacca

SEQ ID NO: 2617736 - RNA, 12 nt, Human
gaccacagcaca

SEQ ID NO: 2617737 - RNA, 14 nt, Human
gaccacagcacagc

SEQ ID NO: 2617738 - RNA, 15 nt, Human
gaccacagcacagcc

SEQ ID NO: 2617739 - RNA, 16 nt, Human
gaccacagcacagcca

SEQ ID NO: 2617740 - RNA, 17 nt, Human
gaccacacuuccugucc

SEQ ID NO: 2617741 - RNA, 18 nt, Human
gaccacacuuccugucca

SEQ ID NO: 2617742 - RNA, 20 nt, Human
gaccacacuuccuguccaga

SEQ ID NO: 2617743 - RNA, 22 nt, Human
gaccacacuuccuguccagaga

SEQ ID NO: 2617744 - RNA, 21 nt, Human
gaccacagcaaggcaccugca

SEQ ID NO: 2617745 - RNA, 20 nt, Human
gaccacagcaaggcaccugc

SEQ ID NO: 2617746 - RNA, 11 nt, Human
gaccacagcaa

SEQ ID NO: 2617747 - RNA, 23 nt, Human
gaccacacuuccuguccagagag

SEQ ID NO: 2617748 - RNA, 16 nt, Human
gaccacacccuguacu

SEQ ID NO: 2617749 - RNA, 12 nt, Human
gaccacaccucc

SEQ ID NO: 2617750 - RNA, 21 nt, Human
gaccacacauuuguguaaaca

SEQ ID NO: 2617751 - RNA, 13 nt, Human
gaccaauucaacc

SEQ ID NO: 2617752 - RNA, 18 nt, Human
gaccacaaaacuuuucua

SEQ ID NO: 2617753 - RNA, 21 nt, Human
gaccaauauuguacaguuuuu

SEQ ID NO: 2617754 - RNA, 19 nt, Human
gaccaauauuguacaguuu

SEQ ID NO: 2617755 - RNA, 18 nt, Human
gaccaauauuguacaguu

SEQ ID NO: 2617756 - RNA, 17 nt, Human
gaccaauauuguacagu

SEQ ID NO: 2617757 - RNA, 16 nt, Human
gacauccauaaagaag

SEQ ID NO: 2617758 - RNA, 19 nt, Human
gacauccauaaagaagcaa

SEQ ID NO: 2617759 - RNA, 18 nt, Human
gacauccauaaagaagca

SEQ ID NO: 2617760 - RNA, 17 nt, Human
gacauccauaaagaagc

SEQ ID NO: 2617761 - RNA, 19 nt, Human
gacaucaguggcauggcuc

SEQ ID NO: 2617762 - RNA, 16 nt, Human
gacauccaagcuuccu

SEQ ID NO: 2617763 - RNA, 15 nt, Human
gacauccaagcuucc

SEQ ID NO: 2617764 - RNA, 17 nt, Human
gacauccaagcuuccuu

SEQ ID NO: 2617765 - RNA, 16 nt, Human
gacaucacuuguacaa

SEQ ID NO: 2617766 - RNA, 22 nt, Human
gacaucacuuguacaaaauaaa

SEQ ID NO: 2617767 - RNA, 13 nt, Human
gacaucaguggca

SEQ ID NO: 2617768 - RNA, 20 nt, Human
gacaucaguggcauggcucc

SEQ ID NO: 2617769 - RNA, 13 nt, Human
gacaucagcuggu

SEQ ID NO: 2617770 - RNA, 20 nt, Human
gacauccauaaagaagcaau

SEQ ID NO: 2617771 - RNA, 15 nt, Human
gaccaagcaggaagc

SEQ ID NO: 2617772 - RNA, 14 nt, Human
gaccaagcaggaag

SEQ ID NO: 2617773 - RNA, 16 nt, Human
gaccaagcaggaagcu

SEQ ID NO: 2617774 - RNA, 17 nt, Human
gaccaagcaggaagcuc

SEQ ID NO: 2617775 - RNA, 19 nt, Human
gaccaagcaggaagcucag

SEQ ID NO: 2617776 - RNA, 20 nt, Human
gaccaagcaggaagcucaga

SEQ ID NO: 2617777 - RNA, 20 nt, Human
gaccaagcaucuuggggggg

SEQ ID NO: 2617778 - RNA, 15 nt, Human
gaccaagcaucuugg

SEQ ID NO: 2617779 - RNA, 13 nt, Human
gaccaaggacccc

SEQ ID NO: 2617780 - RNA, 16 nt, Human
gaccaaggaccccuca

SEQ ID NO: 2617781 - RNA, 14 nt, Human
gaccaaguuauaaa

SEQ ID NO: 2617782 - RNA, 18 nt, Human
gaccaauauucaaaugcg

SEQ ID NO: 2617783 - RNA, 20 nt, Human
gaccaauauuauacuaagaa

SEQ ID NO: 2617784 - RNA, 18 nt, Human
gaccaagguuccagcuca

SEQ ID NO: 2617785 - RNA, 18 nt, Human
gaccaaggggugggccac

SEQ ID NO: 2617786 - RNA, 21 nt, Human
gaccaaguuauaaaucaaugu

SEQ ID NO: 2617787 - RNA, 19 nt, Human
gaccaaggcaaggcaggug

SEQ ID NO: 2617788 - RNA, 17 nt, Human
gaccaaggcaaggcagg

SEQ ID NO: 2617789 - RNA, 23 nt, Human
gaccaaggcaaggcaggugccuc

SEQ ID NO: 2617790 - RNA, 17 nt, Human
gaccaaggaccccucac

SEQ ID NO: 2617791 - RNA, 19 nt, Human
gaccaaggaccccucaccu

SEQ ID NO: 2617792 - RNA, 16 nt, Human
gaccaaggagaugaag

SEQ ID NO: 2617793 - RNA, 16 nt, Human
gaccacguuucuaaag

SEQ ID NO: 2617794 - RNA, 16 nt, Human
gaccaccaccucagag

SEQ ID NO: 2617795 - RNA, 23 nt, Human
gaccacaucuuuaucuguucuug

SEQ ID NO: 2617796 - RNA, 17 nt, Human
gaccacaucuuuaucug

SEQ ID NO: 2617797 - RNA, 18 nt, Human
gaccacauuuuauauuua

SEQ ID NO: 2617798 - RNA, 23 nt, Human
gaccacaggguucaaaaugucug

SEQ ID NO: 2617799 - RNA, 23 nt, Human
gaccacagcaucauuuugcauuc

SEQ ID NO: 2617800 - RNA, 21 nt, Human
gaccacaggguucaaaauguc

SEQ ID NO: 2617801 - RNA, 16 nt, Human
gaccacugcagaagac

SEQ ID NO: 2617802 - RNA, 18 nt, Human
gaccacugcagaagacag

SEQ ID NO: 2617803 - RNA, 21 nt, Human
gaccagacaccuugacagggc

SEQ ID NO: 2617804 - RNA, 22 nt, Human
gaccagacaccuugacagggca

SEQ ID NO: 2617805 - RNA, 21 nt, Human
gaccagagcugccaccugccu

SEQ ID NO: 2617806 - RNA, 23 nt, Human
gaccagacaccuugacagggcac

SEQ ID NO: 2617807 - RNA, 21 nt, Human
gaccagcaccaucucuccucc

SEQ ID NO: 2617808 - RNA, 20 nt, Human
gaccagcaccaucucuccuc

SEQ ID NO: 2617809 - RNA, 16 nt, Human
gaccagcagaucccag

SEQ ID NO: 2617810 - RNA, 17 nt, Human
gaccagcagaucccagc

SEQ ID NO: 2617811 - RNA, 18 nt, Human
gaccagcagaucccagcu

SEQ ID NO: 2617812 - RNA, 20 nt, Human
gaccagcagaucccagcuca

SEQ ID NO: 2617813 - RNA, 17 nt, Human
gaccagcacugucucag

SEQ ID NO: 2617814 - RNA, 20 nt, Human
gaccagcaacuugucuuuuu

SEQ ID NO: 2617815 - RNA, 20 nt, Human
gacccaugcugcccugugag

SEQ ID NO: 2617816 - RNA, 19 nt, Human
gacccaugcugcccuguga

SEQ ID NO: 2617817 - RNA, 18 nt, Human
gacccaugcugcccugug

SEQ ID NO: 2617818 - RNA, 23 nt, Human
gacccaugaguuggggucuggca

SEQ ID NO: 2617819 - RNA, 14 nt, Human
gacccaguggggag

SEQ ID NO: 2617820 - RNA, 13 nt, Human
gacccaugcugcc

SEQ ID NO: 2617821 - RNA, 16 nt, Human
gacccagugcccccac

SEQ ID NO: 2617822 - RNA, 17 nt, Human
gacccagugcccccacu

SEQ ID NO: 2617823 - RNA, 20 nt, Human
gacccagugcccccacugac

SEQ ID NO: 2617824 - RNA, 23 nt, Human
gacccagugagauuacagaggaa

SEQ ID NO: 2617825 - RNA, 22 nt, Human
gacccagccccuugagaaaccu

SEQ ID NO: 2617826 - RNA, 16 nt, Human
gacccagcccucaucc

SEQ ID NO: 2617827 - RNA, 23 nt, Human
gacccagccccuugagaaaccuu

SEQ ID NO: 2617828 - RNA, 15 nt, Human
gacccagugccccca

SEQ ID NO: 2617829 - RNA, 22 nt, Human
gacccagugagauuacagagga

SEQ ID NO: 2617830 - RNA, 12 nt, Human
gacccagugaga

SEQ ID NO: 2617831 - RNA, 16 nt, Human
gacccagucccugggg

SEQ ID NO: 2617832 - RNA, 18 nt, Human
gacccaaaaggcagaagc

SEQ ID NO: 2617833 - RNA, 19 nt, Human
gacccaaaaggcagaagca

SEQ ID NO: 2617834 - RNA, 13 nt, Human
gaccagcagcgcc

SEQ ID NO: 2617835 - RNA, 14 nt, Human
gaccagcagcgccu

SEQ ID NO: 2617836 - RNA, 16 nt, Human
gaccagcagcgccuuu

SEQ ID NO: 2617837 - RNA, 20 nt, Human
gaccagcagcgccuuuccca

SEQ ID NO: 2617838 - RNA, 23 nt, Human
gaccagcagcgccuuucccaacu

SEQ ID NO: 2617839 - RNA, 20 nt, Human
gacccaaaaggcagaagcaa

SEQ ID NO: 2617840 - RNA, 19 nt, Human
gacccacuggacucaccuc

SEQ ID NO: 2617841 - RNA, 20 nt, Human
gacccagauccucacaacca

SEQ ID NO: 2617842 - RNA, 16 nt, Human
gacccagauccucaca

SEQ ID NO: 2617843 - RNA, 15 nt, Human
gacccagauccucac

SEQ ID NO: 2617844 - RNA, 16 nt, Human
gacccagacccagugg

SEQ ID NO: 2617845 - RNA, 17 nt, Human
gacccagcacugcccaa

SEQ ID NO: 2617846 - RNA, 13 nt, Human
gacccagcacugc

SEQ ID NO: 2617847 - RNA, 23 nt, Human
gacccacuucacacacaggcaac

SEQ ID NO: 2617848 - RNA, 14 nt, Human
gacccagacccagu

SEQ ID NO: 2617849 - RNA, 10 nt, Human
gacccagacc

SEQ ID NO: 2617850 - RNA, 22 nt, Human
gaccccacccaagcuuggcagc

SEQ ID NO: 2617851 - RNA, 20 nt, Human
gaccccacccaagcuuggca

SEQ ID NO: 2617852 - RNA, 19 nt, Human
gaccccacccaagcuuggc

SEQ ID NO: 2617853 - RNA, 23 nt, Human
gaccccaaagagccuggagaagc

SEQ ID NO: 2617854 - RNA, 21 nt, Human
gaccccaaagagccuggagaa

SEQ ID NO: 2617855 - RNA, 14 nt, Human
gaccccacccaagc

SEQ ID NO: 2617856 - RNA, 12 nt, Human
gaccccacccaa

SEQ ID NO: 2617857 - RNA, 20 nt, Human
gaccccaaagagccuggaga

SEQ ID NO: 2617858 - RNA, 19 nt, Human
gaccccaaagagccuggag

SEQ ID NO: 2617859 - RNA, 18 nt, Human
gaccccaaagagccugga

SEQ ID NO: 2617860 - RNA, 16 nt, Human
gaccccaaagagccug

SEQ ID NO: 2617861 - RNA, 23 nt, Human
gaccccaaacaccuuccagcucc

SEQ ID NO: 2617862 - RNA, 20 nt, Human
gacccauucuacacagagca

SEQ ID NO: 2617863 - RNA, 17 nt, Human
gacccaugcugcccugu

SEQ ID NO: 2617864 - RNA, 17 nt, Human
gacccaucacgccugug

SEQ ID NO: 2617865 - RNA, 17 nt, Human
gacccccagcuccggcc

SEQ ID NO: 2617866 - RNA, 23 nt, Human
gacccccagcuccggccuguccu

SEQ ID NO: 2617867 - RNA, 13 nt, Human
gacccccagcucc

SEQ ID NO: 2617868 - RNA, 12 nt, Human
gaccccagagga

SEQ ID NO: 2617869 - RNA, 20 nt, Human
gaccccccaccaccagccgg

SEQ ID NO: 2617870 - RNA, 18 nt, Human
gacccccgcccccugccc

SEQ ID NO: 2617871 - RNA, 16 nt, Human
gacccccgcccccugc

SEQ ID NO: 2617872 - RNA, 15 nt, Human
gacccccgcccccug

SEQ ID NO: 2617873 - RNA, 11 nt, Human
gacccccgccc

SEQ ID NO: 2617874 - RNA, 22 nt, Human
gacccugcccugugggccccca

SEQ ID NO: 2617875 - RNA, 20 nt, Human
gacccugcccugugggcccc

SEQ ID NO: 2617876 - RNA, 17 nt, Human
gacccugcccugugggc

SEQ ID NO: 2617877 - RNA, 16 nt, Human
gacccugaggcccaga

SEQ ID NO: 2617878 - RNA, 12 nt, Human
gacccugaggcc

SEQ ID NO: 2617879 - RNA, 11 nt, Human
gacccugaggc

SEQ ID NO: 2617880 - RNA, 14 nt, Human
gacccccuuccccu

SEQ ID NO: 2617881 - RNA, 10 nt, Human
gacccugagg

SEQ ID NO: 2617882 - RNA, 12 nt, Human
gacccccuggag

SEQ ID NO: 2617883 - RNA, 19 nt, Human
gacccccgcccccugcccu

SEQ ID NO: 2617884 - RNA, 19 nt, Human
gacaguugggugagaacaa

SEQ ID NO: 2617885 - RNA, 15 nt, Human
gacaguucugaagaa

SEQ ID NO: 2617886 - RNA, 18 nt, Human
gacaguugggugagaaca

SEQ ID NO: 2617887 - RNA, 17 nt, Human
gacaguucauauguacc

SEQ ID NO: 2617888 - RNA, 15 nt, Human
gacaguucauaugua

SEQ ID NO: 2617889 - RNA, 14 nt, Human
gacaguucugaaga

SEQ ID NO: 2617890 - RNA, 14 nt, Human
gacaguucaagaaa

SEQ ID NO: 2617891 - RNA, 21 nt, Human
gacaguuauacugucgguuuu

SEQ ID NO: 2617892 - RNA, 14 nt, Human
gacaggcccaagag

SEQ ID NO: 2617893 - RNA, 22 nt, Human
gacagggcauggccagguggcc

SEQ ID NO: 2617894 - RNA, 15 nt, Human
gacaggcccaagaga

SEQ ID NO: 2617895 - RNA, 20 nt, Human
gacagggcauggccaggugg

SEQ ID NO: 2617896 - RNA, 15 nt, Human
gacagggcauggcca

SEQ ID NO: 2617897 - RNA, 22 nt, Human
gacaggcauguucucugaggac

SEQ ID NO: 2617898 - RNA, 14 nt, Human
gacagggcauggcc

SEQ ID NO: 2617899 - RNA, 16 nt, Human
gacaggcaaauaaaag

SEQ ID NO: 2617900 - RNA, 11 nt, Human
gacaggcccaa

SEQ ID NO: 2617901 - RNA, 23 nt, Human
gacaguuucuuagcuuuuuaauu

SEQ ID NO: 2617902 - RNA, 21 nt, Human
gacaguuucuuagcuuuuuaa

SEQ ID NO: 2617903 - RNA, 20 nt, Human
gacaguuucuuagcuuuuua

SEQ ID NO: 2617904 - RNA, 14 nt, Human
gacaguuucuuagc

SEQ ID NO: 2617905 - RNA, 12 nt, Human
gacaguuucuua

SEQ ID NO: 2617906 - RNA, 20 nt, Human
gacaguuuuccauaaagaag

SEQ ID NO: 2617907 - RNA, 22 nt, Human
gacaguuuuccuucucaucugu

SEQ ID NO: 2617908 - RNA, 23 nt, Human
gacaucaacugcaucaagaugug

SEQ ID NO: 2617909 - RNA, 15 nt, Human
gacaucacuuguaca

SEQ ID NO: 2617910 - RNA, 21 nt, Human
gacauaacguuuuuccuuuaa

SEQ ID NO: 2617911 - RNA, 16 nt, Human
gacauaacguuuuucc

SEQ ID NO: 2617912 - RNA, 19 nt, Human
gacaucaagcacagaagga

SEQ ID NO: 2617913 - RNA, 16 nt, Human
gacaucaacugcauca

SEQ ID NO: 2617914 - RNA, 22 nt, Human
gacauaacguuuuuccuuuaaa

SEQ ID NO: 2617915 - RNA, 14 nt, Human
gacauaacguuuuu

SEQ ID NO: 2617916 - RNA, 18 nt, Human
gacaggcaagcaccuccu

SEQ ID NO: 2617917 - RNA, 17 nt, Human
gacaggcaagcaccucc

SEQ ID NO: 2617918 - RNA, 12 nt, Human
gacagcaggugg

SEQ ID NO: 2617919 - RNA, 16 nt, Human
gacagcaggugggaaa

SEQ ID NO: 2617920 - RNA, 13 nt, Human
gacaggcaagcac

SEQ ID NO: 2617921 - RNA, 17 nt, Human
gacagaugucagccgag

SEQ ID NO: 2617922 - RNA, 18 nt, Human
gacagaugucagccgagc

SEQ ID NO: 2617923 - RNA, 19 nt, Human
gacagcaacggggaggcca

SEQ ID NO: 2617924 - RNA, 22 nt, Human
gacagcaacggggaggccaagu

SEQ ID NO: 2617925 - RNA, 13 nt, Human
gacagcagcucag

SEQ ID NO: 2617926 - RNA, 14 nt, Human
gacagcagcucagg

SEQ ID NO: 2617927 - RNA, 23 nt, Human
gacaggaugguucccuugaugaa

SEQ ID NO: 2617928 - RNA, 15 nt, Human
gacagcagcucaggc

SEQ ID NO: 2617929 - RNA, 16 nt, Human
gacagcagcucaggca

SEQ ID NO: 2617930 - RNA, 18 nt, Human
gacagcagcucaggcaca

SEQ ID NO: 2617931 - RNA, 20 nt, Human
gacagcagcucaggcacacu

SEQ ID NO: 2617932 - RNA, 19 nt, Human
gacaggcaaugcuggcugu

SEQ ID NO: 2617933 - RNA, 18 nt, Human
gacaggcaaugcuggcug

SEQ ID NO: 2617934 - RNA, 21 nt, Human
gacaggcaagcaccuccugcc

SEQ ID NO: 2617935 - RNA, 20 nt, Human
gacaggcaagcaccuccugc

SEQ ID NO: 2617936 - RNA, 21 nt, Human
gacaggcauguucucugagga

SEQ ID NO: 2617937 - RNA, 20 nt, Human
gacaggcauguucucugagg

SEQ ID NO: 2617938 - RNA, 23 nt, Human
gacaggcaaugcuggcuguuggc

SEQ ID NO: 2617939 - RNA, 22 nt, Human
gacagacacaggcccggcucca

SEQ ID NO: 2617940 - RNA, 20 nt, Human
gacagacacaggcccggcuc

SEQ ID NO: 2617941 - RNA, 17 nt, Human
gacagacacaggcccgg

SEQ ID NO: 2617942 - RNA, 16 nt, Human
gacacuagaagauuuu

SEQ ID NO: 2617943 - RNA, 20 nt, Human
gacacuaaguuauaguauau

SEQ ID NO: 2617944 - RNA, 18 nt, Human
gacacuaaguuauaguau

SEQ ID NO: 2617945 - RNA, 20 nt, Human
gacacggaucugagaaucuu

SEQ ID NO: 2617946 - RNA, 15 nt, Human
gacacggagcccagc

SEQ ID NO: 2617947 - RNA, 19 nt, Human
gacacggaucugagaaucu

SEQ ID NO: 2617948 - RNA, 23 nt, Human
gacacgcucuucuauuuuauucc

SEQ ID NO: 2617949 - RNA, 17 nt, Human
gacacuaaguuauagua

SEQ ID NO: 2617950 - RNA, 15 nt, Human
gacacuaacgacuuc

SEQ ID NO: 2617951 - RNA, 22 nt, Human
gaauuucccaggacccugaagg

SEQ ID NO: 2617952 - RNA, 14 nt, Human
gaauuucccaggac

SEQ ID NO: 2617953 - RNA, 15 nt, Human
gaauuucccaggacc

SEQ ID NO: 2617954 - RNA, 16 nt, Human
gaauuucccaggaccc

SEQ ID NO: 2617955 - RNA, 17 nt, Human
gaauuucccaggacccu

SEQ ID NO: 2617956 - RNA, 22 nt, Human
gacacgaauauugcugauggug

SEQ ID NO: 2617957 - RNA, 18 nt, Human
gaauuucccaaagcagug

SEQ ID NO: 2617958 - RNA, 16 nt, Human
gaauuucccaaagcag

SEQ ID NO: 2617959 - RNA, 22 nt, Human
gaauuucccaaagcagugcaug

SEQ ID NO: 2617960 - RNA, 12 nt, Human
gaauuucaccug

SEQ ID NO: 2617961 - RNA, 17 nt, Human
gaauuucaccuguaaac

SEQ ID NO: 2617962 - RNA, 21 nt, Human
gaauuucaccuguaaaccuga

SEQ ID NO: 2617963 - RNA, 16 nt, Human
gacagagugagacucu

SEQ ID NO: 2617964 - RNA, 21 nt, Human
gacagagucucacuguugccc

SEQ ID NO: 2617965 - RNA, 19 nt, Human
gacagagugagacucuguc

SEQ ID NO: 2617966 - RNA, 15 nt, Human
gacagagucugggug

SEQ ID NO: 2617967 - RNA, 20 nt, Human
gacagaugccccagagcugu

SEQ ID NO: 2617968 - RNA, 20 nt, Human
gacagagggaaacacagcag

SEQ ID NO: 2617969 - RNA, 13 nt, Human
gacagagggaaga

SEQ ID NO: 2617970 - RNA, 16 nt, Human
gacagagggaagaaaa

SEQ ID NO: 2617971 - RNA, 13 nt, Human
gacagagucuggg

SEQ ID NO: 2617972 - RNA, 15 nt, Human
gacagaggaugagcu

SEQ ID NO: 2617973 - RNA, 13 nt, Human
gacagaggcccca

SEQ ID NO: 2617974 - RNA, 18 nt, Human
gacagaggccccagccuc

SEQ ID NO: 2617975 - RNA, 19 nt, Human
gacagaggccccagccucc

SEQ ID NO: 2617976 - RNA, 23 nt, Human
gacagaggcagccccauucugcc

SEQ ID NO: 2617977 - RNA, 15 nt, Human
gacagaggccugccc

SEQ ID NO: 2617978 - RNA, 13 nt, Human
gacagaggccugc

SEQ ID NO: 2617979 - RNA, 12 nt, Human
gacagaggccug

SEQ ID NO: 2617980 - RNA, 19 nt, Human
gacagagggaagaaaagag

SEQ ID NO: 2617981 - RNA, 14 nt, Human
gacagagagagaga

SEQ ID NO: 2617982 - RNA, 16 nt, Human
gacagagaccuccugc

SEQ ID NO: 2617983 - RNA, 15 nt, Human
gacagagaccuccug

SEQ ID NO: 2617984 - RNA, 20 nt, Human
gacagagacccucugccacc

SEQ ID NO: 2617985 - RNA, 20 nt, Human
gacagagcuacacaggggaa

SEQ ID NO: 2617986 - RNA, 20 nt, Human
gacagagcugguugggaaga

SEQ ID NO: 2617987 - RNA, 12 nt, Human
gacagaggaggg

SEQ ID NO: 2617988 - RNA, 12 nt, Human
gacagaggcagc

SEQ ID NO: 2617989 - RNA, 13 nt, Human
gacacuauaucug

SEQ ID NO: 2617990 - RNA, 12 nt, Human
gacacuauaucu

SEQ ID NO: 2617991 - RNA, 18 nt, Human
gacacuagcccaaugaaa

SEQ ID NO: 2617992 - RNA, 16 nt, Human
gacagacagcccucca

SEQ ID NO: 2617993 - RNA, 21 nt, Human
gacagacaggcucuuagcagc

SEQ ID NO: 2617994 - RNA, 15 nt, Human
gacagacaggcucuu

SEQ ID NO: 2617995 - RNA, 14 nt, Human
gacagacaggcucu

SEQ ID NO: 2617996 - RNA, 23 nt, Human
gacagacacuucuaaaugaagug

SEQ ID NO: 2617997 - RNA, 15 nt, Human
gacagagacaccugc

SEQ ID NO: 2617998 - RNA, 16 nt, Human
gacagagacaccugca

SEQ ID NO: 2617999 - RNA, 17 nt, Human
gacagagacaccugcac

SEQ ID NO: 2618000 - RNA, 18 nt, Human
gacagagacaccugcacc

SEQ ID NO: 2618001 - RNA, 21 nt, Human
gacagagacaccugcaccucc

SEQ ID NO: 2618002 - RNA, 22 nt, Human
gacagagacaccugcaccuccc

SEQ ID NO: 2618003 - RNA, 23 nt, Human
gacagacuccugaggacagcugu

SEQ ID NO: 2618004 - RNA, 19 nt, Human
gacagacuccugaggacag

SEQ ID NO: 2618005 - RNA, 16 nt, Human
gacagacuccugagga

SEQ ID NO: 2618006 - RNA, 22 nt, Human
gacagaccacaucuuuaucugu

SEQ ID NO: 2618007 - RNA, 18 nt, Human
gacagaccacaucuuuau

SEQ ID NO: 2618008 - RNA, 18 nt, Human
gacagacaucucugcacc

SEQ ID NO: 2618009 - RNA, 23 nt, Human
gacagacucacaaccugaaccua

SEQ ID NO: 2618010 - RNA, 18 nt, Human
gacuggcacaguuuucug

SEQ ID NO: 2618011 - RNA, 22 nt, Human
gacuggcacaguuuucugagaa

SEQ ID NO: 2618012 - RNA, 14 nt, Human
gacuggcacaguuu

SEQ ID NO: 2618013 - RNA, 15 nt, Human
gacugcuagggagug

SEQ ID NO: 2618014 - RNA, 18 nt, Human
gacugcuaaauaaaauuu

SEQ ID NO: 2618015 - RNA, 17 nt, Human
gacugcuaaauaaaauu

SEQ ID NO: 2618016 - RNA, 14 nt, Human
gacugcuaaauaaa

SEQ ID NO: 2618017 - RNA, 20 nt, Human
gacugcuccccagcccuggc

SEQ ID NO: 2618018 - RNA, 19 nt, Human
gacugcuccccagcccugg

SEQ ID NO: 2618019 - RNA, 15 nt, Human
gacugcuccccagcc

SEQ ID NO: 2618020 - RNA, 24 nt, Human
gacugcuccccagcccuggcucug

SEQ ID NO: 2618021 - RNA, 21 nt, Human
gacugcuccccagcccuggcu

SEQ ID NO: 2618022 - RNA, 18 nt, Human
gacugccccaacuccugg

SEQ ID NO: 2618023 - RNA, 20 nt, Human
gacugcgaucuucagagcag

SEQ ID NO: 2618024 - RNA, 21 nt, Human
gacugcgggaugguccugggg

SEQ ID NO: 2618025 - RNA, 12 nt, Human
gacugcuaaaua

SEQ ID NO: 2618026 - RNA, 22 nt, Human
gacugcgggaugguccuggggc

SEQ ID NO: 2618027 - RNA, 20 nt, Human
gacugggaagauaggcucug

SEQ ID NO: 2618028 - RNA, 22 nt, Human
gacugggaagauaggcucugca

SEQ ID NO: 2618029 - RNA, 23 nt, Human
gacugggaagauaggcucugcac

SEQ ID NO: 2618030 - RNA, 16 nt, Human
gacuuaauagaaacau

SEQ ID NO: 2618031 - RNA, 23 nt, Human
gacuggcuuuuauuaaugcacuu

SEQ ID NO: 2618032 - RNA, 22 nt, Human
gacuggcuuuuauuaaugcacu

SEQ ID NO: 2618033 - RNA, 21 nt, Human
gacuggcuuuuauuaaugcac

SEQ ID NO: 2618034 - RNA, 20 nt, Human
gacuggcuuuuauuaaugca

SEQ ID NO: 2618035 - RNA, 10 nt, Human
gacuggcuuu

SEQ ID NO: 2618036 - RNA, 17 nt, Human
gacuggcuggcugcagu

SEQ ID NO: 2618037 - RNA, 14 nt, Human
gacuggcuggcugc

SEQ ID NO: 2618038 - RNA, 16 nt, Human
gacuggcuggcugcag

SEQ ID NO: 2618039 - RNA, 23 nt, Human
gacuggccaagguuuggggaaga

SEQ ID NO: 2618040 - RNA, 14 nt, Human
gacuggccccuggg

SEQ ID NO: 2618041 - RNA, 16 nt, Human
gacuggccccuggguc

SEQ ID NO: 2618042 - RNA, 22 nt, Human
gacuggccccugggucagucug

SEQ ID NO: 2618043 - RNA, 17 nt, Human
gacuggcuagaguccuc

SEQ ID NO: 2618044 - RNA, 20 nt, Human
gacuggcuagaguccucacu

SEQ ID NO: 2618045 - RNA, 21 nt, Human
gacuggcuagaguccucacuc

SEQ ID NO: 2618046 - RNA, 23 nt, Human
gacuggcuagaguccucacuccc

SEQ ID NO: 2618047 - RNA, 15 nt, Human
gacuuacuguacaug

SEQ ID NO: 2618048 - RNA, 16 nt, Human
gacuuacuguacauga

SEQ ID NO: 2618049 - RNA, 14 nt, Human
gacuuacaugauuc

SEQ ID NO: 2618050 - RNA, 15 nt, Human
gacuuacaugauuca

SEQ ID NO: 2618051 - RNA, 16 nt, Human
gacuuacaugauucau

SEQ ID NO: 2618052 - RNA, 18 nt, Human
gacuuacaugauucauuu

SEQ ID NO: 2618053 - RNA, 12 nt, Human
gacuuacuguac

SEQ ID NO: 2618054 - RNA, 18 nt, Human
gacuuacuguacaugaaa

SEQ ID NO: 2618055 - RNA, 23 nt, Human
gacuuacuguacaugaaaacaca

SEQ ID NO: 2618056 - RNA, 14 nt, Human
gacuuagaaagcag

SEQ ID NO: 2618057 - RNA, 14 nt, Human
gacuuaccaggaag

SEQ ID NO: 2618058 - RNA, 19 nt, Human
gacuuacaugauucauuuu

SEQ ID NO: 2618059 - RNA, 19 nt, Human
gacuuagaaagcaggggcu

SEQ ID NO: 2618060 - RNA, 18 nt, Human
gacuuagaaagcaggggc

SEQ ID NO: 2618061 - RNA, 16 nt, Human
gacuuagaaagcaggg

SEQ ID NO: 2618062 - RNA, 20 nt, Human
gacuucaucccucuggggcu

SEQ ID NO: 2618063 - RNA, 12 nt, Human
gacuucaucccu

SEQ ID NO: 2618064 - RNA, 22 nt, Human
gacuucacgaaguguugcaugg

SEQ ID NO: 2618065 - RNA, 14 nt, Human
gacuucagggcagg

SEQ ID NO: 2618066 - RNA, 14 nt, Human
gacuucagcucugu

SEQ ID NO: 2618067 - RNA, 23 nt, Human
gacuucaggggcugcccgcuccc

SEQ ID NO: 2618068 - RNA, 21 nt, Human
gacuucaggggcugcccgcuc

SEQ ID NO: 2618069 - RNA, 20 nt, Human
gacuucaggggcugcccgcu

SEQ ID NO: 2618070 - RNA, 19 nt, Human
gacuucaggggcugcccgc

SEQ ID NO: 2618071 - RNA, 18 nt, Human
gacuucaggggcugcccg

SEQ ID NO: 2618072 - RNA, 17 nt, Human
gacuucaggggcugccc

SEQ ID NO: 2618073 - RNA, 18 nt, Human
gacuucagggcagggcuc

SEQ ID NO: 2618074 - RNA, 22 nt, Human
gacuucagggcagggcucugau

SEQ ID NO: 2618075 - RNA, 17 nt, Human
gacuuagggcaccaggg

SEQ ID NO: 2618076 - RNA, 16 nt, Human
gacuuagggcaccagg

SEQ ID NO: 2618077 - RNA, 15 nt, Human
gacuuagcugggaga

SEQ ID NO: 2618078 - RNA, 17 nt, Human
gacuuaguauauuuucu

SEQ ID NO: 2618079 - RNA, 13 nt, Human
gacuucacacugc

SEQ ID NO: 2618080 - RNA, 14 nt, Human
gacuucacacugca

SEQ ID NO: 2618081 - RNA, 21 nt, Human
gacuucacauaagcucagaau

SEQ ID NO: 2618082 - RNA, 17 nt, Human
gacuucacauaagcuca

SEQ ID NO: 2618083 - RNA, 16 nt, Human
gacuucacacugcaag

SEQ ID NO: 2618084 - RNA, 22 nt, Human
gacuucacacugcaagagccuu

SEQ ID NO: 2618085 - RNA, 15 nt, Human
gacuuauuuucucug

SEQ ID NO: 2618086 - RNA, 16 nt, Human
gacuuauuuauauaaa

SEQ ID NO: 2618087 - RNA, 21 nt, Human
gacuccugcaggcagccaggc

SEQ ID NO: 2618088 - RNA, 20 nt, Human
gacuccugcaggcagccagg

SEQ ID NO: 2618089 - RNA, 19 nt, Human
gacuccugcaggcagccag

SEQ ID NO: 2618090 - RNA, 18 nt, Human
gacuccugcaggcagcca

SEQ ID NO: 2618091 - RNA, 15 nt, Human
gacuacaggcaccca

SEQ ID NO: 2618092 - RNA, 13 nt, Human
gacuacaggcacc

SEQ ID NO: 2618093 - RNA, 18 nt, Human
gacuacaggcacccacca

SEQ ID NO: 2618094 - RNA, 20 nt, Human
gacucgucugacugugugug

SEQ ID NO: 2618095 - RNA, 19 nt, Human
gacucgguuucuccaaacu

SEQ ID NO: 2618096 - RNA, 15 nt, Human
gacucuacagaggcc

SEQ ID NO: 2618097 - RNA, 16 nt, Human
gacugaauuucuuuug

SEQ ID NO: 2618098 - RNA, 16 nt, Human
gacucuacacugugaa

SEQ ID NO: 2618099 - RNA, 21 nt, Human
gacucuacagaggccaugggc

SEQ ID NO: 2618100 - RNA, 22 nt, Human
gacugaccaauauuguacaguu

SEQ ID NO: 2618101 - RNA, 21 nt, Human
gacugaccaauauuguacagu

SEQ ID NO: 2618102 - RNA, 16 nt, Human
gacugacccugaucag

SEQ ID NO: 2618103 - RNA, 11 nt, Human
gacugagaaau

SEQ ID NO: 2618104 - RNA, 21 nt, Human
gacugagggacucugaagccu

SEQ ID NO: 2618105 - RNA, 15 nt, Human
gacugagggacucug

SEQ ID NO: 2618106 - RNA, 23 nt, Human
gacugaggccugagcgcuccugc

SEQ ID NO: 2618107 - RNA, 21 nt, Human
gacugaggccugagcgcuccu

SEQ ID NO: 2618108 - RNA, 16 nt, Human
gacugaggggagggga

SEQ ID NO: 2618109 - RNA, 19 nt, Human
gacugaguaagaaaugcug

SEQ ID NO: 2618110 - RNA, 21 nt, Human
gacugaguaagaaaugcugcc

SEQ ID NO: 2618111 - RNA, 18 nt, Human
gacugaguacguugugca

SEQ ID NO: 2618112 - RNA, 14 nt, Human
gacugaggccugag

SEQ ID NO: 2618113 - RNA, 13 nt, Human
gacugaggccuga

SEQ ID NO: 2618114 - RNA, 22 nt, Human
gacugagccccgcagaccuccc

SEQ ID NO: 2618115 - RNA, 13 nt, Human
gacugagcucaag

SEQ ID NO: 2618116 - RNA, 16 nt, Human
gacugagcaccugcuu

SEQ ID NO: 2618117 - RNA, 15 nt, Human
gacugagcaccugcu

SEQ ID NO: 2618118 - RNA, 14 nt, Human
gacugagcagacug

SEQ ID NO: 2618119 - RNA, 15 nt, Human
gacugagcagacugg

SEQ ID NO: 2618120 - RNA, 17 nt, Human
gacugagccagucccag

SEQ ID NO: 2618121 - RNA, 14 nt, Human
gacugagccagucc

SEQ ID NO: 2618122 - RNA, 12 nt, Human
gacugagccagu

SEQ ID NO: 2618123 - RNA, 19 nt, Human
gacugagcagacuggugag

SEQ ID NO: 2618124 - RNA, 13 nt, Human
gacugagaaauuu

SEQ ID NO: 2618125 - RNA, 14 nt, Human
gacugagcaccugc

SEQ ID NO: 2618126 - RNA, 24 nt, Human
gacugcauuauauuuauuacugua

SEQ ID NO: 2618127 - RNA, 20 nt, Human
gacugccagucccccugccc

SEQ ID NO: 2618128 - RNA, 15 nt, Human
gacugcacagcggcc

SEQ ID NO: 2618129 - RNA, 21 nt, Human
gacugcacagcguccugucca

SEQ ID NO: 2618130 - RNA, 18 nt, Human
gacugcacagcggccccu

SEQ ID NO: 2618131 - RNA, 21 nt, Human
gacugauguugagggaacaga

SEQ ID NO: 2618132 - RNA, 14 nt, Human
gacugaugcuuuca

SEQ ID NO: 2618133 - RNA, 18 nt, Human
gaccugggaccuccccug

SEQ ID NO: 2618134 - RNA, 16 nt, Human
gaccuggcagcucugg

SEQ ID NO: 2618135 - RNA, 18 nt, Human
gaccuggcaaggacacag

SEQ ID NO: 2618136 - RNA, 21 nt, Human
gaccugguacccuccuggcuc

SEQ ID NO: 2618137 - RNA, 19 nt, Human
gaccugguacccuccuggc

SEQ ID NO: 2618138 - RNA, 17 nt, Human
gaccugguacccuccug

SEQ ID NO: 2618139 - RNA, 21 nt, Human
gacccuugacaccugcugaga

SEQ ID NO: 2618140 - RNA, 21 nt, Human
gacccugcgaaggggcccugg

SEQ ID NO: 2618141 - RNA, 10 nt, Human
gaccuggcag

SEQ ID NO: 2618142 - RNA, 15 nt, Human
gaccuggcagcucug

SEQ ID NO: 2618143 - RNA, 18 nt, Human
gaccuggcacuggaugca

SEQ ID NO: 2618144 - RNA, 22 nt, Human
gaccuggcacuggaugcagaaa

SEQ ID NO: 2618145 - RNA, 23 nt, Human
gacccuugccgucuaccugaggg

SEQ ID NO: 2618146 - RNA, 20 nt, Human
gacccuugccgucuaccuga

SEQ ID NO: 2618147 - RNA, 19 nt, Human
gacccuugccgucuaccug

SEQ ID NO: 2618148 - RNA, 20 nt, Human
gacccugcgaaggggcccug

SEQ ID NO: 2618149 - RNA, 18 nt, Human
gaccuguuagcagacagg

SEQ ID NO: 2618150 - RNA, 19 nt, Human
gaccuguuagcagacaggc

SEQ ID NO: 2618151 - RNA, 19 nt, Human
gaccuguugguuccaagcc

SEQ ID NO: 2618152 - RNA, 15 nt, Human
gaccuguugguucca

SEQ ID NO: 2618153 - RNA, 17 nt, Human
gaccuguuagcagacag

SEQ ID NO: 2618154 - RNA, 19 nt, Human
gaccugugucacuacguga

SEQ ID NO: 2618155 - RNA, 19 nt, Human
gaccuguggugcaaaagca

SEQ ID NO: 2618156 - RNA, 14 nt, Human
gaccuguggugcaa

SEQ ID NO: 2618157 - RNA, 22 nt, Human
gaccuguggggauuucucccag

SEQ ID NO: 2618158 - RNA, 23 nt, Human
gaccuguggggauuucucccagc

SEQ ID NO: 2618159 - RNA, 16 nt, Human
gaccugugagcccagc

SEQ ID NO: 2618160 - RNA, 19 nt, Human
gaccugugagcccagcugg

SEQ ID NO: 2618161 - RNA, 15 nt, Human
gaccugugagcccag

SEQ ID NO: 2618162 - RNA, 15 nt, Human
gaccugugaccagca

SEQ ID NO: 2618163 - RNA, 17 nt, Human
gaccugugaccagcacu

SEQ ID NO: 2618164 - RNA, 23 nt, Human
gaccugugagcccagcuggguca

SEQ ID NO: 2618165 - RNA, 20 nt, Human
gaccuguggggauuucuccc

SEQ ID NO: 2618166 - RNA, 21 nt, Human
gaccuguggggauuucuccca

SEQ ID NO: 2618167 - RNA, 19 nt, Human
gaccuguggccaaguucuu

SEQ ID NO: 2618168 - RNA, 20 nt, Human
gaccugucaugccccccuca

SEQ ID NO: 2618169 - RNA, 19 nt, Human
gaccugucaugccccccuc

SEQ ID NO: 2618170 - RNA, 17 nt, Human
gaccugucaugcccccc

SEQ ID NO: 2618171 - RNA, 15 nt, Human
gaccugucaugcccc

SEQ ID NO: 2618172 - RNA, 12 nt, Human
gaccuguaauca

SEQ ID NO: 2618173 - RNA, 16 nt, Human
gaccuguccuccuggu

SEQ ID NO: 2618174 - RNA, 15 nt, Human
gaccuguccuccugg

SEQ ID NO: 2618175 - RNA, 14 nt, Human
gaccuguccuccug

SEQ ID NO: 2618176 - RNA, 21 nt, Human
gaccugucaugccccccucaa

SEQ ID NO: 2618177 - RNA, 12 nt, Human
gaccugugacca

SEQ ID NO: 2618178 - RNA, 19 nt, Human
gaccuguccuccugguggg

SEQ ID NO: 2618179 - RNA, 17 nt, Human
gaccuggugcugccucu

SEQ ID NO: 2618180 - RNA, 22 nt, Human
gaccuggugcugccucuaccug

SEQ ID NO: 2618181 - RNA, 13 nt, Human
gaccugguuuuua

SEQ ID NO: 2618182 - RNA, 17 nt, Human
gaccuguaacuuuugua

SEQ ID NO: 2618183 - RNA, 23 nt, Human
gaccugguacccuccuggcucuu

SEQ ID NO: 2618184 - RNA, 23 nt, Human
gaccuuccucauccaccccaucc

SEQ ID NO: 2618185 - RNA, 22 nt, Human
gaccuuccucauccaccccauc

SEQ ID NO: 2618186 - RNA, 14 nt, Human
gaccuuccucaucc

SEQ ID NO: 2618187 - RNA, 12 nt, Human
gaccuuccucau

SEQ ID NO: 2618188 - RNA, 18 nt, Human
gaccuuccaagagccuga

SEQ ID NO: 2618189 - RNA, 22 nt, Human
gaccuuccauaaugcuacuguc

SEQ ID NO: 2618190 - RNA, 23 nt, Human
gaccuuccucgcagagaggccag

SEQ ID NO: 2618191 - RNA, 21 nt, Human
gaccuuccucgcagagaggcc

SEQ ID NO: 2618192 - RNA, 20 nt, Human
gaccuuccucgcagagaggc

SEQ ID NO: 2618193 - RNA, 19 nt, Human
gaccuuccucgcagagagg

SEQ ID NO: 2618194 - RNA, 18 nt, Human
gaccuuccucgcagagag

SEQ ID NO: 2618195 - RNA, 17 nt, Human
gaccuuccucgcagaga

SEQ ID NO: 2618196 - RNA, 16 nt, Human
gaccuuccucgcagag

SEQ ID NO: 2618197 - RNA, 16 nt, Human
gaccuuccugccacca

SEQ ID NO: 2618198 - RNA, 14 nt, Human
gaccuuccugccac

SEQ ID NO: 2618199 - RNA, 12 nt, Human
gaccuuccugcc

SEQ ID NO: 2618200 - RNA, 22 nt, Human
gaccuuccucgcagagaggcca

SEQ ID NO: 2618201 - RNA, 16 nt, Human
gaccuucgggcugugc

SEQ ID NO: 2618202 - RNA, 13 nt, Human
gaccuuaggccuu

SEQ ID NO: 2618203 - RNA, 15 nt, Human
gaccuuaggccuucc

SEQ ID NO: 2618204 - RNA, 16 nt, Human
gaccuuaggccuuccu

SEQ ID NO: 2618205 - RNA, 18 nt, Human
gaccuuaggccuuccucu

SEQ ID NO: 2618206 - RNA, 23 nt, Human
gaccuuaguguuucugugcaugg

SEQ ID NO: 2618207 - RNA, 22 nt, Human
gaccuuaguguuucugugcaug

SEQ ID NO: 2618208 - RNA, 21 nt, Human
gaccuuaguguuucugugcau

SEQ ID NO: 2618209 - RNA, 20 nt, Human
gaccuuaguguuucugugca

SEQ ID NO: 2618210 - RNA, 16 nt, Human
gaccuuaguguuucug

SEQ ID NO: 2618211 - RNA, 21 nt, Human
gaccuuaggccuuccucucuc

SEQ ID NO: 2618212 - RNA, 16 nt, Human
gaccuuccaagagccu

SEQ ID NO: 2618213 - RNA, 17 nt, Human
gaccuuccaagagccug

SEQ ID NO: 2618214 - RNA, 19 nt, Human
gaccuucaccaaacauacu

SEQ ID NO: 2618215 - RNA, 16 nt, Human
gaccuucaccaaacau

SEQ ID NO: 2618216 - RNA, 12 nt, Human
gaccuuaucugu

SEQ ID NO: 2618217 - RNA, 14 nt, Human
gaccuuaucugugc

SEQ ID NO: 2618218 - RNA, 21 nt, Human
gaccuuaucugugcgugaaac

SEQ ID NO: 2618219 - RNA, 22 nt, Human
gaccuuaucugugcgugaaaca

SEQ ID NO: 2618220 - RNA, 16 nt, Human
gaccuucuccuucacc

SEQ ID NO: 2618221 - RNA, 15 nt, Human
gaccuucuccuucac

SEQ ID NO: 2618222 - RNA, 18 nt, Human
gaccuucgggcugugccc

SEQ ID NO: 2618223 - RNA, 19 nt, Human
gaccuucgggcugugcccg

SEQ ID NO: 2618224 - RNA, 14 nt, Human
gaccuucuccuuca

SEQ ID NO: 2618225 - RNA, 21 nt, Human
gaccuucuccuucaccuuugu

SEQ ID NO: 2618226 - RNA, 20 nt, Human
gaccuucuccuucaccuuug

SEQ ID NO: 2618227 - RNA, 14 nt, Human
gaccuugaacuggg

SEQ ID NO: 2618228 - RNA, 23 nt, Human
gaccuucuaggacgccacccagc

SEQ ID NO: 2618229 - RNA, 18 nt, Human
gaccuucuccaaaugaga

SEQ ID NO: 2618230 - RNA, 12 nt, Human
gaccuucuggga

SEQ ID NO: 2618231 - RNA, 17 nt, Human
gaccuugaacuccuggg

SEQ ID NO: 2618232 - RNA, 23 nt, Human
gaccuuccugccaccagucacug

SEQ ID NO: 2618233 - RNA, 19 nt, Human
gaccuuccugccaccaguc

SEQ ID NO: 2618234 - RNA, 15 nt, Human
gaccuucuaggaagc

SEQ ID NO: 2618235 - RNA, 20 nt, Human
gaccuuucaauaggaaaaac

SEQ ID NO: 2618236 - RNA, 19 nt, Human
gaccuuucaauaggaaaaa

SEQ ID NO: 2618237 - RNA, 11 nt, Human
gaccuuucaau

SEQ ID NO: 2618238 - RNA, 22 nt, Human
gaccuuuaagagaaaugagcug

SEQ ID NO: 2618239 - RNA, 22 nt, Human
gacgcugugcugcccugcccac

SEQ ID NO: 2618240 - RNA, 21 nt, Human
gacgcugugcugcccugccca

SEQ ID NO: 2618241 - RNA, 13 nt, Human
gacgcuucugaau

SEQ ID NO: 2618242 - RNA, 22 nt, Human
gaccuuuagugguggccauuua

SEQ ID NO: 2618243 - RNA, 13 nt, Human
gacggagucccac

SEQ ID NO: 2618244 - RNA, 23 nt, Human
gacggagucccaccuuggcugca

SEQ ID NO: 2618245 - RNA, 14 nt, Human
gacguccugccacc

SEQ ID NO: 2618246 - RNA, 18 nt, Human
gacguccugccaccuggg

SEQ ID NO: 2618247 - RNA, 15 nt, Human
gacgucccugcccau

SEQ ID NO: 2618248 - RNA, 18 nt, Human
gacgucccuuuuuucucu

SEQ ID NO: 2618249 - RNA, 13 nt, Human
gacguccugccac

SEQ ID NO: 2618250 - RNA, 22 nt, Human
gacgugaccggacuuuucugca

SEQ ID NO: 2618251 - RNA, 22 nt, Human
gacgugauucaauucaacacuc

SEQ ID NO: 2618252 - RNA, 21 nt, Human
gacguccugccaccuggggca

SEQ ID NO: 2618253 - RNA, 16 nt, Human
gacgugauuuugcugu

SEQ ID NO: 2618254 - RNA, 12 nt, Human
gacguggcucag

SEQ ID NO: 2618255 - RNA, 14 nt, Human
gacguggcucagcc

SEQ ID NO: 2618256 - RNA, 23 nt, Human
gacgugccuuuugcaccccuccc

SEQ ID NO: 2618257 - RNA, 22 nt, Human
gacgugccuuuugcaccccucc

SEQ ID NO: 2618258 - RNA, 23 nt, Human
gacgugcacugagagugaaguga

SEQ ID NO: 2618259 - RNA, 18 nt, Human
gacgugcaccuguacuca

SEQ ID NO: 2618260 - RNA, 17 nt, Human
gacgugauuuugcugua

SEQ ID NO: 2618261 - RNA, 19 nt, Human
gacggagucucgcucuguc

SEQ ID NO: 2618262 - RNA, 19 nt, Human
gacggcacccacccagcac

SEQ ID NO: 2618263 - RNA, 21 nt, Human
gacggaagccuuuuuccccaa

SEQ ID NO: 2618264 - RNA, 14 nt, Human
gacggagccgggaa

SEQ ID NO: 2618265 - RNA, 20 nt, Human
gacggcaggcucacugccag

SEQ ID NO: 2618266 - RNA, 16 nt, Human
gacggcaggcucacug

SEQ ID NO: 2618267 - RNA, 11 nt, Human
gacggcaggcu

SEQ ID NO: 2618268 - RNA, 15 nt, Human
gacggccugaugcuc

SEQ ID NO: 2618269 - RNA, 20 nt, Human
gacggccugaugcucccucc

SEQ ID NO: 2618270 - RNA, 22 nt, Human
gacggccugaugcucccucccc

SEQ ID NO: 2618271 - RNA, 23 nt, Human
gacggccugaugcucccuccccu

SEQ ID NO: 2618272 - RNA, 19 nt, Human
gacggcaggcucacugcca

SEQ ID NO: 2618273 - RNA, 18 nt, Human
gacggcugggcacacgcc

SEQ ID NO: 2618274 - RNA, 22 nt, Human
gacgucccuccacguucacccc

SEQ ID NO: 2618275 - RNA, 13 nt, Human
gacggcugggcac

SEQ ID NO: 2618276 - RNA, 12 nt, Human
gacggcugggca

SEQ ID NO: 2618277 - RNA, 23 nt, Human
gacuaacuugucuuuggacccug

SEQ ID NO: 2618278 - RNA, 16 nt, Human
gacuaacuugucuuug

SEQ ID NO: 2618279 - RNA, 21 nt, Human
gacuaagccuaccugcucucc

SEQ ID NO: 2618280 - RNA, 18 nt, Human
gacuaagccuaccugcuc

SEQ ID NO: 2618281 - RNA, 15 nt, Human
gacuaagccuaccug

SEQ ID NO: 2618282 - RNA, 23 nt, Human
gacuaagcccugucgagacacuu

SEQ ID NO: 2618283 - RNA, 17 nt, Human
gacuaauauauuaauau

SEQ ID NO: 2618284 - RNA, 22 nt, Human
gacuaagcccugucgagacacu

SEQ ID NO: 2618285 - RNA, 14 nt, Human
gacuaagcccuguc

SEQ ID NO: 2618286 - RNA, 10 nt, Human
gacuaaagag

SEQ ID NO: 2618287 - RNA, 13 nt, Human
gacuaaagagaga

SEQ ID NO: 2618288 - RNA, 14 nt, Human
gacuaaagagagaa

SEQ ID NO: 2618289 - RNA, 17 nt, Human
gacuaaagagagaaugu

SEQ ID NO: 2618290 - RNA, 18 nt, Human
gacuaaagagagaaugua

SEQ ID NO: 2618291 - RNA, 18 nt, Human
gacuaaccccaccacacc

SEQ ID NO: 2618292 - RNA, 23 nt, Human
gacuaaaagauauaagugcugua

SEQ ID NO: 2618293 - RNA, 22 nt, Human
gacuaaaagauauaagugcugu

SEQ ID NO: 2618294 - RNA, 21 nt, Human
gacuaaaagauauaagugcug

SEQ ID NO: 2618295 - RNA, 20 nt, Human
gacuaaaagauauaagugcu

SEQ ID NO: 2618296 - RNA, 19 nt, Human
gacuaaaagauauaagugc

SEQ ID NO: 2618297 - RNA, 18 nt, Human
gacuaaaagauauaagug

SEQ ID NO: 2618298 - RNA, 17 nt, Human
gacuaaaagauauaagu

SEQ ID NO: 2618299 - RNA, 13 nt, Human
gacuaaaagauau

SEQ ID NO: 2618300 - RNA, 12 nt, Human
gacuaaaagaua

SEQ ID NO: 2618301 - RNA, 13 nt, Human
gacguuuccauca

SEQ ID NO: 2618302 - RNA, 18 nt, Human
gacuaaaaauauuauaac

SEQ ID NO: 2618303 - RNA, 15 nt, Human
gacguuccagccggc

SEQ ID NO: 2618304 - RNA, 13 nt, Human
gacguuccagccg

SEQ ID NO: 2618305 - RNA, 21 nt, Human
gacguucggggcaugcugggg

SEQ ID NO: 2618306 - RNA, 22 nt, Human
gacguuccagccggcauggcug

SEQ ID NO: 2618307 - RNA, 18 nt, Human
gacguuuacaagcccccc

SEQ ID NO: 2618308 - RNA, 15 nt, Human
gacguguuaugacuc

SEQ ID NO: 2618309 - RNA, 14 nt, Human
gacguguuaugacu

SEQ ID NO: 2618310 - RNA, 11 nt, Human
gacguguuaug

SEQ ID NO: 2618311 - RNA, 15 nt, Human
gacguggcucagcca

SEQ ID NO: 2618312 - RNA, 16 nt, Human
gacguggcucagccag

SEQ ID NO: 2618313 - RNA, 21 nt, Human
gaacucaccuggggcugcugg

SEQ ID NO: 2618314 - RNA, 16 nt, Human
gaacucaccuggggcu

SEQ ID NO: 2618315 - RNA, 16 nt, Human
gaacucaacuuugaca

SEQ ID NO: 2618316 - RNA, 13 nt, Human
gaacucagaucca

SEQ ID NO: 2618317 - RNA, 14 nt, Human
gaacucagauccag

SEQ ID NO: 2618318 - RNA, 14 nt, Human
gaacucacuggggc

SEQ ID NO: 2618319 - RNA, 16 nt, Human
gaacucacuggggccu

SEQ ID NO: 2618320 - RNA, 15 nt, Human
gaacucagauccagg

SEQ ID NO: 2618321 - RNA, 16 nt, Human
gaacucagauccaggg

SEQ ID NO: 2618322 - RNA, 18 nt, Human
gaacucagauccagggac

SEQ ID NO: 2618323 - RNA, 19 nt, Human
gaacucagauccagggaca

SEQ ID NO: 2618324 - RNA, 17 nt, Human
gaacucagccaagcaca

SEQ ID NO: 2618325 - RNA, 16 nt, Human
gaacucagccaagcac

SEQ ID NO: 2618326 - RNA, 15 nt, Human
gaacucagccaagca

SEQ ID NO: 2618327 - RNA, 14 nt, Human
gaacucagccaagc

SEQ ID NO: 2618328 - RNA, 18 nt, Human
gaacucagaucugucuga

SEQ ID NO: 2618329 - RNA, 22 nt, Human
gaacucaccuggggcugcuggc

SEQ ID NO: 2618330 - RNA, 21 nt, Human
gaacucagauccagggacaga

SEQ ID NO: 2618331 - RNA, 14 nt, Human
gaacuacugaggau

SEQ ID NO: 2618332 - RNA, 19 nt, Human
gaacuagaauuugauuauu

SEQ ID NO: 2618333 - RNA, 20 nt, Human
gaacuaccuugguuccccca

SEQ ID NO: 2618334 - RNA, 22 nt, Human
gaacuacgcuugcucauuuuuu

SEQ ID NO: 2618335 - RNA, 17 nt, Human
gaacuaacacuauuuua

SEQ ID NO: 2618336 - RNA, 17 nt, Human
gaacuaaacuuucacac

SEQ ID NO: 2618337 - RNA, 19 nt, Human
gaacuaccuugguuccccc

SEQ ID NO: 2618338 - RNA, 23 nt, Human
gaacuacaaacaaaauuucuauu

SEQ ID NO: 2618339 - RNA, 22 nt, Human
gaacuacaaacaaaauuucuau

SEQ ID NO: 2618340 - RNA, 15 nt, Human
gaacuaauaaaagca

SEQ ID NO: 2618341 - RNA, 14 nt, Human
gaacuaaacuuuca

SEQ ID NO: 2618342 - RNA, 16 nt, Human
gaacuaaacuuucaca

SEQ ID NO: 2618343 - RNA, 18 nt, Human
gaacuaaacuuucacacc

SEQ ID NO: 2618344 - RNA, 12 nt, Human
gaacuaaacuuu

SEQ ID NO: 2618345 - RNA, 17 nt, Human
gaacuaaacucauuuau

SEQ ID NO: 2618346 - RNA, 15 nt, Human
gaacguuuuuccugu

SEQ ID NO: 2618347 - RNA, 18 nt, Human
gaacgcccccccccaccc

SEQ ID NO: 2618348 - RNA, 19 nt, Human
gaacgcccccccccacccc

SEQ ID NO: 2618349 - RNA, 20 nt, Human
gaacgcguguguacacggga

SEQ ID NO: 2618350 - RNA, 20 nt, Human
gaacgcccccccccaccccu

SEQ ID NO: 2618351 - RNA, 12 nt, Human
gaacguuuuucc

SEQ ID NO: 2618352 - RNA, 22 nt, Human
gaaccuuuugagugccuuacac

SEQ ID NO: 2618353 - RNA, 21 nt, Human
gaacgacaauagcuuuacccu

SEQ ID NO: 2618354 - RNA, 21 nt, Human
gaacgcagcccuagagccugc

SEQ ID NO: 2618355 - RNA, 20 nt, Human
gaacgcagcccuagagccug

SEQ ID NO: 2618356 - RNA, 17 nt, Human
gaacgcagcccuagagc

SEQ ID NO: 2618357 - RNA, 16 nt, Human
gaacgcagcccuagag

SEQ ID NO: 2618358 - RNA, 23 nt, Human
gaacgcagcccuagagccugccu

SEQ ID NO: 2618359 - RNA, 22 nt, Human
gaacgcagcccuagagccugcc

SEQ ID NO: 2618360 - RNA, 18 nt, Human
gaacgauuuagaaagaag

SEQ ID NO: 2618361 - RNA, 12 nt, Human
gaacgcagcccu

SEQ ID NO: 2618362 - RNA, 14 nt, Human
gaacgagaggggaa

SEQ ID NO: 2618363 - RNA, 21 nt, Human
gaaccuuuugagugccuuaca

SEQ ID NO: 2618364 - RNA, 19 nt, Human
gaaccuuuugagugccuua

SEQ ID NO: 2618365 - RNA, 18 nt, Human
gaaccuuuugagugccuu

SEQ ID NO: 2618366 - RNA, 13 nt, Human
gaaccucuucccc

SEQ ID NO: 2618367 - RNA, 14 nt, Human
gaaccucuucccca

SEQ ID NO: 2618368 - RNA, 14 nt, Human
gaaccucagccugg

SEQ ID NO: 2618369 - RNA, 15 nt, Human
gaaccucagccuggc

SEQ ID NO: 2618370 - RNA, 17 nt, Human
gaaccucagccuggcca

SEQ ID NO: 2618371 - RNA, 18 nt, Human
gaaccucagccuggccag

SEQ ID NO: 2618372 - RNA, 19 nt, Human
gaaccucagccuggccaga

SEQ ID NO: 2618373 - RNA, 21 nt, Human
gaaccucagccuggccagaca

SEQ ID NO: 2618374 - RNA, 11 nt, Human
gaaccucaggc

SEQ ID NO: 2618375 - RNA, 14 nt, Human
gaaccucaggcuuc

SEQ ID NO: 2618376 - RNA, 13 nt, Human
gaaccuccucugu

SEQ ID NO: 2618377 - RNA, 14 nt, Human
gaaccuccucugug

SEQ ID NO: 2618378 - RNA, 15 nt, Human
gaaccuccucuguga

SEQ ID NO: 2618379 - RNA, 13 nt, Human
gaaccuccuuucu

SEQ ID NO: 2618380 - RNA, 16 nt, Human
gaaccuccucugugaa

SEQ ID NO: 2618381 - RNA, 15 nt, Human
gaaccucauccagcu

SEQ ID NO: 2618382 - RNA, 18 nt, Human
gaaccucaggcuuccuug

SEQ ID NO: 2618383 - RNA, 21 nt, Human
gaacauugcauauaacuuaua

SEQ ID NO: 2618384 - RNA, 20 nt, Human
gaacauccaaggagaaacag

SEQ ID NO: 2618385 - RNA, 23 nt, Human
gaacauccaaggagaaacagaga

SEQ ID NO: 2618386 - RNA, 23 nt, Human
gaacauugcauauaacuuauauu

SEQ ID NO: 2618387 - RNA, 14 nt, Human
gaacaucccuccug

SEQ ID NO: 2618388 - RNA, 21 nt, Human
gaaccucacucuugccaaccu

SEQ ID NO: 2618389 - RNA, 20 nt, Human
gaaccucacucuugccaacc

SEQ ID NO: 2618390 - RNA, 19 nt, Human
gaaccucacucuugccaac

SEQ ID NO: 2618391 - RNA, 18 nt, Human
gaaccucacucuugccaa

SEQ ID NO: 2618392 - RNA, 12 nt, Human
gaaccucagccu

SEQ ID NO: 2618393 - RNA, 13 nt, Human
gaaccucagccug

SEQ ID NO: 2618394 - RNA, 17 nt, Human
gaaccucacgcaccucc

SEQ ID NO: 2618395 - RNA, 18 nt, Human
gaaccucacgcaccuccc

SEQ ID NO: 2618396 - RNA, 19 nt, Human
gaaccucacgcaccuccca

SEQ ID NO: 2618397 - RNA, 20 nt, Human
gaaccucacgcaccucccau

SEQ ID NO: 2618398 - RNA, 17 nt, Human
gaaccucacucuugcca

SEQ ID NO: 2618399 - RNA, 16 nt, Human
gaaccucacucuugcc

SEQ ID NO: 2618400 - RNA, 11 nt, Human
gaaccucacuc

SEQ ID NO: 2618401 - RNA, 21 nt, Human
gaaccucacgcaccucccauc

SEQ ID NO: 2618402 - RNA, 21 nt, Human
gaaccaaagagacuggagcau

SEQ ID NO: 2618403 - RNA, 20 nt, Human
gaaccaaagagacuggagca

SEQ ID NO: 2618404 - RNA, 17 nt, Human
gaaccaaagagacugga

SEQ ID NO: 2618405 - RNA, 16 nt, Human
gaaccucacgcaccuc

SEQ ID NO: 2618406 - RNA, 17 nt, Human
gaaccuagaagggcuag

SEQ ID NO: 2618407 - RNA, 14 nt, Human
gaacacucugagac

SEQ ID NO: 2618408 - RNA, 13 nt, Human
gaacacucugaga

SEQ ID NO: 2618409 - RNA, 21 nt, Human
gaaauuuauuaguuaauauau

SEQ ID NO: 2618410 - RNA, 19 nt, Human
gaaauuuauuaguuaauau

SEQ ID NO: 2618411 - RNA, 22 nt, Human
gaaauuuauuuccuaguucugu

SEQ ID NO: 2618412 - RNA, 23 nt, Human
gaaauuuauuuccuaguucugua

SEQ ID NO: 2618413 - RNA, 11 nt, Human
gaaauuucaga

SEQ ID NO: 2618414 - RNA, 17 nt, Human
gaaauuuauaaacuuuu

SEQ ID NO: 2618415 - RNA, 16 nt, Human
gaaauuuauaaacuuu

SEQ ID NO: 2618416 - RNA, 17 nt, Human
gaaaauauacuguaaag

SEQ ID NO: 2618417 - RNA, 18 nt, Human
gaaauuguacauauuugu

SEQ ID NO: 2618418 - RNA, 17 nt, Human
gaaaauaauuguuccaa

SEQ ID NO: 2618419 - RNA, 18 nt, Human
gaaauuguauuacaaauc

SEQ ID NO: 2618420 - RNA, 16 nt, Human
gaaauuguauuacaaa

SEQ ID NO: 2618421 - RNA, 13 nt, Human
gaaaauauacugu

SEQ ID NO: 2618422 - RNA, 14 nt, Human
gaaaauauacugua

SEQ ID NO: 2618423 - RNA, 15 nt, Human
gaaaauauacuguaa

SEQ ID NO: 2618424 - RNA, 16 nt, Human
gaaaauauacuguaaa

SEQ ID NO: 2618425 - RNA, 12 nt, Human
gaaaauauacug

SEQ ID NO: 2618426 - RNA, 16 nt, Human
gaaaauauaaccagcc

SEQ ID NO: 2618427 - RNA, 20 nt, Human
gaaaauaguaaaugcuuugu

SEQ ID NO: 2618428 - RNA, 19 nt, Human
gaaaauagcucuuucaggg

SEQ ID NO: 2618429 - RNA, 23 nt, Human
gaaaauaaaucaaugcuauaacu

SEQ ID NO: 2618430 - RNA, 19 nt, Human
gaaaauacaacuuaaauaa

SEQ ID NO: 2618431 - RNA, 17 nt, Human
gaaaauaaaaaguuaaa

SEQ ID NO: 2618432 - RNA, 21 nt, Human
gaaauuucagauucccagagc

SEQ ID NO: 2618433 - RNA, 23 nt, Human
gaaauuucagauucccagagcaa

SEQ ID NO: 2618434 - RNA, 16 nt, Human
gaacacucuuuugcuu

SEQ ID NO: 2618435 - RNA, 18 nt, Human
gaacacucuuuugcuuua

SEQ ID NO: 2618436 - RNA, 15 nt, Human
gaacacucugagacu

SEQ ID NO: 2618437 - RNA, 21 nt, Human
gaacagauguuucuuuuguau

SEQ ID NO: 2618438 - RNA, 23 nt, Human
gaacacugcacucuuaagcuucc

SEQ ID NO: 2618439 - RNA, 16 nt, Human
gaacagugauuaccag

SEQ ID NO: 2618440 - RNA, 20 nt, Human
gaacagugauuaccagggac

SEQ ID NO: 2618441 - RNA, 21 nt, Human
gaacagauucacacugucugg

SEQ ID NO: 2618442 - RNA, 17 nt, Human
gaacagauucacacugu

SEQ ID NO: 2618443 - RNA, 22 nt, Human
gaacagccaaaugcauggugca

SEQ ID NO: 2618444 - RNA, 21 nt, Human
gaacagcggcuggacuuggag

SEQ ID NO: 2618445 - RNA, 18 nt, Human
gaacagccgcuccugucu

SEQ ID NO: 2618446 - RNA, 21 nt, Human
gaacagcuaugggagccccag

SEQ ID NO: 2618447 - RNA, 22 nt, Human
gaacagcuaugggagccccagg

SEQ ID NO: 2618448 - RNA, 23 nt, Human
gaacagcuaugggagccccaggg

SEQ ID NO: 2618449 - RNA, 22 nt, Human
gaacaucaucaaggcacugccu

SEQ ID NO: 2618450 - RNA, 21 nt, Human
gaacaucaucaaggcacugcc

SEQ ID NO: 2618451 - RNA, 17 nt, Human
gaacauccaaccuuccc

SEQ ID NO: 2618452 - RNA, 18 nt, Human
gaacauccaaccuuccca

SEQ ID NO: 2618453 - RNA, 15 nt, Human
gaacaucauuagaac

SEQ ID NO: 2618454 - RNA, 12 nt, Human
gaacauccaagg

SEQ ID NO: 2618455 - RNA, 23 nt, Human
gaacaucaccgacgcgucuccug

SEQ ID NO: 2618456 - RNA, 20 nt, Human
gaacaucaucaaggcacugc

SEQ ID NO: 2618457 - RNA, 13 nt, Human
gaacauacuucag

SEQ ID NO: 2618458 - RNA, 12 nt, Human
gaacauauuguu

SEQ ID NO: 2618459 - RNA, 18 nt, Human
gaacauauuguugaaagg

SEQ ID NO: 2618460 - RNA, 18 nt, Human
gaacauacuggcugguga

SEQ ID NO: 2618461 - RNA, 18 nt, Human
gaacagugaggugcccag

SEQ ID NO: 2618462 - RNA, 23 nt, Human
gaacagccaaaugcauggugcag

SEQ ID NO: 2618463 - RNA, 18 nt, Human
gaacagugcuugccacag

SEQ ID NO: 2618464 - RNA, 15 nt, Human
gaacauaaaauacaa

SEQ ID NO: 2618465 - RNA, 18 nt, Human
gaagauguagaggagaaa

SEQ ID NO: 2618466 - RNA, 15 nt, Human
gaagauaggcucugc

SEQ ID NO: 2618467 - RNA, 16 nt, Human
gaagauaggcucugca

SEQ ID NO: 2618468 - RNA, 17 nt, Human
gaagauaggcucugcac

SEQ ID NO: 2618469 - RNA, 13 nt, Human
gaagauaggcucu

SEQ ID NO: 2618470 - RNA, 18 nt, Human
gaagaggggcagcccuug

SEQ ID NO: 2618471 - RNA, 21 nt, Human
gaagauaaguguauuuuucaa

SEQ ID NO: 2618472 - RNA, 20 nt, Human
gaagauaauauuaaggaaga

SEQ ID NO: 2618473 - RNA, 17 nt, Human
gaagaggggcagcccuu

SEQ ID NO: 2618474 - RNA, 15 nt, Human
gaagaggggcagccc

SEQ ID NO: 2618475 - RNA, 14 nt, Human
gaagaggggcagcc

SEQ ID NO: 2618476 - RNA, 13 nt, Human
gaagaggggcagc

SEQ ID NO: 2618477 - RNA, 11 nt, Human
gaagaggggca

SEQ ID NO: 2618478 - RNA, 19 nt, Human
gaagaggggacaggucccu

SEQ ID NO: 2618479 - RNA, 14 nt, Human
gaagaggggacagg

SEQ ID NO: 2618480 - RNA, 20 nt, Human
gaagagggccugugggagcc

SEQ ID NO: 2618481 - RNA, 12 nt, Human
gaagagggcugc

SEQ ID NO: 2618482 - RNA, 13 nt, Human
gaagagggccugu

SEQ ID NO: 2618483 - RNA, 19 nt, Human
gaagagggauaagguaccu

SEQ ID NO: 2618484 - RNA, 11 nt, Human
gaagaggcuuc

SEQ ID NO: 2618485 - RNA, 20 nt, Human
gaagagggagaagcaugaaa

SEQ ID NO: 2618486 - RNA, 20 nt, Human
gaagccaagggaaaggggug

SEQ ID NO: 2618487 - RNA, 19 nt, Human
gaagccaagggaaaggggu

SEQ ID NO: 2618488 - RNA, 17 nt, Human
gaagccaagggaaaggg

SEQ ID NO: 2618489 - RNA, 16 nt, Human
gaagccaagggaaagg

SEQ ID NO: 2618490 - RNA, 15 nt, Human
gaagccaagggaaag

SEQ ID NO: 2618491 - RNA, 14 nt, Human
gaagccaagggaaa

SEQ ID NO: 2618492 - RNA, 18 nt, Human
gaagccaacuuggcuuuc

SEQ ID NO: 2618493 - RNA, 21 nt, Human
gaagccaaguggggugcuggg

SEQ ID NO: 2618494 - RNA, 19 nt, Human
gaagccaaguggggugcug

SEQ ID NO: 2618495 - RNA, 13 nt, Human
gaagccaaguggg

SEQ ID NO: 2618496 - RNA, 21 nt, Human
gaagccaagggaaaggggugc

SEQ ID NO: 2618497 - RNA, 23 nt, Human
gaagccaaguggggugcugggag

SEQ ID NO: 2618498 - RNA, 22 nt, Human
gaagccaaguggggugcuggga

SEQ ID NO: 2618499 - RNA, 18 nt, Human
gaagccaauucagacagg

SEQ ID NO: 2618500 - RNA, 16 nt, Human
gaagccacaggccuga

SEQ ID NO: 2618501 - RNA, 15 nt, Human
gaagccacaggccug

SEQ ID NO: 2618502 - RNA, 20 nt, Human
gaagccaauucagacaggca

SEQ ID NO: 2618503 - RNA, 20 nt, Human
gaagcauuaacuucucugga

SEQ ID NO: 2618504 - RNA, 18 nt, Human
gaagcauuaacuucucug

SEQ ID NO: 2618505 - RNA, 17 nt, Human
gaagcauuaacuucucu

SEQ ID NO: 2618506 - RNA, 15 nt, Human
gaagauguuucaaaa

SEQ ID NO: 2618507 - RNA, 22 nt, Human
gaagauguuuaacuuaaucaau

SEQ ID NO: 2618508 - RNA, 21 nt, Human
gaagauguuuaacuuaaucaa

SEQ ID NO: 2618509 - RNA, 13 nt, Human
gaagauguuuaac

SEQ ID NO: 2618510 - RNA, 17 nt, Human
gaagcauucagagagca

SEQ ID NO: 2618511 - RNA, 16 nt, Human
gaagcauucagagagc

SEQ ID NO: 2618512 - RNA, 15 nt, Human
gaagcauucagagag

SEQ ID NO: 2618513 - RNA, 21 nt, Human
gaagcauuaacuucucuggaa

SEQ ID NO: 2618514 - RNA, 18 nt, Human
gaagcauuccuucuuuga

SEQ ID NO: 2618515 - RNA, 15 nt, Human
gaagcauuccuucuu

SEQ ID NO: 2618516 - RNA, 22 nt, Human
gaagcauuccuucuuugauaau

SEQ ID NO: 2618517 - RNA, 17 nt, Human
gaagcauuuacuuugug

SEQ ID NO: 2618518 - RNA, 19 nt, Human
gaagcccaggaaaggcucc

SEQ ID NO: 2618519 - RNA, 16 nt, Human
gaagcccaggaaaggc

SEQ ID NO: 2618520 - RNA, 15 nt, Human
gaagcccaggaaagg

SEQ ID NO: 2618521 - RNA, 13 nt, Human
gaagcccaggaaa

SEQ ID NO: 2618522 - RNA, 22 nt, Human
gaagccagcaggcucucaggcc

SEQ ID NO: 2618523 - RNA, 21 nt, Human
gaagccagcaggcucucaggc

SEQ ID NO: 2618524 - RNA, 18 nt, Human
gaagccacaggccugaga

SEQ ID NO: 2618525 - RNA, 17 nt, Human
gaagccacaggccugag

SEQ ID NO: 2618526 - RNA, 19 nt, Human
gaagccagcaggcucucag

SEQ ID NO: 2618527 - RNA, 20 nt, Human
gaagccagcaggcucucagg

SEQ ID NO: 2618528 - RNA, 23 nt, Human
gaagcccuucuaccuuccugcaa

SEQ ID NO: 2618529 - RNA, 11 nt, Human
gaagcccugga

SEQ ID NO: 2618530 - RNA, 18 nt, Human
gaagcccuggauuucaga

SEQ ID NO: 2618531 - RNA, 19 nt, Human
gaagcccuggauuucagaa

SEQ ID NO: 2618532 - RNA, 22 nt, Human
gaagcccuggauuucagaaaga

SEQ ID NO: 2618533 - RNA, 17 nt, Human
gaagcccuccaaaagca

SEQ ID NO: 2618534 - RNA, 11 nt, Human
gaagcccuccu

SEQ ID NO: 2618535 - RNA, 12 nt, Human
gaagcccuccuu

SEQ ID NO: 2618536 - RNA, 14 nt, Human
gaagcccuccuucc

SEQ ID NO: 2618537 - RNA, 15 nt, Human
gaagcccuccuucca

SEQ ID NO: 2618538 - RNA, 16 nt, Human
gaagcccuccuuccac

SEQ ID NO: 2618539 - RNA, 19 nt, Human
gaagcccuccuuccacgga

SEQ ID NO: 2618540 - RNA, 19 nt, Human
gaagccccuuccccauggg

SEQ ID NO: 2618541 - RNA, 17 nt, Human
gaagccccuuccccaug

SEQ ID NO: 2618542 - RNA, 14 nt, Human
gaagccccuucccc

SEQ ID NO: 2618543 - RNA, 22 nt, Human
gaagcccccagcuaagaaccug

SEQ ID NO: 2618544 - RNA, 20 nt, Human
gaagcccccaccgugggcag

SEQ ID NO: 2618545 - RNA, 14 nt, Human
gaagcccccagcua

SEQ ID NO: 2618546 - RNA, 17 nt, Human
gaagcccccagcuaaga

SEQ ID NO: 2618547 - RNA, 21 nt, Human
gaagcccccagcuaagaaccu

SEQ ID NO: 2618548 - RNA, 23 nt, Human
gaagcccaggccccuuuucacuc

SEQ ID NO: 2618549 - RNA, 23 nt, Human
gaagcccaggaaaggcuccagga

SEQ ID NO: 2618550 - RNA, 12 nt, Human
gaagaacugaaa

SEQ ID NO: 2618551 - RNA, 23 nt, Human
gaagaacggggcucuucucauuu

SEQ ID NO: 2618552 - RNA, 22 nt, Human
gaagaacggggcucuucucauu

SEQ ID NO: 2618553 - RNA, 20 nt, Human
gaagaacggggcucuucuca

SEQ ID NO: 2618554 - RNA, 13 nt, Human
gaagaacggggcu

SEQ ID NO: 2618555 - RNA, 19 nt, Human
gaagacugcauuauauuua

SEQ ID NO: 2618556 - RNA, 15 nt, Human
gaagaacugcaggcc

SEQ ID NO: 2618557 - RNA, 14 nt, Human
gaagaacugcaggc

SEQ ID NO: 2618558 - RNA, 13 nt, Human
gaagaacugcagg

SEQ ID NO: 2618559 - RNA, 13 nt, Human
gaagacuuuggaa

SEQ ID NO: 2618560 - RNA, 11 nt, Human
gaagacuuugg

SEQ ID NO: 2618561 - RNA, 15 nt, Human
gaagacuggaagcua

SEQ ID NO: 2618562 - RNA, 16 nt, Human
gaagacuggaagcuaa

SEQ ID NO: 2618563 - RNA, 17 nt, Human
gaagacuggaagcuaau

SEQ ID NO: 2618564 - RNA, 20 nt, Human
gaagacugucagcuuccaaa

SEQ ID NO: 2618565 - RNA, 11 nt, Human
gaagacugugg

SEQ ID NO: 2618566 - RNA, 12 nt, Human
gaagacuguggc

SEQ ID NO: 2618567 - RNA, 23 nt, Human
gaacuuugaccucugcagcaaua

SEQ ID NO: 2618568 - RNA, 21 nt, Human
gaacucaucuagguaaauuac

SEQ ID NO: 2618569 - RNA, 24 nt, Human
gaacucagccaagcacaguggugg

SEQ ID NO: 2618570 - RNA, 20 nt, Human
gaacucagccaagcacagug

SEQ ID NO: 2618571 - RNA, 19 nt, Human
gaacucagccaagcacagu

SEQ ID NO: 2618572 - RNA, 18 nt, Human
gaacucagccaagcacag

SEQ ID NO: 2618573 - RNA, 20 nt, Human
gaacucaucuagguaaauua

SEQ ID NO: 2618574 - RNA, 19 nt, Human
gaacuuugcugagccugua

SEQ ID NO: 2618575 - RNA, 22 nt, Human
gaacucaucccuaaugcugcag

SEQ ID NO: 2618576 - RNA, 18 nt, Human
gaacucaucccuaaugcu

SEQ ID NO: 2618577 - RNA, 14 nt, Human
gaacuuuuuguagg

SEQ ID NO: 2618578 - RNA, 19 nt, Human
gaagaaccaguccccccac

SEQ ID NO: 2618579 - RNA, 22 nt, Human
gaagaaccaguccccccacccu

SEQ ID NO: 2618580 - RNA, 18 nt, Human
gaagaaaaaauacauuuu

SEQ ID NO: 2618581 - RNA, 13 nt, Human
gaagaaccagucc

SEQ ID NO: 2618582 - RNA, 13 nt, Human
gaagaaaaaauac

SEQ ID NO: 2618583 - RNA, 17 nt, Human
gaagacuuuggaaagag

SEQ ID NO: 2618584 - RNA, 14 nt, Human
gaagacuuuggaaa

SEQ ID NO: 2618585 - RNA, 20 nt, Human
gaagacuuuucuuucagcca

SEQ ID NO: 2618586 - RNA, 12 nt, Human
gaagagaaacca

SEQ ID NO: 2618587 - RNA, 13 nt, Human
gaagacuguggcu

SEQ ID NO: 2618588 - RNA, 19 nt, Human
gaagagaaugcacaaacag

SEQ ID NO: 2618589 - RNA, 18 nt, Human
gaagagacaggagggcaa

SEQ ID NO: 2618590 - RNA, 17 nt, Human
gaagagaagggcagggc

SEQ ID NO: 2618591 - RNA, 16 nt, Human
gaagagacugggaaga

SEQ ID NO: 2618592 - RNA, 16 nt, Human
gaagagagcaugagag

SEQ ID NO: 2618593 - RNA, 19 nt, Human
gaagagagaucaaauggaa

SEQ ID NO: 2618594 - RNA, 16 nt, Human
gaagagagaucaaaug

SEQ ID NO: 2618595 - RNA, 14 nt, Human
gaagagcacagccc

SEQ ID NO: 2618596 - RNA, 13 nt, Human
gaagagcacagcc

SEQ ID NO: 2618597 - RNA, 15 nt, Human
gaagagauuuuucau

SEQ ID NO: 2618598 - RNA, 18 nt, Human
gaagagauuuuucaugau

SEQ ID NO: 2618599 - RNA, 22 nt, Human
gaagagaggaguucaaugaucu

SEQ ID NO: 2618600 - RNA, 18 nt, Human
gaagagaugggcuuguuu

SEQ ID NO: 2618601 - RNA, 15 nt, Human
gaagagaggaguuca

SEQ ID NO: 2618602 - RNA, 13 nt, Human
gaagagaggaguu

SEQ ID NO: 2618603 - RNA, 12 nt, Human
gaagagaggagu

SEQ ID NO: 2618604 - RNA, 21 nt, Human
gaagagaggagaggagagagg

SEQ ID NO: 2618605 - RNA, 19 nt, Human
gaagagaggagaggagaga

SEQ ID NO: 2618606 - RNA, 14 nt, Human
gaagagaggagagg

SEQ ID NO: 2618607 - RNA, 13 nt, Human
gaagagaggagag

SEQ ID NO: 2618608 - RNA, 19 nt, Human
gaagagaggaguucaauga

SEQ ID NO: 2618609 - RNA, 18 nt, Human
gaagagaggaguucaaug

SEQ ID NO: 2618610 - RNA, 17 nt, Human
gaagagaggaguucaau

SEQ ID NO: 2618611 - RNA, 16 nt, Human
gaagagaggaguucaa

SEQ ID NO: 2618612 - RNA, 21 nt, Human
gaagagaggaguucaaugauc

SEQ ID NO: 2618613 - RNA, 20 nt, Human
gaagagaggaguucaaugau

SEQ ID NO: 2618614 - RNA, 21 nt, Human
gaagagaguccauauuucaau

SEQ ID NO: 2618615 - RNA, 15 nt, Human
gaagaggcugguucu

SEQ ID NO: 2618616 - RNA, 16 nt, Human
gaagaggcuggugcug

SEQ ID NO: 2618617 - RNA, 19 nt, Human
gaagaggcgggccagccag

SEQ ID NO: 2618618 - RNA, 18 nt, Human
gaagaggcgggccagcca

SEQ ID NO: 2618619 - RNA, 17 nt, Human
gaagaggcgggccagcc

SEQ ID NO: 2618620 - RNA, 16 nt, Human
gaagaggcgggccagc

SEQ ID NO: 2618621 - RNA, 15 nt, Human
gaagaggcgggccag

SEQ ID NO: 2618622 - RNA, 20 nt, Human
gaagagcacagcccucccgc

SEQ ID NO: 2618623 - RNA, 15 nt, Human
gaagagcacagcccu

SEQ ID NO: 2618624 - RNA, 15 nt, Human
gaagagcaggcacau

SEQ ID NO: 2618625 - RNA, 18 nt, Human
gaagagcaggcacaugga

SEQ ID NO: 2618626 - RNA, 23 nt, Human
gaagagcaggcacauggaggagc

SEQ ID NO: 2618627 - RNA, 15 nt, Human
gaaguacuggagaaa

SEQ ID NO: 2618628 - RNA, 21 nt, Human
gaaguacccguucacauuuuu

SEQ ID NO: 2618629 - RNA, 21 nt, Human
gaaguacguuauuguugacuu

SEQ ID NO: 2618630 - RNA, 13 nt, Human
gaaguagaaaggg

SEQ ID NO: 2618631 - RNA, 18 nt, Human
gaaguacuauaauuuacc

SEQ ID NO: 2618632 - RNA, 23 nt, Human
gaagguggugggggugcagauga

SEQ ID NO: 2618633 - RNA, 13 nt, Human
gaaguaaugaauu

SEQ ID NO: 2618634 - RNA, 15 nt, Human
gaaguaaugaauuuu

SEQ ID NO: 2618635 - RNA, 23 nt, Human
gaaggugcuggaggugggagcag

SEQ ID NO: 2618636 - RNA, 21 nt, Human
gaaggugcuggaggugggagc

SEQ ID NO: 2618637 - RNA, 20 nt, Human
gaaggugcuggaggugggag

SEQ ID NO: 2618638 - RNA, 19 nt, Human
gaaggugcuggagguggga

SEQ ID NO: 2618639 - RNA, 18 nt, Human
gaaggugcuggagguggg

SEQ ID NO: 2618640 - RNA, 17 nt, Human
gaaggugcuggaggugg

SEQ ID NO: 2618641 - RNA, 16 nt, Human
gaaggugcuggaggug

SEQ ID NO: 2618642 - RNA, 18 nt, Human
gaaggugcugacggccag

SEQ ID NO: 2618643 - RNA, 19 nt, Human
gaaggugcugacggccagg

SEQ ID NO: 2618644 - RNA, 14 nt, Human
gaaggugcuggagg

SEQ ID NO: 2618645 - RNA, 12 nt, Human
gaaggugcugga

SEQ ID NO: 2618646 - RNA, 21 nt, Human
gaaggugcugacggccaggga

SEQ ID NO: 2618647 - RNA, 22 nt, Human
gaaguaauaugcacacauuuuu

SEQ ID NO: 2618648 - RNA, 22 nt, Human
gaagguggauggccccagcaca

SEQ ID NO: 2618649 - RNA, 18 nt, Human
gaagguggccucugugga

SEQ ID NO: 2618650 - RNA, 20 nt, Human
gaagguuaggauuuaacagu

SEQ ID NO: 2618651 - RNA, 19 nt, Human
gaagggggcugggacaugg

SEQ ID NO: 2618652 - RNA, 16 nt, Human
gaagggggcugggaca

SEQ ID NO: 2618653 - RNA, 22 nt, Human
gaagggguaggauuacuaggug

SEQ ID NO: 2618654 - RNA, 22 nt, Human
gaaggugccccaaaaugcaaga

SEQ ID NO: 2618655 - RNA, 19 nt, Human
gaaggggguggugucucca

SEQ ID NO: 2618656 - RNA, 12 nt, Human
gaaggggguggu

SEQ ID NO: 2618657 - RNA, 18 nt, Human
gaaggggguccacccagc

SEQ ID NO: 2618658 - RNA, 17 nt, Human
gaaggggguccacccag

SEQ ID NO: 2618659 - RNA, 15 nt, Human
gaagggggcugggac

SEQ ID NO: 2618660 - RNA, 14 nt, Human
gaagcggcuggcag

SEQ ID NO: 2618661 - RNA, 18 nt, Human
gaagcggucguguuguga

SEQ ID NO: 2618662 - RNA, 21 nt, Human
gaagcccuggauuucagaaag

SEQ ID NO: 2618663 - RNA, 15 nt, Human
gaagcgugagacgcc

SEQ ID NO: 2618664 - RNA, 12 nt, Human
gaaguuugaaug

SEQ ID NO: 2618665 - RNA, 11 nt, Human
gaagucugaaa

SEQ ID NO: 2618666 - RNA, 21 nt, Human
gaaguuucugccgcagcccug

SEQ ID NO: 2618667 - RNA, 20 nt, Human
gaaguuucugccgcagcccu

SEQ ID NO: 2618668 - RNA, 15 nt, Human
gaagucuuagaugua

SEQ ID NO: 2618669 - RNA, 22 nt, Human
gaaguccaagcauuuagaugua

SEQ ID NO: 2618670 - RNA, 12 nt, Human
gaaguccaagca

SEQ ID NO: 2618671 - RNA, 15 nt, Human
gaagucucuuuucuu

SEQ ID NO: 2618672 - RNA, 21 nt, Human
gaagucucugaagugaaacug

SEQ ID NO: 2618673 - RNA, 16 nt, Human
gaagucucugaaguga

SEQ ID NO: 2618674 - RNA, 18 nt, Human
gaagucucuagguucuga

SEQ ID NO: 2618675 - RNA, 20 nt, Human
gaagucuaggagcugggagg

SEQ ID NO: 2618676 - RNA, 22 nt, Human
gaagucuaggagcugggaggaa

SEQ ID NO: 2618677 - RNA, 15 nt, Human
gaagucuaggagcug

SEQ ID NO: 2618678 - RNA, 16 nt, Human
gaagucuaggagcugg

SEQ ID NO: 2618679 - RNA, 18 nt, Human
gaagucgucuuaacucac

SEQ ID NO: 2618680 - RNA, 14 nt, Human
gaaguauccuucag

SEQ ID NO: 2618681 - RNA, 13 nt, Human
gaaguaggaagua

SEQ ID NO: 2618682 - RNA, 23 nt, Human
gaaguaggaagugaaaauaggua

SEQ ID NO: 2618683 - RNA, 23 nt, Human
gaaguauuauaaauuauguuuau

SEQ ID NO: 2618684 - RNA, 20 nt, Human
gaaguauuauaaauuauguu

SEQ ID NO: 2618685 - RNA, 19 nt, Human
gaaguauuauaaauuaugu

SEQ ID NO: 2618686 - RNA, 16 nt, Human
gaaguauuauaaauua

SEQ ID NO: 2618687 - RNA, 18 nt, Human
gaagucauaccaaugaaa

SEQ ID NO: 2618688 - RNA, 19 nt, Human
gaagucaugaagcccaagu

SEQ ID NO: 2618689 - RNA, 15 nt, Human
gaagucaugaagccc

SEQ ID NO: 2618690 - RNA, 16 nt, Human
gaaguauccuucagcc

SEQ ID NO: 2618691 - RNA, 14 nt, Human
gaaguauaccugau

SEQ ID NO: 2618692 - RNA, 19 nt, Human
gaaguaguuuguauaacuu

SEQ ID NO: 2618693 - RNA, 15 nt, Human
gaaguauuauaaauu

SEQ ID NO: 2618694 - RNA, 17 nt, Human
gaaguuugaauguuaaa

SEQ ID NO: 2618695 - RNA, 16 nt, Human
gaaguuugaauguuaa

SEQ ID NO: 2618696 - RNA, 14 nt, Human
gaaguuugaauguu

SEQ ID NO: 2618697 - RNA, 13 nt, Human
gaaguuugaaugu

SEQ ID NO: 2618698 - RNA, 20 nt, Human
gaaguuugagaucagccugg

SEQ ID NO: 2618699 - RNA, 20 nt, Human
gaaguuugaauguuaaauaa

SEQ ID NO: 2618700 - RNA, 19 nt, Human
gaaguuugaauguuaaaua

SEQ ID NO: 2618701 - RNA, 23 nt, Human
gaaguuuucaaugaugggcgagc

SEQ ID NO: 2618702 - RNA, 11 nt, Human
gaaguuuucaa

SEQ ID NO: 2618703 - RNA, 13 nt, Human
gaaguuuuacauu

SEQ ID NO: 2618704 - RNA, 19 nt, Human
gaaguuugauauuaaagga

SEQ ID NO: 2618705 - RNA, 18 nt, Human
gaauaacauguaauuaag

SEQ ID NO: 2618706 - RNA, 19 nt, Human
gaauaacauguaauuaagu

SEQ ID NO: 2618707 - RNA, 23 nt, Human
gaauaaaauacuauuuuuacugc

SEQ ID NO: 2618708 - RNA, 19 nt, Human
gaaguuuuuguacuguaaa

SEQ ID NO: 2618709 - RNA, 16 nt, Human
gaauaaaaacuuugcu

SEQ ID NO: 2618710 - RNA, 23 nt, Human
gaaguuuucaggacuuggucuga

SEQ ID NO: 2618711 - RNA, 13 nt, Human
gaaguuuucagga

SEQ ID NO: 2618712 - RNA, 12 nt, Human
gaaguuuugcau

SEQ ID NO: 2618713 - RNA, 18 nt, Human
gaaguuuuuguacuguaa

SEQ ID NO: 2618714 - RNA, 14 nt, Human
gaaguuuuuguacu

SEQ ID NO: 2618715 - RNA, 15 nt, Human
gaaguuuuguacaga

SEQ ID NO: 2618716 - RNA, 17 nt, Human
gaaguuuugcauuuaug

SEQ ID NO: 2618717 - RNA, 21 nt, Human
gaauacagaggcaacugcauu

SEQ ID NO: 2618718 - RNA, 16 nt, Human
gaauacaaacauauuu

SEQ ID NO: 2618719 - RNA, 14 nt, Human
gaauacagaaagau

SEQ ID NO: 2618720 - RNA, 23 nt, Human
gaauacagggcaugcauuuugca

SEQ ID NO: 2618721 - RNA, 21 nt, Human
gaauacaguaagcugcucuau

SEQ ID NO: 2618722 - RNA, 13 nt, Human
gaauacaguguua

SEQ ID NO: 2618723 - RNA, 18 nt, Human
gaauaaucacgcuuuccu

SEQ ID NO: 2618724 - RNA, 19 nt, Human
gaauaaucacgcuuuccug

SEQ ID NO: 2618725 - RNA, 20 nt, Human
gaauaaucacgcuuuccuga

SEQ ID NO: 2618726 - RNA, 21 nt, Human
gaauaaucacgcuuuccugaa

SEQ ID NO: 2618727 - RNA, 14 nt, Human
gaauaauuucccaa

SEQ ID NO: 2618728 - RNA, 17 nt, Human
gaauacaaacaccugga

SEQ ID NO: 2618729 - RNA, 14 nt, Human
gaauaauuucuuac

SEQ ID NO: 2618730 - RNA, 21 nt, Human
gaauaauuucccaauuaggaa

SEQ ID NO: 2618731 - RNA, 23 nt, Human
gaauaauuucccaauuaggaagu

SEQ ID NO: 2618732 - RNA, 17 nt, Human
gaauaagaaaguuucac

SEQ ID NO: 2618733 - RNA, 21 nt, Human
gaauaacucuguggcauuauu

SEQ ID NO: 2618734 - RNA, 21 nt, Human
gaauaaaauacuauuuuuacu

SEQ ID NO: 2618735 - RNA, 22 nt, Human
gaauaaccacuuaaaaaauguc

SEQ ID NO: 2618736 - RNA, 15 nt, Human
gaauaacuagcacca

SEQ ID NO: 2618737 - RNA, 23 nt, Human
gaauaaccacuuaaaaaaugucc

SEQ ID NO: 2618738 - RNA, 17 nt, Human
gaauaauacaguaucuc

SEQ ID NO: 2618739 - RNA, 15 nt, Human
gaauaauagaagaac

SEQ ID NO: 2618740 - RNA, 19 nt, Human
gaauaauaugcugccaaau

SEQ ID NO: 2618741 - RNA, 16 nt, Human
gaauaauacauugaau

SEQ ID NO: 2618742 - RNA, 12 nt, Human
gaauaauagaag

SEQ ID NO: 2618743 - RNA, 22 nt, Human
gaauaauaauuauccagaguuu

SEQ ID NO: 2618744 - RNA, 17 nt, Human
gaaucaagagcugcccu

SEQ ID NO: 2618745 - RNA, 16 nt, Human
gaaucaagagcugccc

SEQ ID NO: 2618746 - RNA, 15 nt, Human
gaaucaagagcugcc

SEQ ID NO: 2618747 - RNA, 14 nt, Human
gaaucaagagcugc

SEQ ID NO: 2618748 - RNA, 17 nt, Human
gaaucaacauuucucaa

SEQ ID NO: 2618749 - RNA, 22 nt, Human
gaaucaaagcaguuaacuuuaa

SEQ ID NO: 2618750 - RNA, 19 nt, Human
gaaucaagagcugcccucc

SEQ ID NO: 2618751 - RNA, 18 nt, Human
gaaucaagagcugcccuc

SEQ ID NO: 2618752 - RNA, 20 nt, Human
gaaucaagaugucagacugg

SEQ ID NO: 2618753 - RNA, 22 nt, Human
gaaucaagcuagaaggccacau

SEQ ID NO: 2618754 - RNA, 20 nt, Human
gaaucaagcuagaaggccac

SEQ ID NO: 2618755 - RNA, 21 nt, Human
gaaucaagaugucagacuggc

SEQ ID NO: 2618756 - RNA, 19 nt, Human
gaaucaaagcaaugcauuu

SEQ ID NO: 2618757 - RNA, 18 nt, Human
gaaucaaagcaaugcauu

SEQ ID NO: 2618758 - RNA, 17 nt, Human
gaaucaaagcaaugcau

SEQ ID NO: 2618759 - RNA, 17 nt, Human
gaaucaaagacauggaa

SEQ ID NO: 2618760 - RNA, 16 nt, Human
gaaucaaagacaugga

SEQ ID NO: 2618761 - RNA, 15 nt, Human
gaaucaaaacucucc

SEQ ID NO: 2618762 - RNA, 13 nt, Human
gaaucaaaacucu

SEQ ID NO: 2618763 - RNA, 14 nt, Human
gaaucaaaacucuc

SEQ ID NO: 2618764 - RNA, 16 nt, Human
gaauauuugaaucuug

SEQ ID NO: 2618765 - RNA, 14 nt, Human
gaauauuugaaucu

SEQ ID NO: 2618766 - RNA, 23 nt, Human
gaauaggcgaucacaacgugcau

SEQ ID NO: 2618767 - RNA, 22 nt, Human
gaauaggcgaucacaacgugca

SEQ ID NO: 2618768 - RNA, 22 nt, Human
gaauauuugaaucuugucucaa

SEQ ID NO: 2618769 - RNA, 18 nt, Human
gaauauuugaaucuuguc

SEQ ID NO: 2618770 - RNA, 17 nt, Human
gaauauuugaauguaug

SEQ ID NO: 2618771 - RNA, 16 nt, Human
gaauauuuuaacuucc

SEQ ID NO: 2618772 - RNA, 18 nt, Human
gaauauuuuaaguauugc

SEQ ID NO: 2618773 - RNA, 13 nt, Human
gaauauuugaauc

SEQ ID NO: 2618774 - RNA, 22 nt, Human
gaauauuuguuauguagauaac

SEQ ID NO: 2618775 - RNA, 22 nt, Human
gaauagcugggacuacaggugu

SEQ ID NO: 2618776 - RNA, 16 nt, Human
gaauaggcgaucacaa

SEQ ID NO: 2618777 - RNA, 23 nt, Human
gaauagcugggacuacaggugug

SEQ ID NO: 2618778 - RNA, 13 nt, Human
gaauaccuguccc

SEQ ID NO: 2618779 - RNA, 20 nt, Human
gaauacaguguuauuuucuu

SEQ ID NO: 2618780 - RNA, 15 nt, Human
gaauaccuguccccc

SEQ ID NO: 2618781 - RNA, 15 nt, Human
gaauuucccaaagca

SEQ ID NO: 2618782 - RNA, 17 nt, Human
gaauuuauuauuguucu

SEQ ID NO: 2618783 - RNA, 23 nt, Human
gaauuuauucaauuccucuggga

SEQ ID NO: 2618784 - RNA, 22 nt, Human
gaauuuaaauauaauucuguaa

SEQ ID NO: 2618785 - RNA, 20 nt, Human
gaauuuaaauauaauucugu

SEQ ID NO: 2618786 - RNA, 17 nt, Human
gaauuuaaauauaauuc

SEQ ID NO: 2618787 - RNA, 15 nt, Human
gaauuuaaauauaau

SEQ ID NO: 2618788 - RNA, 14 nt, Human
gaauuuaaauauaa

SEQ ID NO: 2618789 - RNA, 13 nt, Human
gaauuuaaauaua

SEQ ID NO: 2618790 - RNA, 21 nt, Human
gaauuuagggagaaauguugu

SEQ ID NO: 2618791 - RNA, 19 nt, Human
gaauuuagggagaaauguu

SEQ ID NO: 2618792 - RNA, 23 nt, Human
gaauuuaaauauaauucuguaaa

SEQ ID NO: 2618793 - RNA, 16 nt, Human
gaauuuaauaaucugu

SEQ ID NO: 2618794 - RNA, 22 nt, Human
gaauuuaucacacuucugugag

SEQ ID NO: 2618795 - RNA, 17 nt, Human
gaauuuauucaauuccu

SEQ ID NO: 2618796 - RNA, 13 nt, Human
gaauuuauucaau

SEQ ID NO: 2618797 - RNA, 19 nt, Human
gaauuuagguuuuuauuag

SEQ ID NO: 2618798 - RNA, 22 nt, Human
gaauuuauauacaaccugcuug

SEQ ID NO: 2618799 - RNA, 16 nt, Human
gaauuuagguuuuuau

SEQ ID NO: 2618800 - RNA, 20 nt, Human
gaauuuaucacacuucugug

SEQ ID NO: 2618801 - RNA, 16 nt, Human
gaauugugcucaaaau

SEQ ID NO: 2618802 - RNA, 16 nt, Human
gaauugugucugcagg

SEQ ID NO: 2618803 - RNA, 16 nt, Human
gaauugugugauguuu

SEQ ID NO: 2618804 - RNA, 18 nt, Human
gaauuuaaaaauaagaaa

SEQ ID NO: 2618805 - RNA, 23 nt, Human
gaauuguguuuauaauuuuaaau

SEQ ID NO: 2618806 - RNA, 15 nt, Human
gaauuguguuuauaa

SEQ ID NO: 2618807 - RNA, 22 nt, Human
gaauuguaaggaaugauuaauu

SEQ ID NO: 2618808 - RNA, 14 nt, Human
gaauuguaucauuu

SEQ ID NO: 2618809 - RNA, 14 nt, Human
gaauuguccccagu

SEQ ID NO: 2618810 - RNA, 23 nt, Human
gaauuguccccaguuugcagaaa

SEQ ID NO: 2618811 - RNA, 18 nt, Human
gaauugugaccaaguuau

SEQ ID NO: 2618812 - RNA, 13 nt, Human
gaauugauuugca

SEQ ID NO: 2618813 - RNA, 14 nt, Human
gaauugauuugcau

SEQ ID NO: 2618814 - RNA, 15 nt, Human
gaauugauuugcauu

SEQ ID NO: 2618815 - RNA, 17 nt, Human
gaauugauuugcauuga

SEQ ID NO: 2618816 - RNA, 12 nt, Human
gaauugauuugc

SEQ ID NO: 2618817 - RNA, 21 nt, Human
gaauugaucauuuucccccca

SEQ ID NO: 2618818 - RNA, 17 nt, Human
gaauucucuaguuugau

SEQ ID NO: 2618819 - RNA, 17 nt, Human
gaauucucagaaucuca

SEQ ID NO: 2618820 - RNA, 16 nt, Human
gaauuccuucagggug

SEQ ID NO: 2618821 - RNA, 17 nt, Human
gaauucggugugcacca

SEQ ID NO: 2618822 - RNA, 16 nt, Human
gaauuccaaggaguuc

SEQ ID NO: 2618823 - RNA, 12 nt, Human
gaauuccaagga

SEQ ID NO: 2618824 - RNA, 13 nt, Human
gaauuccaaggag

SEQ ID NO: 2618825 - RNA, 21 nt, Human
gaaugucagugugacugaucu

SEQ ID NO: 2618826 - RNA, 20 nt, Human
gaaugucagugugacugauc

SEQ ID NO: 2618827 - RNA, 23 nt, Human
gaauucaaacuggggccuccaga

SEQ ID NO: 2618828 - RNA, 23 nt, Human
gaauguauuguaccuuuuaacac

SEQ ID NO: 2618829 - RNA, 16 nt, Human
gaauucagauuuuaaa

SEQ ID NO: 2618830 - RNA, 19 nt, Human
gaauucucuaguuugauua

SEQ ID NO: 2618831 - RNA, 16 nt, Human
gaauucuagugcugcu

SEQ ID NO: 2618832 - RNA, 14 nt, Human
gaauucuagugcug

SEQ ID NO: 2618833 - RNA, 17 nt, Human
gaauuccuucaggguga

SEQ ID NO: 2618834 - RNA, 23 nt, Human
gaauucuaggcaucccaggggac

SEQ ID NO: 2618835 - RNA, 15 nt, Human
gaauucuauuugcug

SEQ ID NO: 2618836 - RNA, 17 nt, Human
gaauucuagugcugcug

SEQ ID NO: 2618837 - RNA, 18 nt, Human
gaauucugcuaccucacu

SEQ ID NO: 2618838 - RNA, 23 nt, Human
gaauucuugaaggaaaaugauac

SEQ ID NO: 2618839 - RNA, 20 nt, Human
gaauucuugguugaggaaac

SEQ ID NO: 2618840 - RNA, 19 nt, Human
gaauucuugguugaggaaa

SEQ ID NO: 2618841 - RNA, 19 nt, Human
gaauucugcuaccucacug

SEQ ID NO: 2618842 - RNA, 14 nt, Human
gaauugaaaaacca

SEQ ID NO: 2618843 - RNA, 16 nt, Human
gaauucuuuuggggaa

SEQ ID NO: 2618844 - RNA, 14 nt, Human
gaauugaagcagga

SEQ ID NO: 2618845 - RNA, 22 nt, Human
gaauugaggggauuaauaugaa

SEQ ID NO: 2618846 - RNA, 15 nt, Human
gaauugaggucugcu

SEQ ID NO: 2618847 - RNA, 20 nt, Human
gaauugaucauuuucccccc

SEQ ID NO: 2618848 - RNA, 15 nt, Human
gaauugaacccagga

SEQ ID NO: 2618849 - RNA, 16 nt, Human
gaauugaacccaggag

SEQ ID NO: 2618850 - RNA, 18 nt, Human
gaauugacuucgacugug

SEQ ID NO: 2618851 - RNA, 18 nt, Human
gaauugaacccaggaggu

SEQ ID NO: 2618852 - RNA, 18 nt, Human
gaauugaggggauuaaua

SEQ ID NO: 2618853 - RNA, 22 nt, Human
gaauguauuguaccuuuuaaca

SEQ ID NO: 2618854 - RNA, 21 nt, Human
gaauguauuguaccuuuuaac

SEQ ID NO: 2618855 - RNA, 13 nt, Human
gaauguauuuauu

SEQ ID NO: 2618856 - RNA, 16 nt, Human
gaauguauuuauuugg

SEQ ID NO: 2618857 - RNA, 23 nt, Human
gaauguauuuauuugggagaccg

SEQ ID NO: 2618858 - RNA, 14 nt, Human
gaaugucaguguga

SEQ ID NO: 2618859 - RNA, 21 nt, Human
gaauguaugcuucauacaggg

SEQ ID NO: 2618860 - RNA, 16 nt, Human
gaauguauuauucugc

SEQ ID NO: 2618861 - RNA, 15 nt, Human
gaauguauuguaccu

SEQ ID NO: 2618862 - RNA, 14 nt, Human
gaauguauuguacc

SEQ ID NO: 2618863 - RNA, 13 nt, Human
gaauguauuguac

SEQ ID NO: 2618864 - RNA, 12 nt, Human
gaauguauugua

SEQ ID NO: 2618865 - RNA, 17 nt, Human
gaauguauuauucugca

SEQ ID NO: 2618866 - RNA, 18 nt, Human
gaauguauuauucugcag

SEQ ID NO: 2618867 - RNA, 19 nt, Human
gaauguauuauucugcagc

SEQ ID NO: 2618868 - RNA, 21 nt, Human
gaauguauuauucugcagcau

SEQ ID NO: 2618869 - RNA, 15 nt, Human
gaauguaacugcuga

SEQ ID NO: 2618870 - RNA, 18 nt, Human
gaauguaacugcugaaaa

SEQ ID NO: 2618871 - RNA, 18 nt, Human
gaauguaagaacuacaaa

SEQ ID NO: 2618872 - RNA, 16 nt, Human
gaauguaugcuucaua

SEQ ID NO: 2618873 - RNA, 18 nt, Human
gaauguaugcuucauaca

SEQ ID NO: 2618874 - RNA, 22 nt, Human
gaaugguuccaugccugagggu

SEQ ID NO: 2618875 - RNA, 20 nt, Human
gaaugguuccaugccugagg

SEQ ID NO: 2618876 - RNA, 19 nt, Human
gaaugguuccaugccugag

SEQ ID NO: 2618877 - RNA, 22 nt, Human
gaaugguuuucaaaauaaaaau

SEQ ID NO: 2618878 - RNA, 22 nt, Human
gaauggaaggguucuggcugcc

SEQ ID NO: 2618879 - RNA, 21 nt, Human
gaauggaaggguucuggcugc

SEQ ID NO: 2618880 - RNA, 21 nt, Human
gaaugggcaaaacugaauuau

SEQ ID NO: 2618881 - RNA, 13 nt, Human
gaaugggaaaaga

SEQ ID NO: 2618882 - RNA, 23 nt, Human
gaaugggagguugaucagaucug

SEQ ID NO: 2618883 - RNA, 13 nt, Human
gaauggcaauggu

SEQ ID NO: 2618884 - RNA, 20 nt, Human
gaauggauuggauuauuuaa

SEQ ID NO: 2618885 - RNA, 19 nt, Human
gaauggauuggauuauuua

SEQ ID NO: 2618886 - RNA, 15 nt, Human
gaaugguccaggguu

SEQ ID NO: 2618887 - RNA, 14 nt, Human
gaaugguccagggu

SEQ ID NO: 2618888 - RNA, 16 nt, Human
gaaugguuccaugccu

SEQ ID NO: 2618889 - RNA, 17 nt, Human
gaaugguuauaaaagug

SEQ ID NO: 2618890 - RNA, 16 nt, Human
gaaugguuauaaaagu

SEQ ID NO: 2618891 - RNA, 13 nt, Human
gaaugguuauaaa

SEQ ID NO: 2618892 - RNA, 18 nt, Human
gaauggggaucacagaga

SEQ ID NO: 2618893 - RNA, 17 nt, Human
gaaugggcuguuuuugg

SEQ ID NO: 2618894 - RNA, 16 nt, Human
gaaugggcaguuacau

SEQ ID NO: 2618895 - RNA, 15 nt, Human
gaaugggcaguuaca

SEQ ID NO: 2618896 - RNA, 13 nt, Human
gaaugguccaggg

SEQ ID NO: 2618897 - RNA, 23 nt, Human
gaauggucagcguugcaugucgu

SEQ ID NO: 2618898 - RNA, 18 nt, Human
gaaugcuuuuugaauguu

SEQ ID NO: 2618899 - RNA, 20 nt, Human
gaaugccucaaugugaccag

SEQ ID NO: 2618900 - RNA, 14 nt, Human
gaaugccguggauu

SEQ ID NO: 2618901 - RNA, 13 nt, Human
gaaugcuuuagga

SEQ ID NO: 2618902 - RNA, 18 nt, Human
gaaugcccccagcuggcc

SEQ ID NO: 2618903 - RNA, 17 nt, Human
gaaugcccccagcuggc

SEQ ID NO: 2618904 - RNA, 14 nt, Human
gaaugcccucaggg

SEQ ID NO: 2618905 - RNA, 21 nt, Human
gaaugccacugccuucgcuuc

SEQ ID NO: 2618906 - RNA, 17 nt, Human
gaaugcccacaggcaaa

SEQ ID NO: 2618907 - RNA, 22 nt, Human
gaaugcccacaggcaaaugcau

SEQ ID NO: 2618908 - RNA, 22 nt, Human
gaaugccacugccuucgcuucu

SEQ ID NO: 2618909 - RNA, 14 nt, Human
gaaugcauuuuguu

SEQ ID NO: 2618910 - RNA, 14 nt, Human
gaaugcauaaaaug

SEQ ID NO: 2618911 - RNA, 11 nt, Human
gaaugcagugg

SEQ ID NO: 2618912 - RNA, 18 nt, Human
gaaugaagcuuguguauc

SEQ ID NO: 2618913 - RNA, 16 nt, Human
gaaugaagcuugugua

SEQ ID NO: 2618914 - RNA, 20 nt, Human
gaaugaagcuuguguaucca

SEQ ID NO: 2618915 - RNA, 17 nt, Human
gaaugaaggugucagaa

SEQ ID NO: 2618916 - RNA, 22 nt, Human
gaaucuuuauugagaaagagca

SEQ ID NO: 2618917 - RNA, 19 nt, Human
gaaucuuuauugagaaaga

SEQ ID NO: 2618918 - RNA, 18 nt, Human
gaaucuuuauugagaaag

SEQ ID NO: 2618919 - RNA, 17 nt, Human
gaaucuuuauugagaaa

SEQ ID NO: 2618920 - RNA, 23 nt, Human
gaaucuuuagagaaguauacaua

SEQ ID NO: 2618921 - RNA, 22 nt, Human
gaaucuuuagagaaguauacau

SEQ ID NO: 2618922 - RNA, 22 nt, Human
gaaucuugucucaaugcucaua

SEQ ID NO: 2618923 - RNA, 15 nt, Human
gaaugaaaaaacagu

SEQ ID NO: 2618924 - RNA, 23 nt, Human
gaaucuuuuucagaaacagugag

SEQ ID NO: 2618925 - RNA, 20 nt, Human
gaaucuuuccaauaaaccag

SEQ ID NO: 2618926 - RNA, 15 nt, Human
gaaugaaaaauuuaa

SEQ ID NO: 2618927 - RNA, 19 nt, Human
gaaugaaaaauuuaagcau

SEQ ID NO: 2618928 - RNA, 15 nt, Human
gaaugaaaacucauu

SEQ ID NO: 2618929 - RNA, 20 nt, Human
gaaugaaaaauuuaagcauu

SEQ ID NO: 2618930 - RNA, 22 nt, Human
gaaugaaaaauuuaagcauugu

SEQ ID NO: 2618931 - RNA, 16 nt, Human
gaaugaaaauuguaug

SEQ ID NO: 2618932 - RNA, 23 nt, Human
gaaugaaaaauuuaagcauuguu

SEQ ID NO: 2618933 - RNA, 18 nt, Human
gaaugaaccacaucuugc

SEQ ID NO: 2618934 - RNA, 22 nt, Human
gaaugaaccacaucuugcucug

SEQ ID NO: 2618935 - RNA, 23 nt, Human
gaaugaaccacaucuugcucugc

SEQ ID NO: 2618936 - RNA, 14 nt, Human
gaaugaaaccccca

SEQ ID NO: 2618937 - RNA, 15 nt, Human
gaaugaaccuucugg

SEQ ID NO: 2618938 - RNA, 17 nt, Human
gaaugaaccuucuggcc

SEQ ID NO: 2618939 - RNA, 17 nt, Human
gaucagcuguuugucau

SEQ ID NO: 2618940 - RNA, 18 nt, Human
gaucagcuguuugucaua

SEQ ID NO: 2618941 - RNA, 23 nt, Human
gaucagcuuauugucuagugaaa

SEQ ID NO: 2618942 - RNA, 14 nt, Human
gaucacuggagccc

SEQ ID NO: 2618943 - RNA, 16 nt, Human
gaucagcuguuuguca

SEQ ID NO: 2618944 - RNA, 14 nt, Human
gaucacuacugcag

SEQ ID NO: 2618945 - RNA, 12 nt, Human
gaucacuacugc

SEQ ID NO: 2618946 - RNA, 14 nt, Human
gaucaccugagguc

SEQ ID NO: 2618947 - RNA, 14 nt, Human
gaucaccugagguu

SEQ ID NO: 2618948 - RNA, 12 nt, Human
gaucacuggagc

SEQ ID NO: 2618949 - RNA, 13 nt, Human
gaucacuggagcc

SEQ ID NO: 2618950 - RNA, 20 nt, Human
gaucacggcucacugcagcc

SEQ ID NO: 2618951 - RNA, 23 nt, Human
gaucacggcucacugcagccuca

SEQ ID NO: 2618952 - RNA, 18 nt, Human
gaucaccagcccggccug

SEQ ID NO: 2618953 - RNA, 15 nt, Human
gaucaccagcccggc

SEQ ID NO: 2618954 - RNA, 14 nt, Human
gaucaccagcccgg

SEQ ID NO: 2618955 - RNA, 15 nt, Human
gaucaccagaauaaa

SEQ ID NO: 2618956 - RNA, 22 nt, Human
gaucaccagcccggccugcucc

SEQ ID NO: 2618957 - RNA, 20 nt, Human
gaucaccagcccggccugcu

SEQ ID NO: 2618958 - RNA, 16 nt, Human
gaucacauguggacuu

SEQ ID NO: 2618959 - RNA, 13 nt, Human
gaucacagggccc

SEQ ID NO: 2618960 - RNA, 20 nt, Human
gaucacagggccccagaagg

SEQ ID NO: 2618961 - RNA, 14 nt, Human
gaucaccagaauaa

SEQ ID NO: 2618962 - RNA, 14 nt, Human
gaucacagccucug

SEQ ID NO: 2618963 - RNA, 20 nt, Human
gaucacagcugcuuucuguu

SEQ ID NO: 2618964 - RNA, 17 nt, Human
gaucacagcugcuuucu

SEQ ID NO: 2618965 - RNA, 13 nt, Human
gaucacagcugcu

SEQ ID NO: 2618966 - RNA, 21 nt, Human
gauaucugagggaggaggcca

SEQ ID NO: 2618967 - RNA, 21 nt, Human
gaucacagcuucagccaggag

SEQ ID NO: 2618968 - RNA, 19 nt, Human
gaucacagcuucagccagg

SEQ ID NO: 2618969 - RNA, 19 nt, Human
gauaucacagucuaauuuu

SEQ ID NO: 2618970 - RNA, 18 nt, Human
gauaucacagucuaauuu

SEQ ID NO: 2618971 - RNA, 15 nt, Human
gauauccauucuuuc

SEQ ID NO: 2618972 - RNA, 16 nt, Human
gauauccauucuuucu

SEQ ID NO: 2618973 - RNA, 19 nt, Human
gauauccauucuuucugau

SEQ ID NO: 2618974 - RNA, 17 nt, Human
gauauauuuuucacagu

SEQ ID NO: 2618975 - RNA, 17 nt, Human
gauauauuuuuaagaua

SEQ ID NO: 2618976 - RNA, 15 nt, Human
gauauauuuuucaca

SEQ ID NO: 2618977 - RNA, 20 nt, Human
gauauaucaugagugaauaa

SEQ ID NO: 2618978 - RNA, 23 nt, Human
gauauaggucagugaggcccagg

SEQ ID NO: 2618979 - RNA, 16 nt, Human
gauauauuuuuaagau

SEQ ID NO: 2618980 - RNA, 23 nt, Human
gauaucugagggaggaggccacc

SEQ ID NO: 2618981 - RNA, 20 nt, Human
gauaucugagggaggaggcc

SEQ ID NO: 2618982 - RNA, 16 nt, Human
gauaucugagggagga

SEQ ID NO: 2618983 - RNA, 15 nt, Human
gauaucugagggagg

SEQ ID NO: 2618984 - RNA, 14 nt, Human
gauaucucaucucu

SEQ ID NO: 2618985 - RNA, 23 nt, Human
gauaucgacuuguuuuugcacau

SEQ ID NO: 2618986 - RNA, 13 nt, Human
gauaucucaucuc

SEQ ID NO: 2618987 - RNA, 17 nt, Human
gauaucccuaugcugcc

SEQ ID NO: 2618988 - RNA, 22 nt, Human
gauaucccuaugcugccuaggc

SEQ ID NO: 2618989 - RNA, 23 nt, Human
gauaucccuaugcugccuaggcu

SEQ ID NO: 2618990 - RNA, 17 nt, Human
gauaauuccaguggucc

SEQ ID NO: 2618991 - RNA, 13 nt, Human
gauaauuccagug

SEQ ID NO: 2618992 - RNA, 18 nt, Human
gauaauugcauucaucuu

SEQ ID NO: 2618993 - RNA, 18 nt, Human
gauaauucuagcuuugag

SEQ ID NO: 2618994 - RNA, 17 nt, Human
gauaaucaacugggcug

SEQ ID NO: 2618995 - RNA, 14 nt, Human
gauaauuauaauau

SEQ ID NO: 2618996 - RNA, 18 nt, Human
gauaauauuguggugcca

SEQ ID NO: 2618997 - RNA, 17 nt, Human
gauaauaugagaaucag

SEQ ID NO: 2618998 - RNA, 19 nt, Human
gauaggaaaaaugaguaau

SEQ ID NO: 2618999 - RNA, 16 nt, Human
gauacaaaagcaugug

SEQ ID NO: 2619000 - RNA, 17 nt, Human
gauaggucagugcaaau

SEQ ID NO: 2619001 - RNA, 18 nt, Human
gauaggaaugugaaagca

SEQ ID NO: 2619002 - RNA, 17 nt, Human
gauaggagccugcuggu

SEQ ID NO: 2619003 - RNA, 12 nt, Human
gauaggcucugc

SEQ ID NO: 2619004 - RNA, 20 nt, Human
gauaguuacuguugugaccu

SEQ ID NO: 2619005 - RNA, 17 nt, Human
gauaguuacuguuguga

SEQ ID NO: 2619006 - RNA, 14 nt, Human
gauaguuacuguug

SEQ ID NO: 2619007 - RNA, 12 nt, Human
gauaguuacugu

SEQ ID NO: 2619008 - RNA, 18 nt, Human
gauauaaaagacugacca

SEQ ID NO: 2619009 - RNA, 13 nt, Human
gauauaaauaaaa

SEQ ID NO: 2619010 - RNA, 20 nt, Human
gauagugucccacggugccu

SEQ ID NO: 2619011 - RNA, 13 nt, Human
gauaggcucugca

SEQ ID NO: 2619012 - RNA, 14 nt, Human
gauaggcucugcac

SEQ ID NO: 2619013 - RNA, 17 nt, Human
gauaggcucugcacaga

SEQ ID NO: 2619014 - RNA, 20 nt, Human
gauaggcucugcacagaugg

SEQ ID NO: 2619015 - RNA, 21 nt, Human
gauagggauacaugcucuuag

SEQ ID NO: 2619016 - RNA, 23 nt, Human
gauaguggggagacuucuuggcu

SEQ ID NO: 2619017 - RNA, 21 nt, Human
gauauaucaugagugaauaaa

SEQ ID NO: 2619018 - RNA, 13 nt, Human
gauauauaucaua

SEQ ID NO: 2619019 - RNA, 14 nt, Human
gauauauacauagc

SEQ ID NO: 2619020 - RNA, 18 nt, Human
gauauaugcucugcaugu

SEQ ID NO: 2619021 - RNA, 17 nt, Human
gauauauaaguguacau

SEQ ID NO: 2619022 - RNA, 15 nt, Human
gauauauaaguguac

SEQ ID NO: 2619023 - RNA, 21 nt, Human
gauauaguuuuacuuuuaaac

SEQ ID NO: 2619024 - RNA, 24 nt, Human
gauauaguuuuacuuuuaaacugu

SEQ ID NO: 2619025 - RNA, 19 nt, Human
gauauaguuuuacuuuuaa

SEQ ID NO: 2619026 - RNA, 16 nt, Human
gauauagccagaaaaa

SEQ ID NO: 2619027 - RNA, 15 nt, Human
gauauaaauaaaaca

SEQ ID NO: 2619028 - RNA, 19 nt, Human
gacuuccuguccagcucca

SEQ ID NO: 2619029 - RNA, 20 nt, Human
gacuuccuguccagcuccaa

SEQ ID NO: 2619030 - RNA, 21 nt, Human
gacuuccuguccagcuccaac

SEQ ID NO: 2619031 - RNA, 22 nt, Human
gacuuccuguccagcuccaacc

SEQ ID NO: 2619032 - RNA, 18 nt, Human
gacuuccuguccagcucc

SEQ ID NO: 2619033 - RNA, 14 nt, Human
gacuuccuugagac

SEQ ID NO: 2619034 - RNA, 14 nt, Human
gacuuccuuacuaa

SEQ ID NO: 2619035 - RNA, 21 nt, Human
gaguguguaauuuaaaauugu

SEQ ID NO: 2619036 - RNA, 22 nt, Human
gaguguguaauuuaaaauugug

SEQ ID NO: 2619037 - RNA, 16 nt, Human
gaguguguauuguucc

SEQ ID NO: 2619038 - RNA, 17 nt, Human
gaguguguauuguuccc

SEQ ID NO: 2619039 - RNA, 18 nt, Human
gaguguguauuguuccca

SEQ ID NO: 2619040 - RNA, 19 nt, Human
gacuucccacucuagggca

SEQ ID NO: 2619041 - RNA, 20 nt, Human
gacuucaguauguugucaaa

SEQ ID NO: 2619042 - RNA, 19 nt, Human
gacuucaguauguugucaa

SEQ ID NO: 2619043 - RNA, 17 nt, Human
gacuucaguauguuguc

SEQ ID NO: 2619044 - RNA, 13 nt, Human
gacuucaguaugu

SEQ ID NO: 2619045 - RNA, 24 nt, Human
gacuucaucucccaccuagcagca

SEQ ID NO: 2619046 - RNA, 21 nt, Human
gacuucaguauguugucaaag

SEQ ID NO: 2619047 - RNA, 21 nt, Human
gacuucauagauuuccuuccc

SEQ ID NO: 2619048 - RNA, 15 nt, Human
gacuucauuaauaau

SEQ ID NO: 2619049 - RNA, 16 nt, Human
gacuucauuuuuccua

SEQ ID NO: 2619050 - RNA, 15 nt, Human
gacuucauuuuuccu

SEQ ID NO: 2619051 - RNA, 16 nt, Human
gaguucaaugaucuag

SEQ ID NO: 2619052 - RNA, 15 nt, Human
gaguucaaugaucua

SEQ ID NO: 2619053 - RNA, 14 nt, Human
gaguucaaugaucu

SEQ ID NO: 2619054 - RNA, 13 nt, Human
gaguucaaugauc

SEQ ID NO: 2619055 - RNA, 12 nt, Human
gaguucaaugau

SEQ ID NO: 2619056 - RNA, 11 nt, Human
gaguucaauga

SEQ ID NO: 2619057 - RNA, 22 nt, Human
gaguucaauaaaugucuguuga

SEQ ID NO: 2619058 - RNA, 23 nt, Human
gaguuauuuuaauuaucuuuucu

SEQ ID NO: 2619059 - RNA, 11 nt, Human
gagugugugca

SEQ ID NO: 2619060 - RNA, 19 nt, Human
gaguguguauuguucccag

SEQ ID NO: 2619061 - RNA, 21 nt, Human
gaguguguccaagugugugug

SEQ ID NO: 2619062 - RNA, 19 nt, Human
gagugugugcaugugugug

SEQ ID NO: 2619063 - RNA, 17 nt, Human
gaguguguuugucaccg

SEQ ID NO: 2619064 - RNA, 19 nt, Human
gaguguuccccuuccacug

SEQ ID NO: 2619065 - RNA, 15 nt, Human
gaguucucagggcuc

SEQ ID NO: 2619066 - RNA, 14 nt, Human
gaguucucagggcu

SEQ ID NO: 2619067 - RNA, 13 nt, Human
gaguucucagggc

SEQ ID NO: 2619068 - RNA, 14 nt, Human
gaguucaguuuuac

SEQ ID NO: 2619069 - RNA, 11 nt, Human
gaguucuacau

SEQ ID NO: 2619070 - RNA, 19 nt, Human
gaguucgagaccagccugg

SEQ ID NO: 2619071 - RNA, 20 nt, Human
gaguucgagaccagccuggc

SEQ ID NO: 2619072 - RNA, 21 nt, Human
gaguucgagaccagccuggcc

SEQ ID NO: 2619073 - RNA, 19 nt, Human
gaguucgaggcugcaguca

SEQ ID NO: 2619074 - RNA, 15 nt, Human
gaguucaauggcugc

SEQ ID NO: 2619075 - RNA, 21 nt, Human
gaguucaaugaucuagguuua

SEQ ID NO: 2619076 - RNA, 19 nt, Human
gaguucaaugaucuagguu

SEQ ID NO: 2619077 - RNA, 18 nt, Human
gaguucaaugaucuaggu

SEQ ID NO: 2619078 - RNA, 19 nt, Human
gaguucaauggcugcugaa

SEQ ID NO: 2619079 - RNA, 16 nt, Human
gaguucaauggcugcu

SEQ ID NO: 2619080 - RNA, 22 nt, Human
gaguucacuucaucuucucagc

SEQ ID NO: 2619081 - RNA, 19 nt, Human
gaguucagguagcugcccc

SEQ ID NO: 2619082 - RNA, 21 nt, Human
gaguucagguagcugccccug

SEQ ID NO: 2619083 - RNA, 22 nt, Human
gaguucagguagcugccccugg

SEQ ID NO: 2619084 - RNA, 18 nt, Human
gaguucgagaccagccug

SEQ ID NO: 2619085 - RNA, 16 nt, Human
gauaauaauauauguu

SEQ ID NO: 2619086 - RNA, 12 nt, Human
gauaauacacca

SEQ ID NO: 2619087 - RNA, 23 nt, Human
gauaauacaccacuacauucugu

SEQ ID NO: 2619088 - RNA, 24 nt, Human
gauaauacaccacuacauucuguu

SEQ ID NO: 2619089 - RNA, 23 nt, Human
gauaaguucuuaugccauguuaa

SEQ ID NO: 2619090 - RNA, 15 nt, Human
gauaaccagcuguaa

SEQ ID NO: 2619091 - RNA, 16 nt, Human
gauaacagcacugacu

SEQ ID NO: 2619092 - RNA, 17 nt, Human
gauaaccuauaugauuu

SEQ ID NO: 2619093 - RNA, 23 nt, Human
gauaaccuauaugauuuauaguu

SEQ ID NO: 2619094 - RNA, 21 nt, Human
gauaaccuguacuucaaguua

SEQ ID NO: 2619095 - RNA, 13 nt, Human
gauaacuagaugg

SEQ ID NO: 2619096 - RNA, 22 nt, Human
gauaaccuguacuucaaguuaa

SEQ ID NO: 2619097 - RNA, 22 nt, Human
gauaaaauuauagaugggaaug

SEQ ID NO: 2619098 - RNA, 19 nt, Human
gauaaaauuauagauggga

SEQ ID NO: 2619099 - RNA, 18 nt, Human
gauaaaaugagguucaac

SEQ ID NO: 2619100 - RNA, 15 nt, Human
gauaaagauaucaau

SEQ ID NO: 2619101 - RNA, 11 nt, Human
gauaaagauga

SEQ ID NO: 2619102 - RNA, 17 nt, Human
gauaacaaccuggagac

SEQ ID NO: 2619103 - RNA, 13 nt, Human
gauaacagcacug

SEQ ID NO: 2619104 - RNA, 16 nt, Human
gauaacaaccuggaga

SEQ ID NO: 2619105 - RNA, 15 nt, Human
gauaacaagaucuuu

SEQ ID NO: 2619106 - RNA, 13 nt, Human
gauaaauuauaag

SEQ ID NO: 2619107 - RNA, 12 nt, Human
gauaaauuauaa

SEQ ID NO: 2619108 - RNA, 16 nt, Human
gauaaauuccacugga

SEQ ID NO: 2619109 - RNA, 13 nt, Human
gauaaacaguagu

SEQ ID NO: 2619110 - RNA, 14 nt, Human
gauaaaauaaauga

SEQ ID NO: 2619111 - RNA, 13 nt, Human
gaguucugguucc

SEQ ID NO: 2619112 - RNA, 20 nt, Human
gaguucucagggcuccugcc

SEQ ID NO: 2619113 - RNA, 19 nt, Human
gaguucucagggcuccugc

SEQ ID NO: 2619114 - RNA, 18 nt, Human
gaguucucagggcuccug

SEQ ID NO: 2619115 - RNA, 16 nt, Human
gaguucucagggcucc

SEQ ID NO: 2619116 - RNA, 21 nt, Human
gaguucucagggcuccugccu

SEQ ID NO: 2619117 - RNA, 22 nt, Human
gauccuccugcagaccacgccc

SEQ ID NO: 2619118 - RNA, 12 nt, Human
gauccugagcca

SEQ ID NO: 2619119 - RNA, 16 nt, Human
gauccucccaggcuuc

SEQ ID NO: 2619120 - RNA, 23 nt, Human
gauccuagccuuauccucugauc

SEQ ID NO: 2619121 - RNA, 22 nt, Human
gauccuagccuuauccucugau

SEQ ID NO: 2619122 - RNA, 21 nt, Human
gauccuccugcagaccacgcc

SEQ ID NO: 2619123 - RNA, 16 nt, Human
gauccuccugcagacc

SEQ ID NO: 2619124 - RNA, 15 nt, Human
gauccuccugcagac

SEQ ID NO: 2619125 - RNA, 14 nt, Human
gauccuggaaauca

SEQ ID NO: 2619126 - RNA, 12 nt, Human
gauccuggaggc

SEQ ID NO: 2619127 - RNA, 15 nt, Human
gauccuggaggccca

SEQ ID NO: 2619128 - RNA, 16 nt, Human
gauccuggaggcccag

SEQ ID NO: 2619129 - RNA, 17 nt, Human
gauccuggaggcccagu

SEQ ID NO: 2619130 - RNA, 16 nt, Human
gauccugucuuuaagg

SEQ ID NO: 2619131 - RNA, 19 nt, Human
gauccugucuuuaaggaaa

SEQ ID NO: 2619132 - RNA, 20 nt, Human
gauccugucuuuaaggaaaa

SEQ ID NO: 2619133 - RNA, 12 nt, Human
gauccugugaag

SEQ ID NO: 2619134 - RNA, 17 nt, Human
gaucuaagccuuuccau

SEQ ID NO: 2619135 - RNA, 23 nt, Human
gaucuaaggaugucacagggcca

SEQ ID NO: 2619136 - RNA, 23 nt, Human
gauccuggguggucugcaggcag

SEQ ID NO: 2619137 - RNA, 18 nt, Human
gaucuaagccuuuccaua

SEQ ID NO: 2619138 - RNA, 18 nt, Human
gaucuaggaagacuuugg

SEQ ID NO: 2619139 - RNA, 14 nt, Human
gaucuaggaagacu

SEQ ID NO: 2619140 - RNA, 13 nt, Human
gaucuaggaagac

SEQ ID NO: 2619141 - RNA, 17 nt, Human
gaucuaccccuuacuua

SEQ ID NO: 2619142 - RNA, 21 nt, Human
gaucuaaggaugucacagggc

SEQ ID NO: 2619143 - RNA, 18 nt, Human
gaucuaccagcauaaaua

SEQ ID NO: 2619144 - RNA, 19 nt, Human
gaucuagguuuaacucaga

SEQ ID NO: 2619145 - RNA, 18 nt, Human
gaucuagguuuaacucag

SEQ ID NO: 2619146 - RNA, 17 nt, Human
gaucuagguuuaacuca

SEQ ID NO: 2619147 - RNA, 16 nt, Human
gaucuagguuuaacuc

SEQ ID NO: 2619148 - RNA, 21 nt, Human
gaucuagguuuaacucagauc

SEQ ID NO: 2619149 - RNA, 20 nt, Human
gaucuagguuuaacucagau

SEQ ID NO: 2619150 - RNA, 22 nt, Human
gaucuagguuuaacucagauca

SEQ ID NO: 2619151 - RNA, 15 nt, Human
gaucugguccuaccc

SEQ ID NO: 2619152 - RNA, 14 nt, Human
gaucugguuuugcu

SEQ ID NO: 2619153 - RNA, 16 nt, Human
gaucugguuugacucc

SEQ ID NO: 2619154 - RNA, 16 nt, Human
gaucugguccuaccca

SEQ ID NO: 2619155 - RNA, 20 nt, Human
gaucuaggaagacuuuggaa

SEQ ID NO: 2619156 - RNA, 22 nt, Human
gaucuagaauguguuuucugaa

SEQ ID NO: 2619157 - RNA, 21 nt, Human
gaucuagaauguguuuucuga

SEQ ID NO: 2619158 - RNA, 20 nt, Human
gaucuagaauguguuuucug

SEQ ID NO: 2619159 - RNA, 16 nt, Human
gaucuagaauguguuu

SEQ ID NO: 2619160 - RNA, 15 nt, Human
gaucuagguuuaacu

SEQ ID NO: 2619161 - RNA, 14 nt, Human
gaucuagguuuaac

SEQ ID NO: 2619162 - RNA, 15 nt, Human
gaucuaggugaggau

SEQ ID NO: 2619163 - RNA, 14 nt, Human
gaucccucucugga

SEQ ID NO: 2619164 - RNA, 23 nt, Human
gaucccucuacagagcuucccug

SEQ ID NO: 2619165 - RNA, 21 nt, Human
gaucccucccccccaugcacu

SEQ ID NO: 2619166 - RNA, 23 nt, Human
gaucccucccccccaugcacugu

SEQ ID NO: 2619167 - RNA, 14 nt, Human
gaucccucaucugu

SEQ ID NO: 2619168 - RNA, 18 nt, Human
gaucccucaucugucccu

SEQ ID NO: 2619169 - RNA, 13 nt, Human
gaucccucccccc

SEQ ID NO: 2619170 - RNA, 19 nt, Human
gaucccucccccccaugca

SEQ ID NO: 2619171 - RNA, 20 nt, Human
gaucccuguguugucucuag

SEQ ID NO: 2619172 - RNA, 19 nt, Human
gaucccuguguugucucua

SEQ ID NO: 2619173 - RNA, 18 nt, Human
gaucccuguguugucucu

SEQ ID NO: 2619174 - RNA, 14 nt, Human
gaucccuguguugu

SEQ ID NO: 2619175 - RNA, 24 nt, Human
gaucccuguguugucucuagagca

SEQ ID NO: 2619176 - RNA, 21 nt, Human
gaucccuguguugucucuaga

SEQ ID NO: 2619177 - RNA, 20 nt, Human
gaucccuguuacccagagaa

SEQ ID NO: 2619178 - RNA, 18 nt, Human
gaucccuguuacccagag

SEQ ID NO: 2619179 - RNA, 18 nt, Human
gaucauagguauuucaaa

SEQ ID NO: 2619180 - RNA, 14 nt, Human
gaucaggcucugcc

SEQ ID NO: 2619181 - RNA, 17 nt, Human
gaucauagguauuucaa

SEQ ID NO: 2619182 - RNA, 19 nt, Human
gaucauauacgugaaaauu

SEQ ID NO: 2619183 - RNA, 12 nt, Human
gaucccucaucu

SEQ ID NO: 2619184 - RNA, 13 nt, Human
gaucauccacugu

SEQ ID NO: 2619185 - RNA, 17 nt, Human
gauccucccaccucagc

SEQ ID NO: 2619186 - RNA, 14 nt, Human
gauccuccaggugc

SEQ ID NO: 2619187 - RNA, 16 nt, Human
gauccucccaccucag

SEQ ID NO: 2619188 - RNA, 18 nt, Human
gauccgacugcuuuggac

SEQ ID NO: 2619189 - RNA, 17 nt, Human
gauccgacugcuuugga

SEQ ID NO: 2619190 - RNA, 14 nt, Human
gauccgacugcuuu

SEQ ID NO: 2619191 - RNA, 20 nt, Human
gauccgacugcuuuggaccu

SEQ ID NO: 2619192 - RNA, 23 nt, Human
gauccgacuugaauuuucccacu

SEQ ID NO: 2619193 - RNA, 23 nt, Human
gauccuaaugaaugcauaaaaug

SEQ ID NO: 2619194 - RNA, 20 nt, Human
gauccuagccuuauccucug

SEQ ID NO: 2619195 - RNA, 18 nt, Human
gauccuaagggcucaccg

SEQ ID NO: 2619196 - RNA, 18 nt, Human
gauccuaggcauuugcug

SEQ ID NO: 2619197 - RNA, 23 nt, Human
gaugcaccagcccuuagcaggga

SEQ ID NO: 2619198 - RNA, 15 nt, Human
gaugcaccagcccuu

SEQ ID NO: 2619199 - RNA, 14 nt, Human
gaugagaggaaauc

SEQ ID NO: 2619200 - RNA, 14 nt, Human
gaugcaccagcccu

SEQ ID NO: 2619201 - RNA, 18 nt, Human
gaugaccuugaaugaugc

SEQ ID NO: 2619202 - RNA, 23 nt, Human
gaugagaaauaaaguuucuguug

SEQ ID NO: 2619203 - RNA, 20 nt, Human
gaugaccuugaaugaugcca

SEQ ID NO: 2619204 - RNA, 15 nt, Human
gaugaccuggauaac

SEQ ID NO: 2619205 - RNA, 18 nt, Human
gaugagagcccagaggua

SEQ ID NO: 2619206 - RNA, 17 nt, Human
gaugagagcccagaggu

SEQ ID NO: 2619207 - RNA, 15 nt, Human
gaugagagcccagag

SEQ ID NO: 2619208 - RNA, 14 nt, Human
gaugagagcccaga

SEQ ID NO: 2619209 - RNA, 23 nt, Human
gaugagacuuccaaaccugacag

SEQ ID NO: 2619210 - RNA, 14 nt, Human
gaugagaagagggg

SEQ ID NO: 2619211 - RNA, 14 nt, Human
gaugcagggcaguc

SEQ ID NO: 2619212 - RNA, 22 nt, Human
gaugcaggugagcccauggccc

SEQ ID NO: 2619213 - RNA, 15 nt, Human
gaugcagggcaguca

SEQ ID NO: 2619214 - RNA, 21 nt, Human
gaugagagcccagagguaaca

SEQ ID NO: 2619215 - RNA, 16 nt, Human
gaugagaggaaaucac

SEQ ID NO: 2619216 - RNA, 16 nt, Human
gaugccugguggcagc

SEQ ID NO: 2619217 - RNA, 15 nt, Human
gaugccugguggcag

SEQ ID NO: 2619218 - RNA, 14 nt, Human
gaugccugguggca

SEQ ID NO: 2619219 - RNA, 14 nt, Human
gaugcagugcuucc

SEQ ID NO: 2619220 - RNA, 21 nt, Human
gaugaaaugaggucagagccu

SEQ ID NO: 2619221 - RNA, 15 nt, Human
gaugaaaugagguca

SEQ ID NO: 2619222 - RNA, 19 nt, Human
gaucuugagcaaguuccuu

SEQ ID NO: 2619223 - RNA, 19 nt, Human
gaucuucuuuauaauucua

SEQ ID NO: 2619224 - RNA, 15 nt, Human
gaucuguccucagcc

SEQ ID NO: 2619225 - RNA, 16 nt, Human
gaucuguccucagccu

SEQ ID NO: 2619226 - RNA, 17 nt, Human
gaucuguccucagccuu

SEQ ID NO: 2619227 - RNA, 18 nt, Human
gaucuguccucagccuug

SEQ ID NO: 2619228 - RNA, 22 nt, Human
gaucuucuguggguuucuaaag

SEQ ID NO: 2619229 - RNA, 19 nt, Human
gaucugucacaccagccau

SEQ ID NO: 2619230 - RNA, 18 nt, Human
gaucugucacaccagcca

SEQ ID NO: 2619231 - RNA, 17 nt, Human
gaucugucacaccagcc

SEQ ID NO: 2619232 - RNA, 24 nt, Human
gaucugguuuugcuauuagacugu

SEQ ID NO: 2619233 - RNA, 15 nt, Human
gaucuguccaaggaa

SEQ ID NO: 2619234 - RNA, 20 nt, Human
gaucugucacaccagccaua

SEQ ID NO: 2619235 - RNA, 14 nt, Human
gaucuguccucagc

SEQ ID NO: 2619236 - RNA, 18 nt, Human
gaucugguuuugcuauua

SEQ ID NO: 2619237 - RNA, 16 nt, Human
gaucugguuuugcuau

SEQ ID NO: 2619238 - RNA, 15 nt, Human
gaucuguauauacaa

SEQ ID NO: 2619239 - RNA, 20 nt, Human
gaucuguauauacaauaaca

SEQ ID NO: 2619240 - RNA, 16 nt, Human
gaucugucacaccagc

SEQ ID NO: 2619241 - RNA, 18 nt, Human
gaugaccagaacaagguu

SEQ ID NO: 2619242 - RNA, 23 nt, Human
gaugacccugcgaaggggcccug

SEQ ID NO: 2619243 - RNA, 17 nt, Human
gaugaccccuccccuaa

SEQ ID NO: 2619244 - RNA, 16 nt, Human
gaugaccccuccccua

SEQ ID NO: 2619245 - RNA, 13 nt, Human
gaugaccagaaca

SEQ ID NO: 2619246 - RNA, 12 nt, Human
gaugaccccucc

SEQ ID NO: 2619247 - RNA, 16 nt, Human
gaugaaugccguggau

SEQ ID NO: 2619248 - RNA, 15 nt, Human
gaugaaugccgugga

SEQ ID NO: 2619249 - RNA, 14 nt, Human
gaugaauguaugug

SEQ ID NO: 2619250 - RNA, 13 nt, Human
gaugaauguaugu

SEQ ID NO: 2619251 - RNA, 14 nt, Human
gaugaauguauuua

SEQ ID NO: 2619252 - RNA, 16 nt, Human
gaugaauuaaauuuaa

SEQ ID NO: 2619253 - RNA, 19 nt, Human
gaugacaaauggagaagaa

SEQ ID NO: 2619254 - RNA, 20 nt, Human
gaugacaaaaauucaacuca

SEQ ID NO: 2619255 - RNA, 22 nt, Human
gaugaaguuuuacauuguugag

SEQ ID NO: 2619256 - RNA, 23 nt, Human
gaugaaguuuuacauuguugagc

SEQ ID NO: 2619257 - RNA, 17 nt, Human
gaugaaguuuuacauug

SEQ ID NO: 2619258 - RNA, 13 nt, Human
gaugaaugagaau

SEQ ID NO: 2619259 - RNA, 19 nt, Human
gaugaaugaggucccaggc

SEQ ID NO: 2619260 - RNA, 23 nt, Human
gaugaaugaggucccaggcagag

SEQ ID NO: 2619261 - RNA, 15 nt, Human
gaugaaugauaaacu

SEQ ID NO: 2619262 - RNA, 13 nt, Human
gaucuuuaaaaua

SEQ ID NO: 2619263 - RNA, 16 nt, Human
gaugaaauguaaauac

SEQ ID NO: 2619264 - RNA, 23 nt, Human
gaugaaauuuucuagacuuucug

SEQ ID NO: 2619265 - RNA, 19 nt, Human
gaucuuggcuuacugcagc

SEQ ID NO: 2619266 - RNA, 23 nt, Human
gaugaacccaggacgcuucugaa

SEQ ID NO: 2619267 - RNA, 22 nt, Human
gaugaacccaggacgcuucuga

SEQ ID NO: 2619268 - RNA, 13 nt, Human
gaugaacccagga

SEQ ID NO: 2619269 - RNA, 19 nt, Human
gauucauuuuuaaucauga

SEQ ID NO: 2619270 - RNA, 18 nt, Human
gauuccaaagaguagaau

SEQ ID NO: 2619271 - RNA, 19 nt, Human
gauuccaaagaguagaauu

SEQ ID NO: 2619272 - RNA, 23 nt, Human
gauuccaaagaguagaauugcau

SEQ ID NO: 2619273 - RNA, 15 nt, Human
gauucccaagcucug

SEQ ID NO: 2619274 - RNA, 21 nt, Human
gauucauuuccugcccuuccu

SEQ ID NO: 2619275 - RNA, 16 nt, Human
gauucauuuccugccc

SEQ ID NO: 2619276 - RNA, 13 nt, Human
gauucauuuccug

SEQ ID NO: 2619277 - RNA, 10 nt, Human
gauucauuuu

SEQ ID NO: 2619278 - RNA, 23 nt, Human
gauucauuuccugcccuuccuca

SEQ ID NO: 2619279 - RNA, 19 nt, Human
gauucauuuuaacaucuga

SEQ ID NO: 2619280 - RNA, 23 nt, Human
gauucaucucucagaagggaggc

SEQ ID NO: 2619281 - RNA, 21 nt, Human
gauucaugccaauuagcaauu

SEQ ID NO: 2619282 - RNA, 11 nt, Human
gauucaugugg

SEQ ID NO: 2619283 - RNA, 17 nt, Human
gauucagguauguugcc

SEQ ID NO: 2619284 - RNA, 20 nt, Human
gauucaguguuaaaugugau

SEQ ID NO: 2619285 - RNA, 15 nt, Human
gauucaguuuucauu

SEQ ID NO: 2619286 - RNA, 22 nt, Human
gauucaguuuucauuugguuca

SEQ ID NO: 2619287 - RNA, 22 nt, Human
gauucaucucucagaagggagg

SEQ ID NO: 2619288 - RNA, 16 nt, Human
gauucauaguaacuuc

SEQ ID NO: 2619289 - RNA, 13 nt, Human
gauucaggaaugu

SEQ ID NO: 2619290 - RNA, 12 nt, Human
gauucaggcugc

SEQ ID NO: 2619291 - RNA, 13 nt, Human
gauucaggcugcu

SEQ ID NO: 2619292 - RNA, 16 nt, Human
gauucaggcugcuugg

SEQ ID NO: 2619293 - RNA, 18 nt, Human
gauucagacagcugccug

SEQ ID NO: 2619294 - RNA, 17 nt, Human
gauucagacagcugccu

SEQ ID NO: 2619295 - RNA, 14 nt, Human
gauucagacagcug

SEQ ID NO: 2619296 - RNA, 13 nt, Human
gauucagacagcu

SEQ ID NO: 2619297 - RNA, 21 nt, Human
gauuacaagcgugagccacug

SEQ ID NO: 2619298 - RNA, 13 nt, Human
gauuacaagcgug

SEQ ID NO: 2619299 - RNA, 15 nt, Human
gauuaauuaaaugca

SEQ ID NO: 2619300 - RNA, 12 nt, Human
gauguuuccaga

SEQ ID NO: 2619301 - RNA, 13 nt, Human
gauguuuccagac

SEQ ID NO: 2619302 - RNA, 19 nt, Human
gauguuuccagacuuccuu

SEQ ID NO: 2619303 - RNA, 14 nt, Human
gauguucuggcccu

SEQ ID NO: 2619304 - RNA, 23 nt, Human
gauguuucuuuuguauguaaaug

SEQ ID NO: 2619305 - RNA, 20 nt, Human
gauguuucuuuuguauguaa

SEQ ID NO: 2619306 - RNA, 19 nt, Human
gauguuucuuuuguaugua

SEQ ID NO: 2619307 - RNA, 18 nt, Human
gauguuucuuuuguaugu

SEQ ID NO: 2619308 - RNA, 13 nt, Human
gauguuuguggcc

SEQ ID NO: 2619309 - RNA, 14 nt, Human
gauguuuguggccu

SEQ ID NO: 2619310 - RNA, 15 nt, Human
gauguuuguggccuc

SEQ ID NO: 2619311 - RNA, 16 nt, Human
gauguuuguggccuca

SEQ ID NO: 2619312 - RNA, 17 nt, Human
gauguuuguggccucag

SEQ ID NO: 2619313 - RNA, 14 nt, Human
gauuaaguaaugau

SEQ ID NO: 2619314 - RNA, 18 nt, Human
gauguuuguggccucaga

SEQ ID NO: 2619315 - RNA, 22 nt, Human
gauuaaguaaugauaacuggaa

SEQ ID NO: 2619316 - RNA, 19 nt, Human
gauuaauccagaauaacua

SEQ ID NO: 2619317 - RNA, 15 nt, Human
gauuaauccagaaua

SEQ ID NO: 2619318 - RNA, 18 nt, Human
gauuaauaugaaaacuua

SEQ ID NO: 2619319 - RNA, 14 nt, Human
gauuaauaugaaaa

SEQ ID NO: 2619320 - RNA, 18 nt, Human
gauuaauauggggaugca

SEQ ID NO: 2619321 - RNA, 16 nt, Human
gaugcuagaacucccu

SEQ ID NO: 2619322 - RNA, 14 nt, Human
gaugcgcacugcau

SEQ ID NO: 2619323 - RNA, 22 nt, Human
gaugcagugcucgcuguugcug

SEQ ID NO: 2619324 - RNA, 20 nt, Human
gaugccugugaacugaacuc

SEQ ID NO: 2619325 - RNA, 17 nt, Human
gaugccugguggcagcu

SEQ ID NO: 2619326 - RNA, 18 nt, Human
gauguucuagcauggcug

SEQ ID NO: 2619327 - RNA, 21 nt, Human
gauguucucuaucauuuaaua

SEQ ID NO: 2619328 - RNA, 19 nt, Human
gauguucucuaucauuuaa

SEQ ID NO: 2619329 - RNA, 15 nt, Human
gauguucucuaucau

SEQ ID NO: 2619330 - RNA, 21 nt, Human
gaugcgguggcucacgccugu

SEQ ID NO: 2619331 - RNA, 16 nt, Human
gaugcgguggcucacg

SEQ ID NO: 2619332 - RNA, 19 nt, Human
gauguucuaagucuuucca

SEQ ID NO: 2619333 - RNA, 22 nt, Human
gauucuuuccugaggcugggcu

SEQ ID NO: 2619334 - RNA, 20 nt, Human
gauucuuuccugaggcuggg

SEQ ID NO: 2619335 - RNA, 19 nt, Human
gauugaaaacuuuucucag

SEQ ID NO: 2619336 - RNA, 15 nt, Human
gauugaaaacuuuuc

SEQ ID NO: 2619337 - RNA, 14 nt, Human
gauugaaaacuuuu

SEQ ID NO: 2619338 - RNA, 20 nt, Human
gauuccacuacaccuggcug

SEQ ID NO: 2619339 - RNA, 17 nt, Human
gauuccacuacaccugg

SEQ ID NO: 2619340 - RNA, 20 nt, Human
gauucuuuuuaaaguguuuc

SEQ ID NO: 2619341 - RNA, 16 nt, Human
gauugcaacaggcugg

SEQ ID NO: 2619342 - RNA, 19 nt, Human
gauucuuuccugaggcugg

SEQ ID NO: 2619343 - RNA, 20 nt, Human
gauuccaaguucucaccucu

SEQ ID NO: 2619344 - RNA, 22 nt, Human
gauuccaaccccaacuccagua

SEQ ID NO: 2619345 - RNA, 17 nt, Human
gauuccaaccccaacuc

SEQ ID NO: 2619346 - RNA, 17 nt, Human
gauucccaagcucugcu

SEQ ID NO: 2619347 - RNA, 16 nt, Human
gauucccaagcucugc

SEQ ID NO: 2619348 - RNA, 12 nt, Human
gauuggcucacc

SEQ ID NO: 2619349 - RNA, 20 nt, Human
gauuggcucacacugagaau

SEQ ID NO: 2619350 - RNA, 18 nt, Human
gauuggcucacacugaga

SEQ ID NO: 2619351 - RNA, 17 nt, Human
gauuggcucacacugag

SEQ ID NO: 2619352 - RNA, 22 nt, Human
gauugcugccacuuuuuaacua

SEQ ID NO: 2619353 - RNA, 14 nt, Human
gauugcuuaaaaua

SEQ ID NO: 2619354 - RNA, 21 nt, Human
gauugcugccccaucagugcu

SEQ ID NO: 2619355 - RNA, 17 nt, Human
gauugcuuaaaauagca

SEQ ID NO: 2619356 - RNA, 18 nt, Human
gauugcuuaaaauagcaa

SEQ ID NO: 2619357 - RNA, 16 nt, Human
gauugcuugagcccag

SEQ ID NO: 2619358 - RNA, 19 nt, Human
gauugcuugagcccaggag

SEQ ID NO: 2619359 - RNA, 18 nt, Human
gauugcaacaggcugggc

SEQ ID NO: 2619360 - RNA, 17 nt, Human
gauugcaacaggcuggg

SEQ ID NO: 2619361 - RNA, 16 nt, Human
gauugcugccacuuuu

SEQ ID NO: 2619362 - RNA, 13 nt, Human
gauugcugccacu

SEQ ID NO: 2619363 - RNA, 18 nt, Human
gauugcugauaauaaauu

SEQ ID NO: 2619364 - RNA, 16 nt, Human
gauugcugccccauca

SEQ ID NO: 2619365 - RNA, 20 nt, Human
gauugcugccccaucagugc

SEQ ID NO: 2619366 - RNA, 15 nt, Human
gauugcaacaggcug

SEQ ID NO: 2619367 - RNA, 20 nt, Human
gauugcuaaauguaacaguc

SEQ ID NO: 2619368 - RNA, 16 nt, Human
gauugcuaaauguaac

SEQ ID NO: 2619369 - RNA, 15 nt, Human
gauugcuaugaauga

SEQ ID NO: 2619370 - RNA, 22 nt, Human
gauuucuguuuagauaauacac

SEQ ID NO: 2619371 - RNA, 21 nt, Human
gauuucuguuuagauaauaca

SEQ ID NO: 2619372 - RNA, 18 nt, Human
gauuucaugcuaucucug

SEQ ID NO: 2619373 - RNA, 20 nt, Human
gauuucaugcuaucucugug

SEQ ID NO: 2619374 - RNA, 16 nt, Human
gauuucaugcuaucuc

SEQ ID NO: 2619375 - RNA, 13 nt, Human
gauuucaugauuu

SEQ ID NO: 2619376 - RNA, 20 nt, Human
gauuucauuucaacuguuug

SEQ ID NO: 2619377 - RNA, 17 nt, Human
gauuucuuuccagaggg

SEQ ID NO: 2619378 - RNA, 15 nt, Human
gauuucuuuccagag

SEQ ID NO: 2619379 - RNA, 11 nt, Human
gauuucuuucc

SEQ ID NO: 2619380 - RNA, 15 nt, Human
gauuuccagccaggg

SEQ ID NO: 2619381 - RNA, 21 nt, Human
gauuucauuucaacuguuugc

SEQ ID NO: 2619382 - RNA, 22 nt, Human
gauuugaacucagaucugucug

SEQ ID NO: 2619383 - RNA, 16 nt, Human
gauuugaacucagauc

SEQ ID NO: 2619384 - RNA, 13 nt, Human
gauuugaacucag

SEQ ID NO: 2619385 - RNA, 19 nt, Human
gauuuguuaaugauagcua

SEQ ID NO: 2619386 - RNA, 23 nt, Human
gauugggaauaaauaugccucuc

SEQ ID NO: 2619387 - RNA, 15 nt, Human
gauugggaauaaaua

SEQ ID NO: 2619388 - RNA, 16 nt, Human
gauuggcuuuaaacac

SEQ ID NO: 2619389 - RNA, 19 nt, Human
gauuggcuuguguguuuca

SEQ ID NO: 2619390 - RNA, 18 nt, Human
gauuggcuuguguguuuc

SEQ ID NO: 2619391 - RNA, 18 nt, Human
gauuggcucacccaagca

SEQ ID NO: 2619392 - RNA, 22 nt, Human
gauuggcucacccaagcaaggc

SEQ ID NO: 2619393 - RNA, 16 nt, Human
gauugggaauccgccc

SEQ ID NO: 2619394 - RNA, 13 nt, Human
gauugggacagag

SEQ ID NO: 2619395 - RNA, 15 nt, Human
gauugggccccugcc

SEQ ID NO: 2619396 - RNA, 13 nt, Human
gauuguucaucau

SEQ ID NO: 2619397 - RNA, 16 nt, Human
gauuguuaaaauaacu

SEQ ID NO: 2619398 - RNA, 18 nt, Human
gauuguucgggugugcaa

SEQ ID NO: 2619399 - RNA, 21 nt, Human
gauuguuaagucuaaauauuu

SEQ ID NO: 2619400 - RNA, 15 nt, Human
gauuuaaaagggaag

SEQ ID NO: 2619401 - RNA, 15 nt, Human
gauuuaaaacaugua

SEQ ID NO: 2619402 - RNA, 18 nt, Human
gauuguuuuaucaugaca

SEQ ID NO: 2619403 - RNA, 12 nt, Human
gauuguuuuauc

SEQ ID NO: 2619404 - RNA, 13 nt, Human
gauuguuguuugc

SEQ ID NO: 2619405 - RNA, 17 nt, Human
gauuguuugcucugaga

SEQ ID NO: 2619406 - RNA, 22 nt, Human
gauuucaucugcucuccuuccu

SEQ ID NO: 2619407 - RNA, 21 nt, Human
gauuucaucugcucuccuucc

SEQ ID NO: 2619408 - RNA, 20 nt, Human
gauuucaucugcucuccuuc

SEQ ID NO: 2619409 - RNA, 17 nt, Human
gauuucaucugcucucc

SEQ ID NO: 2619410 - RNA, 17 nt, Human
gcaauccugcaagaaca

SEQ ID NO: 2619411 - RNA, 14 nt, Human
gcaauccugucuuu

SEQ ID NO: 2619412 - RNA, 21 nt, Human
gcaaucguaauguacagaugg

SEQ ID NO: 2619413 - RNA, 21 nt, Human
gcaaucuauuaauagcugccu

SEQ ID NO: 2619414 - RNA, 14 nt, Human
gcaaugaacacuua

SEQ ID NO: 2619415 - RNA, 17 nt, Human
gcaaugaagucucugaa

SEQ ID NO: 2619416 - RNA, 19 nt, Human
gcaaugaagucucugaagu

SEQ ID NO: 2619417 - RNA, 18 nt, Human
gcaaugacagguaaauua

SEQ ID NO: 2619418 - RNA, 15 nt, Human
gcaaugaaaaauucu

SEQ ID NO: 2619419 - RNA, 19 nt, Human
gcaaucucggcucauugaa

SEQ ID NO: 2619420 - RNA, 23 nt, Human
gcaaucuauuaauagcugccuua

SEQ ID NO: 2619421 - RNA, 16 nt, Human
gcaaugaaaaauucuc

SEQ ID NO: 2619422 - RNA, 18 nt, Human
gcaagguccggcccaucc

SEQ ID NO: 2619423 - RNA, 19 nt, Human
gcaaggucuggccucaggu

SEQ ID NO: 2619424 - RNA, 22 nt, Human
gcaaggucuggccucagguggg

SEQ ID NO: 2619425 - RNA, 21 nt, Human
gcaaggugcucacaccccauu

SEQ ID NO: 2619426 - RNA, 14 nt, Human
gcaaggugcucaca

SEQ ID NO: 2619427 - RNA, 20 nt, Human
gcaagguggcuccagcacca

SEQ ID NO: 2619428 - RNA, 20 nt, Human
gcaagguuuaggcugguggc

SEQ ID NO: 2619429 - RNA, 21 nt, Human
gcaagguuuaggcugguggcc

SEQ ID NO: 2619430 - RNA, 22 nt, Human
gcaagguuuaggcugguggccc

SEQ ID NO: 2619431 - RNA, 24 nt, Human
gcaagguuuaggcugguggcccag

SEQ ID NO: 2619432 - RNA, 23 nt, Human
gcaagguuuaggcugguggccca

SEQ ID NO: 2619433 - RNA, 14 nt, Human
gcaaguaugugagu

SEQ ID NO: 2619434 - RNA, 18 nt, Human
gcaaguaugugagugugu

SEQ ID NO: 2619435 - RNA, 23 nt, Human
gcaaguauguuuuagcauguguu

SEQ ID NO: 2619436 - RNA, 18 nt, Human
gcaaggcugucaauuaca

SEQ ID NO: 2619437 - RNA, 14 nt, Human
gcaaggcugucaau

SEQ ID NO: 2619438 - RNA, 14 nt, Human
gcaaggucauuuuu

SEQ ID NO: 2619439 - RNA, 18 nt, Human
gcaaggcugugcucccug

SEQ ID NO: 2619440 - RNA, 13 nt, Human
gcaaggcugugcu

SEQ ID NO: 2619441 - RNA, 12 nt, Human
gcaagggacugu

SEQ ID NO: 2619442 - RNA, 21 nt, Human
gcaagggaauuucuucaacuc

SEQ ID NO: 2619443 - RNA, 12 nt, Human
gcaaggcugugc

SEQ ID NO: 2619444 - RNA, 21 nt, Human
gcaaggacacagaugaaacac

SEQ ID NO: 2619445 - RNA, 20 nt, Human
gcaaggaccaggacucccuc

SEQ ID NO: 2619446 - RNA, 15 nt, Human
gcaaggaaggaaaga

SEQ ID NO: 2619447 - RNA, 13 nt, Human
gcaaggaaggaaa

SEQ ID NO: 2619448 - RNA, 14 nt, Human
gcaaggaaggaaag

SEQ ID NO: 2619449 - RNA, 14 nt, Human
gcaaggaccaggac

SEQ ID NO: 2619450 - RNA, 15 nt, Human
gcaaggaccaggacu

SEQ ID NO: 2619451 - RNA, 13 nt, Human
gcaaggcugucaa

SEQ ID NO: 2619452 - RNA, 16 nt, Human
gcaaggaaaaacaggu

SEQ ID NO: 2619453 - RNA, 17 nt, Human
gcaagcuuggcuguaga

SEQ ID NO: 2619454 - RNA, 21 nt, Human
gcaagcuuggcuguagaagga

SEQ ID NO: 2619455 - RNA, 22 nt, Human
gcaagcuuggcuguagaaggag

SEQ ID NO: 2619456 - RNA, 13 nt, Human
gcaagcuggguaa

SEQ ID NO: 2619457 - RNA, 13 nt, Human
gcaagauauuuau

SEQ ID NO: 2619458 - RNA, 21 nt, Human
gcaagcacugcaugggcaagc

SEQ ID NO: 2619459 - RNA, 20 nt, Human
gcaagcaccuccugccucga

SEQ ID NO: 2619460 - RNA, 18 nt, Human
gcaagcaccuccugccuc

SEQ ID NO: 2619461 - RNA, 20 nt, Human
gcaagcaauccuagguaggg

SEQ ID NO: 2619462 - RNA, 14 nt, Human
gcaagcacaucugc

SEQ ID NO: 2619463 - RNA, 18 nt, Human
gcaagcaagaaacacugg

SEQ ID NO: 2619464 - RNA, 14 nt, Human
gcaagauugcuuaa

SEQ ID NO: 2619465 - RNA, 16 nt, Human
gcaagcaccuccugcc

SEQ ID NO: 2619466 - RNA, 15 nt, Human
gcaagcaccuccugc

SEQ ID NO: 2619467 - RNA, 12 nt, Human
gcaagauguggg

SEQ ID NO: 2619468 - RNA, 16 nt, Human
gcaagauauuuauaua

SEQ ID NO: 2619469 - RNA, 16 nt, Human
gcaagaugugggcagu

SEQ ID NO: 2619470 - RNA, 18 nt, Human
gcaagauucugaaacauu

SEQ ID NO: 2619471 - RNA, 13 nt, Human
gcaagauugcuua

SEQ ID NO: 2619472 - RNA, 22 nt, Human
gcaagauuuuccacaagauucc

SEQ ID NO: 2619473 - RNA, 22 nt, Human
gcaacuuuguauaaaagggacu

SEQ ID NO: 2619474 - RNA, 15 nt, Human
gcaagauauuuauau

SEQ ID NO: 2619475 - RNA, 17 nt, Human
gcaacuuuaagcagcuc

SEQ ID NO: 2619476 - RNA, 21 nt, Human
gcaacuugucuuuuucuggac

SEQ ID NO: 2619477 - RNA, 22 nt, Human
gcaacuugucuuuuucuggacu

SEQ ID NO: 2619478 - RNA, 23 nt, Human
gcaacuugucuuuuucuggacug

SEQ ID NO: 2619479 - RNA, 21 nt, Human
gcaacuguuaugaaauaaaga

SEQ ID NO: 2619480 - RNA, 20 nt, Human
gcaacuguuaugaaauaaag

SEQ ID NO: 2619481 - RNA, 18 nt, Human
gcaacuguuaugaaauaa

SEQ ID NO: 2619482 - RNA, 12 nt, Human
gcaacuguuaug

SEQ ID NO: 2619483 - RNA, 23 nt, Human
gcaacugucuauuucugcugaau

SEQ ID NO: 2619484 - RNA, 20 nt, Human
gcaacugucuauuucugcug

SEQ ID NO: 2619485 - RNA, 19 nt, Human
gcaacugucuauuucugcu

SEQ ID NO: 2619486 - RNA, 19 nt, Human
gcaacuugucuuuuucugg

SEQ ID NO: 2619487 - RNA, 18 nt, Human
gcaacugcauuggcuuug

SEQ ID NO: 2619488 - RNA, 19 nt, Human
gcaacugaggcagacagca

SEQ ID NO: 2619489 - RNA, 21 nt, Human
gcaacugaggcagacagcagc

SEQ ID NO: 2619490 - RNA, 22 nt, Human
gcaacugaggcagacagcagcu

SEQ ID NO: 2619491 - RNA, 18 nt, Human
gcaacugagucugcggga

SEQ ID NO: 2619492 - RNA, 19 nt, Human
gcaacugaauaaauaccuc

SEQ ID NO: 2619493 - RNA, 18 nt, Human
gcaacugaauaaauaccu

SEQ ID NO: 2619494 - RNA, 13 nt, Human
gcaacugaauaaa

SEQ ID NO: 2619495 - RNA, 15 nt, Human
gcaacucuugauuau

SEQ ID NO: 2619496 - RNA, 12 nt, Human
gcaacugaauaa

SEQ ID NO: 2619497 - RNA, 21 nt, Human
gcaacugaauaaauaccucuu

SEQ ID NO: 2619498 - RNA, 13 nt, Human
gcaacugaggcag

SEQ ID NO: 2619499 - RNA, 14 nt, Human
gcaacugaggcaga

SEQ ID NO: 2619500 - RNA, 15 nt, Human
gcaacugaggcagac

SEQ ID NO: 2619501 - RNA, 12 nt, Human
gcaaaugugaau

SEQ ID NO: 2619502 - RNA, 21 nt, Human
gcaaaugucagauacaaugua

SEQ ID NO: 2619503 - RNA, 18 nt, Human
gcaaaugucaucagaacu

SEQ ID NO: 2619504 - RNA, 13 nt, Human
gcaaaugacuuug

SEQ ID NO: 2619505 - RNA, 12 nt, Human
gcaaaucuugaa

SEQ ID NO: 2619506 - RNA, 20 nt, Human
gcaaaugcccaagggaaaga

SEQ ID NO: 2619507 - RNA, 14 nt, Human
gcaaaugcccaagg

SEQ ID NO: 2619508 - RNA, 12 nt, Human
gcaaaugacuuu

SEQ ID NO: 2619509 - RNA, 11 nt, Human
gcaaaugcccu

SEQ ID NO: 2619510 - RNA, 20 nt, Human
gcaaacuuuauuuuguguuu

SEQ ID NO: 2619511 - RNA, 23 nt, Human
gcaaacuuuguaugucauuuccu

SEQ ID NO: 2619512 - RNA, 23 nt, Human
gcaaacuuggaauuuguaaccuc

SEQ ID NO: 2619513 - RNA, 15 nt, Human
gcaaagacagaagcc

SEQ ID NO: 2619514 - RNA, 16 nt, Human
gcaaagacagaagccu

SEQ ID NO: 2619515 - RNA, 17 nt, Human
gcaaagacagaagccuc

SEQ ID NO: 2619516 - RNA, 21 nt, Human
gcaaagacuauucccuucuaa

SEQ ID NO: 2619517 - RNA, 20 nt, Human
gcaaagagccagcacccuga

SEQ ID NO: 2619518 - RNA, 13 nt, Human
gcaaagaggcaag

SEQ ID NO: 2619519 - RNA, 22 nt, Human
gcaaagacuauucccuucuaac

SEQ ID NO: 2619520 - RNA, 12 nt, Human
gcaaauaaaagu

SEQ ID NO: 2619521 - RNA, 23 nt, Human
gcaaaguucccuacuuccuguga

SEQ ID NO: 2619522 - RNA, 19 nt, Human
gcaaauaauuuccuggugu

SEQ ID NO: 2619523 - RNA, 22 nt, Human
gcaaauaauuuccuggugugaa

SEQ ID NO: 2619524 - RNA, 15 nt, Human
gcaaagucuaaaguu

SEQ ID NO: 2619525 - RNA, 14 nt, Human
gcaaagucuaaagu

SEQ ID NO: 2619526 - RNA, 23 nt, Human
gcaaagucaugcaaaggcuggga

SEQ ID NO: 2619527 - RNA, 22 nt, Human
gcaaagucaugcaaaggcuggg

SEQ ID NO: 2619528 - RNA, 16 nt, Human
gcaaagucaugcaaag

SEQ ID NO: 2619529 - RNA, 21 nt, Human
gcaaagucaugcaaaggcugg

SEQ ID NO: 2619530 - RNA, 14 nt, Human
gcaaagaggcaaga

SEQ ID NO: 2619531 - RNA, 21 nt, Human
gcaaagucuaaaguuuacagu

SEQ ID NO: 2619532 - RNA, 16 nt, Human
gcaaagucuaaaguuu

SEQ ID NO: 2619533 - RNA, 22 nt, Human
gcaaagucuaaaguuuacagua

SEQ ID NO: 2619534 - RNA, 20 nt, Human
gcaaagugaagacacuggcu

SEQ ID NO: 2619535 - RNA, 17 nt, Human
gcaaagugagggccgag

SEQ ID NO: 2619536 - RNA, 21 nt, Human
gcaaaccaucauugaaaucuu

SEQ ID NO: 2619537 - RNA, 20 nt, Human
gcaaaccaucauugaaaucu

SEQ ID NO: 2619538 - RNA, 19 nt, Human
gcaaaccaucauugaaauc

SEQ ID NO: 2619539 - RNA, 17 nt, Human
gcaaaccaucauugaaa

SEQ ID NO: 2619540 - RNA, 19 nt, Human
gauuuguuuuuguauuuuu

SEQ ID NO: 2619541 - RNA, 23 nt, Human
gauuuuaaaccauaaaaagcuga

SEQ ID NO: 2619542 - RNA, 22 nt, Human
gauuuuaaagagugaaaaauga

SEQ ID NO: 2619543 - RNA, 16 nt, Human
gcaaaccaucauugaa

SEQ ID NO: 2619544 - RNA, 21 nt, Human
gauuuuaaauucacaauagaa

SEQ ID NO: 2619545 - RNA, 20 nt, Human
gauuuuaacaaaagcaagac

SEQ ID NO: 2619546 - RNA, 12 nt, Human
gauuuuaacaau

SEQ ID NO: 2619547 - RNA, 14 nt, Human
gauuuuaacaauaa

SEQ ID NO: 2619548 - RNA, 15 nt, Human
gauuuuaacaauaac

SEQ ID NO: 2619549 - RNA, 14 nt, Human
gcaaacucugcugu

SEQ ID NO: 2619550 - RNA, 13 nt, Human
gcaaacucugcug

SEQ ID NO: 2619551 - RNA, 19 nt, Human
gcaaacucacugcucaaga

SEQ ID NO: 2619552 - RNA, 19 nt, Human
gcaaacuaagcccccgcug

SEQ ID NO: 2619553 - RNA, 17 nt, Human
gcaaacgcugccugccg

SEQ ID NO: 2619554 - RNA, 17 nt, Human
gcaaacucacugcucaa

SEQ ID NO: 2619555 - RNA, 18 nt, Human
gcaaacuuuauuuugugu

SEQ ID NO: 2619556 - RNA, 14 nt, Human
gcaaacgcugccug

SEQ ID NO: 2619557 - RNA, 15 nt, Human
gcaaacgcugccugc

SEQ ID NO: 2619558 - RNA, 16 nt, Human
gcaaacgcugccugcc

SEQ ID NO: 2619559 - RNA, 18 nt, Human
gcaaacgcugccugcccg

SEQ ID NO: 2619560 - RNA, 19 nt, Human
gcaaaccugaccccugcuc

SEQ ID NO: 2619561 - RNA, 21 nt, Human
gcaaaccugaccccugcucag

SEQ ID NO: 2619562 - RNA, 14 nt, Human
gcaaacgcuaaaga

SEQ ID NO: 2619563 - RNA, 22 nt, Human
gcaaacccccuuugugcugugg

SEQ ID NO: 2619564 - RNA, 18 nt, Human
gcaaacccccuuugugcu

SEQ ID NO: 2619565 - RNA, 19 nt, Human
gcaaacccaucaacaaaaa

SEQ ID NO: 2619566 - RNA, 23 nt, Human
gauuuuaacaauaacuacugugu

SEQ ID NO: 2619567 - RNA, 17 nt, Human
gauuuuaacaauaacua

SEQ ID NO: 2619568 - RNA, 23 nt, Human
gcagagaaugaaagggcccagag

SEQ ID NO: 2619569 - RNA, 22 nt, Human
gcagagaaugaaagggcccaga

SEQ ID NO: 2619570 - RNA, 20 nt, Human
gcagaaggaaaaauguguaa

SEQ ID NO: 2619571 - RNA, 15 nt, Human
gcagaaggaaaaaug

SEQ ID NO: 2619572 - RNA, 21 nt, Human
gcagaaggaaaaauguguaau

SEQ ID NO: 2619573 - RNA, 20 nt, Human
gcagagaaucauacuuagca

SEQ ID NO: 2619574 - RNA, 13 nt, Human
gcagagacacuaa

SEQ ID NO: 2619575 - RNA, 21 nt, Human
gcagagaauucucuuauccaa

SEQ ID NO: 2619576 - RNA, 21 nt, Human
gcagagaaugaaagggcccag

SEQ ID NO: 2619577 - RNA, 20 nt, Human
gcagagaaugaaagggccca

SEQ ID NO: 2619578 - RNA, 19 nt, Human
gcagagaaugaaagggccc

SEQ ID NO: 2619579 - RNA, 13 nt, Human
gcagaaggaaaaa

SEQ ID NO: 2619580 - RNA, 23 nt, Human
gcagagucuugcuaccucaguca

SEQ ID NO: 2619581 - RNA, 15 nt, Human
gcagaguugaagaca

SEQ ID NO: 2619582 - RNA, 22 nt, Human
gcagaguccugcacaguuuucu

SEQ ID NO: 2619583 - RNA, 15 nt, Human
gcagagucuugcuac

SEQ ID NO: 2619584 - RNA, 13 nt, Human
gcagagucagcag

SEQ ID NO: 2619585 - RNA, 14 nt, Human
gcagagucagcaga

SEQ ID NO: 2619586 - RNA, 14 nt, Human
gcagagucacacgg

SEQ ID NO: 2619587 - RNA, 13 nt, Human
gcagagucacacg

SEQ ID NO: 2619588 - RNA, 23 nt, Human
gcagagucacacgggggcagcug

SEQ ID NO: 2619589 - RNA, 12 nt, Human
gcagagucagca

SEQ ID NO: 2619590 - RNA, 15 nt, Human
gcagagaccaucccu

SEQ ID NO: 2619591 - RNA, 14 nt, Human
gcagagaccauccc

SEQ ID NO: 2619592 - RNA, 17 nt, Human
gcagagaccaucccuga

SEQ ID NO: 2619593 - RNA, 17 nt, Human
gcagagacaggaccuga

SEQ ID NO: 2619594 - RNA, 15 nt, Human
gcagagacagagagg

SEQ ID NO: 2619595 - RNA, 17 nt, Human
gcagaguugaagacaga

SEQ ID NO: 2619596 - RNA, 16 nt, Human
gcagaguugaagacag

SEQ ID NO: 2619597 - RNA, 19 nt, Human
gcagaguugaagacagagc

SEQ ID NO: 2619598 - RNA, 18 nt, Human
gcagaugcaaagaggcaa

SEQ ID NO: 2619599 - RNA, 17 nt, Human
gcagaugcaaagaggca

SEQ ID NO: 2619600 - RNA, 18 nt, Human
gcagaugcagagagccau

SEQ ID NO: 2619601 - RNA, 19 nt, Human
gcagaugcaaagaggcaag

SEQ ID NO: 2619602 - RNA, 22 nt, Human
gcagaugcaaagaggcaagagg

SEQ ID NO: 2619603 - RNA, 13 nt, Human
gcagaugcaauga

SEQ ID NO: 2619604 - RNA, 17 nt, Human
gcagaugcagagagcca

SEQ ID NO: 2619605 - RNA, 15 nt, Human
gcagaugcagagagc

SEQ ID NO: 2619606 - RNA, 19 nt, Human
gcagaugcaaugacucagg

SEQ ID NO: 2619607 - RNA, 22 nt, Human
gcagauggaaugcuguguuaaa

SEQ ID NO: 2619608 - RNA, 19 nt, Human
gcagauuuugcccuugaca

SEQ ID NO: 2619609 - RNA, 18 nt, Human
gcagauggaaugcugugu

SEQ ID NO: 2619610 - RNA, 15 nt, Human
gcagaugcuggucau

SEQ ID NO: 2619611 - RNA, 18 nt, Human
gcagcacucacacaggac

SEQ ID NO: 2619612 - RNA, 16 nt, Human
gcagcacucacacagg

SEQ ID NO: 2619613 - RNA, 19 nt, Human
gcagcaccguucugugcac

SEQ ID NO: 2619614 - RNA, 17 nt, Human
gcagcaccguucugugc

SEQ ID NO: 2619615 - RNA, 18 nt, Human
gcagcaccguucugugca

SEQ ID NO: 2619616 - RNA, 22 nt, Human
gcagcacagcaaggaggcuggc

SEQ ID NO: 2619617 - RNA, 12 nt, Human
gcagcacagcaa

SEQ ID NO: 2619618 - RNA, 14 nt, Human
gcagcacagagagg

SEQ ID NO: 2619619 - RNA, 12 nt, Human
gcagcaauaaag

SEQ ID NO: 2619620 - RNA, 20 nt, Human
gcaggaccucugaaacccug

SEQ ID NO: 2619621 - RNA, 14 nt, Human
gcaggaccugccug

SEQ ID NO: 2619622 - RNA, 15 nt, Human
gcaggaccugccugu

SEQ ID NO: 2619623 - RNA, 16 nt, Human
gcaggaccugccugua

SEQ ID NO: 2619624 - RNA, 19 nt, Human
gcaggagauugagaaggag

SEQ ID NO: 2619625 - RNA, 18 nt, Human
gcaggagauugagaagga

SEQ ID NO: 2619626 - RNA, 20 nt, Human
gcaggaccugccuguagccc

SEQ ID NO: 2619627 - RNA, 14 nt, Human
gcaggagauugaga

SEQ ID NO: 2619628 - RNA, 14 nt, Human
gcaggaccaggacu

SEQ ID NO: 2619629 - RNA, 13 nt, Human
gcaggaccaggac

SEQ ID NO: 2619630 - RNA, 12 nt, Human
gcaggaccagga

SEQ ID NO: 2619631 - RNA, 15 nt, Human
gcaggaccaggacua

SEQ ID NO: 2619632 - RNA, 11 nt, Human
gcaggaccuca

SEQ ID NO: 2619633 - RNA, 14 nt, Human
gcaggaccucagag

SEQ ID NO: 2619634 - RNA, 15 nt, Human
gcaggaccucagagu

SEQ ID NO: 2619635 - RNA, 12 nt, Human
gcaggaccucug

SEQ ID NO: 2619636 - RNA, 16 nt, Human
gcaggaccucagaguc

SEQ ID NO: 2619637 - RNA, 22 nt, Human
gcaggaccucagaguccaggcc

SEQ ID NO: 2619638 - RNA, 23 nt, Human
gcaggaccucagaguccaggccc

SEQ ID NO: 2619639 - RNA, 20 nt, Human
gcagcgccaagcaaccuggg

SEQ ID NO: 2619640 - RNA, 18 nt, Human
gcagcgccaagcaaccug

SEQ ID NO: 2619641 - RNA, 13 nt, Human
gcagcgccaggcu

SEQ ID NO: 2619642 - RNA, 18 nt, Human
gcagcgcccuuccucucc

SEQ ID NO: 2619643 - RNA, 16 nt, Human
gcagcgcccuuccucu

SEQ ID NO: 2619644 - RNA, 14 nt, Human
gcagcgccaggcug

SEQ ID NO: 2619645 - RNA, 21 nt, Human
gcagcgcccuuccucuccacc

SEQ ID NO: 2619646 - RNA, 19 nt, Human
gcagcgcccuuccucucca

SEQ ID NO: 2619647 - RNA, 22 nt, Human
gcagcgaccgcccccuccucua

SEQ ID NO: 2619648 - RNA, 18 nt, Human
gcagcgaccgcccccucc

SEQ ID NO: 2619649 - RNA, 17 nt, Human
gcagcgaccgcccccuc

SEQ ID NO: 2619650 - RNA, 16 nt, Human
gcagcgaccgcccccu

SEQ ID NO: 2619651 - RNA, 22 nt, Human
gcagcgagcuaugaucgcgcca

SEQ ID NO: 2619652 - RNA, 15 nt, Human
gcagcgccaagcaac

SEQ ID NO: 2619653 - RNA, 24 nt, Human
gcagcgaguuguggaaagccucug

SEQ ID NO: 2619654 - RNA, 21 nt, Human
gcaggaguuucguuuucaaaa

SEQ ID NO: 2619655 - RNA, 20 nt, Human
gcaggaguuucguuuucaaa

SEQ ID NO: 2619656 - RNA, 20 nt, Human
gcaggaggaggugccaacag

SEQ ID NO: 2619657 - RNA, 18 nt, Human
gcaggagggcccuaccug

SEQ ID NO: 2619658 - RNA, 22 nt, Human
gcaggagggcccuaccugauug

SEQ ID NO: 2619659 - RNA, 15 nt, Human
gcaggaggaggugcc

SEQ ID NO: 2619660 - RNA, 14 nt, Human
gcaggaggaggugc

SEQ ID NO: 2619661 - RNA, 11 nt, Human
gcaggaggaag

SEQ ID NO: 2619662 - RNA, 13 nt, Human
gcaggaggaggug

SEQ ID NO: 2619663 - RNA, 23 nt, Human
gcaggagauugagaaggagagaa

SEQ ID NO: 2619664 - RNA, 13 nt, Human
gcaggagcaguau

SEQ ID NO: 2619665 - RNA, 17 nt, Human
gcaggagcaguaucaug

SEQ ID NO: 2619666 - RNA, 22 nt, Human
gcaggagcaguaucaugaagcc

SEQ ID NO: 2619667 - RNA, 14 nt, Human
gcaggagccugagc

SEQ ID NO: 2619668 - RNA, 22 nt, Human
gcaggagauugagaaggagaga

SEQ ID NO: 2619669 - RNA, 21 nt, Human
gcaggagauugagaaggagag

SEQ ID NO: 2619670 - RNA, 14 nt, Human
gcagccuggacccu

SEQ ID NO: 2619671 - RNA, 23 nt, Human
gcagccugcgccaccgcccagag

SEQ ID NO: 2619672 - RNA, 18 nt, Human
gcagccuggacauagaga

SEQ ID NO: 2619673 - RNA, 22 nt, Human
gcagcgaccaccccugccucca

SEQ ID NO: 2619674 - RNA, 20 nt, Human
gcagcgaccaccccugccuc

SEQ ID NO: 2619675 - RNA, 14 nt, Human
gcagcgaccgcccc

SEQ ID NO: 2619676 - RNA, 16 nt, Human
gcagcgaccaccccug

SEQ ID NO: 2619677 - RNA, 15 nt, Human
gcagcgaccaccccu

SEQ ID NO: 2619678 - RNA, 14 nt, Human
gcagcgaccacccc

SEQ ID NO: 2619679 - RNA, 13 nt, Human
gcagcgaccaccc

SEQ ID NO: 2619680 - RNA, 12 nt, Human
gcagccuggagg

SEQ ID NO: 2619681 - RNA, 13 nt, Human
gcagccuggaggc

SEQ ID NO: 2619682 - RNA, 22 nt, Human
gcagccucaaccuccugggcua

SEQ ID NO: 2619683 - RNA, 21 nt, Human
gcagccucaaccuccugggcu

SEQ ID NO: 2619684 - RNA, 18 nt, Human
gcagccguuugagaagaa

SEQ ID NO: 2619685 - RNA, 22 nt, Human
gcagccguuugagaagaaaaca

SEQ ID NO: 2619686 - RNA, 18 nt, Human
gcagccgugccuucagcu

SEQ ID NO: 2619687 - RNA, 12 nt, Human
gcagcagggcua

SEQ ID NO: 2619688 - RNA, 17 nt, Human
gcagcagggcuacccug

SEQ ID NO: 2619689 - RNA, 15 nt, Human
gcagcagggaugccc

SEQ ID NO: 2619690 - RNA, 17 nt, Human
gcagcagggaugcccug

SEQ ID NO: 2619691 - RNA, 19 nt, Human
gcagcagggaugcccugga

SEQ ID NO: 2619692 - RNA, 20 nt, Human
gcagcagggaugcccuggag

SEQ ID NO: 2619693 - RNA, 19 nt, Human
gcagcacucacacaggacc

SEQ ID NO: 2619694 - RNA, 12 nt, Human
gcagcagaaggg

SEQ ID NO: 2619695 - RNA, 19 nt, Human
gcagcaggugcugcuaccc

SEQ ID NO: 2619696 - RNA, 18 nt, Human
gcagcaggugcugcuacc

SEQ ID NO: 2619697 - RNA, 17 nt, Human
gcagcaggugcugcuac

SEQ ID NO: 2619698 - RNA, 16 nt, Human
gcagcaggugcugcua

SEQ ID NO: 2619699 - RNA, 15 nt, Human
gcagcaggugcugcu

SEQ ID NO: 2619700 - RNA, 14 nt, Human
gcagcaggugcugc

SEQ ID NO: 2619701 - RNA, 13 nt, Human
gcagcaggugcug

SEQ ID NO: 2619702 - RNA, 12 nt, Human
gcagcaggugcu

SEQ ID NO: 2619703 - RNA, 19 nt, Human
gcagcagggcuacccugag

SEQ ID NO: 2619704 - RNA, 20 nt, Human
gcagcagggcuacccugagc

SEQ ID NO: 2619705 - RNA, 20 nt, Human
gcagccucaaccuccugggc

SEQ ID NO: 2619706 - RNA, 19 nt, Human
gcagccucaaccuccuggg

SEQ ID NO: 2619707 - RNA, 17 nt, Human
gcagccgugccuucagc

SEQ ID NO: 2619708 - RNA, 15 nt, Human
gcagccgugccuuca

SEQ ID NO: 2619709 - RNA, 14 nt, Human
gcagccgugccuuc

SEQ ID NO: 2619710 - RNA, 22 nt, Human
gcagcaggugcugcuacccucc

SEQ ID NO: 2619711 - RNA, 20 nt, Human
gcagcaggugcugcuacccu

SEQ ID NO: 2619712 - RNA, 14 nt, Human
gcacugauauuuua

SEQ ID NO: 2619713 - RNA, 22 nt, Human
gcacugaugcugccccucaucu

SEQ ID NO: 2619714 - RNA, 18 nt, Human
gcacugaugcugccccuc

SEQ ID NO: 2619715 - RNA, 19 nt, Human
gcacugaugcugccccuca

SEQ ID NO: 2619716 - RNA, 12 nt, Human
gcacugauuuca

SEQ ID NO: 2619717 - RNA, 15 nt, Human
gcacugauuucacaa

SEQ ID NO: 2619718 - RNA, 14 nt, Human
gcacugggcuuggg

SEQ ID NO: 2619719 - RNA, 23 nt, Human
gcacugggcuuggggaccagagc

SEQ ID NO: 2619720 - RNA, 22 nt, Human
gcacugggcuuggggaccagag

SEQ ID NO: 2619721 - RNA, 13 nt, Human
gcacugcaggggc

SEQ ID NO: 2619722 - RNA, 23 nt, Human
gcacuggggagcccgucucagug

SEQ ID NO: 2619723 - RNA, 22 nt, Human
gcacuggggagcccgucucagu

SEQ ID NO: 2619724 - RNA, 19 nt, Human
gcacuggggagcccgucuc

SEQ ID NO: 2619725 - RNA, 18 nt, Human
gcacuggggagcccgucu

SEQ ID NO: 2619726 - RNA, 20 nt, Human
gcacugauuucacaacagau

SEQ ID NO: 2619727 - RNA, 19 nt, Human
gcacugauuucacaacaga

SEQ ID NO: 2619728 - RNA, 15 nt, Human
gcacuggggagcccg

SEQ ID NO: 2619729 - RNA, 15 nt, Human
gcacugucaagauga

SEQ ID NO: 2619730 - RNA, 20 nt, Human
gcacugucacuuugcucugg

SEQ ID NO: 2619731 - RNA, 18 nt, Human
gcacugucacuuugcucu

SEQ ID NO: 2619732 - RNA, 16 nt, Human
gcacugucacuuugcu

SEQ ID NO: 2619733 - RNA, 15 nt, Human
gcacuguaugcugga

SEQ ID NO: 2619734 - RNA, 16 nt, Human
gcacuguaugcuggac

SEQ ID NO: 2619735 - RNA, 14 nt, Human
gcagaaggaagacu

SEQ ID NO: 2619736 - RNA, 13 nt, Human
gcagaaggaagac

SEQ ID NO: 2619737 - RNA, 21 nt, Human
gcagaagacaccagagcagau

SEQ ID NO: 2619738 - RNA, 20 nt, Human
gcagaagacaccagagcaga

SEQ ID NO: 2619739 - RNA, 18 nt, Human
gcagaagacaccagagca

SEQ ID NO: 2619740 - RNA, 16 nt, Human
gcagaagacaccagag

SEQ ID NO: 2619741 - RNA, 13 nt, Human
gcagaagcauuaa

SEQ ID NO: 2619742 - RNA, 12 nt, Human
gcagaaggaaga

SEQ ID NO: 2619743 - RNA, 12 nt, Human
gcacuguccugc

SEQ ID NO: 2619744 - RNA, 21 nt, Human
gcacugucacuuugcucuggg

SEQ ID NO: 2619745 - RNA, 23 nt, Human
gcacugucccuugccucaaugcc

SEQ ID NO: 2619746 - RNA, 18 nt, Human
gcacugucccuugccuca

SEQ ID NO: 2619747 - RNA, 17 nt, Human
gcacugucccuugccuc

SEQ ID NO: 2619748 - RNA, 17 nt, Human
gcacuguccugcuccac

SEQ ID NO: 2619749 - RNA, 16 nt, Human
gcacuguccugcucca

SEQ ID NO: 2619750 - RNA, 15 nt, Human
gcacuguccugcucc

SEQ ID NO: 2619751 - RNA, 14 nt, Human
gcacuguccugcuc

SEQ ID NO: 2619752 - RNA, 19 nt, Human
gcacuguccugcuccacag

SEQ ID NO: 2619753 - RNA, 18 nt, Human
gcacuguccugcuccaca

SEQ ID NO: 2619754 - RNA, 20 nt, Human
gcacuguccugcuccacagu

SEQ ID NO: 2619755 - RNA, 14 nt, Human
gcagaagacaguau

SEQ ID NO: 2619756 - RNA, 22 nt, Human
gcagaagaaugggaauauuuua

SEQ ID NO: 2619757 - RNA, 21 nt, Human
gcagaagaauugaacccagga

SEQ ID NO: 2619758 - RNA, 15 nt, Human
gcagaagacaccaga

SEQ ID NO: 2619759 - RNA, 14 nt, Human
gcagaagacaccag

SEQ ID NO: 2619760 - RNA, 23 nt, Human
gcagaagaauugaacccaggagg

SEQ ID NO: 2619761 - RNA, 19 nt, Human
gcaccucugaccuaucacu

SEQ ID NO: 2619762 - RNA, 21 nt, Human
gcaccugauggaaaagauaua

SEQ ID NO: 2619763 - RNA, 20 nt, Human
gcaccugcagguugggccau

SEQ ID NO: 2619764 - RNA, 15 nt, Human
gcaccugcagguugg

SEQ ID NO: 2619765 - RNA, 21 nt, Human
gcaccugcagguugggccaua

SEQ ID NO: 2619766 - RNA, 22 nt, Human
gcaccugcauccguaguucccu

SEQ ID NO: 2619767 - RNA, 13 nt, Human
gcaccugccagcc

SEQ ID NO: 2619768 - RNA, 14 nt, Human
gcaccugccagccu

SEQ ID NO: 2619769 - RNA, 15 nt, Human
gcaccugccagccug

SEQ ID NO: 2619770 - RNA, 16 nt, Human
gcaccugccagccugg

SEQ ID NO: 2619771 - RNA, 17 nt, Human
gcaccugccagccuggc

SEQ ID NO: 2619772 - RNA, 22 nt, Human
gcaccugccagccuggcuucug

SEQ ID NO: 2619773 - RNA, 15 nt, Human
gcaccugcccccugg

SEQ ID NO: 2619774 - RNA, 16 nt, Human
gcaccugcccccuggu

SEQ ID NO: 2619775 - RNA, 17 nt, Human
gcaccugcccccuggug

SEQ ID NO: 2619776 - RNA, 18 nt, Human
gcaccugcccccuggugg

SEQ ID NO: 2619777 - RNA, 20 nt, Human
gcaccugcuucaugcucagc

SEQ ID NO: 2619778 - RNA, 15 nt, Human
gcaccugcucucuug

SEQ ID NO: 2619779 - RNA, 19 nt, Human
gcacuaacguugagccccu

SEQ ID NO: 2619780 - RNA, 17 nt, Human
gcacuaaggugugcucu

SEQ ID NO: 2619781 - RNA, 13 nt, Human
gcaccugccucag

SEQ ID NO: 2619782 - RNA, 14 nt, Human
gcaccugccucagg

SEQ ID NO: 2619783 - RNA, 15 nt, Human
gcaccugccucagga

SEQ ID NO: 2619784 - RNA, 16 nt, Human
gcaccugccucaggac

SEQ ID NO: 2619785 - RNA, 12 nt, Human
gcaccugccuca

SEQ ID NO: 2619786 - RNA, 23 nt, Human
gcaccugcauccguaguucccug

SEQ ID NO: 2619787 - RNA, 21 nt, Human
gcaccugccgaccucguccuc

SEQ ID NO: 2619788 - RNA, 19 nt, Human
gcaccugccgaccucgucc

SEQ ID NO: 2619789 - RNA, 22 nt, Human
gcaccugcccccugguggacag

SEQ ID NO: 2619790 - RNA, 21 nt, Human
gcacuaggggauauaggagag

SEQ ID NO: 2619791 - RNA, 21 nt, Human
gcacuagccuuuggcucugga

SEQ ID NO: 2619792 - RNA, 22 nt, Human
gcacuagccuuuggcucuggag

SEQ ID NO: 2619793 - RNA, 20 nt, Human
gcacuagccuuuggcucugg

SEQ ID NO: 2619794 - RNA, 18 nt, Human
gcacuagccuuuggcucu

SEQ ID NO: 2619795 - RNA, 16 nt, Human
gcacuagccuuuggcu

SEQ ID NO: 2619796 - RNA, 15 nt, Human
gcacuagccuuuggc

SEQ ID NO: 2619797 - RNA, 13 nt, Human
gcacuagccuuug

SEQ ID NO: 2619798 - RNA, 20 nt, Human
gcacugagggccacacuauu

SEQ ID NO: 2619799 - RNA, 16 nt, Human
gcacugagggccacac

SEQ ID NO: 2619800 - RNA, 15 nt, Human
gcacugagggccaca

SEQ ID NO: 2619801 - RNA, 14 nt, Human
gcacugagggccac

SEQ ID NO: 2619802 - RNA, 13 nt, Human
gcacugaugcugc

SEQ ID NO: 2619803 - RNA, 24 nt, Human
gcacugagggccacacuauuacca

SEQ ID NO: 2619804 - RNA, 13 nt, Human
gcacugagggcca

SEQ ID NO: 2619805 - RNA, 12 nt, Human
gcacugagggcc

SEQ ID NO: 2619806 - RNA, 11 nt, Human
gcacugagggc

SEQ ID NO: 2619807 - RNA, 18 nt, Human
gcacugaggaagaacggg

SEQ ID NO: 2619808 - RNA, 17 nt, Human
gcacugaggaccagcca

SEQ ID NO: 2619809 - RNA, 18 nt, Human
gcacuacugacauguggg

SEQ ID NO: 2619810 - RNA, 17 nt, Human
gcacuacucugugccag

SEQ ID NO: 2619811 - RNA, 15 nt, Human
gcacuacucugugcc

SEQ ID NO: 2619812 - RNA, 17 nt, Human
gcacuacugacaugugg

SEQ ID NO: 2619813 - RNA, 19 nt, Human
gcacuacuccucugcagug

SEQ ID NO: 2619814 - RNA, 17 nt, Human
gcacuacuccucugcag

SEQ ID NO: 2619815 - RNA, 16 nt, Human
gcacuacuccucugca

SEQ ID NO: 2619816 - RNA, 13 nt, Human
gcacuacuccucu

SEQ ID NO: 2619817 - RNA, 21 nt, Human
gcacuaccacuccugccaagg

SEQ ID NO: 2619818 - RNA, 23 nt, Human
gcacuaaggggcccggccagcca

SEQ ID NO: 2619819 - RNA, 21 nt, Human
gcacuacucccucaaagcaca

SEQ ID NO: 2619820 - RNA, 18 nt, Human
gcacuaaggugugcucug

SEQ ID NO: 2619821 - RNA, 20 nt, Human
gcacuaacguugagccccug

SEQ ID NO: 2619822 - RNA, 14 nt, Human
gcacuaaggggccc

SEQ ID NO: 2619823 - RNA, 14 nt, Human
gcacaggcccccuu

SEQ ID NO: 2619824 - RNA, 14 nt, Human
gcacaggcagcugg

SEQ ID NO: 2619825 - RNA, 12 nt, Human
gcacaggcagcu

SEQ ID NO: 2619826 - RNA, 23 nt, Human
gcacaugcugagucucccaaggc

SEQ ID NO: 2619827 - RNA, 19 nt, Human
gcacaugccuguaguccca

SEQ ID NO: 2619828 - RNA, 21 nt, Human
gcacaggacaugcgguagcca

SEQ ID NO: 2619829 - RNA, 22 nt, Human
gcacaggacaugcgguagccag

SEQ ID NO: 2619830 - RNA, 16 nt, Human
gcacagcuucauuucc

SEQ ID NO: 2619831 - RNA, 14 nt, Human
gcacaggacaugcg

SEQ ID NO: 2619832 - RNA, 12 nt, Human
gcacagcuggcc

SEQ ID NO: 2619833 - RNA, 21 nt, Human
gcaaugacaucucaggggcca

SEQ ID NO: 2619834 - RNA, 19 nt, Human
gcaaugacaucucaggggc

SEQ ID NO: 2619835 - RNA, 16 nt, Human
gcaaugacaucucagg

SEQ ID NO: 2619836 - RNA, 19 nt, Human
gcaaugacagguaaauuaa

SEQ ID NO: 2619837 - RNA, 20 nt, Human
gcacagccucuuagaugcag

SEQ ID NO: 2619838 - RNA, 14 nt, Human
gcaaugaccuuuca

SEQ ID NO: 2619839 - RNA, 13 nt, Human
gcaaugaccuuuc

SEQ ID NO: 2619840 - RNA, 19 nt, Human
gcacagcuaacauggaagu

SEQ ID NO: 2619841 - RNA, 13 nt, Human
gcacagcuaugaa

SEQ ID NO: 2619842 - RNA, 14 nt, Human
gcacagccuucucc

SEQ ID NO: 2619843 - RNA, 16 nt, Human
gcaaugacaucuucaa

SEQ ID NO: 2619844 - RNA, 21 nt, Human
gcacagcggggccccagggcu

SEQ ID NO: 2619845 - RNA, 16 nt, Human
gcacagcuaugaaggc

SEQ ID NO: 2619846 - RNA, 15 nt, Human
gcaccuccugccucg

SEQ ID NO: 2619847 - RNA, 14 nt, Human
gcaccuccugccuc

SEQ ID NO: 2619848 - RNA, 17 nt, Human
gcacccggccccugcug

SEQ ID NO: 2619849 - RNA, 15 nt, Human
gcacccggccccugc

SEQ ID NO: 2619850 - RNA, 21 nt, Human
gcacccagugagcacucccaa

SEQ ID NO: 2619851 - RNA, 17 nt, Human
gcacccagugagcacuc

SEQ ID NO: 2619852 - RNA, 21 nt, Human
gcacccagccucuagggaccc

SEQ ID NO: 2619853 - RNA, 19 nt, Human
gcacccagccucuagggac

SEQ ID NO: 2619854 - RNA, 23 nt, Human
gcacccagugagcacucccaagu

SEQ ID NO: 2619855 - RNA, 15 nt, Human
gcacccagcccuggu

SEQ ID NO: 2619856 - RNA, 14 nt, Human
gcacccagcccugg

SEQ ID NO: 2619857 - RNA, 13 nt, Human
gcacccagcccug

SEQ ID NO: 2619858 - RNA, 12 nt, Human
gcacccagcccu

SEQ ID NO: 2619859 - RNA, 11 nt, Human
gcacccagccc

SEQ ID NO: 2619860 - RNA, 20 nt, Human
gcacccaccguggaggagga

SEQ ID NO: 2619861 - RNA, 14 nt, Human
gcacccacucugcu

SEQ ID NO: 2619862 - RNA, 14 nt, Human
gcacccggccccug

SEQ ID NO: 2619863 - RNA, 17 nt, Human
gcaccccaaagcuuucc

SEQ ID NO: 2619864 - RNA, 20 nt, Human
gcaccccaaagcuuuccugc

SEQ ID NO: 2619865 - RNA, 13 nt, Human
gcaccccaaggcu

SEQ ID NO: 2619866 - RNA, 20 nt, Human
gcacaugucuuguacaugug

SEQ ID NO: 2619867 - RNA, 13 nt, Human
gcacaugucuugu

SEQ ID NO: 2619868 - RNA, 18 nt, Human
gcaccaccaagccaaggg

SEQ ID NO: 2619869 - RNA, 21 nt, Human
gcacaugucuuguacaugugu

SEQ ID NO: 2619870 - RNA, 11 nt, Human
gcaccacccua

SEQ ID NO: 2619871 - RNA, 20 nt, Human
gcaccacccuagucccuucc

SEQ ID NO: 2619872 - RNA, 22 nt, Human
gcaccacccuagucccuucccc

SEQ ID NO: 2619873 - RNA, 22 nt, Human
gcacaugucuuaaugaaguuug

SEQ ID NO: 2619874 - RNA, 21 nt, Human
gcacaugucuuaaugaaguuu

SEQ ID NO: 2619875 - RNA, 20 nt, Human
gcacaugucuuaaugaaguu

SEQ ID NO: 2619876 - RNA, 17 nt, Human
gcacaugucuuaaugaa

SEQ ID NO: 2619877 - RNA, 15 nt, Human
gcacaugucuuaaug

SEQ ID NO: 2619878 - RNA, 13 nt, Human
gcacaugucuuaa

SEQ ID NO: 2619879 - RNA, 20 nt, Human
gcacaugcugagucucccaa

SEQ ID NO: 2619880 - RNA, 19 nt, Human
gcacaugcugagucuccca

SEQ ID NO: 2619881 - RNA, 22 nt, Human
gcacaugcugagucucccaagg

SEQ ID NO: 2619882 - RNA, 22 nt, Human
gcacauggaggagcuuggggga

SEQ ID NO: 2619883 - RNA, 22 nt, Human
gcaccaccgagagaggcuggga

SEQ ID NO: 2619884 - RNA, 23 nt, Human
gcaccacccuagucccuuccccu

SEQ ID NO: 2619885 - RNA, 19 nt, Human
gcaccacugcacuccagcc

SEQ ID NO: 2619886 - RNA, 19 nt, Human
gcacccaccguggaggagg

SEQ ID NO: 2619887 - RNA, 18 nt, Human
gcacccaccguggaggag

SEQ ID NO: 2619888 - RNA, 17 nt, Human
gcacccacccugggacc

SEQ ID NO: 2619889 - RNA, 14 nt, Human
gcacccacccuggg

SEQ ID NO: 2619890 - RNA, 13 nt, Human
gcacccacccugg

SEQ ID NO: 2619891 - RNA, 22 nt, Human
gcacccacccagcacccagcaa

SEQ ID NO: 2619892 - RNA, 22 nt, Human
gcaggggcucuggagagaaaca

SEQ ID NO: 2619893 - RNA, 20 nt, Human
gcaggggcucuggagagaaa

SEQ ID NO: 2619894 - RNA, 19 nt, Human
gcaggggcucuggagagaa

SEQ ID NO: 2619895 - RNA, 21 nt, Human
gcaggggcucuggagagaaac

SEQ ID NO: 2619896 - RNA, 18 nt, Human
gcaggggcucuggagaga

SEQ ID NO: 2619897 - RNA, 17 nt, Human
gcaggggcucuggagag

SEQ ID NO: 2619898 - RNA, 16 nt, Human
gcaggggcucuggaga

SEQ ID NO: 2619899 - RNA, 14 nt, Human
gcaggggcucugga

SEQ ID NO: 2619900 - RNA, 13 nt, Human
gcaggggcucugg

SEQ ID NO: 2619901 - RNA, 23 nt, Human
gcagggcuacccugagcugaggc

SEQ ID NO: 2619902 - RNA, 21 nt, Human
gcagggcuacccugagcugag

SEQ ID NO: 2619903 - RNA, 22 nt, Human
gcagggcuacccugagcugagg

SEQ ID NO: 2619904 - RNA, 12 nt, Human
gcagggcucagc

SEQ ID NO: 2619905 - RNA, 18 nt, Human
gcagggagggccugggcc

SEQ ID NO: 2619906 - RNA, 22 nt, Human
gcagggagggccugggccccag

SEQ ID NO: 2619907 - RNA, 16 nt, Human
gcagggagggcuucug

SEQ ID NO: 2619908 - RNA, 17 nt, Human
gcagggcuacccugagc

SEQ ID NO: 2619909 - RNA, 20 nt, Human
gcagggcuacccugagcuga

SEQ ID NO: 2619910 - RNA, 12 nt, Human
gcagggagggga

SEQ ID NO: 2619911 - RNA, 16 nt, Human
gcagggccucacacgg

SEQ ID NO: 2619912 - RNA, 13 nt, Human
gcagggaggggac

SEQ ID NO: 2619913 - RNA, 18 nt, Human
gcagggccuugcccagag

SEQ ID NO: 2619914 - RNA, 19 nt, Human
gcagggccuugcccagaga

SEQ ID NO: 2619915 - RNA, 21 nt, Human
gcagggccuugcccagagaug

SEQ ID NO: 2619916 - RNA, 15 nt, Human
gcaggcucacugcca

SEQ ID NO: 2619917 - RNA, 14 nt, Human
gcaggcucacugcc

SEQ ID NO: 2619918 - RNA, 16 nt, Human
gcaggcuagaaccugg

SEQ ID NO: 2619919 - RNA, 20 nt, Human
gcaggcuacacugacacugg

SEQ ID NO: 2619920 - RNA, 16 nt, Human
gcaggcuacacugaca

SEQ ID NO: 2619921 - RNA, 22 nt, Human
gcaggcuaaggcguggagcugc

SEQ ID NO: 2619922 - RNA, 21 nt, Human
gcaggcuaaggcguggagcug

SEQ ID NO: 2619923 - RNA, 20 nt, Human
gcaggcuaaggcguggagcu

SEQ ID NO: 2619924 - RNA, 15 nt, Human
gcaggcuacugucag

SEQ ID NO: 2619925 - RNA, 21 nt, Human
gcaggcucacugccaggccag

SEQ ID NO: 2619926 - RNA, 19 nt, Human
gcaggcucacugccaggcc

SEQ ID NO: 2619927 - RNA, 18 nt, Human
gcaggcucacugccaggc

SEQ ID NO: 2619928 - RNA, 17 nt, Human
gcaggcucacugccagg

SEQ ID NO: 2619929 - RNA, 23 nt, Human
gcaggcucacugccaggccagcc

SEQ ID NO: 2619930 - RNA, 22 nt, Human
gcaggcucacugccaggccagc

SEQ ID NO: 2619931 - RNA, 14 nt, Human
gcagggagggccug

SEQ ID NO: 2619932 - RNA, 17 nt, Human
gcagggagggccugggc

SEQ ID NO: 2619933 - RNA, 20 nt, Human
gcaggauucuuccucccucc

SEQ ID NO: 2619934 - RNA, 21 nt, Human
gcaggauaguugcuccgccuc

SEQ ID NO: 2619935 - RNA, 22 nt, Human
gcaggauaguugcuccgccucu

SEQ ID NO: 2619936 - RNA, 17 nt, Human
gcaggcuaaggcgugga

SEQ ID NO: 2619937 - RNA, 19 nt, Human
gcaggcguucagcucacug

SEQ ID NO: 2619938 - RNA, 13 nt, Human
gcaggcacagcac

SEQ ID NO: 2619939 - RNA, 12 nt, Human
gcaggcacagca

SEQ ID NO: 2619940 - RNA, 21 nt, Human
gcaggauugauuaugcagaau

SEQ ID NO: 2619941 - RNA, 19 nt, Human
gcaggauugauuaugcaga

SEQ ID NO: 2619942 - RNA, 24 nt, Human
gcaggauggccuggccagggccug

SEQ ID NO: 2619943 - RNA, 16 nt, Human
gcaggauggccuggcc

SEQ ID NO: 2619944 - RNA, 16 nt, Human
gcagugggagcugccu

SEQ ID NO: 2619945 - RNA, 15 nt, Human
gcagugcuucucaaa

SEQ ID NO: 2619946 - RNA, 23 nt, Human
gcagugccuuggggaauuuccuc

SEQ ID NO: 2619947 - RNA, 16 nt, Human
gcagugcuucucuaca

SEQ ID NO: 2619948 - RNA, 21 nt, Human
gcagugcucgcuguugcugaa

SEQ ID NO: 2619949 - RNA, 19 nt, Human
gcagugcucgcuguugcug

SEQ ID NO: 2619950 - RNA, 18 nt, Human
gcagugcucgcuguugcu

SEQ ID NO: 2619951 - RNA, 17 nt, Human
gcagugcucgcuguugc

SEQ ID NO: 2619952 - RNA, 23 nt, Human
gcagugcuuccaaggauggacca

SEQ ID NO: 2619953 - RNA, 17 nt, Human
gcagguggcaucucuaa

SEQ ID NO: 2619954 - RNA, 23 nt, Human
gcaggugcugcuacccucccugc

SEQ ID NO: 2619955 - RNA, 22 nt, Human
gcaggugcugcuacccucccug

SEQ ID NO: 2619956 - RNA, 21 nt, Human
gcaggugcugcuacccucccu

SEQ ID NO: 2619957 - RNA, 20 nt, Human
gcaggugcugcuacccuccc

SEQ ID NO: 2619958 - RNA, 15 nt, Human
gcaggugcugcugcg

SEQ ID NO: 2619959 - RNA, 15 nt, Human
gcagugccuugggga

SEQ ID NO: 2619960 - RNA, 22 nt, Human
gcagugccuuccauaauuauga

SEQ ID NO: 2619961 - RNA, 16 nt, Human
gcagugccuuccauaa

SEQ ID NO: 2619962 - RNA, 22 nt, Human
gcagugcgcgugcacguggaga

SEQ ID NO: 2619963 - RNA, 21 nt, Human
gcagguggggagacugggcug

SEQ ID NO: 2619964 - RNA, 13 nt, Human
gcagguggggagg

SEQ ID NO: 2619965 - RNA, 17 nt, Human
gcagguggggagacugg

SEQ ID NO: 2619966 - RNA, 16 nt, Human
gcaggugggagcuuga

SEQ ID NO: 2619967 - RNA, 20 nt, Human
gcaggggcuuguugcaggcu

SEQ ID NO: 2619968 - RNA, 14 nt, Human
gcagguccccagac

SEQ ID NO: 2619969 - RNA, 21 nt, Human
gcagggguggggguggaggcu

SEQ ID NO: 2619970 - RNA, 20 nt, Human
gcagggguggggguggaggc

SEQ ID NO: 2619971 - RNA, 19 nt, Human
gcagggguccuugguguga

SEQ ID NO: 2619972 - RNA, 18 nt, Human
gcagggguggcugccuca

SEQ ID NO: 2619973 - RNA, 17 nt, Human
gcaggggugggggugga

SEQ ID NO: 2619974 - RNA, 22 nt, Human
gcagggguggcugccucauuua

SEQ ID NO: 2619975 - RNA, 11 nt, Human
gcaggucccua

SEQ ID NO: 2619976 - RNA, 10 nt, Human
gcaggucccu

SEQ ID NO: 2619977 - RNA, 13 nt, Human
gcaggucccuaau

SEQ ID NO: 2619978 - RNA, 12 nt, Human
gcaggucccuaa

SEQ ID NO: 2619979 - RNA, 23 nt, Human
gcagguccccagacuccaccaag

SEQ ID NO: 2619980 - RNA, 23 nt, Human
gcagggguggggguggaggcuuc

SEQ ID NO: 2619981 - RNA, 15 nt, Human
gcaggugcugcuacc

SEQ ID NO: 2619982 - RNA, 14 nt, Human
gcaggugcugcuac

SEQ ID NO: 2619983 - RNA, 21 nt, Human
gcaggugccuccaggugugca

SEQ ID NO: 2619984 - RNA, 18 nt, Human
gcaggugccuccaggugu

SEQ ID NO: 2619985 - RNA, 16 nt, Human
gcaggugccuccaggu

SEQ ID NO: 2619986 - RNA, 15 nt, Human
gcaggugccuccagg

SEQ ID NO: 2619987 - RNA, 14 nt, Human
gcaggugccuccag

SEQ ID NO: 2619988 - RNA, 13 nt, Human
gcaggugccucca

SEQ ID NO: 2619989 - RNA, 16 nt, Human
gcauauaacuuauauu

SEQ ID NO: 2619990 - RNA, 23 nt, Human
gcauauaacuuauauuguaagaa

SEQ ID NO: 2619991 - RNA, 15 nt, Human
gcauauaacuuauau

SEQ ID NO: 2619992 - RNA, 23 nt, Human
gcauaggccugggugcuggcugc

SEQ ID NO: 2619993 - RNA, 17 nt, Human
gcauaggccugggugcu

SEQ ID NO: 2619994 - RNA, 22 nt, Human
gcauaggccugggugcuggcug

SEQ ID NO: 2619995 - RNA, 19 nt, Human
gcauaggaccuuuccacca

SEQ ID NO: 2619996 - RNA, 22 nt, Human
gcauagcccagacacagaagag

SEQ ID NO: 2619997 - RNA, 12 nt, Human
gcauaggccugg

SEQ ID NO: 2619998 - RNA, 16 nt, Human
gcauaggccugggugc

SEQ ID NO: 2619999 - RNA, 14 nt, Human
gcaguucugaagaa

SEQ ID NO: 2620000 - RNA, 13 nt, Human
gcaguucugaaga

SEQ ID NO: 2620001 - RNA, 18 nt, Human
gcauagauucccugagca

SEQ ID NO: 2620002 - RNA, 16 nt, Human
gcaguucuaguuugca

SEQ ID NO: 2620003 - RNA, 14 nt, Human
gcauagcaaacaga

SEQ ID NO: 2620004 - RNA, 21 nt, Human
gcaguucuaguuugcauuccu

SEQ ID NO: 2620005 - RNA, 16 nt, Human
gcauagcaagacacau

SEQ ID NO: 2620006 - RNA, 21 nt, Human
gcaguuccggauuggcuugug

SEQ ID NO: 2620007 - RNA, 23 nt, Human
gcaguuccggauuggcuugugug

SEQ ID NO: 2620008 - RNA, 15 nt, Human
gcaguguuuccuuuu

SEQ ID NO: 2620009 - RNA, 21 nt, Human
gcaguguuccuauuuggggcu

SEQ ID NO: 2620010 - RNA, 14 nt, Human
gcaguguuuccuuu

SEQ ID NO: 2620011 - RNA, 13 nt, Human
gcaguuacaugca

SEQ ID NO: 2620012 - RNA, 21 nt, Human
gcaguuacaugcauacuucaa

SEQ ID NO: 2620013 - RNA, 18 nt, Human
gcaguuacaugcauacuu

SEQ ID NO: 2620014 - RNA, 14 nt, Human
gcaguuauagaaaa

SEQ ID NO: 2620015 - RNA, 18 nt, Human
gcagugggagcugccugu

SEQ ID NO: 2620016 - RNA, 17 nt, Human
gcagugggagcugccug

SEQ ID NO: 2620017 - RNA, 21 nt, Human
gcagugugaggccagggcaga

SEQ ID NO: 2620018 - RNA, 20 nt, Human
gcagugugcacuaaggggcc

SEQ ID NO: 2620019 - RNA, 19 nt, Human
gcagugugaggccagggca

SEQ ID NO: 2620020 - RNA, 15 nt, Human
gcagugugaggccag

SEQ ID NO: 2620021 - RNA, 20 nt, Human
gcaguguuccccaucugggu

SEQ ID NO: 2620022 - RNA, 21 nt, Human
gcaguguuccccaucuggguc

SEQ ID NO: 2620023 - RNA, 21 nt, Human
gcagugugcacuaaggggccc

SEQ ID NO: 2620024 - RNA, 12 nt, Human
gcauauuguaca

SEQ ID NO: 2620025 - RNA, 19 nt, Human
gcauauugcuuuuucuaau

SEQ ID NO: 2620026 - RNA, 16 nt, Human
gcauauucuuauguau

SEQ ID NO: 2620027 - RNA, 18 nt, Human
gcauauuguacacuuuuu

SEQ ID NO: 2620028 - RNA, 17 nt, Human
gcauauuguacacuuuu

SEQ ID NO: 2620029 - RNA, 16 nt, Human
gcauauuguacacuuu

SEQ ID NO: 2620030 - RNA, 15 nt, Human
gcauauuguacacuu

SEQ ID NO: 2620031 - RNA, 20 nt, Human
gcauauuguacacuuuuuug

SEQ ID NO: 2620032 - RNA, 19 nt, Human
gcauauuguacacuuuuuu

SEQ ID NO: 2620033 - RNA, 21 nt, Human
gcauauuguauuacuagaaga

SEQ ID NO: 2620034 - RNA, 15 nt, Human
gcauauuguuauuau

SEQ ID NO: 2620035 - RNA, 21 nt, Human
gcaucaagaugugacauguuu

SEQ ID NO: 2620036 - RNA, 19 nt, Human
gcaucaaaagacaauucuu

SEQ ID NO: 2620037 - RNA, 18 nt, Human
gcaucaaaagacaauucu

SEQ ID NO: 2620038 - RNA, 17 nt, Human
gcaucaaaagacaauuc

SEQ ID NO: 2620039 - RNA, 19 nt, Human
gcauauuguuauuauauaa

SEQ ID NO: 2620040 - RNA, 16 nt, Human
gcaucaaaagacaauu

SEQ ID NO: 2620041 - RNA, 18 nt, Human
gcauauucaggaagcuca

SEQ ID NO: 2620042 - RNA, 17 nt, Human
gcauauucaggaagcuc

SEQ ID NO: 2620043 - RNA, 20 nt, Human
gcauauucaggaagcucagg

SEQ ID NO: 2620044 - RNA, 16 nt, Human
gcauauuccuuucuau

SEQ ID NO: 2620045 - RNA, 15 nt, Human
gcauauuccuuucua

SEQ ID NO: 2620046 - RNA, 20 nt, Human
gcauauuccuuucuaucauu

SEQ ID NO: 2620047 - RNA, 18 nt, Human
gcauauguguuggcuugu

SEQ ID NO: 2620048 - RNA, 21 nt, Human
gcauauguuucgcugauauau

SEQ ID NO: 2620049 - RNA, 15 nt, Human
gcauauucaggaagc

SEQ ID NO: 2620050 - RNA, 23 nt, Human
gcauauuauuuuauguugcauag

SEQ ID NO: 2620051 - RNA, 18 nt, Human
gcauauguugaauacuuu

SEQ ID NO: 2620052 - RNA, 19 nt, Human
gcauauguugaauacuuuu

SEQ ID NO: 2620053 - RNA, 20 nt, Human
gcauauguugaauacuuuuu

SEQ ID NO: 2620054 - RNA, 21 nt, Human
gcauauguugaauacuuuuua

SEQ ID NO: 2620055 - RNA, 18 nt, Human
gcauauuauuuuauguug

SEQ ID NO: 2620056 - RNA, 15 nt, Human
gcauauguaugacuc

SEQ ID NO: 2620057 - RNA, 14 nt, Human
gcauauguugaaua

SEQ ID NO: 2620058 - RNA, 17 nt, Human
gcauauguugaauacuu

SEQ ID NO: 2620059 - RNA, 12 nt, Human
gcauauguugaa

SEQ ID NO: 2620060 - RNA, 15 nt, Human
gcauauguguuggcu

SEQ ID NO: 2620061 - RNA, 15 nt, Human
gcaucaggccaggcc

SEQ ID NO: 2620062 - RNA, 13 nt, Human
gcaucaggccagg

SEQ ID NO: 2620063 - RNA, 22 nt, Human
gcaucaaaagacaauucuuuau

SEQ ID NO: 2620064 - RNA, 21 nt, Human
gcaucaaaagacaauucuuua

SEQ ID NO: 2620065 - RNA, 14 nt, Human
gcaucacagggcag

SEQ ID NO: 2620066 - RNA, 15 nt, Human
gcaucacagggcaga

SEQ ID NO: 2620067 - RNA, 16 nt, Human
gcaucacagggcagag

SEQ ID NO: 2620068 - RNA, 17 nt, Human
gcaucacagggcagagc

SEQ ID NO: 2620069 - RNA, 21 nt, Human
gcaucacagggcagagccggg

SEQ ID NO: 2620070 - RNA, 22 nt, Human
gcaucacagggcagagccggga

SEQ ID NO: 2620071 - RNA, 17 nt, Human
gcaucaggccaggcccu

SEQ ID NO: 2620072 - RNA, 16 nt, Human
gcaucaggccaggccc

SEQ ID NO: 2620073 - RNA, 15 nt, Human
gcaugaauuugugaa

SEQ ID NO: 2620074 - RNA, 23 nt, Human
gcaugaaguaauaugcacacauu

SEQ ID NO: 2620075 - RNA, 12 nt, Human
gcaucacaguuu

SEQ ID NO: 2620076 - RNA, 13 nt, Human
gcaucaccucagg

SEQ ID NO: 2620077 - RNA, 16 nt, Human
gcaugcacuguucccc

SEQ ID NO: 2620078 - RNA, 17 nt, Human
gcaugcacuguuccccc

SEQ ID NO: 2620079 - RNA, 21 nt, Human
gcaugcacuguucccccugug

SEQ ID NO: 2620080 - RNA, 22 nt, Human
gcaugcacuguucccccugugc

SEQ ID NO: 2620081 - RNA, 17 nt, Human
gcaugaauuugugaagg

SEQ ID NO: 2620082 - RNA, 15 nt, Human
gcaugacaagcccca

SEQ ID NO: 2620083 - RNA, 16 nt, Human
gcaugacaagccccag

SEQ ID NO: 2620084 - RNA, 17 nt, Human
gcaugacaagccccagg

SEQ ID NO: 2620085 - RNA, 18 nt, Human
gcaugacaagccccaggc

SEQ ID NO: 2620086 - RNA, 19 nt, Human
gcaugacaagccccaggca

SEQ ID NO: 2620087 - RNA, 22 nt, Human
gcaugccuggauggggcugcac

SEQ ID NO: 2620088 - RNA, 17 nt, Human
gcaugccuggauggggc

SEQ ID NO: 2620089 - RNA, 23 nt, Human
gcaugcacuguucccccugugca

SEQ ID NO: 2620090 - RNA, 21 nt, Human
gcaugacaagccccaggcagg

SEQ ID NO: 2620091 - RNA, 15 nt, Human
gcaugcauuuugcag

SEQ ID NO: 2620092 - RNA, 14 nt, Human
gcaugcauuuugca

SEQ ID NO: 2620093 - RNA, 21 nt, Human
gcaugcauuuugcagcaguga

SEQ ID NO: 2620094 - RNA, 19 nt, Human
gcauguuuuccagcuccuc

SEQ ID NO: 2620095 - RNA, 18 nt, Human
gcauguuuuccagcuccu

SEQ ID NO: 2620096 - RNA, 12 nt, Human
gcauguuugcug

SEQ ID NO: 2620097 - RNA, 20 nt, Human
gcauguuucauguuuuguga

SEQ ID NO: 2620098 - RNA, 15 nt, Human
gcauguuucauguuu

SEQ ID NO: 2620099 - RNA, 13 nt, Human
gcauuaaaagaaa

SEQ ID NO: 2620100 - RNA, 14 nt, Human
gcauuaaaagaaaa

SEQ ID NO: 2620101 - RNA, 18 nt, Human
gcauuacgugagccaggu

SEQ ID NO: 2620102 - RNA, 17 nt, Human
gcauuacgugagccagg

SEQ ID NO: 2620103 - RNA, 15 nt, Human
gcauuaaaagaaaau

SEQ ID NO: 2620104 - RNA, 14 nt, Human
gcauuacugcaugc

SEQ ID NO: 2620105 - RNA, 17 nt, Human
gcauuacugcaugcacu

SEQ ID NO: 2620106 - RNA, 15 nt, Human
gcauuagaauuauuu

SEQ ID NO: 2620107 - RNA, 16 nt, Human
gcauuagaaauagaca

SEQ ID NO: 2620108 - RNA, 21 nt, Human
gcauuagaaauagacaguaua

SEQ ID NO: 2620109 - RNA, 15 nt, Human
gcauuccagccccuc

SEQ ID NO: 2620110 - RNA, 12 nt, Human
gcauuccagccc

SEQ ID NO: 2620111 - RNA, 18 nt, Human
gcauuccaacaaaggguu

SEQ ID NO: 2620112 - RNA, 17 nt, Human
gcauuccaacaaagggu

SEQ ID NO: 2620113 - RNA, 19 nt, Human
gcauuccagccccucuggu

SEQ ID NO: 2620114 - RNA, 16 nt, Human
gcauuccagccccucu

SEQ ID NO: 2620115 - RNA, 18 nt, Human
gcauuagaauuauuuaaa

SEQ ID NO: 2620116 - RNA, 17 nt, Human
gcauuagaauuauuuaa

SEQ ID NO: 2620117 - RNA, 20 nt, Human
gcauuagauuucucauuugc

SEQ ID NO: 2620118 - RNA, 13 nt, Human
gcauuagaaauua

SEQ ID NO: 2620119 - RNA, 17 nt, Human
gcauguuugugauugac

SEQ ID NO: 2620120 - RNA, 16 nt, Human
gcauguugcugaggag

SEQ ID NO: 2620121 - RNA, 18 nt, Human
gcauguugagccaggccu

SEQ ID NO: 2620122 - RNA, 13 nt, Human
gcauggaauuugu

SEQ ID NO: 2620123 - RNA, 23 nt, Human
gcauggaaauucccuucaucugg

SEQ ID NO: 2620124 - RNA, 17 nt, Human
gcauggaauuuguaagu

SEQ ID NO: 2620125 - RNA, 23 nt, Human
gcauggacaccccuuauccagga

SEQ ID NO: 2620126 - RNA, 15 nt, Human
gcauggagaauaaac

SEQ ID NO: 2620127 - RNA, 15 nt, Human
gcaugcugucccuua

SEQ ID NO: 2620128 - RNA, 16 nt, Human
gcaugcuggggcaagu

SEQ ID NO: 2620129 - RNA, 21 nt, Human
gcaugccuuccagcacccugc

SEQ ID NO: 2620130 - RNA, 16 nt, Human
gcaugccuuccagcac

SEQ ID NO: 2620131 - RNA, 14 nt, Human
gcaugcgcacaagg

SEQ ID NO: 2620132 - RNA, 13 nt, Human
gcaugcggcccag

SEQ ID NO: 2620133 - RNA, 21 nt, Human
gcaugcgcacaaggcugacca

SEQ ID NO: 2620134 - RNA, 15 nt, Human
gcaugcccccucgug

SEQ ID NO: 2620135 - RNA, 12 nt, Human
gcaugcccccuc

SEQ ID NO: 2620136 - RNA, 13 nt, Human
gcaugccugugug

SEQ ID NO: 2620137 - RNA, 15 nt, Human
gcaugccugugugac

SEQ ID NO: 2620138 - RNA, 16 nt, Human
gcauugccaagggcuu

SEQ ID NO: 2620139 - RNA, 14 nt, Human
gcauugccauuccc

SEQ ID NO: 2620140 - RNA, 14 nt, Human
gcauugccaagggc

SEQ ID NO: 2620141 - RNA, 13 nt, Human
gcauugcauggac

SEQ ID NO: 2620142 - RNA, 13 nt, Human
gcauugcugguuc

SEQ ID NO: 2620143 - RNA, 15 nt, Human
gcauugcuuuccacu

SEQ ID NO: 2620144 - RNA, 12 nt, Human
gcauugcuuucc

SEQ ID NO: 2620145 - RNA, 12 nt, Human
gcauugcuuucu

SEQ ID NO: 2620146 - RNA, 14 nt, Human
gcauucucugaaga

SEQ ID NO: 2620147 - RNA, 16 nt, Human
gcauugauggggaagg

SEQ ID NO: 2620148 - RNA, 17 nt, Human
gcauugauggggaagga

SEQ ID NO: 2620149 - RNA, 18 nt, Human
gcauugauggggaaggag

SEQ ID NO: 2620150 - RNA, 14 nt, Human
gcauucucauggag

SEQ ID NO: 2620151 - RNA, 18 nt, Human
gcauucucacuccuaccu

SEQ ID NO: 2620152 - RNA, 13 nt, Human
gcauucuaguacu

SEQ ID NO: 2620153 - RNA, 23 nt, Human
gcauuccuucuuugauaauguua

SEQ ID NO: 2620154 - RNA, 15 nt, Human
gcauucucacuccua

SEQ ID NO: 2620155 - RNA, 13 nt, Human
gcauucucacucc

SEQ ID NO: 2620156 - RNA, 22 nt, Human
gcauuccuucuuugauaauguu

SEQ ID NO: 2620157 - RNA, 13 nt, Human
gcauucccagugg

SEQ ID NO: 2620158 - RNA, 12 nt, Human
gcauuccccagg

SEQ ID NO: 2620159 - RNA, 12 nt, Human
gcauuccccacu

SEQ ID NO: 2620160 - RNA, 15 nt, Human
gcauuggcagcaggu

SEQ ID NO: 2620161 - RNA, 17 nt, Human
gcauuugcugaauacag

SEQ ID NO: 2620162 - RNA, 16 nt, Human
gcauuuggauuggggu

SEQ ID NO: 2620163 - RNA, 22 nt, Human
gcauuuggauuggggucccucu

SEQ ID NO: 2620164 - RNA, 21 nt, Human
gcauuuggugguuucagaaau

SEQ ID NO: 2620165 - RNA, 23 nt, Human
gcauuugcugaauacagaggcaa

SEQ ID NO: 2620166 - RNA, 16 nt, Human
gcauuggaagacccca

SEQ ID NO: 2620167 - RNA, 20 nt, Human
gcauugcuuucugaaauuag

SEQ ID NO: 2620168 - RNA, 21 nt, Human
gcauuggaaacccuauuuccc

SEQ ID NO: 2620169 - RNA, 13 nt, Human
gcauugcuuucug

SEQ ID NO: 2620170 - RNA, 15 nt, Human
gcauuuuaaaaauga

SEQ ID NO: 2620171 - RNA, 23 nt, Human
gcauuuggauuggggucccucua

SEQ ID NO: 2620172 - RNA, 16 nt, Human
gcauuuuacuguacag

SEQ ID NO: 2620173 - RNA, 16 nt, Human
gcauuuuauugcuuga

SEQ ID NO: 2620174 - RNA, 12 nt, Human
gcauuuuauucu

SEQ ID NO: 2620175 - RNA, 17 nt, Human
gcauuuuaaaaaugaaa

SEQ ID NO: 2620176 - RNA, 13 nt, Human
gcauuuuauaaau

SEQ ID NO: 2620177 - RNA, 17 nt, Human
gcauuuuacuguacaga

SEQ ID NO: 2620178 - RNA, 21 nt, Human
gccaaacucaccugccccuca

SEQ ID NO: 2620179 - RNA, 18 nt, Human
gccaaacucugccagcca

SEQ ID NO: 2620180 - RNA, 19 nt, Human
gccaaacucaccugccccu

SEQ ID NO: 2620181 - RNA, 15 nt, Human
gccaaacagccacac

SEQ ID NO: 2620182 - RNA, 20 nt, Human
gccaaaggaagcacaugccu

SEQ ID NO: 2620183 - RNA, 16 nt, Human
gccaaaggaagcacau

SEQ ID NO: 2620184 - RNA, 14 nt, Human
gccaaaggaagcac

SEQ ID NO: 2620185 - RNA, 17 nt, Human
gccaaacucugccagcc

SEQ ID NO: 2620186 - RNA, 23 nt, Human
gccaaacaaaaagguucucaggu

SEQ ID NO: 2620187 - RNA, 14 nt, Human
gccaaaagcugcuc

SEQ ID NO: 2620188 - RNA, 15 nt, Human
gccaaaagcugcuca

SEQ ID NO: 2620189 - RNA, 16 nt, Human
gcauuuuguuugguau

SEQ ID NO: 2620190 - RNA, 23 nt, Human
gcauuuuguauuugucuaacugg

SEQ ID NO: 2620191 - RNA, 14 nt, Human
gcauuuuguauuug

SEQ ID NO: 2620192 - RNA, 19 nt, Human
gcauuuugcuauuguaaau

SEQ ID NO: 2620193 - RNA, 17 nt, Human
gcauuuugcuauuguaa

SEQ ID NO: 2620194 - RNA, 14 nt, Human
gcauuuugcuauug

SEQ ID NO: 2620195 - RNA, 13 nt, Human
gcauuuugcuauu

SEQ ID NO: 2620196 - RNA, 22 nt, Human
gcauuuuggagaguuuccugaa

SEQ ID NO: 2620197 - RNA, 23 nt, Human
gcauuuuggagaguuuccugaaa

SEQ ID NO: 2620198 - RNA, 22 nt, Human
gcauuuugcuaaaugugaauga

SEQ ID NO: 2620199 - RNA, 14 nt, Human
gcauuuucccagau

SEQ ID NO: 2620200 - RNA, 18 nt, Human
gcauuuucaccccacccu

SEQ ID NO: 2620201 - RNA, 20 nt, Human
gcauuuuccuccaucgcagu

SEQ ID NO: 2620202 - RNA, 22 nt, Human
gcccacccuccugucuucccag

SEQ ID NO: 2620203 - RNA, 19 nt, Human
gcccacccuccugucuucc

SEQ ID NO: 2620204 - RNA, 18 nt, Human
gcccacccuccugucuuc

SEQ ID NO: 2620205 - RNA, 20 nt, Human
gcccacccuccugucuuccc

SEQ ID NO: 2620206 - RNA, 18 nt, Human
gcccaccccgcucugcau

SEQ ID NO: 2620207 - RNA, 17 nt, Human
gcccaccccgcucugca

SEQ ID NO: 2620208 - RNA, 13 nt, Human
gcccaccccgcuc

SEQ ID NO: 2620209 - RNA, 22 nt, Human
gcccacccccugcccugcacgu

SEQ ID NO: 2620210 - RNA, 14 nt, Human
gcccacccuccugu

SEQ ID NO: 2620211 - RNA, 19 nt, Human
gcccacccguggagauggg

SEQ ID NO: 2620212 - RNA, 20 nt, Human
gcccacccccugcccugcac

SEQ ID NO: 2620213 - RNA, 19 nt, Human
gcccacccccugcccugca

SEQ ID NO: 2620214 - RNA, 18 nt, Human
gcccacccccugcccugc

SEQ ID NO: 2620215 - RNA, 17 nt, Human
gcccacccccugcccug

SEQ ID NO: 2620216 - RNA, 16 nt, Human
gcccacccccugcccu

SEQ ID NO: 2620217 - RNA, 15 nt, Human
gcccacccccugccc

SEQ ID NO: 2620218 - RNA, 14 nt, Human
gcccacccccugcc

SEQ ID NO: 2620219 - RNA, 22 nt, Human
gcccacccccucaagccaaucc

SEQ ID NO: 2620220 - RNA, 15 nt, Human
gcccaccccucaaca

SEQ ID NO: 2620221 - RNA, 18 nt, Human
gcccacaggaucagucug

SEQ ID NO: 2620222 - RNA, 13 nt, Human
gcccacaggauca

SEQ ID NO: 2620223 - RNA, 19 nt, Human
gcccacaggaucagucuga

SEQ ID NO: 2620224 - RNA, 15 nt, Human
gcccacccccucaag

SEQ ID NO: 2620225 - RNA, 19 nt, Human
gcccacagggaacccugcu

SEQ ID NO: 2620226 - RNA, 12 nt, Human
gcccacagggaa

SEQ ID NO: 2620227 - RNA, 19 nt, Human
gcccacagcucccacccca

SEQ ID NO: 2620228 - RNA, 15 nt, Human
gcccaccccccucau

SEQ ID NO: 2620229 - RNA, 16 nt, Human
gcccaaagaugcagcc

SEQ ID NO: 2620230 - RNA, 15 nt, Human
gcccaaagaugcagc

SEQ ID NO: 2620231 - RNA, 16 nt, Human
gcccaaagccagacag

SEQ ID NO: 2620232 - RNA, 17 nt, Human
gcccaaagccagacagc

SEQ ID NO: 2620233 - RNA, 17 nt, Human
gcccaaagucuguguga

SEQ ID NO: 2620234 - RNA, 19 nt, Human
gcccaaagugguauagaaa

SEQ ID NO: 2620235 - RNA, 16 nt, Human
gcccacagcuguauga

SEQ ID NO: 2620236 - RNA, 16 nt, Human
gcccacagcaggugcu

SEQ ID NO: 2620237 - RNA, 14 nt, Human
gcccacagcuccca

SEQ ID NO: 2620238 - RNA, 13 nt, Human
gcccacagcuccc

SEQ ID NO: 2620239 - RNA, 16 nt, Human
gcccacagcucccacc

SEQ ID NO: 2620240 - RNA, 17 nt, Human
gcccacagcucccaccc

SEQ ID NO: 2620241 - RNA, 13 nt, Human
gcccacacuugag

SEQ ID NO: 2620242 - RNA, 13 nt, Human
gcccacacccccu

SEQ ID NO: 2620243 - RNA, 23 nt, Human
gcccacacccagcuacuuuaaca

SEQ ID NO: 2620244 - RNA, 13 nt, Human
gcccacacacccc

SEQ ID NO: 2620245 - RNA, 17 nt, Human
gccauuucuuccacaag

SEQ ID NO: 2620246 - RNA, 21 nt, Human
gccauuuagccaccaucuuug

SEQ ID NO: 2620247 - RNA, 23 nt, Human
gccauugucuucggaaaccuugg

SEQ ID NO: 2620248 - RNA, 22 nt, Human
gccauuuaaagcuuauuaaaac

SEQ ID NO: 2620249 - RNA, 24 nt, Human
gccauggcuuccaagguggucugc

SEQ ID NO: 2620250 - RNA, 19 nt, Human
gccauggcuuccaaggugg

SEQ ID NO: 2620251 - RNA, 22 nt, Human
gccauuucuuccacaagagccc

SEQ ID NO: 2620252 - RNA, 20 nt, Human
gccauuucuuccacaagagc

SEQ ID NO: 2620253 - RNA, 15 nt, Human
gccauuugcuuuuuc

SEQ ID NO: 2620254 - RNA, 20 nt, Human
gccauuugcacccuccgccu

SEQ ID NO: 2620255 - RNA, 23 nt, Human
gccauuugcacccuccgccuuca

SEQ ID NO: 2620256 - RNA, 16 nt, Human
gccaucccagccuugg

SEQ ID NO: 2620257 - RNA, 20 nt, Human
gccauggagagcuggagccu

SEQ ID NO: 2620258 - RNA, 18 nt, Human
gccauggagagcuggagc

SEQ ID NO: 2620259 - RNA, 16 nt, Human
gccauggagagcugga

SEQ ID NO: 2620260 - RNA, 15 nt, Human
gccauggagagcugg

SEQ ID NO: 2620261 - RNA, 18 nt, Human
gccauggaggcacacagc

SEQ ID NO: 2620262 - RNA, 16 nt, Human
gccauggaggcacaca

SEQ ID NO: 2620263 - RNA, 23 nt, Human
gccauggagagcuggagccuggu

SEQ ID NO: 2620264 - RNA, 22 nt, Human
gccauggagagcuggagccugg

SEQ ID NO: 2620265 - RNA, 15 nt, Human
gccauggaggcacac

SEQ ID NO: 2620266 - RNA, 14 nt, Human
gccaugggacaggg

SEQ ID NO: 2620267 - RNA, 19 nt, Human
gccaugggacagggaggac

SEQ ID NO: 2620268 - RNA, 16 nt, Human
gccauggcgugucccu

SEQ ID NO: 2620269 - RNA, 17 nt, Human
gccauggcgugucccuc

SEQ ID NO: 2620270 - RNA, 20 nt, Human
gccauggcugucucaaacca

SEQ ID NO: 2620271 - RNA, 22 nt, Human
gccauggcgugucccucucgga

SEQ ID NO: 2620272 - RNA, 21 nt, Human
gccauggaggcacacagcugc

SEQ ID NO: 2620273 - RNA, 18 nt, Human
gccaggaagccagcaggc

SEQ ID NO: 2620274 - RNA, 17 nt, Human
gccaggaagccagcagg

SEQ ID NO: 2620275 - RNA, 11 nt, Human
gccaggaagcc

SEQ ID NO: 2620276 - RNA, 15 nt, Human
gccagcuuucccugc

SEQ ID NO: 2620277 - RNA, 17 nt, Human
gccagcuuuuccucccu

SEQ ID NO: 2620278 - RNA, 19 nt, Human
gccaggaagccagcaggcu

SEQ ID NO: 2620279 - RNA, 20 nt, Human
gccaggaagccagcaggcuc

SEQ ID NO: 2620280 - RNA, 13 nt, Human
gccagggcccugc

SEQ ID NO: 2620281 - RNA, 15 nt, Human
gccagggcccugcag

SEQ ID NO: 2620282 - RNA, 16 nt, Human
gccagggcccugcaga

SEQ ID NO: 2620283 - RNA, 17 nt, Human
gccagggcccugcagag

SEQ ID NO: 2620284 - RNA, 19 nt, Human
gccagggcccugcagaggg

SEQ ID NO: 2620285 - RNA, 23 nt, Human
gccaggguguggcccugccaucu

SEQ ID NO: 2620286 - RNA, 20 nt, Human
gccaggguguggcccugcca

SEQ ID NO: 2620287 - RNA, 14 nt, Human
gccaggguguggcc

SEQ ID NO: 2620288 - RNA, 20 nt, Human
gccaggguggucuugaucuc

SEQ ID NO: 2620289 - RNA, 23 nt, Human
gccaggggaaaaucagccugcuc

SEQ ID NO: 2620290 - RNA, 16 nt, Human
gccagguccuugcccu

SEQ ID NO: 2620291 - RNA, 22 nt, Human
gccaggucacccuuugcuguga

SEQ ID NO: 2620292 - RNA, 21 nt, Human
gccaggucacccuuugcugug

SEQ ID NO: 2620293 - RNA, 21 nt, Human
gccagguaaugugaauaaauu

SEQ ID NO: 2620294 - RNA, 16 nt, Human
gccagguaaugaggga

SEQ ID NO: 2620295 - RNA, 21 nt, Human
gccaggguuucgagaagcugc

SEQ ID NO: 2620296 - RNA, 15 nt, Human
gccagguaaugugaa

SEQ ID NO: 2620297 - RNA, 21 nt, Human
gccaggggaaaaucagccugc

SEQ ID NO: 2620298 - RNA, 22 nt, Human
gccaggggaaaaucagccugcu

SEQ ID NO: 2620299 - RNA, 17 nt, Human
gccaggggaaaaucagc

SEQ ID NO: 2620300 - RNA, 22 nt, Human
gccagggcuauagcucaggacc

SEQ ID NO: 2620301 - RNA, 22 nt, Human
gccagggccuggaagacagaga

SEQ ID NO: 2620302 - RNA, 11 nt, Human
gccagggcugc

SEQ ID NO: 2620303 - RNA, 16 nt, Human
gccagggccuggaaga

SEQ ID NO: 2620304 - RNA, 15 nt, Human
gccagggccuggaag

SEQ ID NO: 2620305 - RNA, 17 nt, Human
gccaucccagccuuggc

SEQ ID NO: 2620306 - RNA, 14 nt, Human
gccagugacagaca

SEQ ID NO: 2620307 - RNA, 17 nt, Human
gccaucccagccccaau

SEQ ID NO: 2620308 - RNA, 16 nt, Human
gccaucccagccccaa

SEQ ID NO: 2620309 - RNA, 15 nt, Human
gccaucccagcccca

SEQ ID NO: 2620310 - RNA, 14 nt, Human
gccaucccagcccc

SEQ ID NO: 2620311 - RNA, 13 nt, Human
gccaucccagccc

SEQ ID NO: 2620312 - RNA, 14 nt, Human
gccagucgcgcugc

SEQ ID NO: 2620313 - RNA, 15 nt, Human
gccagucgcgcugcc

SEQ ID NO: 2620314 - RNA, 19 nt, Human
gccaguccugccuggccag

SEQ ID NO: 2620315 - RNA, 20 nt, Human
gccaguccugccuggccagg

SEQ ID NO: 2620316 - RNA, 19 nt, Human
gccagucgcgcugccugug

SEQ ID NO: 2620317 - RNA, 18 nt, Human
gccagucgcgcugccugu

SEQ ID NO: 2620318 - RNA, 17 nt, Human
gccagucgcgcugccug

SEQ ID NO: 2620319 - RNA, 16 nt, Human
gccagucgcgcugccu

SEQ ID NO: 2620320 - RNA, 14 nt, Human
gccagucugggcug

SEQ ID NO: 2620321 - RNA, 13 nt, Human
gccagucugggcu

SEQ ID NO: 2620322 - RNA, 20 nt, Human
gccagucgcgcugccugugu

SEQ ID NO: 2620323 - RNA, 22 nt, Human
gccagucucacugugggaaggc

SEQ ID NO: 2620324 - RNA, 16 nt, Human
gccaggugccuuggag

SEQ ID NO: 2620325 - RNA, 15 nt, Human
gccaggugccuugga

SEQ ID NO: 2620326 - RNA, 14 nt, Human
gccaggugccuugg

SEQ ID NO: 2620327 - RNA, 13 nt, Human
gccaggugccuug

SEQ ID NO: 2620328 - RNA, 18 nt, Human
gccaguccugccuggcca

SEQ ID NO: 2620329 - RNA, 12 nt, Human
gccaggugccuu

SEQ ID NO: 2620330 - RNA, 14 nt, Human
gccaggugcagugg

SEQ ID NO: 2620331 - RNA, 13 nt, Human
gccaggugcagug

SEQ ID NO: 2620332 - RNA, 20 nt, Human
gccauccagguucagcuugu

SEQ ID NO: 2620333 - RNA, 19 nt, Human
gccauccagguucagcuug

SEQ ID NO: 2620334 - RNA, 20 nt, Human
gccagucuguggaucagaga

SEQ ID NO: 2620335 - RNA, 13 nt, Human
gccagucugugga

SEQ ID NO: 2620336 - RNA, 16 nt, Human
gccagucugggcugcc

SEQ ID NO: 2620337 - RNA, 15 nt, Human
gccagucugggcugc

SEQ ID NO: 2620338 - RNA, 12 nt, Human
gccagucugugg

SEQ ID NO: 2620339 - RNA, 13 nt, Human
gccagugacagac

SEQ ID NO: 2620340 - RNA, 13 nt, Human
gccagucuugugu

SEQ ID NO: 2620341 - RNA, 17 nt, Human
gccagucugggcugccg

SEQ ID NO: 2620342 - RNA, 20 nt, Human
gccagucuugacgaguguga

SEQ ID NO: 2620343 - RNA, 21 nt, Human
gccagaugcugauguucagug

SEQ ID NO: 2620344 - RNA, 20 nt, Human
gccagaugcugauguucagu

SEQ ID NO: 2620345 - RNA, 19 nt, Human
gccagaugcugauguucag

SEQ ID NO: 2620346 - RNA, 17 nt, Human
gccagaugcugauguuc

SEQ ID NO: 2620347 - RNA, 16 nt, Human
gccagaugcugauguu

SEQ ID NO: 2620348 - RNA, 15 nt, Human
gccagaugcugaugu

SEQ ID NO: 2620349 - RNA, 23 nt, Human
gccagaggaacuguccagagagc

SEQ ID NO: 2620350 - RNA, 22 nt, Human
gccagaggaacuguccagagag

SEQ ID NO: 2620351 - RNA, 16 nt, Human
gccagauucuuuccug

SEQ ID NO: 2620352 - RNA, 20 nt, Human
gccagagggagugacagagg

SEQ ID NO: 2620353 - RNA, 19 nt, Human
gccagagggagugacagag

SEQ ID NO: 2620354 - RNA, 14 nt, Human
gccagauggggccu

SEQ ID NO: 2620355 - RNA, 22 nt, Human
gccagauggacuccagccugcc

SEQ ID NO: 2620356 - RNA, 24 nt, Human
gccagaugcugauguucaguguaa

SEQ ID NO: 2620357 - RNA, 17 nt, Human
gccagauucuuuccuga

SEQ ID NO: 2620358 - RNA, 17 nt, Human
gccagccccggcccugg

SEQ ID NO: 2620359 - RNA, 19 nt, Human
gccagccccacccaggagg

SEQ ID NO: 2620360 - RNA, 18 nt, Human
gccagauggggccucugu

SEQ ID NO: 2620361 - RNA, 17 nt, Human
gccagauggggccucug

SEQ ID NO: 2620362 - RNA, 18 nt, Human
gccagccccacccaggag

SEQ ID NO: 2620363 - RNA, 19 nt, Human
gccagccccggcccugggc

SEQ ID NO: 2620364 - RNA, 18 nt, Human
gccagccccggcccuggg

SEQ ID NO: 2620365 - RNA, 11 nt, Human
gccagccccuc

SEQ ID NO: 2620366 - RNA, 12 nt, Human
gccagccccucc

SEQ ID NO: 2620367 - RNA, 21 nt, Human
gccagccccggcccugggcuc

SEQ ID NO: 2620368 - RNA, 16 nt, Human
gccagccccucccacc

SEQ ID NO: 2620369 - RNA, 19 nt, Human
gccagccuucuuccauccc

SEQ ID NO: 2620370 - RNA, 12 nt, Human
gccagccuucuu

SEQ ID NO: 2620371 - RNA, 22 nt, Human
gccagccuuccucugcagcuga

SEQ ID NO: 2620372 - RNA, 21 nt, Human
gccagccuuccucugcagcug

SEQ ID NO: 2620373 - RNA, 19 nt, Human
gccagccuuccucugcagc

SEQ ID NO: 2620374 - RNA, 17 nt, Human
gccagccuuccucugca

SEQ ID NO: 2620375 - RNA, 16 nt, Human
gccagccuuccucugc

SEQ ID NO: 2620376 - RNA, 20 nt, Human
gccagccugucccauggaca

SEQ ID NO: 2620377 - RNA, 12 nt, Human
gccagccuugac

SEQ ID NO: 2620378 - RNA, 20 nt, Human
gccagccgagauagccaagg

SEQ ID NO: 2620379 - RNA, 21 nt, Human
gccagccgagauagccaaggc

SEQ ID NO: 2620380 - RNA, 20 nt, Human
gccagccccuggccccagga

SEQ ID NO: 2620381 - RNA, 14 nt, Human
gccagccccuggcc

SEQ ID NO: 2620382 - RNA, 19 nt, Human
gccagccccuggccccagg

SEQ ID NO: 2620383 - RNA, 17 nt, Human
gccagccccucccacca

SEQ ID NO: 2620384 - RNA, 20 nt, Human
gccagccccucccaccacag

SEQ ID NO: 2620385 - RNA, 21 nt, Human
gccagccccucccaccacagc

SEQ ID NO: 2620386 - RNA, 22 nt, Human
gccagcccucccuguccuccuc

SEQ ID NO: 2620387 - RNA, 23 nt, Human
gccagcccucccuguccuccucg

SEQ ID NO: 2620388 - RNA, 15 nt, Human
gccagcccggcuggu

SEQ ID NO: 2620389 - RNA, 10 nt, Human
gccagcccuc

SEQ ID NO: 2620390 - RNA, 13 nt, Human
gccagcccucccu

SEQ ID NO: 2620391 - RNA, 14 nt, Human
gccagcccucccug

SEQ ID NO: 2620392 - RNA, 15 nt, Human
gccagcccucccugu

SEQ ID NO: 2620393 - RNA, 17 nt, Human
gccagcccucccugucc

SEQ ID NO: 2620394 - RNA, 20 nt, Human
gccagcccucccuguccucc

SEQ ID NO: 2620395 - RNA, 21 nt, Human
gccagcccucccuguccuccu

SEQ ID NO: 2620396 - RNA, 18 nt, Human
gccagcuuguuauuuaua

SEQ ID NO: 2620397 - RNA, 14 nt, Human
gccagcuggcagca

SEQ ID NO: 2620398 - RNA, 17 nt, Human
gccagcuggcagcagag

SEQ ID NO: 2620399 - RNA, 18 nt, Human
gccagcuggcagcagagu

SEQ ID NO: 2620400 - RNA, 15 nt, Human
gccagcugcuugggc

SEQ ID NO: 2620401 - RNA, 13 nt, Human
gccagcuggagaa

SEQ ID NO: 2620402 - RNA, 14 nt, Human
gccagcugcuuggg

SEQ ID NO: 2620403 - RNA, 14 nt, Human
gccagcugcucccc

SEQ ID NO: 2620404 - RNA, 15 nt, Human
gccagcugcucccca

SEQ ID NO: 2620405 - RNA, 16 nt, Human
gccagcugcuccccag

SEQ ID NO: 2620406 - RNA, 13 nt, Human
gccagcucccucu

SEQ ID NO: 2620407 - RNA, 16 nt, Human
gccagcucagucccau

SEQ ID NO: 2620408 - RNA, 13 nt, Human
gccagcucucagc

SEQ ID NO: 2620409 - RNA, 14 nt, Human
gccagcucucagcc

SEQ ID NO: 2620410 - RNA, 13 nt, Human
gccagcucuguau

SEQ ID NO: 2620411 - RNA, 15 nt, Human
gccagcucucagcca

SEQ ID NO: 2620412 - RNA, 14 nt, Human
gccagcucauuuca

SEQ ID NO: 2620413 - RNA, 13 nt, Human
gccagcugcuccc

SEQ ID NO: 2620414 - RNA, 13 nt, Human
gccagcugccucc

SEQ ID NO: 2620415 - RNA, 22 nt, Human
gccagccuugaccauucuccac

SEQ ID NO: 2620416 - RNA, 21 nt, Human
gccagccuugaccauucucca

SEQ ID NO: 2620417 - RNA, 20 nt, Human
gccagccuugaccauucucc

SEQ ID NO: 2620418 - RNA, 14 nt, Human
gccagccuugacca

SEQ ID NO: 2620419 - RNA, 19 nt, Human
gccagcguccuccucugug

SEQ ID NO: 2620420 - RNA, 22 nt, Human
gccagcguccuccucugugacc

SEQ ID NO: 2620421 - RNA, 23 nt, Human
gccagcuacuuccuccuccccac

SEQ ID NO: 2620422 - RNA, 12 nt, Human
gccagcgaacuu

SEQ ID NO: 2620423 - RNA, 21 nt, Human
gccagccuucuuccaucccag

SEQ ID NO: 2620424 - RNA, 12 nt, Human
gccagcguccuc

SEQ ID NO: 2620425 - RNA, 13 nt, Human
gccagcguccucc

SEQ ID NO: 2620426 - RNA, 16 nt, Human
gccagcgaacuugaca

SEQ ID NO: 2620427 - RNA, 19 nt, Human
gccagcgggaauggcagcu

SEQ ID NO: 2620428 - RNA, 13 nt, Human
gccacucagcuuc

SEQ ID NO: 2620429 - RNA, 16 nt, Human
gccacucaccgaagcc

SEQ ID NO: 2620430 - RNA, 23 nt, Human
gccacucacuaggcccccacuug

SEQ ID NO: 2620431 - RNA, 19 nt, Human
gccacucacuaggccccca

SEQ ID NO: 2620432 - RNA, 18 nt, Human
gccacucacuaggccccc

SEQ ID NO: 2620433 - RNA, 20 nt, Human
gccacucacacagccaggug

SEQ ID NO: 2620434 - RNA, 18 nt, Human
gccacucacacagccagg

SEQ ID NO: 2620435 - RNA, 17 nt, Human
gccacucacacagccag

SEQ ID NO: 2620436 - RNA, 14 nt, Human
gccacucacacagc

SEQ ID NO: 2620437 - RNA, 15 nt, Human
gccacucacuaggcc

SEQ ID NO: 2620438 - RNA, 14 nt, Human
gccacucacuaggc

SEQ ID NO: 2620439 - RNA, 23 nt, Human
gccacuaacuagagcagcccugg

SEQ ID NO: 2620440 - RNA, 20 nt, Human
gccacuauuguuagucucuu

SEQ ID NO: 2620441 - RNA, 21 nt, Human
gccacuauuguuagucucuug

SEQ ID NO: 2620442 - RNA, 16 nt, Human
gccacggccaggccag

SEQ ID NO: 2620443 - RNA, 21 nt, Human
gccacgugggcaaacaggcag

SEQ ID NO: 2620444 - RNA, 18 nt, Human
gccacgugccaggcccgg

SEQ ID NO: 2620445 - RNA, 16 nt, Human
gccacgugccaggccc

SEQ ID NO: 2620446 - RNA, 17 nt, Human
gccacgugccaggcccg

SEQ ID NO: 2620447 - RNA, 14 nt, Human
gccacgugccaggc

SEQ ID NO: 2620448 - RNA, 22 nt, Human
gccacguucuuacuaguuuccc

SEQ ID NO: 2620449 - RNA, 22 nt, Human
gccacguuggagaagcccgugu

SEQ ID NO: 2620450 - RNA, 22 nt, Human
gccacguuccuuacugcagaau

SEQ ID NO: 2620451 - RNA, 23 nt, Human
gccacguguuugugcuguggugu

SEQ ID NO: 2620452 - RNA, 16 nt, Human
gccacguuccuuacug

SEQ ID NO: 2620453 - RNA, 21 nt, Human
gccacguuccuuacugcagaa

SEQ ID NO: 2620454 - RNA, 22 nt, Human
gccaaauaaugucucugugaga

SEQ ID NO: 2620455 - RNA, 18 nt, Human
gccaaauaaugucucugu

SEQ ID NO: 2620456 - RNA, 15 nt, Human
gccaaauauguccug

SEQ ID NO: 2620457 - RNA, 16 nt, Human
gccaaauaaugucucu

SEQ ID NO: 2620458 - RNA, 12 nt, Human
gccaaaguguua

SEQ ID NO: 2620459 - RNA, 17 nt, Human
gccaaaggaugugauau

SEQ ID NO: 2620460 - RNA, 16 nt, Human
gccaaaggaugugaua

SEQ ID NO: 2620461 - RNA, 18 nt, Human
gccaaaggaugugauaua

SEQ ID NO: 2620462 - RNA, 19 nt, Human
gccaaagggaaauaucauu

SEQ ID NO: 2620463 - RNA, 19 nt, Human
gccaaagacuuaguauauu

SEQ ID NO: 2620464 - RNA, 16 nt, Human
gccaaagauaaucucu

SEQ ID NO: 2620465 - RNA, 14 nt, Human
gccaaagaucacuu

SEQ ID NO: 2620466 - RNA, 23 nt, Human
gccaaaggagggucaggaaggau

SEQ ID NO: 2620467 - RNA, 15 nt, Human
gccacggccaggcca

SEQ ID NO: 2620468 - RNA, 14 nt, Human
gccacggccaggcc

SEQ ID NO: 2620469 - RNA, 17 nt, Human
gccaaauauguccuggg

SEQ ID NO: 2620470 - RNA, 22 nt, Human
gccaaaugguuuaacuucugcc

SEQ ID NO: 2620471 - RNA, 16 nt, Human
gccaaauguaauugaa

SEQ ID NO: 2620472 - RNA, 18 nt, Human
gccaaauguaauugaaua

SEQ ID NO: 2620473 - RNA, 14 nt, Human
gccacggcagccua

SEQ ID NO: 2620474 - RNA, 18 nt, Human
gccacuccagaccccugg

SEQ ID NO: 2620475 - RNA, 16 nt, Human
gccacuccagaccccu

SEQ ID NO: 2620476 - RNA, 19 nt, Human
gccacuccagaccccuggc

SEQ ID NO: 2620477 - RNA, 19 nt, Human
gccacugaagcugggauuc

SEQ ID NO: 2620478 - RNA, 16 nt, Human
gccacucauuccugua

SEQ ID NO: 2620479 - RNA, 15 nt, Human
gccacucagcuuccu

SEQ ID NO: 2620480 - RNA, 22 nt, Human
gccacucaggcccaaagccucg

SEQ ID NO: 2620481 - RNA, 14 nt, Human
gccacucaggccca

SEQ ID NO: 2620482 - RNA, 20 nt, Human
gccacucaggaggcugaggc

SEQ ID NO: 2620483 - RNA, 21 nt, Human
gccacucaggaggcugaggca

SEQ ID NO: 2620484 - RNA, 16 nt, Human
gccacugcacagagcu

SEQ ID NO: 2620485 - RNA, 15 nt, Human
gccacugcacagagc

SEQ ID NO: 2620486 - RNA, 22 nt, Human
gccacugcacagagcucuccag

SEQ ID NO: 2620487 - RNA, 17 nt, Human
gccacugcacagagcuc

SEQ ID NO: 2620488 - RNA, 10 nt, Human
gccagagaag

SEQ ID NO: 2620489 - RNA, 13 nt, Human
gccagagaaguga

SEQ ID NO: 2620490 - RNA, 11 nt, Human
gccagagaagu

SEQ ID NO: 2620491 - RNA, 13 nt, Human
gccagagaagcua

SEQ ID NO: 2620492 - RNA, 18 nt, Human
gccacugcaccgggccac

SEQ ID NO: 2620493 - RNA, 17 nt, Human
gccacugcaccgggcca

SEQ ID NO: 2620494 - RNA, 22 nt, Human
gccagagauccaaaagaagccc

SEQ ID NO: 2620495 - RNA, 12 nt, Human
gccagagccagg

SEQ ID NO: 2620496 - RNA, 14 nt, Human
gccagagccagggg

SEQ ID NO: 2620497 - RNA, 17 nt, Human
gccagagaagugacagg

SEQ ID NO: 2620498 - RNA, 16 nt, Human
gccagagaagugacag

SEQ ID NO: 2620499 - RNA, 15 nt, Human
gccagagaagugaca

SEQ ID NO: 2620500 - RNA, 14 nt, Human
gccagagaagugac

SEQ ID NO: 2620501 - RNA, 19 nt, Human
gccagagaagugacaggga

SEQ ID NO: 2620502 - RNA, 18 nt, Human
gccagagaagugacaggg

SEQ ID NO: 2620503 - RNA, 23 nt, Human
gccagagauccaaaagaagcccc

SEQ ID NO: 2620504 - RNA, 15 nt, Human
gccagagacacaagc

SEQ ID NO: 2620505 - RNA, 12 nt, Human
gccagagacaca

SEQ ID NO: 2620506 - RNA, 21 nt, Human
gccagaggaacuguccagaga

SEQ ID NO: 2620507 - RNA, 20 nt, Human
gccagaggaacuguccagag

SEQ ID NO: 2620508 - RNA, 18 nt, Human
gccagaggaacuguccag

SEQ ID NO: 2620509 - RNA, 14 nt, Human
gccagaggaacugu

SEQ ID NO: 2620510 - RNA, 18 nt, Human
gccagagggagugacaga

SEQ ID NO: 2620511 - RNA, 15 nt, Human
gccagagcugggagg

SEQ ID NO: 2620512 - RNA, 22 nt, Human
gccagagcuacccgcagaguuc

SEQ ID NO: 2620513 - RNA, 18 nt, Human
gcccgggcucugccuccc

SEQ ID NO: 2620514 - RNA, 15 nt, Human
gcccgggcucugccu

SEQ ID NO: 2620515 - RNA, 14 nt, Human
gcccgggcucugcc

SEQ ID NO: 2620516 - RNA, 13 nt, Human
gcccgggcucugc

SEQ ID NO: 2620517 - RNA, 12 nt, Human
gcccgggcucug

SEQ ID NO: 2620518 - RNA, 15 nt, Human
gcccggcuccaggcu

SEQ ID NO: 2620519 - RNA, 14 nt, Human
gcccggcuccaggc

SEQ ID NO: 2620520 - RNA, 13 nt, Human
gcccggcuccagg

SEQ ID NO: 2620521 - RNA, 19 nt, Human
gccccuucugacccaugcu

SEQ ID NO: 2620522 - RNA, 17 nt, Human
gccccuucucagaaucu

SEQ ID NO: 2620523 - RNA, 13 nt, Human
gcccgcgcccgcg

SEQ ID NO: 2620524 - RNA, 20 nt, Human
gccccuucugacccaugcug

SEQ ID NO: 2620525 - RNA, 16 nt, Human
gccccuuccccgaggg

SEQ ID NO: 2620526 - RNA, 12 nt, Human
gccccugggcuu

SEQ ID NO: 2620527 - RNA, 11 nt, Human
gccccugggcu

SEQ ID NO: 2620528 - RNA, 18 nt, Human
gccccuucucagaaucua

SEQ ID NO: 2620529 - RNA, 20 nt, Human
gccccuuccuugcucugcac

SEQ ID NO: 2620530 - RNA, 23 nt, Human
gccccuucuagguggcaaggcug

SEQ ID NO: 2620531 - RNA, 14 nt, Human
gcccggaccuuggc

SEQ ID NO: 2620532 - RNA, 23 nt, Human
gcccgcuugccucggcuccugcu

SEQ ID NO: 2620533 - RNA, 22 nt, Human
gcccgcuugccucggcuccugc

SEQ ID NO: 2620534 - RNA, 21 nt, Human
gcccgcuugccucggcuccug

SEQ ID NO: 2620535 - RNA, 19 nt, Human
gcccgcuugccucggcucc

SEQ ID NO: 2620536 - RNA, 18 nt, Human
gcccgcuugccucggcuc

SEQ ID NO: 2620537 - RNA, 14 nt, Human
gcccgcuugccucg

SEQ ID NO: 2620538 - RNA, 12 nt, Human
gcccgcuugccu

SEQ ID NO: 2620539 - RNA, 12 nt, Human
gcccggcuccag

SEQ ID NO: 2620540 - RNA, 18 nt, Human
gcccgcugggcugagccc

SEQ ID NO: 2620541 - RNA, 17 nt, Human
gcccgcugggcugagcc

SEQ ID NO: 2620542 - RNA, 16 nt, Human
gcccgcugggcugagc

SEQ ID NO: 2620543 - RNA, 15 nt, Human
gcccgcugggcugag

SEQ ID NO: 2620544 - RNA, 14 nt, Human
gcccgcugggcuga

SEQ ID NO: 2620545 - RNA, 13 nt, Human
gcccgcugggcug

SEQ ID NO: 2620546 - RNA, 12 nt, Human
gcccgcugggcu

SEQ ID NO: 2620547 - RNA, 17 nt, Human
gcccgcugaguggacug

SEQ ID NO: 2620548 - RNA, 15 nt, Human
gcccgcucugcagac

SEQ ID NO: 2620549 - RNA, 13 nt, Human
gcccgcucccagu

SEQ ID NO: 2620550 - RNA, 22 nt, Human
gcccgcucuacaucuucugccu

SEQ ID NO: 2620551 - RNA, 12 nt, Human
gcccgcucccag

SEQ ID NO: 2620552 - RNA, 23 nt, Human
gcccgcgcccucgcccccgcccc

SEQ ID NO: 2620553 - RNA, 18 nt, Human
gcccgcggggacauuggg

SEQ ID NO: 2620554 - RNA, 16 nt, Human
gcccuccuuguccacc

SEQ ID NO: 2620555 - RNA, 14 nt, Human
gcccucuggagugg

SEQ ID NO: 2620556 - RNA, 16 nt, Human
gcccucuggaguggcc

SEQ ID NO: 2620557 - RNA, 17 nt, Human
gcccucuggaguggcca

SEQ ID NO: 2620558 - RNA, 18 nt, Human
gcccucuggaguggccac

SEQ ID NO: 2620559 - RNA, 19 nt, Human
gcccucuggaguggccacu

SEQ ID NO: 2620560 - RNA, 20 nt, Human
gcccucuggaguggccacua

SEQ ID NO: 2620561 - RNA, 22 nt, Human
gcccucuggaguggccacuaag

SEQ ID NO: 2620562 - RNA, 22 nt, Human
gcccucugcccacucccugcaa

SEQ ID NO: 2620563 - RNA, 14 nt, Human
gcccuccucuccca

SEQ ID NO: 2620564 - RNA, 17 nt, Human
gcccuccucucccauug

SEQ ID NO: 2620565 - RNA, 20 nt, Human
gcccuccucucccauugucc

SEQ ID NO: 2620566 - RNA, 12 nt, Human
gcccuccucucc

SEQ ID NO: 2620567 - RNA, 23 nt, Human
gcccuccugaaacuuacacacaa

SEQ ID NO: 2620568 - RNA, 15 nt, Human
gcccuccuuguccac

SEQ ID NO: 2620569 - RNA, 10 nt, Human
gcccuccuuc

SEQ ID NO: 2620570 - RNA, 20 nt, Human
gcccgggcucugccucccau

SEQ ID NO: 2620571 - RNA, 19 nt, Human
gcccgggcucugccuccca

SEQ ID NO: 2620572 - RNA, 21 nt, Human
gcccgggcucugccucccauc

SEQ ID NO: 2620573 - RNA, 19 nt, Human
gcccuccccauggagccag

SEQ ID NO: 2620574 - RNA, 22 nt, Human
gcccggagauuggacggccuga

SEQ ID NO: 2620575 - RNA, 19 nt, Human
gcccggagauuggacggcc

SEQ ID NO: 2620576 - RNA, 21 nt, Human
gcccggagauuggacggccug

SEQ ID NO: 2620577 - RNA, 13 nt, Human
gcccucccgcccc

SEQ ID NO: 2620578 - RNA, 22 nt, Human
gcccuccccuccccugcugcag

SEQ ID NO: 2620579 - RNA, 18 nt, Human
gcccuccuacccugcgcc

SEQ ID NO: 2620580 - RNA, 15 nt, Human
gcccucccugccccu

SEQ ID NO: 2620581 - RNA, 15 nt, Human
gcccucccgccccuu

SEQ ID NO: 2620582 - RNA, 13 nt, Human
gcccuccucaccc

SEQ ID NO: 2620583 - RNA, 14 nt, Human
gcccuccucacccc

SEQ ID NO: 2620584 - RNA, 21 nt, Human
gcccuccucaccccgucuggg

SEQ ID NO: 2620585 - RNA, 24 nt, Human
gcccuccuacccugcgcccagucc

SEQ ID NO: 2620586 - RNA, 19 nt, Human
gcccuccuacccugcgccc

SEQ ID NO: 2620587 - RNA, 19 nt, Human
gcccuccccuccccugcug

SEQ ID NO: 2620588 - RNA, 18 nt, Human
gcccuccccuccccugcu

SEQ ID NO: 2620589 - RNA, 17 nt, Human
gcccuccccuccccugc

SEQ ID NO: 2620590 - RNA, 16 nt, Human
gcccuccccuccccug

SEQ ID NO: 2620591 - RNA, 13 nt, Human
gcccuccccuccc

SEQ ID NO: 2620592 - RNA, 18 nt, Human
gcccuccccauggagcca

SEQ ID NO: 2620593 - RNA, 12 nt, Human
gcccuccccucc

SEQ ID NO: 2620594 - RNA, 19 nt, Human
gcccuccccucucugcacc

SEQ ID NO: 2620595 - RNA, 18 nt, Human
gcccuccccucucugcac

SEQ ID NO: 2620596 - RNA, 21 nt, Human
gcccuccccuccccugcugca

SEQ ID NO: 2620597 - RNA, 20 nt, Human
gcccuccccuccccugcugc

SEQ ID NO: 2620598 - RNA, 15 nt, Human
gcccuccccucucug

SEQ ID NO: 2620599 - RNA, 21 nt, Human
gccccucccacacacacccac

SEQ ID NO: 2620600 - RNA, 15 nt, Human
gccccucccacacac

SEQ ID NO: 2620601 - RNA, 14 nt, Human
gccccuccagcuug

SEQ ID NO: 2620602 - RNA, 18 nt, Human
gccccuccagcuugugga

SEQ ID NO: 2620603 - RNA, 13 nt, Human
gccccuccagcuu

SEQ ID NO: 2620604 - RNA, 12 nt, Human
gccccuccagcu

SEQ ID NO: 2620605 - RNA, 21 nt, Human
gccccucaucugcucagcagc

SEQ ID NO: 2620606 - RNA, 21 nt, Human
gccccucaucucucugcccaa

SEQ ID NO: 2620607 - RNA, 22 nt, Human
gccccuagcuuagagccucccu

SEQ ID NO: 2620608 - RNA, 20 nt, Human
gccccuauguaguccgugcu

SEQ ID NO: 2620609 - RNA, 21 nt, Human
gccccucagggucccuggugg

SEQ ID NO: 2620610 - RNA, 19 nt, Human
gccccucagggucccuggu

SEQ ID NO: 2620611 - RNA, 19 nt, Human
gccccuagcccaggagaga

SEQ ID NO: 2620612 - RNA, 18 nt, Human
gccccuagcccaggagag

SEQ ID NO: 2620613 - RNA, 15 nt, Human
gccccuagcccagga

SEQ ID NO: 2620614 - RNA, 14 nt, Human
gccccuagcccagg

SEQ ID NO: 2620615 - RNA, 21 nt, Human
gccccuagcccaggagagaga

SEQ ID NO: 2620616 - RNA, 20 nt, Human
gccccuagcccaggagagag

SEQ ID NO: 2620617 - RNA, 23 nt, Human
gccccucaacucuccuccagagu

SEQ ID NO: 2620618 - RNA, 16 nt, Human
gccccuaccccacacc

SEQ ID NO: 2620619 - RNA, 19 nt, Human
gccccguguccugccuguc

SEQ ID NO: 2620620 - RNA, 15 nt, Human
gccccgugcagacug

SEQ ID NO: 2620621 - RNA, 19 nt, Human
gccccgugcagacuggagg

SEQ ID NO: 2620622 - RNA, 20 nt, Human
gccccgugcagacuggaggg

SEQ ID NO: 2620623 - RNA, 22 nt, Human
gccccgugcagacuggagggga

SEQ ID NO: 2620624 - RNA, 17 nt, Human
gccccuagaaucagccu

SEQ ID NO: 2620625 - RNA, 13 nt, Human
gccccuagcccag

SEQ ID NO: 2620626 - RNA, 20 nt, Human
gccccuagaaucagccuagg

SEQ ID NO: 2620627 - RNA, 19 nt, Human
gccccuggcccagcggccc

SEQ ID NO: 2620628 - RNA, 18 nt, Human
gccccuggcccagcggcc

SEQ ID NO: 2620629 - RNA, 17 nt, Human
gccccuggcccagcggc

SEQ ID NO: 2620630 - RNA, 16 nt, Human
gccccuggcccagcgg

SEQ ID NO: 2620631 - RNA, 23 nt, Human
gccccuggcccagcggccccucc

SEQ ID NO: 2620632 - RNA, 22 nt, Human
gccccuggcccagcggccccuc

SEQ ID NO: 2620633 - RNA, 13 nt, Human
gccccuggcccca

SEQ ID NO: 2620634 - RNA, 13 nt, Human
gccccuggcccag

SEQ ID NO: 2620635 - RNA, 14 nt, Human
gccccuggccccag

SEQ ID NO: 2620636 - RNA, 12 nt, Human
gccccuggcugg

SEQ ID NO: 2620637 - RNA, 14 nt, Human
gccccuggcuggga

SEQ ID NO: 2620638 - RNA, 16 nt, Human
gccccuggcugggacg

SEQ ID NO: 2620639 - RNA, 23 nt, Human
gccccuggcugggacguggcuca

SEQ ID NO: 2620640 - RNA, 17 nt, Human
gccccuucccccuccaa

SEQ ID NO: 2620641 - RNA, 19 nt, Human
gccccugcacuccagccug

SEQ ID NO: 2620642 - RNA, 23 nt, Human
gccccuggcagccccuguucugg

SEQ ID NO: 2620643 - RNA, 20 nt, Human
gccccugagaucucugcagg

SEQ ID NO: 2620644 - RNA, 22 nt, Human
gccccugagcaaugucugugcu

SEQ ID NO: 2620645 - RNA, 20 nt, Human
gccccugagcaaugucugug

SEQ ID NO: 2620646 - RNA, 23 nt, Human
gccccugagcaaugucugugcua

SEQ ID NO: 2620647 - RNA, 13 nt, Human
gccccugcacaaa

SEQ ID NO: 2620648 - RNA, 21 nt, Human
gccccgucccccucuggcucc

SEQ ID NO: 2620649 - RNA, 23 nt, Human
gccccgucaccaucucaggccac

SEQ ID NO: 2620650 - RNA, 21 nt, Human
gccccgucaccaucucaggcc

SEQ ID NO: 2620651 - RNA, 22 nt, Human
gccccgucaccaucucaggcca

SEQ ID NO: 2620652 - RNA, 17 nt, Human
gccccgucccccucugg

SEQ ID NO: 2620653 - RNA, 18 nt, Human
gccccgggacuuggaggg

SEQ ID NO: 2620654 - RNA, 17 nt, Human
gccccgucaccaucuca

SEQ ID NO: 2620655 - RNA, 18 nt, Human
gccccgucaccaucucag

SEQ ID NO: 2620656 - RNA, 20 nt, Human
gccccgucaccaucucaggc

SEQ ID NO: 2620657 - RNA, 17 nt, Human
gccccgugggguuccuc

SEQ ID NO: 2620658 - RNA, 13 nt, Human
gccccgugaggca

SEQ ID NO: 2620659 - RNA, 20 nt, Human
gccccgucucaugaggggcc

SEQ ID NO: 2620660 - RNA, 14 nt, Human
gccccggcccuggg

SEQ ID NO: 2620661 - RNA, 13 nt, Human
gccccggccccgg

SEQ ID NO: 2620662 - RNA, 18 nt, Human
gccccggccccagccaga

SEQ ID NO: 2620663 - RNA, 17 nt, Human
gccccggccccagccag

SEQ ID NO: 2620664 - RNA, 16 nt, Human
gccccggccccagcca

SEQ ID NO: 2620665 - RNA, 14 nt, Human
gccccggccccagc

SEQ ID NO: 2620666 - RNA, 18 nt, Human
gccccggccaccucugcg

SEQ ID NO: 2620667 - RNA, 17 nt, Human
gccccggccaccucugc

SEQ ID NO: 2620668 - RNA, 17 nt, Human
gccccgggacuuggagg

SEQ ID NO: 2620669 - RNA, 21 nt, Human
gccccggcccugggcucggag

SEQ ID NO: 2620670 - RNA, 17 nt, Human
gccccggcccugggcuc

SEQ ID NO: 2620671 - RNA, 15 nt, Human
gccccggcccugggc

SEQ ID NO: 2620672 - RNA, 19 nt, Human
gccccggggugaguccauu

SEQ ID NO: 2620673 - RNA, 15 nt, Human
gccccgucaccaucu

SEQ ID NO: 2620674 - RNA, 22 nt, Human
gccccgcuuggcuucuucuuua

SEQ ID NO: 2620675 - RNA, 18 nt, Human
gccccgcuuggcuucuuc

SEQ ID NO: 2620676 - RNA, 17 nt, Human
gccccgcgccuccuucc

SEQ ID NO: 2620677 - RNA, 14 nt, Human
gccccgcuugucca

SEQ ID NO: 2620678 - RNA, 16 nt, Human
gccccgcuuguccagc

SEQ ID NO: 2620679 - RNA, 18 nt, Human
gccccgcuuguccagcgc

SEQ ID NO: 2620680 - RNA, 19 nt, Human
gccccgcuuguccagcgcc

SEQ ID NO: 2620681 - RNA, 16 nt, Human
gccccggccaccucug

SEQ ID NO: 2620682 - RNA, 15 nt, Human
gccccggccaccucu

SEQ ID NO: 2620683 - RNA, 14 nt, Human
gccccggccaccuc

SEQ ID NO: 2620684 - RNA, 13 nt, Human
gccccggccaccu

SEQ ID NO: 2620685 - RNA, 20 nt, Human
gccccgcuuguccagcgccu

SEQ ID NO: 2620686 - RNA, 14 nt, Human
gccccgcccaggcu

SEQ ID NO: 2620687 - RNA, 22 nt, Human
gccccgaggccuucucugaagg

SEQ ID NO: 2620688 - RNA, 19 nt, Human
gccccgcagaccuccccag

SEQ ID NO: 2620689 - RNA, 18 nt, Human
gccccgcagaccucccca

SEQ ID NO: 2620690 - RNA, 15 nt, Human
gccccgcagaccucc

SEQ ID NO: 2620691 - RNA, 15 nt, Human
gccccgccccacauu

SEQ ID NO: 2620692 - RNA, 22 nt, Human
gccccgccccacauuccgacaa

SEQ ID NO: 2620693 - RNA, 21 nt, Human
gccccgcagaccuccccagcc

SEQ ID NO: 2620694 - RNA, 20 nt, Human
gccccgcagaccuccccagc

SEQ ID NO: 2620695 - RNA, 13 nt, Human
gccccgccccaca

SEQ ID NO: 2620696 - RNA, 14 nt, Human
gccccgccccacau

SEQ ID NO: 2620697 - RNA, 14 nt, Human
gccccgccuccccg

SEQ ID NO: 2620698 - RNA, 21 nt, Human
gccccgcccccaguccccacc

SEQ ID NO: 2620699 - RNA, 13 nt, Human
gccccgccgccug

SEQ ID NO: 2620700 - RNA, 23 nt, Human
gccccauucugccugcccaggcc

SEQ ID NO: 2620701 - RNA, 22 nt, Human
gccccauucugccugcccaggc

SEQ ID NO: 2620702 - RNA, 23 nt, Human
gccccgaggccuucucugaagga

SEQ ID NO: 2620703 - RNA, 14 nt, Human
gccccaugcuggag

SEQ ID NO: 2620704 - RNA, 13 nt, Human
gccccaugcugga

SEQ ID NO: 2620705 - RNA, 20 nt, Human
gccccauucuuuuguaauuu

SEQ ID NO: 2620706 - RNA, 21 nt, Human
gcccaucccuggaaggugcug

SEQ ID NO: 2620707 - RNA, 19 nt, Human
gcccaucccugccugguca

SEQ ID NO: 2620708 - RNA, 18 nt, Human
gcccaucccugccugguc

SEQ ID NO: 2620709 - RNA, 16 nt, Human
gcccaucccugccugg

SEQ ID NO: 2620710 - RNA, 14 nt, Human
gcccaucccugccu

SEQ ID NO: 2620711 - RNA, 12 nt, Human
gcccaucccugc

SEQ ID NO: 2620712 - RNA, 20 nt, Human
gcccauccccccucaccagg

SEQ ID NO: 2620713 - RNA, 22 nt, Human
gcccaucugggggccucuucug

SEQ ID NO: 2620714 - RNA, 22 nt, Human
gcccaucuaugucccuugcugu

SEQ ID NO: 2620715 - RNA, 20 nt, Human
gccccagccagaguuccugc

SEQ ID NO: 2620716 - RNA, 19 nt, Human
gccccagccagaguuccug

SEQ ID NO: 2620717 - RNA, 14 nt, Human
gccccagccagagu

SEQ ID NO: 2620718 - RNA, 12 nt, Human
gccccagccaga

SEQ ID NO: 2620719 - RNA, 11 nt, Human
gccccagccag

SEQ ID NO: 2620720 - RNA, 19 nt, Human
gcccauggacaggcuggcu

SEQ ID NO: 2620721 - RNA, 20 nt, Human
gcccauggacaggcuggcuc

SEQ ID NO: 2620722 - RNA, 21 nt, Human
gcccauggacaggcuggcucc

SEQ ID NO: 2620723 - RNA, 23 nt, Human
gcccauggacaggcuggcuccag

SEQ ID NO: 2620724 - RNA, 16 nt, Human
gcccaugccaccgcuu

SEQ ID NO: 2620725 - RNA, 17 nt, Human
gcccaugaguccuugaa

SEQ ID NO: 2620726 - RNA, 18 nt, Human
gcccaucugggaaaauac

SEQ ID NO: 2620727 - RNA, 18 nt, Human
gcccaggcuggccagccc

SEQ ID NO: 2620728 - RNA, 13 nt, Human
gcccaugcccacc

SEQ ID NO: 2620729 - RNA, 14 nt, Human
gcccaugcccaccu

SEQ ID NO: 2620730 - RNA, 15 nt, Human
gcccaugcccaccug

SEQ ID NO: 2620731 - RNA, 19 nt, Human
gcccaugcccaccugccca

SEQ ID NO: 2620732 - RNA, 18 nt, Human
gccccagccuggcccagc

SEQ ID NO: 2620733 - RNA, 17 nt, Human
gccccagccuggcccag

SEQ ID NO: 2620734 - RNA, 16 nt, Human
gccccagccuggccca

SEQ ID NO: 2620735 - RNA, 15 nt, Human
gccccagccuggccc

SEQ ID NO: 2620736 - RNA, 14 nt, Human
gccccagccuggcc

SEQ ID NO: 2620737 - RNA, 13 nt, Human
gccccagccuggc

SEQ ID NO: 2620738 - RNA, 12 nt, Human
gccccagccugg

SEQ ID NO: 2620739 - RNA, 22 nt, Human
gccccagccuggcccagcuccc

SEQ ID NO: 2620740 - RNA, 21 nt, Human
gccccagccuggcccagcucc

SEQ ID NO: 2620741 - RNA, 20 nt, Human
gccccagccuggcccagcuc

SEQ ID NO: 2620742 - RNA, 19 nt, Human
gccccagccuggcccagcu

SEQ ID NO: 2620743 - RNA, 13 nt, Human
gccccagcucugg

SEQ ID NO: 2620744 - RNA, 22 nt, Human
gccccaggaaaggcccagccac

SEQ ID NO: 2620745 - RNA, 11 nt, Human
gccccaggacc

SEQ ID NO: 2620746 - RNA, 14 nt, Human
gccccaggaagccg

SEQ ID NO: 2620747 - RNA, 15 nt, Human
gccccaggaaaggcc

SEQ ID NO: 2620748 - RNA, 17 nt, Human
gccccagcugacaugga

SEQ ID NO: 2620749 - RNA, 11 nt, Human
gccccagcuga

SEQ ID NO: 2620750 - RNA, 14 nt, Human
gccccagcucuggc

SEQ ID NO: 2620751 - RNA, 16 nt, Human
gccccagcccacccuc

SEQ ID NO: 2620752 - RNA, 15 nt, Human
gccccagcccacccu

SEQ ID NO: 2620753 - RNA, 14 nt, Human
gccccagcccaccc

SEQ ID NO: 2620754 - RNA, 12 nt, Human
gccccagcccac

SEQ ID NO: 2620755 - RNA, 16 nt, Human
gccccagcccaagucc

SEQ ID NO: 2620756 - RNA, 15 nt, Human
gccccagcccaaguc

SEQ ID NO: 2620757 - RNA, 14 nt, Human
gccccagcccaagu

SEQ ID NO: 2620758 - RNA, 12 nt, Human
gccccagcccaa

SEQ ID NO: 2620759 - RNA, 17 nt, Human
gccccagcccccuuugg

SEQ ID NO: 2620760 - RNA, 20 nt, Human
gccccagcccacccuccugu

SEQ ID NO: 2620761 - RNA, 18 nt, Human
gccccagcccacccuccu

SEQ ID NO: 2620762 - RNA, 21 nt, Human
gccccagcccacccuccuguc

SEQ ID NO: 2620763 - RNA, 21 nt, Human
gccccagccucccugaagccu

SEQ ID NO: 2620764 - RNA, 16 nt, Human
gccccagccucccuga

SEQ ID NO: 2620765 - RNA, 18 nt, Human
gccccagccucccugaag

SEQ ID NO: 2620766 - RNA, 10 nt, Human
gccccagccu

SEQ ID NO: 2620767 - RNA, 21 nt, Human
gccccauucugccugcccagg

SEQ ID NO: 2620768 - RNA, 20 nt, Human
gccccauucugccugcccag

SEQ ID NO: 2620769 - RNA, 18 nt, Human
gccccauucugccugccc

SEQ ID NO: 2620770 - RNA, 17 nt, Human
gccccauucugccugcc

SEQ ID NO: 2620771 - RNA, 23 nt, Human
gccccauccucuguacagagccc

SEQ ID NO: 2620772 - RNA, 14 nt, Human
gccccaugccuguc

SEQ ID NO: 2620773 - RNA, 16 nt, Human
gccccaugccugucca

SEQ ID NO: 2620774 - RNA, 12 nt, Human
gccccaugcugg

SEQ ID NO: 2620775 - RNA, 23 nt, Human
gccccaugccuguccagccuggg

SEQ ID NO: 2620776 - RNA, 17 nt, Human
gccccaugccuguccag

SEQ ID NO: 2620777 - RNA, 20 nt, Human
gccccaugccuguccagccu

SEQ ID NO: 2620778 - RNA, 21 nt, Human
gccccagugcccacaggauca

SEQ ID NO: 2620779 - RNA, 17 nt, Human
gccccagugcccacagg

SEQ ID NO: 2620780 - RNA, 16 nt, Human
gccccagugcccacag

SEQ ID NO: 2620781 - RNA, 15 nt, Human
gccccagugcccaca

SEQ ID NO: 2620782 - RNA, 12 nt, Human
gccccaggacca

SEQ ID NO: 2620783 - RNA, 14 nt, Human
gccccaggaccagc

SEQ ID NO: 2620784 - RNA, 15 nt, Human
gccccaggaccagcu

SEQ ID NO: 2620785 - RNA, 16 nt, Human
gccccaggaccagcuc

SEQ ID NO: 2620786 - RNA, 17 nt, Human
gccccaggaccagcuca

SEQ ID NO: 2620787 - RNA, 18 nt, Human
gccccaggaccagcucag

SEQ ID NO: 2620788 - RNA, 19 nt, Human
gccccaggaccagcucagg

SEQ ID NO: 2620789 - RNA, 22 nt, Human
gccccaggaccagcucaggaca

SEQ ID NO: 2620790 - RNA, 23 nt, Human
gccccaggaccagcucaggacag

SEQ ID NO: 2620791 - RNA, 24 nt, Human
gccccaggaccagcucaggacaga

SEQ ID NO: 2620792 - RNA, 20 nt, Human
gccccaggaccuggcugcca

SEQ ID NO: 2620793 - RNA, 21 nt, Human
gccccaggaccuggcugccau

SEQ ID NO: 2620794 - RNA, 22 nt, Human
gccccaggaccuggcugccaua

SEQ ID NO: 2620795 - RNA, 12 nt, Human
gccccaggcagg

SEQ ID NO: 2620796 - RNA, 15 nt, Human
gccccaggcaggcug

SEQ ID NO: 2620797 - RNA, 19 nt, Human
gccccaggcaggcugugcg

SEQ ID NO: 2620798 - RNA, 20 nt, Human
gccccaggcaggcugugcgc

SEQ ID NO: 2620799 - RNA, 21 nt, Human
gccccaggcagggccaacccu

SEQ ID NO: 2620800 - RNA, 18 nt, Human
gcccaggccuccuacagc

SEQ ID NO: 2620801 - RNA, 16 nt, Human
gcccaggaaaggcucc

SEQ ID NO: 2620802 - RNA, 15 nt, Human
gcccaggaaaggcuc

SEQ ID NO: 2620803 - RNA, 12 nt, Human
gcccaggaaagg

SEQ ID NO: 2620804 - RNA, 22 nt, Human
gcccaggcgggagcgguggccc

SEQ ID NO: 2620805 - RNA, 12 nt, Human
gcccaggcggga

SEQ ID NO: 2620806 - RNA, 23 nt, Human
gcccagcuugggcccagcugggc

SEQ ID NO: 2620807 - RNA, 22 nt, Human
gcccagcuugggcccagcuggg

SEQ ID NO: 2620808 - RNA, 21 nt, Human
gcccagcuugggcccagcugg

SEQ ID NO: 2620809 - RNA, 20 nt, Human
gcccagcuugggcccagcug

SEQ ID NO: 2620810 - RNA, 19 nt, Human
gcccagcuugggcccagcu

SEQ ID NO: 2620811 - RNA, 17 nt, Human
gcccaggccugccuguu

SEQ ID NO: 2620812 - RNA, 22 nt, Human
gcccaggcuggccagccccaca

SEQ ID NO: 2620813 - RNA, 20 nt, Human
gcccaggcuggccagcccca

SEQ ID NO: 2620814 - RNA, 19 nt, Human
gcccaggcuggccagcccc

SEQ ID NO: 2620815 - RNA, 11 nt, Human
gcccaggcugg

SEQ ID NO: 2620816 - RNA, 19 nt, Human
gcccaccgcaugcccccuc

SEQ ID NO: 2620817 - RNA, 18 nt, Human
gcccaccgcaugcccccu

SEQ ID NO: 2620818 - RNA, 17 nt, Human
gcccaccgcaugccccc

SEQ ID NO: 2620819 - RNA, 16 nt, Human
gcccaccgcaugcccc

SEQ ID NO: 2620820 - RNA, 14 nt, Human
gcccaccgcaugcc

SEQ ID NO: 2620821 - RNA, 21 nt, Human
gcccaccuccccacgcccucc

SEQ ID NO: 2620822 - RNA, 17 nt, Human
gcccaccuccccacgcc

SEQ ID NO: 2620823 - RNA, 15 nt, Human
gcccaccuccccacg

SEQ ID NO: 2620824 - RNA, 12 nt, Human
gcccaccucccc

SEQ ID NO: 2620825 - RNA, 20 nt, Human
gcccaccgcaugcccccucg

SEQ ID NO: 2620826 - RNA, 10 nt, Human
gcccaccucc

SEQ ID NO: 2620827 - RNA, 19 nt, Human
gcccagcuauaccugugcc

SEQ ID NO: 2620828 - RNA, 18 nt, Human
gcccaccuccccacgccc

SEQ ID NO: 2620829 - RNA, 20 nt, Human
gcccagcuauaccugugccu

SEQ ID NO: 2620830 - RNA, 15 nt, Human
gcccagcucagaggg

SEQ ID NO: 2620831 - RNA, 13 nt, Human
gcccaccugccca

SEQ ID NO: 2620832 - RNA, 14 nt, Human
gcccaccugcccau

SEQ ID NO: 2620833 - RNA, 15 nt, Human
gcccaccugcccauc

SEQ ID NO: 2620834 - RNA, 20 nt, Human
gcccaccugcccaucacagg

SEQ ID NO: 2620835 - RNA, 17 nt, Human
gcccagcucccccggga

SEQ ID NO: 2620836 - RNA, 16 nt, Human
gcccagcucccccggg

SEQ ID NO: 2620837 - RNA, 19 nt, Human
gcccagcucccccgggagg

SEQ ID NO: 2620838 - RNA, 13 nt, Human
gcccagcucugaa

SEQ ID NO: 2620839 - RNA, 12 nt, Human
gcccagcuccaa

SEQ ID NO: 2620840 - RNA, 15 nt, Human
gcccagcuccaaggg

SEQ ID NO: 2620841 - RNA, 13 nt, Human
gcccagcuccccc

SEQ ID NO: 2620842 - RNA, 12 nt, Human
gcccagcucccc

SEQ ID NO: 2620843 - RNA, 11 nt, Human
gcccagcuccc

SEQ ID NO: 2620844 - RNA, 13 nt, Human
gcccagcugcacc

SEQ ID NO: 2620845 - RNA, 14 nt, Human
gcccagcugcaccu

SEQ ID NO: 2620846 - RNA, 15 nt, Human
gcccagcugcaccug

SEQ ID NO: 2620847 - RNA, 18 nt, Human
gcccagcugcaccugcca

SEQ ID NO: 2620848 - RNA, 23 nt, Human
gcccagcugcaccugccagccug

SEQ ID NO: 2620849 - RNA, 24 nt, Human
gcccagcugcaccugccagccugg

SEQ ID NO: 2620850 - RNA, 18 nt, Human
gcccagcuugggcccagc

SEQ ID NO: 2620851 - RNA, 17 nt, Human
gcccagcuugggcccag

SEQ ID NO: 2620852 - RNA, 16 nt, Human
gcccagcuugggccca

SEQ ID NO: 2620853 - RNA, 15 nt, Human
gcccaggcuggcgug

SEQ ID NO: 2620854 - RNA, 14 nt, Human
gcccaggcuggcgu

SEQ ID NO: 2620855 - RNA, 14 nt, Human
gcccagggcccaga

SEQ ID NO: 2620856 - RNA, 15 nt, Human
gcccagggcccagag

SEQ ID NO: 2620857 - RNA, 16 nt, Human
gcccagggcccagagc

SEQ ID NO: 2620858 - RNA, 17 nt, Human
gcccagggcccagagcc

SEQ ID NO: 2620859 - RNA, 16 nt, Human
gcccaggcuggcgugc

SEQ ID NO: 2620860 - RNA, 18 nt, Human
gcccagggcccagagccc

SEQ ID NO: 2620861 - RNA, 19 nt, Human
gcccagggcccagagccca

SEQ ID NO: 2620862 - RNA, 20 nt, Human
gcccagggcccagagcccag

SEQ ID NO: 2620863 - RNA, 21 nt, Human
gcccagggcccagagcccagc

SEQ ID NO: 2620864 - RNA, 23 nt, Human
gcccagggcccagagcccagcuc

SEQ ID NO: 2620865 - RNA, 12 nt, Human
gcccagggcuca

SEQ ID NO: 2620866 - RNA, 13 nt, Human
gcccagggcucag

SEQ ID NO: 2620867 - RNA, 14 nt, Human
gcccagggcucagc

SEQ ID NO: 2620868 - RNA, 15 nt, Human
gcccagggcucagcc

SEQ ID NO: 2620869 - RNA, 16 nt, Human
gcccagggcucagccu

SEQ ID NO: 2620870 - RNA, 17 nt, Human
gcccagggcucagccug

SEQ ID NO: 2620871 - RNA, 23 nt, Human
gcccaggcuggccagccccacag

SEQ ID NO: 2620872 - RNA, 17 nt, Human
gcccaggguucccccag

SEQ ID NO: 2620873 - RNA, 19 nt, Human
gcccaggguucccccagcc

SEQ ID NO: 2620874 - RNA, 20 nt, Human
gcccaggguucccccagccc

SEQ ID NO: 2620875 - RNA, 21 nt, Human
gcccaggguucccccagcccu

SEQ ID NO: 2620876 - RNA, 16 nt, Human
gcccagguccucugau

SEQ ID NO: 2620877 - RNA, 15 nt, Human
gcccagguccucuga

SEQ ID NO: 2620878 - RNA, 22 nt, Human
gcccaggguucccccagcccug

SEQ ID NO: 2620879 - RNA, 23 nt, Human
gcccaggguucccccagcccugu

SEQ ID NO: 2620880 - RNA, 18 nt, Human
gcccauccccccucacca

SEQ ID NO: 2620881 - RNA, 17 nt, Human
gcccauccccccucacc

SEQ ID NO: 2620882 - RNA, 16 nt, Human
gcccauccccccucac

SEQ ID NO: 2620883 - RNA, 15 nt, Human
gcccauccccccuca

SEQ ID NO: 2620884 - RNA, 14 nt, Human
gcccauccccccuc

SEQ ID NO: 2620885 - RNA, 12 nt, Human
gcccaucccccc

SEQ ID NO: 2620886 - RNA, 18 nt, Human
gcccauccccaggcaccu

SEQ ID NO: 2620887 - RNA, 19 nt, Human
gcccaguucacccugauuu

SEQ ID NO: 2620888 - RNA, 15 nt, Human
gcccagucccccaac

SEQ ID NO: 2620889 - RNA, 14 nt, Human
gcccagucccccaa

SEQ ID NO: 2620890 - RNA, 17 nt, Human
gcccagucccccaaccc

SEQ ID NO: 2620891 - RNA, 13 nt, Human
gcccaguggcugc

SEQ ID NO: 2620892 - RNA, 22 nt, Human
gcccagugucaaguugugcuug

SEQ ID NO: 2620893 - RNA, 21 nt, Human
gcccagucccccaaccccagc

SEQ ID NO: 2620894 - RNA, 20 nt, Human
gcccagucuggaaugcagug

SEQ ID NO: 2620895 - RNA, 13 nt, Human
gcccaguccccca

SEQ ID NO: 2620896 - RNA, 22 nt, Human
gcccagucuggaaugcaguggu

SEQ ID NO: 2620897 - RNA, 17 nt, Human
gcccaguagaccuuguu

SEQ ID NO: 2620898 - RNA, 15 nt, Human
gcccaguagaccuug

SEQ ID NO: 2620899 - RNA, 17 nt, Human
gcccagguuucuggucu

SEQ ID NO: 2620900 - RNA, 23 nt, Human
gcccagguuucuggucucuaggc

SEQ ID NO: 2620901 - RNA, 14 nt, Human
gcccagguuucugg

SEQ ID NO: 2620902 - RNA, 18 nt, Human
gcccuugagcuccccaaa

SEQ ID NO: 2620903 - RNA, 12 nt, Human
gccgaccucagc

SEQ ID NO: 2620904 - RNA, 13 nt, Human
gccgaccucagcc

SEQ ID NO: 2620905 - RNA, 14 nt, Human
gccgaccucagccu

SEQ ID NO: 2620906 - RNA, 15 nt, Human
gccgaccucagccuu

SEQ ID NO: 2620907 - RNA, 17 nt, Human
gccgaccucagccuucc

SEQ ID NO: 2620908 - RNA, 13 nt, Human
gccgaccucgucc

SEQ ID NO: 2620909 - RNA, 19 nt, Human
gccgaccucguccuccccc

SEQ ID NO: 2620910 - RNA, 21 nt, Human
gccgaccucguccucccccug

SEQ ID NO: 2620911 - RNA, 17 nt, Human
gcccuugagcuccccaa

SEQ ID NO: 2620912 - RNA, 22 nt, Human
gcccuugagcuccccaaaaacc

SEQ ID NO: 2620913 - RNA, 19 nt, Human
gcccuugcaguucagcacc

SEQ ID NO: 2620914 - RNA, 20 nt, Human
gcccuugcaguucagcacca

SEQ ID NO: 2620915 - RNA, 21 nt, Human
gcccuugcaguucagcaccac

SEQ ID NO: 2620916 - RNA, 22 nt, Human
gcccuugcaguucagcaccacc

SEQ ID NO: 2620917 - RNA, 16 nt, Human
gccgagauagccaagg

SEQ ID NO: 2620918 - RNA, 17 nt, Human
gccgagagccugcuccc

SEQ ID NO: 2620919 - RNA, 19 nt, Human
gccgagagccugcuccccc

SEQ ID NO: 2620920 - RNA, 20 nt, Human
gccgagagccugcuccccca

SEQ ID NO: 2620921 - RNA, 22 nt, Human
gccgagagccugcucccccacc

SEQ ID NO: 2620922 - RNA, 13 nt, Human
gccgacuccuggg

SEQ ID NO: 2620923 - RNA, 23 nt, Human
gccgacuuuguaccccccaaccc

SEQ ID NO: 2620924 - RNA, 21 nt, Human
gccgacuuuguaccccccaac

SEQ ID NO: 2620925 - RNA, 22 nt, Human
gccgacugcacagcggccccug

SEQ ID NO: 2620926 - RNA, 20 nt, Human
gccgaccucguccucccccu

SEQ ID NO: 2620927 - RNA, 13 nt, Human
gccgagaagcaag

SEQ ID NO: 2620928 - RNA, 14 nt, Human
gccgagaagcaaga

SEQ ID NO: 2620929 - RNA, 22 nt, Human
gccgagacauggcuugccacag

SEQ ID NO: 2620930 - RNA, 20 nt, Human
gccgagaagccagugcggca

SEQ ID NO: 2620931 - RNA, 12 nt, Human
gccgagagccug

SEQ ID NO: 2620932 - RNA, 15 nt, Human
gccgagagccugcuc

SEQ ID NO: 2620933 - RNA, 16 nt, Human
gccgagagccugcucc

SEQ ID NO: 2620934 - RNA, 23 nt, Human
gcccuucucuccagccccuggau

SEQ ID NO: 2620935 - RNA, 19 nt, Human
gcccuucuuuccacagaag

SEQ ID NO: 2620936 - RNA, 13 nt, Human
gcccuucucucca

SEQ ID NO: 2620937 - RNA, 22 nt, Human
gcccuuccucuccacugccuuc

SEQ ID NO: 2620938 - RNA, 12 nt, Human
gcccucuguccu

SEQ ID NO: 2620939 - RNA, 15 nt, Human
gcccucuguccugac

SEQ ID NO: 2620940 - RNA, 14 nt, Human
gcccucuguccuga

SEQ ID NO: 2620941 - RNA, 13 nt, Human
gcccucuguccug

SEQ ID NO: 2620942 - RNA, 14 nt, Human
gcccucuuccauca

SEQ ID NO: 2620943 - RNA, 11 nt, Human
gcccucuucca

SEQ ID NO: 2620944 - RNA, 19 nt, Human
gccgggccgaauccccucc

SEQ ID NO: 2620945 - RNA, 19 nt, Human
gccgggccccugggcuugg

SEQ ID NO: 2620946 - RNA, 17 nt, Human
gccgggccccugggcuu

SEQ ID NO: 2620947 - RNA, 14 nt, Human
gccgggccccuggg

SEQ ID NO: 2620948 - RNA, 16 nt, Human
gccggggacagaggcc

SEQ ID NO: 2620949 - RNA, 22 nt, Human
gccgggguggagcaugggccug

SEQ ID NO: 2620950 - RNA, 22 nt, Human
gccggggguucauaggucacug

SEQ ID NO: 2620951 - RNA, 15 nt, Human
gccggggcugagacu

SEQ ID NO: 2620952 - RNA, 21 nt, Human
gccggggacagaggccugccc

SEQ ID NO: 2620953 - RNA, 19 nt, Human
gccggggacagaggccugc

SEQ ID NO: 2620954 - RNA, 23 nt, Human
gccggggacagaggccugcccgg

SEQ ID NO: 2620955 - RNA, 19 nt, Human
gccgggugcgguggcucac

SEQ ID NO: 2620956 - RNA, 16 nt, Human
gccgggugcgguggcu

SEQ ID NO: 2620957 - RNA, 13 nt, Human
gccgggugcggug

SEQ ID NO: 2620958 - RNA, 14 nt, Human
gccgggucugccuc

SEQ ID NO: 2620959 - RNA, 21 nt, Human
gccgggucugccucuucuggg

SEQ ID NO: 2620960 - RNA, 22 nt, Human
gccggguacugagagucugcac

SEQ ID NO: 2620961 - RNA, 14 nt, Human
gccgagucugucuc

SEQ ID NO: 2620962 - RNA, 23 nt, Human
gccgggcaugguggcgcaagccu

SEQ ID NO: 2620963 - RNA, 12 nt, Human
gccgggccccug

SEQ ID NO: 2620964 - RNA, 22 nt, Human
gccgcaaaccacacuggacucc

SEQ ID NO: 2620965 - RNA, 13 nt, Human
gccgcagcccugc

SEQ ID NO: 2620966 - RNA, 17 nt, Human
gccgagauagccaaggc

SEQ ID NO: 2620967 - RNA, 18 nt, Human
gccgaggguccuggcucc

SEQ ID NO: 2620968 - RNA, 20 nt, Human
gccgaggguccuggcuccug

SEQ ID NO: 2620969 - RNA, 16 nt, Human
gccgaggguccuggcu

SEQ ID NO: 2620970 - RNA, 17 nt, Human
gccgauucaccugagca

SEQ ID NO: 2620971 - RNA, 17 nt, Human
gccgauauacucuagau

SEQ ID NO: 2620972 - RNA, 22 nt, Human
gccgauauacucuagaugaagu

SEQ ID NO: 2620973 - RNA, 14 nt, Human
gccgaguccaagcu

SEQ ID NO: 2620974 - RNA, 15 nt, Human
gccgaguccaagcug

SEQ ID NO: 2620975 - RNA, 18 nt, Human
gccgaguccaagcuggga

SEQ ID NO: 2620976 - RNA, 17 nt, Human
gccgcagcccugcagag

SEQ ID NO: 2620977 - RNA, 16 nt, Human
gccgcagcccugcaga

SEQ ID NO: 2620978 - RNA, 15 nt, Human
gccgcagcccugcag

SEQ ID NO: 2620979 - RNA, 21 nt, Human
gccgcaaaccacacuggacuc

SEQ ID NO: 2620980 - RNA, 19 nt, Human
gccgcaaaccacacuggac

SEQ ID NO: 2620981 - RNA, 17 nt, Human
gccgcaaaccacacugg

SEQ ID NO: 2620982 - RNA, 16 nt, Human
gccgcaaaccacacug

SEQ ID NO: 2620983 - RNA, 22 nt, Human
gccuaaaagugggcuugauucu

SEQ ID NO: 2620984 - RNA, 15 nt, Human
gccuauucccacacc

SEQ ID NO: 2620985 - RNA, 21 nt, Human
gccuauuucaguggcacguca

SEQ ID NO: 2620986 - RNA, 15 nt, Human
gccucaaaggcccgc

SEQ ID NO: 2620987 - RNA, 17 nt, Human
gccucaaaggcccgcuc

SEQ ID NO: 2620988 - RNA, 17 nt, Human
gccuauuuuaauaaaca

SEQ ID NO: 2620989 - RNA, 22 nt, Human
gccuauucccacaccuccacag

SEQ ID NO: 2620990 - RNA, 21 nt, Human
gccucagcauccuggcacccg

SEQ ID NO: 2620991 - RNA, 17 nt, Human
gccucagccauucacug

SEQ ID NO: 2620992 - RNA, 16 nt, Human
gccucagccauucacu

SEQ ID NO: 2620993 - RNA, 15 nt, Human
gccucagccauucac

SEQ ID NO: 2620994 - RNA, 16 nt, Human
gccucagccagagaag

SEQ ID NO: 2620995 - RNA, 14 nt, Human
gccucagccagaga

SEQ ID NO: 2620996 - RNA, 15 nt, Human
gccucagccagagaa

SEQ ID NO: 2620997 - RNA, 13 nt, Human
gccucagccagag

SEQ ID NO: 2620998 - RNA, 15 nt, Human
gccucacagaagaau

SEQ ID NO: 2620999 - RNA, 17 nt, Human
gccucagcauccuggca

SEQ ID NO: 2621000 - RNA, 18 nt, Human
gccucagcauccuggcac

SEQ ID NO: 2621001 - RNA, 14 nt, Human
gccucaacccuccc

SEQ ID NO: 2621002 - RNA, 14 nt, Human
gccucaaugccagu

SEQ ID NO: 2621003 - RNA, 17 nt, Human
gccucaauaagccuugu

SEQ ID NO: 2621004 - RNA, 15 nt, Human
gccucaacccucccu

SEQ ID NO: 2621005 - RNA, 23 nt, Human
gccucacacgguuugaagccugg

SEQ ID NO: 2621006 - RNA, 21 nt, Human
gccucaaugugguugcaaggc

SEQ ID NO: 2621007 - RNA, 13 nt, Human
gccucacagaaga

SEQ ID NO: 2621008 - RNA, 18 nt, Human
gccucaauaagccuuguc

SEQ ID NO: 2621009 - RNA, 21 nt, Human
gccucaaugugaaucagaccc

SEQ ID NO: 2621010 - RNA, 17 nt, Human
gccucaaugugaccagg

SEQ ID NO: 2621011 - RNA, 22 nt, Human
gccucaaugugaaucagacccu

SEQ ID NO: 2621012 - RNA, 24 nt, Human
gccucaagugauucuccugccuca

SEQ ID NO: 2621013 - RNA, 22 nt, Human
gccucaagugauucuccugccu

SEQ ID NO: 2621014 - RNA, 23 nt, Human
gccgucuaccugaggggccucuu

SEQ ID NO: 2621015 - RNA, 22 nt, Human
gccgucuaccugaggggccucu

SEQ ID NO: 2621016 - RNA, 20 nt, Human
gccgucuaccugaggggccu

SEQ ID NO: 2621017 - RNA, 18 nt, Human
gccgucuaccugaggggc

SEQ ID NO: 2621018 - RNA, 16 nt, Human
gccgugaguucucagg

SEQ ID NO: 2621019 - RNA, 21 nt, Human
gccgucuucacucgcccccgg

SEQ ID NO: 2621020 - RNA, 22 nt, Human
gccgucuucacucgcccccggg

SEQ ID NO: 2621021 - RNA, 23 nt, Human
gccgugaguucucagggcuccug

SEQ ID NO: 2621022 - RNA, 21 nt, Human
gccgugaguucucagggcucc

SEQ ID NO: 2621023 - RNA, 20 nt, Human
gccgugaguucucagggcuc

SEQ ID NO: 2621024 - RNA, 18 nt, Human
gccgugaguucucagggc

SEQ ID NO: 2621025 - RNA, 17 nt, Human
gccgugaugcucaggcu

SEQ ID NO: 2621026 - RNA, 12 nt, Human
gccgugcccagg

SEQ ID NO: 2621027 - RNA, 15 nt, Human
gccgugaugccuccc

SEQ ID NO: 2621028 - RNA, 18 nt, Human
gccggguucuagucuccu

SEQ ID NO: 2621029 - RNA, 16 nt, Human
gccgggugcucagggc

SEQ ID NO: 2621030 - RNA, 17 nt, Human
gccgggugcucagggcu

SEQ ID NO: 2621031 - RNA, 14 nt, Human
gccgucuccagggg

SEQ ID NO: 2621032 - RNA, 11 nt, Human
gccgucucaac

SEQ ID NO: 2621033 - RNA, 21 nt, Human
gccgucuccaggggcugcuuc

SEQ ID NO: 2621034 - RNA, 16 nt, Human
gccgucuccaggggcu

SEQ ID NO: 2621035 - RNA, 23 nt, Human
gccgucuccaggggcugcuuccu

SEQ ID NO: 2621036 - RNA, 19 nt, Human
gccgucuucacucgccccc

SEQ ID NO: 2621037 - RNA, 20 nt, Human
gccgucuucacucgcccccg

SEQ ID NO: 2621038 - RNA, 13 nt, Human
gccguggcuuccc

SEQ ID NO: 2621039 - RNA, 18 nt, Human
gccguugaagaggaaggg

SEQ ID NO: 2621040 - RNA, 12 nt, Human
gccguggcuucc

SEQ ID NO: 2621041 - RNA, 11 nt, Human
gccguggcuuc

SEQ ID NO: 2621042 - RNA, 23 nt, Human
gccguggauugcacguggccucu

SEQ ID NO: 2621043 - RNA, 22 nt, Human
gccguggauugcacguggccuc

SEQ ID NO: 2621044 - RNA, 21 nt, Human
gccguggauugcacguggccu

SEQ ID NO: 2621045 - RNA, 14 nt, Human
gccgugcccagggg

SEQ ID NO: 2621046 - RNA, 15 nt, Human
gccguggcugcggca

SEQ ID NO: 2621047 - RNA, 14 nt, Human
gccguggcugcggc

SEQ ID NO: 2621048 - RNA, 18 nt, Human
gccguggcugcggcaccc

SEQ ID NO: 2621049 - RNA, 23 nt, Human
gccuaaaagugggcuugauucug

SEQ ID NO: 2621050 - RNA, 16 nt, Human
gccuaaaaguaaacau

SEQ ID NO: 2621051 - RNA, 15 nt, Human
gccuaaaaguaaaca

SEQ ID NO: 2621052 - RNA, 17 nt, Human
gccuaaaaaugcaacuu

SEQ ID NO: 2621053 - RNA, 13 nt, Human
gccguuguuuacu

SEQ ID NO: 2621054 - RNA, 14 nt, Human
gccguuggccacgu

SEQ ID NO: 2621055 - RNA, 12 nt, Human
gccguuggccac

SEQ ID NO: 2621056 - RNA, 23 nt, Human
gccguuugagaagaaaacaucua

SEQ ID NO: 2621057 - RNA, 14 nt, Human
gccuaaaaaugcaa

SEQ ID NO: 2621058 - RNA, 19 nt, Human
gccguugauguuggcuggg

SEQ ID NO: 2621059 - RNA, 17 nt, Human
gccguugauguuggcug

SEQ ID NO: 2621060 - RNA, 20 nt, Human
gccguugauguuggcuggga

SEQ ID NO: 2621061 - RNA, 20 nt, Human
gccucucuggccucccaccc

SEQ ID NO: 2621062 - RNA, 19 nt, Human
gccucucuggccucccacc

SEQ ID NO: 2621063 - RNA, 18 nt, Human
gccucucuggccucccac

SEQ ID NO: 2621064 - RNA, 17 nt, Human
gccucucuggccuccca

SEQ ID NO: 2621065 - RNA, 16 nt, Human
gccucucuggccuccc

SEQ ID NO: 2621066 - RNA, 15 nt, Human
gccucucuggccucc

SEQ ID NO: 2621067 - RNA, 14 nt, Human
gccucucuggccuc

SEQ ID NO: 2621068 - RNA, 13 nt, Human
gccucucuggccu

SEQ ID NO: 2621069 - RNA, 12 nt, Human
gccucucuggcc

SEQ ID NO: 2621070 - RNA, 23 nt, Human
gccucucccgucagggcccaagu

SEQ ID NO: 2621071 - RNA, 17 nt, Human
gccucucucccagucua

SEQ ID NO: 2621072 - RNA, 17 nt, Human
gccucucugcagguccc

SEQ ID NO: 2621073 - RNA, 16 nt, Human
gccucucugcaggucc

SEQ ID NO: 2621074 - RNA, 19 nt, Human
gccucucccgucagggccc

SEQ ID NO: 2621075 - RNA, 18 nt, Human
gccucucccgucagggcc

SEQ ID NO: 2621076 - RNA, 17 nt, Human
gccucucccgucagggc

SEQ ID NO: 2621077 - RNA, 13 nt, Human
gccucucccguca

SEQ ID NO: 2621078 - RNA, 13 nt, Human
gccucuccccuga

SEQ ID NO: 2621079 - RNA, 12 nt, Human
gccucuccccug

SEQ ID NO: 2621080 - RNA, 23 nt, Human
gccucuccccagguccagcucug

SEQ ID NO: 2621081 - RNA, 22 nt, Human
gccucuccccagguccagcucu

SEQ ID NO: 2621082 - RNA, 20 nt, Human
gccucuccccagguccagcu

SEQ ID NO: 2621083 - RNA, 14 nt, Human
gccucucugcaggu

SEQ ID NO: 2621084 - RNA, 10 nt, Human
gccucucugc

SEQ ID NO: 2621085 - RNA, 16 nt, Human
gccucccuagccagca

SEQ ID NO: 2621086 - RNA, 19 nt, Human
gccucccgcguugggcaac

SEQ ID NO: 2621087 - RNA, 13 nt, Human
gccucccucaacc

SEQ ID NO: 2621088 - RNA, 14 nt, Human
gccucccucaaccc

SEQ ID NO: 2621089 - RNA, 20 nt, Human
gccucccucacccugagccc

SEQ ID NO: 2621090 - RNA, 18 nt, Human
gccucccucacccugagc

SEQ ID NO: 2621091 - RNA, 17 nt, Human
gccucccucacccugag

SEQ ID NO: 2621092 - RNA, 16 nt, Human
gccucccucucucuuc

SEQ ID NO: 2621093 - RNA, 21 nt, Human
gccucccucucucuucugcuc

SEQ ID NO: 2621094 - RNA, 22 nt, Human
gccucccucucucuucugcucc

SEQ ID NO: 2621095 - RNA, 23 nt, Human
gccucccucucucuucugcucca

SEQ ID NO: 2621096 - RNA, 12 nt, Human
gccucccucuga

SEQ ID NO: 2621097 - RNA, 14 nt, Human
gccucccucugacc

SEQ ID NO: 2621098 - RNA, 20 nt, Human
gccucccucugaccugcagg

SEQ ID NO: 2621099 - RNA, 21 nt, Human
gccucccucugaccugcaggc

SEQ ID NO: 2621100 - RNA, 13 nt, Human
gccucccugaagc

SEQ ID NO: 2621101 - RNA, 18 nt, Human
gccucccugaagccuuug

SEQ ID NO: 2621102 - RNA, 11 nt, Human
gccucccugaa

SEQ ID NO: 2621103 - RNA, 22 nt, Human
gccucccugaaaauguuuuucu

SEQ ID NO: 2621104 - RNA, 15 nt, Human
gccucucccaucacu

SEQ ID NO: 2621105 - RNA, 18 nt, Human
gccucuccccagguccag

SEQ ID NO: 2621106 - RNA, 20 nt, Human
gccucccgaauagcugggac

SEQ ID NO: 2621107 - RNA, 23 nt, Human
gccucccgaguagcugggacuac

SEQ ID NO: 2621108 - RNA, 21 nt, Human
gccucccgaguagcugggacu

SEQ ID NO: 2621109 - RNA, 19 nt, Human
gccucccgaauagcuggga

SEQ ID NO: 2621110 - RNA, 18 nt, Human
gccucccgaauagcuggg

SEQ ID NO: 2621111 - RNA, 15 nt, Human
gccucccauccaggg

SEQ ID NO: 2621112 - RNA, 22 nt, Human
gccucccauccagggcccccau

SEQ ID NO: 2621113 - RNA, 17 nt, Human
gccuccccaacccugcc

SEQ ID NO: 2621114 - RNA, 19 nt, Human
gccuccccaacccugcccc

SEQ ID NO: 2621115 - RNA, 20 nt, Human
gccuccccaacccugccccu

SEQ ID NO: 2621116 - RNA, 21 nt, Human
gccuccccaacccugccccug

SEQ ID NO: 2621117 - RNA, 22 nt, Human
gccuccccaacccugccccugc

SEQ ID NO: 2621118 - RNA, 19 nt, Human
gccuccccacggccgcucc

SEQ ID NO: 2621119 - RNA, 12 nt, Human
gccuccccaccu

SEQ ID NO: 2621120 - RNA, 20 nt, Human
gccuccccauuucccaucug

SEQ ID NO: 2621121 - RNA, 19 nt, Human
gccuccccauuucccaucu

SEQ ID NO: 2621122 - RNA, 18 nt, Human
gccuccccauuucccauc

SEQ ID NO: 2621123 - RNA, 16 nt, Human
gccuccccauuuccca

SEQ ID NO: 2621124 - RNA, 13 nt, Human
gccuccccauuuc

SEQ ID NO: 2621125 - RNA, 17 nt, Human
gccuccccagcucaccc

SEQ ID NO: 2621126 - RNA, 22 nt, Human
gccuccccacggccgcuccagg

SEQ ID NO: 2621127 - RNA, 21 nt, Human
gccuccccacggccgcuccag

SEQ ID NO: 2621128 - RNA, 22 nt, Human
gccuccccauuucccaucugca

SEQ ID NO: 2621129 - RNA, 21 nt, Human
gccuccccauuucccaucugc

SEQ ID NO: 2621130 - RNA, 23 nt, Human
gccuccccauuucccaucugcac

SEQ ID NO: 2621131 - RNA, 18 nt, Human
gccuccccgaaacaggcu

SEQ ID NO: 2621132 - RNA, 14 nt, Human
gccucagccuccca

SEQ ID NO: 2621133 - RNA, 12 nt, Human
gccucagccucc

SEQ ID NO: 2621134 - RNA, 22 nt, Human
gccucagccucccaaagugcug

SEQ ID NO: 2621135 - RNA, 22 nt, Human
gccucagcccugacccugugga

SEQ ID NO: 2621136 - RNA, 17 nt, Human
gccucagcccugacccu

SEQ ID NO: 2621137 - RNA, 12 nt, Human
gccugcccaggc

SEQ ID NO: 2621138 - RNA, 11 nt, Human
gccugcccagg

SEQ ID NO: 2621139 - RNA, 10 nt, Human
gccugcuggc

SEQ ID NO: 2621140 - RNA, 10 nt, Human
gccugcccac

SEQ ID NO: 2621141 - RNA, 13 nt, Human
gccugcccacccg

SEQ ID NO: 2621142 - RNA, 16 nt, Human
gccugccaguccuagc

SEQ ID NO: 2621143 - RNA, 14 nt, Human
gccugcccacccgu

SEQ ID NO: 2621144 - RNA, 21 nt, Human
gccugcuggucacagccuccu

SEQ ID NO: 2621145 - RNA, 19 nt, Human
gccugcuggucacagccuc

SEQ ID NO: 2621146 - RNA, 18 nt, Human
gccugcuggucacagccu

SEQ ID NO: 2621147 - RNA, 17 nt, Human
gccugcuggucacagcc

SEQ ID NO: 2621148 - RNA, 14 nt, Human
gccuggacccugug

SEQ ID NO: 2621149 - RNA, 19 nt, Human
gccugcuggcacccaccgu

SEQ ID NO: 2621150 - RNA, 17 nt, Human
gccugcuggcacccacc

SEQ ID NO: 2621151 - RNA, 16 nt, Human
gccugcuggcacccac

SEQ ID NO: 2621152 - RNA, 13 nt, Human
gccugcuggcacc

SEQ ID NO: 2621153 - RNA, 22 nt, Human
gccugcuggcacccaccgugga

SEQ ID NO: 2621154 - RNA, 13 nt, Human
gccugcugggcuc

SEQ ID NO: 2621155 - RNA, 16 nt, Human
gccugcugggcucucc

SEQ ID NO: 2621156 - RNA, 17 nt, Human
gccugcugggcucucca

SEQ ID NO: 2621157 - RNA, 18 nt, Human
gccugcugggcucuccac

SEQ ID NO: 2621158 - RNA, 19 nt, Human
gccugcugggcucuccacc

SEQ ID NO: 2621159 - RNA, 20 nt, Human
gccugcugggcucuccaccu

SEQ ID NO: 2621160 - RNA, 21 nt, Human
gccugcugggcucuccaccuc

SEQ ID NO: 2621161 - RNA, 22 nt, Human
gccugcugggcucuccaccuca

SEQ ID NO: 2621162 - RNA, 23 nt, Human
gccugcugggcucuccaccucag

SEQ ID NO: 2621163 - RNA, 24 nt, Human
gccugcugggcucuccaccucagc

SEQ ID NO: 2621164 - RNA, 20 nt, Human
gccugcagagcugcgggcug

SEQ ID NO: 2621165 - RNA, 20 nt, Human
gccugcagaggucugugcug

SEQ ID NO: 2621166 - RNA, 19 nt, Human
gccugcagaggucugugcu

SEQ ID NO: 2621167 - RNA, 10 nt, Human
gccugcagcc

SEQ ID NO: 2621168 - RNA, 18 nt, Human
gccugagcaacucuugau

SEQ ID NO: 2621169 - RNA, 23 nt, Human
gccugagauuucaucugcucucc

SEQ ID NO: 2621170 - RNA, 22 nt, Human
gccugagcaacagagugagacc

SEQ ID NO: 2621171 - RNA, 23 nt, Human
gccugccaguccuagcugcacag

SEQ ID NO: 2621172 - RNA, 20 nt, Human
gccugccaguccuagcugca

SEQ ID NO: 2621173 - RNA, 19 nt, Human
gccugccaguccuagcugc

SEQ ID NO: 2621174 - RNA, 18 nt, Human
gccugccaguccuagcug

SEQ ID NO: 2621175 - RNA, 21 nt, Human
gccugcagaggucugugcuga

SEQ ID NO: 2621176 - RNA, 18 nt, Human
gccugcaggaccugccug

SEQ ID NO: 2621177 - RNA, 19 nt, Human
gccugcaggaccugccugu

SEQ ID NO: 2621178 - RNA, 20 nt, Human
gccugcaggaccugccugua

SEQ ID NO: 2621179 - RNA, 21 nt, Human
gccugcaggaccugccuguag

SEQ ID NO: 2621180 - RNA, 14 nt, Human
gccugcaggaccug

SEQ ID NO: 2621181 - RNA, 16 nt, Human
gccugcaggaccugcc

SEQ ID NO: 2621182 - RNA, 17 nt, Human
gccugcaggaccugccu

SEQ ID NO: 2621183 - RNA, 11 nt, Human
gccugcagccc

SEQ ID NO: 2621184 - RNA, 20 nt, Human
gccucugcacuccccugcug

SEQ ID NO: 2621185 - RNA, 19 nt, Human
gccucugcacuccccugcu

SEQ ID NO: 2621186 - RNA, 18 nt, Human
gccucugcacuccccugc

SEQ ID NO: 2621187 - RNA, 17 nt, Human
gccucugcacuccccug

SEQ ID NO: 2621188 - RNA, 15 nt, Human
gccucugacacacag

SEQ ID NO: 2621189 - RNA, 23 nt, Human
gccucucuggccucccacccgau

SEQ ID NO: 2621190 - RNA, 19 nt, Human
gccucucuugguuuccuuc

SEQ ID NO: 2621191 - RNA, 16 nt, Human
gccucugcacuccccu

SEQ ID NO: 2621192 - RNA, 16 nt, Human
gccucugacacacagc

SEQ ID NO: 2621193 - RNA, 17 nt, Human
gccugaaaggagcccuu

SEQ ID NO: 2621194 - RNA, 23 nt, Human
gccugaaaggagcccuuaucugu

SEQ ID NO: 2621195 - RNA, 15 nt, Human
gccugaacauccuuc

SEQ ID NO: 2621196 - RNA, 18 nt, Human
gccugaaauuucaccauu

SEQ ID NO: 2621197 - RNA, 14 nt, Human
gccugaacauccuu

SEQ ID NO: 2621198 - RNA, 23 nt, Human
gccugaaagaggcugaggccugg

SEQ ID NO: 2621199 - RNA, 14 nt, Human
gccugaaaggagcc

SEQ ID NO: 2621200 - RNA, 21 nt, Human
gccucugcacuccccugcugg

SEQ ID NO: 2621201 - RNA, 15 nt, Human
gccucugcacucccc

SEQ ID NO: 2621202 - RNA, 12 nt, Human
gccucugcauuc

SEQ ID NO: 2621203 - RNA, 22 nt, Human
gccugagauuucaucugcucuc

SEQ ID NO: 2621204 - RNA, 18 nt, Human
gccugagauuucaucugc

SEQ ID NO: 2621205 - RNA, 13 nt, Human
gccugagaugguc

SEQ ID NO: 2621206 - RNA, 16 nt, Human
gccugagauuucaucu

SEQ ID NO: 2621207 - RNA, 17 nt, Human
gccugaaggggcgucug

SEQ ID NO: 2621208 - RNA, 18 nt, Human
gccugaaggggcgucugu

SEQ ID NO: 2621209 - RNA, 22 nt, Human
gccugaaggggcgucuguuccc

SEQ ID NO: 2621210 - RNA, 13 nt, Human
gccugagaguauu

SEQ ID NO: 2621211 - RNA, 21 nt, Human
gccugagaguauuuaggcaga

SEQ ID NO: 2621212 - RNA, 21 nt, Human
gccugaacauccuuccuuccc

SEQ ID NO: 2621213 - RNA, 14 nt, Human
gccugaaccuucca

SEQ ID NO: 2621214 - RNA, 18 nt, Human
gccugaagaguccucuga

SEQ ID NO: 2621215 - RNA, 22 nt, Human
gccugagaggcaggcauagagg

SEQ ID NO: 2621216 - RNA, 15 nt, Human
gccugaaccuuccau

SEQ ID NO: 2621217 - RNA, 20 nt, Human
gccugaagaguccucugaau

SEQ ID NO: 2621218 - RNA, 23 nt, Human
gcgguccacccaggagccccgag

SEQ ID NO: 2621219 - RNA, 18 nt, Human
gcggggcgaagcccaggc

SEQ ID NO: 2621220 - RNA, 17 nt, Human
gcggggcgaagcccagg

SEQ ID NO: 2621221 - RNA, 12 nt, Human
gcggggccuugc

SEQ ID NO: 2621222 - RNA, 19 nt, Human
gcggggacucgguaagcac

SEQ ID NO: 2621223 - RNA, 20 nt, Human
gcgguccacccaggagcccc

SEQ ID NO: 2621224 - RNA, 23 nt, Human
gcggggacagcuccuucuguccu

SEQ ID NO: 2621225 - RNA, 20 nt, Human
gcguccgcgcgccagcacag

SEQ ID NO: 2621226 - RNA, 19 nt, Human
gcguccgcgcgccagcaca

SEQ ID NO: 2621227 - RNA, 14 nt, Human
gcguccuccucugu

SEQ ID NO: 2621228 - RNA, 15 nt, Human
gcguccuccucugug

SEQ ID NO: 2621229 - RNA, 16 nt, Human
gcguccuccucuguga

SEQ ID NO: 2621230 - RNA, 21 nt, Human
gcguccuguccacacccagcu

SEQ ID NO: 2621231 - RNA, 19 nt, Human
gcguccuguccacacccag

SEQ ID NO: 2621232 - RNA, 20 nt, Human
gcguccuccucaccucaugc

SEQ ID NO: 2621233 - RNA, 13 nt, Human
gcguccuguccac

SEQ ID NO: 2621234 - RNA, 19 nt, Human
gcgguccccuccgccaggc

SEQ ID NO: 2621235 - RNA, 16 nt, Human
gcguccgcgcgccagc

SEQ ID NO: 2621236 - RNA, 20 nt, Human
gcggucucaggcugguggga

SEQ ID NO: 2621237 - RNA, 22 nt, Human
gcggucucaggcuggugggagg

SEQ ID NO: 2621238 - RNA, 22 nt, Human
gcgguccccuccgccaggcgag

SEQ ID NO: 2621239 - RNA, 19 nt, Human
gcggacagccacggccagg

SEQ ID NO: 2621240 - RNA, 16 nt, Human
gcggacagccacggcc

SEQ ID NO: 2621241 - RNA, 19 nt, Human
gcgcuggcccagccggccu

SEQ ID NO: 2621242 - RNA, 15 nt, Human
gcgcuuucuggaaaa

SEQ ID NO: 2621243 - RNA, 19 nt, Human
gcggaaugaaccacaucuu

SEQ ID NO: 2621244 - RNA, 23 nt, Human
gcggacagccacggccaggccag

SEQ ID NO: 2621245 - RNA, 22 nt, Human
gcgcuuucuggaaaagaggagu

SEQ ID NO: 2621246 - RNA, 15 nt, Human
gcggaaagcagcuca

SEQ ID NO: 2621247 - RNA, 17 nt, Human
gcgcuuuugcuggucac

SEQ ID NO: 2621248 - RNA, 20 nt, Human
gcggaacaaggagucagaca

SEQ ID NO: 2621249 - RNA, 19 nt, Human
gcggggacagcuccuucug

SEQ ID NO: 2621250 - RNA, 18 nt, Human
gcggggacagcuccuucu

SEQ ID NO: 2621251 - RNA, 16 nt, Human
gcggacaucagcuggu

SEQ ID NO: 2621252 - RNA, 17 nt, Human
gcgcuggcccagccggc

SEQ ID NO: 2621253 - RNA, 16 nt, Human
gcgcuggcccagccgg

SEQ ID NO: 2621254 - RNA, 19 nt, Human
gcgcuggccgggaccccga

SEQ ID NO: 2621255 - RNA, 17 nt, Human
gcgcugccccuggcagc

SEQ ID NO: 2621256 - RNA, 15 nt, Human
gcgcuggcccagccg

SEQ ID NO: 2621257 - RNA, 11 nt, Human
gcgcugcaaau

SEQ ID NO: 2621258 - RNA, 23 nt, Human
gcgcugacaaccaccgcucccca

SEQ ID NO: 2621259 - RNA, 14 nt, Human
gcgcugccccuggc

SEQ ID NO: 2621260 - RNA, 16 nt, Human
gcgcucuagccugggc

SEQ ID NO: 2621261 - RNA, 19 nt, Human
gcgcugacaaccaccgcuc

SEQ ID NO: 2621262 - RNA, 21 nt, Human
gcgccuacaggagugagcacu

SEQ ID NO: 2621263 - RNA, 20 nt, Human
gcgccuacaggagugagcac

SEQ ID NO: 2621264 - RNA, 21 nt, Human
gcgcuccugccgcagagcugg

SEQ ID NO: 2621265 - RNA, 20 nt, Human
gcgcuccugccgcagagcug

SEQ ID NO: 2621266 - RNA, 19 nt, Human
gcgcuccugccgcagagcu

SEQ ID NO: 2621267 - RNA, 20 nt, Human
gcgccuaguggggucucccu

SEQ ID NO: 2621268 - RNA, 21 nt, Human
gcgccuaguggggucucccuc

SEQ ID NO: 2621269 - RNA, 19 nt, Human
gcgcccaguccuuccaccu

SEQ ID NO: 2621270 - RNA, 21 nt, Human
gcgccagcacagaaacagagg

SEQ ID NO: 2621271 - RNA, 17 nt, Human
gcgccagcacagaaaca

SEQ ID NO: 2621272 - RNA, 12 nt, Human
gcgacuuucugc

SEQ ID NO: 2621273 - RNA, 19 nt, Human
gcgacuccguuggccacuc

SEQ ID NO: 2621274 - RNA, 18 nt, Human
gcgacuccguuggccacu

SEQ ID NO: 2621275 - RNA, 20 nt, Human
gcgacuccguuggccacucc

SEQ ID NO: 2621276 - RNA, 21 nt, Human
gcgacucuauagacucuagga

SEQ ID NO: 2621277 - RNA, 21 nt, Human
gcgaccccaucugcccaggac

SEQ ID NO: 2621278 - RNA, 13 nt, Human
gcgacuaauuuca

SEQ ID NO: 2621279 - RNA, 21 nt, Human
gcgacuaauuucaaaaugcuu

SEQ ID NO: 2621280 - RNA, 23 nt, Human
gcgacuaauuucaaaaugcuuuu

SEQ ID NO: 2621281 - RNA, 22 nt, Human
gcgacguuagucgugagcucuu

SEQ ID NO: 2621282 - RNA, 21 nt, Human
gcgacguuagucgugagcucu

SEQ ID NO: 2621283 - RNA, 23 nt, Human
gcgaccuuccucauccaccccau

SEQ ID NO: 2621284 - RNA, 21 nt, Human
gcgccaggauggaacacggcc

SEQ ID NO: 2621285 - RNA, 22 nt, Human
gcgccaggauggaacacggcca

SEQ ID NO: 2621286 - RNA, 15 nt, Human
gcgccaggcugacca

SEQ ID NO: 2621287 - RNA, 20 nt, Human
gcgccaggcugaccacagca

SEQ ID NO: 2621288 - RNA, 22 nt, Human
gcgccaggcugaccacagcaca

SEQ ID NO: 2621289 - RNA, 16 nt, Human
gcgccauugcacucca

SEQ ID NO: 2621290 - RNA, 16 nt, Human
gcgcccaccccgcucu

SEQ ID NO: 2621291 - RNA, 20 nt, Human
gcgccauugcacuccagccu

SEQ ID NO: 2621292 - RNA, 18 nt, Human
gcgccuacaggagugagc

SEQ ID NO: 2621293 - RNA, 13 nt, Human
gcgcccaccuccc

SEQ ID NO: 2621294 - RNA, 12 nt, Human
gcgcccaccucc

SEQ ID NO: 2621295 - RNA, 17 nt, Human
gcgcccaccuccccacg

SEQ ID NO: 2621296 - RNA, 17 nt, Human
gcgcccaguccuuccac

SEQ ID NO: 2621297 - RNA, 20 nt, Human
gcuaccaaagcaccuuagcu

SEQ ID NO: 2621298 - RNA, 23 nt, Human
gcuacccucccugcuguccccuc

SEQ ID NO: 2621299 - RNA, 19 nt, Human
gcuacccucccugcugucc

SEQ ID NO: 2621300 - RNA, 12 nt, Human
gcuacccugagc

SEQ ID NO: 2621301 - RNA, 14 nt, Human
gcuacccugagcug

SEQ ID NO: 2621302 - RNA, 16 nt, Human
gcuacccugagcugag

SEQ ID NO: 2621303 - RNA, 20 nt, Human
gcuacccugagcugaggcag

SEQ ID NO: 2621304 - RNA, 16 nt, Human
gcuacccuuuuucucc

SEQ ID NO: 2621305 - RNA, 19 nt, Human
gcuacccugagcugaggca

SEQ ID NO: 2621306 - RNA, 17 nt, Human
gcuacccacuucuaaau

SEQ ID NO: 2621307 - RNA, 17 nt, Human
gcuacccucccugcugu

SEQ ID NO: 2621308 - RNA, 16 nt, Human
gcuacccucccugcug

SEQ ID NO: 2621309 - RNA, 20 nt, Human
gcuacccccaugcuggaggu

SEQ ID NO: 2621310 - RNA, 14 nt, Human
gcuacccucccugc

SEQ ID NO: 2621311 - RNA, 22 nt, Human
gcuagacgagcaggcuucuucc

SEQ ID NO: 2621312 - RNA, 21 nt, Human
gcuagacgagcaggcuucuuc

SEQ ID NO: 2621313 - RNA, 21 nt, Human
gcuacccuuuuucuccagcug

SEQ ID NO: 2621314 - RNA, 20 nt, Human
gcuacccuuuuucuccagcu

SEQ ID NO: 2621315 - RNA, 19 nt, Human
gcuacccuuuuucuccagc

SEQ ID NO: 2621316 - RNA, 18 nt, Human
gcuacccuuuuucuccag

SEQ ID NO: 2621317 - RNA, 22 nt, Human
gcuacccuuuuucuccagcugg

SEQ ID NO: 2621318 - RNA, 13 nt, Human
gcuaccucaaggg

SEQ ID NO: 2621319 - RNA, 17 nt, Human
gcuaccucaagggggac

SEQ ID NO: 2621320 - RNA, 15 nt, Human
gcuagacacccauuu

SEQ ID NO: 2621321 - RNA, 14 nt, Human
gcuaccucacuggg

SEQ ID NO: 2621322 - RNA, 20 nt, Human
gcuagagauauggcagcgaa

SEQ ID NO: 2621323 - RNA, 21 nt, Human
gcuagagauauggcagcgaaa

SEQ ID NO: 2621324 - RNA, 20 nt, Human
gcuagaggaaccaaccccca

SEQ ID NO: 2621325 - RNA, 14 nt, Human
gcuaagaauauuug

SEQ ID NO: 2621326 - RNA, 23 nt, Human
gcuaagaaccuggaacuugggga

SEQ ID NO: 2621327 - RNA, 16 nt, Human
gcuaagaaccuggaac

SEQ ID NO: 2621328 - RNA, 17 nt, Human
gcuaagaaccuggaacu

SEQ ID NO: 2621329 - RNA, 14 nt, Human
gcuaagaaaagauu

SEQ ID NO: 2621330 - RNA, 18 nt, Human
gcuaacuuggagccccag

SEQ ID NO: 2621331 - RNA, 13 nt, Human
gcuaacuggaagc

SEQ ID NO: 2621332 - RNA, 20 nt, Human
gcuaacuuggagccccagug

SEQ ID NO: 2621333 - RNA, 21 nt, Human
gcuaacccccuucuacugagc

SEQ ID NO: 2621334 - RNA, 21 nt, Human
gcuaacauuuuaaauaaaaga

SEQ ID NO: 2621335 - RNA, 12 nt, Human
gcuaacuggaag

SEQ ID NO: 2621336 - RNA, 21 nt, Human
gcuaacuagcuuggaaacugg

SEQ ID NO: 2621337 - RNA, 17 nt, Human
gcuacacccuuuuccag

SEQ ID NO: 2621338 - RNA, 22 nt, Human
gcuacacaggggaaaagaggag

SEQ ID NO: 2621339 - RNA, 20 nt, Human
gcuacaccuuucuccuuugu

SEQ ID NO: 2621340 - RNA, 15 nt, Human
gcuacaccuuucucc

SEQ ID NO: 2621341 - RNA, 19 nt, Human
gcuacacccuuuuccagcu

SEQ ID NO: 2621342 - RNA, 13 nt, Human
gcuacaccuuucu

SEQ ID NO: 2621343 - RNA, 18 nt, Human
gcuaacauggaaguacua

SEQ ID NO: 2621344 - RNA, 17 nt, Human
gcuaacauggaaguacu

SEQ ID NO: 2621345 - RNA, 13 nt, Human
gcuaacauuuuaa

SEQ ID NO: 2621346 - RNA, 15 nt, Human
gcgugagacgccacc

SEQ ID NO: 2621347 - RNA, 11 nt, Human
gcgugagacgc

SEQ ID NO: 2621348 - RNA, 24 nt, Human
gcguccuguccacacccagcucag

SEQ ID NO: 2621349 - RNA, 14 nt, Human
gcuaacauggaagu

SEQ ID NO: 2621350 - RNA, 23 nt, Human
gcuaacauuuuaaauaaaagaaa

SEQ ID NO: 2621351 - RNA, 17 nt, Human
gcuaacauuuuaaauaa

SEQ ID NO: 2621352 - RNA, 14 nt, Human
gcuaacauuuuaaa

SEQ ID NO: 2621353 - RNA, 22 nt, Human
gcuaacccccuucuacugagcc

SEQ ID NO: 2621354 - RNA, 15 nt, Human
gcgugagccacugca

SEQ ID NO: 2621355 - RNA, 16 nt, Human
gcgugagaccugcccc

SEQ ID NO: 2621356 - RNA, 14 nt, Human
gcgugagccacugc

SEQ ID NO: 2621357 - RNA, 15 nt, Human
gcgugagaccugccc

SEQ ID NO: 2621358 - RNA, 16 nt, Human
gcgucgcccucccagg

SEQ ID NO: 2621359 - RNA, 15 nt, Human
gccuucaauaaaugg

SEQ ID NO: 2621360 - RNA, 19 nt, Human
gccuuauuagagugucuuu

SEQ ID NO: 2621361 - RNA, 12 nt, Human
gccuuauuaaag

SEQ ID NO: 2621362 - RNA, 18 nt, Human
gccuuagucucaguuugu

SEQ ID NO: 2621363 - RNA, 22 nt, Human
gccuuagucucaguuugugugu

SEQ ID NO: 2621364 - RNA, 23 nt, Human
gccuuauggaacacucugagacu

SEQ ID NO: 2621365 - RNA, 22 nt, Human
gccuuauggaacacucugagac

SEQ ID NO: 2621366 - RNA, 21 nt, Human
gccuuauggaacacucugaga

SEQ ID NO: 2621367 - RNA, 20 nt, Human
gccuuagcauguuugcugaa

SEQ ID NO: 2621368 - RNA, 18 nt, Human
gccuuagcauguuugcug

SEQ ID NO: 2621369 - RNA, 17 nt, Human
gccuuagcauguuugcu

SEQ ID NO: 2621370 - RNA, 15 nt, Human
gccuuagcauguuug

SEQ ID NO: 2621371 - RNA, 14 nt, Human
gccuuagcauguuu

SEQ ID NO: 2621372 - RNA, 23 nt, Human
gccuuagagccaggcacacacug

SEQ ID NO: 2621373 - RNA, 15 nt, Human
gccuuagucucaguu

SEQ ID NO: 2621374 - RNA, 16 nt, Human
gccuuagaaccuuucu

SEQ ID NO: 2621375 - RNA, 15 nt, Human
gccuuaccuccugcc

SEQ ID NO: 2621376 - RNA, 16 nt, Human
gccuuaccuccugccc

SEQ ID NO: 2621377 - RNA, 17 nt, Human
gccuuaccuccugccca

SEQ ID NO: 2621378 - RNA, 18 nt, Human
gccuuaccuccugcccag

SEQ ID NO: 2621379 - RNA, 19 nt, Human
gccuuaccuccugcccagg

SEQ ID NO: 2621380 - RNA, 20 nt, Human
gccuuaccuccugcccagga

SEQ ID NO: 2621381 - RNA, 21 nt, Human
gccuuaccuccugcccaggag

SEQ ID NO: 2621382 - RNA, 22 nt, Human
gccuuaccuccugcccaggaga

SEQ ID NO: 2621383 - RNA, 17 nt, Human
gccuuagagccaggcac

SEQ ID NO: 2621384 - RNA, 15 nt, Human
gccuuagagccaggc

SEQ ID NO: 2621385 - RNA, 14 nt, Human
gccuuagagccagg

SEQ ID NO: 2621386 - RNA, 13 nt, Human
gccuuagagccag

SEQ ID NO: 2621387 - RNA, 20 nt, Human
gccuuagaagucacacagua

SEQ ID NO: 2621388 - RNA, 19 nt, Human
gccuuacccucauguucuu

SEQ ID NO: 2621389 - RNA, 20 nt, Human
gccuguccugaccugucuca

SEQ ID NO: 2621390 - RNA, 12 nt, Human
gccuuaccuccu

SEQ ID NO: 2621391 - RNA, 13 nt, Human
gccuuaccuccug

SEQ ID NO: 2621392 - RNA, 14 nt, Human
gccuuaccuccugc

SEQ ID NO: 2621393 - RNA, 22 nt, Human
gccuguccuccaacaccaagca

SEQ ID NO: 2621394 - RNA, 14 nt, Human
gccugucccucuca

SEQ ID NO: 2621395 - RNA, 22 nt, Human
gccugucccauggacacuccag

SEQ ID NO: 2621396 - RNA, 18 nt, Human
gccugucccucucaggca

SEQ ID NO: 2621397 - RNA, 21 nt, Human
gccugucccauggacacucca

SEQ ID NO: 2621398 - RNA, 20 nt, Human
gccugucccacccccacccc

SEQ ID NO: 2621399 - RNA, 15 nt, Human
gccuguccagccugg

SEQ ID NO: 2621400 - RNA, 17 nt, Human
gccuguccagccugggc

SEQ ID NO: 2621401 - RNA, 16 nt, Human
gccuggagauccuccu

SEQ ID NO: 2621402 - RNA, 23 nt, Human
gccuggagacuuagggcaccagg

SEQ ID NO: 2621403 - RNA, 19 nt, Human
gccuggagacuuagggcac

SEQ ID NO: 2621404 - RNA, 17 nt, Human
gccuggagacuuagggc

SEQ ID NO: 2621405 - RNA, 15 nt, Human
gccuggagaagcuga

SEQ ID NO: 2621406 - RNA, 12 nt, Human
gccuggagaagc

SEQ ID NO: 2621407 - RNA, 23 nt, Human
gccuggaccugccuccugccugc

SEQ ID NO: 2621408 - RNA, 18 nt, Human
gccuggacuuuccugcaa

SEQ ID NO: 2621409 - RNA, 17 nt, Human
gccuggacuuuccugca

SEQ ID NO: 2621410 - RNA, 16 nt, Human
gccuggacuuuccugc

SEQ ID NO: 2621411 - RNA, 15 nt, Human
gccuggacuuuccug

SEQ ID NO: 2621412 - RNA, 19 nt, Human
gccuggaccugccuccugc

SEQ ID NO: 2621413 - RNA, 18 nt, Human
gccuggaccugccuccug

SEQ ID NO: 2621414 - RNA, 14 nt, Human
gccuggacuuuccu

SEQ ID NO: 2621415 - RNA, 17 nt, Human
gccuggaccugccuccu

SEQ ID NO: 2621416 - RNA, 16 nt, Human
gccuggaccugccucc

SEQ ID NO: 2621417 - RNA, 15 nt, Human
gccuggaccugccuc

SEQ ID NO: 2621418 - RNA, 14 nt, Human
gccuggaccugccu

SEQ ID NO: 2621419 - RNA, 11 nt, Human
gccuggaccug

SEQ ID NO: 2621420 - RNA, 15 nt, Human
gccugguggcagcug

SEQ ID NO: 2621421 - RNA, 20 nt, Human
gccuggagauccuccugcag

SEQ ID NO: 2621422 - RNA, 19 nt, Human
gccuggagauccuccugca

SEQ ID NO: 2621423 - RNA, 18 nt, Human
gccuggagauccuccugc

SEQ ID NO: 2621424 - RNA, 17 nt, Human
gccuggagauccuccug

SEQ ID NO: 2621425 - RNA, 13 nt, Human
gccuggagaagcu

SEQ ID NO: 2621426 - RNA, 22 nt, Human
gccuggagauccuccugcagac

SEQ ID NO: 2621427 - RNA, 17 nt, Human
gccugguggcagcugcg

SEQ ID NO: 2621428 - RNA, 16 nt, Human
gccugguggcagcugc

SEQ ID NO: 2621429 - RNA, 18 nt, Human
gccuguaaucacagcuac

SEQ ID NO: 2621430 - RNA, 12 nt, Human
gccuguccagcc

SEQ ID NO: 2621431 - RNA, 13 nt, Human
gccuguccagccu

SEQ ID NO: 2621432 - RNA, 14 nt, Human
gccuguccagccug

SEQ ID NO: 2621433 - RNA, 18 nt, Human
gccuguaaucccagcacu

SEQ ID NO: 2621434 - RNA, 16 nt, Human
gccuguaaucccagca

SEQ ID NO: 2621435 - RNA, 17 nt, Human
gccuguaaucccagcac

SEQ ID NO: 2621436 - RNA, 20 nt, Human
gccuguaaucccagcacuuu

SEQ ID NO: 2621437 - RNA, 19 nt, Human
gccuguaaucccagcacuu

SEQ ID NO: 2621438 - RNA, 17 nt, Human
gccuguaaucccagcag

SEQ ID NO: 2621439 - RNA, 18 nt, Human
gccuguaaucccagcagu

SEQ ID NO: 2621440 - RNA, 15 nt, Human
gccuguaaucccagc

SEQ ID NO: 2621441 - RNA, 20 nt, Human
gccuuuugcaccccucccau

SEQ ID NO: 2621442 - RNA, 22 nt, Human
gcgacagugagacucugucuca

SEQ ID NO: 2621443 - RNA, 22 nt, Human
gcgaccuuccucauccacccca

SEQ ID NO: 2621444 - RNA, 15 nt, Human
gcgaccuuccucauc

SEQ ID NO: 2621445 - RNA, 23 nt, Human
gcgaccucuccaucuucagcuuc

SEQ ID NO: 2621446 - RNA, 15 nt, Human
gcgaccgcccccucc

SEQ ID NO: 2621447 - RNA, 17 nt, Human
gcgaccccgucacagcc

SEQ ID NO: 2621448 - RNA, 20 nt, Human
gcgaccccaucugcccagga

SEQ ID NO: 2621449 - RNA, 19 nt, Human
gcgaccccaucugcccagg

SEQ ID NO: 2621450 - RNA, 14 nt, Human
gcgaccgcccccuc

SEQ ID NO: 2621451 - RNA, 13 nt, Human
gcgaccgcccccu

SEQ ID NO: 2621452 - RNA, 18 nt, Human
gcgaccccaucugcccag

SEQ ID NO: 2621453 - RNA, 17 nt, Human
gcgaccccaucugccca

SEQ ID NO: 2621454 - RNA, 16 nt, Human
gcgaccccaucugccc

SEQ ID NO: 2621455 - RNA, 15 nt, Human
gcgaccccaucugcc

SEQ ID NO: 2621456 - RNA, 14 nt, Human
gcgaccccaucugc

SEQ ID NO: 2621457 - RNA, 16 nt, Human
gcgaccaccccugccu

SEQ ID NO: 2621458 - RNA, 19 nt, Human
gcgaccaccccugccucca

SEQ ID NO: 2621459 - RNA, 21 nt, Human
gcgacauagcccaucccugcc

SEQ ID NO: 2621460 - RNA, 18 nt, Human
gcgacauagcccaucccu

SEQ ID NO: 2621461 - RNA, 15 nt, Human
gcgaccaccccugcc

SEQ ID NO: 2621462 - RNA, 17 nt, Human
gcgacauagcccauccc

SEQ ID NO: 2621463 - RNA, 16 nt, Human
gcgacauagcccaucc

SEQ ID NO: 2621464 - RNA, 14 nt, Human
gccuuuaugguuuc

SEQ ID NO: 2621465 - RNA, 13 nt, Human
gccuuuauugugu

SEQ ID NO: 2621466 - RNA, 20 nt, Human
gccuuuauuguguuugucau

SEQ ID NO: 2621467 - RNA, 14 nt, Human
gccuuuauuguguu

SEQ ID NO: 2621468 - RNA, 23 nt, Human
gccuuuauuguguuugucauuag

SEQ ID NO: 2621469 - RNA, 22 nt, Human
gccuuuauuguguuugucauua

SEQ ID NO: 2621470 - RNA, 13 nt, Human
gccuuuaaaauuu

SEQ ID NO: 2621471 - RNA, 18 nt, Human
gccuuuuauaaaccucua

SEQ ID NO: 2621472 - RNA, 14 nt, Human
gccuuuuauagcua

SEQ ID NO: 2621473 - RNA, 16 nt, Human
gccuuuuauuucuuaa

SEQ ID NO: 2621474 - RNA, 20 nt, Human
gccuuuucccucuuuggcuc

SEQ ID NO: 2621475 - RNA, 13 nt, Human
gccuuuucccucu

SEQ ID NO: 2621476 - RNA, 14 nt, Human
gccuuuucuagccc

SEQ ID NO: 2621477 - RNA, 19 nt, Human
gccuuuugcaccccuccca

SEQ ID NO: 2621478 - RNA, 18 nt, Human
gccuuuugcaccccuccc

SEQ ID NO: 2621479 - RNA, 17 nt, Human
gccuuuugcaccccucc

SEQ ID NO: 2621480 - RNA, 16 nt, Human
gccuuuugcaccccuc

SEQ ID NO: 2621481 - RNA, 15 nt, Human
gccuuuugcaccccu

SEQ ID NO: 2621482 - RNA, 14 nt, Human
gccuuuugcacccc

SEQ ID NO: 2621483 - RNA, 16 nt, Human
gccuucagcucuacag

SEQ ID NO: 2621484 - RNA, 13 nt, Human
gccuuccauaauu

SEQ ID NO: 2621485 - RNA, 14 nt, Human
gccuuccauaauua

SEQ ID NO: 2621486 - RNA, 15 nt, Human
gccuuccauaauuau

SEQ ID NO: 2621487 - RNA, 16 nt, Human
gccuuccauaauuaug

SEQ ID NO: 2621488 - RNA, 19 nt, Human
gccuuccaugucggccucu

SEQ ID NO: 2621489 - RNA, 18 nt, Human
gccuuccaugucggccuc

SEQ ID NO: 2621490 - RNA, 17 nt, Human
gccuuccaugucggccu

SEQ ID NO: 2621491 - RNA, 21 nt, Human
gccuuccauaauuaugacagu

SEQ ID NO: 2621492 - RNA, 17 nt, Human
gccuucagaaccaucca

SEQ ID NO: 2621493 - RNA, 16 nt, Human
gccuucagauguucuc

SEQ ID NO: 2621494 - RNA, 13 nt, Human
gccuucagcucua

SEQ ID NO: 2621495 - RNA, 23 nt, Human
gccuucagacagagaggacugua

SEQ ID NO: 2621496 - RNA, 20 nt, Human
gccuucacuccggugugccu

SEQ ID NO: 2621497 - RNA, 18 nt, Human
gccuucggccuccauccu

SEQ ID NO: 2621498 - RNA, 17 nt, Human
gccuucgcuucuugccu

SEQ ID NO: 2621499 - RNA, 22 nt, Human
gccuucgcgguggaaggcccga

SEQ ID NO: 2621500 - RNA, 14 nt, Human
gccuuccccugggc

SEQ ID NO: 2621501 - RNA, 16 nt, Human
gccuuccccuugccca

SEQ ID NO: 2621502 - RNA, 20 nt, Human
gccuuccaugucggccucua

SEQ ID NO: 2621503 - RNA, 14 nt, Human
gccuuccccagccu

SEQ ID NO: 2621504 - RNA, 15 nt, Human
gccuuccccagccuc

SEQ ID NO: 2621505 - RNA, 16 nt, Human
gccuuccccagccucu

SEQ ID NO: 2621506 - RNA, 17 nt, Human
gccuuccccagccucuu

SEQ ID NO: 2621507 - RNA, 18 nt, Human
gccuucccccucccaggg

SEQ ID NO: 2621508 - RNA, 23 nt, Human
gccuucccccucccagggccagg

SEQ ID NO: 2621509 - RNA, 19 nt, Human
gccuuuaaaucugugauga

SEQ ID NO: 2621510 - RNA, 19 nt, Human
gccuuuagugaucacagca

SEQ ID NO: 2621511 - RNA, 22 nt, Human
gccuuuagugaucacagcagcu

SEQ ID NO: 2621512 - RNA, 21 nt, Human
gccuuuagugaucacagcagc

SEQ ID NO: 2621513 - RNA, 21 nt, Human
gccuuuaaaauuuuuuuagaa

SEQ ID NO: 2621514 - RNA, 17 nt, Human
gccuuuaaaucugugau

SEQ ID NO: 2621515 - RNA, 18 nt, Human
gccuuuaaaguaugaauc

SEQ ID NO: 2621516 - RNA, 15 nt, Human
gccuuuaaaguauga

SEQ ID NO: 2621517 - RNA, 18 nt, Human
gccuuggggcugaugcag

SEQ ID NO: 2621518 - RNA, 16 nt, Human
gccuugggcugcuccu

SEQ ID NO: 2621519 - RNA, 18 nt, Human
gccuugggcugcuccuca

SEQ ID NO: 2621520 - RNA, 19 nt, Human
gccuuggggaauuuccucu

SEQ ID NO: 2621521 - RNA, 18 nt, Human
gccuuggggaauuuccuc

SEQ ID NO: 2621522 - RNA, 22 nt, Human
gccuugggcugcuccucauggu

SEQ ID NO: 2621523 - RNA, 21 nt, Human
gccuucgcuucuugccucugu

SEQ ID NO: 2621524 - RNA, 20 nt, Human
gccuucgcuucuugccucug

SEQ ID NO: 2621525 - RNA, 22 nt, Human
gccuucgcuucuugccucugug

SEQ ID NO: 2621526 - RNA, 20 nt, Human
gccuuggcuguuggcaguga

SEQ ID NO: 2621527 - RNA, 19 nt, Human
gccuucggccuccauccug

SEQ ID NO: 2621528 - RNA, 14 nt, Human
gccuugggcugcuc

SEQ ID NO: 2621529 - RNA, 15 nt, Human
gccuugggcugcucc

SEQ ID NO: 2621530 - RNA, 19 nt, Human
gccuucggacaacucaguc

SEQ ID NO: 2621531 - RNA, 17 nt, Human
ggucucuaggcugggga

SEQ ID NO: 2621532 - RNA, 16 nt, Human
ggucucuaggcugggg

SEQ ID NO: 2621533 - RNA, 15 nt, Human
ggucucuaggcuggg

SEQ ID NO: 2621534 - RNA, 16 nt, Human
ggucucuagugcugug

SEQ ID NO: 2621535 - RNA, 19 nt, Human
ggucucuagugcugugaaa

SEQ ID NO: 2621536 - RNA, 23 nt, Human
ggucucgcugaugcugggcuggg

SEQ ID NO: 2621537 - RNA, 21 nt, Human
ggucucgcuuuguugcccagg

SEQ ID NO: 2621538 - RNA, 19 nt, Human
ggucucgcuuuguugccca

SEQ ID NO: 2621539 - RNA, 20 nt, Human
ggucucgcuuuguugcccag

SEQ ID NO: 2621540 - RNA, 20 nt, Human
ggucucagcagcgaccaccc

SEQ ID NO: 2621541 - RNA, 18 nt, Human
ggucucaggcugguggga

SEQ ID NO: 2621542 - RNA, 16 nt, Human
ggucucccacguggga

SEQ ID NO: 2621543 - RNA, 14 nt, Human
ggucucccucuccu

SEQ ID NO: 2621544 - RNA, 22 nt, Human
ggucucgcugaugcugggcugg

SEQ ID NO: 2621545 - RNA, 18 nt, Human
ggucucuaggcuggggaa

SEQ ID NO: 2621546 - RNA, 19 nt, Human
ggucucucucucucuacaa

SEQ ID NO: 2621547 - RNA, 10 nt, Human
ggucucuggu

SEQ ID NO: 2621548 - RNA, 14 nt, Human
ggucucugcugccg

SEQ ID NO: 2621549 - RNA, 13 nt, Human
ggucucugcugcc

SEQ ID NO: 2621550 - RNA, 12 nt, Human
ggucucugcugc

SEQ ID NO: 2621551 - RNA, 19 nt, Human
ggucucugccggcucuuuc

SEQ ID NO: 2621552 - RNA, 20 nt, Human
ggucucuuacuuuccuuucc

SEQ ID NO: 2621553 - RNA, 21 nt, Human
ggucucuugagggagcuuagc

SEQ ID NO: 2621554 - RNA, 15 nt, Human
ggucucuugagggag

SEQ ID NO: 2621555 - RNA, 12 nt, Human
ggucugaaaugg

SEQ ID NO: 2621556 - RNA, 13 nt, Human
ggucugaaaugga

SEQ ID NO: 2621557 - RNA, 11 nt, Human
ggucugaaugu

SEQ ID NO: 2621558 - RNA, 12 nt, Human
ggucugaauguu

SEQ ID NO: 2621559 - RNA, 14 nt, Human
ggucugaauguucu

SEQ ID NO: 2621560 - RNA, 23 nt, Human
ggucucacucugucgcccagucu

SEQ ID NO: 2621561 - RNA, 22 nt, Human
ggucucacucugucgcccaguc

SEQ ID NO: 2621562 - RNA, 21 nt, Human
ggucucacaguguugcccagg

SEQ ID NO: 2621563 - RNA, 19 nt, Human
ggucucacaguguugccca

SEQ ID NO: 2621564 - RNA, 20 nt, Human
ggucucacaguguugcccag

SEQ ID NO: 2621565 - RNA, 14 nt, Human
ggucccaccccaca

SEQ ID NO: 2621566 - RNA, 23 nt, Human
ggucuauguaaaugcaucugucc

SEQ ID NO: 2621567 - RNA, 17 nt, Human
ggucccaccccacacac

SEQ ID NO: 2621568 - RNA, 12 nt, Human
ggucuauuucua

SEQ ID NO: 2621569 - RNA, 19 nt, Human
ggucuauugucuguauuug

SEQ ID NO: 2621570 - RNA, 21 nt, Human
ggucucaaacuccugggcuca

SEQ ID NO: 2621571 - RNA, 23 nt, Human
ggucucaaacuccugggcucagg

SEQ ID NO: 2621572 - RNA, 18 nt, Human
ggucucacaguguugccc

SEQ ID NO: 2621573 - RNA, 17 nt, Human
ggucuauugucuguauu

SEQ ID NO: 2621574 - RNA, 15 nt, Human
ggucuauugucugua

SEQ ID NO: 2621575 - RNA, 17 nt, Human
ggucucaaacuccugac

SEQ ID NO: 2621576 - RNA, 21 nt, Human
ggugaccaaaauccccuucuc

SEQ ID NO: 2621577 - RNA, 18 nt, Human
ggugacaugugaaaccuu

SEQ ID NO: 2621578 - RNA, 15 nt, Human
ggugacaugugaaac

SEQ ID NO: 2621579 - RNA, 22 nt, Human
ggugaccagcaccaucucuccu

SEQ ID NO: 2621580 - RNA, 20 nt, Human
ggugaccuuccaagagccug

SEQ ID NO: 2621581 - RNA, 21 nt, Human
ggugaccuuccaagagccuga

SEQ ID NO: 2621582 - RNA, 19 nt, Human
ggugaccuuccaagagccu

SEQ ID NO: 2621583 - RNA, 21 nt, Human
ggugaccucugccugaaguca

SEQ ID NO: 2621584 - RNA, 12 nt, Human
ggugagaacucu

SEQ ID NO: 2621585 - RNA, 19 nt, Human
ggugacugggcccugccuc

SEQ ID NO: 2621586 - RNA, 23 nt, Human
ggugacugcgaucuucagagcag

SEQ ID NO: 2621587 - RNA, 18 nt, Human
ggugacgccugcccuccc

SEQ ID NO: 2621588 - RNA, 15 nt, Human
ggugaccuucuggga

SEQ ID NO: 2621589 - RNA, 16 nt, Human
ggucugcaagucagag

SEQ ID NO: 2621590 - RNA, 15 nt, Human
ggucugcaagucaga

SEQ ID NO: 2621591 - RNA, 14 nt, Human
ggucugcaagucag

SEQ ID NO: 2621592 - RNA, 17 nt, Human
ggucugaauguucugac

SEQ ID NO: 2621593 - RNA, 21 nt, Human
ggucugaauguucugacauua

SEQ ID NO: 2621594 - RNA, 20 nt, Human
ggucugagucauggccgggu

SEQ ID NO: 2621595 - RNA, 22 nt, Human
ggucugaauguucugacauuaa

SEQ ID NO: 2621596 - RNA, 14 nt, Human
ggucugacccacug

SEQ ID NO: 2621597 - RNA, 16 nt, Human
ggucugcucgggccca

SEQ ID NO: 2621598 - RNA, 23 nt, Human
ggucugccucuucugggagggca

SEQ ID NO: 2621599 - RNA, 19 nt, Human
ggucugcaagucagaggau

SEQ ID NO: 2621600 - RNA, 17 nt, Human
ggucugcaagucagagg

SEQ ID NO: 2621601 - RNA, 20 nt, Human
ggucugcaagucagaggaug

SEQ ID NO: 2621602 - RNA, 13 nt, Human
ggucugcaggcag

SEQ ID NO: 2621603 - RNA, 12 nt, Human
ggucugccacca

SEQ ID NO: 2621604 - RNA, 14 nt, Human
ggucugcaggcagg

SEQ ID NO: 2621605 - RNA, 23 nt, Human
ggucugcaggcagggcugacucu

SEQ ID NO: 2621606 - RNA, 18 nt, Human
ggucugcucuuucucugc

SEQ ID NO: 2621607 - RNA, 16 nt, Human
ggucugcucuuucucu

SEQ ID NO: 2621608 - RNA, 19 nt, Human
ggucugcucgggcccaggc

SEQ ID NO: 2621609 - RNA, 18 nt, Human
ggucugcucgggcccagg

SEQ ID NO: 2621610 - RNA, 17 nt, Human
ggucugcucgggcccag

SEQ ID NO: 2621611 - RNA, 21 nt, Human
ggugacagagugagacucugu

SEQ ID NO: 2621612 - RNA, 20 nt, Human
ggucugcucuuucucugcca

SEQ ID NO: 2621613 - RNA, 19 nt, Human
ggucugcucuuucucugcc

SEQ ID NO: 2621614 - RNA, 14 nt, Human
ggugacaugugaaa

SEQ ID NO: 2621615 - RNA, 22 nt, Human
ggucugcucgggcccaggccau

SEQ ID NO: 2621616 - RNA, 12 nt, Human
ggugacaguggc

SEQ ID NO: 2621617 - RNA, 13 nt, Human
gguggcaucccag

SEQ ID NO: 2621618 - RNA, 15 nt, Human
gguggcauacgccug

SEQ ID NO: 2621619 - RNA, 16 nt, Human
gguggcagugggagcu

SEQ ID NO: 2621620 - RNA, 22 nt, Human
gguggcagugggagcugccugu

SEQ ID NO: 2621621 - RNA, 19 nt, Human
gguggcagugggagcugcc

SEQ ID NO: 2621622 - RNA, 21 nt, Human
ggugcugccauccagguucag

SEQ ID NO: 2621623 - RNA, 15 nt, Human
ggugcugacggccag

SEQ ID NO: 2621624 - RNA, 16 nt, Human
ggugcugacggccagg

SEQ ID NO: 2621625 - RNA, 17 nt, Human
ggugcugacggccaggg

SEQ ID NO: 2621626 - RNA, 20 nt, Human
ggugcugacggccagggaga

SEQ ID NO: 2621627 - RNA, 21 nt, Human
ggugcuauaggcuggagaagc

SEQ ID NO: 2621628 - RNA, 19 nt, Human
ggugcuauaggcuggagaa

SEQ ID NO: 2621629 - RNA, 17 nt, Human
ggugcuauaggcuggag

SEQ ID NO: 2621630 - RNA, 15 nt, Human
ggugcugccauccag

SEQ ID NO: 2621631 - RNA, 21 nt, Human
ggugcugacuucaucucccac

SEQ ID NO: 2621632 - RNA, 13 nt, Human
ggugcugagaagc

SEQ ID NO: 2621633 - RNA, 22 nt, Human
gguggccacuccagaccccugg

SEQ ID NO: 2621634 - RNA, 21 nt, Human
gguggccacuccagaccccug

SEQ ID NO: 2621635 - RNA, 20 nt, Human
gguggccacuccagaccccu

SEQ ID NO: 2621636 - RNA, 17 nt, Human
gguggcaucccaguggc

SEQ ID NO: 2621637 - RNA, 22 nt, Human
gguggccucccaacucacccca

SEQ ID NO: 2621638 - RNA, 23 nt, Human
gguggccacuccagaccccuggc

SEQ ID NO: 2621639 - RNA, 10 nt, Human
gguggccaug

SEQ ID NO: 2621640 - RNA, 23 nt, Human
gguggccucuccuuguggccugg

SEQ ID NO: 2621641 - RNA, 21 nt, Human
gguggcgacucuauagacucu

SEQ ID NO: 2621642 - RNA, 21 nt, Human
gguggcgggcgccuguaaucc

SEQ ID NO: 2621643 - RNA, 19 nt, Human
gguggcgggcaccuauagu

SEQ ID NO: 2621644 - RNA, 20 nt, Human
gguggcuagucaagcuccuc

SEQ ID NO: 2621645 - RNA, 23 nt, Human
gguggccucccaacucaccccag

SEQ ID NO: 2621646 - RNA, 22 nt, Human
gguggccucgggacaccugccc

SEQ ID NO: 2621647 - RNA, 12 nt, Human
gguggccucggg

SEQ ID NO: 2621648 - RNA, 20 nt, Human
gguggccaugccucagcccu

SEQ ID NO: 2621649 - RNA, 17 nt, Human
gguggccaugccucagc

SEQ ID NO: 2621650 - RNA, 20 nt, Human
ggugcuaucucccccagccc

SEQ ID NO: 2621651 - RNA, 19 nt, Human
ggugcuaucucccccagcc

SEQ ID NO: 2621652 - RNA, 17 nt, Human
ggugcuaucucccccag

SEQ ID NO: 2621653 - RNA, 16 nt, Human
ggugcuaucuccccca

SEQ ID NO: 2621654 - RNA, 23 nt, Human
ggugcuacaaaaacacagcaagg

SEQ ID NO: 2621655 - RNA, 23 nt, Human
ggugcuacacccuuuuccagcug

SEQ ID NO: 2621656 - RNA, 15 nt, Human
ggugcuacgccugca

SEQ ID NO: 2621657 - RNA, 22 nt, Human
ggugcgaccccaucugcccagg

SEQ ID NO: 2621658 - RNA, 21 nt, Human
ggugcgaccccaucugcccag

SEQ ID NO: 2621659 - RNA, 22 nt, Human
ggugcuacacccuuuuccagcu

SEQ ID NO: 2621660 - RNA, 19 nt, Human
ggugcgaccccaucugccc

SEQ ID NO: 2621661 - RNA, 21 nt, Human
ggugccugugaggcaggggcg

SEQ ID NO: 2621662 - RNA, 19 nt, Human
ggugagcccauggcccucc

SEQ ID NO: 2621663 - RNA, 15 nt, Human
ggugaggaccacucc

SEQ ID NO: 2621664 - RNA, 23 nt, Human
ggugagcacggccaacaaagcug

SEQ ID NO: 2621665 - RNA, 14 nt, Human
ggugagcaaccagu

SEQ ID NO: 2621666 - RNA, 19 nt, Human
ggugagcagaaguggagcu

SEQ ID NO: 2621667 - RNA, 18 nt, Human
ggugagcagacugguggg

SEQ ID NO: 2621668 - RNA, 22 nt, Human
ggugagcccauggcccucccag

SEQ ID NO: 2621669 - RNA, 18 nt, Human
ggugaggaccacuccugu

SEQ ID NO: 2621670 - RNA, 19 nt, Human
ggugccugagaggcaggca

SEQ ID NO: 2621671 - RNA, 18 nt, Human
ggugccugauucggcugu

SEQ ID NO: 2621672 - RNA, 14 nt, Human
ggugccugaggucu

SEQ ID NO: 2621673 - RNA, 21 nt, Human
ggugccugauucggcugucuc

SEQ ID NO: 2621674 - RNA, 18 nt, Human
ggugccuggguggggcug

SEQ ID NO: 2621675 - RNA, 13 nt, Human
ggugccuguccca

SEQ ID NO: 2621676 - RNA, 19 nt, Human
ggugccuggguggggcugc

SEQ ID NO: 2621677 - RNA, 22 nt, Human
ggugccuggguggggcugcucc

SEQ ID NO: 2621678 - RNA, 17 nt, Human
ggugccugucccacccc

SEQ ID NO: 2621679 - RNA, 23 nt, Human
ggugccuggguggggcugcuccu

SEQ ID NO: 2621680 - RNA, 17 nt, Human
ggugccugugaggcagg

SEQ ID NO: 2621681 - RNA, 18 nt, Human
ggugccugugaggcaggg

SEQ ID NO: 2621682 - RNA, 19 nt, Human
ggugccugugaggcagggg

SEQ ID NO: 2621683 - RNA, 23 nt, Human
ggugccuucuuauucucacucca

SEQ ID NO: 2621684 - RNA, 14 nt, Human
ggugcgaccccauc

SEQ ID NO: 2621685 - RNA, 12 nt, Human
ggugagagcugc

SEQ ID NO: 2621686 - RNA, 15 nt, Human
ggugagaagcagagg

SEQ ID NO: 2621687 - RNA, 16 nt, Human
ggugagaggggaacag

SEQ ID NO: 2621688 - RNA, 23 nt, Human
ggugagaugcuggagaagagagg

SEQ ID NO: 2621689 - RNA, 22 nt, Human
ggugagaugcuggagaagagag

SEQ ID NO: 2621690 - RNA, 21 nt, Human
ggugagaugcuggagaagaga

SEQ ID NO: 2621691 - RNA, 17 nt, Human
ggugagaugcuggagaa

SEQ ID NO: 2621692 - RNA, 14 nt, Human
ggugagaugcugga

SEQ ID NO: 2621693 - RNA, 16 nt, Human
ggugagaugcagcugg

SEQ ID NO: 2621694 - RNA, 16 nt, Human
gguugacuuucaggua

SEQ ID NO: 2621695 - RNA, 13 nt, Human
gguugagaaauga

SEQ ID NO: 2621696 - RNA, 11 nt, Human
gguugaggaaa

SEQ ID NO: 2621697 - RNA, 18 nt, Human
gguugaggggcuccugga

SEQ ID NO: 2621698 - RNA, 21 nt, Human
gguugagguccagcccuggcu

SEQ ID NO: 2621699 - RNA, 19 nt, Human
gguugaggggcuccuggaa

SEQ ID NO: 2621700 - RNA, 13 nt, Human
gguugagguuuca

SEQ ID NO: 2621701 - RNA, 14 nt, Human
gguugaucacacuc

SEQ ID NO: 2621702 - RNA, 22 nt, Human
gguugauaguuuaccugaauaa

SEQ ID NO: 2621703 - RNA, 19 nt, Human
gguugauaacuuugcuugc

SEQ ID NO: 2621704 - RNA, 17 nt, Human
gguugauaacuuugcuu

SEQ ID NO: 2621705 - RNA, 23 nt, Human
gguugagguccagcccuggcuga

SEQ ID NO: 2621706 - RNA, 19 nt, Human
gguugagguggaagcccuc

SEQ ID NO: 2621707 - RNA, 22 nt, Human
gguucuuguauuaagaaugaaa

SEQ ID NO: 2621708 - RNA, 17 nt, Human
gguucuugguagagauu

SEQ ID NO: 2621709 - RNA, 14 nt, Human
gguucuuguauuaa

SEQ ID NO: 2621710 - RNA, 16 nt, Human
gguucuuucuuccucu

SEQ ID NO: 2621711 - RNA, 14 nt, Human
gguucuuucuuccu

SEQ ID NO: 2621712 - RNA, 21 nt, Human
gguucacucuuggagccugca

SEQ ID NO: 2621713 - RNA, 23 nt, Human
gguucacucuuggagccugcaga

SEQ ID NO: 2621714 - RNA, 13 nt, Human
gguucuucccuuu

SEQ ID NO: 2621715 - RNA, 18 nt, Human
gguucuuaguucucacug

SEQ ID NO: 2621716 - RNA, 16 nt, Human
gguucuuagugucacu

SEQ ID NO: 2621717 - RNA, 21 nt, Human
gguucaaagauauuuugcuuu

SEQ ID NO: 2621718 - RNA, 22 nt, Human
gguucacaggcgaggccuggag

SEQ ID NO: 2621719 - RNA, 12 nt, Human
gguucaccagcc

SEQ ID NO: 2621720 - RNA, 13 nt, Human
gguucaccagccu

SEQ ID NO: 2621721 - RNA, 14 nt, Human
gguucaccagccuc

SEQ ID NO: 2621722 - RNA, 19 nt, Human
gguucacucuuggagccug

SEQ ID NO: 2621723 - RNA, 20 nt, Human
gguucacucuuggagccugc

SEQ ID NO: 2621724 - RNA, 15 nt, Human
gguucaccagccucu

SEQ ID NO: 2621725 - RNA, 21 nt, Human
gguucacgccuguaaucccag

SEQ ID NO: 2621726 - RNA, 22 nt, Human
gguucacgccuguaaucccagc

SEQ ID NO: 2621727 - RNA, 20 nt, Human
gguucacgugcagcucaagg

SEQ ID NO: 2621728 - RNA, 15 nt, Human
gguucacuaaagcag

SEQ ID NO: 2621729 - RNA, 13 nt, Human
gguuauuucucug

SEQ ID NO: 2621730 - RNA, 14 nt, Human
gguuauuuauuuaa

SEQ ID NO: 2621731 - RNA, 20 nt, Human
gguuauuuagggaacugcuu

SEQ ID NO: 2621732 - RNA, 13 nt, Human
gguuaugaauauu

SEQ ID NO: 2621733 - RNA, 23 nt, Human
gguuaucgaaauaacaauguuaa

SEQ ID NO: 2621734 - RNA, 15 nt, Human
gguuaucugucccag

SEQ ID NO: 2621735 - RNA, 20 nt, Human
gguuauugaaaauaugaugu

SEQ ID NO: 2621736 - RNA, 13 nt, Human
gguucaaagauau

SEQ ID NO: 2621737 - RNA, 19 nt, Human
gguuauuuuaguuucuguu

SEQ ID NO: 2621738 - RNA, 17 nt, Human
gguuauuuuaguuucug

SEQ ID NO: 2621739 - RNA, 24 nt, Human
gguuauuucucaacaaagcacagu

SEQ ID NO: 2621740 - RNA, 18 nt, Human
gguuauuuauuuaaaugu

SEQ ID NO: 2621741 - RNA, 23 nt, Human
gguuauuuuaguuucuguucugu

SEQ ID NO: 2621742 - RNA, 16 nt, Human
gguuaccaagaagccu

SEQ ID NO: 2621743 - RNA, 23 nt, Human
gguuacaaucauugcugaaaaug

SEQ ID NO: 2621744 - RNA, 17 nt, Human
gguuaggcauuguggga

SEQ ID NO: 2621745 - RNA, 16 nt, Human
gguuagggaaaacauu

SEQ ID NO: 2621746 - RNA, 20 nt, Human
gguuaggaguucgagaccag

SEQ ID NO: 2621747 - RNA, 13 nt, Human
gguuagggagggg

SEQ ID NO: 2621748 - RNA, 15 nt, Human
gguuagggaggggua

SEQ ID NO: 2621749 - RNA, 21 nt, Human
gguuaguggauggaaggggcu

SEQ ID NO: 2621750 - RNA, 22 nt, Human
gguuaguggauggaaggggcug

SEQ ID NO: 2621751 - RNA, 21 nt, Human
gguuauauuuuacuacugugg

SEQ ID NO: 2621752 - RNA, 14 nt, Human
gguuauaaaaguga

SEQ ID NO: 2621753 - RNA, 16 nt, Human
gguuaggauuuaacag

SEQ ID NO: 2621754 - RNA, 17 nt, Human
gguuaucgaaauaacaa

SEQ ID NO: 2621755 - RNA, 18 nt, Human
gguuaucaaaaauuucau

SEQ ID NO: 2621756 - RNA, 14 nt, Human
gguuaucucugugu

SEQ ID NO: 2621757 - RNA, 13 nt, Human
gguuauggagagg

SEQ ID NO: 2621758 - RNA, 13 nt, Human
gguuaagucuguu

SEQ ID NO: 2621759 - RNA, 16 nt, Human
gguuaagucuguuuua

SEQ ID NO: 2621760 - RNA, 23 nt, Human
gguuaagucuguuuuaugacuuc

SEQ ID NO: 2621761 - RNA, 17 nt, Human
gguuaaucuuuccugau

SEQ ID NO: 2621762 - RNA, 21 nt, Human
gguuaagcauuaccacucagg

SEQ ID NO: 2621763 - RNA, 15 nt, Human
gguuaaggcugagga

SEQ ID NO: 2621764 - RNA, 16 nt, Human
gguuaagcccugaggg

SEQ ID NO: 2621765 - RNA, 22 nt, Human
gguuaaggcugaggaaaggcca

SEQ ID NO: 2621766 - RNA, 21 nt, Human
gguuacccaguuagcucucaa

SEQ ID NO: 2621767 - RNA, 13 nt, Human
gguuacaacagau

SEQ ID NO: 2621768 - RNA, 14 nt, Human
gguuacaacagauu

SEQ ID NO: 2621769 - RNA, 13 nt, Human
gguuaauaaguuu

SEQ ID NO: 2621770 - RNA, 21 nt, Human
gguuacaacagauuugugaac

SEQ ID NO: 2621771 - RNA, 19 nt, Human
gguuacaacagauuuguga

SEQ ID NO: 2621772 - RNA, 14 nt, Human
gguguccugaccac

SEQ ID NO: 2621773 - RNA, 13 nt, Human
gguguccugacca

SEQ ID NO: 2621774 - RNA, 12 nt, Human
gguguccugacc

SEQ ID NO: 2621775 - RNA, 17 nt, Human
gguguccuuucccucca

SEQ ID NO: 2621776 - RNA, 23 nt, Human
gguuaaaaaaaggcauuguuuga

SEQ ID NO: 2621777 - RNA, 18 nt, Human
gguguccugaccacccuc

SEQ ID NO: 2621778 - RNA, 17 nt, Human
gguguccugaccacccu

SEQ ID NO: 2621779 - RNA, 20 nt, Human
gguguccugaccacccuccc

SEQ ID NO: 2621780 - RNA, 13 nt, Human
gguuaaaacuguc

SEQ ID NO: 2621781 - RNA, 11 nt, Human
gguuaaaacug

SEQ ID NO: 2621782 - RNA, 16 nt, Human
gguguaugguucugug

SEQ ID NO: 2621783 - RNA, 17 nt, Human
ggugucaagagggucug

SEQ ID NO: 2621784 - RNA, 19 nt, Human
ggugucaagagggucugag

SEQ ID NO: 2621785 - RNA, 17 nt, Human
gguguauuuauuuuccu

SEQ ID NO: 2621786 - RNA, 22 nt, Human
gguguauuuauuuuccucccca

SEQ ID NO: 2621787 - RNA, 23 nt, Human
gguguauuuauuuuccuccccag

SEQ ID NO: 2621788 - RNA, 20 nt, Human
ggugucaggcugcuggcgcc

SEQ ID NO: 2621789 - RNA, 17 nt, Human
ggugucaggcugcuggc

SEQ ID NO: 2621790 - RNA, 13 nt, Human
ggugucaggcugc

SEQ ID NO: 2621791 - RNA, 19 nt, Human
ggugucacuuacuguuucu

SEQ ID NO: 2621792 - RNA, 17 nt, Human
ggugucacuuacuguuu

SEQ ID NO: 2621793 - RNA, 23 nt, Human
ggugucacuuacuguuucuguca

SEQ ID NO: 2621794 - RNA, 15 nt, Human
ggugucacuuacugu

SEQ ID NO: 2621795 - RNA, 19 nt, Human
ggugucaccugaagacuca

SEQ ID NO: 2621796 - RNA, 17 nt, Human
ggugguuucagaaaugu

SEQ ID NO: 2621797 - RNA, 18 nt, Human
ggugguuucagaaaugug

SEQ ID NO: 2621798 - RNA, 22 nt, Human
ggugguucacucuuggagccug

SEQ ID NO: 2621799 - RNA, 23 nt, Human
ggugguucacucuuggagccugc

SEQ ID NO: 2621800 - RNA, 21 nt, Human
ggugguuauggagaggguguc

SEQ ID NO: 2621801 - RNA, 15 nt, Human
ggugguuuucuguuc

SEQ ID NO: 2621802 - RNA, 18 nt, Human
ggugguuuucuguucuuu

SEQ ID NO: 2621803 - RNA, 16 nt, Human
gguguaauaagacaua

SEQ ID NO: 2621804 - RNA, 15 nt, Human
gguguaauaagacau

SEQ ID NO: 2621805 - RNA, 18 nt, Human
gguguaauaagacauaac

SEQ ID NO: 2621806 - RNA, 21 nt, Human
gguggugucuccaacccccca

SEQ ID NO: 2621807 - RNA, 21 nt, Human
ggugguugcuguuuuccuccc

SEQ ID NO: 2621808 - RNA, 23 nt, Human
ggugguugcuguuuuccucccuu

SEQ ID NO: 2621809 - RNA, 14 nt, Human
gguguaauaagaca

SEQ ID NO: 2621810 - RNA, 14 nt, Human
gguggguggugggg

SEQ ID NO: 2621811 - RNA, 16 nt, Human
ggugggugguggggag

SEQ ID NO: 2621812 - RNA, 14 nt, Human
ggugguaacccugg

SEQ ID NO: 2621813 - RNA, 17 nt, Human
gguggguuuucuuccca

SEQ ID NO: 2621814 - RNA, 19 nt, Human
gguggguucuuuggaagga

SEQ ID NO: 2621815 - RNA, 16 nt, Human
gguggguuuucuuccc

SEQ ID NO: 2621816 - RNA, 16 nt, Human
ggugguaccaggucuc

SEQ ID NO: 2621817 - RNA, 15 nt, Human
ggugguaccaggucu

SEQ ID NO: 2621818 - RNA, 16 nt, Human
ggugguacccucugga

SEQ ID NO: 2621819 - RNA, 19 nt, Human
gguggucacuggaacucag

SEQ ID NO: 2621820 - RNA, 22 nt, Human
ggugguaccaggucuccuccac

SEQ ID NO: 2621821 - RNA, 14 nt, Human
ggugguaugugugu

SEQ ID NO: 2621822 - RNA, 14 nt, Human
gguggguauaaaag

SEQ ID NO: 2621823 - RNA, 10 nt, Human
ggugggucca

SEQ ID NO: 2621824 - RNA, 14 nt, Human
gguggguccauggg

SEQ ID NO: 2621825 - RNA, 20 nt, Human
gguggguccaggggccccuc

SEQ ID NO: 2621826 - RNA, 17 nt, Human
gguggguccaugggcag

SEQ ID NO: 2621827 - RNA, 20 nt, Human
gguggguccaugggcagagc

SEQ ID NO: 2621828 - RNA, 21 nt, Human
gguggcuagucaagcuccucc

SEQ ID NO: 2621829 - RNA, 22 nt, Human
gguggcuagucaagcuccuccu

SEQ ID NO: 2621830 - RNA, 23 nt, Human
gguggcuagucaagcuccuccuc

SEQ ID NO: 2621831 - RNA, 15 nt, Human
gguggcuagucagag

SEQ ID NO: 2621832 - RNA, 16 nt, Human
gguggcuagucagaga

SEQ ID NO: 2621833 - RNA, 17 nt, Human
gguggcuagucagagag

SEQ ID NO: 2621834 - RNA, 20 nt, Human
gguggcucccggagggcccu

SEQ ID NO: 2621835 - RNA, 17 nt, Human
gguggcucaugccugua

SEQ ID NO: 2621836 - RNA, 19 nt, Human
gguggcucacgccuguaau

SEQ ID NO: 2621837 - RNA, 13 nt, Human
gguggcugaccca

SEQ ID NO: 2621838 - RNA, 15 nt, Human
gguggcugacccagu

SEQ ID NO: 2621839 - RNA, 18 nt, Human
gguggcugacccaguccc

SEQ ID NO: 2621840 - RNA, 23 nt, Human
ggugggguccuggagcagaccac

SEQ ID NO: 2621841 - RNA, 14 nt, Human
ggugggguccugga

SEQ ID NO: 2621842 - RNA, 23 nt, Human
gguggggucaugcccuccucucc

SEQ ID NO: 2621843 - RNA, 22 nt, Human
gguggcuggagacgggugggcg

SEQ ID NO: 2621844 - RNA, 19 nt, Human
gguggcugacccagucccu

SEQ ID NO: 2621845 - RNA, 21 nt, Human
gguggcugacccagucccugg

SEQ ID NO: 2621846 - RNA, 22 nt, Human
gguggcugacccagucccuggg

SEQ ID NO: 2621847 - RNA, 23 nt, Human
gguggcugacccagucccugggg

SEQ ID NO: 2621848 - RNA, 15 nt, Human
gguggugaccucugc

SEQ ID NO: 2621849 - RNA, 14 nt, Human
gguggugaccucug

SEQ ID NO: 2621850 - RNA, 14 nt, Human
gguggucaggcgua

SEQ ID NO: 2621851 - RNA, 19 nt, Human
ggugguccugacucaacau

SEQ ID NO: 2621852 - RNA, 18 nt, Human
ggugguccugagaccuga

SEQ ID NO: 2621853 - RNA, 17 nt, Human
ggugguccugagaccug

SEQ ID NO: 2621854 - RNA, 15 nt, Human
gguggucugaauguu

SEQ ID NO: 2621855 - RNA, 18 nt, Human
gguggucugaauguucug

SEQ ID NO: 2621856 - RNA, 20 nt, Human
gguggucugcucgggcccag

SEQ ID NO: 2621857 - RNA, 19 nt, Human
gguggucugcucgggccca

SEQ ID NO: 2621858 - RNA, 14 nt, Human
gguggucugcucgg

SEQ ID NO: 2621859 - RNA, 13 nt, Human
gguggucugcucg

SEQ ID NO: 2621860 - RNA, 19 nt, Human
gguggucugaauguucuga

SEQ ID NO: 2621861 - RNA, 16 nt, Human
gguggucugcaggcag

SEQ ID NO: 2621862 - RNA, 17 nt, Human
gguggucugcaggcagg

SEQ ID NO: 2621863 - RNA, 18 nt, Human
gguggucugcaggcaggg

SEQ ID NO: 2621864 - RNA, 14 nt, Human
ggugguggggaggg

SEQ ID NO: 2621865 - RNA, 13 nt, Human
ggugguggggagg

SEQ ID NO: 2621866 - RNA, 17 nt, Human
ggugguggcacugagcc

SEQ ID NO: 2621867 - RNA, 21 nt, Human
ggugguggaucuguccaagga

SEQ ID NO: 2621868 - RNA, 20 nt, Human
gguggugggaaccaugaaga

SEQ ID NO: 2621869 - RNA, 14 nt, Human
ggugguggaucugu

SEQ ID NO: 2621870 - RNA, 13 nt, Human
ggugguggagcca

SEQ ID NO: 2621871 - RNA, 23 nt, Human
gguggugcugggacugagccagu

SEQ ID NO: 2621872 - RNA, 22 nt, Human
gguggucugcucgggcccaggc

SEQ ID NO: 2621873 - RNA, 16 nt, Human
gguggugaccucugcc

SEQ ID NO: 2621874 - RNA, 21 nt, Human
gguggucuguuggcaggcugg

SEQ ID NO: 2621875 - RNA, 16 nt, Human
gguggucuguuggcag

SEQ ID NO: 2621876 - RNA, 22 nt, Human
gguggucuguuggcaggcuggc

SEQ ID NO: 2621877 - RNA, 20 nt, Human
gguggugcugggacugagcc

SEQ ID NO: 2621878 - RNA, 18 nt, Human
gguauuuuugcccugagu

SEQ ID NO: 2621879 - RNA, 22 nt, Human
gguauuuuaggcagggauuuga

SEQ ID NO: 2621880 - RNA, 22 nt, Human
ggucaaaccgcacucacccaug

SEQ ID NO: 2621881 - RNA, 20 nt, Human
gguauuuucccccuuuucug

SEQ ID NO: 2621882 - RNA, 18 nt, Human
ggucaacagcuaugcugg

SEQ ID NO: 2621883 - RNA, 14 nt, Human
ggucaacagagaag

SEQ ID NO: 2621884 - RNA, 20 nt, Human
ggucaacagagaaggcagga

SEQ ID NO: 2621885 - RNA, 18 nt, Human
ggucacaggacucugccu

SEQ ID NO: 2621886 - RNA, 16 nt, Human
ggucacaggacucugc

SEQ ID NO: 2621887 - RNA, 19 nt, Human
ggucaacauggugaaaccc

SEQ ID NO: 2621888 - RNA, 23 nt, Human
ggucaacaucuuuuacauucugc

SEQ ID NO: 2621889 - RNA, 21 nt, Human
ggucacagcggagguguggag

SEQ ID NO: 2621890 - RNA, 14 nt, Human
ggucaccaugaaac

SEQ ID NO: 2621891 - RNA, 21 nt, Human
ggucacauucaggaagaugaa

SEQ ID NO: 2621892 - RNA, 17 nt, Human
ggucacauucaggaaga

SEQ ID NO: 2621893 - RNA, 16 nt, Human
ggucaccagcuccucc

SEQ ID NO: 2621894 - RNA, 15 nt, Human
ggucaccaugaaacu

SEQ ID NO: 2621895 - RNA, 13 nt, Human
ggucacuccuggg

SEQ ID NO: 2621896 - RNA, 18 nt, Human
ggucacuggcucuccaag

SEQ ID NO: 2621897 - RNA, 16 nt, Human
ggucacuggcucucca

SEQ ID NO: 2621898 - RNA, 13 nt, Human
ggucacuggcucu

SEQ ID NO: 2621899 - RNA, 13 nt, Human
ggucacuggaacu

SEQ ID NO: 2621900 - RNA, 15 nt, Human
ggucacuggaaaggg

SEQ ID NO: 2621901 - RNA, 13 nt, Human
ggucacuggaaag

SEQ ID NO: 2621902 - RNA, 14 nt, Human
ggucacugcuguca

SEQ ID NO: 2621903 - RNA, 13 nt, Human
ggucacugcuguc

SEQ ID NO: 2621904 - RNA, 12 nt, Human
ggucacugcugu

SEQ ID NO: 2621905 - RNA, 15 nt, Human
ggucacugccaugga

SEQ ID NO: 2621906 - RNA, 16 nt, Human
ggucccaccccacaca

SEQ ID NO: 2621907 - RNA, 15 nt, Human
ggucccaccccacac

SEQ ID NO: 2621908 - RNA, 13 nt, Human
ggucaggcuccau

SEQ ID NO: 2621909 - RNA, 19 nt, Human
ggucagguguucaagacca

SEQ ID NO: 2621910 - RNA, 17 nt, Human
ggucagggaccaaggac

SEQ ID NO: 2621911 - RNA, 22 nt, Human
ggucaggaguuagaggccagcc

SEQ ID NO: 2621912 - RNA, 16 nt, Human
ggucaggccacggcag

SEQ ID NO: 2621913 - RNA, 11 nt, Human
ggucagagccu

SEQ ID NO: 2621914 - RNA, 17 nt, Human
ggucacuggcucuccaa

SEQ ID NO: 2621915 - RNA, 13 nt, Human
ggucaggcagggu

SEQ ID NO: 2621916 - RNA, 21 nt, Human
ggucaggaguuccuaaccagc

SEQ ID NO: 2621917 - RNA, 22 nt, Human
ggucaggaaggaugagcauuua

SEQ ID NO: 2621918 - RNA, 18 nt, Human
ggucagcucccuucucug

SEQ ID NO: 2621919 - RNA, 21 nt, Human
ggucaggaguuagaggccagc

SEQ ID NO: 2621920 - RNA, 20 nt, Human
ggucagagacugcuguguuu

SEQ ID NO: 2621921 - RNA, 22 nt, Human
ggucagcuugcugcccuaggcu

SEQ ID NO: 2621922 - RNA, 22 nt, Human
ggucaggagaggggcagaacag

SEQ ID NO: 2621923 - RNA, 12 nt, Human
gguagccauccc

SEQ ID NO: 2621924 - RNA, 14 nt, Human
gguagccaggggga

SEQ ID NO: 2621925 - RNA, 19 nt, Human
gguauuguauuuauucaau

SEQ ID NO: 2621926 - RNA, 21 nt, Human
gguagccagcacacagggcag

SEQ ID NO: 2621927 - RNA, 16 nt, Human
gguagccaucauggau

SEQ ID NO: 2621928 - RNA, 22 nt, Human
gguauuguauuuauucaauaaa

SEQ ID NO: 2621929 - RNA, 20 nt, Human
gguauuguauuuauucaaua

SEQ ID NO: 2621930 - RNA, 23 nt, Human
gguauuguauuuauucaauaaag

SEQ ID NO: 2621931 - RNA, 14 nt, Human
gguauuuauaauau

SEQ ID NO: 2621932 - RNA, 14 nt, Human
gguagcagcuggac

SEQ ID NO: 2621933 - RNA, 13 nt, Human
gguagcagcugga

SEQ ID NO: 2621934 - RNA, 12 nt, Human
gguagcagcugg

SEQ ID NO: 2621935 - RNA, 13 nt, Human
gguagccagcaca

SEQ ID NO: 2621936 - RNA, 16 nt, Human
gguagccagcacacag

SEQ ID NO: 2621937 - RNA, 14 nt, Human
gguagauguucaga

SEQ ID NO: 2621938 - RNA, 12 nt, Human
gguagauguuca

SEQ ID NO: 2621939 - RNA, 18 nt, Human
gguagaucacgagaucaa

SEQ ID NO: 2621940 - RNA, 22 nt, Human
gguagaagcccuucuaccuucc

SEQ ID NO: 2621941 - RNA, 23 nt, Human
gguagaaauaucugaaaauguau

SEQ ID NO: 2621942 - RNA, 23 nt, Human
gguagagcugauccagagcacag

SEQ ID NO: 2621943 - RNA, 21 nt, Human
gguagagcugauccagagcac

SEQ ID NO: 2621944 - RNA, 17 nt, Human
gguagagcugauccaga

SEQ ID NO: 2621945 - RNA, 15 nt, Human
gguagagcugaucca

SEQ ID NO: 2621946 - RNA, 17 nt, Human
gguagaggaugaggaaa

SEQ ID NO: 2621947 - RNA, 23 nt, Human
gguagaguuugaaggaggugagg

SEQ ID NO: 2621948 - RNA, 19 nt, Human
gguagagauucauuauuuu

SEQ ID NO: 2621949 - RNA, 11 nt, Human
gguagaacaca

SEQ ID NO: 2621950 - RNA, 17 nt, Human
gguacuuguggacacag

SEQ ID NO: 2621951 - RNA, 16 nt, Human
gguacuuguggacaca

SEQ ID NO: 2621952 - RNA, 16 nt, Human
gguacuugucauuucg

SEQ ID NO: 2621953 - RNA, 19 nt, Human
gguacuucuugaaggugcu

SEQ ID NO: 2621954 - RNA, 22 nt, Human
gguagaaauaucugaaaaugua

SEQ ID NO: 2621955 - RNA, 13 nt, Human
gguacccacugcu

SEQ ID NO: 2621956 - RNA, 15 nt, Human
gguacuucuugaagg

SEQ ID NO: 2621957 - RNA, 16 nt, Human
gguacuucuugaaggu

SEQ ID NO: 2621958 - RNA, 11 nt, Human
gguacccacug

SEQ ID NO: 2621959 - RNA, 14 nt, Human
gguaccagcugcgc

SEQ ID NO: 2621960 - RNA, 12 nt, Human
gguaccagcugc

SEQ ID NO: 2621961 - RNA, 20 nt, Human
gguaccaggucuccuccacc

SEQ ID NO: 2621962 - RNA, 15 nt, Human
gguaccagcugcgcu

SEQ ID NO: 2621963 - RNA, 16 nt, Human
gguacccaauucaauu

SEQ ID NO: 2621964 - RNA, 22 nt, Human
gggugauuucagagagggcaga

SEQ ID NO: 2621965 - RNA, 16 nt, Human
gggugaugccagguuc

SEQ ID NO: 2621966 - RNA, 16 nt, Human
gggugauuucagagag

SEQ ID NO: 2621967 - RNA, 18 nt, Human
gggugauauggacagcag

SEQ ID NO: 2621968 - RNA, 14 nt, Human
gggugaggagcugg

SEQ ID NO: 2621969 - RNA, 15 nt, Human
gggugaggagcuggg

SEQ ID NO: 2621970 - RNA, 17 nt, Human
gggugagggucccaugu

SEQ ID NO: 2621971 - RNA, 19 nt, Human
gggugaguccauucuccca

SEQ ID NO: 2621972 - RNA, 18 nt, Human
gggugaggaccacuccug

SEQ ID NO: 2621973 - RNA, 17 nt, Human
gggugagaacaaccaaa

SEQ ID NO: 2621974 - RNA, 18 nt, Human
gggugagaugcuggagaa

SEQ ID NO: 2621975 - RNA, 15 nt, Human
gggugagaugcugga

SEQ ID NO: 2621976 - RNA, 20 nt, Human
gggugagaugcuggagaaga

SEQ ID NO: 2621977 - RNA, 15 nt, Human
gggugaggaccacuc

SEQ ID NO: 2621978 - RNA, 22 nt, Human
gggugcgaccccaucugcccag

SEQ ID NO: 2621979 - RNA, 21 nt, Human
gggugcgaccccaucugccca

SEQ ID NO: 2621980 - RNA, 19 nt, Human
gggugcgaccccaucugcc

SEQ ID NO: 2621981 - RNA, 16 nt, Human
gggugcucccuaccac

SEQ ID NO: 2621982 - RNA, 21 nt, Human
gggugcugcuucccucugccu

SEQ ID NO: 2621983 - RNA, 23 nt, Human
gggugcugcuucccucugccugu

SEQ ID NO: 2621984 - RNA, 15 nt, Human
gggugcugggaggag

SEQ ID NO: 2621985 - RNA, 19 nt, Human
gggugcuggcugcccagac

SEQ ID NO: 2621986 - RNA, 23 nt, Human
gggugcaguaucaugcccugugc

SEQ ID NO: 2621987 - RNA, 12 nt, Human
gggugcccccuc

SEQ ID NO: 2621988 - RNA, 18 nt, Human
gggugcccaagcucagaa

SEQ ID NO: 2621989 - RNA, 21 nt, Human
gggugccccccuugccagaca

SEQ ID NO: 2621990 - RNA, 14 nt, Human
gggugccgccugcc

SEQ ID NO: 2621991 - RNA, 15 nt, Human
gggugcccccuccuc

SEQ ID NO: 2621992 - RNA, 12 nt, Human
gggugccgccug

SEQ ID NO: 2621993 - RNA, 20 nt, Human
gggucuugguuccagccugc

SEQ ID NO: 2621994 - RNA, 23 nt, Human
gggucuucccuaccucaggcagg

SEQ ID NO: 2621995 - RNA, 21 nt, Human
gggucuuuucaucugggaaag

SEQ ID NO: 2621996 - RNA, 20 nt, Human
gggugaacaaagcagccacg

SEQ ID NO: 2621997 - RNA, 19 nt, Human
gggugaagagaaccgagca

SEQ ID NO: 2621998 - RNA, 20 nt, Human
gggucuguaaaaucuuucuu

SEQ ID NO: 2621999 - RNA, 17 nt, Human
gggucuguaaaaucuuu

SEQ ID NO: 2622000 - RNA, 16 nt, Human
gggucuguaaaaucuu

SEQ ID NO: 2622001 - RNA, 15 nt, Human
gggucuguaaaaucu

SEQ ID NO: 2622002 - RNA, 15 nt, Human
gggucugugucucuu

SEQ ID NO: 2622003 - RNA, 21 nt, Human
gggucuguaaaaucuuucuuu

SEQ ID NO: 2622004 - RNA, 20 nt, Human
gggucuucagggggccaggu

SEQ ID NO: 2622005 - RNA, 19 nt, Human
gggugacagagcaagugag

SEQ ID NO: 2622006 - RNA, 21 nt, Human
gggugacaagauagagagcua

SEQ ID NO: 2622007 - RNA, 13 nt, Human
gggugacaagaua

SEQ ID NO: 2622008 - RNA, 23 nt, Human
gggugaauaauaaaaguauauau

SEQ ID NO: 2622009 - RNA, 13 nt, Human
gggugaagggaga

SEQ ID NO: 2622010 - RNA, 14 nt, Human
gggugaagggagag

SEQ ID NO: 2622011 - RNA, 17 nt, Human
gggugaagugaagacaa

SEQ ID NO: 2622012 - RNA, 16 nt, Human
ggguuaagaagacuuu

SEQ ID NO: 2622013 - RNA, 18 nt, Human
gggugcugggaggaggga

SEQ ID NO: 2622014 - RNA, 22 nt, Human
ggguuaagaaaagagauauuuu

SEQ ID NO: 2622015 - RNA, 22 nt, Human
ggguucaagcgauucuucugcu

SEQ ID NO: 2622016 - RNA, 17 nt, Human
gggugcugggccccugc

SEQ ID NO: 2622017 - RNA, 14 nt, Human
ggguguguguuugu

SEQ ID NO: 2622018 - RNA, 22 nt, Human
ggguguguguuugugugagaga

SEQ ID NO: 2622019 - RNA, 16 nt, Human
gggugugggaggcccg

SEQ ID NO: 2622020 - RNA, 19 nt, Human
ggguucagaaaugcugccu

SEQ ID NO: 2622021 - RNA, 16 nt, Human
ggguucaaaaugucug

SEQ ID NO: 2622022 - RNA, 21 nt, Human
ggguucagaaaugcugccugc

SEQ ID NO: 2622023 - RNA, 20 nt, Human
ggguucagaaaugcugccug

SEQ ID NO: 2622024 - RNA, 19 nt, Human
ggguucagagacucagggc

SEQ ID NO: 2622025 - RNA, 13 nt, Human
ggguucagccccu

SEQ ID NO: 2622026 - RNA, 16 nt, Human
ggguucagccccuccu

SEQ ID NO: 2622027 - RNA, 17 nt, Human
ggguucagccccuccuc

SEQ ID NO: 2622028 - RNA, 19 nt, Human
ggguucagccccuccucug

SEQ ID NO: 2622029 - RNA, 20 nt, Human
ggguucagccccuccucugc

SEQ ID NO: 2622030 - RNA, 21 nt, Human
ggguucagccccuccucugcc

SEQ ID NO: 2622031 - RNA, 13 nt, Human
ggguucaggggac

SEQ ID NO: 2622032 - RNA, 23 nt, Human
ggguucaagcgauucuucugcuu

SEQ ID NO: 2622033 - RNA, 14 nt, Human
ggguuaugaauauu

SEQ ID NO: 2622034 - RNA, 13 nt, Human
ggguuaucucugu

SEQ ID NO: 2622035 - RNA, 20 nt, Human
ggguucaccugggcugaggc

SEQ ID NO: 2622036 - RNA, 12 nt, Human
ggguucuaccca

SEQ ID NO: 2622037 - RNA, 20 nt, Human
ggguuccuuccucugagccu

SEQ ID NO: 2622038 - RNA, 21 nt, Human
ggguuccuuccucugagccuu

SEQ ID NO: 2622039 - RNA, 14 nt, Human
ggguuccucuuccc

SEQ ID NO: 2622040 - RNA, 11 nt, Human
ggguuccugca

SEQ ID NO: 2622041 - RNA, 19 nt, Human
ggguuccuuccucugagcc

SEQ ID NO: 2622042 - RNA, 21 nt, Human
ggguucauaggucacuggcuc

SEQ ID NO: 2622043 - RNA, 20 nt, Human
ggguucauaggucacuggcu

SEQ ID NO: 2622044 - RNA, 19 nt, Human
ggguucauaggucacuggc

SEQ ID NO: 2622045 - RNA, 22 nt, Human
ggguucagccccuccucugcca

SEQ ID NO: 2622046 - RNA, 22 nt, Human
ggguucauaggucacuggcucu

SEQ ID NO: 2622047 - RNA, 13 nt, Human
ggguucauuauug

SEQ ID NO: 2622048 - RNA, 17 nt, Human
ggguucauuauuggaau

SEQ ID NO: 2622049 - RNA, 16 nt, Human
ggguucuuucuuccuc

SEQ ID NO: 2622050 - RNA, 17 nt, Human
ggguucuuucuuccucu

SEQ ID NO: 2622051 - RNA, 19 nt, Human
ggguucuuuggaaggagug

SEQ ID NO: 2622052 - RNA, 16 nt, Human
ggguucuuuggaagga

SEQ ID NO: 2622053 - RNA, 18 nt, Human
ggguucguggaaagggug

SEQ ID NO: 2622054 - RNA, 19 nt, Human
ggguucuuucuuccucugc

SEQ ID NO: 2622055 - RNA, 12 nt, Human
ggguugagggga

SEQ ID NO: 2622056 - RNA, 23 nt, Human
ggguugaaaauucaaaaaguguu

SEQ ID NO: 2622057 - RNA, 12 nt, Human
ggguugaaaauu

SEQ ID NO: 2622058 - RNA, 19 nt, Human
ggguugccacaggccuccc

SEQ ID NO: 2622059 - RNA, 21 nt, Human
ggguugagcagggauccuggu

SEQ ID NO: 2622060 - RNA, 18 nt, Human
ggguugccacaggccucc

SEQ ID NO: 2622061 - RNA, 20 nt, Human
ggguugccacaggccucccu

SEQ ID NO: 2622062 - RNA, 21 nt, Human
ggguuggagcaguagcuggag

SEQ ID NO: 2622063 - RNA, 17 nt, Human
ggguaagugagagaggg

SEQ ID NO: 2622064 - RNA, 14 nt, Human
gggucucacucugu

SEQ ID NO: 2622065 - RNA, 21 nt, Human
ggguaauaaacuuagaauaaa

SEQ ID NO: 2622066 - RNA, 18 nt, Human
gggucuccaggaggagac

SEQ ID NO: 2622067 - RNA, 19 nt, Human
gggucuccaggaggagacu

SEQ ID NO: 2622068 - RNA, 15 nt, Human
gggucucccuggagu

SEQ ID NO: 2622069 - RNA, 15 nt, Human
gggucucccucuccu

SEQ ID NO: 2622070 - RNA, 16 nt, Human
gggucucccucuccug

SEQ ID NO: 2622071 - RNA, 18 nt, Human
gggucucccucuccugcc

SEQ ID NO: 2622072 - RNA, 19 nt, Human
gggucucccucuccugccu

SEQ ID NO: 2622073 - RNA, 23 nt, Human
gggguuuucgaagcucagcccac

SEQ ID NO: 2622074 - RNA, 22 nt, Human
ggguaaaauuccuuagcuuaga

SEQ ID NO: 2622075 - RNA, 13 nt, Human
ggguaaacugugg

SEQ ID NO: 2622076 - RNA, 13 nt, Human
ggguaaggugccu

SEQ ID NO: 2622077 - RNA, 14 nt, Human
ggguaaggugccuu

SEQ ID NO: 2622078 - RNA, 19 nt, Human
gggguguggcuccuuccca

SEQ ID NO: 2622079 - RNA, 16 nt, Human
gggguggggucaugcc

SEQ ID NO: 2622080 - RNA, 21 nt, Human
gggguguguuccaacugcccc

SEQ ID NO: 2622081 - RNA, 15 nt, Human
gggguuguguuguca

SEQ ID NO: 2622082 - RNA, 17 nt, Human
gggguugugaggccugg

SEQ ID NO: 2622083 - RNA, 22 nt, Human
gggguugggauugggggcuggu

SEQ ID NO: 2622084 - RNA, 21 nt, Human
gggguugggauugggggcugg

SEQ ID NO: 2622085 - RNA, 15 nt, Human
gggguuaucucugug

SEQ ID NO: 2622086 - RNA, 13 nt, Human
gggguuggcuggg

SEQ ID NO: 2622087 - RNA, 21 nt, Human
gggucuggucuccucagccuc

SEQ ID NO: 2622088 - RNA, 14 nt, Human
gggucuguaaaauc

SEQ ID NO: 2622089 - RNA, 13 nt, Human
gggucuguaaaau

SEQ ID NO: 2622090 - RNA, 15 nt, Human
gggucuggcugagcu

SEQ ID NO: 2622091 - RNA, 22 nt, Human
gggucuggaguugaucuggaac

SEQ ID NO: 2622092 - RNA, 22 nt, Human
gggucuggcagccucccaucca

SEQ ID NO: 2622093 - RNA, 19 nt, Human
gggucugcucuuucucugc

SEQ ID NO: 2622094 - RNA, 20 nt, Human
gggucugccaccauccugcu

SEQ ID NO: 2622095 - RNA, 21 nt, Human
gggucugagucauggccgggu

SEQ ID NO: 2622096 - RNA, 21 nt, Human
gggucugcucuuucucugcca

SEQ ID NO: 2622097 - RNA, 20 nt, Human
gggucugcucuuucucugcc

SEQ ID NO: 2622098 - RNA, 22 nt, Human
gggucugcucuuucucugccag

SEQ ID NO: 2622099 - RNA, 20 nt, Human
gggucuggaguugaucugga

SEQ ID NO: 2622100 - RNA, 18 nt, Human
gggucucugcugccgccc

SEQ ID NO: 2622101 - RNA, 15 nt, Human
gggucucugcugccg

SEQ ID NO: 2622102 - RNA, 14 nt, Human
gggucucugcugcc

SEQ ID NO: 2622103 - RNA, 13 nt, Human
gggucucugcugc

SEQ ID NO: 2622104 - RNA, 12 nt, Human
gggucucugcug

SEQ ID NO: 2622105 - RNA, 20 nt, Human
gggucucuagugcugugaaa

SEQ ID NO: 2622106 - RNA, 15 nt, Human
gggucucuagugcug

SEQ ID NO: 2622107 - RNA, 20 nt, Human
gggucucccucuccugccua

SEQ ID NO: 2622108 - RNA, 21 nt, Human
gggucugaggaauccagaccc

SEQ ID NO: 2622109 - RNA, 12 nt, Human
gggucugaggaa

SEQ ID NO: 2622110 - RNA, 12 nt, Human
gggguggccucc

SEQ ID NO: 2622111 - RNA, 18 nt, Human
ggggugcugggccccugc

SEQ ID NO: 2622112 - RNA, 23 nt, Human
gggggacagggcuggcccagccc

SEQ ID NO: 2622113 - RNA, 22 nt, Human
gggggagccccuucugcucagc

SEQ ID NO: 2622114 - RNA, 12 nt, Human
gggggauaugaa

SEQ ID NO: 2622115 - RNA, 13 nt, Human
gggggaguggaau

SEQ ID NO: 2622116 - RNA, 17 nt, Human
gggggagucugaagcag

SEQ ID NO: 2622117 - RNA, 22 nt, Human
gggggagucugaagcagaugca

SEQ ID NO: 2622118 - RNA, 18 nt, Human
gggguggggguggaggcu

SEQ ID NO: 2622119 - RNA, 15 nt, Human
gggguggguauaaaa

SEQ ID NO: 2622120 - RNA, 15 nt, Human
ggggugggccucugg

SEQ ID NO: 2622121 - RNA, 14 nt, Human
ggggugggccucug

SEQ ID NO: 2622122 - RNA, 14 nt, Human
ggggugggccaggc

SEQ ID NO: 2622123 - RNA, 17 nt, Human
ggggugggccaggcuga

SEQ ID NO: 2622124 - RNA, 20 nt, Human
gggguggggggggugcuggg

SEQ ID NO: 2622125 - RNA, 17 nt, Human
gggguggggaccucagg

SEQ ID NO: 2622126 - RNA, 17 nt, Human
gggguggaggcuuccug

SEQ ID NO: 2622127 - RNA, 20 nt, Human
ggggugcuuuuauagaggcu

SEQ ID NO: 2622128 - RNA, 13 nt, Human
ggggugggccagg

SEQ ID NO: 2622129 - RNA, 15 nt, Human
ggggugggagagguc

SEQ ID NO: 2622130 - RNA, 16 nt, Human
gggggacuagccccug

SEQ ID NO: 2622131 - RNA, 21 nt, Human
gggggacuuacaugauucauu

SEQ ID NO: 2622132 - RNA, 22 nt, Human
gggggaggugggauccuccagg

SEQ ID NO: 2622133 - RNA, 23 nt, Human
ggggcugcaccggcuggccuggc

SEQ ID NO: 2622134 - RNA, 22 nt, Human
gggggacagggcuggcccagcc

SEQ ID NO: 2622135 - RNA, 18 nt, Human
gggggacagggcuggccc

SEQ ID NO: 2622136 - RNA, 23 nt, Human
ggggcugaccuuccucgcagaga

SEQ ID NO: 2622137 - RNA, 20 nt, Human
ggggcugaccuuccucgcag

SEQ ID NO: 2622138 - RNA, 18 nt, Human
ggggcucuggagagaaac

SEQ ID NO: 2622139 - RNA, 18 nt, Human
ggggcugaacggggagaa

SEQ ID NO: 2622140 - RNA, 22 nt, Human
ggggcugcaccggcuggccugg

SEQ ID NO: 2622141 - RNA, 21 nt, Human
ggggcugcaccggcuggccug

SEQ ID NO: 2622142 - RNA, 12 nt, Human
ggggcugcaccg

SEQ ID NO: 2622143 - RNA, 19 nt, Human
ggggcugaggugggaggau

SEQ ID NO: 2622144 - RNA, 17 nt, Human
ggggcugaggugggagg

SEQ ID NO: 2622145 - RNA, 17 nt, Human
ggggcucuggagagaaa

SEQ ID NO: 2622146 - RNA, 16 nt, Human
ggggcucuggagagaa

SEQ ID NO: 2622147 - RNA, 14 nt, Human
ggggcucuggagag

SEQ ID NO: 2622148 - RNA, 24 nt, Human
ggggcucucauguuuucaacugcc

SEQ ID NO: 2622149 - RNA, 14 nt, Human
ggggcucuucucau

SEQ ID NO: 2622150 - RNA, 12 nt, Human
ggggcucuggga

SEQ ID NO: 2622151 - RNA, 15 nt, Human
ggggcucgccaugcc

SEQ ID NO: 2622152 - RNA, 22 nt, Human
ggggcuccuuucuccagccagc

SEQ ID NO: 2622153 - RNA, 21 nt, Human
ggggcuccuuucuccagccag

SEQ ID NO: 2622154 - RNA, 21 nt, Human
ggggcuccuggaaaggcucag

SEQ ID NO: 2622155 - RNA, 20 nt, Human
ggggcucucagcucagcgcc

SEQ ID NO: 2622156 - RNA, 16 nt, Human
ggggcucucagcucag

SEQ ID NO: 2622157 - RNA, 13 nt, Human
ggggcucuggaga

SEQ ID NO: 2622158 - RNA, 15 nt, Human
ggggcuacaagaggg

SEQ ID NO: 2622159 - RNA, 14 nt, Human
ggggcuacaagagg

SEQ ID NO: 2622160 - RNA, 20 nt, Human
ggggcgucuguucccccuuc

SEQ ID NO: 2622161 - RNA, 15 nt, Human
ggggcguggggaggg

SEQ ID NO: 2622162 - RNA, 18 nt, Human
ggggcgucuguucccccu

SEQ ID NO: 2622163 - RNA, 17 nt, Human
ggggcuacaagagggaa

SEQ ID NO: 2622164 - RNA, 16 nt, Human
ggggcuacaagaggga

SEQ ID NO: 2622165 - RNA, 14 nt, Human
ggggcuagaaccua

SEQ ID NO: 2622166 - RNA, 21 nt, Human
ggggcuagaaccuagagaagc

SEQ ID NO: 2622167 - RNA, 13 nt, Human
ggggcucccgccc

SEQ ID NO: 2622168 - RNA, 11 nt, Human
ggggcuccugg

SEQ ID NO: 2622169 - RNA, 12 nt, Human
ggggcuccugga

SEQ ID NO: 2622170 - RNA, 13 nt, Human
ggggcuccuggaa

SEQ ID NO: 2622171 - RNA, 16 nt, Human
ggggcaacccugguga

SEQ ID NO: 2622172 - RNA, 17 nt, Human
ggggcacugcaggggcc

SEQ ID NO: 2622173 - RNA, 21 nt, Human
ggggcacaugcugagucuccc

SEQ ID NO: 2622174 - RNA, 22 nt, Human
ggggcaagaagaucacgcuccc

SEQ ID NO: 2622175 - RNA, 13 nt, Human
ggggcagaacagc

SEQ ID NO: 2622176 - RNA, 17 nt, Human
ggggcagucuggagggg

SEQ ID NO: 2622177 - RNA, 23 nt, Human
ggggcgcuggcccagccggccuc

SEQ ID NO: 2622178 - RNA, 18 nt, Human
ggggcgcuggcccagccg

SEQ ID NO: 2622179 - RNA, 17 nt, Human
ggggcgcuggcccagcc

SEQ ID NO: 2622180 - RNA, 15 nt, Human
ggggcgcuggcccag

SEQ ID NO: 2622181 - RNA, 14 nt, Human
ggggcgcuggccca

SEQ ID NO: 2622182 - RNA, 13 nt, Human
ggggcgcuggccc

SEQ ID NO: 2622183 - RNA, 21 nt, Human
ggggcgcucgcuuccgcaucc

SEQ ID NO: 2622184 - RNA, 13 nt, Human
ggggcaguggcaa

SEQ ID NO: 2622185 - RNA, 14 nt, Human
ggggcaucugcccc

SEQ ID NO: 2622186 - RNA, 20 nt, Human
ggggcaucugccccuccccc

SEQ ID NO: 2622187 - RNA, 11 nt, Human
gggccugggcc

SEQ ID NO: 2622188 - RNA, 22 nt, Human
gggcuuggggaccagagcugcc

SEQ ID NO: 2622189 - RNA, 23 nt, Human
gggcuuguugcuguugauguuuu

SEQ ID NO: 2622190 - RNA, 14 nt, Human
gggcuuucuggaga

SEQ ID NO: 2622191 - RNA, 15 nt, Human
gggcuuucuggagag

SEQ ID NO: 2622192 - RNA, 16 nt, Human
ggggaaaaucagccug

SEQ ID NO: 2622193 - RNA, 17 nt, Human
ggggaaaaucagccugc

SEQ ID NO: 2622194 - RNA, 19 nt, Human
ggggaaaaucagccugcuc

SEQ ID NO: 2622195 - RNA, 14 nt, Human
ggggagggauucug

SEQ ID NO: 2622196 - RNA, 22 nt, Human
ggggaggcggacguuccagccg

SEQ ID NO: 2622197 - RNA, 19 nt, Human
ggggaggaucacuggagcc

SEQ ID NO: 2622198 - RNA, 14 nt, Human
ggggaggcagccgg

SEQ ID NO: 2622199 - RNA, 13 nt, Human
ggggaggccaagu

SEQ ID NO: 2622200 - RNA, 21 nt, Human
ggggaggccaagugcaggcug

SEQ ID NO: 2622201 - RNA, 15 nt, Human
ggggaaaagagauga

SEQ ID NO: 2622202 - RNA, 12 nt, Human
ggggaggagggc

SEQ ID NO: 2622203 - RNA, 21 nt, Human
ggggaaaaucagccugcucca

SEQ ID NO: 2622204 - RNA, 21 nt, Human
ggggagggccguaccccaccc

SEQ ID NO: 2622205 - RNA, 15 nt, Human
ggggagggauucugg

SEQ ID NO: 2622206 - RNA, 20 nt, Human
ggggaggggcgcuggcccag

SEQ ID NO: 2622207 - RNA, 16 nt, Human
ggggaggggcgcuggc

SEQ ID NO: 2622208 - RNA, 13 nt, Human
ggggaggggcgcu

SEQ ID NO: 2622209 - RNA, 15 nt, Human
ggggagggggauccg

SEQ ID NO: 2622210 - RNA, 22 nt, Human
ggggagggguugccacaggccu

SEQ ID NO: 2622211 - RNA, 18 nt, Human
ggggaggggcugugggcg

SEQ ID NO: 2622212 - RNA, 21 nt, Human
ggggauuuccagccagggcug

SEQ ID NO: 2622213 - RNA, 14 nt, Human
ggggauuucuccca

SEQ ID NO: 2622214 - RNA, 15 nt, Human
ggggauuucucccag

SEQ ID NO: 2622215 - RNA, 20 nt, Human
ggggauucuuccaucugauu

SEQ ID NO: 2622216 - RNA, 13 nt, Human
gggccuggcuccc

SEQ ID NO: 2622217 - RNA, 17 nt, Human
gggccuggcucaggugg

SEQ ID NO: 2622218 - RNA, 18 nt, Human
gggccuggccugagcugg

SEQ ID NO: 2622219 - RNA, 14 nt, Human
gggccuggccugag

SEQ ID NO: 2622220 - RNA, 14 nt, Human
gggcccugggcugg

SEQ ID NO: 2622221 - RNA, 23 nt, Human
gggccccugggcuuggccugcug

SEQ ID NO: 2622222 - RNA, 21 nt, Human
gggccccugggcuuggccugc

SEQ ID NO: 2622223 - RNA, 14 nt, Human
gggccccugggcuu

SEQ ID NO: 2622224 - RNA, 19 nt, Human
gggccccugcuucuccagc

SEQ ID NO: 2622225 - RNA, 21 nt, Human
gggccccugcuucuccagccu

SEQ ID NO: 2622226 - RNA, 23 nt, Human
gggccccucugcccagcuugggc

SEQ ID NO: 2622227 - RNA, 22 nt, Human
gggccccucugcccagcuuggg

SEQ ID NO: 2622228 - RNA, 22 nt, Human
gggccccugccucucugcaggu

SEQ ID NO: 2622229 - RNA, 12 nt, Human
gggcccugagcu

SEQ ID NO: 2622230 - RNA, 18 nt, Human
gggccccuuuuuacuccc

SEQ ID NO: 2622231 - RNA, 16 nt, Human
gggcccgccuggcaga

SEQ ID NO: 2622232 - RNA, 20 nt, Human
gggcccgccuggcagaacug

SEQ ID NO: 2622233 - RNA, 13 nt, Human
gggcccugagcuc

SEQ ID NO: 2622234 - RNA, 22 nt, Human
gggcccugagcucgguggaccc

SEQ ID NO: 2622235 - RNA, 19 nt, Human
gggcccugcaccugugcag

SEQ ID NO: 2622236 - RNA, 18 nt, Human
gggcccugcaccugugca

SEQ ID NO: 2622237 - RNA, 18 nt, Human
gggcccugagcugagggc

SEQ ID NO: 2622238 - RNA, 23 nt, Human
gggcccgccuggcagaacugagc

SEQ ID NO: 2622239 - RNA, 13 nt, Human
gggcccugccucc

SEQ ID NO: 2622240 - RNA, 15 nt, Human
gggcccugcagaggg

SEQ ID NO: 2622241 - RNA, 13 nt, Human
gggccuggccuga

SEQ ID NO: 2622242 - RNA, 15 nt, Human
gggcccugggcugga

SEQ ID NO: 2622243 - RNA, 12 nt, Human
gggccuggccug

SEQ ID NO: 2622244 - RNA, 13 nt, Human
gggcccugggcug

SEQ ID NO: 2622245 - RNA, 14 nt, Human
gggccccagaggcu

SEQ ID NO: 2622246 - RNA, 18 nt, Human
gggccccagaaggcaggg

SEQ ID NO: 2622247 - RNA, 15 nt, Human
gggccccaccaccua

SEQ ID NO: 2622248 - RNA, 22 nt, Human
gggcccagggacaccagccagg

SEQ ID NO: 2622249 - RNA, 18 nt, Human
gggcccagggacaccagc

SEQ ID NO: 2622250 - RNA, 11 nt, Human
gggcccaggga

SEQ ID NO: 2622251 - RNA, 20 nt, Human
gggcccaggccaucuuccag

SEQ ID NO: 2622252 - RNA, 22 nt, Human
gggccccaaacgggcugcccug

SEQ ID NO: 2622253 - RNA, 14 nt, Human
gggcccaggaccag

SEQ ID NO: 2622254 - RNA, 9 nt, Human
gggcccagg

SEQ ID NO: 2622255 - RNA, 21 nt, Human
gggcccagcugggcucugcca

SEQ ID NO: 2622256 - RNA, 16 nt, Human
gggcccagcugggcuc

SEQ ID NO: 2622257 - RNA, 15 nt, Human
gggcccagcugggcu

SEQ ID NO: 2622258 - RNA, 12 nt, Human
gggcccagcugg

SEQ ID NO: 2622259 - RNA, 22 nt, Human
gggcccagcccccacagugcug

SEQ ID NO: 2622260 - RNA, 18 nt, Human
gggcccagcccccacagu

SEQ ID NO: 2622261 - RNA, 19 nt, Human
gggcccaggaccagcuggg

SEQ ID NO: 2622262 - RNA, 18 nt, Human
gggcccaggaccagcugg

SEQ ID NO: 2622263 - RNA, 17 nt, Human
gggcccaggaccagcug

SEQ ID NO: 2622264 - RNA, 16 nt, Human
gggcccaggaccagcu

SEQ ID NO: 2622265 - RNA, 14 nt, Human
gggcccaggcaaau

SEQ ID NO: 2622266 - RNA, 24 nt, Human
gggcccaggaccagcuggggcgug

SEQ ID NO: 2622267 - RNA, 13 nt, Human
gggcccaggcagg

SEQ ID NO: 2622268 - RNA, 14 nt, Human
gggccccagucagc

SEQ ID NO: 2622269 - RNA, 17 nt, Human
gggccccagcccacccu

SEQ ID NO: 2622270 - RNA, 18 nt, Human
gggccccagcccacccuc

SEQ ID NO: 2622271 - RNA, 16 nt, Human
gggccccagcccaccc

SEQ ID NO: 2622272 - RNA, 14 nt, Human
gggccccagcccac

SEQ ID NO: 2622273 - RNA, 13 nt, Human
gggccccagccca

SEQ ID NO: 2622274 - RNA, 12 nt, Human
gggccccagccc

SEQ ID NO: 2622275 - RNA, 14 nt, Human
gggcccccaucuca

SEQ ID NO: 2622276 - RNA, 18 nt, Human
gggccccagucagccucu

SEQ ID NO: 2622277 - RNA, 17 nt, Human
gggccccagucagccuc

SEQ ID NO: 2622278 - RNA, 23 nt, Human
gggcccccagcgagagucccugc

SEQ ID NO: 2622279 - RNA, 19 nt, Human
gggccccccuccuugcucu

SEQ ID NO: 2622280 - RNA, 17 nt, Human
gggccccccuccuugcu

SEQ ID NO: 2622281 - RNA, 15 nt, Human
gggccccccuccuug

SEQ ID NO: 2622282 - RNA, 19 nt, Human
gggccccagucagccucuc

SEQ ID NO: 2622283 - RNA, 21 nt, Human
gggccccccuccuugcucugc

SEQ ID NO: 2622284 - RNA, 19 nt, Human
gggccccucacccugccuu

SEQ ID NO: 2622285 - RNA, 17 nt, Human
gggccccucacccugcc

SEQ ID NO: 2622286 - RNA, 15 nt, Human
gggccccuccagcuu

SEQ ID NO: 2622287 - RNA, 14 nt, Human
gggccccuccagcu

SEQ ID NO: 2622288 - RNA, 21 nt, Human
gggccccucaucgcguccucc

SEQ ID NO: 2622289 - RNA, 13 nt, Human
gggccccuccagc

SEQ ID NO: 2622290 - RNA, 21 nt, Human
gggccccugccucucugcagg

SEQ ID NO: 2622291 - RNA, 19 nt, Human
gggccccugccucucugca

SEQ ID NO: 2622292 - RNA, 18 nt, Human
gggccccugccucucugc

SEQ ID NO: 2622293 - RNA, 17 nt, Human
gggccccugccucucug

SEQ ID NO: 2622294 - RNA, 15 nt, Human
gggccccugccucuc

SEQ ID NO: 2622295 - RNA, 13 nt, Human
gggccccugccuc

SEQ ID NO: 2622296 - RNA, 17 nt, Human
gggccccucugcccagc

SEQ ID NO: 2622297 - RNA, 16 nt, Human
gggccccucugcccag

SEQ ID NO: 2622298 - RNA, 15 nt, Human
gggccccucugccca

SEQ ID NO: 2622299 - RNA, 13 nt, Human
gggccccugccag

SEQ ID NO: 2622300 - RNA, 12 nt, Human
gggccccucugc

SEQ ID NO: 2622301 - RNA, 21 nt, Human
gggcauguauuggccuggagg

SEQ ID NO: 2622302 - RNA, 20 nt, Human
gggcauguauuggccuggag

SEQ ID NO: 2622303 - RNA, 19 nt, Human
gggcauguauuggccugga

SEQ ID NO: 2622304 - RNA, 22 nt, Human
gggcauguauuggccuggaggu

SEQ ID NO: 2622305 - RNA, 21 nt, Human
gggcauggggugggccucugg

SEQ ID NO: 2622306 - RNA, 18 nt, Human
gggcauguauuggccugg

SEQ ID NO: 2622307 - RNA, 20 nt, Human
gggcauggggugggccucug

SEQ ID NO: 2622308 - RNA, 17 nt, Human
gggcauggggugggccu

SEQ ID NO: 2622309 - RNA, 15 nt, Human
gggcauggggugggc

SEQ ID NO: 2622310 - RNA, 16 nt, Human
gggcauggccagcagc

SEQ ID NO: 2622311 - RNA, 20 nt, Human
gggcauggccagguggccac

SEQ ID NO: 2622312 - RNA, 17 nt, Human
gggcauggccagguggc

SEQ ID NO: 2622313 - RNA, 15 nt, Human
gggcauggccaggug

SEQ ID NO: 2622314 - RNA, 20 nt, Human
gggcauggacguucggggca

SEQ ID NO: 2622315 - RNA, 22 nt, Human
gggcauggacguucggggcaug

SEQ ID NO: 2622316 - RNA, 12 nt, Human
gggcaugacacg

SEQ ID NO: 2622317 - RNA, 14 nt, Human
gggcaucugccccu

SEQ ID NO: 2622318 - RNA, 17 nt, Human
gggcaucugccccuccc

SEQ ID NO: 2622319 - RNA, 19 nt, Human
gggcaucugccccuccccc

SEQ ID NO: 2622320 - RNA, 16 nt, Human
gggcaugccccggcca

SEQ ID NO: 2622321 - RNA, 20 nt, Human
gggcaucugccccuccccca

SEQ ID NO: 2622322 - RNA, 23 nt, Human
gggcaugccccggccaccucugc

SEQ ID NO: 2622323 - RNA, 22 nt, Human
gggcaugccccggccaccucug

SEQ ID NO: 2622324 - RNA, 20 nt, Human
gggcaugccccggccaccuc

SEQ ID NO: 2622325 - RNA, 14 nt, Human
gggcaugcuggggc

SEQ ID NO: 2622326 - RNA, 17 nt, Human
gggcaugcuggggcaag

SEQ ID NO: 2622327 - RNA, 17 nt, Human
gggcauauccaccaccu

SEQ ID NO: 2622328 - RNA, 22 nt, Human
gggcauagaugcaggugagccc

SEQ ID NO: 2622329 - RNA, 15 nt, Human
gggcauacuaauaaa

SEQ ID NO: 2622330 - RNA, 14 nt, Human
gggcaucuccagga

SEQ ID NO: 2622331 - RNA, 13 nt, Human
gggcauccucagg

SEQ ID NO: 2622332 - RNA, 13 nt, Human
gggcaucaugcau

SEQ ID NO: 2622333 - RNA, 22 nt, Human
gggcagugguaagcucuggcuu

SEQ ID NO: 2622334 - RNA, 21 nt, Human
gggcagugguaagcucuggcu

SEQ ID NO: 2622335 - RNA, 20 nt, Human
gggcagugguguggagaagc

SEQ ID NO: 2622336 - RNA, 18 nt, Human
gggcagugggucccagau

SEQ ID NO: 2622337 - RNA, 15 nt, Human
gggcagucuggaggg

SEQ ID NO: 2622338 - RNA, 17 nt, Human
gggcagucauuauccag

SEQ ID NO: 2622339 - RNA, 14 nt, Human
gggcagucuggagg

SEQ ID NO: 2622340 - RNA, 17 nt, Human
gggcagucuggaggggc

SEQ ID NO: 2622341 - RNA, 14 nt, Human
gggcccaccuggcc

SEQ ID NO: 2622342 - RNA, 13 nt, Human
gggcccaccuggc

SEQ ID NO: 2622343 - RNA, 10 nt, Human
gggcccaccu

SEQ ID NO: 2622344 - RNA, 12 nt, Human
gggcccacaccc

SEQ ID NO: 2622345 - RNA, 20 nt, Human
gggcccaagucccuguuuuc

SEQ ID NO: 2622346 - RNA, 17 nt, Human
gggcccagagagggugg

SEQ ID NO: 2622347 - RNA, 18 nt, Human
gggccacgugccaggccc

SEQ ID NO: 2622348 - RNA, 19 nt, Human
gggccacgugccaggcccg

SEQ ID NO: 2622349 - RNA, 15 nt, Human
gggccacucugccuc

SEQ ID NO: 2622350 - RNA, 16 nt, Human
gggccacucugccucu

SEQ ID NO: 2622351 - RNA, 19 nt, Human
gggcccaagacagaugccc

SEQ ID NO: 2622352 - RNA, 19 nt, Human
gggcccaaggcggccccuc

SEQ ID NO: 2622353 - RNA, 18 nt, Human
gggcccaaggcggccccu

SEQ ID NO: 2622354 - RNA, 23 nt, Human
gggcccaagacagaugccccaga

SEQ ID NO: 2622355 - RNA, 19 nt, Human
gggcccaccuggccaccug

SEQ ID NO: 2622356 - RNA, 18 nt, Human
gggcccaccuggccaccu

SEQ ID NO: 2622357 - RNA, 16 nt, Human
gggcccaccuggccac

SEQ ID NO: 2622358 - RNA, 15 nt, Human
gggcccaccuggcca

SEQ ID NO: 2622359 - RNA, 12 nt, Human
gggcccagagca

SEQ ID NO: 2622360 - RNA, 22 nt, Human
gggcccaccuggccaccugagg

SEQ ID NO: 2622361 - RNA, 11 nt, Human
gggcccagagc

SEQ ID NO: 2622362 - RNA, 12 nt, Human
gggcccagagcc

SEQ ID NO: 2622363 - RNA, 13 nt, Human
gggcccagagccc

SEQ ID NO: 2622364 - RNA, 15 nt, Human
gggcccagagcccag

SEQ ID NO: 2622365 - RNA, 16 nt, Human
gggcccagagcccagc

SEQ ID NO: 2622366 - RNA, 14 nt, Human
gggcccagagcagg

SEQ ID NO: 2622367 - RNA, 20 nt, Human
gggcccagagcccagcucca

SEQ ID NO: 2622368 - RNA, 17 nt, Human
gggcccagagcccagcu

SEQ ID NO: 2622369 - RNA, 19 nt, Human
gggcccagagcccagcucc

SEQ ID NO: 2622370 - RNA, 13 nt, Human
gggcccagccccc

SEQ ID NO: 2622371 - RNA, 12 nt, Human
gggcccagcccc

SEQ ID NO: 2622372 - RNA, 11 nt, Human
gggcccagccc

SEQ ID NO: 2622373 - RNA, 13 nt, Human
gggcccagaucug

SEQ ID NO: 2622374 - RNA, 14 nt, Human
gggcccagauucua

SEQ ID NO: 2622375 - RNA, 18 nt, Human
gggcauugauggggaagg

SEQ ID NO: 2622376 - RNA, 23 nt, Human
gggcauugauggggaaggaggcu

SEQ ID NO: 2622377 - RNA, 14 nt, Human
gggcauugcuuucc

SEQ ID NO: 2622378 - RNA, 13 nt, Human
gggccaagcccag

SEQ ID NO: 2622379 - RNA, 23 nt, Human
gggccaacuugagggcccagagc

SEQ ID NO: 2622380 - RNA, 13 nt, Human
gggccaagaaaga

SEQ ID NO: 2622381 - RNA, 11 nt, Human
gggccaacacc

SEQ ID NO: 2622382 - RNA, 15 nt, Human
gggccaacaccaggg

SEQ ID NO: 2622383 - RNA, 22 nt, Human
gggccaacuugagggcccagag

SEQ ID NO: 2622384 - RNA, 16 nt, Human
gggccaacaccaggga

SEQ ID NO: 2622385 - RNA, 16 nt, Human
gggccacagagaaagu

SEQ ID NO: 2622386 - RNA, 17 nt, Human
gggccaagacuuggcaa

SEQ ID NO: 2622387 - RNA, 13 nt, Human
gggccaaggacug

SEQ ID NO: 2622388 - RNA, 15 nt, Human
gggccacacagaaac

SEQ ID NO: 2622389 - RNA, 23 nt, Human
gggccacagagaaaguacuucuc

SEQ ID NO: 2622390 - RNA, 19 nt, Human
gggccacaugggaggcuca

SEQ ID NO: 2622391 - RNA, 19 nt, Human
gggccacagggcgagacuc

SEQ ID NO: 2622392 - RNA, 17 nt, Human
gggccaccuccccaggc

SEQ ID NO: 2622393 - RNA, 16 nt, Human
gggccaccuccccagg

SEQ ID NO: 2622394 - RNA, 15 nt, Human
gggccaccuccccag

SEQ ID NO: 2622395 - RNA, 14 nt, Human
gggccacgugccag

SEQ ID NO: 2622396 - RNA, 22 nt, Human
gggccaccuccccaggccgugg

SEQ ID NO: 2622397 - RNA, 19 nt, Human
gggccaccuccccaggccg

SEQ ID NO: 2622398 - RNA, 13 nt, Human
gggauagagagag

SEQ ID NO: 2622399 - RNA, 13 nt, Human
gggauagaugugu

SEQ ID NO: 2622400 - RNA, 13 nt, Human
gggauacugcagg

SEQ ID NO: 2622401 - RNA, 15 nt, Human
gggauacaugcucuu

SEQ ID NO: 2622402 - RNA, 13 nt, Human
gggauacaugcuc

SEQ ID NO: 2622403 - RNA, 23 nt, Human
gggaguucgagaccaaccugacc

SEQ ID NO: 2622404 - RNA, 21 nt, Human
gggauaugauuuaaaucagcc

SEQ ID NO: 2622405 - RNA, 14 nt, Human
gggauagaugugug

SEQ ID NO: 2622406 - RNA, 16 nt, Human
gggauagcacugagca

SEQ ID NO: 2622407 - RNA, 15 nt, Human
gggauauaggagagg

SEQ ID NO: 2622408 - RNA, 16 nt, Human
gggauccuccaggugc

SEQ ID NO: 2622409 - RNA, 15 nt, Human
gggauccuccaggug

SEQ ID NO: 2622410 - RNA, 16 nt, Human
gggauauaggagagga

SEQ ID NO: 2622411 - RNA, 12 nt, Human
gggauaugcuua

SEQ ID NO: 2622412 - RNA, 13 nt, Human
gggaucacaaggu

SEQ ID NO: 2622413 - RNA, 22 nt, Human
gggaucaaccagcuaagaaaag

SEQ ID NO: 2622414 - RNA, 22 nt, Human
gggaucacagagacauuccucc

SEQ ID NO: 2622415 - RNA, 13 nt, Human
gggaucacagaga

SEQ ID NO: 2622416 - RNA, 14 nt, Human
gggaucacagggcc

SEQ ID NO: 2622417 - RNA, 15 nt, Human
gggaucugccccucc

SEQ ID NO: 2622418 - RNA, 14 nt, Human
gggaucucaggggc

SEQ ID NO: 2622419 - RNA, 17 nt, Human
gggauccgacugcuuug

SEQ ID NO: 2622420 - RNA, 20 nt, Human
gggaucccucccccccaugc

SEQ ID NO: 2622421 - RNA, 23 nt, Human
gggauccuggaguucugguuccu

SEQ ID NO: 2622422 - RNA, 18 nt, Human
gggcaacccuggugacca

SEQ ID NO: 2622423 - RNA, 20 nt, Human
gggcaacccccagccugcua

SEQ ID NO: 2622424 - RNA, 24 nt, Human
gggcaagucccugacucucuguga

SEQ ID NO: 2622425 - RNA, 19 nt, Human
gggaucugguccuacccau

SEQ ID NO: 2622426 - RNA, 23 nt, Human
gggaucugguccuacccaucccc

SEQ ID NO: 2622427 - RNA, 18 nt, Human
gggaucuugcauucccag

SEQ ID NO: 2622428 - RNA, 17 nt, Human
gggaucugugcccagag

SEQ ID NO: 2622429 - RNA, 15 nt, Human
gggaugaaagagaag

SEQ ID NO: 2622430 - RNA, 11 nt, Human
gggaugaaaga

SEQ ID NO: 2622431 - RNA, 20 nt, Human
gggcaagaagaucacgcucc

SEQ ID NO: 2622432 - RNA, 13 nt, Human
gggcaagggccau

SEQ ID NO: 2622433 - RNA, 13 nt, Human
gggcaaggagacc

SEQ ID NO: 2622434 - RNA, 21 nt, Human
gggcaagaagaucacgcuccc

SEQ ID NO: 2622435 - RNA, 13 nt, Human
gggacugagaaau

SEQ ID NO: 2622436 - RNA, 19 nt, Human
gggacucugaagccucugg

SEQ ID NO: 2622437 - RNA, 20 nt, Human
gggacucugaagccucuggg

SEQ ID NO: 2622438 - RNA, 15 nt, Human
gggacuagccccugu

SEQ ID NO: 2622439 - RNA, 16 nt, Human
gggacucagcccugag

SEQ ID NO: 2622440 - RNA, 22 nt, Human
gggacucagccuucagacagag

SEQ ID NO: 2622441 - RNA, 17 nt, Human
gggacucagcccugagg

SEQ ID NO: 2622442 - RNA, 15 nt, Human
gggacuaugaauggg

SEQ ID NO: 2622443 - RNA, 17 nt, Human
gggaggugggauccucc

SEQ ID NO: 2622444 - RNA, 16 nt, Human
gggaggucgagguagg

SEQ ID NO: 2622445 - RNA, 16 nt, Human
gggaggugaccccagg

SEQ ID NO: 2622446 - RNA, 15 nt, Human
gggaggucgagguag

SEQ ID NO: 2622447 - RNA, 15 nt, Human
gggacugaagccaaa

SEQ ID NO: 2622448 - RNA, 18 nt, Human
gggacugaagccaaaguu

SEQ ID NO: 2622449 - RNA, 18 nt, Human
gggacugaaaaccucucc

SEQ ID NO: 2622450 - RNA, 19 nt, Human
gggacugaaaaccucuccu

SEQ ID NO: 2622451 - RNA, 14 nt, Human
gggagugagcuggu

SEQ ID NO: 2622452 - RNA, 11 nt, Human
gggagugagcu

SEQ ID NO: 2622453 - RNA, 18 nt, Human
gggagugacagaggcagc

SEQ ID NO: 2622454 - RNA, 23 nt, Human
gggagguggaagaagggagaaga

SEQ ID NO: 2622455 - RNA, 14 nt, Human
gggagguggcuggg

SEQ ID NO: 2622456 - RNA, 17 nt, Human
gggaguuaagaccuggc

SEQ ID NO: 2622457 - RNA, 20 nt, Human
gggaguuaagaccuggcagc

SEQ ID NO: 2622458 - RNA, 23 nt, Human
gggaguuaagaccuggcagcucu

SEQ ID NO: 2622459 - RNA, 20 nt, Human
gggaguucgagaccaaccug

SEQ ID NO: 2622460 - RNA, 21 nt, Human
gggaguuucuuuccugccuuc

SEQ ID NO: 2622461 - RNA, 22 nt, Human
gggaguugucaagucucugcug

SEQ ID NO: 2622462 - RNA, 11 nt, Human
gggagugugua

SEQ ID NO: 2622463 - RNA, 19 nt, Human
gggagugagacagaaguaa

SEQ ID NO: 2622464 - RNA, 21 nt, Human
gggagugggacagagucuggg

SEQ ID NO: 2622465 - RNA, 15 nt, Human
gggaguuaagaccug

SEQ ID NO: 2622466 - RNA, 16 nt, Human
gggaguuaagaccugg

SEQ ID NO: 2622467 - RNA, 21 nt, Human
gggcacagaaaauggaagaca

SEQ ID NO: 2622468 - RNA, 20 nt, Human
gggcacagaaaauggaagac

SEQ ID NO: 2622469 - RNA, 23 nt, Human
gggcacaccgggcacucagaaga

SEQ ID NO: 2622470 - RNA, 13 nt, Human
gggcacacacugu

SEQ ID NO: 2622471 - RNA, 12 nt, Human
gggcacacacug

SEQ ID NO: 2622472 - RNA, 15 nt, Human
gggcacacgccuccc

SEQ ID NO: 2622473 - RNA, 18 nt, Human
gggcacagaaaauggaag

SEQ ID NO: 2622474 - RNA, 19 nt, Human
gggcacacgccucccacug

SEQ ID NO: 2622475 - RNA, 20 nt, Human
gggcaccagggguuucucgc

SEQ ID NO: 2622476 - RNA, 18 nt, Human
gggcaccagggguuucuc

SEQ ID NO: 2622477 - RNA, 22 nt, Human
gggcacaugcugagucucccaa

SEQ ID NO: 2622478 - RNA, 20 nt, Human
gggcacaugcugagucuccc

SEQ ID NO: 2622479 - RNA, 23 nt, Human
gggcacaugcugagucucccaag

SEQ ID NO: 2622480 - RNA, 13 nt, Human
gggcacagggucu

SEQ ID NO: 2622481 - RNA, 16 nt, Human
gggcacagggucucua

SEQ ID NO: 2622482 - RNA, 19 nt, Human
gggcacucagaagacacug

SEQ ID NO: 2622483 - RNA, 16 nt, Human
gggcacucagaagaca

SEQ ID NO: 2622484 - RNA, 14 nt, Human
gggcaccggggccu

SEQ ID NO: 2622485 - RNA, 19 nt, Human
gggcaccuauagucccagc

SEQ ID NO: 2622486 - RNA, 12 nt, Human
gggcacccaccc

SEQ ID NO: 2622487 - RNA, 14 nt, Human
gggcacuggagcug

SEQ ID NO: 2622488 - RNA, 22 nt, Human
gggcacugcuggguggcccauc

SEQ ID NO: 2622489 - RNA, 21 nt, Human
gggcacugcuggguggcccau

SEQ ID NO: 2622490 - RNA, 20 nt, Human
gggcacugcuggguggccca

SEQ ID NO: 2622491 - RNA, 16 nt, Human
gggcacugcugggugg

SEQ ID NO: 2622492 - RNA, 14 nt, Human
gggcacugcugggu

SEQ ID NO: 2622493 - RNA, 13 nt, Human
gggcacugcuggg

SEQ ID NO: 2622494 - RNA, 16 nt, Human
gggcacugguggcccg

SEQ ID NO: 2622495 - RNA, 13 nt, Human
gggcacugguggc

SEQ ID NO: 2622496 - RNA, 18 nt, Human
gggcacgcugugggcagg

SEQ ID NO: 2622497 - RNA, 17 nt, Human
gggcacgcugugggcag

SEQ ID NO: 2622498 - RNA, 18 nt, Human
gggcaccuggggaguggg

SEQ ID NO: 2622499 - RNA, 20 nt, Human
gggcacucagaagacacuga

SEQ ID NO: 2622500 - RNA, 14 nt, Human
gggcagaaggaaga

SEQ ID NO: 2622501 - RNA, 16 nt, Human
gggcacuucacagagu

SEQ ID NO: 2622502 - RNA, 15 nt, Human
gggcacuucacagag

SEQ ID NO: 2622503 - RNA, 14 nt, Human
gggcacuucacaga

SEQ ID NO: 2622504 - RNA, 18 nt, Human
gggcacuucacagagugu

SEQ ID NO: 2622505 - RNA, 17 nt, Human
gggcacuucacagagug

SEQ ID NO: 2622506 - RNA, 18 nt, Human
gggcagaaggaagacuuc

SEQ ID NO: 2622507 - RNA, 23 nt, Human
gggcacuuuuuaauucaccaaag

SEQ ID NO: 2622508 - RNA, 22 nt, Human
gggcacuuuuuaauucaccaaa

SEQ ID NO: 2622509 - RNA, 14 nt, Human
gggcagaacacuaa

SEQ ID NO: 2622510 - RNA, 15 nt, Human
gggcagaaaguggcc

SEQ ID NO: 2622511 - RNA, 14 nt, Human
gggcagaagggaga

SEQ ID NO: 2622512 - RNA, 22 nt, Human
gggcagaacacuaaccugaccg

SEQ ID NO: 2622513 - RNA, 22 nt, Human
gggcagaacagccgcuccuguc

SEQ ID NO: 2622514 - RNA, 20 nt, Human
gggcaguagaaggucggagg

SEQ ID NO: 2622515 - RNA, 22 nt, Human
gggcaggugguggcacugagcc

SEQ ID NO: 2622516 - RNA, 17 nt, Human
gggcagguugguggggg

SEQ ID NO: 2622517 - RNA, 14 nt, Human
gggcagggugaccc

SEQ ID NO: 2622518 - RNA, 13 nt, Human
gggcaggugggag

SEQ ID NO: 2622519 - RNA, 18 nt, Human
gggcaggugguggcacug

SEQ ID NO: 2622520 - RNA, 16 nt, Human
gggcaggugguggcac

SEQ ID NO: 2622521 - RNA, 17 nt, Human
gggcaggugggagcuug

SEQ ID NO: 2622522 - RNA, 12 nt, Human
gggcagagcaga

SEQ ID NO: 2622523 - RNA, 18 nt, Human
gggcagaagggagaagga

SEQ ID NO: 2622524 - RNA, 16 nt, Human
gggcagaagggagaag

SEQ ID NO: 2622525 - RNA, 19 nt, Human
gggcagaagggagaaggau

SEQ ID NO: 2622526 - RNA, 11 nt, Human
gggcagagcag

SEQ ID NO: 2622527 - RNA, 14 nt, Human
gggcagggcaugac

SEQ ID NO: 2622528 - RNA, 20 nt, Human
gggcagggcaucuccugugc

SEQ ID NO: 2622529 - RNA, 22 nt, Human
ggcuugaguuuaaauuguaaua

SEQ ID NO: 2622530 - RNA, 21 nt, Human
ggcuuggggaccagagcugcc

SEQ ID NO: 2622531 - RNA, 19 nt, Human
ggcuuggggaccagagcug

SEQ ID NO: 2622532 - RNA, 22 nt, Human
ggcuuggggcucacacaccugu

SEQ ID NO: 2622533 - RNA, 16 nt, Human
ggcuugaagccaaaga

SEQ ID NO: 2622534 - RNA, 23 nt, Human
ggcuugcaaguauguuuuagcau

SEQ ID NO: 2622535 - RNA, 21 nt, Human
ggcuuuauccucuuuagaguu

SEQ ID NO: 2622536 - RNA, 20 nt, Human
ggcuuuauccucuuuagagu

SEQ ID NO: 2622537 - RNA, 18 nt, Human
ggcuuuauccucuuuaga

SEQ ID NO: 2622538 - RNA, 15 nt, Human
ggcuuuauccucuuu

SEQ ID NO: 2622539 - RNA, 14 nt, Human
ggcuuuauccucuu

SEQ ID NO: 2622540 - RNA, 13 nt, Human
ggcuuuagacacu

SEQ ID NO: 2622541 - RNA, 16 nt, Human
ggcuuguguguuucac

SEQ ID NO: 2622542 - RNA, 15 nt, Human
ggcuugucagagcug

SEQ ID NO: 2622543 - RNA, 16 nt, Human
ggcuugucagagcugg

SEQ ID NO: 2622544 - RNA, 17 nt, Human
ggcuugucagagcuggg

SEQ ID NO: 2622545 - RNA, 17 nt, Human
ggcuuguaacuccacca

SEQ ID NO: 2622546 - RNA, 18 nt, Human
ggcuuguaacuccaccaa

SEQ ID NO: 2622547 - RNA, 15 nt, Human
ggcuuggggcuuccu

SEQ ID NO: 2622548 - RNA, 15 nt, Human
ggcuuguaacuccac

SEQ ID NO: 2622549 - RNA, 22 nt, Human
ggcuuucauuauuaguacugcu

SEQ ID NO: 2622550 - RNA, 11 nt, Human
ggcuuucaugu

SEQ ID NO: 2622551 - RNA, 17 nt, Human
ggcuuuucacugcuggc

SEQ ID NO: 2622552 - RNA, 15 nt, Human
ggcuuuucacugcug

SEQ ID NO: 2622553 - RNA, 16 nt, Human
ggcuuucccuuaucaa

SEQ ID NO: 2622554 - RNA, 13 nt, Human
ggcuuuucacugc

SEQ ID NO: 2622555 - RNA, 14 nt, Human
ggcuuuucacugcu

SEQ ID NO: 2622556 - RNA, 10 nt, Human
ggcuuuugug

SEQ ID NO: 2622557 - RNA, 14 nt, Human
ggcuuuucucagcu

SEQ ID NO: 2622558 - RNA, 15 nt, Human
ggcuuuucucagcug

SEQ ID NO: 2622559 - RNA, 22 nt, Human
ggcuuuucacugcuggcugccu

SEQ ID NO: 2622560 - RNA, 19 nt, Human
ggcuuuucacugcuggcug

SEQ ID NO: 2622561 - RNA, 20 nt, Human
ggcuugaagccaaagaaaaa

SEQ ID NO: 2622562 - RNA, 21 nt, Human
ggcuugagaaauauggacacu

SEQ ID NO: 2622563 - RNA, 20 nt, Human
ggcuugagcccccgcgccca

SEQ ID NO: 2622564 - RNA, 15 nt, Human
ggcuugaagccaaag

SEQ ID NO: 2622565 - RNA, 13 nt, Human
ggcuugaagccaa

SEQ ID NO: 2622566 - RNA, 12 nt, Human
ggcuugaagcca

SEQ ID NO: 2622567 - RNA, 22 nt, Human
ggcuucaaccuugagacagcuu

SEQ ID NO: 2622568 - RNA, 20 nt, Human
ggcuucuucagaucagugcu

SEQ ID NO: 2622569 - RNA, 16 nt, Human
ggcuuauccagcuggu

SEQ ID NO: 2622570 - RNA, 22 nt, Human
ggcuuaguuuguguguugucuc

SEQ ID NO: 2622571 - RNA, 21 nt, Human
ggcuuagucacugagacagcc

SEQ ID NO: 2622572 - RNA, 22 nt, Human
ggcuuacuacaugugggagcuu

SEQ ID NO: 2622573 - RNA, 17 nt, Human
ggcuuacacguggagga

SEQ ID NO: 2622574 - RNA, 13 nt, Human
ggcuuacacccac

SEQ ID NO: 2622575 - RNA, 12 nt, Human
ggcugggcuuca

SEQ ID NO: 2622576 - RNA, 18 nt, Human
ggcugggcucccuuccca

SEQ ID NO: 2622577 - RNA, 17 nt, Human
ggcugggcucccuuccc

SEQ ID NO: 2622578 - RNA, 14 nt, Human
ggcugggcccagaa

SEQ ID NO: 2622579 - RNA, 17 nt, Human
ggcugggcuucaguggc

SEQ ID NO: 2622580 - RNA, 13 nt, Human
ggcugggcuucag

SEQ ID NO: 2622581 - RNA, 15 nt, Human
ggcuuaaaacaacac

SEQ ID NO: 2622582 - RNA, 16 nt, Human
ggcuuaauguuuauuc

SEQ ID NO: 2622583 - RNA, 14 nt, Human
ggcuuaauguuuau

SEQ ID NO: 2622584 - RNA, 12 nt, Human
ggcuuaauguuu

SEQ ID NO: 2622585 - RNA, 16 nt, Human
ggcuuaaugcuucuuu

SEQ ID NO: 2622586 - RNA, 19 nt, Human
ggcuuaagaaaucuaguau

SEQ ID NO: 2622587 - RNA, 14 nt, Human
ggcuuuugugcauu

SEQ ID NO: 2622588 - RNA, 16 nt, Human
gggaaggauacaaaag

SEQ ID NO: 2622589 - RNA, 21 nt, Human
gggaaggauacaaaagcaugu

SEQ ID NO: 2622590 - RNA, 23 nt, Human
gggaaggauacaaaagcauguga

SEQ ID NO: 2622591 - RNA, 14 nt, Human
gggaagggacacac

SEQ ID NO: 2622592 - RNA, 19 nt, Human
gggaaggccccacagacaa

SEQ ID NO: 2622593 - RNA, 13 nt, Human
gggaagggccagu

SEQ ID NO: 2622594 - RNA, 12 nt, Human
gggaagggccag

SEQ ID NO: 2622595 - RNA, 13 nt, Human
gggaagggagagc

SEQ ID NO: 2622596 - RNA, 16 nt, Human
gggaagggagagcggg

SEQ ID NO: 2622597 - RNA, 22 nt, Human
gggaaggcagggagggccuggg

SEQ ID NO: 2622598 - RNA, 12 nt, Human
gggaaggccagc

SEQ ID NO: 2622599 - RNA, 12 nt, Human
ggcuuucuggag

SEQ ID NO: 2622600 - RNA, 23 nt, Human
gggaaguccccgaguuuccccag

SEQ ID NO: 2622601 - RNA, 19 nt, Human
gggaaggucaccagcacca

SEQ ID NO: 2622602 - RNA, 14 nt, Human
gggaaguccccagg

SEQ ID NO: 2622603 - RNA, 21 nt, Human
gggaaggugggguccuggagc

SEQ ID NO: 2622604 - RNA, 12 nt, Human
gggaaggucacc

SEQ ID NO: 2622605 - RNA, 20 nt, Human
gggaaugaggcuugcugaga

SEQ ID NO: 2622606 - RNA, 14 nt, Human
gggaaugaggcuug

SEQ ID NO: 2622607 - RNA, 24 nt, Human
gggaaugaagcuuguguauccauu

SEQ ID NO: 2622608 - RNA, 14 nt, Human
gggaaugaagcuug

SEQ ID NO: 2622609 - RNA, 16 nt, Human
gggaaugaaccuggag

SEQ ID NO: 2622610 - RNA, 14 nt, Human
gggaaugaaccugg

SEQ ID NO: 2622611 - RNA, 21 nt, Human
gggaaugccugagugccuggc

SEQ ID NO: 2622612 - RNA, 17 nt, Human
gggaaugccugagugcc

SEQ ID NO: 2622613 - RNA, 21 nt, Human
gggaaugaggcuugcugagag

SEQ ID NO: 2622614 - RNA, 22 nt, Human
gggaauggcacagcccaaagaa

SEQ ID NO: 2622615 - RNA, 16 nt, Human
gggaauggcacagccc

SEQ ID NO: 2622616 - RNA, 16 nt, Human
gggaagggggcuggga

SEQ ID NO: 2622617 - RNA, 14 nt, Human
gggaagggggcugg

SEQ ID NO: 2622618 - RNA, 17 nt, Human
gggaagggggcugggac

SEQ ID NO: 2622619 - RNA, 22 nt, Human
gggaagggccagucugggcugc

SEQ ID NO: 2622620 - RNA, 16 nt, Human
gggaagggccagucug

SEQ ID NO: 2622621 - RNA, 18 nt, Human
gggaaggggacccccgcc

SEQ ID NO: 2622622 - RNA, 18 nt, Human
gggaccccgagccuggcu

SEQ ID NO: 2622623 - RNA, 20 nt, Human
gggaccccgagccuggcucc

SEQ ID NO: 2622624 - RNA, 18 nt, Human
gggacaaguggacucagg

SEQ ID NO: 2622625 - RNA, 16 nt, Human
gggaccccgagccugg

SEQ ID NO: 2622626 - RNA, 20 nt, Human
gggaccccuggugguucacu

SEQ ID NO: 2622627 - RNA, 14 nt, Human
gggaccccugagcu

SEQ ID NO: 2622628 - RNA, 13 nt, Human
gggaccccuccuc

SEQ ID NO: 2622629 - RNA, 20 nt, Human
gggacccuaagacuccucgg

SEQ ID NO: 2622630 - RNA, 23 nt, Human
gggacccugugacauggugccug

SEQ ID NO: 2622631 - RNA, 16 nt, Human
gggacccuuuccuucc

SEQ ID NO: 2622632 - RNA, 17 nt, Human
gggaauuucuucaacuc

SEQ ID NO: 2622633 - RNA, 21 nt, Human
gggaauguaacugcugaaaac

SEQ ID NO: 2622634 - RNA, 20 nt, Human
gggaauguauuauucugcag

SEQ ID NO: 2622635 - RNA, 14 nt, Human
gggaauugugugau

SEQ ID NO: 2622636 - RNA, 22 nt, Human
gggaauugaggucugcucggcc

SEQ ID NO: 2622637 - RNA, 21 nt, Human
gggaauguauuauucugcagc

SEQ ID NO: 2622638 - RNA, 15 nt, Human
gggaauggcagcugc

SEQ ID NO: 2622639 - RNA, 23 nt, Human
gggacaaggacuaggguccuggg

SEQ ID NO: 2622640 - RNA, 18 nt, Human
gggacaaaacccaccuug

SEQ ID NO: 2622641 - RNA, 13 nt, Human
gggaauuuccucu

SEQ ID NO: 2622642 - RNA, 12 nt, Human
gggaauuuccuc

SEQ ID NO: 2622643 - RNA, 18 nt, Human
gggaauugugugauguuu

SEQ ID NO: 2622644 - RNA, 15 nt, Human
gggaccucaggccug

SEQ ID NO: 2622645 - RNA, 13 nt, Human
gggaccucaggcc

SEQ ID NO: 2622646 - RNA, 12 nt, Human
gggaccucaggc

SEQ ID NO: 2622647 - RNA, 23 nt, Human
gggaccgccagauggggccucug

SEQ ID NO: 2622648 - RNA, 18 nt, Human
gggaccgguacagaaagg

SEQ ID NO: 2622649 - RNA, 16 nt, Human
gggacucaaugcacug

SEQ ID NO: 2622650 - RNA, 17 nt, Human
gggacuacaggcaccca

SEQ ID NO: 2622651 - RNA, 22 nt, Human
gggacguggcucagccagcacu

SEQ ID NO: 2622652 - RNA, 20 nt, Human
gggacguggcucagccagca

SEQ ID NO: 2622653 - RNA, 22 nt, Human
gggaccuccccugaggcucagg

SEQ ID NO: 2622654 - RNA, 19 nt, Human
gggacguggcucagccagc

SEQ ID NO: 2622655 - RNA, 12 nt, Human
gggaccucuccc

SEQ ID NO: 2622656 - RNA, 16 nt, Human
gggaccucucccaggg

SEQ ID NO: 2622657 - RNA, 23 nt, Human
gggaccucucccagggucccugg

SEQ ID NO: 2622658 - RNA, 14 nt, Human
ggcugcugaaggcu

SEQ ID NO: 2622659 - RNA, 13 nt, Human
ggcugcagggagu

SEQ ID NO: 2622660 - RNA, 12 nt, Human
ggcugcagggag

SEQ ID NO: 2622661 - RNA, 17 nt, Human
ggcugcugaaggcucga

SEQ ID NO: 2622662 - RNA, 15 nt, Human
ggcugcugaaggcuc

SEQ ID NO: 2622663 - RNA, 18 nt, Human
ggcugcugaaggcucgag

SEQ ID NO: 2622664 - RNA, 16 nt, Human
ggcugcugaccuccac

SEQ ID NO: 2622665 - RNA, 21 nt, Human
ggcugcugaccuccacagcuu

SEQ ID NO: 2622666 - RNA, 22 nt, Human
ggcugcuucaaggauccugagc

SEQ ID NO: 2622667 - RNA, 14 nt, Human
ggcugcuucaagga

SEQ ID NO: 2622668 - RNA, 12 nt, Human
ggcugcuucaag

SEQ ID NO: 2622669 - RNA, 11 nt, Human
ggcugcuucaa

SEQ ID NO: 2622670 - RNA, 17 nt, Human
ggcugcugcccccaccc

SEQ ID NO: 2622671 - RNA, 13 nt, Human
ggcugcugccccc

SEQ ID NO: 2622672 - RNA, 14 nt, Human
ggcugcugcccagg

SEQ ID NO: 2622673 - RNA, 12 nt, Human
ggcugcugccca

SEQ ID NO: 2622674 - RNA, 11 nt, Human
ggcugcugccc

SEQ ID NO: 2622675 - RNA, 10 nt, Human
ggcugcugcc

SEQ ID NO: 2622676 - RNA, 18 nt, Human
ggcugcugcccccacccc

SEQ ID NO: 2622677 - RNA, 19 nt, Human
ggcugcuggcgccucugca

SEQ ID NO: 2622678 - RNA, 18 nt, Human
ggcugcuggcgccucugc

SEQ ID NO: 2622679 - RNA, 14 nt, Human
ggcugcuggcgccu

SEQ ID NO: 2622680 - RNA, 15 nt, Human
ggcugcugugugccu

SEQ ID NO: 2622681 - RNA, 12 nt, Human
ggcugcuggagg

SEQ ID NO: 2622682 - RNA, 13 nt, Human
ggcugcuggagga

SEQ ID NO: 2622683 - RNA, 14 nt, Human
ggcugcuggaggaa

SEQ ID NO: 2622684 - RNA, 15 nt, Human
ggcugcuggaggaaa

SEQ ID NO: 2622685 - RNA, 13 nt, Human
ggcugcuggccug

SEQ ID NO: 2622686 - RNA, 16 nt, Human
ggcugcuggaggaaaa

SEQ ID NO: 2622687 - RNA, 18 nt, Human
ggcugcuuccuccuggaa

SEQ ID NO: 2622688 - RNA, 17 nt, Human
ggcugcuuccuccugga

SEQ ID NO: 2622689 - RNA, 16 nt, Human
ggcugcuuccuccugg

SEQ ID NO: 2622690 - RNA, 15 nt, Human
ggcugcuuccuccug

SEQ ID NO: 2622691 - RNA, 22 nt, Human
ggcuggaacagauucacacugu

SEQ ID NO: 2622692 - RNA, 14 nt, Human
ggcugcuuggccuu

SEQ ID NO: 2622693 - RNA, 19 nt, Human
ggcugcuuccuccuggaaa

SEQ ID NO: 2622694 - RNA, 15 nt, Human
ggcugcuuuccaaag

SEQ ID NO: 2622695 - RNA, 13 nt, Human
ggcugcuuccucc

SEQ ID NO: 2622696 - RNA, 17 nt, Human
ggcugcugugugccuuc

SEQ ID NO: 2622697 - RNA, 14 nt, Human
ggcugcuuagaauc

SEQ ID NO: 2622698 - RNA, 23 nt, Human
ggcugcuucaaggauccugagcc

SEQ ID NO: 2622699 - RNA, 16 nt, Human
ggcuggaccuaugucc

SEQ ID NO: 2622700 - RNA, 20 nt, Human
ggcuggaaucuggagagcua

SEQ ID NO: 2622701 - RNA, 19 nt, Human
ggcugggagagccuuccag

SEQ ID NO: 2622702 - RNA, 22 nt, Human
ggcuggaagauccugcgggugg

SEQ ID NO: 2622703 - RNA, 15 nt, Human
ggcuggaagauccug

SEQ ID NO: 2622704 - RNA, 23 nt, Human
ggcuggaacagauucacacuguc

SEQ ID NO: 2622705 - RNA, 19 nt, Human
ggcuggaaucuggagagcu

SEQ ID NO: 2622706 - RNA, 18 nt, Human
ggcuggaaucuggagagc

SEQ ID NO: 2622707 - RNA, 16 nt, Human
ggcuggaaucuggaga

SEQ ID NO: 2622708 - RNA, 14 nt, Human
ggcuggaaucugga

SEQ ID NO: 2622709 - RNA, 19 nt, Human
ggcuggaagauccugcggg

SEQ ID NO: 2622710 - RNA, 13 nt, Human
ggcuggaaucugg

SEQ ID NO: 2622711 - RNA, 23 nt, Human
ggcugggagagccuuccaggggu

SEQ ID NO: 2622712 - RNA, 20 nt, Human
ggcugggagagccuuccagg

SEQ ID NO: 2622713 - RNA, 14 nt, Human
ggcugggcagagga

SEQ ID NO: 2622714 - RNA, 13 nt, Human
ggcugggcagagg

SEQ ID NO: 2622715 - RNA, 19 nt, Human
ggcugggcagaggaaagca

SEQ ID NO: 2622716 - RNA, 15 nt, Human
ggcugggcagaggaa

SEQ ID NO: 2622717 - RNA, 18 nt, Human
ggcugggagagccuucca

SEQ ID NO: 2622718 - RNA, 22 nt, Human
ggcuggaccuauguccuaagga

SEQ ID NO: 2622719 - RNA, 12 nt, Human
ggcugggcagcu

SEQ ID NO: 2622720 - RNA, 15 nt, Human
ggcuggacguggugg

SEQ ID NO: 2622721 - RNA, 13 nt, Human
ggcugggcagcua

SEQ ID NO: 2622722 - RNA, 14 nt, Human
ggcugggcagcugu

SEQ ID NO: 2622723 - RNA, 13 nt, Human
ggcugggcagcug

SEQ ID NO: 2622724 - RNA, 13 nt, Human
ggcugagguggga

SEQ ID NO: 2622725 - RNA, 15 nt, Human
ggcugaggugggagg

SEQ ID NO: 2622726 - RNA, 19 nt, Human
ggcugagcggaugcaucug

SEQ ID NO: 2622727 - RNA, 22 nt, Human
ggcugagccccuaccccacacc

SEQ ID NO: 2622728 - RNA, 15 nt, Human
ggcugagcucucugu

SEQ ID NO: 2622729 - RNA, 16 nt, Human
ggcugagggagccugg

SEQ ID NO: 2622730 - RNA, 23 nt, Human
ggcugagggauggacugaugcuu

SEQ ID NO: 2622731 - RNA, 22 nt, Human
ggcugagggauggacugaugcu

SEQ ID NO: 2622732 - RNA, 15 nt, Human
ggcugagccuggcug

SEQ ID NO: 2622733 - RNA, 15 nt, Human
ggcugagcccuggca

SEQ ID NO: 2622734 - RNA, 16 nt, Human
ggcugagcccuggcag

SEQ ID NO: 2622735 - RNA, 18 nt, Human
ggcugagccccuacccca

SEQ ID NO: 2622736 - RNA, 16 nt, Human
ggcugagccccuaccc

SEQ ID NO: 2622737 - RNA, 12 nt, Human
ggcugagcccug

SEQ ID NO: 2622738 - RNA, 13 nt, Human
ggcugagcccugg

SEQ ID NO: 2622739 - RNA, 14 nt, Human
ggcugagcccuggc

SEQ ID NO: 2622740 - RNA, 19 nt, Human
ggcugagagccccagcuga

SEQ ID NO: 2622741 - RNA, 18 nt, Human
ggcugagagccccagcug

SEQ ID NO: 2622742 - RNA, 17 nt, Human
ggcugagagccccagcu

SEQ ID NO: 2622743 - RNA, 16 nt, Human
ggcugagagccccagc

SEQ ID NO: 2622744 - RNA, 13 nt, Human
ggcugagccccua

SEQ ID NO: 2622745 - RNA, 20 nt, Human
ggcugagagccccagcugac

SEQ ID NO: 2622746 - RNA, 15 nt, Human
ggcugagauaugaac

SEQ ID NO: 2622747 - RNA, 12 nt, Human
ggcugagacugg

SEQ ID NO: 2622748 - RNA, 15 nt, Human
ggcucuggagagaaa

SEQ ID NO: 2622749 - RNA, 13 nt, Human
ggcugagacugga

SEQ ID NO: 2622750 - RNA, 14 nt, Human
ggcugagagcccca

SEQ ID NO: 2622751 - RNA, 17 nt, Human
ggcugagagaguggcau

SEQ ID NO: 2622752 - RNA, 15 nt, Human
ggcugagagaguggc

SEQ ID NO: 2622753 - RNA, 21 nt, Human
ggcugagacuggauacugccc

SEQ ID NO: 2622754 - RNA, 14 nt, Human
ggcucuggagagaa

SEQ ID NO: 2622755 - RNA, 21 nt, Human
ggcucuggagacagccccaga

SEQ ID NO: 2622756 - RNA, 19 nt, Human
ggcucuggagacagcccca

SEQ ID NO: 2622757 - RNA, 17 nt, Human
ggcucuggagacagccc

SEQ ID NO: 2622758 - RNA, 16 nt, Human
ggcucuggagacagcc

SEQ ID NO: 2622759 - RNA, 15 nt, Human
ggcucuggagacagc

SEQ ID NO: 2622760 - RNA, 12 nt, Human
ggcucuggagac

SEQ ID NO: 2622761 - RNA, 17 nt, Human
ggccccugcauccccuu

SEQ ID NO: 2622762 - RNA, 19 nt, Human
ggcucugcuggccggagca

SEQ ID NO: 2622763 - RNA, 20 nt, Human
ggccccugccagacccccug

SEQ ID NO: 2622764 - RNA, 14 nt, Human
ggcucuggagccca

SEQ ID NO: 2622765 - RNA, 13 nt, Human
ggcucuggagccc

SEQ ID NO: 2622766 - RNA, 17 nt, Human
ggccccugcccggcugc

SEQ ID NO: 2622767 - RNA, 16 nt, Human
ggccccugcccggcug

SEQ ID NO: 2622768 - RNA, 17 nt, Human
ggcucugccucccauca

SEQ ID NO: 2622769 - RNA, 20 nt, Human
ggccccugcccggcugcgga

SEQ ID NO: 2622770 - RNA, 18 nt, Human
ggcugcagaggccagagg

SEQ ID NO: 2622771 - RNA, 16 nt, Human
ggcugcagaggccaga

SEQ ID NO: 2622772 - RNA, 21 nt, Human
ggcugcacucugugcccaugg

SEQ ID NO: 2622773 - RNA, 20 nt, Human
ggcugcacucugugcccaug

SEQ ID NO: 2622774 - RNA, 13 nt, Human
ggcugcagaggcc

SEQ ID NO: 2622775 - RNA, 19 nt, Human
ggcugcacucugugcccau

SEQ ID NO: 2622776 - RNA, 18 nt, Human
ggcugcacucugugccca

SEQ ID NO: 2622777 - RNA, 17 nt, Human
ggcugcacucugugccc

SEQ ID NO: 2622778 - RNA, 16 nt, Human
ggcugcacucugugcc

SEQ ID NO: 2622779 - RNA, 15 nt, Human
ggcugcacucugugc

SEQ ID NO: 2622780 - RNA, 22 nt, Human
ggcugcaagguuuaggcuggug

SEQ ID NO: 2622781 - RNA, 20 nt, Human
ggcugcagcagcgguggccu

SEQ ID NO: 2622782 - RNA, 13 nt, Human
ggcugcagcagcg

SEQ ID NO: 2622783 - RNA, 19 nt, Human
ggcugcagaggccagaggc

SEQ ID NO: 2622784 - RNA, 16 nt, Human
ggcugcagccaggcca

SEQ ID NO: 2622785 - RNA, 12 nt, Human
ggcugcagcaug

SEQ ID NO: 2622786 - RNA, 22 nt, Human
ggcugcagcagcgguggccucu

SEQ ID NO: 2622787 - RNA, 21 nt, Human
ggcugcagcauguugcugagg

SEQ ID NO: 2622788 - RNA, 22 nt, Human
ggcugcagccaggccacuggcc

SEQ ID NO: 2622789 - RNA, 19 nt, Human
ggcugcaccggcuggccug

SEQ ID NO: 2622790 - RNA, 18 nt, Human
ggcugcaccggcuggccu

SEQ ID NO: 2622791 - RNA, 17 nt, Human
ggcugcaccggcuggcc

SEQ ID NO: 2622792 - RNA, 24 nt, Human
ggcugcaaaggguaucaggugcug

SEQ ID NO: 2622793 - RNA, 24 nt, Human
ggcugaugucaauuucuguguugc

SEQ ID NO: 2622794 - RNA, 22 nt, Human
ggcugaugucaauuucuguguu

SEQ ID NO: 2622795 - RNA, 18 nt, Human
ggcugaugucaauuucug

SEQ ID NO: 2622796 - RNA, 22 nt, Human
ggcugaugccaaguuguuugag

SEQ ID NO: 2622797 - RNA, 18 nt, Human
ggcugcaaaggguaucag

SEQ ID NO: 2622798 - RNA, 23 nt, Human
ggcugcaaaggguaucaggugcu

SEQ ID NO: 2622799 - RNA, 22 nt, Human
ggcugcaaaggguaucaggugc

SEQ ID NO: 2622800 - RNA, 22 nt, Human
ggcugagguuccucugccugcc

SEQ ID NO: 2622801 - RNA, 21 nt, Human
ggcugagguuccucugccugc

SEQ ID NO: 2622802 - RNA, 20 nt, Human
ggcugagguuccucugccug

SEQ ID NO: 2622803 - RNA, 19 nt, Human
ggcugagguuccucugccu

SEQ ID NO: 2622804 - RNA, 18 nt, Human
ggcugagguuccucugcc

SEQ ID NO: 2622805 - RNA, 17 nt, Human
ggcugagguuccucugc

SEQ ID NO: 2622806 - RNA, 16 nt, Human
ggcugagguuccucug

SEQ ID NO: 2622807 - RNA, 14 nt, Human
ggcugagguuccuc

SEQ ID NO: 2622808 - RNA, 23 nt, Human
ggcugagguuccucugccugccc

SEQ ID NO: 2622809 - RNA, 22 nt, Human
ggcugagucaugaucucccugc

SEQ ID NO: 2622810 - RNA, 23 nt, Human
ggcugagucaugaucucccugcc

SEQ ID NO: 2622811 - RNA, 21 nt, Human
ggcugaugccaaguuguuuga

SEQ ID NO: 2622812 - RNA, 19 nt, Human
ggcugauaauuccaguggu

SEQ ID NO: 2622813 - RNA, 15 nt, Human
ggcugauggaguaaa

SEQ ID NO: 2622814 - RNA, 21 nt, Human
gcuugcaguagauuuucuuua

SEQ ID NO: 2622815 - RNA, 22 nt, Human
gcuugcacuuuguaacauguuu

SEQ ID NO: 2622816 - RNA, 19 nt, Human
gcuugcacuuuguaacaug

SEQ ID NO: 2622817 - RNA, 19 nt, Human
gcuugcagugagccgagau

SEQ ID NO: 2622818 - RNA, 23 nt, Human
gcuugcauaauaagcuaaagagg

SEQ ID NO: 2622819 - RNA, 14 nt, Human
gcuugccacagagc

SEQ ID NO: 2622820 - RNA, 15 nt, Human
gcuugcauaauaagc

SEQ ID NO: 2622821 - RNA, 22 nt, Human
gcuugcagagaugaggccgcca

SEQ ID NO: 2622822 - RNA, 14 nt, Human
gcuugauuuuugcc

SEQ ID NO: 2622823 - RNA, 23 nt, Human
gcuugcaaguauguuuuagcaug

SEQ ID NO: 2622824 - RNA, 14 nt, Human
gcuugauucugcag

SEQ ID NO: 2622825 - RNA, 19 nt, Human
gcuugaguuuggggaaugc

SEQ ID NO: 2622826 - RNA, 19 nt, Human
gcuucugguacucuccuag

SEQ ID NO: 2622827 - RNA, 18 nt, Human
gcuucugguacucuccua

SEQ ID NO: 2622828 - RNA, 17 nt, Human
gcuucugguacucuccu

SEQ ID NO: 2622829 - RNA, 23 nt, Human
gcuucugucuuauuugaaggcca

SEQ ID NO: 2622830 - RNA, 19 nt, Human
gcuucuggugaccuuccaa

SEQ ID NO: 2622831 - RNA, 16 nt, Human
gcuucuguugcugccu

SEQ ID NO: 2622832 - RNA, 22 nt, Human
gcuugaggguugggcugguguc

SEQ ID NO: 2622833 - RNA, 18 nt, Human
gcuugcccuguuaaaaga

SEQ ID NO: 2622834 - RNA, 13 nt, Human
gcuuggaggaagg

SEQ ID NO: 2622835 - RNA, 15 nt, Human
gcuuggaggaaggaa

SEQ ID NO: 2622836 - RNA, 14 nt, Human
gcuuggaggaagga

SEQ ID NO: 2622837 - RNA, 17 nt, Human
gcuugcccuggugccuc

SEQ ID NO: 2622838 - RNA, 19 nt, Human
gcuugcccuggugccucac

SEQ ID NO: 2622839 - RNA, 14 nt, Human
gcuugccccggccc

SEQ ID NO: 2622840 - RNA, 12 nt, Human
gcuugccccggc

SEQ ID NO: 2622841 - RNA, 16 nt, Human
gcuugccacagagcgg

SEQ ID NO: 2622842 - RNA, 15 nt, Human
gcuugccacagcucu

SEQ ID NO: 2622843 - RNA, 18 nt, Human
gcuucuaucccaggaggu

SEQ ID NO: 2622844 - RNA, 14 nt, Human
gcuucuaucccagg

SEQ ID NO: 2622845 - RNA, 20 nt, Human
gcuucuaucccaggaggugg

SEQ ID NO: 2622846 - RNA, 16 nt, Human
gcuucuauuagccagu

SEQ ID NO: 2622847 - RNA, 23 nt, Human
gcuucuccgccagccuccucugg

SEQ ID NO: 2622848 - RNA, 14 nt, Human
gcuucuccugaccc

SEQ ID NO: 2622849 - RNA, 24 nt, Human
gcuucuccgccagccuccucugga

SEQ ID NO: 2622850 - RNA, 12 nt, Human
gcuucuccugac

SEQ ID NO: 2622851 - RNA, 12 nt, Human
gcuucucucuca

SEQ ID NO: 2622852 - RNA, 15 nt, Human
gcuucuccuguguga

SEQ ID NO: 2622853 - RNA, 14 nt, Human
gcuucucuacagac

SEQ ID NO: 2622854 - RNA, 12 nt, Human
gcuucuauccca

SEQ ID NO: 2622855 - RNA, 20 nt, Human
gcuguucacccacagggcua

SEQ ID NO: 2622856 - RNA, 20 nt, Human
gcuucucugacuucugccug

SEQ ID NO: 2622857 - RNA, 18 nt, Human
gcuucucugacuucugcc

SEQ ID NO: 2622858 - RNA, 17 nt, Human
gcuucucugacuucugc

SEQ ID NO: 2622859 - RNA, 14 nt, Human
gcuucucugacuuc

SEQ ID NO: 2622860 - RNA, 14 nt, Human
gcuucucucucacc

SEQ ID NO: 2622861 - RNA, 13 nt, Human
gcuucucucucac

SEQ ID NO: 2622862 - RNA, 14 nt, Human
gcuucucucugugg

SEQ ID NO: 2622863 - RNA, 13 nt, Human
gcuucucugacuu

SEQ ID NO: 2622864 - RNA, 16 nt, Human
gcuucucucuguggga

SEQ ID NO: 2622865 - RNA, 22 nt, Human
gcuucucugacuucugccugga

SEQ ID NO: 2622866 - RNA, 21 nt, Human
gcuucucugacuucugccugg

SEQ ID NO: 2622867 - RNA, 16 nt, Human
gcuucucucucaccag

SEQ ID NO: 2622868 - RNA, 16 nt, Human
gcuucugguacucucc

SEQ ID NO: 2622869 - RNA, 15 nt, Human
gcuucugguacucuc

SEQ ID NO: 2622870 - RNA, 15 nt, Human
gcuguucacagccag

SEQ ID NO: 2622871 - RNA, 16 nt, Human
gcuguucacagccaga

SEQ ID NO: 2622872 - RNA, 23 nt, Human
gcuguucacagccagacuggcac

SEQ ID NO: 2622873 - RNA, 18 nt, Human
gcuuccagugaggcucug

SEQ ID NO: 2622874 - RNA, 20 nt, Human
gcuuccagugaggcucugcc

SEQ ID NO: 2622875 - RNA, 19 nt, Human
gcuuccagugaggcucugc

SEQ ID NO: 2622876 - RNA, 21 nt, Human
gcuuccagugaggcucugccc

SEQ ID NO: 2622877 - RNA, 23 nt, Human
gcuguguccuugcaccugcaucc

SEQ ID NO: 2622878 - RNA, 22 nt, Human
gcuguucacccacagggcuaag

SEQ ID NO: 2622879 - RNA, 13 nt, Human
ggaaaaauagccu

SEQ ID NO: 2622880 - RNA, 17 nt, Human
ggaaaaagcacaagaag

SEQ ID NO: 2622881 - RNA, 16 nt, Human
ggaaaaagcacaagaa

SEQ ID NO: 2622882 - RNA, 14 nt, Human
ggaaaaacugauuu

SEQ ID NO: 2622883 - RNA, 13 nt, Human
ggaaaaacacaag

SEQ ID NO: 2622884 - RNA, 21 nt, Human
ggaaaaacaucugaaagccac

SEQ ID NO: 2622885 - RNA, 19 nt, Human
ggaaaaaccacccccaaau

SEQ ID NO: 2622886 - RNA, 22 nt, Human
ggaaaaccaagccguggcuucc

SEQ ID NO: 2622887 - RNA, 15 nt, Human
ggaaaaauagccugc

SEQ ID NO: 2622888 - RNA, 16 nt, Human
ggaaaacugacagagg

SEQ ID NO: 2622889 - RNA, 21 nt, Human
ggaaaacugagacucagacag

SEQ ID NO: 2622890 - RNA, 11 nt, Human
ggaaaaauauu

SEQ ID NO: 2622891 - RNA, 21 nt, Human
ggaaaaccaagccguggcuuc

SEQ ID NO: 2622892 - RNA, 15 nt, Human
gcuuuuaccaugccc

SEQ ID NO: 2622893 - RNA, 20 nt, Human
gcuuuuaccaugccccugag

SEQ ID NO: 2622894 - RNA, 17 nt, Human
gcuuuuaaaaaaaaaua

SEQ ID NO: 2622895 - RNA, 16 nt, Human
gcuuugggcugcccug

SEQ ID NO: 2622896 - RNA, 15 nt, Human
gcuuugggcugcccu

SEQ ID NO: 2622897 - RNA, 20 nt, Human
ggaaaaaauaacaaugaaag

SEQ ID NO: 2622898 - RNA, 14 nt, Human
gcuuuuacuuaaac

SEQ ID NO: 2622899 - RNA, 19 nt, Human
ggaaaaaauguuggauuua

SEQ ID NO: 2622900 - RNA, 21 nt, Human
gcuuuuacugaagccuuucuu

SEQ ID NO: 2622901 - RNA, 13 nt, Human
gcuuggcagccga

SEQ ID NO: 2622902 - RNA, 14 nt, Human
gcuuggcacaugac

SEQ ID NO: 2622903 - RNA, 16 nt, Human
gcuuggagcagagggg

SEQ ID NO: 2622904 - RNA, 18 nt, Human
gcuuggagcagaggggcu

SEQ ID NO: 2622905 - RNA, 13 nt, Human
gcuuggccagaag

SEQ ID NO: 2622906 - RNA, 13 nt, Human
gcuuggcagcuga

SEQ ID NO: 2622907 - RNA, 18 nt, Human
gcuuggccagaagggggc

SEQ ID NO: 2622908 - RNA, 20 nt, Human
gcuuuaauaucaucaguauu

SEQ ID NO: 2622909 - RNA, 22 nt, Human
gcuuuaauaucaucaguauuga

SEQ ID NO: 2622910 - RNA, 23 nt, Human
gcuuuaauaucaucaguauugaa

SEQ ID NO: 2622911 - RNA, 13 nt, Human
gcuuggccugcug

SEQ ID NO: 2622912 - RNA, 12 nt, Human
gcuuuacaugca

SEQ ID NO: 2622913 - RNA, 19 nt, Human
gcuuuauccucuuuagagu

SEQ ID NO: 2622914 - RNA, 17 nt, Human
gcuuuauccucuuuaga

SEQ ID NO: 2622915 - RNA, 16 nt, Human
gcuuuauccucuuuag

SEQ ID NO: 2622916 - RNA, 15 nt, Human
gcuuuauccucuuua

SEQ ID NO: 2622917 - RNA, 20 nt, Human
gcuuuauccucuuuagaguu

SEQ ID NO: 2622918 - RNA, 21 nt, Human
gcuuuaauuuuuuuaaccaaa

SEQ ID NO: 2622919 - RNA, 20 nt, Human
gcuuuauggguguuaauuga

SEQ ID NO: 2622920 - RNA, 17 nt, Human
gcuuuauuccagaaugc

SEQ ID NO: 2622921 - RNA, 13 nt, Human
gcuuuaugcugaa

SEQ ID NO: 2622922 - RNA, 14 nt, Human
gcuuuaugcugaaa

SEQ ID NO: 2622923 - RNA, 15 nt, Human
gcuuuauguaauaau

SEQ ID NO: 2622924 - RNA, 22 nt, Human
gcuuuauucuucagauacaaac

SEQ ID NO: 2622925 - RNA, 13 nt, Human
gcuuuauucuuca

SEQ ID NO: 2622926 - RNA, 13 nt, Human
gcuuuauuuuuua

SEQ ID NO: 2622927 - RNA, 17 nt, Human
gcuuuauuuuuuaagua

SEQ ID NO: 2622928 - RNA, 22 nt, Human
gcuuuggaccuaaauggccuca

SEQ ID NO: 2622929 - RNA, 17 nt, Human
gcuuuggaccuaaucca

SEQ ID NO: 2622930 - RNA, 17 nt, Human
gcuuuggauuugacauu

SEQ ID NO: 2622931 - RNA, 14 nt, Human
gcuuugggcugccc

SEQ ID NO: 2622932 - RNA, 13 nt, Human
gcuuuggcuucuu

SEQ ID NO: 2622933 - RNA, 22 nt, Human
gcuuugggaauguuuuuagcug

SEQ ID NO: 2622934 - RNA, 15 nt, Human
ggaaauauuuauuuu

SEQ ID NO: 2622935 - RNA, 13 nt, Human
ggaaauauuuauu

SEQ ID NO: 2622936 - RNA, 12 nt, Human
ggaaauauuuau

SEQ ID NO: 2622937 - RNA, 16 nt, Human
ggaaaguguaaagcau

SEQ ID NO: 2622938 - RNA, 15 nt, Human
ggaaaguguaaagca

SEQ ID NO: 2622939 - RNA, 14 nt, Human
ggaaaguguaaagc

SEQ ID NO: 2622940 - RNA, 13 nt, Human
ggaaaguguaaag

SEQ ID NO: 2622941 - RNA, 18 nt, Human
ggaaauauuuauuuuaau

SEQ ID NO: 2622942 - RNA, 17 nt, Human
ggaaauauuuauuuuaa

SEQ ID NO: 2622943 - RNA, 20 nt, Human
ggaaauauuuagcaaauaau

SEQ ID NO: 2622944 - RNA, 17 nt, Human
ggaaauauuuagcaaau

SEQ ID NO: 2622945 - RNA, 17 nt, Human
ggaaaguguaaagcauu

SEQ ID NO: 2622946 - RNA, 17 nt, Human
ggaaauauugcuggggu

SEQ ID NO: 2622947 - RNA, 17 nt, Human
ggaacagacuggaagca

SEQ ID NO: 2622948 - RNA, 21 nt, Human
ggaaaagagauggccugagaa

SEQ ID NO: 2622949 - RNA, 14 nt, Human
ggaaaagaauacag

SEQ ID NO: 2622950 - RNA, 18 nt, Human
ggaaaagaauacagaaag

SEQ ID NO: 2622951 - RNA, 22 nt, Human
ggaaaagagcgcaucaggccug

SEQ ID NO: 2622952 - RNA, 22 nt, Human
ggaaaauaccccaucauucaug

SEQ ID NO: 2622953 - RNA, 13 nt, Human
ggaaaauacccca

SEQ ID NO: 2622954 - RNA, 14 nt, Human
ggaaaauaaauuau

SEQ ID NO: 2622955 - RNA, 16 nt, Human
ggaaagucauuggcuu

SEQ ID NO: 2622956 - RNA, 21 nt, Human
ggaaagucauuggcuuuaucc

SEQ ID NO: 2622957 - RNA, 13 nt, Human
ggaaagugaauuu

SEQ ID NO: 2622958 - RNA, 14 nt, Human
ggaaagugaauuug

SEQ ID NO: 2622959 - RNA, 18 nt, Human
ggaaagugaauuugaaug

SEQ ID NO: 2622960 - RNA, 19 nt, Human
ggaaagugaauuugaauga

SEQ ID NO: 2622961 - RNA, 22 nt, Human
ggaaagugaauuugaaugaaaa

SEQ ID NO: 2622962 - RNA, 15 nt, Human
ggaaaaucagccugc

SEQ ID NO: 2622963 - RNA, 20 nt, Human
ggaaagggugcugcuucccu

SEQ ID NO: 2622964 - RNA, 15 nt, Human
ggaaagggugcugcu

SEQ ID NO: 2622965 - RNA, 22 nt, Human
ggaaagggggucccagugggag

SEQ ID NO: 2622966 - RNA, 20 nt, Human
ggaaaggggucggcugacca

SEQ ID NO: 2622967 - RNA, 21 nt, Human
ggaaccucacucuugccaacc

SEQ ID NO: 2622968 - RNA, 16 nt, Human
ggaacgugacugcccc

SEQ ID NO: 2622969 - RNA, 23 nt, Human
ggaacuagacucccaagcuggac

SEQ ID NO: 2622970 - RNA, 17 nt, Human
ggaacgugacugcccca

SEQ ID NO: 2622971 - RNA, 21 nt, Human
ggaacuagagggauacacuga

SEQ ID NO: 2622972 - RNA, 17 nt, Human
ggaacucaccuggggcu

SEQ ID NO: 2622973 - RNA, 22 nt, Human
ggaacuagagggauacacugaa

SEQ ID NO: 2622974 - RNA, 13 nt, Human
ggaacucagaucc

SEQ ID NO: 2622975 - RNA, 15 nt, Human
ggaacucagauccag

SEQ ID NO: 2622976 - RNA, 16 nt, Human
ggaacucagauccagg

SEQ ID NO: 2622977 - RNA, 17 nt, Human
ggaacucagauccaggg

SEQ ID NO: 2622978 - RNA, 19 nt, Human
ggaacucagauccagggac

SEQ ID NO: 2622979 - RNA, 20 nt, Human
ggaacucagauccagggaca

SEQ ID NO: 2622980 - RNA, 21 nt, Human
ggaacucauuccugccugucu

SEQ ID NO: 2622981 - RNA, 11 nt, Human
ggaacucccag

SEQ ID NO: 2622982 - RNA, 14 nt, Human
ggaaccucagccug

SEQ ID NO: 2622983 - RNA, 15 nt, Human
ggaaccucagccugg

SEQ ID NO: 2622984 - RNA, 16 nt, Human
ggaaccucagccuggc

SEQ ID NO: 2622985 - RNA, 19 nt, Human
ggaaccucagccuggccag

SEQ ID NO: 2622986 - RNA, 20 nt, Human
ggaaccucagccuggccaga

SEQ ID NO: 2622987 - RNA, 21 nt, Human
ggaaccucagccuggccagac

SEQ ID NO: 2622988 - RNA, 23 nt, Human
ggaaccucagccuggccagacac

SEQ ID NO: 2622989 - RNA, 22 nt, Human
ggaaccucagccuggccagaca

SEQ ID NO: 2622990 - RNA, 18 nt, Human
ggaacgggguccuucaag

SEQ ID NO: 2622991 - RNA, 20 nt, Human
ggaacgguaaauuucugugg

SEQ ID NO: 2622992 - RNA, 20 nt, Human
ggaacagacuggaagcacag

SEQ ID NO: 2622993 - RNA, 19 nt, Human
ggaacagacuggaagcaca

SEQ ID NO: 2622994 - RNA, 16 nt, Human
ggaaaucaaauaugca

SEQ ID NO: 2622995 - RNA, 19 nt, Human
ggaacagcuaugggagccc

SEQ ID NO: 2622996 - RNA, 21 nt, Human
ggaaccccggggugcccacag

SEQ ID NO: 2622997 - RNA, 20 nt, Human
ggaacagcuaugggagcccc

SEQ ID NO: 2622998 - RNA, 24 nt, Human
ggaacccuuacaguaggagcccag

SEQ ID NO: 2622999 - RNA, 12 nt, Human
ggaaccucagcc

SEQ ID NO: 2623000 - RNA, 13 nt, Human
ggaaccucagccu

SEQ ID NO: 2623001 - RNA, 18 nt, Human
ggaaccucacucuugcca

SEQ ID NO: 2623002 - RNA, 12 nt, Human
ggaaccucacuc

SEQ ID NO: 2623003 - RNA, 17 nt, Human
ggaaccgcaggaagcug

SEQ ID NO: 2623004 - RNA, 15 nt, Human
ggaaccgcaggaagc

SEQ ID NO: 2623005 - RNA, 16 nt, Human
ggaaccgcaggaagcu

SEQ ID NO: 2623006 - RNA, 18 nt, Human
ggaaccgcaggaagcugc

SEQ ID NO: 2623007 - RNA, 18 nt, Human
ggaagcagaauaaagcaa

SEQ ID NO: 2623008 - RNA, 17 nt, Human
ggaagcagaauaaagca

SEQ ID NO: 2623009 - RNA, 16 nt, Human
ggaagcagaauaaagc

SEQ ID NO: 2623010 - RNA, 15 nt, Human
ggaagcagaauaaag

SEQ ID NO: 2623011 - RNA, 14 nt, Human
ggaagcagaauaaa

SEQ ID NO: 2623012 - RNA, 13 nt, Human
ggaagcagaauaa

SEQ ID NO: 2623013 - RNA, 12 nt, Human
ggaagcagaaua

SEQ ID NO: 2623014 - RNA, 23 nt, Human
ggaagcacauguuuauuuauucu

SEQ ID NO: 2623015 - RNA, 22 nt, Human
ggaagcagaauaaagcaauuuu

SEQ ID NO: 2623016 - RNA, 21 nt, Human
ggaagcagaauaaagcaauuu

SEQ ID NO: 2623017 - RNA, 20 nt, Human
ggaagcagaauaaagcaauu

SEQ ID NO: 2623018 - RNA, 19 nt, Human
ggaagcagaauaaagcaau

SEQ ID NO: 2623019 - RNA, 22 nt, Human
ggaagcagauacauaugagugu

SEQ ID NO: 2623020 - RNA, 19 nt, Human
ggaagcagugccuuccaua

SEQ ID NO: 2623021 - RNA, 20 nt, Human
ggaagcagugccuuccauaa

SEQ ID NO: 2623022 - RNA, 21 nt, Human
ggaagcagugccuuccauaau

SEQ ID NO: 2623023 - RNA, 12 nt, Human
ggaagcagugcc

SEQ ID NO: 2623024 - RNA, 13 nt, Human
ggaagcagcuuuc

SEQ ID NO: 2623025 - RNA, 11 nt, Human
ggaagcagugc

SEQ ID NO: 2623026 - RNA, 22 nt, Human
ggaagcacaugccucucucagg

SEQ ID NO: 2623027 - RNA, 21 nt, Human
ggaagcacaugccucucucag

SEQ ID NO: 2623028 - RNA, 23 nt, Human
ggaagcacaugccucucucaggc

SEQ ID NO: 2623029 - RNA, 22 nt, Human
ggaagcaccccaugccaaagcu

SEQ ID NO: 2623030 - RNA, 13 nt, Human
ggaagcaccccau

SEQ ID NO: 2623031 - RNA, 15 nt, Human
ggaagcaccccaugc

SEQ ID NO: 2623032 - RNA, 18 nt, Human
ggaagccagcaggcucuc

SEQ ID NO: 2623033 - RNA, 17 nt, Human
ggaagccagcaggcucu

SEQ ID NO: 2623034 - RNA, 16 nt, Human
ggaagccagcaggcuc

SEQ ID NO: 2623035 - RNA, 15 nt, Human
ggaagccagcaggcu

SEQ ID NO: 2623036 - RNA, 14 nt, Human
ggaagccagcaggc

SEQ ID NO: 2623037 - RNA, 13 nt, Human
ggaagccagcagg

SEQ ID NO: 2623038 - RNA, 22 nt, Human
ggaagccaaaauguaggcuuag

SEQ ID NO: 2623039 - RNA, 22 nt, Human
ggaagccaaaccucugugagca

SEQ ID NO: 2623040 - RNA, 18 nt, Human
ggaagccaacuuggcuuu

SEQ ID NO: 2623041 - RNA, 14 nt, Human
ggaagccaaagagu

SEQ ID NO: 2623042 - RNA, 18 nt, Human
ggaagcauucagagagca

SEQ ID NO: 2623043 - RNA, 16 nt, Human
ggaagcauucagagag

SEQ ID NO: 2623044 - RNA, 20 nt, Human
ggaagcauucagagagcagc

SEQ ID NO: 2623045 - RNA, 20 nt, Human
ggaagcauauuguuauuaua

SEQ ID NO: 2623046 - RNA, 17 nt, Human
ggaagcauguaggagaa

SEQ ID NO: 2623047 - RNA, 20 nt, Human
ggaagcauguaggagaaucc

SEQ ID NO: 2623048 - RNA, 21 nt, Human
ggaagcauguaggagaaucca

SEQ ID NO: 2623049 - RNA, 14 nt, Human
ggaagaggggacag

SEQ ID NO: 2623050 - RNA, 15 nt, Human
ggaagaguguacugg

SEQ ID NO: 2623051 - RNA, 16 nt, Human
ggaagaguguacuggg

SEQ ID NO: 2623052 - RNA, 20 nt, Human
ggaagaggggacaggucccu

SEQ ID NO: 2623053 - RNA, 19 nt, Human
ggaagaguguacugggggu

SEQ ID NO: 2623054 - RNA, 18 nt, Human
ggaagauaggcucugcac

SEQ ID NO: 2623055 - RNA, 17 nt, Human
ggaagauaggcucugca

SEQ ID NO: 2623056 - RNA, 21 nt, Human
ggaagauaggcucugcacaga

SEQ ID NO: 2623057 - RNA, 15 nt, Human
ggaagagggacagau

SEQ ID NO: 2623058 - RNA, 13 nt, Human
ggaagagccuugc

SEQ ID NO: 2623059 - RNA, 17 nt, Human
ggaagagcacagcccuc

SEQ ID NO: 2623060 - RNA, 16 nt, Human
ggaagagcacagcccu

SEQ ID NO: 2623061 - RNA, 14 nt, Human
ggaagagcacagcc

SEQ ID NO: 2623062 - RNA, 22 nt, Human
ggaagagaggaguucaaugauc

SEQ ID NO: 2623063 - RNA, 19 nt, Human
ggaagagcacagcccuccc

SEQ ID NO: 2623064 - RNA, 18 nt, Human
ggaagagcacagcccucc

SEQ ID NO: 2623065 - RNA, 19 nt, Human
ggaagagcagaacggagcc

SEQ ID NO: 2623066 - RNA, 21 nt, Human
ggaagagcaggcacauggagg

SEQ ID NO: 2623067 - RNA, 15 nt, Human
ggaagagcaggcaca

SEQ ID NO: 2623068 - RNA, 14 nt, Human
ggaagagcaggcac

SEQ ID NO: 2623069 - RNA, 22 nt, Human
ggaacucccagcaacacaagcu

SEQ ID NO: 2623070 - RNA, 13 nt, Human
ggaacucccagca

SEQ ID NO: 2623071 - RNA, 22 nt, Human
ggaacucauuccugccugucuc

SEQ ID NO: 2623072 - RNA, 23 nt, Human
ggaagagaggaguucaaugaucu

SEQ ID NO: 2623073 - RNA, 15 nt, Human
ggaacuccuggaaau

SEQ ID NO: 2623074 - RNA, 17 nt, Human
ggaagcacaugccucuc

SEQ ID NO: 2623075 - RNA, 15 nt, Human
ggaagcacaugccuc

SEQ ID NO: 2623076 - RNA, 14 nt, Human
ggaagcacaugccu

SEQ ID NO: 2623077 - RNA, 13 nt, Human
ggaagcacaugcc

SEQ ID NO: 2623078 - RNA, 17 nt, Human
ggaagcacagcuucauu

SEQ ID NO: 2623079 - RNA, 22 nt, Human
ggaagaugggggcaagaagauc

SEQ ID NO: 2623080 - RNA, 20 nt, Human
ggaagaugggggcaagaaga

SEQ ID NO: 2623081 - RNA, 19 nt, Human
ggaagaugggggcaagaag

SEQ ID NO: 2623082 - RNA, 18 nt, Human
ggaagauuuuaaauucac

SEQ ID NO: 2623083 - RNA, 22 nt, Human
ggaagauccugcggguggggcu

SEQ ID NO: 2623084 - RNA, 12 nt, Human
ggaagauccugc

SEQ ID NO: 2623085 - RNA, 18 nt, Human
ggaagaugggggcaagaa

SEQ ID NO: 2623086 - RNA, 23 nt, Human
ggaagaucuuaaauuuugugaua

SEQ ID NO: 2623087 - RNA, 22 nt, Human
ggaagaucuuaaauuuugugau

SEQ ID NO: 2623088 - RNA, 20 nt, Human
gcugggacuacaggcaccca

SEQ ID NO: 2623089 - RNA, 19 nt, Human
gcugggacuacaggcaccc

SEQ ID NO: 2623090 - RNA, 18 nt, Human
gcugggacuacaggcacc

SEQ ID NO: 2623091 - RNA, 13 nt, Human
gcugggacuacag

SEQ ID NO: 2623092 - RNA, 21 nt, Human
gcugggacguggcucagccag

SEQ ID NO: 2623093 - RNA, 22 nt, Human
gcugggacguggcucagccagc

SEQ ID NO: 2623094 - RNA, 12 nt, Human
gcugggacucag

SEQ ID NO: 2623095 - RNA, 19 nt, Human
gcugggacuacagguguga

SEQ ID NO: 2623096 - RNA, 19 nt, Human
gcugggacucagccuucag

SEQ ID NO: 2623097 - RNA, 16 nt, Human
gcugggacucagccuu

SEQ ID NO: 2623098 - RNA, 15 nt, Human
gcugggacucagccu

SEQ ID NO: 2623099 - RNA, 14 nt, Human
gcugggacucagcc

SEQ ID NO: 2623100 - RNA, 23 nt, Human
gcugggacucagccuucagacag

SEQ ID NO: 2623101 - RNA, 22 nt, Human
gcugggacucagccuucagaca

SEQ ID NO: 2623102 - RNA, 15 nt, Human
gcugggacugagcca

SEQ ID NO: 2623103 - RNA, 14 nt, Human
gcugggacugagcc

SEQ ID NO: 2623104 - RNA, 14 nt, Human
gcugggacuggcca

SEQ ID NO: 2623105 - RNA, 23 nt, Human
gcuggccucuggcucucaugggg

SEQ ID NO: 2623106 - RNA, 18 nt, Human
gcuggccucuggcucuca

SEQ ID NO: 2623107 - RNA, 14 nt, Human
gcuggccuggaucu

SEQ ID NO: 2623108 - RNA, 12 nt, Human
gcuggccuggau

SEQ ID NO: 2623109 - RNA, 19 nt, Human
gcugggacguggcucagcc

SEQ ID NO: 2623110 - RNA, 20 nt, Human
gcugggacguggcucagcca

SEQ ID NO: 2623111 - RNA, 17 nt, Human
gcugggacguggcucag

SEQ ID NO: 2623112 - RNA, 15 nt, Human
gcuggccuggaucuc

SEQ ID NO: 2623113 - RNA, 20 nt, Human
gcugggacaugggaaagggg

SEQ ID NO: 2623114 - RNA, 13 nt, Human
gcuggccgggacc

SEQ ID NO: 2623115 - RNA, 22 nt, Human
gcuggccggagcaaacucugcu

SEQ ID NO: 2623116 - RNA, 12 nt, Human
gcuggcccugcc

SEQ ID NO: 2623117 - RNA, 22 nt, Human
gcuggcccgugacagacuccug

SEQ ID NO: 2623118 - RNA, 19 nt, Human
gcuggcccgugacagacuc

SEQ ID NO: 2623119 - RNA, 17 nt, Human
gcuggcccgugacagac

SEQ ID NO: 2623120 - RNA, 20 nt, Human
gcuggccccucaccugggca

SEQ ID NO: 2623121 - RNA, 17 nt, Human
gcuggccgggagccuga

SEQ ID NO: 2623122 - RNA, 18 nt, Human
gcuggccgugggccuggg

SEQ ID NO: 2623123 - RNA, 22 nt, Human
gcuggccucccaaaugagccau

SEQ ID NO: 2623124 - RNA, 21 nt, Human
gcuggccucccaaaugagcca

SEQ ID NO: 2623125 - RNA, 22 nt, Human
gcuggaccuugaacuggguacu

SEQ ID NO: 2623126 - RNA, 21 nt, Human
gcuggaccuugaacuggguac

SEQ ID NO: 2623127 - RNA, 15 nt, Human
gcuggaugauggucu

SEQ ID NO: 2623128 - RNA, 20 nt, Human
gcuggaugagaauuugagug

SEQ ID NO: 2623129 - RNA, 20 nt, Human
gcuggaugagacuuccaaac

SEQ ID NO: 2623130 - RNA, 13 nt, Human
gcugcuuggccuu

SEQ ID NO: 2623131 - RNA, 21 nt, Human
gcuggaugucugccaauuuuu

SEQ ID NO: 2623132 - RNA, 18 nt, Human
gcuggaugucugccaauu

SEQ ID NO: 2623133 - RNA, 18 nt, Human
gcuggauggagcccaggc

SEQ ID NO: 2623134 - RNA, 16 nt, Human
gcuggauggagcccag

SEQ ID NO: 2623135 - RNA, 21 nt, Human
gcuggaugcuccuuccaacag

SEQ ID NO: 2623136 - RNA, 14 nt, Human
gcuggauggagccc

SEQ ID NO: 2623137 - RNA, 22 nt, Human
gcuggaugcuccuuccaacagg

SEQ ID NO: 2623138 - RNA, 22 nt, Human
gcugcuugggcuucauccuccu

SEQ ID NO: 2623139 - RNA, 17 nt, Human
gcugcuugggcuucauc

SEQ ID NO: 2623140 - RNA, 18 nt, Human
gcuggaccuugaacuggg

SEQ ID NO: 2623141 - RNA, 22 nt, Human
gcugcuugcccccaugcuggcg

SEQ ID NO: 2623142 - RNA, 12 nt, Human
gcugcuugcccc

SEQ ID NO: 2623143 - RNA, 21 nt, Human
gcugcuucuuaaccccaguaa

SEQ ID NO: 2623144 - RNA, 16 nt, Human
gcuggaccuugaacug

SEQ ID NO: 2623145 - RNA, 23 nt, Human
gcuggcccagccggccucucugg

SEQ ID NO: 2623146 - RNA, 20 nt, Human
gcuggcccagccggccucuc

SEQ ID NO: 2623147 - RNA, 19 nt, Human
gcuggcccagccggccucu

SEQ ID NO: 2623148 - RNA, 18 nt, Human
gcuggcccagccggccuc

SEQ ID NO: 2623149 - RNA, 17 nt, Human
gcuggcccagccggccu

SEQ ID NO: 2623150 - RNA, 16 nt, Human
gcuggcccagccggcc

SEQ ID NO: 2623151 - RNA, 13 nt, Human
gcuggcccagccg

SEQ ID NO: 2623152 - RNA, 20 nt, Human
gcuggcccagcccugcuggc

SEQ ID NO: 2623153 - RNA, 13 nt, Human
gcuggcccagggc

SEQ ID NO: 2623154 - RNA, 15 nt, Human
gcuggcccagggccc

SEQ ID NO: 2623155 - RNA, 16 nt, Human
gcuggcccagggccca

SEQ ID NO: 2623156 - RNA, 17 nt, Human
gcuggcccagggcccag

SEQ ID NO: 2623157 - RNA, 20 nt, Human
gcuggcaaagguggcucucc

SEQ ID NO: 2623158 - RNA, 15 nt, Human
gcuggcaaagguggc

SEQ ID NO: 2623159 - RNA, 19 nt, Human
gcuggcccagcccugcugg

SEQ ID NO: 2623160 - RNA, 17 nt, Human
gcuggcccagcccugcu

SEQ ID NO: 2623161 - RNA, 16 nt, Human
gcuggcccagcccugc

SEQ ID NO: 2623162 - RNA, 22 nt, Human
gcuggauuggguuaugaauauu

SEQ ID NO: 2623163 - RNA, 22 nt, Human
gcuggaugucugccaauuuuug

SEQ ID NO: 2623164 - RNA, 15 nt, Human
gcuggcaaagacaga

SEQ ID NO: 2623165 - RNA, 19 nt, Human
gcuggcaaagacagaagcc

SEQ ID NO: 2623166 - RNA, 16 nt, Human
gcuggauuacaggcau

SEQ ID NO: 2623167 - RNA, 21 nt, Human
gcuggcccagggcccagagcc

SEQ ID NO: 2623168 - RNA, 18 nt, Human
gcuggcccagggcccaga

SEQ ID NO: 2623169 - RNA, 19 nt, Human
gcuggcccagggcccagag

SEQ ID NO: 2623170 - RNA, 14 nt, Human
gcuggccccucacc

SEQ ID NO: 2623171 - RNA, 19 nt, Human
gcuggccccucaccugggc

SEQ ID NO: 2623172 - RNA, 23 nt, Human
gcuggccccucaccugggcaccu

SEQ ID NO: 2623173 - RNA, 11 nt, Human
gcuggccccuc

SEQ ID NO: 2623174 - RNA, 12 nt, Human
gcuggccccuca

SEQ ID NO: 2623175 - RNA, 24 nt, Human
gcuggccccgccgccugguacuca

SEQ ID NO: 2623176 - RNA, 23 nt, Human
gcuggccccgccgccugguacuc

SEQ ID NO: 2623177 - RNA, 22 nt, Human
gcuggccccgccgccugguacu

SEQ ID NO: 2623178 - RNA, 20 nt, Human
gcuggcccagggcccagagc

SEQ ID NO: 2623179 - RNA, 13 nt, Human
gcuggccccgccg

SEQ ID NO: 2623180 - RNA, 22 nt, Human
gcugcuucaaggauccugagcc

SEQ ID NO: 2623181 - RNA, 21 nt, Human
gcugcuucaaggauccugagc

SEQ ID NO: 2623182 - RNA, 20 nt, Human
gcugcuuagaauccaaacuu

SEQ ID NO: 2623183 - RNA, 18 nt, Human
gcugcuuagacauaacaa

SEQ ID NO: 2623184 - RNA, 23 nt, Human
gcugcuucaaggauccugagcca

SEQ ID NO: 2623185 - RNA, 21 nt, Human
gcugcuucucccacuuggcca

SEQ ID NO: 2623186 - RNA, 17 nt, Human
gcugcuuccuccuggaa

SEQ ID NO: 2623187 - RNA, 16 nt, Human
gcugcuugggcuucau

SEQ ID NO: 2623188 - RNA, 16 nt, Human
gcugcuuccuccugga

SEQ ID NO: 2623189 - RNA, 15 nt, Human
gcugcuuccuccugg

SEQ ID NO: 2623190 - RNA, 14 nt, Human
gcugcuuccuccug

SEQ ID NO: 2623191 - RNA, 13 nt, Human
gcugcuuccuccu

SEQ ID NO: 2623192 - RNA, 12 nt, Human
gcugcuucccuc

SEQ ID NO: 2623193 - RNA, 14 nt, Human
gcugcuucccucug

SEQ ID NO: 2623194 - RNA, 15 nt, Human
gcugcuucccucugc

SEQ ID NO: 2623195 - RNA, 20 nt, Human
gcugcuucccucugccuguc

SEQ ID NO: 2623196 - RNA, 21 nt, Human
gcugcuucccucugccugucc

SEQ ID NO: 2623197 - RNA, 22 nt, Human
gcugcuucccucugccuguccc

SEQ ID NO: 2623198 - RNA, 23 nt, Human
gcugcuucccucugccugucccu

SEQ ID NO: 2623199 - RNA, 18 nt, Human
gcugcgguccacccagga

SEQ ID NO: 2623200 - RNA, 17 nt, Human
gcugcgguccacccagg

SEQ ID NO: 2623201 - RNA, 19 nt, Human
gcugcgguccacccaggag

SEQ ID NO: 2623202 - RNA, 16 nt, Human
gcugcuagagccagca

SEQ ID NO: 2623203 - RNA, 19 nt, Human
gcugcuagcacuuggagcc

SEQ ID NO: 2623204 - RNA, 17 nt, Human
gcugcuauagccugggg

SEQ ID NO: 2623205 - RNA, 20 nt, Human
gcugcuagcacuuggagcca

SEQ ID NO: 2623206 - RNA, 23 nt, Human
gcugcuagcacuuggagccaagg

SEQ ID NO: 2623207 - RNA, 15 nt, Human
gcugcuauagccugg

SEQ ID NO: 2623208 - RNA, 16 nt, Human
gcugcuauagccuggg

SEQ ID NO: 2623209 - RNA, 23 nt, Human
gcugcucacuaccuccucaggga

SEQ ID NO: 2623210 - RNA, 21 nt, Human
gcugcucacuaccuccucagg

SEQ ID NO: 2623211 - RNA, 20 nt, Human
gcugcucagggaaaagcagc

SEQ ID NO: 2623212 - RNA, 13 nt, Human
gcugcuucaagga

SEQ ID NO: 2623213 - RNA, 19 nt, Human
gcugcucaucugauuuuug

SEQ ID NO: 2623214 - RNA, 21 nt, Human
gcugcucagggaaaagcagcu

SEQ ID NO: 2623215 - RNA, 21 nt, Human
gcuagaggccagccccaccca

SEQ ID NO: 2623216 - RNA, 18 nt, Human
gcuagaggccagccccac

SEQ ID NO: 2623217 - RNA, 19 nt, Human
gcuagaggccagccccacc

SEQ ID NO: 2623218 - RNA, 20 nt, Human
gcuagaggccagccccaccc

SEQ ID NO: 2623219 - RNA, 18 nt, Human
gcuagauguauguacuuc

SEQ ID NO: 2623220 - RNA, 11 nt, Human
gcugcccugug

SEQ ID NO: 2623221 - RNA, 22 nt, Human
gcugcccuggugcugccacacu

SEQ ID NO: 2623222 - RNA, 20 nt, Human
gcugcccuggugcugccaca

SEQ ID NO: 2623223 - RNA, 19 nt, Human
gcugcccuggugcugccac

SEQ ID NO: 2623224 - RNA, 18 nt, Human
gcugcccuggugcugcca

SEQ ID NO: 2623225 - RNA, 22 nt, Human
gcuagcagcagggagggcuucu

SEQ ID NO: 2623226 - RNA, 17 nt, Human
gcuagcacuuggagcca

SEQ ID NO: 2623227 - RNA, 23 nt, Human
gcuagcagaaaucuagaagacug

SEQ ID NO: 2623228 - RNA, 16 nt, Human
gcugcgcuugcuuuuc

SEQ ID NO: 2623229 - RNA, 15 nt, Human
gcugcgcuugcuuuu

SEQ ID NO: 2623230 - RNA, 19 nt, Human
gcugcgcccuuaccuuccc

SEQ ID NO: 2623231 - RNA, 16 nt, Human
gcugcgcccugggcuc

SEQ ID NO: 2623232 - RNA, 16 nt, Human
gcugcgguccacccag

SEQ ID NO: 2623233 - RNA, 15 nt, Human
gcugcgcccugggcu

SEQ ID NO: 2623234 - RNA, 20 nt, Human
gcugccuuuagucgcugagg

SEQ ID NO: 2623235 - RNA, 21 nt, Human
gcugccuuggcucagacaugu

SEQ ID NO: 2623236 - RNA, 23 nt, Human
gcugccuuggcucagacauguuu

SEQ ID NO: 2623237 - RNA, 17 nt, Human
gcugccuuggcucagac

SEQ ID NO: 2623238 - RNA, 19 nt, Human
gcugccuuggcucagacau

SEQ ID NO: 2623239 - RNA, 16 nt, Human
gcugccuuggcucaga

SEQ ID NO: 2623240 - RNA, 14 nt, Human
gcugccuuggcuca

SEQ ID NO: 2623241 - RNA, 14 nt, Human
gcugcccugugagu

SEQ ID NO: 2623242 - RNA, 12 nt, Human
gcugcccuguga

SEQ ID NO: 2623243 - RNA, 17 nt, Human
gcugcccuuucugggca

SEQ ID NO: 2623244 - RNA, 16 nt, Human
gcugccgaccagagcc

SEQ ID NO: 2623245 - RNA, 17 nt, Human
gcugccgaccagagccc

SEQ ID NO: 2623246 - RNA, 23 nt, Human
gcugcccuggugcugccacacuu

SEQ ID NO: 2623247 - RNA, 18 nt, Human
gcugcccuguaccccagc

SEQ ID NO: 2623248 - RNA, 17 nt, Human
gcugggauuacaggcgu

SEQ ID NO: 2623249 - RNA, 18 nt, Human
gcugggauuacaggcgug

SEQ ID NO: 2623250 - RNA, 19 nt, Human
gcugggauuacaggcuccu

SEQ ID NO: 2623251 - RNA, 20 nt, Human
gcugggauuacaggcuccug

SEQ ID NO: 2623252 - RNA, 15 nt, Human
gcugggcuggggccu

SEQ ID NO: 2623253 - RNA, 22 nt, Human
gcugggaggagggagagggagg

SEQ ID NO: 2623254 - RNA, 18 nt, Human
gcugggaggagggagagg

SEQ ID NO: 2623255 - RNA, 14 nt, Human
gcugggcuggggcc

SEQ ID NO: 2623256 - RNA, 17 nt, Human
gcugggcuucaguggca

SEQ ID NO: 2623257 - RNA, 17 nt, Human
gcugggaggagggagag

SEQ ID NO: 2623258 - RNA, 16 nt, Human
gcugggaggagggaga

SEQ ID NO: 2623259 - RNA, 21 nt, Human
gcugggaugauuggagggggg

SEQ ID NO: 2623260 - RNA, 21 nt, Human
gcugggagcuccacucugcuu

SEQ ID NO: 2623261 - RNA, 20 nt, Human
gcugggagcuccacucugcu

SEQ ID NO: 2623262 - RNA, 15 nt, Human
gcugggagcucugca

SEQ ID NO: 2623263 - RNA, 13 nt, Human
gcugggagcugaa

SEQ ID NO: 2623264 - RNA, 22 nt, Human
gcugggagcuccacucugcuuc

SEQ ID NO: 2623265 - RNA, 16 nt, Human
gcugggagcucugcag

SEQ ID NO: 2623266 - RNA, 18 nt, Human
gcugggagagccuuccag

SEQ ID NO: 2623267 - RNA, 17 nt, Human
gcugggagagccuucca

SEQ ID NO: 2623268 - RNA, 13 nt, Human
gcugggagagccu

SEQ ID NO: 2623269 - RNA, 12 nt, Human
gcugggagagcc

SEQ ID NO: 2623270 - RNA, 22 nt, Human
gcugggagagccuuccaggggu

SEQ ID NO: 2623271 - RNA, 19 nt, Human
gcugggagagccuuccagg

SEQ ID NO: 2623272 - RNA, 18 nt, Human
gcugggagcuccacucug

SEQ ID NO: 2623273 - RNA, 16 nt, Human
gcugggagcuccacuc

SEQ ID NO: 2623274 - RNA, 14 nt, Human
gcugggagcuccac

SEQ ID NO: 2623275 - RNA, 13 nt, Human
gcugggagcucca

SEQ ID NO: 2623276 - RNA, 17 nt, Human
gcugggacugagccagu

SEQ ID NO: 2623277 - RNA, 15 nt, Human
gcugggacuggccag

SEQ ID NO: 2623278 - RNA, 16 nt, Human
gcugggacuggccagg

SEQ ID NO: 2623279 - RNA, 15 nt, Human
gcuggggcugaccuu

SEQ ID NO: 2623280 - RNA, 19 nt, Human
gcuggggcguggggagggc

SEQ ID NO: 2623281 - RNA, 18 nt, Human
gcuggggcguggggaggg

SEQ ID NO: 2623282 - RNA, 13 nt, Human
gcugggggcagga

SEQ ID NO: 2623283 - RNA, 20 nt, Human
gcugggggcaggagggcccu

SEQ ID NO: 2623284 - RNA, 23 nt, Human
gcugggggcaggagggcccuacc

SEQ ID NO: 2623285 - RNA, 16 nt, Human
gcugggggccaugagc

SEQ ID NO: 2623286 - RNA, 23 nt, Human
gcugggggccaugagcuccagac

SEQ ID NO: 2623287 - RNA, 20 nt, Human
gcugggggccucagugccac

SEQ ID NO: 2623288 - RNA, 19 nt, Human
gcugggggccucagugcca

SEQ ID NO: 2623289 - RNA, 19 nt, Human
gcuggucccacucagucca

SEQ ID NO: 2623290 - RNA, 15 nt, Human
gcuggucccacucag

SEQ ID NO: 2623291 - RNA, 19 nt, Human
gcugggggugggccaggcu

SEQ ID NO: 2623292 - RNA, 15 nt, Human
gcugggggugggcca

SEQ ID NO: 2623293 - RNA, 18 nt, Human
gcugggggugggccaggc

SEQ ID NO: 2623294 - RNA, 13 nt, Human
gcugggggccuca

SEQ ID NO: 2623295 - RNA, 19 nt, Human
gcuggggccaggcuggguc

SEQ ID NO: 2623296 - RNA, 16 nt, Human
gcuggggccaggcugg

SEQ ID NO: 2623297 - RNA, 19 nt, Human
gcugggcuucaguggcagc

SEQ ID NO: 2623298 - RNA, 18 nt, Human
gcugggcuucaguggcag

SEQ ID NO: 2623299 - RNA, 15 nt, Human
gcugggcugggugcg

SEQ ID NO: 2623300 - RNA, 14 nt, Human
gcugggcugggugc

SEQ ID NO: 2623301 - RNA, 12 nt, Human
gcugggcugggu

SEQ ID NO: 2623302 - RNA, 17 nt, Human
gcugggcuggggccuga

SEQ ID NO: 2623303 - RNA, 21 nt, Human
gcuggggccuaucagugugcc

SEQ ID NO: 2623304 - RNA, 20 nt, Human
gcuggggccuaucagugugc

SEQ ID NO: 2623305 - RNA, 12 nt, Human
gcuggggccagu

SEQ ID NO: 2623306 - RNA, 17 nt, Human
gcuggggcguggggagg

SEQ ID NO: 2623307 - RNA, 15 nt, Human
gcuggggccugaugg

SEQ ID NO: 2623308 - RNA, 12 nt, Human
gcuggggccuga

SEQ ID NO: 2623309 - RNA, 19 nt, Human
gcuggggccugauggggag

SEQ ID NO: 2623310 - RNA, 23 nt, Human
gcugggggaagaagcucucuccu

SEQ ID NO: 2623311 - RNA, 16 nt, Human
gcuguguaaaguuagu

SEQ ID NO: 2623312 - RNA, 15 nt, Human
gcuguguaaaguuag

SEQ ID NO: 2623313 - RNA, 14 nt, Human
gcuguguaaaguua

SEQ ID NO: 2623314 - RNA, 13 nt, Human
gcuguguaaaguu

SEQ ID NO: 2623315 - RNA, 11 nt, Human
gcuguguaaag

SEQ ID NO: 2623316 - RNA, 12 nt, Human
gcuguguaaagu

SEQ ID NO: 2623317 - RNA, 14 nt, Human
gcuguguaucugau

SEQ ID NO: 2623318 - RNA, 22 nt, Human
gcuguguacacugacaccuuug

SEQ ID NO: 2623319 - RNA, 18 nt, Human
gcuguguaaaguuagucu

SEQ ID NO: 2623320 - RNA, 17 nt, Human
gcuguguaaaguuaguc

SEQ ID NO: 2623321 - RNA, 19 nt, Human
gcuguguaaaguuagucua

SEQ ID NO: 2623322 - RNA, 14 nt, Human
gcuguguccuugca

SEQ ID NO: 2623323 - RNA, 18 nt, Human
gcuguguccuugcaccug

SEQ ID NO: 2623324 - RNA, 19 nt, Human
gcuguguccuugcaccugc

SEQ ID NO: 2623325 - RNA, 20 nt, Human
gcuguguccuugcaccugca

SEQ ID NO: 2623326 - RNA, 21 nt, Human
gcuguguccuugcaccugcau

SEQ ID NO: 2623327 - RNA, 17 nt, Human
gcugucuggccaggccu

SEQ ID NO: 2623328 - RNA, 19 nt, Human
gcugucugaucugugcuuu

SEQ ID NO: 2623329 - RNA, 13 nt, Human
gcugucuggccag

SEQ ID NO: 2623330 - RNA, 20 nt, Human
gcugucuucucaggcucugc

SEQ ID NO: 2623331 - RNA, 22 nt, Human
gcugucuucucaggcucugccc

SEQ ID NO: 2623332 - RNA, 17 nt, Human
gcugucuccauguuuga

SEQ ID NO: 2623333 - RNA, 22 nt, Human
gcugucugaucugugcuuucca

SEQ ID NO: 2623334 - RNA, 18 nt, Human
gcugucugaucugugcuu

SEQ ID NO: 2623335 - RNA, 17 nt, Human
gcugucugaucugugcu

SEQ ID NO: 2623336 - RNA, 15 nt, Human
gcugucccugucacc

SEQ ID NO: 2623337 - RNA, 18 nt, Human
gcugucccugucaccaag

SEQ ID NO: 2623338 - RNA, 23 nt, Human
gcugucaauuacaggaaguacug

SEQ ID NO: 2623339 - RNA, 22 nt, Human
gcugucaauuacaggaaguacu

SEQ ID NO: 2623340 - RNA, 19 nt, Human
gcugucaauuacaggaagu

SEQ ID NO: 2623341 - RNA, 17 nt, Human
gcugucaauuacaggaa

SEQ ID NO: 2623342 - RNA, 15 nt, Human
gcugucccucccccu

SEQ ID NO: 2623343 - RNA, 13 nt, Human
gcugucacaggcg

SEQ ID NO: 2623344 - RNA, 19 nt, Human
gcugucccuuacgugaguc

SEQ ID NO: 2623345 - RNA, 21 nt, Human
gcugucccuuacgugaguccu

SEQ ID NO: 2623346 - RNA, 22 nt, Human
gcugucccuuacgugaguccug

SEQ ID NO: 2623347 - RNA, 16 nt, Human
gcugucccucccccuu

SEQ ID NO: 2623348 - RNA, 13 nt, Human
gcugucccucacu

SEQ ID NO: 2623349 - RNA, 14 nt, Human
gcugucccugucac

SEQ ID NO: 2623350 - RNA, 20 nt, Human
gcuggucccacucaguccau

SEQ ID NO: 2623351 - RNA, 14 nt, Human
gcuggucccacuca

SEQ ID NO: 2623352 - RNA, 15 nt, Human
gcuggugcuguggcc

SEQ ID NO: 2623353 - RNA, 19 nt, Human
gcuggugcuguggccaggg

SEQ ID NO: 2623354 - RNA, 17 nt, Human
gcuggugcuguggccag

SEQ ID NO: 2623355 - RNA, 12 nt, Human
gcugguggccca

SEQ ID NO: 2623356 - RNA, 13 nt, Human
gcugguggcccag

SEQ ID NO: 2623357 - RNA, 18 nt, Human
gcugguguccugaccacc

SEQ ID NO: 2623358 - RNA, 17 nt, Human
gcugguguccugaccac

SEQ ID NO: 2623359 - RNA, 16 nt, Human
gcugguguccugacca

SEQ ID NO: 2623360 - RNA, 15 nt, Human
gcugguguccugacc

SEQ ID NO: 2623361 - RNA, 13 nt, Human
gcuggugguuuca

SEQ ID NO: 2623362 - RNA, 14 nt, Human
gcuggugggagggg

SEQ ID NO: 2623363 - RNA, 12 nt, Human
gcuggugguuuc

SEQ ID NO: 2623364 - RNA, 18 nt, Human
gcuggugucaccugaaga

SEQ ID NO: 2623365 - RNA, 16 nt, Human
gcuggugucaccugaa

SEQ ID NO: 2623366 - RNA, 14 nt, Human
gcugguggcccagg

SEQ ID NO: 2623367 - RNA, 15 nt, Human
gcugguggcccagga

SEQ ID NO: 2623368 - RNA, 15 nt, Human
gcugguggcucccgg

SEQ ID NO: 2623369 - RNA, 21 nt, Human
gcuggugggaagcgucugucc

SEQ ID NO: 2623370 - RNA, 13 nt, Human
gcuggugggaggg

SEQ ID NO: 2623371 - RNA, 12 nt, Human
gcuggugggagg

SEQ ID NO: 2623372 - RNA, 22 nt, Human
gcugguguccugaccacccucc

SEQ ID NO: 2623373 - RNA, 19 nt, Human
gcugguguccugaccaccc

SEQ ID NO: 2623374 - RNA, 21 nt, Human
gcugguuagagguucccuuug

SEQ ID NO: 2623375 - RNA, 15 nt, Human
gcugguucaggguug

SEQ ID NO: 2623376 - RNA, 22 nt, Human
gcuguauuuuaaaagaaugauu

SEQ ID NO: 2623377 - RNA, 22 nt, Human
gcugguucaggguuggccccug

SEQ ID NO: 2623378 - RNA, 16 nt, Human
gcugucaauuacagga

SEQ ID NO: 2623379 - RNA, 18 nt, Human
gcugucaaguuccuuugg

SEQ ID NO: 2623380 - RNA, 14 nt, Human
gcugguuagaaaug

SEQ ID NO: 2623381 - RNA, 20 nt, Human
gcugucaaaacaaguuuuuc

SEQ ID NO: 2623382 - RNA, 19 nt, Human
ggcagugagugagccuggc

SEQ ID NO: 2623383 - RNA, 18 nt, Human
ggcagugagugagccugg

SEQ ID NO: 2623384 - RNA, 16 nt, Human
ggcagugagugagccu

SEQ ID NO: 2623385 - RNA, 15 nt, Human
ggcagugagugagcc

SEQ ID NO: 2623386 - RNA, 16 nt, Human
ggcagugagggagggc

SEQ ID NO: 2623387 - RNA, 21 nt, Human
ggcagugagggagggcuguca

SEQ ID NO: 2623388 - RNA, 23 nt, Human
ggcauguucucugaggacacuaa

SEQ ID NO: 2623389 - RNA, 19 nt, Human
ggcauuagaauuauuuaaa

SEQ ID NO: 2623390 - RNA, 17 nt, Human
ggcauuagaauuauuua

SEQ ID NO: 2623391 - RNA, 20 nt, Human
ggcauuagaauuauuuaaac

SEQ ID NO: 2623392 - RNA, 20 nt, Human
ggcauuauguccacugugua

SEQ ID NO: 2623393 - RNA, 14 nt, Human
ggcagugccagggc

SEQ ID NO: 2623394 - RNA, 16 nt, Human
ggcagugccagggcag

SEQ ID NO: 2623395 - RNA, 18 nt, Human
ggcagugaugcuggaugc

SEQ ID NO: 2623396 - RNA, 15 nt, Human
ggcagguuggugggg

SEQ ID NO: 2623397 - RNA, 22 nt, Human
ggcaggugguggcacugagccc

SEQ ID NO: 2623398 - RNA, 21 nt, Human
ggcaggugguggcacugagcc

SEQ ID NO: 2623399 - RNA, 17 nt, Human
ggcaggugguggcacug

SEQ ID NO: 2623400 - RNA, 14 nt, Human
ggcaggugguggca

SEQ ID NO: 2623401 - RNA, 23 nt, Human
ggcagguggaggugucaggcugc

SEQ ID NO: 2623402 - RNA, 12 nt, Human
ggcaggugggag

SEQ ID NO: 2623403 - RNA, 16 nt, Human
ggcaggugggagcuug

SEQ ID NO: 2623404 - RNA, 17 nt, Human
ggcaggugggagcuuga

SEQ ID NO: 2623405 - RNA, 23 nt, Human
ggcagucgggggcuggccuagga

SEQ ID NO: 2623406 - RNA, 22 nt, Human
ggcagucgggggcuggccuagg

SEQ ID NO: 2623407 - RNA, 19 nt, Human
ggcagucugaauuuuuaaa

SEQ ID NO: 2623408 - RNA, 20 nt, Human
ggcagguuagaaccuagaag

SEQ ID NO: 2623409 - RNA, 16 nt, Human
ggcagguuagaaccua

SEQ ID NO: 2623410 - RNA, 21 nt, Human
ggcagucgggggcuggccuag

SEQ ID NO: 2623411 - RNA, 13 nt, Human
ggcagucuggagg

SEQ ID NO: 2623412 - RNA, 14 nt, Human
ggcagucuggaggg

SEQ ID NO: 2623413 - RNA, 16 nt, Human
ggcagucuggaggggc

SEQ ID NO: 2623414 - RNA, 21 nt, Human
ggcagucuggaggggcauggc

SEQ ID NO: 2623415 - RNA, 22 nt, Human
ggccaccugcggugcuaucucc

SEQ ID NO: 2623416 - RNA, 16 nt, Human
ggccaccugcggugcu

SEQ ID NO: 2623417 - RNA, 23 nt, Human
ggcauuccagcuccuccgugcuu

SEQ ID NO: 2623418 - RNA, 21 nt, Human
ggccacacuauuaccaugaga

SEQ ID NO: 2623419 - RNA, 22 nt, Human
ggccacacuauuaccaugagaa

SEQ ID NO: 2623420 - RNA, 14 nt, Human
ggccaccugccccc

SEQ ID NO: 2623421 - RNA, 22 nt, Human
ggccaccugcccccuucuccca

SEQ ID NO: 2623422 - RNA, 17 nt, Human
ggccacaagacccuugu

SEQ ID NO: 2623423 - RNA, 16 nt, Human
ggccacaagacccuug

SEQ ID NO: 2623424 - RNA, 15 nt, Human
ggcauuccccaggag

SEQ ID NO: 2623425 - RNA, 20 nt, Human
ggccaagugcaggcuggcac

SEQ ID NO: 2623426 - RNA, 12 nt, Human
ggccaaguucuu

SEQ ID NO: 2623427 - RNA, 11 nt, Human
ggccacuguga

SEQ ID NO: 2623428 - RNA, 19 nt, Human
ggccacugcacagagcucu

SEQ ID NO: 2623429 - RNA, 15 nt, Human
ggccacugcacagag

SEQ ID NO: 2623430 - RNA, 14 nt, Human
ggccacugaagaua

SEQ ID NO: 2623431 - RNA, 22 nt, Human
ggccacucugccucugccugca

SEQ ID NO: 2623432 - RNA, 14 nt, Human
ggccaccuuuucag

SEQ ID NO: 2623433 - RNA, 23 nt, Human
ggccaccugcccccuucucccac

SEQ ID NO: 2623434 - RNA, 16 nt, Human
ggccacucugccucug

SEQ ID NO: 2623435 - RNA, 15 nt, Human
ggccacucugccucu

SEQ ID NO: 2623436 - RNA, 20 nt, Human
ggccacucugccucugccug

SEQ ID NO: 2623437 - RNA, 21 nt, Human
ggccacucugccucugccugc

SEQ ID NO: 2623438 - RNA, 16 nt, Human
ggccaggagccuccug

SEQ ID NO: 2623439 - RNA, 19 nt, Human
ggccaggaguuugagacca

SEQ ID NO: 2623440 - RNA, 18 nt, Human
ggccacuggccaucucca

SEQ ID NO: 2623441 - RNA, 18 nt, Human
ggccacugcacagagcuc

SEQ ID NO: 2623442 - RNA, 13 nt, Human
ggccaggagcucu

SEQ ID NO: 2623443 - RNA, 14 nt, Human
ggccaggagccucc

SEQ ID NO: 2623444 - RNA, 16 nt, Human
ggccacugugaagaga

SEQ ID NO: 2623445 - RNA, 16 nt, Human
ggccaggccagaggga

SEQ ID NO: 2623446 - RNA, 14 nt, Human
ggccaggccagagg

SEQ ID NO: 2623447 - RNA, 12 nt, Human
ggccaggcaggu

SEQ ID NO: 2623448 - RNA, 11 nt, Human
ggccaggccac

SEQ ID NO: 2623449 - RNA, 22 nt, Human
ggccaggcagaucugugcccca

SEQ ID NO: 2623450 - RNA, 16 nt, Human
ggccaggauggagggg

SEQ ID NO: 2623451 - RNA, 15 nt, Human
ggccaggcagaucug

SEQ ID NO: 2623452 - RNA, 15 nt, Human
ggccaggagcucuuc

SEQ ID NO: 2623453 - RNA, 20 nt, Human
ggccaggaguuugagaccag

SEQ ID NO: 2623454 - RNA, 22 nt, Human
ggccaggcugggucgcccugga

SEQ ID NO: 2623455 - RNA, 18 nt, Human
ggccaggcugggucgccc

SEQ ID NO: 2623456 - RNA, 11 nt, Human
ggccaggcugg

SEQ ID NO: 2623457 - RNA, 17 nt, Human
ggccaggccaccaggau

SEQ ID NO: 2623458 - RNA, 16 nt, Human
ggccaggccaccagga

SEQ ID NO: 2623459 - RNA, 15 nt, Human
ggccaggccaccagg

SEQ ID NO: 2623460 - RNA, 11 nt, Human
ggccaggcagg

SEQ ID NO: 2623461 - RNA, 15 nt, Human
ggccaggccagcugc

SEQ ID NO: 2623462 - RNA, 17 nt, Human
ggccaggccagcugccu

SEQ ID NO: 2623463 - RNA, 17 nt, Human
ggccccugagaucucug

SEQ ID NO: 2623464 - RNA, 21 nt, Human
ggccccugagaucucugcagg

SEQ ID NO: 2623465 - RNA, 12 nt, Human
ggccccugccac

SEQ ID NO: 2623466 - RNA, 16 nt, Human
ggccccugccacccug

SEQ ID NO: 2623467 - RNA, 13 nt, Human
ggccccugccacc

SEQ ID NO: 2623468 - RNA, 17 nt, Human
ggccccugccagacccc

SEQ ID NO: 2623469 - RNA, 19 nt, Human
ggccccugccagacccccu

SEQ ID NO: 2623470 - RNA, 13 nt, Human
ggccccugcccgg

SEQ ID NO: 2623471 - RNA, 18 nt, Human
ggccccugccacccuggg

SEQ ID NO: 2623472 - RNA, 17 nt, Human
ggccccugccacccugg

SEQ ID NO: 2623473 - RNA, 21 nt, Human
ggccccucagggucccuggug

SEQ ID NO: 2623474 - RNA, 20 nt, Human
ggccccucagggucccuggu

SEQ ID NO: 2623475 - RNA, 19 nt, Human
ggccccucagggucccugg

SEQ ID NO: 2623476 - RNA, 16 nt, Human
ggccccucaggguccc

SEQ ID NO: 2623477 - RNA, 22 nt, Human
ggccccucccacacacacccac

SEQ ID NO: 2623478 - RNA, 12 nt, Human
ggccccuccagc

SEQ ID NO: 2623479 - RNA, 23 nt, Human
ggccccucaucugcucagcagcu

SEQ ID NO: 2623480 - RNA, 22 nt, Human
ggccccucacccugccuuaucu

SEQ ID NO: 2623481 - RNA, 22 nt, Human
ggccccuauguaguccgugcug

SEQ ID NO: 2623482 - RNA, 17 nt, Human
ggccccuccagcuugug

SEQ ID NO: 2623483 - RNA, 19 nt, Human
ggccccucugcccagcuug

SEQ ID NO: 2623484 - RNA, 17 nt, Human
ggccccucugcccagcu

SEQ ID NO: 2623485 - RNA, 16 nt, Human
ggccccucugcccagc

SEQ ID NO: 2623486 - RNA, 15 nt, Human
ggccccucugcccag

SEQ ID NO: 2623487 - RNA, 14 nt, Human
ggccccucugaccu

SEQ ID NO: 2623488 - RNA, 14 nt, Human
ggccccucugccca

SEQ ID NO: 2623489 - RNA, 12 nt, Human
ggccccucugcc

SEQ ID NO: 2623490 - RNA, 20 nt, Human
ggcccccagcccagggcucc

SEQ ID NO: 2623491 - RNA, 18 nt, Human
ggcccccagcccagggcu

SEQ ID NO: 2623492 - RNA, 17 nt, Human
ggcccccagcccagggc

SEQ ID NO: 2623493 - RNA, 14 nt, Human
ggcccccagcccag

SEQ ID NO: 2623494 - RNA, 17 nt, Human
ggcccccagagcgcccc

SEQ ID NO: 2623495 - RNA, 16 nt, Human
ggcccccagagcgccc

SEQ ID NO: 2623496 - RNA, 15 nt, Human
ggcccccagagcgcc

SEQ ID NO: 2623497 - RNA, 12 nt, Human
ggcccccagagc

SEQ ID NO: 2623498 - RNA, 18 nt, Human
ggcccccacuugccucuu

SEQ ID NO: 2623499 - RNA, 16 nt, Human
ggcccccacuugccuc

SEQ ID NO: 2623500 - RNA, 15 nt, Human
ggcccccacuugccu

SEQ ID NO: 2623501 - RNA, 22 nt, Human
ggccaugggacagggaggacgc

SEQ ID NO: 2623502 - RNA, 13 nt, Human
ggccaugggccuc

SEQ ID NO: 2623503 - RNA, 22 nt, Human
ggccauggagagcuggagccug

SEQ ID NO: 2623504 - RNA, 21 nt, Human
ggccaggccaccuccagaaac

SEQ ID NO: 2623505 - RNA, 16 nt, Human
ggccaggcugcucuug

SEQ ID NO: 2623506 - RNA, 13 nt, Human
ggccauggcagaa

SEQ ID NO: 2623507 - RNA, 21 nt, Human
ggccauggagagcuggagccu

SEQ ID NO: 2623508 - RNA, 17 nt, Human
ggccccccuccuugcuc

SEQ ID NO: 2623509 - RNA, 15 nt, Human
ggcccccaucucaug

SEQ ID NO: 2623510 - RNA, 21 nt, Human
ggcccccaucucaugccccug

SEQ ID NO: 2623511 - RNA, 14 nt, Human
ggcccccaucucau

SEQ ID NO: 2623512 - RNA, 15 nt, Human
ggcccccagcugugg

SEQ ID NO: 2623513 - RNA, 23 nt, Human
ggcccccagcccagggcuccugc

SEQ ID NO: 2623514 - RNA, 19 nt, Human
ggcccccagagcgccccuc

SEQ ID NO: 2623515 - RNA, 12 nt, Human
ggcccccagcug

SEQ ID NO: 2623516 - RNA, 15 nt, Human
ggcccccuccaucgg

SEQ ID NO: 2623517 - RNA, 20 nt, Human
ggccccccuccuugcucugc

SEQ ID NO: 2623518 - RNA, 13 nt, Human
ggcccccgagcug

SEQ ID NO: 2623519 - RNA, 15 nt, Human
ggcccccgagcuggg

SEQ ID NO: 2623520 - RNA, 19 nt, Human
ggccccucacccugccuua

SEQ ID NO: 2623521 - RNA, 18 nt, Human
ggccccguuucugguggu

SEQ ID NO: 2623522 - RNA, 21 nt, Human
ggccccggccccagccagagu

SEQ ID NO: 2623523 - RNA, 18 nt, Human
ggccccggccccagccag

SEQ ID NO: 2623524 - RNA, 17 nt, Human
ggccccggccccagcca

SEQ ID NO: 2623525 - RNA, 16 nt, Human
ggccccggccccagcc

SEQ ID NO: 2623526 - RNA, 14 nt, Human
ggccccggccccag

SEQ ID NO: 2623527 - RNA, 21 nt, Human
ggccccgcuuguccagcgccu

SEQ ID NO: 2623528 - RNA, 13 nt, Human
ggccccggcccca

SEQ ID NO: 2623529 - RNA, 19 nt, Human
ggccccgcuuguccagcgc

SEQ ID NO: 2623530 - RNA, 17 nt, Human
ggccccgaggacccaga

SEQ ID NO: 2623531 - RNA, 18 nt, Human
ggcccccuggucucuggu

SEQ ID NO: 2623532 - RNA, 14 nt, Human
ggcccccuguccuc

SEQ ID NO: 2623533 - RNA, 17 nt, Human
ggcccccuggucucugg

SEQ ID NO: 2623534 - RNA, 18 nt, Human
ggccccgccgccugguac

SEQ ID NO: 2623535 - RNA, 15 nt, Human
ggccccgccgccugg

SEQ ID NO: 2623536 - RNA, 19 nt, Human
ggccccgaggacccagacc

SEQ ID NO: 2623537 - RNA, 18 nt, Human
ggccccgaggacccagac

SEQ ID NO: 2623538 - RNA, 14 nt, Human
ggccccgccgccug

SEQ ID NO: 2623539 - RNA, 21 nt, Human
ggcagaguuuguguguugucu

SEQ ID NO: 2623540 - RNA, 23 nt, Human
ggcagaguuguaaauauauaaau

SEQ ID NO: 2623541 - RNA, 22 nt, Human
ggcagaguuguaaauauauaaa

SEQ ID NO: 2623542 - RNA, 18 nt, Human
ggcagaguuguaaauaua

SEQ ID NO: 2623543 - RNA, 17 nt, Human
ggcagaguuguaaauau

SEQ ID NO: 2623544 - RNA, 16 nt, Human
ggcagaguuguaaaua

SEQ ID NO: 2623545 - RNA, 15 nt, Human
ggcagaguuguaaau

SEQ ID NO: 2623546 - RNA, 14 nt, Human
ggcagaguuguaaa

SEQ ID NO: 2623547 - RNA, 23 nt, Human
ggcagaguugaagacagagcuac

SEQ ID NO: 2623548 - RNA, 23 nt, Human
ggcagauacaggaaaagcugcug

SEQ ID NO: 2623549 - RNA, 15 nt, Human
ggcagauaaucagcc

SEQ ID NO: 2623550 - RNA, 18 nt, Human
ggcagauaaucagccucu

SEQ ID NO: 2623551 - RNA, 19 nt, Human
ggcagauaaucagccucuu

SEQ ID NO: 2623552 - RNA, 20 nt, Human
ggcagauaaucagccucuua

SEQ ID NO: 2623553 - RNA, 17 nt, Human
ggcagaggaaagcaaag

SEQ ID NO: 2623554 - RNA, 21 nt, Human
ggcagagcuuggacuggaugc

SEQ ID NO: 2623555 - RNA, 17 nt, Human
ggcagagcuuggacugg

SEQ ID NO: 2623556 - RNA, 13 nt, Human
ggcagagcuucuu

SEQ ID NO: 2623557 - RNA, 15 nt, Human
ggcagaggacagauc

SEQ ID NO: 2623558 - RNA, 12 nt, Human
ggcagaggcugg

SEQ ID NO: 2623559 - RNA, 13 nt, Human
ggcagaggcugga

SEQ ID NO: 2623560 - RNA, 10 nt, Human
ggcagcagau

SEQ ID NO: 2623561 - RNA, 18 nt, Human
ggcagcagaagggggugg

SEQ ID NO: 2623562 - RNA, 21 nt, Human
ggcagcaccugucuccuuuca

SEQ ID NO: 2623563 - RNA, 21 nt, Human
ggcagcacagagacccccgga

SEQ ID NO: 2623564 - RNA, 14 nt, Human
ggcagcacagagac

SEQ ID NO: 2623565 - RNA, 24 nt, Human
ggcagauuuagugaaagcuagaga

SEQ ID NO: 2623566 - RNA, 20 nt, Human
ggcagaucugugccccaugc

SEQ ID NO: 2623567 - RNA, 13 nt, Human
ggcagauugaaaa

SEQ ID NO: 2623568 - RNA, 16 nt, Human
ggcagauccaggacua

SEQ ID NO: 2623569 - RNA, 14 nt, Human
ggcagauccaggac

SEQ ID NO: 2623570 - RNA, 18 nt, Human
ggcagaucaccagagguc

SEQ ID NO: 2623571 - RNA, 15 nt, Human
ggcagaucugugccc

SEQ ID NO: 2623572 - RNA, 16 nt, Human
ggcagaucugugcccc

SEQ ID NO: 2623573 - RNA, 17 nt, Human
ggcagaucugugcccca

SEQ ID NO: 2623574 - RNA, 18 nt, Human
ggcagaucugugccccau

SEQ ID NO: 2623575 - RNA, 14 nt, Human
ggcaggaaggcuga

SEQ ID NO: 2623576 - RNA, 23 nt, Human
ggcaggaaggagagccugcugca

SEQ ID NO: 2623577 - RNA, 13 nt, Human
ggcagguccaggg

SEQ ID NO: 2623578 - RNA, 18 nt, Human
ggcagcuugccccggccc

SEQ ID NO: 2623579 - RNA, 15 nt, Human
ggcagcuugccccgg

SEQ ID NO: 2623580 - RNA, 13 nt, Human
ggcagcuugcccc

SEQ ID NO: 2623581 - RNA, 21 nt, Human
ggcagcuuuaaccauuaaaac

SEQ ID NO: 2623582 - RNA, 11 nt, Human
ggcaggaaaag

SEQ ID NO: 2623583 - RNA, 15 nt, Human
ggcaggaaggagagc

SEQ ID NO: 2623584 - RNA, 16 nt, Human
ggcaggaaggagagcc

SEQ ID NO: 2623585 - RNA, 14 nt, Human
ggcagguccccaga

SEQ ID NO: 2623586 - RNA, 19 nt, Human
ggcagguccccagacucca

SEQ ID NO: 2623587 - RNA, 23 nt, Human
ggcaggucuugaacuccuggccu

SEQ ID NO: 2623588 - RNA, 20 nt, Human
ggcaggugccuccaggugug

SEQ ID NO: 2623589 - RNA, 18 nt, Human
ggcaggugccuccaggug

SEQ ID NO: 2623590 - RNA, 16 nt, Human
ggcaggugccuccagg

SEQ ID NO: 2623591 - RNA, 15 nt, Human
ggcaggugccuccag

SEQ ID NO: 2623592 - RNA, 21 nt, Human
ggcaggugccuccaggugugc

SEQ ID NO: 2623593 - RNA, 14 nt, Human
ggcaggugccucca

SEQ ID NO: 2623594 - RNA, 13 nt, Human
ggcaggugccucc

SEQ ID NO: 2623595 - RNA, 22 nt, Human
ggcaggugccaugucugggaac

SEQ ID NO: 2623596 - RNA, 21 nt, Human
ggcaggugccaugucugggaa

SEQ ID NO: 2623597 - RNA, 16 nt, Human
ggcaggugaccuucug

SEQ ID NO: 2623598 - RNA, 21 nt, Human
ggcagcucaccucucccuugg

SEQ ID NO: 2623599 - RNA, 18 nt, Human
ggcagcucaccucucccu

SEQ ID NO: 2623600 - RNA, 22 nt, Human
ggcagcucaccucucccuugga

SEQ ID NO: 2623601 - RNA, 16 nt, Human
ggcagcucaccucucc

SEQ ID NO: 2623602 - RNA, 19 nt, Human
ggcagcugcgguccaccca

SEQ ID NO: 2623603 - RNA, 21 nt, Human
ggcagcuugaggguugggcug

SEQ ID NO: 2623604 - RNA, 19 nt, Human
ggaucaugguguaauaaga

SEQ ID NO: 2623605 - RNA, 16 nt, Human
ggaucaugguguaaua

SEQ ID NO: 2623606 - RNA, 21 nt, Human
ggaucaugguguaauaagaca

SEQ ID NO: 2623607 - RNA, 19 nt, Human
ggaucaucugccgugccug

SEQ ID NO: 2623608 - RNA, 15 nt, Human
ggauccacaccuggu

SEQ ID NO: 2623609 - RNA, 14 nt, Human
ggauccacaccugg

SEQ ID NO: 2623610 - RNA, 13 nt, Human
ggauccagaaggg

SEQ ID NO: 2623611 - RNA, 23 nt, Human
ggaucccaccccauuuucugugg

SEQ ID NO: 2623612 - RNA, 19 nt, Human
ggcaacccccagccugcua

SEQ ID NO: 2623613 - RNA, 16 nt, Human
ggaucagaugaacucu

SEQ ID NO: 2623614 - RNA, 16 nt, Human
ggaucagauugcaugu

SEQ ID NO: 2623615 - RNA, 12 nt, Human
ggaucagaauag

SEQ ID NO: 2623616 - RNA, 19 nt, Human
ggaucagcccucauuuugu

SEQ ID NO: 2623617 - RNA, 21 nt, Human
ggaucagaugaacucuuagaa

SEQ ID NO: 2623618 - RNA, 21 nt, Human
ggaucagucugauucccaagc

SEQ ID NO: 2623619 - RNA, 15 nt, Human
ggcaaccuugucucu

SEQ ID NO: 2623620 - RNA, 19 nt, Human
ggcaaccuugucucuaugc

SEQ ID NO: 2623621 - RNA, 18 nt, Human
ggcaacugcauuggcuuu

SEQ ID NO: 2623622 - RNA, 13 nt, Human
ggcaacugaggca

SEQ ID NO: 2623623 - RNA, 14 nt, Human
ggcaacugaggcag

SEQ ID NO: 2623624 - RNA, 15 nt, Human
ggcaacugaggcaga

SEQ ID NO: 2623625 - RNA, 15 nt, Human
ggcaaggcugucaau

SEQ ID NO: 2623626 - RNA, 23 nt, Human
ggcaacuugggaacuagacuccc

SEQ ID NO: 2623627 - RNA, 18 nt, Human
ggcaacuugggaacuaga

SEQ ID NO: 2623628 - RNA, 19 nt, Human
ggcaacugcauuggcuuug

SEQ ID NO: 2623629 - RNA, 19 nt, Human
ggcaacugaggcagacagc

SEQ ID NO: 2623630 - RNA, 20 nt, Human
ggcaacugaggcagacagca

SEQ ID NO: 2623631 - RNA, 23 nt, Human
ggcaacugaggcagacagcagcu

SEQ ID NO: 2623632 - RNA, 16 nt, Human
ggcacccggccccugc

SEQ ID NO: 2623633 - RNA, 15 nt, Human
ggcacccggccccug

SEQ ID NO: 2623634 - RNA, 19 nt, Human
ggcacccccuggagagaag

SEQ ID NO: 2623635 - RNA, 18 nt, Human
ggcacccccuggagagaa

SEQ ID NO: 2623636 - RNA, 17 nt, Human
ggcaccuaauccaggca

SEQ ID NO: 2623637 - RNA, 18 nt, Human
ggcaccuaauccaggcag

SEQ ID NO: 2623638 - RNA, 19 nt, Human
ggcaccuaauccaggcaga

SEQ ID NO: 2623639 - RNA, 16 nt, Human
ggcacccccuggagag

SEQ ID NO: 2623640 - RNA, 15 nt, Human
ggcacccccuggaga

SEQ ID NO: 2623641 - RNA, 14 nt, Human
ggcacccccuggag

SEQ ID NO: 2623642 - RNA, 17 nt, Human
ggcacccggccccugcu

SEQ ID NO: 2623643 - RNA, 13 nt, Human
ggcaaggcugugc

SEQ ID NO: 2623644 - RNA, 22 nt, Human
ggcaacuuuccuuguuccccau

SEQ ID NO: 2623645 - RNA, 21 nt, Human
ggcaagggccaugcugaaggg

SEQ ID NO: 2623646 - RNA, 14 nt, Human
ggcaaggcugugcu

SEQ ID NO: 2623647 - RNA, 19 nt, Human
ggcaagggccaugcugaag

SEQ ID NO: 2623648 - RNA, 16 nt, Human
ggcaaggcugucaauu

SEQ ID NO: 2623649 - RNA, 13 nt, Human
ggcaagugauuga

SEQ ID NO: 2623650 - RNA, 23 nt, Human
ggcaagucccugacucucuguga

SEQ ID NO: 2623651 - RNA, 22 nt, Human
ggcaagucccugacucucugug

SEQ ID NO: 2623652 - RNA, 16 nt, Human
ggcagagcagagacca

SEQ ID NO: 2623653 - RNA, 15 nt, Human
ggcagagcagagacc

SEQ ID NO: 2623654 - RNA, 20 nt, Human
ggcagagcagagaccauccc

SEQ ID NO: 2623655 - RNA, 16 nt, Human
ggcaccucacaggccc

SEQ ID NO: 2623656 - RNA, 19 nt, Human
ggcaccucacaggccccag

SEQ ID NO: 2623657 - RNA, 20 nt, Human
ggcacccccuggagagaagu

SEQ ID NO: 2623658 - RNA, 22 nt, Human
ggcaccuaauccaggcagaucc

SEQ ID NO: 2623659 - RNA, 18 nt, Human
ggcaccuauagucccagc

SEQ ID NO: 2623660 - RNA, 19 nt, Human
ggcaccuauagucccagcu

SEQ ID NO: 2623661 - RNA, 22 nt, Human
ggcaccuauagucccagcuacu

SEQ ID NO: 2623662 - RNA, 23 nt, Human
ggcaccuccuacgucaaacauga

SEQ ID NO: 2623663 - RNA, 20 nt, Human
ggcaccugcagguugggcca

SEQ ID NO: 2623664 - RNA, 16 nt, Human
ggcaccugcagguugg

SEQ ID NO: 2623665 - RNA, 17 nt, Human
ggcaccuauaaaacagg

SEQ ID NO: 2623666 - RNA, 12 nt, Human
ggcagagcagag

SEQ ID NO: 2623667 - RNA, 15 nt, Human
ggagggcuccagaca

SEQ ID NO: 2623668 - RNA, 14 nt, Human
ggagggcuccagac

SEQ ID NO: 2623669 - RNA, 20 nt, Human
ggagggcuagaaucuggaga

SEQ ID NO: 2623670 - RNA, 19 nt, Human
ggagggcuagaacuggaga

SEQ ID NO: 2623671 - RNA, 22 nt, Human
ggagggcuagaaucuggagagc

SEQ ID NO: 2623672 - RNA, 17 nt, Human
ggagggcuccagacaca

SEQ ID NO: 2623673 - RNA, 21 nt, Human
ggaguccaggccauggaggca

SEQ ID NO: 2623674 - RNA, 19 nt, Human
ggaguccacucccagugcu

SEQ ID NO: 2623675 - RNA, 16 nt, Human
ggagucccaaggaaag

SEQ ID NO: 2623676 - RNA, 17 nt, Human
ggagucccaaggaaagc

SEQ ID NO: 2623677 - RNA, 16 nt, Human
ggaguccacuuuguuu

SEQ ID NO: 2623678 - RNA, 15 nt, Human
ggaguccacucccag

SEQ ID NO: 2623679 - RNA, 17 nt, Human
ggagucaucucaaccau

SEQ ID NO: 2623680 - RNA, 23 nt, Human
ggagucaucucaaccauccccuc

SEQ ID NO: 2623681 - RNA, 16 nt, Human
ggagggcuggaaucug

SEQ ID NO: 2623682 - RNA, 14 nt, Human
ggagggcuggaauc

SEQ ID NO: 2623683 - RNA, 22 nt, Human
ggagggcugucaucugugcacu

SEQ ID NO: 2623684 - RNA, 20 nt, Human
ggagggcuggaaucuggaga

SEQ ID NO: 2623685 - RNA, 13 nt, Human
ggaggggacgcug

SEQ ID NO: 2623686 - RNA, 20 nt, Human
ggaggggacuauuuaugaag

SEQ ID NO: 2623687 - RNA, 21 nt, Human
ggaggggacuauuuaugaagg

SEQ ID NO: 2623688 - RNA, 18 nt, Human
ggagucagugccaggucc

SEQ ID NO: 2623689 - RNA, 21 nt, Human
ggagucccaccuuggcugcag

SEQ ID NO: 2623690 - RNA, 20 nt, Human
ggagucccaccuuggcugca

SEQ ID NO: 2623691 - RNA, 24 nt, Human
ggagucguggggugugcugggagc

SEQ ID NO: 2623692 - RNA, 22 nt, Human
ggagucguggggugugcuggga

SEQ ID NO: 2623693 - RNA, 21 nt, Human
ggagucuccagugguugcugu

SEQ ID NO: 2623694 - RNA, 16 nt, Human
ggagucccgucaggac

SEQ ID NO: 2623695 - RNA, 14 nt, Human
ggagucugaagcag

SEQ ID NO: 2623696 - RNA, 15 nt, Human
ggagucugaagcaga

SEQ ID NO: 2623697 - RNA, 16 nt, Human
ggagugaagaggggca

SEQ ID NO: 2623698 - RNA, 15 nt, Human
ggagugaagaggggc

SEQ ID NO: 2623699 - RNA, 12 nt, Human
ggagugaagagg

SEQ ID NO: 2623700 - RNA, 23 nt, Human
ggagugaaaccuuuagggcagcu

SEQ ID NO: 2623701 - RNA, 22 nt, Human
ggagugaaaccuuuagggcagc

SEQ ID NO: 2623702 - RNA, 21 nt, Human
ggagugaaaccuuuagggcag

SEQ ID NO: 2623703 - RNA, 16 nt, Human
ggagugacagaggcag

SEQ ID NO: 2623704 - RNA, 11 nt, Human
ggagugacaga

SEQ ID NO: 2623705 - RNA, 16 nt, Human
ggaucacagccucuga

SEQ ID NO: 2623706 - RNA, 14 nt, Human
ggaucacagagaca

SEQ ID NO: 2623707 - RNA, 17 nt, Human
ggauaggagccugcugg

SEQ ID NO: 2623708 - RNA, 13 nt, Human
ggaucacagggcc

SEQ ID NO: 2623709 - RNA, 14 nt, Human
ggaucacagggccc

SEQ ID NO: 2623710 - RNA, 17 nt, Human
ggaucacagggccccag

SEQ ID NO: 2623711 - RNA, 13 nt, Human
ggaucacuggagc

SEQ ID NO: 2623712 - RNA, 16 nt, Human
ggaucagaaauacaga

SEQ ID NO: 2623713 - RNA, 14 nt, Human
ggaucagaaauaca

SEQ ID NO: 2623714 - RNA, 17 nt, Human
ggaucagaacagcagag

SEQ ID NO: 2623715 - RNA, 16 nt, Human
ggaucagaacagcaga

SEQ ID NO: 2623716 - RNA, 14 nt, Human
ggaucacuggagcc

SEQ ID NO: 2623717 - RNA, 17 nt, Human
ggaucacuggagcccag

SEQ ID NO: 2623718 - RNA, 18 nt, Human
ggaucacuggagcccagg

SEQ ID NO: 2623719 - RNA, 19 nt, Human
ggaucacuggagcccagga

SEQ ID NO: 2623720 - RNA, 15 nt, Human
ggauaggagccugcu

SEQ ID NO: 2623721 - RNA, 14 nt, Human
ggauaggagccugc

SEQ ID NO: 2623722 - RNA, 18 nt, Human
ggauaggaaaaaugagua

SEQ ID NO: 2623723 - RNA, 13 nt, Human
ggauagcauuuuu

SEQ ID NO: 2623724 - RNA, 23 nt, Human
ggagugaggaauaguugagcccc

SEQ ID NO: 2623725 - RNA, 21 nt, Human
ggauagaugcuggcccagggc

SEQ ID NO: 2623726 - RNA, 14 nt, Human
ggauagaugugugg

SEQ ID NO: 2623727 - RNA, 15 nt, Human
ggauagaugugugga

SEQ ID NO: 2623728 - RNA, 19 nt, Human
ggauagaugcuggcccagg

SEQ ID NO: 2623729 - RNA, 20 nt, Human
ggauagaugcuggcccaggg

SEQ ID NO: 2623730 - RNA, 13 nt, Human
ggauagaugugug

SEQ ID NO: 2623731 - RNA, 18 nt, Human
ggauagaugcuggcccag

SEQ ID NO: 2623732 - RNA, 21 nt, Human
ggagugaggaauaguugagcc

SEQ ID NO: 2623733 - RNA, 21 nt, Human
ggagugaggaaggcaggaaga

SEQ ID NO: 2623734 - RNA, 21 nt, Human
ggagugaguguggcuccccuc

SEQ ID NO: 2623735 - RNA, 21 nt, Human
ggagugacagaggcagcccca

SEQ ID NO: 2623736 - RNA, 19 nt, Human
ggagugacagaggcagccc

SEQ ID NO: 2623737 - RNA, 18 nt, Human
ggagugacagaggcagcc

SEQ ID NO: 2623738 - RNA, 17 nt, Human
ggagugacagaggcagc

SEQ ID NO: 2623739 - RNA, 21 nt, Human
ggagugaguugauagcacaga

SEQ ID NO: 2623740 - RNA, 14 nt, Human
ggagugagcugguu

SEQ ID NO: 2623741 - RNA, 12 nt, Human
ggagugagcugg

SEQ ID NO: 2623742 - RNA, 20 nt, Human
ggagugaagaggggcagccc

SEQ ID NO: 2623743 - RNA, 19 nt, Human
ggagugaagaggggcagcc

SEQ ID NO: 2623744 - RNA, 18 nt, Human
ggagugaagaggggcagc

SEQ ID NO: 2623745 - RNA, 17 nt, Human
ggagugaagaggggcag

SEQ ID NO: 2623746 - RNA, 23 nt, Human
ggagugaagaggggcagcccuug

SEQ ID NO: 2623747 - RNA, 22 nt, Human
ggagugaagaggggcagcccuu

SEQ ID NO: 2623748 - RNA, 15 nt, Human
ggagugagaugccug

SEQ ID NO: 2623749 - RNA, 20 nt, Human
ggaggacgcucucuggccuu

SEQ ID NO: 2623750 - RNA, 21 nt, Human
ggaggacgcucucuggccuuc

SEQ ID NO: 2623751 - RNA, 19 nt, Human
ggaggacuagaaccuggag

SEQ ID NO: 2623752 - RNA, 16 nt, Human
ggaggacuagaaccug

SEQ ID NO: 2623753 - RNA, 22 nt, Human
ggaggacuagaaccuggagggc

SEQ ID NO: 2623754 - RNA, 21 nt, Human
ggaggacuagaaccuggaggg

SEQ ID NO: 2623755 - RNA, 21 nt, Human
ggaggacugccccgugcagac

SEQ ID NO: 2623756 - RNA, 17 nt, Human
ggaggagcaaaggcuga

SEQ ID NO: 2623757 - RNA, 13 nt, Human
ggaggagaaugag

SEQ ID NO: 2623758 - RNA, 12 nt, Human
ggaggagcaaag

SEQ ID NO: 2623759 - RNA, 21 nt, Human
ggagccgggaaagaagagccg

SEQ ID NO: 2623760 - RNA, 20 nt, Human
ggagccgcuggcagaaggga

SEQ ID NO: 2623761 - RNA, 14 nt, Human
ggagccgcuggcag

SEQ ID NO: 2623762 - RNA, 13 nt, Human
ggagccgcuggca

SEQ ID NO: 2623763 - RNA, 19 nt, Human
ggaggacgcucucuggccu

SEQ ID NO: 2623764 - RNA, 21 nt, Human
ggagccgaggccuaccccgca

SEQ ID NO: 2623765 - RNA, 13 nt, Human
ggagccgcagcag

SEQ ID NO: 2623766 - RNA, 21 nt, Human
ggagccgagaucacgccacug

SEQ ID NO: 2623767 - RNA, 13 nt, Human
ggagcccuugggu

SEQ ID NO: 2623768 - RNA, 22 nt, Human
ggaggaggccugggggcaggga

SEQ ID NO: 2623769 - RNA, 12 nt, Human
ggaggaggccug

SEQ ID NO: 2623770 - RNA, 22 nt, Human
ggaggaggccaccucuccaagg

SEQ ID NO: 2623771 - RNA, 19 nt, Human
ggaggaggccaccucucca

SEQ ID NO: 2623772 - RNA, 16 nt, Human
ggaggaggccaccucu

SEQ ID NO: 2623773 - RNA, 15 nt, Human
ggaggaggccaccuc

SEQ ID NO: 2623774 - RNA, 14 nt, Human
ggaggaggccaccu

SEQ ID NO: 2623775 - RNA, 13 nt, Human
ggaggaggccacc

SEQ ID NO: 2623776 - RNA, 13 nt, Human
ggaggaggaggca

SEQ ID NO: 2623777 - RNA, 14 nt, Human
ggaggaggaggcaa

SEQ ID NO: 2623778 - RNA, 12 nt, Human
ggaggagcaggg

SEQ ID NO: 2623779 - RNA, 13 nt, Human
ggaggagagaaga

SEQ ID NO: 2623780 - RNA, 17 nt, Human
ggaggagcagugcaggc

SEQ ID NO: 2623781 - RNA, 15 nt, Human
ggaggaggaaggcaa

SEQ ID NO: 2623782 - RNA, 13 nt, Human
ggaggaggaaggc

SEQ ID NO: 2623783 - RNA, 17 nt, Human
ggaggagcuugggggau

SEQ ID NO: 2623784 - RNA, 13 nt, Human
ggaggagggagag

SEQ ID NO: 2623785 - RNA, 12 nt, Human
ggaggagggaga

SEQ ID NO: 2623786 - RNA, 19 nt, Human
ggaggagggcggggggcac

SEQ ID NO: 2623787 - RNA, 15 nt, Human
ggaggaggugccaac

SEQ ID NO: 2623788 - RNA, 20 nt, Human
ggaggagguggcagcccugu

SEQ ID NO: 2623789 - RNA, 23 nt, Human
ggaggagguuuaggucaagaaga

SEQ ID NO: 2623790 - RNA, 16 nt, Human
ggaggaucacuggagc

SEQ ID NO: 2623791 - RNA, 17 nt, Human
ggaggaucacuggagcc

SEQ ID NO: 2623792 - RNA, 19 nt, Human
ggaggaucacuggagccca

SEQ ID NO: 2623793 - RNA, 20 nt, Human
ggaggaucacuggagcccag

SEQ ID NO: 2623794 - RNA, 21 nt, Human
ggaggaucacuggagcccagg

SEQ ID NO: 2623795 - RNA, 23 nt, Human
ggagggcuagaaccuggcagguu

SEQ ID NO: 2623796 - RNA, 13 nt, Human
ggagggcagcagg

SEQ ID NO: 2623797 - RNA, 15 nt, Human
ggagggcagcagggc

SEQ ID NO: 2623798 - RNA, 16 nt, Human
ggagggcagcagggcu

SEQ ID NO: 2623799 - RNA, 17 nt, Human
ggagggcagcagggcua

SEQ ID NO: 2623800 - RNA, 13 nt, Human
ggagggcuccaga

SEQ ID NO: 2623801 - RNA, 12 nt, Human
ggagggcuccag

SEQ ID NO: 2623802 - RNA, 21 nt, Human
ggagggcacauuccuugccug

SEQ ID NO: 2623803 - RNA, 23 nt, Human
ggagggcaagggccaugcugaag

SEQ ID NO: 2623804 - RNA, 16 nt, Human
ggagggcagcagaagg

SEQ ID NO: 2623805 - RNA, 21 nt, Human
ggagggcaagggccaugcuga

SEQ ID NO: 2623806 - RNA, 20 nt, Human
ggagggauuggccgcuuggc

SEQ ID NO: 2623807 - RNA, 22 nt, Human
ggagggauucugguuccagggu

SEQ ID NO: 2623808 - RNA, 12 nt, Human
ggagggauuugg

SEQ ID NO: 2623809 - RNA, 12 nt, Human
ggagggagggcu

SEQ ID NO: 2623810 - RNA, 15 nt, Human
ggagggaggcucagg

SEQ ID NO: 2623811 - RNA, 16 nt, Human
ggagggaggcucaggu

SEQ ID NO: 2623812 - RNA, 16 nt, Human
ggagggagcagacagg

SEQ ID NO: 2623813 - RNA, 13 nt, Human
ggagggagaggga

SEQ ID NO: 2623814 - RNA, 13 nt, Human
ggagggagaugga

SEQ ID NO: 2623815 - RNA, 15 nt, Human
ggaggauguucuggg

SEQ ID NO: 2623816 - RNA, 13 nt, Human
ggaggaugggcuc

SEQ ID NO: 2623817 - RNA, 14 nt, Human
ggaggauggagaga

SEQ ID NO: 2623818 - RNA, 21 nt, Human
ggaggauggagagaggggaau

SEQ ID NO: 2623819 - RNA, 22 nt, Human
ggagggacaaguggacucaggg

SEQ ID NO: 2623820 - RNA, 13 nt, Human
ggagggacauggc

SEQ ID NO: 2623821 - RNA, 21 nt, Human
ggagggaaugaaccuggaggg

SEQ ID NO: 2623822 - RNA, 15 nt, Human
ggagggaauugaggu

SEQ ID NO: 2623823 - RNA, 17 nt, Human
ggagggaauugaggucu

SEQ ID NO: 2623824 - RNA, 19 nt, Human
ggagggaauugaggucugc

SEQ ID NO: 2623825 - RNA, 23 nt, Human
ggaggaucacuugaguccagaag

SEQ ID NO: 2623826 - RNA, 17 nt, Human
ggaggaucucuugagcc

SEQ ID NO: 2623827 - RNA, 21 nt, Human
ggaggaucucuugagccuggg

SEQ ID NO: 2623828 - RNA, 17 nt, Human
ggaggaggugccaacag

SEQ ID NO: 2623829 - RNA, 22 nt, Human
ggaggaucacuggagcccagga

SEQ ID NO: 2623830 - RNA, 12 nt, Human
ggaggauggaga

SEQ ID NO: 2623831 - RNA, 13 nt, Human
ggaggauggagag

SEQ ID NO: 2623832 - RNA, 20 nt, Human
ggaggaucuuuugaacccag

SEQ ID NO: 2623833 - RNA, 20 nt, Human
ggaagccagcaggcucucag

SEQ ID NO: 2623834 - RNA, 14 nt, Human
ggaaggagagccug

SEQ ID NO: 2623835 - RNA, 15 nt, Human
ggaaggagagccugc

SEQ ID NO: 2623836 - RNA, 16 nt, Human
ggaaggagagccugcu

SEQ ID NO: 2623837 - RNA, 17 nt, Human
ggaaggagagccugcug

SEQ ID NO: 2623838 - RNA, 19 nt, Human
ggaccagcucaggacagau

SEQ ID NO: 2623839 - RNA, 22 nt, Human
ggaccagcucaggacagaugcc

SEQ ID NO: 2623840 - RNA, 19 nt, Human
ggaccagcuggggcguggg

SEQ ID NO: 2623841 - RNA, 12 nt, Human
ggaccagcuggg

SEQ ID NO: 2623842 - RNA, 22 nt, Human
ggaccagcuggggcguggggag

SEQ ID NO: 2623843 - RNA, 15 nt, Human
ggaccagcuuuuccc

SEQ ID NO: 2623844 - RNA, 17 nt, Human
ggaccagcuuuucccaa

SEQ ID NO: 2623845 - RNA, 22 nt, Human
ggaccagcuuuucccaaaagcc

SEQ ID NO: 2623846 - RNA, 14 nt, Human
ggaccaggacagga

SEQ ID NO: 2623847 - RNA, 16 nt, Human
ggaccagcucaggaca

SEQ ID NO: 2623848 - RNA, 18 nt, Human
ggaccagcucaggacaga

SEQ ID NO: 2623849 - RNA, 13 nt, Human
ggaaggagggagg

SEQ ID NO: 2623850 - RNA, 13 nt, Human
ggaaggagugaga

SEQ ID NO: 2623851 - RNA, 20 nt, Human
ggaaggaggguuagggaggg

SEQ ID NO: 2623852 - RNA, 14 nt, Human
ggacccagacccag

SEQ ID NO: 2623853 - RNA, 13 nt, Human
ggacccagaccca

SEQ ID NO: 2623854 - RNA, 17 nt, Human
ggacccagacccagugg

SEQ ID NO: 2623855 - RNA, 16 nt, Human
ggacccagacccagug

SEQ ID NO: 2623856 - RNA, 21 nt, Human
ggacccagaggaaggggccag

SEQ ID NO: 2623857 - RNA, 21 nt, Human
ggaccaggacuauagcccagg

SEQ ID NO: 2623858 - RNA, 17 nt, Human
ggaccaggacucccucc

SEQ ID NO: 2623859 - RNA, 11 nt, Human
ggaccaggacu

SEQ ID NO: 2623860 - RNA, 17 nt, Human
ggaccaggacaggacca

SEQ ID NO: 2623861 - RNA, 15 nt, Human
ggaccaggacucccu

SEQ ID NO: 2623862 - RNA, 14 nt, Human
ggacccagggauga

SEQ ID NO: 2623863 - RNA, 22 nt, Human
ggacccaugaguuggggucugg

SEQ ID NO: 2623864 - RNA, 19 nt, Human
ggacccaucacgccugugc

SEQ ID NO: 2623865 - RNA, 16 nt, Human
ggaccucugcucugag

SEQ ID NO: 2623866 - RNA, 14 nt, Human
ggaccucugcucug

SEQ ID NO: 2623867 - RNA, 13 nt, Human
ggaccucugcucu

SEQ ID NO: 2623868 - RNA, 12 nt, Human
ggaccucugcuc

SEQ ID NO: 2623869 - RNA, 12 nt, Human
ggaccucuccca

SEQ ID NO: 2623870 - RNA, 14 nt, Human
ggaccucucccagg

SEQ ID NO: 2623871 - RNA, 15 nt, Human
ggaccucucccaggg

SEQ ID NO: 2623872 - RNA, 22 nt, Human
ggacugcaagcagggcucugcc

SEQ ID NO: 2623873 - RNA, 16 nt, Human
ggacucuugcucuuuc

SEQ ID NO: 2623874 - RNA, 23 nt, Human
ggacugcacagcguccuguccac

SEQ ID NO: 2623875 - RNA, 22 nt, Human
ggacugcacagcguccugucca

SEQ ID NO: 2623876 - RNA, 17 nt, Human
ggacucugggguuuuua

SEQ ID NO: 2623877 - RNA, 11 nt, Human
ggacucugccu

SEQ ID NO: 2623878 - RNA, 20 nt, Human
ggacucucagucucugagca

SEQ ID NO: 2623879 - RNA, 21 nt, Human
ggacucucagucucugagcag

SEQ ID NO: 2623880 - RNA, 19 nt, Human
ggacucugaagccucuggg

SEQ ID NO: 2623881 - RNA, 17 nt, Human
ggacucugaagccucug

SEQ ID NO: 2623882 - RNA, 17 nt, Human
ggacucucagucucuga

SEQ ID NO: 2623883 - RNA, 18 nt, Human
ggacucucagucucugag

SEQ ID NO: 2623884 - RNA, 20 nt, Human
ggacucugcacaugucuugu

SEQ ID NO: 2623885 - RNA, 15 nt, Human
ggacucugcacauga

SEQ ID NO: 2623886 - RNA, 21 nt, Human
ggacucugcacaugucuugua

SEQ ID NO: 2623887 - RNA, 13 nt, Human
ggacucugcacau

SEQ ID NO: 2623888 - RNA, 21 nt, Human
ggacucugaggcucuuucugg

SEQ ID NO: 2623889 - RNA, 11 nt, Human
ggacucugagg

SEQ ID NO: 2623890 - RNA, 13 nt, Human
ggacucugaggcu

SEQ ID NO: 2623891 - RNA, 12 nt, Human
ggacuccucugu

SEQ ID NO: 2623892 - RNA, 14 nt, Human
ggacuccucugucc

SEQ ID NO: 2623893 - RNA, 13 nt, Human
ggaccuuccugcc

SEQ ID NO: 2623894 - RNA, 12 nt, Human
ggaccuuccugc

SEQ ID NO: 2623895 - RNA, 15 nt, Human
ggaccuuccugccac

SEQ ID NO: 2623896 - RNA, 15 nt, Human
ggacuccucugucca

SEQ ID NO: 2623897 - RNA, 17 nt, Human
ggaccugguacccuccu

SEQ ID NO: 2623898 - RNA, 17 nt, Human
ggaccuggugcugccuc

SEQ ID NO: 2623899 - RNA, 18 nt, Human
ggaccuuaggccuuccuc

SEQ ID NO: 2623900 - RNA, 21 nt, Human
ggaccuuaggccuuccucucu

SEQ ID NO: 2623901 - RNA, 15 nt, Human
ggaccuuaucugugc

SEQ ID NO: 2623902 - RNA, 22 nt, Human
ggaccuuaucugugcgugaaac

SEQ ID NO: 2623903 - RNA, 17 nt, Human
ggaccugccaggcaggg

SEQ ID NO: 2623904 - RNA, 16 nt, Human
ggaccugccaggcagg

SEQ ID NO: 2623905 - RNA, 14 nt, Human
ggaccugccaggca

SEQ ID NO: 2623906 - RNA, 17 nt, Human
ggaccugagucugcuau

SEQ ID NO: 2623907 - RNA, 17 nt, Human
ggaccucugcucugagg

SEQ ID NO: 2623908 - RNA, 23 nt, Human
ggaccugccuccugccugccccu

SEQ ID NO: 2623909 - RNA, 15 nt, Human
ggaccugccuguagc

SEQ ID NO: 2623910 - RNA, 14 nt, Human
ggaccuggcugcca

SEQ ID NO: 2623911 - RNA, 19 nt, Human
ggaccugccuccugccugc

SEQ ID NO: 2623912 - RNA, 14 nt, Human
ggaccugccuguag

SEQ ID NO: 2623913 - RNA, 22 nt, Human
ggaccugccuccugccugcccc

SEQ ID NO: 2623914 - RNA, 13 nt, Human
ggagauggaguuc

SEQ ID NO: 2623915 - RNA, 20 nt, Human
ggagauggaaguugcaguga

SEQ ID NO: 2623916 - RNA, 15 nt, Human
ggagaugcuccuugg

SEQ ID NO: 2623917 - RNA, 20 nt, Human
ggagagggucuggagaagca

SEQ ID NO: 2623918 - RNA, 14 nt, Human
ggagagggucugga

SEQ ID NO: 2623919 - RNA, 17 nt, Human
ggagagggucuggagaa

SEQ ID NO: 2623920 - RNA, 18 nt, Human
ggagagggucuggagaag

SEQ ID NO: 2623921 - RNA, 15 nt, Human
ggagaggggcacagg

SEQ ID NO: 2623922 - RNA, 18 nt, Human
ggagaggggaagggccag

SEQ ID NO: 2623923 - RNA, 22 nt, Human
ggagaggggaagggccagucug

SEQ ID NO: 2623924 - RNA, 24 nt, Human
ggagagggaugaggugcugggagg

SEQ ID NO: 2623925 - RNA, 14 nt, Human
ggagaggggcagaa

SEQ ID NO: 2623926 - RNA, 20 nt, Human
ggagauuuacaacuggggga

SEQ ID NO: 2623927 - RNA, 17 nt, Human
ggagauugagaaggaga

SEQ ID NO: 2623928 - RNA, 16 nt, Human
ggagauugagaaggag

SEQ ID NO: 2623929 - RNA, 14 nt, Human
ggagauugagaagg

SEQ ID NO: 2623930 - RNA, 21 nt, Human
ggagauugagaaggagagaaa

SEQ ID NO: 2623931 - RNA, 20 nt, Human
ggagauugagaaggagagaa

SEQ ID NO: 2623932 - RNA, 17 nt, Human
ggagauuggacggccug

SEQ ID NO: 2623933 - RNA, 14 nt, Human
ggagaugucuucgu

SEQ ID NO: 2623934 - RNA, 22 nt, Human
ggagaugucuucguacaguucu

SEQ ID NO: 2623935 - RNA, 14 nt, Human
ggagauucagacug

SEQ ID NO: 2623936 - RNA, 13 nt, Human
ggagaugucuucg

SEQ ID NO: 2623937 - RNA, 12 nt, Human
ggagaugucuuc

SEQ ID NO: 2623938 - RNA, 19 nt, Human
ggagauggaggaaagugau

SEQ ID NO: 2623939 - RNA, 18 nt, Human
ggagaugggccuuuugga

SEQ ID NO: 2623940 - RNA, 16 nt, Human
ggagauguagcaaaac

SEQ ID NO: 2623941 - RNA, 13 nt, Human
ggagcccugggag

SEQ ID NO: 2623942 - RNA, 20 nt, Human
ggagcccuuaucugugcuca

SEQ ID NO: 2623943 - RNA, 22 nt, Human
ggagcccuuaucugugcucagg

SEQ ID NO: 2623944 - RNA, 12 nt, Human
ggagcccuggga

SEQ ID NO: 2623945 - RNA, 16 nt, Human
ggagcccgucucagug

SEQ ID NO: 2623946 - RNA, 20 nt, Human
ggagcccgcacccccacccu

SEQ ID NO: 2623947 - RNA, 21 nt, Human
ggagcccgcacccccacccuu

SEQ ID NO: 2623948 - RNA, 14 nt, Human
ggagcccgcacccc

SEQ ID NO: 2623949 - RNA, 16 nt, Human
ggagcccgcaccccca

SEQ ID NO: 2623950 - RNA, 18 nt, Human
ggagcccgcacccccacc

SEQ ID NO: 2623951 - RNA, 14 nt, Human
ggagcaaaggcuga

SEQ ID NO: 2623952 - RNA, 22 nt, Human
ggagccccuggguggguggugg

SEQ ID NO: 2623953 - RNA, 18 nt, Human
ggagccccuucugcucag

SEQ ID NO: 2623954 - RNA, 19 nt, Human
ggagccccuucugcucagc

SEQ ID NO: 2623955 - RNA, 21 nt, Human
ggagccccuucugcucagcuc

SEQ ID NO: 2623956 - RNA, 17 nt, Human
ggagauuuuccuuccua

SEQ ID NO: 2623957 - RNA, 19 nt, Human
ggagauuuuagguguugau

SEQ ID NO: 2623958 - RNA, 16 nt, Human
ggagauuuuagguguu

SEQ ID NO: 2623959 - RNA, 16 nt, Human
ggagcaaacucugcug

SEQ ID NO: 2623960 - RNA, 16 nt, Human
ggagauuuuccuuccu

SEQ ID NO: 2623961 - RNA, 20 nt, Human
ggagcaaaaucgaugcagug

SEQ ID NO: 2623962 - RNA, 21 nt, Human
ggagaccccuuggggagcagg

SEQ ID NO: 2623963 - RNA, 15 nt, Human
ggacugucauagaaa

SEQ ID NO: 2623964 - RNA, 24 nt, Human
ggacuggguuuggaccccagcugg

SEQ ID NO: 2623965 - RNA, 23 nt, Human
ggacuggguuuggaccccagcug

SEQ ID NO: 2623966 - RNA, 21 nt, Human
ggacuggguuuggaccccagc

SEQ ID NO: 2623967 - RNA, 15 nt, Human
ggacuguauuuguga

SEQ ID NO: 2623968 - RNA, 20 nt, Human
ggacuguagggagggcggca

SEQ ID NO: 2623969 - RNA, 18 nt, Human
ggacuguagggagggcgg

SEQ ID NO: 2623970 - RNA, 20 nt, Human
ggacugccuugaauaucccc

SEQ ID NO: 2623971 - RNA, 18 nt, Human
ggacugccccgugcagac

SEQ ID NO: 2623972 - RNA, 21 nt, Human
ggacugccagucccccugccc

SEQ ID NO: 2623973 - RNA, 21 nt, Human
ggacugccccgugcagacugg

SEQ ID NO: 2623974 - RNA, 12 nt, Human
ggacugggaggu

SEQ ID NO: 2623975 - RNA, 11 nt, Human
ggacugggagg

SEQ ID NO: 2623976 - RNA, 19 nt, Human
ggacugcuaaauaaaauuu

SEQ ID NO: 2623977 - RNA, 18 nt, Human
ggacugcuaaauaaaauu

SEQ ID NO: 2623978 - RNA, 23 nt, Human
ggacuggggaugugggagggagc

SEQ ID NO: 2623979 - RNA, 17 nt, Human
ggacuggggauguggga

SEQ ID NO: 2623980 - RNA, 23 nt, Human
ggacugggccacuucuggguggg

SEQ ID NO: 2623981 - RNA, 18 nt, Human
ggacuggguuuggacccc

SEQ ID NO: 2623982 - RNA, 13 nt, Human
ggacuggguuugg

SEQ ID NO: 2623983 - RNA, 15 nt, Human
ggacugggggccaga

SEQ ID NO: 2623984 - RNA, 11 nt, Human
ggacuggguuu

SEQ ID NO: 2623985 - RNA, 17 nt, Human
ggagagggaggucacug

SEQ ID NO: 2623986 - RNA, 14 nt, Human
ggagagggaugagg

SEQ ID NO: 2623987 - RNA, 21 nt, Human
ggagagggaugaggugcuggg

SEQ ID NO: 2623988 - RNA, 13 nt, Human
ggagagggagguc

SEQ ID NO: 2623989 - RNA, 15 nt, Human
ggagagcuggugccc

SEQ ID NO: 2623990 - RNA, 17 nt, Human
ggagagcuggugcccgg

SEQ ID NO: 2623991 - RNA, 18 nt, Human
ggagagcuggugcccgga

SEQ ID NO: 2623992 - RNA, 22 nt, Human
ggagagcuggagccuggugccc

SEQ ID NO: 2623993 - RNA, 18 nt, Human
ggagagcuggagccuggu

SEQ ID NO: 2623994 - RNA, 17 nt, Human
ggagagcuggagccugg

SEQ ID NO: 2623995 - RNA, 13 nt, Human
ggagagcuggagc

SEQ ID NO: 2623996 - RNA, 17 nt, Human
ggagacuaucagcccaa

SEQ ID NO: 2623997 - RNA, 16 nt, Human
ggagacuaagcccugu

SEQ ID NO: 2623998 - RNA, 22 nt, Human
ggagacuagauuuaugaauaca

SEQ ID NO: 2623999 - RNA, 14 nt, Human
ggagacuagauugc

SEQ ID NO: 2624000 - RNA, 19 nt, Human
ggagacuagauugccuuug

SEQ ID NO: 2624001 - RNA, 17 nt, Human
ggagagcuagcagcagg

SEQ ID NO: 2624002 - RNA, 21 nt, Human
ggagagcuagcagcagggagg

SEQ ID NO: 2624003 - RNA, 20 nt, Human
ggagaccgggguauccuggg

SEQ ID NO: 2624004 - RNA, 22 nt, Human
ggagacguacguaucagcggcc

SEQ ID NO: 2624005 - RNA, 10 nt, Human
ggagacuaga

SEQ ID NO: 2624006 - RNA, 14 nt, Human
uagugcaaaucaua

SEQ ID NO: 2624007 - RNA, 16 nt, Human
uagucacacguggucu

SEQ ID NO: 2624008 - RNA, 14 nt, Human
uagugcuaagugug

SEQ ID NO: 2624009 - RNA, 19 nt, Human
uagugcuaagugugaacug

SEQ ID NO: 2624010 - RNA, 18 nt, Human
uagugcuaagugugaacu

SEQ ID NO: 2624011 - RNA, 17 nt, Human
uagugcuaagugugaac

SEQ ID NO: 2624012 - RNA, 15 nt, Human
uagugcuaaguguga

SEQ ID NO: 2624013 - RNA, 18 nt, Human
uagugaugguuccccugu

SEQ ID NO: 2624014 - RNA, 14 nt, Human
uagugaugguuccc

SEQ ID NO: 2624015 - RNA, 23 nt, Human
uagugcuuuccuuuuuuaaaaau

SEQ ID NO: 2624016 - RNA, 13 nt, Human
uagugcugugaaa

SEQ ID NO: 2624017 - RNA, 16 nt, Human
uagugcugugaaaaaa

SEQ ID NO: 2624018 - RNA, 17 nt, Human
uagugcugugaaaaaaa

SEQ ID NO: 2624019 - RNA, 21 nt, Human
uagugcuuaaaaaucauugau

SEQ ID NO: 2624020 - RNA, 12 nt, Human
uagugcugugaa

SEQ ID NO: 2624021 - RNA, 22 nt, Human
uagugcugcugaagaugaauca

SEQ ID NO: 2624022 - RNA, 13 nt, Human
uagugcugcugaa

SEQ ID NO: 2624023 - RNA, 19 nt, Human
uagugcucgcuuucuaugu

SEQ ID NO: 2624024 - RNA, 18 nt, Human
uagucaaauugugugaaa

SEQ ID NO: 2624025 - RNA, 23 nt, Human
uagucaagaaaaauuauuguaua

SEQ ID NO: 2624026 - RNA, 15 nt, Human
uagucaagauugugu

SEQ ID NO: 2624027 - RNA, 13 nt, Human
uagucaagcuccu

SEQ ID NO: 2624028 - RNA, 14 nt, Human
uagucaagcuccuc

SEQ ID NO: 2624029 - RNA, 15 nt, Human
uagucaagcuccucc

SEQ ID NO: 2624030 - RNA, 21 nt, Human
uagucacauggccuaugcaca

SEQ ID NO: 2624031 - RNA, 13 nt, Human
uagugaugguucc

SEQ ID NO: 2624032 - RNA, 20 nt, Human
uaggcuacaauuuucuccca

SEQ ID NO: 2624033 - RNA, 15 nt, Human
uaggcuacaauuuuc

SEQ ID NO: 2624034 - RNA, 18 nt, Human
uaggcgagugccaggacu

SEQ ID NO: 2624035 - RNA, 14 nt, Human
uaggcgagugccag

SEQ ID NO: 2624036 - RNA, 13 nt, Human
uaggcgaucacaa

SEQ ID NO: 2624037 - RNA, 23 nt, Human
uaggcgaucacaacgugcauugu

SEQ ID NO: 2624038 - RNA, 16 nt, Human
uaggcgggaaggaggg

SEQ ID NO: 2624039 - RNA, 21 nt, Human
uaggcgggcggucagggguuc

SEQ ID NO: 2624040 - RNA, 22 nt, Human
uaguguaaaauaagaaugauuu

SEQ ID NO: 2624041 - RNA, 19 nt, Human
uaguguaaaauaagaauga

SEQ ID NO: 2624042 - RNA, 13 nt, Human
uaguguaaaauaa

SEQ ID NO: 2624043 - RNA, 23 nt, Human
uaguggucuuuguaagaguguag

SEQ ID NO: 2624044 - RNA, 20 nt, Human
uaguguaggucagcgugcuu

SEQ ID NO: 2624045 - RNA, 13 nt, Human
uaguugcuugccu

SEQ ID NO: 2624046 - RNA, 15 nt, Human
uaguugguguucaaa

SEQ ID NO: 2624047 - RNA, 16 nt, Human
uaguugcuccgccucu

SEQ ID NO: 2624048 - RNA, 15 nt, Human
uaguugcuccgccuc

SEQ ID NO: 2624049 - RNA, 17 nt, Human
uaguggauuacugccau

SEQ ID NO: 2624050 - RNA, 18 nt, Human
uaguggucuuuguaagag

SEQ ID NO: 2624051 - RNA, 18 nt, Human
uaguggauggaaggggcu

SEQ ID NO: 2624052 - RNA, 21 nt, Human
uaguggucuuuguaagagugu

SEQ ID NO: 2624053 - RNA, 19 nt, Human
uaguggucuuuguaagagu

SEQ ID NO: 2624054 - RNA, 11 nt, Human
uaguguaaaau

SEQ ID NO: 2624055 - RNA, 15 nt, Human
uaguggauggaaggg

SEQ ID NO: 2624056 - RNA, 15 nt, Human
uaguggauguucuga

SEQ ID NO: 2624057 - RNA, 13 nt, Human
uaguuucuccaag

SEQ ID NO: 2624058 - RNA, 17 nt, Human
uaguuucuguucugugg

SEQ ID NO: 2624059 - RNA, 16 nt, Human
uaguuucuguucugug

SEQ ID NO: 2624060 - RNA, 15 nt, Human
uaguuucuguucugu

SEQ ID NO: 2624061 - RNA, 14 nt, Human
uaguuucuguucug

SEQ ID NO: 2624062 - RNA, 23 nt, Human
uaguuugauuaaauucuugcaaa

SEQ ID NO: 2624063 - RNA, 12 nt, Human
uaguuugcaguu

SEQ ID NO: 2624064 - RNA, 17 nt, Human
uaguugucuuuccuggc

SEQ ID NO: 2624065 - RNA, 22 nt, Human
uaguugugaccuuaguguuucu

SEQ ID NO: 2624066 - RNA, 18 nt, Human
uaguugugaccuuagugu

SEQ ID NO: 2624067 - RNA, 17 nt, Human
uaguugugggugggaga

SEQ ID NO: 2624068 - RNA, 21 nt, Human
uaguuguaccgcaaugugacu

SEQ ID NO: 2624069 - RNA, 18 nt, Human
uaguuucagauauauauc

SEQ ID NO: 2624070 - RNA, 22 nt, Human
uaguuuaccugaauaaauggua

SEQ ID NO: 2624071 - RNA, 15 nt, Human
uaguuuacuauuuua

SEQ ID NO: 2624072 - RNA, 14 nt, Human
uauaccugugccuc

SEQ ID NO: 2624073 - RNA, 20 nt, Human
uauaccugauuuuuuuuccu

SEQ ID NO: 2624074 - RNA, 13 nt, Human
uauaccugugccu

SEQ ID NO: 2624075 - RNA, 22 nt, Human
uauaccugggcauacuaauaaa

SEQ ID NO: 2624076 - RNA, 17 nt, Human
uauacucacuuucuaga

SEQ ID NO: 2624077 - RNA, 16 nt, Human
uauacuauauuuaugg

SEQ ID NO: 2624078 - RNA, 16 nt, Human
uauacucuuucuguau

SEQ ID NO: 2624079 - RNA, 17 nt, Human
uauacucuuucuguaua

SEQ ID NO: 2624080 - RNA, 19 nt, Human
uauacucuuucuguauaua

SEQ ID NO: 2624081 - RNA, 22 nt, Human
uauacucuuucuguauauacuu

SEQ ID NO: 2624082 - RNA, 18 nt, Human
uauacucuagaugaaguu

SEQ ID NO: 2624083 - RNA, 20 nt, Human
uauacucuuauagacaacau

SEQ ID NO: 2624084 - RNA, 12 nt, Human
uauaauucugua

SEQ ID NO: 2624085 - RNA, 13 nt, Human
uauaauucuguaa

SEQ ID NO: 2624086 - RNA, 13 nt, Human
uauaauucccuau

SEQ ID NO: 2624087 - RNA, 12 nt, Human
uauaccugauuu

SEQ ID NO: 2624088 - RNA, 23 nt, Human
uauacccaugaacuuaaaaugaa

SEQ ID NO: 2624089 - RNA, 17 nt, Human
uauacccccugcaaagc

SEQ ID NO: 2624090 - RNA, 19 nt, Human
uauacccguacaacguguc

SEQ ID NO: 2624091 - RNA, 18 nt, Human
uauaaugaaugagagaau

SEQ ID NO: 2624092 - RNA, 15 nt, Human
uauaaugguugacug

SEQ ID NO: 2624093 - RNA, 16 nt, Human
uauaauggaguuaacg

SEQ ID NO: 2624094 - RNA, 14 nt, Human
uauaauguaagcuc

SEQ ID NO: 2624095 - RNA, 19 nt, Human
uauaauguaagcucuacug

SEQ ID NO: 2624096 - RNA, 20 nt, Human
uauaauguaagcucuacuga

SEQ ID NO: 2624097 - RNA, 20 nt, Human
uauaauucacauuguauuca

SEQ ID NO: 2624098 - RNA, 19 nt, Human
uauaaugguuucaaagauu

SEQ ID NO: 2624099 - RNA, 18 nt, Human
uauaaugguuucaaagau

SEQ ID NO: 2624100 - RNA, 17 nt, Human
uauaaugguuucaaaga

SEQ ID NO: 2624101 - RNA, 16 nt, Human
uauaaugguuucaaag

SEQ ID NO: 2624102 - RNA, 23 nt, Human
uauaaugguuucaaagauucaaa

SEQ ID NO: 2624103 - RNA, 17 nt, Human
uauaauucuacuuugag

SEQ ID NO: 2624104 - RNA, 18 nt, Human
uaguuucuguucugugga

SEQ ID NO: 2624105 - RNA, 17 nt, Human
uaguuugcauuccugau

SEQ ID NO: 2624106 - RNA, 11 nt, Human
uaguuugcauu

SEQ ID NO: 2624107 - RNA, 21 nt, Human
uaguuugauuauucaguguca

SEQ ID NO: 2624108 - RNA, 11 nt, Human
uaguuuggauu

SEQ ID NO: 2624109 - RNA, 18 nt, Human
uaguuugcauuccugaua

SEQ ID NO: 2624110 - RNA, 18 nt, Human
uaguuuguauaacuucuu

SEQ ID NO: 2624111 - RNA, 17 nt, Human
uaguuuguauaacuucu

SEQ ID NO: 2624112 - RNA, 14 nt, Human
uaguuuguauaacu

SEQ ID NO: 2624113 - RNA, 17 nt, Human
uaguuuguacaugcauu

SEQ ID NO: 2624114 - RNA, 13 nt, Human
uaguuugguucac

SEQ ID NO: 2624115 - RNA, 23 nt, Human
uaguuuuaaaaaaauaaaacauu

SEQ ID NO: 2624116 - RNA, 19 nt, Human
uaguuuguguguugucucu

SEQ ID NO: 2624117 - RNA, 14 nt, Human
uaguuuuacuuuua

SEQ ID NO: 2624118 - RNA, 23 nt, Human
uauaaauauauauaaauauauau

SEQ ID NO: 2624119 - RNA, 22 nt, Human
uauaaauauauauaaauauaua

SEQ ID NO: 2624120 - RNA, 21 nt, Human
uauaaauauauauaaauauau

SEQ ID NO: 2624121 - RNA, 19 nt, Human
uauaaauauauauaaauau

SEQ ID NO: 2624122 - RNA, 17 nt, Human
uauaaauauauauaaau

SEQ ID NO: 2624123 - RNA, 13 nt, Human
uauaaauauauau

SEQ ID NO: 2624124 - RNA, 14 nt, Human
uauaaauauauaua

SEQ ID NO: 2624125 - RNA, 15 nt, Human
uauaaauauauuuaa

SEQ ID NO: 2624126 - RNA, 10 nt, Human
uauaaauaug

SEQ ID NO: 2624127 - RNA, 15 nt, Human
uauaaaucaauguca

SEQ ID NO: 2624128 - RNA, 12 nt, Human
uauaaauauaua

SEQ ID NO: 2624129 - RNA, 10 nt, Human
uauaaauaua

SEQ ID NO: 2624130 - RNA, 19 nt, Human
uauaaauaggagaggauga

SEQ ID NO: 2624131 - RNA, 15 nt, Human
uaguuuuauaugcuu

SEQ ID NO: 2624132 - RNA, 20 nt, Human
uaguuuuacuuuuaaacugu

SEQ ID NO: 2624133 - RNA, 22 nt, Human
uaguuuuacuuuuaaacugugu

SEQ ID NO: 2624134 - RNA, 14 nt, Human
uaguuuuaguugca

SEQ ID NO: 2624135 - RNA, 16 nt, Human
uaguuuuaguugcaga

SEQ ID NO: 2624136 - RNA, 17 nt, Human
uaguuuuaguugcagaa

SEQ ID NO: 2624137 - RNA, 14 nt, Human
uauaaugaggauga

SEQ ID NO: 2624138 - RNA, 14 nt, Human
uauaaugaagcuuu

SEQ ID NO: 2624139 - RNA, 23 nt, Human
uauaaugaagcuuuauacgugua

SEQ ID NO: 2624140 - RNA, 20 nt, Human
uauaaugaaugaaacauuuu

SEQ ID NO: 2624141 - RNA, 22 nt, Human
uauaaauuuauuuacugcuagu

SEQ ID NO: 2624142 - RNA, 18 nt, Human
uauaaugaaugaaacauu

SEQ ID NO: 2624143 - RNA, 21 nt, Human
uauaaauuccucuuugcuuug

SEQ ID NO: 2624144 - RNA, 20 nt, Human
uauaaauuccucuuugcuuu

SEQ ID NO: 2624145 - RNA, 14 nt, Human
uauaaauuuauuua

SEQ ID NO: 2624146 - RNA, 18 nt, Human
uauaaaucgcuuuugaua

SEQ ID NO: 2624147 - RNA, 19 nt, Human
uauaaaucgcuuuugauaa

SEQ ID NO: 2624148 - RNA, 20 nt, Human
uauaaaucaaugucacuuaa

SEQ ID NO: 2624149 - RNA, 16 nt, Human
uauaaaucaaugucac

SEQ ID NO: 2624150 - RNA, 21 nt, Human
uauaaauuuuuuuuguuucau

SEQ ID NO: 2624151 - RNA, 15 nt, Human
uauaaauuuauuuac

SEQ ID NO: 2624152 - RNA, 16 nt, Human
uauaaauuuauuuacu

SEQ ID NO: 2624153 - RNA, 17 nt, Human
uauaaauuuuuuuuguu

SEQ ID NO: 2624154 - RNA, 19 nt, Human
uaucgaaauaacaauguua

SEQ ID NO: 2624155 - RNA, 18 nt, Human
uaucgaaauaacaauguu

SEQ ID NO: 2624156 - RNA, 16 nt, Human
uaucgaaauaacaaug

SEQ ID NO: 2624157 - RNA, 15 nt, Human
uaucgaaauaacaau

SEQ ID NO: 2624158 - RNA, 21 nt, Human
uaucgaaauaacaauguuaag

SEQ ID NO: 2624159 - RNA, 20 nt, Human
uaucgaaauaacaauguuaa

SEQ ID NO: 2624160 - RNA, 23 nt, Human
uaucgacuuguuuuugcacaugu

SEQ ID NO: 2624161 - RNA, 20 nt, Human
uaucgcaccacuguguauuu

SEQ ID NO: 2624162 - RNA, 19 nt, Human
uaucgauguuauguaaaag

SEQ ID NO: 2624163 - RNA, 16 nt, Human
uaucgaucucuuauuu

SEQ ID NO: 2624164 - RNA, 19 nt, Human
uaucgucacugcuuaacuu

SEQ ID NO: 2624165 - RNA, 16 nt, Human
uaucggagacagugau

SEQ ID NO: 2624166 - RNA, 18 nt, Human
uaucgcuucauguaacua

SEQ ID NO: 2624167 - RNA, 14 nt, Human
uaucggaagcagug

SEQ ID NO: 2624168 - RNA, 15 nt, Human
uaucggaagcagugc

SEQ ID NO: 2624169 - RNA, 15 nt, Human
uaucuaaauguugaa

SEQ ID NO: 2624170 - RNA, 14 nt, Human
uaucuaaaagaaau

SEQ ID NO: 2624171 - RNA, 14 nt, Human
uaucgggaacagug

SEQ ID NO: 2624172 - RNA, 23 nt, Human
uaucuaaacuggauucacagcuc

SEQ ID NO: 2624173 - RNA, 12 nt, Human
uaucucuguguu

SEQ ID NO: 2624174 - RNA, 22 nt, Human
uaucucuuuugaauccaugcuu

SEQ ID NO: 2624175 - RNA, 22 nt, Human
uaucaugugaaaucauucauuu

SEQ ID NO: 2624176 - RNA, 17 nt, Human
uaucaugugaaaucauu

SEQ ID NO: 2624177 - RNA, 14 nt, Human
uaucauguguaauc

SEQ ID NO: 2624178 - RNA, 13 nt, Human
uaucauguguaau

SEQ ID NO: 2624179 - RNA, 11 nt, Human
uaucaugugua

SEQ ID NO: 2624180 - RNA, 16 nt, Human
uaucaucaguauugaa

SEQ ID NO: 2624181 - RNA, 21 nt, Human
uaucaugucaaacgugaaaau

SEQ ID NO: 2624182 - RNA, 19 nt, Human
uaucauguguaaucaauaa

SEQ ID NO: 2624183 - RNA, 17 nt, Human
uaucauguguaaucaau

SEQ ID NO: 2624184 - RNA, 18 nt, Human
uauccugccaaaaucauu

SEQ ID NO: 2624185 - RNA, 15 nt, Human
uauccugccucagcc

SEQ ID NO: 2624186 - RNA, 12 nt, Human
uauccugccuca

SEQ ID NO: 2624187 - RNA, 11 nt, Human
uauccugccuc

SEQ ID NO: 2624188 - RNA, 22 nt, Human
uauccuggggcucccuucaucu

SEQ ID NO: 2624189 - RNA, 14 nt, Human
uaucgaaauaacaa

SEQ ID NO: 2624190 - RNA, 19 nt, Human
uauccugugacauguaaca

SEQ ID NO: 2624191 - RNA, 22 nt, Human
uauccugggggacccaauguag

SEQ ID NO: 2624192 - RNA, 10 nt, Human
uauccugggg

SEQ ID NO: 2624193 - RNA, 20 nt, Human
uauccugccucagcccgcca

SEQ ID NO: 2624194 - RNA, 16 nt, Human
uauccugccucagccc

SEQ ID NO: 2624195 - RNA, 22 nt, Human
uauccugcuucugauaugcagu

SEQ ID NO: 2624196 - RNA, 22 nt, Human
uaucauccacauuguuuuaaaa

SEQ ID NO: 2624197 - RNA, 17 nt, Human
uaucauccacauuguuu

SEQ ID NO: 2624198 - RNA, 16 nt, Human
uaucauccacauuguu

SEQ ID NO: 2624199 - RNA, 19 nt, Human
uaucaucuggauaggagcc

SEQ ID NO: 2624200 - RNA, 11 nt, Human
uaucaugaagc

SEQ ID NO: 2624201 - RNA, 16 nt, Human
uaucaugacaaagacu

SEQ ID NO: 2624202 - RNA, 16 nt, Human
uaucaugucaaacgug

SEQ ID NO: 2624203 - RNA, 15 nt, Human
uaucagugugccccc

SEQ ID NO: 2624204 - RNA, 13 nt, Human
uaucagugugccc

SEQ ID NO: 2624205 - RNA, 17 nt, Human
uaucaguguaagcccug

SEQ ID NO: 2624206 - RNA, 15 nt, Human
uaucaguuacucagc

SEQ ID NO: 2624207 - RNA, 23 nt, Human
uaucagugcucgagacacaguga

SEQ ID NO: 2624208 - RNA, 20 nt, Human
uaucagugacagaguucacu

SEQ ID NO: 2624209 - RNA, 22 nt, Human
uaucagugacagaguucacuau

SEQ ID NO: 2624210 - RNA, 15 nt, Human
uaucagugacagagu

SEQ ID NO: 2624211 - RNA, 16 nt, Human
uaucagugacagaguu

SEQ ID NO: 2624212 - RNA, 17 nt, Human
uaucagugacagaguuc

SEQ ID NO: 2624213 - RNA, 15 nt, Human
uaucaguugcaauaa

SEQ ID NO: 2624214 - RNA, 22 nt, Human
uaucaucaguauugaagcauuu

SEQ ID NO: 2624215 - RNA, 21 nt, Human
uaucaguugcaauaauacuuc

SEQ ID NO: 2624216 - RNA, 14 nt, Human
uaucaguugcaaua

SEQ ID NO: 2624217 - RNA, 21 nt, Human
uaucaguuacucagcccuggg

SEQ ID NO: 2624218 - RNA, 17 nt, Human
uaucagugugcccccca

SEQ ID NO: 2624219 - RNA, 16 nt, Human
uaucaguuacucagcc

SEQ ID NO: 2624220 - RNA, 17 nt, Human
uaucaguuacucagccc

SEQ ID NO: 2624221 - RNA, 18 nt, Human
uaucaguuacucagcccu

SEQ ID NO: 2624222 - RNA, 19 nt, Human
uaucaguuacucagcccug

SEQ ID NO: 2624223 - RNA, 20 nt, Human
uaucaguuacucagcccugg

SEQ ID NO: 2624224 - RNA, 21 nt, Human
uaucaguugagcuucauauac

SEQ ID NO: 2624225 - RNA, 20 nt, Human
uaucagcggccccuugacuc

SEQ ID NO: 2624226 - RNA, 20 nt, Human
uaucaggacccagaggaagg

SEQ ID NO: 2624227 - RNA, 21 nt, Human
uaucaggacccagaggaaggg

SEQ ID NO: 2624228 - RNA, 14 nt, Human
uaucagcuucagaa

SEQ ID NO: 2624229 - RNA, 19 nt, Human
uaucagcggccccuugacu

SEQ ID NO: 2624230 - RNA, 22 nt, Human
uaucagccugucucuuccauau

SEQ ID NO: 2624231 - RNA, 19 nt, Human
uaucagccugucucuucca

SEQ ID NO: 2624232 - RNA, 13 nt, Human
uaucagccugucu

SEQ ID NO: 2624233 - RNA, 11 nt, Human
uaucagccugu

SEQ ID NO: 2624234 - RNA, 19 nt, Human
uaucagccugagucuccug

SEQ ID NO: 2624235 - RNA, 13 nt, Human
uaucagccugagu

SEQ ID NO: 2624236 - RNA, 14 nt, Human
uaucagucucugag

SEQ ID NO: 2624237 - RNA, 22 nt, Human
uaucagucauaacuaaauaaag

SEQ ID NO: 2624238 - RNA, 23 nt, Human
uaucaggugcccaucccuggaag

SEQ ID NO: 2624239 - RNA, 16 nt, Human
uaucaggugcccaucc

SEQ ID NO: 2624240 - RNA, 23 nt, Human
uaucaggucucccacgugggaga

SEQ ID NO: 2624241 - RNA, 15 nt, Human
uaucaggucucccac

SEQ ID NO: 2624242 - RNA, 17 nt, Human
uaucaggugcugccauc

SEQ ID NO: 2624243 - RNA, 19 nt, Human
uauauuuuuuguuaaauga

SEQ ID NO: 2624244 - RNA, 12 nt, Human
uauauuuuuguc

SEQ ID NO: 2624245 - RNA, 15 nt, Human
uaucagcacgugugg

SEQ ID NO: 2624246 - RNA, 19 nt, Human
uauauuuuugguugucaau

SEQ ID NO: 2624247 - RNA, 18 nt, Human
uauauuuuugguugucaa

SEQ ID NO: 2624248 - RNA, 18 nt, Human
uauauuuuuauauuuagu

SEQ ID NO: 2624249 - RNA, 15 nt, Human
uauauuuuucacagu

SEQ ID NO: 2624250 - RNA, 20 nt, Human
uauauuuuuauauuuaguua

SEQ ID NO: 2624251 - RNA, 21 nt, Human
uauauuuuauacauuaacuuc

SEQ ID NO: 2624252 - RNA, 19 nt, Human
uauauacaaccugcuuggg

SEQ ID NO: 2624253 - RNA, 16 nt, Human
uauauacaauaacaua

SEQ ID NO: 2624254 - RNA, 17 nt, Human
uauauacaauaacauaa

SEQ ID NO: 2624255 - RNA, 19 nt, Human
uauauaaugguuucaaaga

SEQ ID NO: 2624256 - RNA, 17 nt, Human
uauauaauucuguacau

SEQ ID NO: 2624257 - RNA, 16 nt, Human
uauauaauucuguaca

SEQ ID NO: 2624258 - RNA, 14 nt, Human
uauauaauucugua

SEQ ID NO: 2624259 - RNA, 22 nt, Human
uauauaauuacauauuugcaua

SEQ ID NO: 2624260 - RNA, 19 nt, Human
uauauaaguguacauaugu

SEQ ID NO: 2624261 - RNA, 23 nt, Human
uauacuuguggacuaaaagauau

SEQ ID NO: 2624262 - RNA, 22 nt, Human
uauacuuguggacuaaaagaua

SEQ ID NO: 2624263 - RNA, 15 nt, Human
uauauaaugguuuca

SEQ ID NO: 2624264 - RNA, 23 nt, Human
uauauaaguguacauaugugcug

SEQ ID NO: 2624265 - RNA, 23 nt, Human
uauauaauacugacugagaauau

SEQ ID NO: 2624266 - RNA, 22 nt, Human
uauacuguaauuuaguuauuga

SEQ ID NO: 2624267 - RNA, 23 nt, Human
uauacuguaaagaaagagagaaa

SEQ ID NO: 2624268 - RNA, 17 nt, Human
uauacucuuuuuucaug

SEQ ID NO: 2624269 - RNA, 17 nt, Human
uauacuguauuaagagu

SEQ ID NO: 2624270 - RNA, 13 nt, Human
uauacuguauuaa

SEQ ID NO: 2624271 - RNA, 14 nt, Human
uauacuguaauuua

SEQ ID NO: 2624272 - RNA, 22 nt, Human
uauacuguaaagaaagagagaa

SEQ ID NO: 2624273 - RNA, 15 nt, Human
uauacuguaauuuag

SEQ ID NO: 2624274 - RNA, 16 nt, Human
uauacuguacuuaaua

SEQ ID NO: 2624275 - RNA, 21 nt, Human
uauacuuguggacuaaaagau

SEQ ID NO: 2624276 - RNA, 17 nt, Human
uauacuuguggacuaaa

SEQ ID NO: 2624277 - RNA, 22 nt, Human
uauacuuaaauggaaaaaauga

SEQ ID NO: 2624278 - RNA, 23 nt, Human
uauauacaguaacuuuaugugua

SEQ ID NO: 2624279 - RNA, 21 nt, Human
uauauacauuuaugaauuaaa

SEQ ID NO: 2624280 - RNA, 20 nt, Human
uauauacccguacaacgugu

SEQ ID NO: 2624281 - RNA, 18 nt, Human
uauauacgcaucuauaaa

SEQ ID NO: 2624282 - RNA, 22 nt, Human
uauauacaauaacauaauuugu

SEQ ID NO: 2624283 - RNA, 22 nt, Human
uauauacaguaacuuuaugugu

SEQ ID NO: 2624284 - RNA, 17 nt, Human
uauauacaguaacuuua

SEQ ID NO: 2624285 - RNA, 14 nt, Human
uauauacaguaacu

SEQ ID NO: 2624286 - RNA, 20 nt, Human
uauauacaaccugcuugggu

SEQ ID NO: 2624287 - RNA, 15 nt, Human
uauauacauauauau

SEQ ID NO: 2624288 - RNA, 22 nt, Human
uauaugaauuuaaauauaauuc

SEQ ID NO: 2624289 - RNA, 19 nt, Human
uauauagagauguuuuuaa

SEQ ID NO: 2624290 - RNA, 16 nt, Human
uauauagagauguuuu

SEQ ID NO: 2624291 - RNA, 14 nt, Human
uauauagagauguu

SEQ ID NO: 2624292 - RNA, 13 nt, Human
uauauagagaugu

SEQ ID NO: 2624293 - RNA, 21 nt, Human
uauaugauuuauaguuuguac

SEQ ID NO: 2624294 - RNA, 16 nt, Human
uauaugauuuauaguu

SEQ ID NO: 2624295 - RNA, 15 nt, Human
uauaugauuuauagu

SEQ ID NO: 2624296 - RNA, 13 nt, Human
uauaugauggggg

SEQ ID NO: 2624297 - RNA, 19 nt, Human
uauaugaggacuugugucu

SEQ ID NO: 2624298 - RNA, 22 nt, Human
uauauggaugauucagaaauug

SEQ ID NO: 2624299 - RNA, 21 nt, Human
uauaugcacuuauaauuuucc

SEQ ID NO: 2624300 - RNA, 19 nt, Human
uauauguacuugucaaaga

SEQ ID NO: 2624301 - RNA, 13 nt, Human
uauauguacuugu

SEQ ID NO: 2624302 - RNA, 12 nt, Human
uauauguacaug

SEQ ID NO: 2624303 - RNA, 23 nt, Human
uauauggcagaguuguaaauaua

SEQ ID NO: 2624304 - RNA, 17 nt, Human
uauauggccucaagauc

SEQ ID NO: 2624305 - RNA, 22 nt, Human
uauauggcagaguuguaaauau

SEQ ID NO: 2624306 - RNA, 20 nt, Human
uauauggcagaguuguaaau

SEQ ID NO: 2624307 - RNA, 19 nt, Human
uauauggcagaguuguaaa

SEQ ID NO: 2624308 - RNA, 18 nt, Human
uauauggcagaguuguaa

SEQ ID NO: 2624309 - RNA, 16 nt, Human
uauaugccaugaugga

SEQ ID NO: 2624310 - RNA, 16 nt, Human
uauauggcaagaaagc

SEQ ID NO: 2624311 - RNA, 23 nt, Human
uauauuuauuacuguaagaaaau

SEQ ID NO: 2624312 - RNA, 20 nt, Human
uauauuuauuacuguaagaa

SEQ ID NO: 2624313 - RNA, 12 nt, Human
uauauguaugug

SEQ ID NO: 2624314 - RNA, 21 nt, Human
uauauuucccugaaggaacca

SEQ ID NO: 2624315 - RNA, 16 nt, Human
uauauuucacuauuuu

SEQ ID NO: 2624316 - RNA, 14 nt, Human
uauauuugaaauau

SEQ ID NO: 2624317 - RNA, 22 nt, Human
uauauuugugauagcacuuucu

SEQ ID NO: 2624318 - RNA, 23 nt, Human
uauauuugugauagcacuuucua

SEQ ID NO: 2624319 - RNA, 13 nt, Human
uauauuugaaaua

SEQ ID NO: 2624320 - RNA, 14 nt, Human
uauauuuuaagacg

SEQ ID NO: 2624321 - RNA, 16 nt, Human
uauauuuuacaauuuu

SEQ ID NO: 2624322 - RNA, 14 nt, Human
uauauuuuaauuug

SEQ ID NO: 2624323 - RNA, 13 nt, Human
uauauuuuaagac

SEQ ID NO: 2624324 - RNA, 13 nt, Human
uauauuuuaagaa

SEQ ID NO: 2624325 - RNA, 20 nt, Human
uauauuuguguauuuaacag

SEQ ID NO: 2624326 - RNA, 14 nt, Human
uauauuucuuuguu

SEQ ID NO: 2624327 - RNA, 16 nt, Human
uauauuuguguauuua

SEQ ID NO: 2624328 - RNA, 15 nt, Human
uagacuugaaauacu

SEQ ID NO: 2624329 - RNA, 18 nt, Human
uagacuugugcugaucgu

SEQ ID NO: 2624330 - RNA, 19 nt, Human
uagagaacgcagcccuaga

SEQ ID NO: 2624331 - RNA, 17 nt, Human
uagagaacgcagcccua

SEQ ID NO: 2624332 - RNA, 16 nt, Human
uagagaacgcagcccu

SEQ ID NO: 2624333 - RNA, 12 nt, Human
uagacuuucugu

SEQ ID NO: 2624334 - RNA, 11 nt, Human
uagacuuucug

SEQ ID NO: 2624335 - RNA, 21 nt, Human
uagaccucagccugugcugcc

SEQ ID NO: 2624336 - RNA, 22 nt, Human
uagaccucagccugugcugccc

SEQ ID NO: 2624337 - RNA, 20 nt, Human
uagacucuuacuuuuuaaaa

SEQ ID NO: 2624338 - RNA, 14 nt, Human
uagaccucagccug

SEQ ID NO: 2624339 - RNA, 15 nt, Human
uagaccucagccugu

SEQ ID NO: 2624340 - RNA, 16 nt, Human
uagaccucagccugug

SEQ ID NO: 2624341 - RNA, 20 nt, Human
uagaccucagccugugcugc

SEQ ID NO: 2624342 - RNA, 20 nt, Human
uagacccugggugggcucug

SEQ ID NO: 2624343 - RNA, 16 nt, Human
uagacccugggugggc

SEQ ID NO: 2624344 - RNA, 12 nt, Human
uagacccugggu

SEQ ID NO: 2624345 - RNA, 19 nt, Human
uagaccuagggaggaccuu

SEQ ID NO: 2624346 - RNA, 22 nt, Human
uagaccuagggaggaccuuauc

SEQ ID NO: 2624347 - RNA, 11 nt, Human
uagaccucagc

SEQ ID NO: 2624348 - RNA, 12 nt, Human
uagaccucagcc

SEQ ID NO: 2624349 - RNA, 13 nt, Human
uagaccucagccu

SEQ ID NO: 2624350 - RNA, 14 nt, Human
uagacccucucaag

SEQ ID NO: 2624351 - RNA, 23 nt, Human
uagaaccuagagaagcuaaaacc

SEQ ID NO: 2624352 - RNA, 23 nt, Human
uagaaccuagaagggcuagaacc

SEQ ID NO: 2624353 - RNA, 17 nt, Human
uagaaccuagaagggcu

SEQ ID NO: 2624354 - RNA, 16 nt, Human
uagaaccuagaagggc

SEQ ID NO: 2624355 - RNA, 14 nt, Human
uagaaccuagaagg

SEQ ID NO: 2624356 - RNA, 13 nt, Human
uagaaccuagaag

SEQ ID NO: 2624357 - RNA, 23 nt, Human
uagaaccaggcaacuugggaacu

SEQ ID NO: 2624358 - RNA, 22 nt, Human
uagaacccggcaggcuagaacc

SEQ ID NO: 2624359 - RNA, 16 nt, Human
uagaaccacuaugaag

SEQ ID NO: 2624360 - RNA, 12 nt, Human
uagaaccaggca

SEQ ID NO: 2624361 - RNA, 22 nt, Human
uagaaccaccaacaagcaagcu

SEQ ID NO: 2624362 - RNA, 20 nt, Human
uagaaccaccaacaagcaag

SEQ ID NO: 2624363 - RNA, 15 nt, Human
uagaaccacuaugaa

SEQ ID NO: 2624364 - RNA, 16 nt, Human
uagagagagaccacuu

SEQ ID NO: 2624365 - RNA, 19 nt, Human
uagagacgggguuucacca

SEQ ID NO: 2624366 - RNA, 16 nt, Human
uagagaacuguggccg

SEQ ID NO: 2624367 - RNA, 13 nt, Human
uagagagcuauuu

SEQ ID NO: 2624368 - RNA, 13 nt, Human
uagagaggaaaag

SEQ ID NO: 2624369 - RNA, 16 nt, Human
uagagagggagaagaa

SEQ ID NO: 2624370 - RNA, 19 nt, Human
uagagagggagaagaaguc

SEQ ID NO: 2624371 - RNA, 19 nt, Human
uagagguucaaagauauuu

SEQ ID NO: 2624372 - RNA, 16 nt, Human
uagagguucaaagaua

SEQ ID NO: 2624373 - RNA, 21 nt, Human
uagagguucaaagauauuuug

SEQ ID NO: 2624374 - RNA, 19 nt, Human
uagagguuuuguuguuuua

SEQ ID NO: 2624375 - RNA, 19 nt, Human
uagagguuuuaaagugauu

SEQ ID NO: 2624376 - RNA, 15 nt, Human
uagagguuuuaaagu

SEQ ID NO: 2624377 - RNA, 16 nt, Human
uagagguuuuguuguu

SEQ ID NO: 2624378 - RNA, 19 nt, Human
uagaguagaagauuugaug

SEQ ID NO: 2624379 - RNA, 14 nt, Human
uagaguauaugcac

SEQ ID NO: 2624380 - RNA, 13 nt, Human
uagagucagccuu

SEQ ID NO: 2624381 - RNA, 14 nt, Human
uagagucagccuuc

SEQ ID NO: 2624382 - RNA, 21 nt, Human
uagaguagaagauuugaugcu

SEQ ID NO: 2624383 - RNA, 21 nt, Human
uagagucaucuccaucagcug

SEQ ID NO: 2624384 - RNA, 22 nt, Human
uagagucaucuccaucagcugu

SEQ ID NO: 2624385 - RNA, 23 nt, Human
uagagucaucuccaucagcugua

SEQ ID NO: 2624386 - RNA, 22 nt, Human
uagaguccaacguggggcagca

SEQ ID NO: 2624387 - RNA, 19 nt, Human
uagaguccaacguggggca

SEQ ID NO: 2624388 - RNA, 18 nt, Human
uagaguuuagcuggaaaa

SEQ ID NO: 2624389 - RNA, 17 nt, Human
uagaguuuagcuggaaa

SEQ ID NO: 2624390 - RNA, 17 nt, Human
uagaguuugcuauuaga

SEQ ID NO: 2624391 - RNA, 12 nt, Human
uagauaaacuca

SEQ ID NO: 2624392 - RNA, 12 nt, Human
uagaguuuaaca

SEQ ID NO: 2624393 - RNA, 13 nt, Human
uagaguuuaacac

SEQ ID NO: 2624394 - RNA, 22 nt, Human
uagaugggaaugaagcuugugu

SEQ ID NO: 2624395 - RNA, 19 nt, Human
uagaugggaaugaagcuug

SEQ ID NO: 2624396 - RNA, 18 nt, Human
uagaugggaaugaagcuu

SEQ ID NO: 2624397 - RNA, 17 nt, Human
uagaugggaaugaagcu

SEQ ID NO: 2624398 - RNA, 18 nt, Human
uagauacaugcuuuuuaa

SEQ ID NO: 2624399 - RNA, 15 nt, Human
uagaugggaaugaag

SEQ ID NO: 2624400 - RNA, 18 nt, Human
uagauaauacaccacuac

SEQ ID NO: 2624401 - RNA, 23 nt, Human
uagauaacaagaccucagugccu

SEQ ID NO: 2624402 - RNA, 18 nt, Human
uagauaaauaaauauaug

SEQ ID NO: 2624403 - RNA, 15 nt, Human
uagauaaacucagaa

SEQ ID NO: 2624404 - RNA, 12 nt, Human
uagauguauaua

SEQ ID NO: 2624405 - RNA, 16 nt, Human
uagauggugcugagaa

SEQ ID NO: 2624406 - RNA, 19 nt, Human
uagauggugcugagaagcu

SEQ ID NO: 2624407 - RNA, 20 nt, Human
uagauguagauaaacucaga

SEQ ID NO: 2624408 - RNA, 22 nt, Human
uagaugggucuggcugagcuga

SEQ ID NO: 2624409 - RNA, 20 nt, Human
uagaugggucuggcugagcu

SEQ ID NO: 2624410 - RNA, 16 nt, Human
uagaugggucuggcug

SEQ ID NO: 2624411 - RNA, 20 nt, Human
uagaugggcauggggugggc

SEQ ID NO: 2624412 - RNA, 23 nt, Human
uagaugggaaugaagcuugugua

SEQ ID NO: 2624413 - RNA, 21 nt, Human
uagaugggagggaggcucagg

SEQ ID NO: 2624414 - RNA, 15 nt, Human
uagauggugaaauuu

SEQ ID NO: 2624415 - RNA, 14 nt, Human
uagauggugaaauu

SEQ ID NO: 2624416 - RNA, 14 nt, Human
uagauggugcugag

SEQ ID NO: 2624417 - RNA, 15 nt, Human
uagauggugcugaga

SEQ ID NO: 2624418 - RNA, 19 nt, Human
uagaugguuugagccugag

SEQ ID NO: 2624419 - RNA, 22 nt, Human
uagauguucucuaucauuuaau

SEQ ID NO: 2624420 - RNA, 21 nt, Human
uagauguucucuaucauuuaa

SEQ ID NO: 2624421 - RNA, 19 nt, Human
uagauguucucuaucauuu

SEQ ID NO: 2624422 - RNA, 18 nt, Human
uagauguucucuaucauu

SEQ ID NO: 2624423 - RNA, 14 nt, Human
uagauguucucuau

SEQ ID NO: 2624424 - RNA, 21 nt, Human
uagauguucuaagucuuucca

SEQ ID NO: 2624425 - RNA, 22 nt, Human
uagauguucagauugcuuugau

SEQ ID NO: 2624426 - RNA, 17 nt, Human
uagauguucagauugcu

SEQ ID NO: 2624427 - RNA, 18 nt, Human
uagauguuccaguaaucu

SEQ ID NO: 2624428 - RNA, 19 nt, Human
uagaugugauuuaauagug

SEQ ID NO: 2624429 - RNA, 15 nt, Human
uagaugugauuuaau

SEQ ID NO: 2624430 - RNA, 13 nt, Human
uagaugugauuua

SEQ ID NO: 2624431 - RNA, 21 nt, Human
uagaugucuuuaggcagcagc

SEQ ID NO: 2624432 - RNA, 11 nt, Human
uagaugugugg

SEQ ID NO: 2624433 - RNA, 23 nt, Human
uagaugugauuuaauaguguuaa

SEQ ID NO: 2624434 - RNA, 21 nt, Human
uagaugugauuuaauaguguu

SEQ ID NO: 2624435 - RNA, 22 nt, Human
uagaugugcauuuuugugaaau

SEQ ID NO: 2624436 - RNA, 16 nt, Human
uagauguauguacuuc

SEQ ID NO: 2624437 - RNA, 23 nt, Human
uagauguagauaaacucagaaau

SEQ ID NO: 2624438 - RNA, 20 nt, Human
uagauguauguacuucaugc

SEQ ID NO: 2624439 - RNA, 18 nt, Human
uagaugucccuuucuugg

SEQ ID NO: 2624440 - RNA, 21 nt, Human
uagaugucccuuucuuggcca

SEQ ID NO: 2624441 - RNA, 22 nt, Human
uagaugucccuuucuuggccag

SEQ ID NO: 2624442 - RNA, 21 nt, Human
uagaugucuagguacuucagg

SEQ ID NO: 2624443 - RNA, 23 nt, Human
uagaugucccuuucuuggccagu

SEQ ID NO: 2624444 - RNA, 23 nt, Human
uagcagagaaugaaagggcccag

SEQ ID NO: 2624445 - RNA, 19 nt, Human
uagcagagaaugaaagggc

SEQ ID NO: 2624446 - RNA, 18 nt, Human
uagcagagagacuuucag

SEQ ID NO: 2624447 - RNA, 15 nt, Human
uagcagacaguguuu

SEQ ID NO: 2624448 - RNA, 13 nt, Human
uagcagacaggcc

SEQ ID NO: 2624449 - RNA, 19 nt, Human
uagcagacaggccccguga

SEQ ID NO: 2624450 - RNA, 20 nt, Human
uagcagauuuuaauuuugaa

SEQ ID NO: 2624451 - RNA, 14 nt, Human
uagcagauuuuaau

SEQ ID NO: 2624452 - RNA, 20 nt, Human
uagcagcagccuuuaaugca

SEQ ID NO: 2624453 - RNA, 20 nt, Human
uagcagcaccguucugugca

SEQ ID NO: 2624454 - RNA, 19 nt, Human
uagcagcaccguucugugc

SEQ ID NO: 2624455 - RNA, 18 nt, Human
uagcagauuuuaauuuug

SEQ ID NO: 2624456 - RNA, 20 nt, Human
uagcagggcauggcugggaa

SEQ ID NO: 2624457 - RNA, 23 nt, Human
uagcaggugguccugagaccuga

SEQ ID NO: 2624458 - RNA, 21 nt, Human
uagcagggaaaauauauaucu

SEQ ID NO: 2624459 - RNA, 14 nt, Human
uagcagggaaaaua

SEQ ID NO: 2624460 - RNA, 15 nt, Human
uagcaggugguccug

SEQ ID NO: 2624461 - RNA, 17 nt, Human
uagcagguaccacugau

SEQ ID NO: 2624462 - RNA, 23 nt, Human
uagcagaagguugcaccuccccc

SEQ ID NO: 2624463 - RNA, 11 nt, Human
uagcagacagg

SEQ ID NO: 2624464 - RNA, 16 nt, Human
uagcacuuugggaggc

SEQ ID NO: 2624465 - RNA, 23 nt, Human
uagauugaaaacuuuucucagau

SEQ ID NO: 2624466 - RNA, 21 nt, Human
uagauugagaaguuuuguaca

SEQ ID NO: 2624467 - RNA, 21 nt, Human
uagauugaaaacuuuucucag

SEQ ID NO: 2624468 - RNA, 20 nt, Human
uagauugaaaacuuuucuca

SEQ ID NO: 2624469 - RNA, 18 nt, Human
uagauugaaaacuuuucu

SEQ ID NO: 2624470 - RNA, 16 nt, Human
uagauuguuaaaauaa

SEQ ID NO: 2624471 - RNA, 18 nt, Human
uagauuaagagauggguu

SEQ ID NO: 2624472 - RNA, 20 nt, Human
uagauucuacauauucuuua

SEQ ID NO: 2624473 - RNA, 23 nt, Human
uagauguucucuaucauuuaaua

SEQ ID NO: 2624474 - RNA, 18 nt, Human
uagcugggggugggccag

SEQ ID NO: 2624475 - RNA, 16 nt, Human
uaggaaaugaaugugu

SEQ ID NO: 2624476 - RNA, 15 nt, Human
uagcugggauuacag

SEQ ID NO: 2624477 - RNA, 18 nt, Human
uaggaaaugaaugugugu

SEQ ID NO: 2624478 - RNA, 22 nt, Human
uaggaaauggcuuugugauuca

SEQ ID NO: 2624479 - RNA, 23 nt, Human
uaggaaauggcuuugugauucaa

SEQ ID NO: 2624480 - RNA, 14 nt, Human
uaggaacacuccuu

SEQ ID NO: 2624481 - RNA, 13 nt, Human
uaggaacacuccu

SEQ ID NO: 2624482 - RNA, 15 nt, Human
uaggaacugcugggc

SEQ ID NO: 2624483 - RNA, 18 nt, Human
uaggaacugcugggcuug

SEQ ID NO: 2624484 - RNA, 21 nt, Human
uaggaacuuaaauaaugugaa

SEQ ID NO: 2624485 - RNA, 17 nt, Human
uaggaacacuccuucac

SEQ ID NO: 2624486 - RNA, 19 nt, Human
uaggaaaugaaugugugug

SEQ ID NO: 2624487 - RNA, 20 nt, Human
uaggaacgguaaauuucugu

SEQ ID NO: 2624488 - RNA, 16 nt, Human
uaggaacauaugaaaa

SEQ ID NO: 2624489 - RNA, 17 nt, Human
uaggaagacuuuggaaa

SEQ ID NO: 2624490 - RNA, 16 nt, Human
uaggaagacuuuggaa

SEQ ID NO: 2624491 - RNA, 22 nt, Human
uaggaagaguagcauuucauuc

SEQ ID NO: 2624492 - RNA, 22 nt, Human
uaggaagaauuuuaaaaaugaa

SEQ ID NO: 2624493 - RNA, 19 nt, Human
uaggaagagaaaccaggga

SEQ ID NO: 2624494 - RNA, 15 nt, Human
uaggaagagaaacca

SEQ ID NO: 2624495 - RNA, 21 nt, Human
uaggaagaauuuuaaaaauga

SEQ ID NO: 2624496 - RNA, 18 nt, Human
uaggaagaauuuuaaaaa

SEQ ID NO: 2624497 - RNA, 14 nt, Human
uaggaagagaaacc

SEQ ID NO: 2624498 - RNA, 15 nt, Human
uaggaagacuuugga

SEQ ID NO: 2624499 - RNA, 14 nt, Human
uaggaagacuuugg

SEQ ID NO: 2624500 - RNA, 13 nt, Human
uaggaagacuuug

SEQ ID NO: 2624501 - RNA, 17 nt, Human
uaggaagaauuuuaaaa

SEQ ID NO: 2624502 - RNA, 15 nt, Human
uaggaagaauuuuaa

SEQ ID NO: 2624503 - RNA, 13 nt, Human
uaggaagaauuuu

SEQ ID NO: 2624504 - RNA, 23 nt, Human
uaggaauugacccacaagaaaug

SEQ ID NO: 2624505 - RNA, 20 nt, Human
uaggaauugacccacaagaa

SEQ ID NO: 2624506 - RNA, 14 nt, Human
uaggaauuguguuu

SEQ ID NO: 2624507 - RNA, 22 nt, Human
uaggaaguguaacagcugaggu

SEQ ID NO: 2624508 - RNA, 18 nt, Human
uaggaaguguaacagcug

SEQ ID NO: 2624509 - RNA, 19 nt, Human
uaggaaguguaacagcuga

SEQ ID NO: 2624510 - RNA, 20 nt, Human
uaggaaguguaacagcugag

SEQ ID NO: 2624511 - RNA, 21 nt, Human
uaggaaguguaacagcugagg

SEQ ID NO: 2624512 - RNA, 16 nt, Human
uaggaaguaaauuaua

SEQ ID NO: 2624513 - RNA, 17 nt, Human
uaggaaguguaacagcu

SEQ ID NO: 2624514 - RNA, 18 nt, Human
uaggaagggaccaaggca

SEQ ID NO: 2624515 - RNA, 15 nt, Human
uaggaagggaccaag

SEQ ID NO: 2624516 - RNA, 15 nt, Human
uaggaagguuaaugu

SEQ ID NO: 2624517 - RNA, 13 nt, Human
uaggccaugggac

SEQ ID NO: 2624518 - RNA, 17 nt, Human
uaggccguuccuucaaa

SEQ ID NO: 2624519 - RNA, 13 nt, Human
uaggccacuccuc

SEQ ID NO: 2624520 - RNA, 14 nt, Human
uaggccacuccucc

SEQ ID NO: 2624521 - RNA, 15 nt, Human
uaggccacuccucca

SEQ ID NO: 2624522 - RNA, 19 nt, Human
uaggccaaauuuguagugc

SEQ ID NO: 2624523 - RNA, 12 nt, Human
uaggaauaaaua

SEQ ID NO: 2624524 - RNA, 17 nt, Human
uaggccuggcacagugu

SEQ ID NO: 2624525 - RNA, 14 nt, Human
uaggccuggcacag

SEQ ID NO: 2624526 - RNA, 22 nt, Human
uaggccucagccagagaagcua

SEQ ID NO: 2624527 - RNA, 16 nt, Human
uaggccucagccagag

SEQ ID NO: 2624528 - RNA, 18 nt, Human
uaggccucagccagagaa

SEQ ID NO: 2624529 - RNA, 14 nt, Human
uaggccuggccaga

SEQ ID NO: 2624530 - RNA, 13 nt, Human
uaggccuggccag

SEQ ID NO: 2624531 - RNA, 20 nt, Human
uaggccaugaaaaaaaugau

SEQ ID NO: 2624532 - RNA, 14 nt, Human
uaggccucagccag

SEQ ID NO: 2624533 - RNA, 14 nt, Human
uaggccaugaaaaa

SEQ ID NO: 2624534 - RNA, 22 nt, Human
uagcucauucuccuuguguuac

SEQ ID NO: 2624535 - RNA, 17 nt, Human
uagccugccucuucucu

SEQ ID NO: 2624536 - RNA, 20 nt, Human
uagcuccccuccucuccccu

SEQ ID NO: 2624537 - RNA, 15 nt, Human
uagcuccccuccucu

SEQ ID NO: 2624538 - RNA, 14 nt, Human
uagcuccccuccuc

SEQ ID NO: 2624539 - RNA, 13 nt, Human
uagcuccccuccu

SEQ ID NO: 2624540 - RNA, 14 nt, Human
uagcucccuguucu

SEQ ID NO: 2624541 - RNA, 14 nt, Human
uagcuccccuccaa

SEQ ID NO: 2624542 - RNA, 21 nt, Human
uagcuccccgcuucugccugc

SEQ ID NO: 2624543 - RNA, 20 nt, Human
uagccucgccgucugugaau

SEQ ID NO: 2624544 - RNA, 19 nt, Human
uagccuccuucgcaggcau

SEQ ID NO: 2624545 - RNA, 20 nt, Human
uagcuccacacccucuccca

SEQ ID NO: 2624546 - RNA, 16 nt, Human
uagcuccuguggcccc

SEQ ID NO: 2624547 - RNA, 14 nt, Human
uagcuccuguggcc

SEQ ID NO: 2624548 - RNA, 13 nt, Human
uagcuccuguggc

SEQ ID NO: 2624549 - RNA, 12 nt, Human
uagcuccugugg

SEQ ID NO: 2624550 - RNA, 22 nt, Human
uagcuccuguggccccacccug

SEQ ID NO: 2624551 - RNA, 20 nt, Human
uagcuccuguggccccaccc

SEQ ID NO: 2624552 - RNA, 17 nt, Human
uagcucugagccaguuc

SEQ ID NO: 2624553 - RNA, 17 nt, Human
uagcucuauguuuacaa

SEQ ID NO: 2624554 - RNA, 21 nt, Human
uagcucuaggagggcuggcaa

SEQ ID NO: 2624555 - RNA, 20 nt, Human
uagcugggacuacaggcacc

SEQ ID NO: 2624556 - RNA, 22 nt, Human
uagcugggagaaagagagagcu

SEQ ID NO: 2624557 - RNA, 18 nt, Human
uagcugggacuacaggug

SEQ ID NO: 2624558 - RNA, 13 nt, Human
uagcugcuacaaa

SEQ ID NO: 2624559 - RNA, 12 nt, Human
uagcugcuacaa

SEQ ID NO: 2624560 - RNA, 20 nt, Human
uagcucuuaauuguucauuu

SEQ ID NO: 2624561 - RNA, 19 nt, Human
uagcuggaacuacaggcuc

SEQ ID NO: 2624562 - RNA, 21 nt, Human
uagcugcuacaaagaagacau

SEQ ID NO: 2624563 - RNA, 23 nt, Human
uagcugcuacaaagaagacaugu

SEQ ID NO: 2624564 - RNA, 20 nt, Human
uagcugcuacaaagaagaca

SEQ ID NO: 2624565 - RNA, 19 nt, Human
uagcugcuacaaagaagac

SEQ ID NO: 2624566 - RNA, 16 nt, Human
uagcugcuacaaagaa

SEQ ID NO: 2624567 - RNA, 15 nt, Human
uagcugcuacaaaga

SEQ ID NO: 2624568 - RNA, 11 nt, Human
uagcugggacu

SEQ ID NO: 2624569 - RNA, 20 nt, Human
uagcccgccugccaguccua

SEQ ID NO: 2624570 - RNA, 18 nt, Human
uagcccucacccuggggc

SEQ ID NO: 2624571 - RNA, 16 nt, Human
uagcccuggccagagg

SEQ ID NO: 2624572 - RNA, 18 nt, Human
uagcccuggccagaggcu

SEQ ID NO: 2624573 - RNA, 19 nt, Human
uagcccgccugccaguccu

SEQ ID NO: 2624574 - RNA, 16 nt, Human
uagcccgccugccagu

SEQ ID NO: 2624575 - RNA, 15 nt, Human
uagcccgccugccag

SEQ ID NO: 2624576 - RNA, 14 nt, Human
uagcccgccugcca

SEQ ID NO: 2624577 - RNA, 16 nt, Human
uagccccacaggaggu

SEQ ID NO: 2624578 - RNA, 22 nt, Human
uagcccauggacuucacauaag

SEQ ID NO: 2624579 - RNA, 12 nt, Human
uagccucccuga

SEQ ID NO: 2624580 - RNA, 15 nt, Human
uagccugaguagaaa

SEQ ID NO: 2624581 - RNA, 17 nt, Human
uagccuccugaccugag

SEQ ID NO: 2624582 - RNA, 13 nt, Human
uagccucccugaa

SEQ ID NO: 2624583 - RNA, 14 nt, Human
uagcccuuucugug

SEQ ID NO: 2624584 - RNA, 13 nt, Human
uagcccuuucugu

SEQ ID NO: 2624585 - RNA, 17 nt, Human
uagcccuuucugugugc

SEQ ID NO: 2624586 - RNA, 15 nt, Human
uagcccuuucugugu

SEQ ID NO: 2624587 - RNA, 13 nt, Human
uagccgaccucag

SEQ ID NO: 2624588 - RNA, 15 nt, Human
uagccgaccucagcc

SEQ ID NO: 2624589 - RNA, 16 nt, Human
uagccuaggugacaga

SEQ ID NO: 2624590 - RNA, 14 nt, Human
uagccgaccucagc

SEQ ID NO: 2624591 - RNA, 17 nt, Human
uagccuauauuuacagu

SEQ ID NO: 2624592 - RNA, 13 nt, Human
uagccaugaccuu

SEQ ID NO: 2624593 - RNA, 15 nt, Human
uagcauacauuuaua

SEQ ID NO: 2624594 - RNA, 22 nt, Human
uagcaggugguccugagaccug

SEQ ID NO: 2624595 - RNA, 14 nt, Human
uagcccaaaaccaa

SEQ ID NO: 2624596 - RNA, 14 nt, Human
uagccaugggacca

SEQ ID NO: 2624597 - RNA, 13 nt, Human
uagccaugggacc

SEQ ID NO: 2624598 - RNA, 21 nt, Human
uagcauacauuuauaauguuu

SEQ ID NO: 2624599 - RNA, 19 nt, Human
uagccauuccugguaccca

SEQ ID NO: 2624600 - RNA, 18 nt, Human
uagccauuccugguaccc

SEQ ID NO: 2624601 - RNA, 22 nt, Human
uagccauuccugguacccagcc

SEQ ID NO: 2624602 - RNA, 21 nt, Human
uagcccaucccugccugguca

SEQ ID NO: 2624603 - RNA, 20 nt, Human
uagcccaucccugccugguc

SEQ ID NO: 2624604 - RNA, 18 nt, Human
uagcccaucccugccugg

SEQ ID NO: 2624605 - RNA, 17 nt, Human
uagcccaucccugccug

SEQ ID NO: 2624606 - RNA, 16 nt, Human
uagcccaucccugccu

SEQ ID NO: 2624607 - RNA, 15 nt, Human
uagcccaucccugcc

SEQ ID NO: 2624608 - RNA, 14 nt, Human
uagcccaucccugc

SEQ ID NO: 2624609 - RNA, 12 nt, Human
uagcccaucccu

SEQ ID NO: 2624610 - RNA, 18 nt, Human
uagcccaggagagagaaa

SEQ ID NO: 2624611 - RNA, 17 nt, Human
uagcccaggagagagaa

SEQ ID NO: 2624612 - RNA, 22 nt, Human
uagcccaggagagagaaagcca

SEQ ID NO: 2624613 - RNA, 19 nt, Human
uagcccagguccucugaua

SEQ ID NO: 2624614 - RNA, 18 nt, Human
uagcccaaugaaaugaau

SEQ ID NO: 2624615 - RNA, 23 nt, Human
uagcccacacuugagaggaugaa

SEQ ID NO: 2624616 - RNA, 15 nt, Human
uagcccacucugcuc

SEQ ID NO: 2624617 - RNA, 16 nt, Human
uagcccaggagagaga

SEQ ID NO: 2624618 - RNA, 15 nt, Human
uagcccaggagagag

SEQ ID NO: 2624619 - RNA, 14 nt, Human
uagcccaggagaga

SEQ ID NO: 2624620 - RNA, 13 nt, Human
uagcccaggagag

SEQ ID NO: 2624621 - RNA, 12 nt, Human
uagcccaggaga

SEQ ID NO: 2624622 - RNA, 17 nt, Human
uacacuguuucaaacuu

SEQ ID NO: 2624623 - RNA, 18 nt, Human
uacacuguuucaaacuuu

SEQ ID NO: 2624624 - RNA, 19 nt, Human
uacacuguuucaaacuuua

SEQ ID NO: 2624625 - RNA, 23 nt, Human
uacacuuuaugccggaugugcuu

SEQ ID NO: 2624626 - RNA, 22 nt, Human
uacacuuuaugccggaugugcu

SEQ ID NO: 2624627 - RNA, 21 nt, Human
uacacuuuaugccggaugugc

SEQ ID NO: 2624628 - RNA, 22 nt, Human
uacacugggagaggugccagca

SEQ ID NO: 2624629 - RNA, 13 nt, Human
uacacuuuaugca

SEQ ID NO: 2624630 - RNA, 18 nt, Human
uacacuuuuuuggggaua

SEQ ID NO: 2624631 - RNA, 13 nt, Human
uacagaaagcugc

SEQ ID NO: 2624632 - RNA, 21 nt, Human
uacagaaagauggaugugcuu

SEQ ID NO: 2624633 - RNA, 21 nt, Human
uacagaauugugucugcagga

SEQ ID NO: 2624634 - RNA, 19 nt, Human
uacagaauugugucugcag

SEQ ID NO: 2624635 - RNA, 18 nt, Human
uacagaauugugucugca

SEQ ID NO: 2624636 - RNA, 15 nt, Human
uacagcacuacucug

SEQ ID NO: 2624637 - RNA, 20 nt, Human
uacagaauugugucugcagg

SEQ ID NO: 2624638 - RNA, 14 nt, Human
uacagcacuacucu

SEQ ID NO: 2624639 - RNA, 24 nt, Human
uacagcaaggagauuuacaacugg

SEQ ID NO: 2624640 - RNA, 13 nt, Human
uacagaauuuuau

SEQ ID NO: 2624641 - RNA, 21 nt, Human
uacagaauucugcuaccucac

SEQ ID NO: 2624642 - RNA, 18 nt, Human
uacagaauucugcuaccu

SEQ ID NO: 2624643 - RNA, 16 nt, Human
uacagaacucuuucaa

SEQ ID NO: 2624644 - RNA, 17 nt, Human
uacagaacucuuucaaa

SEQ ID NO: 2624645 - RNA, 19 nt, Human
uacagaacucuuucaaaac

SEQ ID NO: 2624646 - RNA, 23 nt, Human
uacagaacccauuccauuuaucu

SEQ ID NO: 2624647 - RNA, 20 nt, Human
uacagaaaguggugcucagu

SEQ ID NO: 2624648 - RNA, 10 nt, Human
uacagaaagu

SEQ ID NO: 2624649 - RNA, 14 nt, Human
uacagaaagcugcc

SEQ ID NO: 2624650 - RNA, 17 nt, Human
uacagaaauuagccggg

SEQ ID NO: 2624651 - RNA, 19 nt, Human
uacagaacacgcuuucaca

SEQ ID NO: 2624652 - RNA, 22 nt, Human
uacagaaaguggugcucaguug

SEQ ID NO: 2624653 - RNA, 24 nt, Human
uacagaaaguggugcucaguugua

SEQ ID NO: 2624654 - RNA, 18 nt, Human
uacagaaauuagccgggc

SEQ ID NO: 2624655 - RNA, 18 nt, Human
uacaggaaaagcugcuga

SEQ ID NO: 2624656 - RNA, 17 nt, Human
uacaggaaaagcugcug

SEQ ID NO: 2624657 - RNA, 23 nt, Human
uacagcuugaccgugaggccaga

SEQ ID NO: 2624658 - RNA, 14 nt, Human
uacagcgagaggca

SEQ ID NO: 2624659 - RNA, 19 nt, Human
uacagccccuuuuucauau

SEQ ID NO: 2624660 - RNA, 18 nt, Human
uacagcuuucaugauuag

SEQ ID NO: 2624661 - RNA, 21 nt, Human
uacagcuugaccgugaggcca

SEQ ID NO: 2624662 - RNA, 17 nt, Human
uacagcccaccuggcuu

SEQ ID NO: 2624663 - RNA, 22 nt, Human
uacagcuugaccgugaggccag

SEQ ID NO: 2624664 - RNA, 19 nt, Human
uacagcacuacucugugcc

SEQ ID NO: 2624665 - RNA, 22 nt, Human
uacagcauuacaaauugcuuac

SEQ ID NO: 2624666 - RNA, 21 nt, Human
uacagcauuacaaauugcuua

SEQ ID NO: 2624667 - RNA, 16 nt, Human
uacagcauuacaaauu

SEQ ID NO: 2624668 - RNA, 17 nt, Human
uacagcacuacucugug

SEQ ID NO: 2624669 - RNA, 22 nt, Human
uacagccaaagauaaucucuca

SEQ ID NO: 2624670 - RNA, 18 nt, Human
uacagccaaagauaaucu

SEQ ID NO: 2624671 - RNA, 14 nt, Human
uacaggauuugaaa

SEQ ID NO: 2624672 - RNA, 16 nt, Human
uacaggcacccaccau

SEQ ID NO: 2624673 - RNA, 19 nt, Human
uacaggaaaagcugcugac

SEQ ID NO: 2624674 - RNA, 22 nt, Human
uacagcuuugugacuguauaua

SEQ ID NO: 2624675 - RNA, 20 nt, Human
uacagcuuugugacuguaua

SEQ ID NO: 2624676 - RNA, 19 nt, Human
uacagcuuugaucccugac

SEQ ID NO: 2624677 - RNA, 21 nt, Human
uacaggaagcaccccaugcca

SEQ ID NO: 2624678 - RNA, 16 nt, Human
uacaguguacagucuu

SEQ ID NO: 2624679 - RNA, 15 nt, Human
uacaguguacagucu

SEQ ID NO: 2624680 - RNA, 22 nt, Human
uacagugguuuuauacugaagg

SEQ ID NO: 2624681 - RNA, 20 nt, Human
uacaggcaccgagaauguug

SEQ ID NO: 2624682 - RNA, 22 nt, Human
uacaguguacagucuuguauua

SEQ ID NO: 2624683 - RNA, 14 nt, Human
uacaggcacaaaau

SEQ ID NO: 2624684 - RNA, 20 nt, Human
uacaggauuugaacucagau

SEQ ID NO: 2624685 - RNA, 23 nt, Human
uacaggauuugaacucagaucug

SEQ ID NO: 2624686 - RNA, 14 nt, Human
uacaggcaccgaga

SEQ ID NO: 2624687 - RNA, 19 nt, Human
uacaggcaccgagaauguu

SEQ ID NO: 2624688 - RNA, 15 nt, Human
uacaggcagcacaga

SEQ ID NO: 2624689 - RNA, 21 nt, Human
uacagugguuuuauacugaag

SEQ ID NO: 2624690 - RNA, 13 nt, Human
uacaguguacagu

SEQ ID NO: 2624691 - RNA, 21 nt, Human
uacaagauuagaagcugaaaa

SEQ ID NO: 2624692 - RNA, 17 nt, Human
uacaauuuuuuaucaug

SEQ ID NO: 2624693 - RNA, 20 nt, Human
uacaauuuuuuuaauuuugu

SEQ ID NO: 2624694 - RNA, 13 nt, Human
uacaagauuagaa

SEQ ID NO: 2624695 - RNA, 23 nt, Human
uacaauuuuuuaucaugcauguc

SEQ ID NO: 2624696 - RNA, 22 nt, Human
uacaauuuuuuuaauuuuguau

SEQ ID NO: 2624697 - RNA, 21 nt, Human
uacaauuuuuuuaauuuugua

SEQ ID NO: 2624698 - RNA, 23 nt, Human
uacacaaaacaaaugccacacau

SEQ ID NO: 2624699 - RNA, 14 nt, Human
uacacaaguaaaca

SEQ ID NO: 2624700 - RNA, 15 nt, Human
uacaagacacaguga

SEQ ID NO: 2624701 - RNA, 16 nt, Human
uacaagagcagccugu

SEQ ID NO: 2624702 - RNA, 19 nt, Human
uacaagagcagccuguggc

SEQ ID NO: 2624703 - RNA, 19 nt, Human
uacaagagcuuaacagugu

SEQ ID NO: 2624704 - RNA, 20 nt, Human
uacaagagcagccuguggca

SEQ ID NO: 2624705 - RNA, 23 nt, Human
uacaagagcagccuguggcaucu

SEQ ID NO: 2624706 - RNA, 24 nt, Human
uacaagaugaaggagaggcaacau

SEQ ID NO: 2624707 - RNA, 22 nt, Human
uaauuuugguuguauucuuuga

SEQ ID NO: 2624708 - RNA, 21 nt, Human
uaauuuugguuguauucuuug

SEQ ID NO: 2624709 - RNA, 18 nt, Human
uaauuuugguuguauucu

SEQ ID NO: 2624710 - RNA, 17 nt, Human
uaauuuugguuguauuc

SEQ ID NO: 2624711 - RNA, 14 nt, Human
uaauuuugguugua

SEQ ID NO: 2624712 - RNA, 18 nt, Human
uaauuuuguauuuuccaa

SEQ ID NO: 2624713 - RNA, 15 nt, Human
uaauuuuguauuuuc

SEQ ID NO: 2624714 - RNA, 21 nt, Human
uaauuuuguauuuuccaagug

SEQ ID NO: 2624715 - RNA, 13 nt, Human
uaauuuuguauuu

SEQ ID NO: 2624716 - RNA, 14 nt, Human
uaauuuuguauuuu

SEQ ID NO: 2624717 - RNA, 17 nt, Human
uaauuuugaaaaacugc

SEQ ID NO: 2624718 - RNA, 13 nt, Human
uaauuuugaaaaa

SEQ ID NO: 2624719 - RNA, 21 nt, Human
uaauuuugacacuauaucugu

SEQ ID NO: 2624720 - RNA, 12 nt, Human
uaauuuugacac

SEQ ID NO: 2624721 - RNA, 15 nt, Human
uaauuuugaauaaau

SEQ ID NO: 2624722 - RNA, 12 nt, Human
uaauuuucuacc

SEQ ID NO: 2624723 - RNA, 14 nt, Human
uaauuuucuucaug

SEQ ID NO: 2624724 - RNA, 23 nt, Human
uaauuuucuucaugcaaugacau

SEQ ID NO: 2624725 - RNA, 18 nt, Human
uacacagagcaggacugc

SEQ ID NO: 2624726 - RNA, 18 nt, Human
uacacagaaauacaguua

SEQ ID NO: 2624727 - RNA, 22 nt, Human
uacacagaucacagcuucagcc

SEQ ID NO: 2624728 - RNA, 22 nt, Human
uacacacugcauguuugugauu

SEQ ID NO: 2624729 - RNA, 16 nt, Human
uacacugugcugaguc

SEQ ID NO: 2624730 - RNA, 14 nt, Human
uacacuguuucaaa

SEQ ID NO: 2624731 - RNA, 21 nt, Human
uacacuggaggagagaagaau

SEQ ID NO: 2624732 - RNA, 19 nt, Human
uacacuggaggagagaaga

SEQ ID NO: 2624733 - RNA, 22 nt, Human
uacacuggaggagagaagaaug

SEQ ID NO: 2624734 - RNA, 21 nt, Human
uacacugguuugagcuuagug

SEQ ID NO: 2624735 - RNA, 16 nt, Human
uacacuguauuuguau

SEQ ID NO: 2624736 - RNA, 12 nt, Human
uacacugugaac

SEQ ID NO: 2624737 - RNA, 23 nt, Human
uacacaaugguuuucuugugugu

SEQ ID NO: 2624738 - RNA, 21 nt, Human
uacacaaugguuuucuugugu

SEQ ID NO: 2624739 - RNA, 16 nt, Human
uacacaaguaaacauu

SEQ ID NO: 2624740 - RNA, 15 nt, Human
uacacaaguaaacau

SEQ ID NO: 2624741 - RNA, 17 nt, Human
uacacaaugguuuucuu

SEQ ID NO: 2624742 - RNA, 15 nt, Human
uacacacacauacac

SEQ ID NO: 2624743 - RNA, 21 nt, Human
uacacacacacgcgugcacac

SEQ ID NO: 2624744 - RNA, 22 nt, Human
uacacacacacacacagccaca

SEQ ID NO: 2624745 - RNA, 23 nt, Human
uacacacacacacacagccacac

SEQ ID NO: 2624746 - RNA, 22 nt, Human
uacacaccuaagggacauguuu

SEQ ID NO: 2624747 - RNA, 17 nt, Human
uacacaccuaagggaca

SEQ ID NO: 2624748 - RNA, 17 nt, Human
uacacacugcauguuug

SEQ ID NO: 2624749 - RNA, 18 nt, Human
uacacaccuuauauuuac

SEQ ID NO: 2624750 - RNA, 22 nt, Human
uacauccucaugcagccgugau

SEQ ID NO: 2624751 - RNA, 22 nt, Human
uacauaagcggcguaaguuuaa

SEQ ID NO: 2624752 - RNA, 22 nt, Human
uacaguucaguuccucuuugca

SEQ ID NO: 2624753 - RNA, 15 nt, Human
uacauaaguaauuca

SEQ ID NO: 2624754 - RNA, 22 nt, Human
uacauaagauaaaugugcugaa

SEQ ID NO: 2624755 - RNA, 20 nt, Human
uacaucuauuuuggauugua

SEQ ID NO: 2624756 - RNA, 22 nt, Human
uacaucuauuuuggauuguaua

SEQ ID NO: 2624757 - RNA, 23 nt, Human
uacaucuauuuuggauuguauau

SEQ ID NO: 2624758 - RNA, 18 nt, Human
uacaucuauuuuggauug

SEQ ID NO: 2624759 - RNA, 19 nt, Human
uacaucuauuuuggauugu

SEQ ID NO: 2624760 - RNA, 14 nt, Human
uacaucgcccucca

SEQ ID NO: 2624761 - RNA, 15 nt, Human
uacauccucaugcag

SEQ ID NO: 2624762 - RNA, 15 nt, Human
uacaucgcccuccac

SEQ ID NO: 2624763 - RNA, 18 nt, Human
uacaugagaacaaacaga

SEQ ID NO: 2624764 - RNA, 16 nt, Human
uacaugagaaggaacu

SEQ ID NO: 2624765 - RNA, 16 nt, Human
uacaugacauuuauuu

SEQ ID NO: 2624766 - RNA, 21 nt, Human
uacaugacauuuauuuuucau

SEQ ID NO: 2624767 - RNA, 17 nt, Human
uacaugagaacaaacag

SEQ ID NO: 2624768 - RNA, 19 nt, Human
uacaugacucagcauaccu

SEQ ID NO: 2624769 - RNA, 17 nt, Human
uacaucuucugccuuag

SEQ ID NO: 2624770 - RNA, 14 nt, Human
uacaucuucugccu

SEQ ID NO: 2624771 - RNA, 14 nt, Human
uacaucuuucacau

SEQ ID NO: 2624772 - RNA, 18 nt, Human
uacaugaauugcauuuua

SEQ ID NO: 2624773 - RNA, 23 nt, Human
uacaguuacucagaauucucuag

SEQ ID NO: 2624774 - RNA, 13 nt, Human
uacaguuaaguuu

SEQ ID NO: 2624775 - RNA, 19 nt, Human
uacaguuacucagaauucu

SEQ ID NO: 2624776 - RNA, 16 nt, Human
uacaguguuauuuucu

SEQ ID NO: 2624777 - RNA, 15 nt, Human
uacaguguucuguuu

SEQ ID NO: 2624778 - RNA, 14 nt, Human
uacaguguucuguu

SEQ ID NO: 2624779 - RNA, 19 nt, Human
uacaguguuauuuucuuug

SEQ ID NO: 2624780 - RNA, 12 nt, Human
uacaguucaguu

SEQ ID NO: 2624781 - RNA, 18 nt, Human
uacauaagauaaaugugc

SEQ ID NO: 2624782 - RNA, 19 nt, Human
uacauaagauaaaugugcu

SEQ ID NO: 2624783 - RNA, 20 nt, Human
uacaugcaauuuauuaaaau

SEQ ID NO: 2624784 - RNA, 23 nt, Human
uacauuuggagacacaacuauuu

SEQ ID NO: 2624785 - RNA, 16 nt, Human
uacauuuguauaaaau

SEQ ID NO: 2624786 - RNA, 11 nt, Human
uacauuugugu

SEQ ID NO: 2624787 - RNA, 17 nt, Human
uacauuuguauaaaaua

SEQ ID NO: 2624788 - RNA, 21 nt, Human
uacaugagguacugagaguga

SEQ ID NO: 2624789 - RNA, 22 nt, Human
uacaugagguacugagagugaa

SEQ ID NO: 2624790 - RNA, 15 nt, Human
uacaugauucauuuu

SEQ ID NO: 2624791 - RNA, 19 nt, Human
uacaugcaauuuauuaaaa

SEQ ID NO: 2624792 - RNA, 16 nt, Human
uacaugcaauuuauua

SEQ ID NO: 2624793 - RNA, 14 nt, Human
uacaugauucauuu

SEQ ID NO: 2624794 - RNA, 14 nt, Human
uacauuuuauauua

SEQ ID NO: 2624795 - RNA, 18 nt, Human
uaccaaaauuauuucaga

SEQ ID NO: 2624796 - RNA, 17 nt, Human
uaccaaaauuauuucag

SEQ ID NO: 2624797 - RNA, 16 nt, Human
uaccaacacgagcagg

SEQ ID NO: 2624798 - RNA, 23 nt, Human
uaccaaaauuauuucagaaaugu

SEQ ID NO: 2624799 - RNA, 13 nt, Human
uaccaacuuucug

SEQ ID NO: 2624800 - RNA, 20 nt, Human
uaccaacuguuuagggcccu

SEQ ID NO: 2624801 - RNA, 20 nt, Human
uaccaaaugcuuuaaaaacu

SEQ ID NO: 2624802 - RNA, 12 nt, Human
uaccaaccuguu

SEQ ID NO: 2624803 - RNA, 18 nt, Human
uaccaaaccgccagcgaa

SEQ ID NO: 2624804 - RNA, 17 nt, Human
uaccaaaugcuuuaaaa

SEQ ID NO: 2624805 - RNA, 19 nt, Human
uacccacccccacccaagg

SEQ ID NO: 2624806 - RNA, 17 nt, Human
uacccacccccacccaa

SEQ ID NO: 2624807 - RNA, 19 nt, Human
uacccacaccucugccaga

SEQ ID NO: 2624808 - RNA, 17 nt, Human
uacccacaccucugcca

SEQ ID NO: 2624809 - RNA, 18 nt, Human
uacccacaccucugccag

SEQ ID NO: 2624810 - RNA, 23 nt, Human
uacccacccccacccaagggccu

SEQ ID NO: 2624811 - RNA, 21 nt, Human
uaccauuuuuuaaggaaacaa

SEQ ID NO: 2624812 - RNA, 22 nt, Human
uacccaaaggauacuguaacac

SEQ ID NO: 2624813 - RNA, 11 nt, Human
uacccaaagga

SEQ ID NO: 2624814 - RNA, 12 nt, Human
uacccaagcaaa

SEQ ID NO: 2624815 - RNA, 21 nt, Human
uacccaaccacucaaauuaau

SEQ ID NO: 2624816 - RNA, 13 nt, Human
uacccaaccacuc

SEQ ID NO: 2624817 - RNA, 17 nt, Human
uacccaaauccucucca

SEQ ID NO: 2624818 - RNA, 15 nt, Human
uacccacccccaccc

SEQ ID NO: 2624819 - RNA, 12 nt, Human
uacccaccccca

SEQ ID NO: 2624820 - RNA, 22 nt, Human
uacccaggugcuaggaacacuc

SEQ ID NO: 2624821 - RNA, 18 nt, Human
uacccagcgagcccuggu

SEQ ID NO: 2624822 - RNA, 16 nt, Human
uacccagcgagcccug

SEQ ID NO: 2624823 - RNA, 14 nt, Human
uacccacugcucug

SEQ ID NO: 2624824 - RNA, 13 nt, Human
uacccacugcucu

SEQ ID NO: 2624825 - RNA, 12 nt, Human
uacccacugcuc

SEQ ID NO: 2624826 - RNA, 11 nt, Human
uacccacugcu

SEQ ID NO: 2624827 - RNA, 20 nt, Human
uacccacguucucacaccca

SEQ ID NO: 2624828 - RNA, 13 nt, Human
uaccacagugucu

SEQ ID NO: 2624829 - RNA, 23 nt, Human
uaccauucagugauuacugucaa

SEQ ID NO: 2624830 - RNA, 23 nt, Human
uaccacaggaaccacaagacugc

SEQ ID NO: 2624831 - RNA, 15 nt, Human
uaccaccacgcccgg

SEQ ID NO: 2624832 - RNA, 12 nt, Human
uaccacagcagc

SEQ ID NO: 2624833 - RNA, 19 nt, Human
uaccaaugcuuuuaucaaa

SEQ ID NO: 2624834 - RNA, 14 nt, Human
uaccacagugucug

SEQ ID NO: 2624835 - RNA, 12 nt, Human
uaccauuucaga

SEQ ID NO: 2624836 - RNA, 15 nt, Human
uaccauuucagagag

SEQ ID NO: 2624837 - RNA, 14 nt, Human
uaccauuuauacaa

SEQ ID NO: 2624838 - RNA, 15 nt, Human
uaccauuuauacaaa

SEQ ID NO: 2624839 - RNA, 17 nt, Human
uaccauuuauacaaauu

SEQ ID NO: 2624840 - RNA, 18 nt, Human
uaccauuuauacaaauua

SEQ ID NO: 2624841 - RNA, 15 nt, Human
uaccauuugccuccc

SEQ ID NO: 2624842 - RNA, 16 nt, Human
uaccauuucagagagg

SEQ ID NO: 2624843 - RNA, 21 nt, Human
uaccauuuauacaaauuagaa

SEQ ID NO: 2624844 - RNA, 20 nt, Human
uaccauuuuuuaaggaaaca

SEQ ID NO: 2624845 - RNA, 23 nt, Human
uaccauuuugggguacccacugc

SEQ ID NO: 2624846 - RNA, 22 nt, Human
uaccaauagauuccccauugcc

SEQ ID NO: 2624847 - RNA, 19 nt, Human
uaccaacuuucuguaaacu

SEQ ID NO: 2624848 - RNA, 17 nt, Human
uaccaacuuucuguaaa

SEQ ID NO: 2624849 - RNA, 15 nt, Human
uaccaacuuucugua

SEQ ID NO: 2624850 - RNA, 14 nt, Human
uaccaacuuucugu

SEQ ID NO: 2624851 - RNA, 21 nt, Human
uaccaaguuucagguauuaag

SEQ ID NO: 2624852 - RNA, 16 nt, Human
uaccaaguuucaggua

SEQ ID NO: 2624853 - RNA, 13 nt, Human
uaccacagacaua

SEQ ID NO: 2624854 - RNA, 14 nt, Human
uaccaaugcaugca

SEQ ID NO: 2624855 - RNA, 12 nt, Human
uaccaaugcaug

SEQ ID NO: 2624856 - RNA, 11 nt, Human
uaccaaugcau

SEQ ID NO: 2624857 - RNA, 13 nt, Human
uaccaaugcugca

SEQ ID NO: 2624858 - RNA, 13 nt, Human
uaccaaugcaugc

SEQ ID NO: 2624859 - RNA, 15 nt, Human
uaccaaugaaaaaau

SEQ ID NO: 2624860 - RNA, 17 nt, Human
uaccaaugaaaaaaugu

SEQ ID NO: 2624861 - RNA, 13 nt, Human
uaccaaugaaaaa

SEQ ID NO: 2624862 - RNA, 22 nt, Human
uaccaaucauuuuaauuauuau

SEQ ID NO: 2624863 - RNA, 20 nt, Human
uaccaaucauuuuaauuauu

SEQ ID NO: 2624864 - RNA, 19 nt, Human
uaccaaucauuuuaauuau

SEQ ID NO: 2624865 - RNA, 15 nt, Human
uaccaaucauuuuaa

SEQ ID NO: 2624866 - RNA, 22 nt, Human
uacccaucccauaugccugggc

SEQ ID NO: 2624867 - RNA, 12 nt, Human
uacccauauccc

SEQ ID NO: 2624868 - RNA, 15 nt, Human
uacccauauccccuc

SEQ ID NO: 2624869 - RNA, 17 nt, Human
uacccauccccgcagug

SEQ ID NO: 2624870 - RNA, 19 nt, Human
uacccaguaacucaucugu

SEQ ID NO: 2624871 - RNA, 22 nt, Human
uacccaguaacucaucugucac

SEQ ID NO: 2624872 - RNA, 16 nt, Human
uacccagggccugcag

SEQ ID NO: 2624873 - RNA, 21 nt, Human
uacccacguucucacacccac

SEQ ID NO: 2624874 - RNA, 14 nt, Human
uacccaccucagcc

SEQ ID NO: 2624875 - RNA, 15 nt, Human
uacccaccucagccu

SEQ ID NO: 2624876 - RNA, 22 nt, Human
uaccuucucccucauuucagga

SEQ ID NO: 2624877 - RNA, 15 nt, Human
uaccuugaggucuuu

SEQ ID NO: 2624878 - RNA, 14 nt, Human
uaccuucuguaguu

SEQ ID NO: 2624879 - RNA, 14 nt, Human
uaccuucucccuca

SEQ ID NO: 2624880 - RNA, 22 nt, Human
uaccuugaaaauaagaauagaa

SEQ ID NO: 2624881 - RNA, 18 nt, Human
uaccuugaacacuggggg

SEQ ID NO: 2624882 - RNA, 16 nt, Human
uaccuuccuucccugg

SEQ ID NO: 2624883 - RNA, 15 nt, Human
uaccuuccuucccug

SEQ ID NO: 2624884 - RNA, 14 nt, Human
uaccuuccuucccu

SEQ ID NO: 2624885 - RNA, 18 nt, Human
uacccaugacuuuauaug

SEQ ID NO: 2624886 - RNA, 22 nt, Human
uacccauccccgcagugugcac

SEQ ID NO: 2624887 - RNA, 21 nt, Human
uacccauucguggugaucaau

SEQ ID NO: 2624888 - RNA, 20 nt, Human
uaccuuuguauucucuccug

SEQ ID NO: 2624889 - RNA, 19 nt, Human
uaccuuugacaaagguaaa

SEQ ID NO: 2624890 - RNA, 13 nt, Human
uaccuugguuccc

SEQ ID NO: 2624891 - RNA, 22 nt, Human
uaccuugguucccccacugauc

SEQ ID NO: 2624892 - RNA, 16 nt, Human
uaccuuguauacugua

SEQ ID NO: 2624893 - RNA, 14 nt, Human
uaccuuguauacug

SEQ ID NO: 2624894 - RNA, 20 nt, Human
uaccuuguauacuguaggca

SEQ ID NO: 2624895 - RNA, 18 nt, Human
uaccuugugacccagcac

SEQ ID NO: 2624896 - RNA, 19 nt, Human
uaccuuuuuuauacauaaa

SEQ ID NO: 2624897 - RNA, 20 nt, Human
uaccuuuuuuauacauaaac

SEQ ID NO: 2624898 - RNA, 18 nt, Human
uaccuuuuuuauacauaa

SEQ ID NO: 2624899 - RNA, 12 nt, Human
uaccuuugucac

SEQ ID NO: 2624900 - RNA, 14 nt, Human
uaccuuuaugguuu

SEQ ID NO: 2624901 - RNA, 16 nt, Human
uaccuuuaugguuucu

SEQ ID NO: 2624902 - RNA, 15 nt, Human
uacuaauagacaauu

SEQ ID NO: 2624903 - RNA, 17 nt, Human
uacuaauagacaauuua

SEQ ID NO: 2624904 - RNA, 22 nt, Human
uacuaauaaaauuuaaaagucu

SEQ ID NO: 2624905 - RNA, 17 nt, Human
uacuacaguccucccau

SEQ ID NO: 2624906 - RNA, 12 nt, Human
uacuacaguccu

SEQ ID NO: 2624907 - RNA, 13 nt, Human
uacuacaaaauuu

SEQ ID NO: 2624908 - RNA, 18 nt, Human
uacuacaaaauuugaaau

SEQ ID NO: 2624909 - RNA, 18 nt, Human
uacuacacauucaauaag

SEQ ID NO: 2624910 - RNA, 16 nt, Human
uacuacaaaaaaguug

SEQ ID NO: 2624911 - RNA, 17 nt, Human
uacuaaccagcagaaau

SEQ ID NO: 2624912 - RNA, 18 nt, Human
uacuaaccagcagaaaug

SEQ ID NO: 2624913 - RNA, 19 nt, Human
uacuaaccagcagaaaugc

SEQ ID NO: 2624914 - RNA, 15 nt, Human
uacuaacuaaacucu

SEQ ID NO: 2624915 - RNA, 14 nt, Human
uacgacuuuauuuu

SEQ ID NO: 2624916 - RNA, 15 nt, Human
uacgacuuuauuuuc

SEQ ID NO: 2624917 - RNA, 14 nt, Human
uacuaacuaaacuc

SEQ ID NO: 2624918 - RNA, 17 nt, Human
uacgacuuuauuuucug

SEQ ID NO: 2624919 - RNA, 23 nt, Human
uaccuuuguucccaaauuucaua

SEQ ID NO: 2624920 - RNA, 22 nt, Human
uaccuuuuuuauacauaaacaa

SEQ ID NO: 2624921 - RNA, 14 nt, Human
uacgaauacuuuug

SEQ ID NO: 2624922 - RNA, 22 nt, Human
uacucagaauucucuaguuuga

SEQ ID NO: 2624923 - RNA, 14 nt, Human
uacucagcagcccu

SEQ ID NO: 2624924 - RNA, 15 nt, Human
uacucagcagcccuc

SEQ ID NO: 2624925 - RNA, 16 nt, Human
uacucagcagcccucc

SEQ ID NO: 2624926 - RNA, 17 nt, Human
uacucagcagcccuccu

SEQ ID NO: 2624927 - RNA, 18 nt, Human
uacucagcagcccuccuc

SEQ ID NO: 2624928 - RNA, 16 nt, Human
uacucagaauucucua

SEQ ID NO: 2624929 - RNA, 14 nt, Human
uacucagaauuaag

SEQ ID NO: 2624930 - RNA, 19 nt, Human
uacucagaagccugaggcu

SEQ ID NO: 2624931 - RNA, 16 nt, Human
uacucagaagccugag

SEQ ID NO: 2624932 - RNA, 17 nt, Human
uacucagaagccugagg

SEQ ID NO: 2624933 - RNA, 19 nt, Human
uacucauaaugugaagugu

SEQ ID NO: 2624934 - RNA, 15 nt, Human
uacucauaaugugaa

SEQ ID NO: 2624935 - RNA, 14 nt, Human
uacucauaauguga

SEQ ID NO: 2624936 - RNA, 15 nt, Human
uacucaggaggcuga

SEQ ID NO: 2624937 - RNA, 21 nt, Human
uacucauaaugugaaguguua

SEQ ID NO: 2624938 - RNA, 20 nt, Human
uacucauaaugugaaguguu

SEQ ID NO: 2624939 - RNA, 19 nt, Human
uacucauauauaucuaucu

SEQ ID NO: 2624940 - RNA, 21 nt, Human
uacucauauauaucuaucuua

SEQ ID NO: 2624941 - RNA, 17 nt, Human
uacucauccuuguauaa

SEQ ID NO: 2624942 - RNA, 23 nt, Human
uacucauauauaucuaucuuaua

SEQ ID NO: 2624943 - RNA, 16 nt, Human
uacucaugaucuugug

SEQ ID NO: 2624944 - RNA, 17 nt, Human
uacucaugaucuuguga

SEQ ID NO: 2624945 - RNA, 14 nt, Human
uacucaggaagaac

SEQ ID NO: 2624946 - RNA, 12 nt, Human
uacucaggaggc

SEQ ID NO: 2624947 - RNA, 22 nt, Human
uacucaggaggcugaggcagaa

SEQ ID NO: 2624948 - RNA, 13 nt, Human
uacucaggaagaa

SEQ ID NO: 2624949 - RNA, 22 nt, Human
uacucagcccugggccccacca

SEQ ID NO: 2624950 - RNA, 23 nt, Human
uacucagcccugggccccaccac

SEQ ID NO: 2624951 - RNA, 19 nt, Human
uacucagcagcccuccuca

SEQ ID NO: 2624952 - RNA, 20 nt, Human
uacucagcagcccuccucac

SEQ ID NO: 2624953 - RNA, 23 nt, Human
uacucagcagcccuccucacccc

SEQ ID NO: 2624954 - RNA, 12 nt, Human
uacucagcccug

SEQ ID NO: 2624955 - RNA, 13 nt, Human
uacucagcccugg

SEQ ID NO: 2624956 - RNA, 14 nt, Human
uacucagcccuggg

SEQ ID NO: 2624957 - RNA, 15 nt, Human
uacucagcccugggc

SEQ ID NO: 2624958 - RNA, 16 nt, Human
uacucagcccugggcc

SEQ ID NO: 2624959 - RNA, 14 nt, Human
uacucaccucaccc

SEQ ID NO: 2624960 - RNA, 20 nt, Human
uacucacuuucuagauuaag

SEQ ID NO: 2624961 - RNA, 21 nt, Human
uacucacagucucuuuaaucu

SEQ ID NO: 2624962 - RNA, 17 nt, Human
uacuacuagaugucuuu

SEQ ID NO: 2624963 - RNA, 18 nt, Human
uacuacuagaugucuuua

SEQ ID NO: 2624964 - RNA, 12 nt, Human
uacucaccucac

SEQ ID NO: 2624965 - RNA, 16 nt, Human
uacuaccuugaaaaua

SEQ ID NO: 2624966 - RNA, 20 nt, Human
uacuaccuugaaaauaagaa

SEQ ID NO: 2624967 - RNA, 15 nt, Human
uacucacagucucuu

SEQ ID NO: 2624968 - RNA, 20 nt, Human
uacuacaguuuguuaguaug

SEQ ID NO: 2624969 - RNA, 20 nt, Human
uacuacaguccucccaucuc

SEQ ID NO: 2624970 - RNA, 13 nt, Human
uacuaccuugaaa

SEQ ID NO: 2624971 - RNA, 14 nt, Human
uacuaccuugaaaa

SEQ ID NO: 2624972 - RNA, 13 nt, Human
uacuacaugcacu

SEQ ID NO: 2624973 - RNA, 17 nt, Human
uacuacaucgcccucca

SEQ ID NO: 2624974 - RNA, 18 nt, Human
uacuacaugugggagcuu

SEQ ID NO: 2624975 - RNA, 17 nt, Human
uacucccaucugugaaa

SEQ ID NO: 2624976 - RNA, 16 nt, Human
uacucccaucugugaa

SEQ ID NO: 2624977 - RNA, 14 nt, Human
uacucccaucugug

SEQ ID NO: 2624978 - RNA, 12 nt, Human
uacucccaucug

SEQ ID NO: 2624979 - RNA, 12 nt, Human
uacuccugcaaa

SEQ ID NO: 2624980 - RNA, 14 nt, Human
uacuccugcaaaau

SEQ ID NO: 2624981 - RNA, 16 nt, Human
uacuccugcaaaauuu

SEQ ID NO: 2624982 - RNA, 17 nt, Human
uacuccugcaaaauuuu

SEQ ID NO: 2624983 - RNA, 22 nt, Human
uacuccuguaauuccuaccucc

SEQ ID NO: 2624984 - RNA, 19 nt, Human
uacuccuguaauuccuacc

SEQ ID NO: 2624985 - RNA, 17 nt, Human
uacuccuguaauuccua

SEQ ID NO: 2624986 - RNA, 22 nt, Human
uacuccugcaaaauuuuauagc

SEQ ID NO: 2624987 - RNA, 13 nt, Human
uacuccucugcag

SEQ ID NO: 2624988 - RNA, 12 nt, Human
uacuccucugca

SEQ ID NO: 2624989 - RNA, 11 nt, Human
uacucaugugu

SEQ ID NO: 2624990 - RNA, 22 nt, Human
uacuccucugcagugccuuggg

SEQ ID NO: 2624991 - RNA, 21 nt, Human
uacuccucugcagugccuugg

SEQ ID NO: 2624992 - RNA, 16 nt, Human
uacuccucugcagugc

SEQ ID NO: 2624993 - RNA, 14 nt, Human
uacuccucugcagu

SEQ ID NO: 2624994 - RNA, 17 nt, Human
uacuccucuuuacacug

SEQ ID NO: 2624995 - RNA, 18 nt, Human
uacugagccuuguaauuc

SEQ ID NO: 2624996 - RNA, 15 nt, Human
uacugagccuuguaa

SEQ ID NO: 2624997 - RNA, 15 nt, Human
uacugaggugcuaug

SEQ ID NO: 2624998 - RNA, 23 nt, Human
uacugagccuuguaauucuaaau

SEQ ID NO: 2624999 - RNA, 19 nt, Human
uacugagccuuguaauucu

SEQ ID NO: 2625000 - RNA, 17 nt, Human
uacugagcuucucugug

SEQ ID NO: 2625001 - RNA, 14 nt, Human
uacugagcuucucu

SEQ ID NO: 2625002 - RNA, 18 nt, Human
uacugagcuucucuguga

SEQ ID NO: 2625003 - RNA, 23 nt, Human
uacugagggaccaacugggccca

SEQ ID NO: 2625004 - RNA, 22 nt, Human
uacugaggccuaaaaguaaaca

SEQ ID NO: 2625005 - RNA, 16 nt, Human
uacugauaaagaaaga

SEQ ID NO: 2625006 - RNA, 16 nt, Human
uacugaguuacauugu

SEQ ID NO: 2625007 - RNA, 14 nt, Human
uacugauauauuuu

SEQ ID NO: 2625008 - RNA, 16 nt, Human
uacugauauauuuuac

SEQ ID NO: 2625009 - RNA, 16 nt, Human
uacugaucaugcauug

SEQ ID NO: 2625010 - RNA, 17 nt, Human
uacugaucaugcauugu

SEQ ID NO: 2625011 - RNA, 23 nt, Human
uacugauguuccuagugaaagag

SEQ ID NO: 2625012 - RNA, 18 nt, Human
uacugauucacugcaugg

SEQ ID NO: 2625013 - RNA, 18 nt, Human
uacugaucaugcauuguu

SEQ ID NO: 2625014 - RNA, 20 nt, Human
uacuuucauccugacucugc

SEQ ID NO: 2625015 - RNA, 20 nt, Human
uacuuuauuuauacacuguc

SEQ ID NO: 2625016 - RNA, 20 nt, Human
uacuuuauguuacuacaugc

SEQ ID NO: 2625017 - RNA, 17 nt, Human
uacuuuauguuacuaca

SEQ ID NO: 2625018 - RNA, 16 nt, Human
uacuuuacucauuuuu

SEQ ID NO: 2625019 - RNA, 19 nt, Human
uacuuuaccacccccacac

SEQ ID NO: 2625020 - RNA, 15 nt, Human
uacuuuaccaccccc

SEQ ID NO: 2625021 - RNA, 22 nt, Human
uagaaagcaggggcuacaagag

SEQ ID NO: 2625022 - RNA, 14 nt, Human
uagaaagcaggggc

SEQ ID NO: 2625023 - RNA, 14 nt, Human
uagaaagcauuuga

SEQ ID NO: 2625024 - RNA, 13 nt, Human
uagaaagcauuug

SEQ ID NO: 2625025 - RNA, 15 nt, Human
uagaaacuuccaaau

SEQ ID NO: 2625026 - RNA, 14 nt, Human
uagaaagaagccca

SEQ ID NO: 2625027 - RNA, 15 nt, Human
uagaaagaagaugaa

SEQ ID NO: 2625028 - RNA, 23 nt, Human
uagaaagaagcccaauauuauaa

SEQ ID NO: 2625029 - RNA, 21 nt, Human
uagaaagaagcccaauauuau

SEQ ID NO: 2625030 - RNA, 17 nt, Human
uagaaagacagagcugg

SEQ ID NO: 2625031 - RNA, 22 nt, Human
uagaaagcauuugaaugcauuu

SEQ ID NO: 2625032 - RNA, 21 nt, Human
uagaaagcauuugaaugcauu

SEQ ID NO: 2625033 - RNA, 20 nt, Human
uagaaagcauuugaaugcau

SEQ ID NO: 2625034 - RNA, 19 nt, Human
uagaaagcauuugaaugca

SEQ ID NO: 2625035 - RNA, 18 nt, Human
uagaaagcauuugaaugc

SEQ ID NO: 2625036 - RNA, 17 nt, Human
uagaaagcauuugaaug

SEQ ID NO: 2625037 - RNA, 16 nt, Human
uagaaagcauuugaau

SEQ ID NO: 2625038 - RNA, 15 nt, Human
uagaaagcauuugaa

SEQ ID NO: 2625039 - RNA, 16 nt, Human
uagaaaggccuuuaaa

SEQ ID NO: 2625040 - RNA, 15 nt, Human
uagaaaggccuuuaa

SEQ ID NO: 2625041 - RNA, 14 nt, Human
uagaaaggccuuua

SEQ ID NO: 2625042 - RNA, 13 nt, Human
uagaaaggccuuu

SEQ ID NO: 2625043 - RNA, 23 nt, Human
uagaaagccuguuccccucacug

SEQ ID NO: 2625044 - RNA, 15 nt, Human
uagaaagcaggggcu

SEQ ID NO: 2625045 - RNA, 22 nt, Human
uagaaagccaaaucaaaauaug

SEQ ID NO: 2625046 - RNA, 20 nt, Human
uagaaauaaaggaugugauu

SEQ ID NO: 2625047 - RNA, 19 nt, Human
uagaaauaaauagcuauau

SEQ ID NO: 2625048 - RNA, 12 nt, Human
uagaaauaagug

SEQ ID NO: 2625049 - RNA, 11 nt, Human
uagaaauaagu

SEQ ID NO: 2625050 - RNA, 16 nt, Human
uagaaauaaauagcua

SEQ ID NO: 2625051 - RNA, 21 nt, Human
uagaaauagcuccguggagca

SEQ ID NO: 2625052 - RNA, 23 nt, Human
uagaaauaagugguuauuucuca

SEQ ID NO: 2625053 - RNA, 16 nt, Human
uagaaauaauaugcau

SEQ ID NO: 2625054 - RNA, 22 nt, Human
uagaaauaagugguuauuucuc

SEQ ID NO: 2625055 - RNA, 16 nt, Human
uagaaauaagugguua

SEQ ID NO: 2625056 - RNA, 15 nt, Human
uagaaauaauaugca

SEQ ID NO: 2625057 - RNA, 20 nt, Human
uagaaaguucaaaaagucua

SEQ ID NO: 2625058 - RNA, 19 nt, Human
uagaaauaaaggaugugau

SEQ ID NO: 2625059 - RNA, 15 nt, Human
uagaaaggggcccag

SEQ ID NO: 2625060 - RNA, 15 nt, Human
uagaaauauaauuga

SEQ ID NO: 2625061 - RNA, 20 nt, Human
uagaaauaucugaaaaugua

SEQ ID NO: 2625062 - RNA, 21 nt, Human
uagaaauaucugaaaauguau

SEQ ID NO: 2625063 - RNA, 23 nt, Human
uagaaauaucugaaaauguaugu

SEQ ID NO: 2625064 - RNA, 19 nt, Human
uagaaauguaacuuuugua

SEQ ID NO: 2625065 - RNA, 23 nt, Human
uagaaaugguuguauuagauguu

SEQ ID NO: 2625066 - RNA, 20 nt, Human
uagaaaugguuguauuagau

SEQ ID NO: 2625067 - RNA, 19 nt, Human
uagaaaugguuguauuaga

SEQ ID NO: 2625068 - RNA, 17 nt, Human
uagaaaugguuguauua

SEQ ID NO: 2625069 - RNA, 16 nt, Human
uagaaaugguuguauu

SEQ ID NO: 2625070 - RNA, 14 nt, Human
uagaaauaugauuu

SEQ ID NO: 2625071 - RNA, 22 nt, Human
uagaaauagcuccguggagcag

SEQ ID NO: 2625072 - RNA, 12 nt, Human
uagaaaucauuu

SEQ ID NO: 2625073 - RNA, 15 nt, Human
uagaaaugguuguau

SEQ ID NO: 2625074 - RNA, 19 nt, Human
uagaaaugaugauguggaa

SEQ ID NO: 2625075 - RNA, 18 nt, Human
uagaaaugaccaauauua

SEQ ID NO: 2625076 - RNA, 15 nt, Human
uagaacacagaaagc

SEQ ID NO: 2625077 - RNA, 15 nt, Human
uagaacacaggcaaa

SEQ ID NO: 2625078 - RNA, 14 nt, Human
uagaacacagaaag

SEQ ID NO: 2625079 - RNA, 20 nt, Human
uagaacaaaggacagaguau

SEQ ID NO: 2625080 - RNA, 16 nt, Human
uagaacaaaggacaga

SEQ ID NO: 2625081 - RNA, 16 nt, Human
uagaaauuuccagaga

SEQ ID NO: 2625082 - RNA, 15 nt, Human
uagaaauuuccagag

SEQ ID NO: 2625083 - RNA, 19 nt, Human
uagaaauuuuucagaugcu

SEQ ID NO: 2625084 - RNA, 22 nt, Human
uagaaauuuuucagaugcuucu

SEQ ID NO: 2625085 - RNA, 22 nt, Human
uagaaauuaccagaguuguucu

SEQ ID NO: 2625086 - RNA, 19 nt, Human
uagaaauuacacccaaaga

SEQ ID NO: 2625087 - RNA, 23 nt, Human
uagaaauuuauuuccuaguucug

SEQ ID NO: 2625088 - RNA, 14 nt, Human
uagaaauuuccaga

SEQ ID NO: 2625089 - RNA, 18 nt, Human
uagaaauuagcuguguga

SEQ ID NO: 2625090 - RNA, 17 nt, Human
uagaacagauaaucagu

SEQ ID NO: 2625091 - RNA, 23 nt, Human
uagaacagagaaagaggaagcuu

SEQ ID NO: 2625092 - RNA, 23 nt, Human
uagaaccaagaagggcuagaacc

SEQ ID NO: 2625093 - RNA, 17 nt, Human
uagaaccaagaagggcu

SEQ ID NO: 2625094 - RNA, 16 nt, Human
uagaaccaagaagggc

SEQ ID NO: 2625095 - RNA, 22 nt, Human
uagaacauggagagcuagaacc

SEQ ID NO: 2625096 - RNA, 18 nt, Human
uagaacaucccugccagc

SEQ ID NO: 2625097 - RNA, 14 nt, Human
uagaacaucccugc

SEQ ID NO: 2625098 - RNA, 17 nt, Human
uacugcauacuuuuuaa

SEQ ID NO: 2625099 - RNA, 18 nt, Human
uacugcauacuuuuuaaa

SEQ ID NO: 2625100 - RNA, 21 nt, Human
uacugcauacuuuuuaaaugu

SEQ ID NO: 2625101 - RNA, 22 nt, Human
uacugcauacuuuuuaaaugua

SEQ ID NO: 2625102 - RNA, 17 nt, Human
uacugcauaugaaagga

SEQ ID NO: 2625103 - RNA, 19 nt, Human
uacugcagggccaggacug

SEQ ID NO: 2625104 - RNA, 18 nt, Human
uacugcagggccaggacu

SEQ ID NO: 2625105 - RNA, 16 nt, Human
uacugcagggccagga

SEQ ID NO: 2625106 - RNA, 13 nt, Human
uacugcauacuuu

SEQ ID NO: 2625107 - RNA, 15 nt, Human
uacugcauacuuuuu

SEQ ID NO: 2625108 - RNA, 14 nt, Human
uacugcagggccag

SEQ ID NO: 2625109 - RNA, 12 nt, Human
uacugcagggcc

SEQ ID NO: 2625110 - RNA, 10 nt, Human
uacugcaggg

SEQ ID NO: 2625111 - RNA, 23 nt, Human
uacugcagcuuuacaugcaauuu

SEQ ID NO: 2625112 - RNA, 22 nt, Human
uacugcagcuuuacaugcaauu

SEQ ID NO: 2625113 - RNA, 19 nt, Human
uacugcagcuuuacaugca

SEQ ID NO: 2625114 - RNA, 14 nt, Human
uacugauuguuuca

SEQ ID NO: 2625115 - RNA, 15 nt, Human
uacugcagcuuuaca

SEQ ID NO: 2625116 - RNA, 21 nt, Human
uacuguaucaugacaaagacu

SEQ ID NO: 2625117 - RNA, 19 nt, Human
uacugucaaaauaauuuua

SEQ ID NO: 2625118 - RNA, 18 nt, Human
uacugucaaaauaauuuu

SEQ ID NO: 2625119 - RNA, 22 nt, Human
uacuguauuuuuaccuuuuucc

SEQ ID NO: 2625120 - RNA, 17 nt, Human
uacuguauuuuguauug

SEQ ID NO: 2625121 - RNA, 23 nt, Human
uacuguauuuuguauuguuucaa

SEQ ID NO: 2625122 - RNA, 12 nt, Human
uacuguauuuga

SEQ ID NO: 2625123 - RNA, 17 nt, Human
uacuguucugugucuuu

SEQ ID NO: 2625124 - RNA, 14 nt, Human
uacuguucuguguc

SEQ ID NO: 2625125 - RNA, 12 nt, Human
uacuguucucuu

SEQ ID NO: 2625126 - RNA, 18 nt, Human
uacuguucucuucuugaa

SEQ ID NO: 2625127 - RNA, 16 nt, Human
uacuguucugugucuu

SEQ ID NO: 2625128 - RNA, 14 nt, Human
uacuguugugaccu

SEQ ID NO: 2625129 - RNA, 17 nt, Human
uacuguuguccuauggg

SEQ ID NO: 2625130 - RNA, 14 nt, Human
uacuuaauaaauuc

SEQ ID NO: 2625131 - RNA, 17 nt, Human
uacuuaauaaauucaga

SEQ ID NO: 2625132 - RNA, 19 nt, Human
uacuuaauaaauucagaua

SEQ ID NO: 2625133 - RNA, 22 nt, Human
uacuguguacagaauucugcua

SEQ ID NO: 2625134 - RNA, 23 nt, Human
uacuguguacagaauucugcuac

SEQ ID NO: 2625135 - RNA, 15 nt, Human
uacuguggcuucuua

SEQ ID NO: 2625136 - RNA, 19 nt, Human
uacugugugugugaaugaa

SEQ ID NO: 2625137 - RNA, 17 nt, Human
uacugugugugugaaug

SEQ ID NO: 2625138 - RNA, 18 nt, Human
uacugugugugugaauga

SEQ ID NO: 2625139 - RNA, 14 nt, Human
uacuguguguguga

SEQ ID NO: 2625140 - RNA, 21 nt, Human
uacuugaagggccagagccag

SEQ ID NO: 2625141 - RNA, 22 nt, Human
uacuugaagggccagagccagg

SEQ ID NO: 2625142 - RNA, 20 nt, Human
uacuugaagggccagagcca

SEQ ID NO: 2625143 - RNA, 18 nt, Human
uacuuagcaaaguuuuac

SEQ ID NO: 2625144 - RNA, 13 nt, Human
uacuuaauaaauu

SEQ ID NO: 2625145 - RNA, 15 nt, Human
uacuuagcagcuauc

SEQ ID NO: 2625146 - RNA, 13 nt, Human
uacuuaauuucuu

SEQ ID NO: 2625147 - RNA, 18 nt, Human
uacuuaauuccuuucuca

SEQ ID NO: 2625148 - RNA, 15 nt, Human
uacuuaauccaaugg

SEQ ID NO: 2625149 - RNA, 23 nt, Human
uacuuacaugcauuacugcaugc

SEQ ID NO: 2625150 - RNA, 16 nt, Human
uacuuagaggaaauaa

SEQ ID NO: 2625151 - RNA, 22 nt, Human
uacuuaccuaaacagauauaaa

SEQ ID NO: 2625152 - RNA, 19 nt, Human
uacuuacaugcauuacugc

SEQ ID NO: 2625153 - RNA, 16 nt, Human
uacuuaccuaaacaga

SEQ ID NO: 2625154 - RNA, 17 nt, Human
uacuuaccauaugugcu

SEQ ID NO: 2625155 - RNA, 14 nt, Human
uacuugaccuccua

SEQ ID NO: 2625156 - RNA, 21 nt, Human
uacuugcucuugaugccuggc

SEQ ID NO: 2625157 - RNA, 23 nt, Human
uacuugccuuauuagagugucuu

SEQ ID NO: 2625158 - RNA, 18 nt, Human
uacuuguggacacagcuc

SEQ ID NO: 2625159 - RNA, 15 nt, Human
uacuuguggacacag

SEQ ID NO: 2625160 - RNA, 19 nt, Human
uacuuguggacacagcucu

SEQ ID NO: 2625161 - RNA, 22 nt, Human
uacuuuaagcacuacauaaacu

SEQ ID NO: 2625162 - RNA, 19 nt, Human
uacuugggccauagcuccu

SEQ ID NO: 2625163 - RNA, 23 nt, Human
uacuugggagaccuguaaucaua

SEQ ID NO: 2625164 - RNA, 12 nt, Human
uacuugggaggc

SEQ ID NO: 2625165 - RNA, 20 nt, Human
uacuugcucuugaugccugg

SEQ ID NO: 2625166 - RNA, 18 nt, Human
uacuugcuggcucucaga

SEQ ID NO: 2625167 - RNA, 17 nt, Human
uacuugggaagcugagg

SEQ ID NO: 2625168 - RNA, 21 nt, Human
uacuugggagaccuguaauca

SEQ ID NO: 2625169 - RNA, 19 nt, Human
uacuugggaagcugaggcg

SEQ ID NO: 2625170 - RNA, 15 nt, Human
uaauaagguugaaca

SEQ ID NO: 2625171 - RNA, 15 nt, Human
uaauaacugugaagu

SEQ ID NO: 2625172 - RNA, 21 nt, Human
uaauaacauuaccuuacugug

SEQ ID NO: 2625173 - RNA, 17 nt, Human
uaauaacagugcauauu

SEQ ID NO: 2625174 - RNA, 13 nt, Human
uaauaaauucaga

SEQ ID NO: 2625175 - RNA, 20 nt, Human
uaauaacauuaccuuacugu

SEQ ID NO: 2625176 - RNA, 15 nt, Human
uaauaacauuaccuu

SEQ ID NO: 2625177 - RNA, 12 nt, Human
uaauaacauuac

SEQ ID NO: 2625178 - RNA, 17 nt, Human
uaauaaagaugcucuuu

SEQ ID NO: 2625179 - RNA, 16 nt, Human
uaauaaagcuacugau

SEQ ID NO: 2625180 - RNA, 15 nt, Human
uaauaaagcuacuga

SEQ ID NO: 2625181 - RNA, 15 nt, Human
uaauaaaucugguag

SEQ ID NO: 2625182 - RNA, 19 nt, Human
uaauaaauguacauuaauu

SEQ ID NO: 2625183 - RNA, 17 nt, Human
uaauaaauguacauuaa

SEQ ID NO: 2625184 - RNA, 16 nt, Human
uaauaaauuauuuauu

SEQ ID NO: 2625185 - RNA, 15 nt, Human
uaauaaauucagaua

SEQ ID NO: 2625186 - RNA, 16 nt, Human
uaauaaagaucaugua

SEQ ID NO: 2625187 - RNA, 17 nt, Human
uaauaaagaucauguaa

SEQ ID NO: 2625188 - RNA, 14 nt, Human
uaauaaagaugcuc

SEQ ID NO: 2625189 - RNA, 16 nt, Human
uaauaaagaugcucuu

SEQ ID NO: 2625190 - RNA, 22 nt, Human
uaagugcuguauaaaaucagcc

SEQ ID NO: 2625191 - RNA, 20 nt, Human
uaagugcuguauaaaaucag

SEQ ID NO: 2625192 - RNA, 19 nt, Human
uaagugcuguauaaaauca

SEQ ID NO: 2625193 - RNA, 18 nt, Human
uaagugcuguauaaaauc

SEQ ID NO: 2625194 - RNA, 14 nt, Human
uaagugcuguauaa

SEQ ID NO: 2625195 - RNA, 20 nt, Human
uaaggcguggagcugccuga

SEQ ID NO: 2625196 - RNA, 17 nt, Human
uaagugcuguauaaaau

SEQ ID NO: 2625197 - RNA, 15 nt, Human
uaagugcuguauaaa

SEQ ID NO: 2625198 - RNA, 17 nt, Human
uaaggcguggagcugcc

SEQ ID NO: 2625199 - RNA, 16 nt, Human
uaaggcguggagcugc

SEQ ID NO: 2625200 - RNA, 19 nt, Human
uaaggccauuauuguacuu

SEQ ID NO: 2625201 - RNA, 15 nt, Human
uaaggcaugaaggau

SEQ ID NO: 2625202 - RNA, 16 nt, Human
uaaggccgaagaaggg

SEQ ID NO: 2625203 - RNA, 20 nt, Human
uaaggccgaagaaggguccu

SEQ ID NO: 2625204 - RNA, 20 nt, Human
uaagugguacuaacuuuccu

SEQ ID NO: 2625205 - RNA, 15 nt, Human
uaaguggaggcacuu

SEQ ID NO: 2625206 - RNA, 16 nt, Human
uaaguggaggcacuuu

SEQ ID NO: 2625207 - RNA, 17 nt, Human
uaaguggaggcacuuua

SEQ ID NO: 2625208 - RNA, 19 nt, Human
uaaguggaggcacuuuagg

SEQ ID NO: 2625209 - RNA, 23 nt, Human
uaagugcuguauaaaaucagcca

SEQ ID NO: 2625210 - RNA, 13 nt, Human
uaagugcuuugua

SEQ ID NO: 2625211 - RNA, 15 nt, Human
uaagugcuuuguaau

SEQ ID NO: 2625212 - RNA, 23 nt, Human
uaauaaacuuagaauaaaauugu

SEQ ID NO: 2625213 - RNA, 18 nt, Human
uaauaaacuuagaauaaa

SEQ ID NO: 2625214 - RNA, 17 nt, Human
uaauaaacuuuaauaua

SEQ ID NO: 2625215 - RNA, 21 nt, Human
uaagugggguugcaaccacug

SEQ ID NO: 2625216 - RNA, 20 nt, Human
uaagugggguugcaaccacu

SEQ ID NO: 2625217 - RNA, 13 nt, Human
uaaguggcugcug

SEQ ID NO: 2625218 - RNA, 21 nt, Human
uaauaaacuuuuuuuugagaa

SEQ ID NO: 2625219 - RNA, 19 nt, Human
uaauaaacuuuuuuuugag

SEQ ID NO: 2625220 - RNA, 13 nt, Human
uaauaaagacagg

SEQ ID NO: 2625221 - RNA, 17 nt, Human
uaauaauuauuauuaaa

SEQ ID NO: 2625222 - RNA, 21 nt, Human
uaauaauauacuuguggacua

SEQ ID NO: 2625223 - RNA, 15 nt, Human
uaauaauguuucaaa

SEQ ID NO: 2625224 - RNA, 19 nt, Human
uaauaauauacuuguggac

SEQ ID NO: 2625225 - RNA, 16 nt, Human
uaauaauauacuugug

SEQ ID NO: 2625226 - RNA, 14 nt, Human
uaauaauaauguuu

SEQ ID NO: 2625227 - RNA, 14 nt, Human
uaauaauauacuug

SEQ ID NO: 2625228 - RNA, 13 nt, Human
uaauaauauacuu

SEQ ID NO: 2625229 - RNA, 22 nt, Human
uaauauaagaagcuuucaguau

SEQ ID NO: 2625230 - RNA, 18 nt, Human
uaauauaagaagcuuuca

SEQ ID NO: 2625231 - RNA, 23 nt, Human
uaauauaacugccuuaaaacuuu

SEQ ID NO: 2625232 - RNA, 22 nt, Human
uaauauaacugccuuaaaacuu

SEQ ID NO: 2625233 - RNA, 21 nt, Human
uaauauaacugccuuaaaacu

SEQ ID NO: 2625234 - RNA, 16 nt, Human
uaauauaacugccuua

SEQ ID NO: 2625235 - RNA, 21 nt, Human
uaauauaaaaagcuuccauga

SEQ ID NO: 2625236 - RNA, 21 nt, Human
uaauauaaaguaguccuguga

SEQ ID NO: 2625237 - RNA, 19 nt, Human
uaauauaaaguuggaugcg

SEQ ID NO: 2625238 - RNA, 14 nt, Human
uaauauaaaguugg

SEQ ID NO: 2625239 - RNA, 19 nt, Human
uaauaguuuacauguagua

SEQ ID NO: 2625240 - RNA, 21 nt, Human
uaauaguucagguaacaggca

SEQ ID NO: 2625241 - RNA, 22 nt, Human
uaauacaacauguagcugaguu

SEQ ID NO: 2625242 - RNA, 15 nt, Human
uaauacacacaguua

SEQ ID NO: 2625243 - RNA, 11 nt, Human
uaaucuaaaug

SEQ ID NO: 2625244 - RNA, 18 nt, Human
uaaucuauuggguucauu

SEQ ID NO: 2625245 - RNA, 17 nt, Human
uaaucguuaugugugua

SEQ ID NO: 2625246 - RNA, 18 nt, Human
uaaucguuauguguguau

SEQ ID NO: 2625247 - RNA, 19 nt, Human
uaaucguuauguguguaua

SEQ ID NO: 2625248 - RNA, 19 nt, Human
uaaucuauuggguucauua

SEQ ID NO: 2625249 - RNA, 19 nt, Human
uaaucucguuucaaaaaca

SEQ ID NO: 2625250 - RNA, 19 nt, Human
uaaucuauuucuaugagaa

SEQ ID NO: 2625251 - RNA, 17 nt, Human
uaaucuauuucuaugag

SEQ ID NO: 2625252 - RNA, 20 nt, Human
uaaucuauuggguucauuau

SEQ ID NO: 2625253 - RNA, 22 nt, Human
uaaucuauuggguucauuauug

SEQ ID NO: 2625254 - RNA, 13 nt, Human
uaaucuccacagu

SEQ ID NO: 2625255 - RNA, 15 nt, Human
uaaucucguuucaaa

SEQ ID NO: 2625256 - RNA, 18 nt, Human
uaaucuccucuuuuaucu

SEQ ID NO: 2625257 - RNA, 19 nt, Human
uaaucuguguacaaagaaa

SEQ ID NO: 2625258 - RNA, 14 nt, Human
uaaucuguguacaa

SEQ ID NO: 2625259 - RNA, 19 nt, Human
uaaucuuaggggagagcuu

SEQ ID NO: 2625260 - RNA, 20 nt, Human
uaaucuuaggggagagcuuu

SEQ ID NO: 2625261 - RNA, 17 nt, Human
uaaucucguuucaaaaa

SEQ ID NO: 2625262 - RNA, 16 nt, Human
uaaucucguuucaaaa

SEQ ID NO: 2625263 - RNA, 13 nt, Human
uaaucuguguaca

SEQ ID NO: 2625264 - RNA, 20 nt, Human
uaaucugauggcuucuccag

SEQ ID NO: 2625265 - RNA, 14 nt, Human
uaaugcacuuucua

SEQ ID NO: 2625266 - RNA, 13 nt, Human
uaaugcacuuucu

SEQ ID NO: 2625267 - RNA, 12 nt, Human
uaaugcacuuuc

SEQ ID NO: 2625268 - RNA, 11 nt, Human
uaaugauguuu

SEQ ID NO: 2625269 - RNA, 23 nt, Human
uaaugaugucguuugaaucacag

SEQ ID NO: 2625270 - RNA, 17 nt, Human
uaaugaugucguuugaa

SEQ ID NO: 2625271 - RNA, 19 nt, Human
uaaugccacuaaauugaca

SEQ ID NO: 2625272 - RNA, 22 nt, Human
uaaugcaucuagauuauggagc

SEQ ID NO: 2625273 - RNA, 16 nt, Human
uaaugcauguuaggaa

SEQ ID NO: 2625274 - RNA, 17 nt, Human
uaaugcauguuaggaaa

SEQ ID NO: 2625275 - RNA, 13 nt, Human
uaaucuucaguuu

SEQ ID NO: 2625276 - RNA, 16 nt, Human
uaaucuucaguuuuau

SEQ ID NO: 2625277 - RNA, 13 nt, Human
uaaucuuauuagg

SEQ ID NO: 2625278 - RNA, 21 nt, Human
uaaucuuauuagggagaaaau

SEQ ID NO: 2625279 - RNA, 19 nt, Human
uaaugauaaguaaaugcua

SEQ ID NO: 2625280 - RNA, 20 nt, Human
uaaucuucaguuuuaucuuu

SEQ ID NO: 2625281 - RNA, 22 nt, Human
uaaugaugaugggaauugugug

SEQ ID NO: 2625282 - RNA, 22 nt, Human
uaauauuaaaaauauggaacuu

SEQ ID NO: 2625283 - RNA, 23 nt, Human
uaauccucucaaccaccuuucag

SEQ ID NO: 2625284 - RNA, 21 nt, Human
uaauccuucuaguuucccaca

SEQ ID NO: 2625285 - RNA, 19 nt, Human
uaauccuucuaguuuccca

SEQ ID NO: 2625286 - RNA, 18 nt, Human
uaauauuaaaaauaugga

SEQ ID NO: 2625287 - RNA, 14 nt, Human
uaauauuaaaaaua

SEQ ID NO: 2625288 - RNA, 23 nt, Human
uaauauguuaaccucagugucau

SEQ ID NO: 2625289 - RNA, 20 nt, Human
uaauccuucuaguuucccac

SEQ ID NO: 2625290 - RNA, 13 nt, Human
uaaucgaccugcc

SEQ ID NO: 2625291 - RNA, 14 nt, Human
uaaucgaccugccu

SEQ ID NO: 2625292 - RNA, 16 nt, Human
uaaucguguccccuau

SEQ ID NO: 2625293 - RNA, 22 nt, Human
uaaucggcccacagcucccacc

SEQ ID NO: 2625294 - RNA, 15 nt, Human
uaaucguuaugugug

SEQ ID NO: 2625295 - RNA, 16 nt, Human
uaaucguuaugugugu

SEQ ID NO: 2625296 - RNA, 16 nt, Human
uaaucgaccugccucg

SEQ ID NO: 2625297 - RNA, 18 nt, Human
uaaucgcuuaaagauguu

SEQ ID NO: 2625298 - RNA, 15 nt, Human
uaaucggcccacagc

SEQ ID NO: 2625299 - RNA, 16 nt, Human
uaaucggcccacagcu

SEQ ID NO: 2625300 - RNA, 21 nt, Human
uaauauacuuguggacuaaaa

SEQ ID NO: 2625301 - RNA, 17 nt, Human
uaauauacuuguggacu

SEQ ID NO: 2625302 - RNA, 15 nt, Human
uaauauacuugugga

SEQ ID NO: 2625303 - RNA, 13 nt, Human
uaauauacuugug

SEQ ID NO: 2625304 - RNA, 16 nt, Human
uaauauacuauauuua

SEQ ID NO: 2625305 - RNA, 22 nt, Human
uaauauaaguuucuuugcuuca

SEQ ID NO: 2625306 - RNA, 17 nt, Human
uaauauauaucugcugu

SEQ ID NO: 2625307 - RNA, 13 nt, Human
uaauauauguuua

SEQ ID NO: 2625308 - RNA, 17 nt, Human
uaauauaucccagaaau

SEQ ID NO: 2625309 - RNA, 12 nt, Human
uaauauauugcu

SEQ ID NO: 2625310 - RNA, 14 nt, Human
uaauauauguuuac

SEQ ID NO: 2625311 - RNA, 21 nt, Human
uaauauauuuucuguuuucuu

SEQ ID NO: 2625312 - RNA, 17 nt, Human
uaauauauuuucuguuu

SEQ ID NO: 2625313 - RNA, 20 nt, Human
uaauaugggcauuguaguua

SEQ ID NO: 2625314 - RNA, 19 nt, Human
uaauaugggcauuguaguu

SEQ ID NO: 2625315 - RNA, 22 nt, Human
uaauauauuuuuauauuuaguu

SEQ ID NO: 2625316 - RNA, 18 nt, Human
uaauaugggcauuguagu

SEQ ID NO: 2625317 - RNA, 17 nt, Human
uaauauggguucuuuuu

SEQ ID NO: 2625318 - RNA, 21 nt, Human
uaauauguuaaccucaguguc

SEQ ID NO: 2625319 - RNA, 20 nt, Human
uaauauguuaaccucagugu

SEQ ID NO: 2625320 - RNA, 16 nt, Human
uaauauggggaugcag

SEQ ID NO: 2625321 - RNA, 14 nt, Human
uaauauauugcugc

SEQ ID NO: 2625322 - RNA, 19 nt, Human
uaauauauuuguguauuua

SEQ ID NO: 2625323 - RNA, 13 nt, Human
uaauauauuuucu

SEQ ID NO: 2625324 - RNA, 20 nt, Human
uaauauauuuguguauuuaa

SEQ ID NO: 2625325 - RNA, 20 nt, Human
uaauuaaugaaauaucugua

SEQ ID NO: 2625326 - RNA, 19 nt, Human
uaauuaaugaaauaucugu

SEQ ID NO: 2625327 - RNA, 21 nt, Human
uaauuaaugaaauaucuguau

SEQ ID NO: 2625328 - RNA, 17 nt, Human
uaauuaccaaccuguua

SEQ ID NO: 2625329 - RNA, 21 nt, Human
uaauuaccaaccuguuaccua

SEQ ID NO: 2625330 - RNA, 16 nt, Human
uaauuaccaaccuguu

SEQ ID NO: 2625331 - RNA, 17 nt, Human
uaauuacauauuugcau

SEQ ID NO: 2625332 - RNA, 12 nt, Human
uaauucucuuga

SEQ ID NO: 2625333 - RNA, 12 nt, Human
uaauuagagcag

SEQ ID NO: 2625334 - RNA, 18 nt, Human
uaauucuuagcucauucu

SEQ ID NO: 2625335 - RNA, 15 nt, Human
uaauucuguacugau

SEQ ID NO: 2625336 - RNA, 14 nt, Human
uaauucuguacuga

SEQ ID NO: 2625337 - RNA, 21 nt, Human
uaauucuguacauagccuaua

SEQ ID NO: 2625338 - RNA, 14 nt, Human
uaauucuguacaua

SEQ ID NO: 2625339 - RNA, 23 nt, Human
uaauucuguacugauuuuuguaa

SEQ ID NO: 2625340 - RNA, 17 nt, Human
uaauucuguacugauuu

SEQ ID NO: 2625341 - RNA, 13 nt, Human
uaauucucuugaa

SEQ ID NO: 2625342 - RNA, 16 nt, Human
uaauucucuuucaaag

SEQ ID NO: 2625343 - RNA, 12 nt, Human
uaauucuguaca

SEQ ID NO: 2625344 - RNA, 15 nt, Human
uaauucuguaaaugu

SEQ ID NO: 2625345 - RNA, 13 nt, Human
uaauucuguaaau

SEQ ID NO: 2625346 - RNA, 12 nt, Human
uaauucuguaaa

SEQ ID NO: 2625347 - RNA, 10 nt, Human
uaauucugua

SEQ ID NO: 2625348 - RNA, 18 nt, Human
uaauugaucaaauucauu

SEQ ID NO: 2625349 - RNA, 22 nt, Human
uaauugacaggauuauuggaaa

SEQ ID NO: 2625350 - RNA, 20 nt, Human
uaauugacaggauuauugga

SEQ ID NO: 2625351 - RNA, 19 nt, Human
uaauucuuugaccuguugg

SEQ ID NO: 2625352 - RNA, 15 nt, Human
uaauucuuguauauu

SEQ ID NO: 2625353 - RNA, 16 nt, Human
uaauucuuguauauua

SEQ ID NO: 2625354 - RNA, 20 nt, Human
uaauucuucaccuuaggaau

SEQ ID NO: 2625355 - RNA, 14 nt, Human
uaauguuucaaaca

SEQ ID NO: 2625356 - RNA, 23 nt, Human
uaaugcgcaggcuggcccugccc

SEQ ID NO: 2625357 - RNA, 15 nt, Human
uaauguuucaaacau

SEQ ID NO: 2625358 - RNA, 15 nt, Human
uaauguuuaugagcc

SEQ ID NO: 2625359 - RNA, 16 nt, Human
uaauguuuaugagcca

SEQ ID NO: 2625360 - RNA, 17 nt, Human
uaauguuuaugagccag

SEQ ID NO: 2625361 - RNA, 22 nt, Human
uaauguuuaugagccagacaaa

SEQ ID NO: 2625362 - RNA, 14 nt, Human
uaaugcgugcauac

SEQ ID NO: 2625363 - RNA, 19 nt, Human
uaaugcgcaggcuggcccu

SEQ ID NO: 2625364 - RNA, 22 nt, Human
uaaugcgcaggcuggcccugcc

SEQ ID NO: 2625365 - RNA, 15 nt, Human
uaaugccuuacucuu

SEQ ID NO: 2625366 - RNA, 22 nt, Human
uaaugccuuuaaaguaugaauc

SEQ ID NO: 2625367 - RNA, 21 nt, Human
uaaugccuuacucuucuugaa

SEQ ID NO: 2625368 - RNA, 22 nt, Human
uaaugccggugagaauaagaga

SEQ ID NO: 2625369 - RNA, 21 nt, Human
uaaugcauguuaggaaaauuu

SEQ ID NO: 2625370 - RNA, 17 nt, Human
uaauuaaugaaauaucu

SEQ ID NO: 2625371 - RNA, 21 nt, Human
uaauuaaucaugaauguguaa

SEQ ID NO: 2625372 - RNA, 15 nt, Human
uaauuaaucaugaau

SEQ ID NO: 2625373 - RNA, 20 nt, Human
uaauuaaaagaauauuuuaa

SEQ ID NO: 2625374 - RNA, 17 nt, Human
uaauuaaaacacaacau

SEQ ID NO: 2625375 - RNA, 23 nt, Human
uaauuaaauuuugaguucuacau

SEQ ID NO: 2625376 - RNA, 22 nt, Human
uaauuaaauaaaucauuaauac

SEQ ID NO: 2625377 - RNA, 13 nt, Human
uaauuaaaugcuc

SEQ ID NO: 2625378 - RNA, 18 nt, Human
uaauguuuaugagccaga

SEQ ID NO: 2625379 - RNA, 16 nt, Human
uaauuaaaguguccau

SEQ ID NO: 2625380 - RNA, 12 nt, Human
uaauuaaagugu

SEQ ID NO: 2625381 - RNA, 21 nt, Human
uaauuaaauaaaaaucugugg

SEQ ID NO: 2625382 - RNA, 21 nt, Human
uaauugugaaaaaguuaaaca

SEQ ID NO: 2625383 - RNA, 23 nt, Human
uaauuguaucguauagcuguauu

SEQ ID NO: 2625384 - RNA, 21 nt, Human
uaauuguaucguauagcugua

SEQ ID NO: 2625385 - RNA, 20 nt, Human
uaauuguaucguauagcugu

SEQ ID NO: 2625386 - RNA, 19 nt, Human
uaauuguaucguauagcug

SEQ ID NO: 2625387 - RNA, 15 nt, Human
uaauuguaucguaua

SEQ ID NO: 2625388 - RNA, 13 nt, Human
uaauuguaucgua

SEQ ID NO: 2625389 - RNA, 18 nt, Human
uaauuguauaacagguua

SEQ ID NO: 2625390 - RNA, 17 nt, Human
uaauuguauaacagguu

SEQ ID NO: 2625391 - RNA, 16 nt, Human
uaauuguauaacaggu

SEQ ID NO: 2625392 - RNA, 16 nt, Human
uaauuguugcuaaucu

SEQ ID NO: 2625393 - RNA, 22 nt, Human
uaauuguucauuuugagcugaa

SEQ ID NO: 2625394 - RNA, 20 nt, Human
uaauuguuaagauaugaugu

SEQ ID NO: 2625395 - RNA, 22 nt, Human
uaauuggaaaggcagcucuaaa

SEQ ID NO: 2625396 - RNA, 21 nt, Human
uaauuggaagaaauuccugua

SEQ ID NO: 2625397 - RNA, 20 nt, Human
uaauuggaagaaauuccugu

SEQ ID NO: 2625398 - RNA, 12 nt, Human
uaauugcuuuga

SEQ ID NO: 2625399 - RNA, 18 nt, Human
uaauugguccgaucuuug

SEQ ID NO: 2625400 - RNA, 14 nt, Human
uaauuggcagcaga

SEQ ID NO: 2625401 - RNA, 12 nt, Human
uaauuggcagca

SEQ ID NO: 2625402 - RNA, 15 nt, Human
uaauuggcagcagau

SEQ ID NO: 2625403 - RNA, 23 nt, Human
uaauugcuuacauuuuuacaaua

SEQ ID NO: 2625404 - RNA, 21 nt, Human
uaauugcuuacauuuuuacaa

SEQ ID NO: 2625405 - RNA, 16 nt, Human
uaauugcuuacauuuu

SEQ ID NO: 2625406 - RNA, 15 nt, Human
uaauugcuuacauuu

SEQ ID NO: 2625407 - RNA, 22 nt, Human
uaauugcauucaucuuguguuu

SEQ ID NO: 2625408 - RNA, 13 nt, Human
uaauugcauucau

SEQ ID NO: 2625409 - RNA, 12 nt, Human
uaauugcauuca

SEQ ID NO: 2625410 - RNA, 19 nt, Human
uaauugaucaaauucauuu

SEQ ID NO: 2625411 - RNA, 14 nt, Human
uaauugauuucaag

SEQ ID NO: 2625412 - RNA, 11 nt, Human
uaauugcacuc

SEQ ID NO: 2625413 - RNA, 19 nt, Human
uaauugauuucaagaccuu

SEQ ID NO: 2625414 - RNA, 21 nt, Human
uaauuuucuagauuuucuacu

SEQ ID NO: 2625415 - RNA, 17 nt, Human
uaauuuuccuaauaaag

SEQ ID NO: 2625416 - RNA, 18 nt, Human
uaauuuuaugaaugucuu

SEQ ID NO: 2625417 - RNA, 13 nt, Human
uaauuuuaagaaa

SEQ ID NO: 2625418 - RNA, 22 nt, Human
uaauuuuaaccaaaacaugucu

SEQ ID NO: 2625419 - RNA, 13 nt, Human
uaauuuuaaauaa

SEQ ID NO: 2625420 - RNA, 12 nt, Human
uaauuuuaauau

SEQ ID NO: 2625421 - RNA, 23 nt, Human
uaauuuuaaccaaaacaugucuc

SEQ ID NO: 2625422 - RNA, 19 nt, Human
uaauuuuagugacagcucu

SEQ ID NO: 2625423 - RNA, 19 nt, Human
uaauuugugauacaaugcu

SEQ ID NO: 2625424 - RNA, 22 nt, Human
uaauuugugauacaaugcugug

SEQ ID NO: 2625425 - RNA, 14 nt, Human
uaauuuuaaacaaa

SEQ ID NO: 2625426 - RNA, 14 nt, Human
uaauuuuaaccaaa

SEQ ID NO: 2625427 - RNA, 13 nt, Human
uaauuuguaucug

SEQ ID NO: 2625428 - RNA, 21 nt, Human
uaauuuguacauauguaaaau

SEQ ID NO: 2625429 - RNA, 23 nt, Human
uaauuuguaguguuggagaagaa

SEQ ID NO: 2625430 - RNA, 14 nt, Human
uaauuugugauaca

SEQ ID NO: 2625431 - RNA, 15 nt, Human
uaauuugugauacaa

SEQ ID NO: 2625432 - RNA, 18 nt, Human
uaauuugugauacaaugc

SEQ ID NO: 2625433 - RNA, 14 nt, Human
uaauuguuguuucu

SEQ ID NO: 2625434 - RNA, 20 nt, Human
uaauuuguaguguuggagaa

SEQ ID NO: 2625435 - RNA, 19 nt, Human
uaagaucucagugguuaag

SEQ ID NO: 2625436 - RNA, 13 nt, Human
uaagaucucagug

SEQ ID NO: 2625437 - RNA, 15 nt, Human
uaagcaucaaacucu

SEQ ID NO: 2625438 - RNA, 16 nt, Human
uaagcaucaaacucuu

SEQ ID NO: 2625439 - RNA, 15 nt, Human
uaagcaugcacaaau

SEQ ID NO: 2625440 - RNA, 18 nt, Human
uaagcauuaccacucagg

SEQ ID NO: 2625441 - RNA, 21 nt, Human
uaagcauuaccacucaggcau

SEQ ID NO: 2625442 - RNA, 19 nt, Human
uaagcauuaccacucaggc

SEQ ID NO: 2625443 - RNA, 22 nt, Human
uaagccacaagaaauuugauuu

SEQ ID NO: 2625444 - RNA, 19 nt, Human
uaagccaauuuuucugcac

SEQ ID NO: 2625445 - RNA, 18 nt, Human
uaagccaauuuuucugca

SEQ ID NO: 2625446 - RNA, 17 nt, Human
uaagccacuuaaaaugu

SEQ ID NO: 2625447 - RNA, 19 nt, Human
uaagccacuuaaaauguuc

SEQ ID NO: 2625448 - RNA, 13 nt, Human
uaagccagacauc

SEQ ID NO: 2625449 - RNA, 10 nt, Human
uaagccaagg

SEQ ID NO: 2625450 - RNA, 15 nt, Human
uaagccaauuuuucu

SEQ ID NO: 2625451 - RNA, 14 nt, Human
uaagccaagggccu

SEQ ID NO: 2625452 - RNA, 23 nt, Human
uaagcauuguuugcuuauuguuc

SEQ ID NO: 2625453 - RNA, 18 nt, Human
uaagcauuguuugcuuau

SEQ ID NO: 2625454 - RNA, 19 nt, Human
uaagcauuguuugcuuauu

SEQ ID NO: 2625455 - RNA, 20 nt, Human
uaagcauuguuugcuuauug

SEQ ID NO: 2625456 - RNA, 21 nt, Human
uaagcauuguuugcuuauugu

SEQ ID NO: 2625457 - RNA, 18 nt, Human
uaagcauuccaacuaucu

SEQ ID NO: 2625458 - RNA, 16 nt, Human
uaagcauuccaacuau

SEQ ID NO: 2625459 - RNA, 20 nt, Human
uaagcauuccaacuaucuca

SEQ ID NO: 2625460 - RNA, 18 nt, Human
uaagcauuggguggguaa

SEQ ID NO: 2625461 - RNA, 12 nt, Human
uaagcauuguuu

SEQ ID NO: 2625462 - RNA, 15 nt, Human
uaagcauuguuugcu

SEQ ID NO: 2625463 - RNA, 17 nt, Human
uaagcauuguuugcuua

SEQ ID NO: 2625464 - RNA, 20 nt, Human
uaagccagacaucaacagau

SEQ ID NO: 2625465 - RNA, 21 nt, Human
uaagccagacaucaacagaua

SEQ ID NO: 2625466 - RNA, 16 nt, Human
uaagccacaagaaauu

SEQ ID NO: 2625467 - RNA, 20 nt, Human
uaagccacuuaaaauguuca

SEQ ID NO: 2625468 - RNA, 17 nt, Human
uaagccaucuugguaaa

SEQ ID NO: 2625469 - RNA, 20 nt, Human
uaagccucauauuuaaagac

SEQ ID NO: 2625470 - RNA, 14 nt, Human
uaagccuccauuua

SEQ ID NO: 2625471 - RNA, 14 nt, Human
uaagccuuuggaaa

SEQ ID NO: 2625472 - RNA, 17 nt, Human
uaagccuuuggaaacag

SEQ ID NO: 2625473 - RNA, 17 nt, Human
uaagccuccauuuaguu

SEQ ID NO: 2625474 - RNA, 19 nt, Human
uaagccuccauuuaguucu

SEQ ID NO: 2625475 - RNA, 20 nt, Human
uaagccuccauuuaguucuu

SEQ ID NO: 2625476 - RNA, 21 nt, Human
uaagccuccauuuaguucuuu

SEQ ID NO: 2625477 - RNA, 19 nt, Human
uaaggaugcuuguacauaa

SEQ ID NO: 2625478 - RNA, 21 nt, Human
uaagccuuuggaaacagcucg

SEQ ID NO: 2625479 - RNA, 16 nt, Human
uaagccuuuccauaag

SEQ ID NO: 2625480 - RNA, 12 nt, Human
uaagccuugucg

SEQ ID NO: 2625481 - RNA, 15 nt, Human
uaagccuuuccauaa

SEQ ID NO: 2625482 - RNA, 20 nt, Human
uaaggaugcuuguacauaau

SEQ ID NO: 2625483 - RNA, 21 nt, Human
uaaggaugcuuguacauaaug

SEQ ID NO: 2625484 - RNA, 22 nt, Human
uaaggaugcuuguacauaaugc

SEQ ID NO: 2625485 - RNA, 23 nt, Human
uaaggaugcuuguacauaaugcg

SEQ ID NO: 2625486 - RNA, 15 nt, Human
uaaggcaaucauggu

SEQ ID NO: 2625487 - RNA, 20 nt, Human
uaaggaugucacagggccaa

SEQ ID NO: 2625488 - RNA, 13 nt, Human
uaaggcaugaagg

SEQ ID NO: 2625489 - RNA, 23 nt, Human
uaagcgaauguguacaaagugua

SEQ ID NO: 2625490 - RNA, 19 nt, Human
uaaggauggagccagcucu

SEQ ID NO: 2625491 - RNA, 20 nt, Human
uaaggauggagccagcucug

SEQ ID NO: 2625492 - RNA, 18 nt, Human
uaaggaugcuuguacaua

SEQ ID NO: 2625493 - RNA, 18 nt, Human
uaaggaugggaaggaggg

SEQ ID NO: 2625494 - RNA, 19 nt, Human
uaaggaugucacagggcca

SEQ ID NO: 2625495 - RNA, 17 nt, Human
uaaggaugucacagggc

SEQ ID NO: 2625496 - RNA, 12 nt, Human
uaaggaugggaa

SEQ ID NO: 2625497 - RNA, 16 nt, Human
uaaggaugggaaggag

SEQ ID NO: 2625498 - RNA, 22 nt, Human
uaagaggcagggucucacucug

SEQ ID NO: 2625499 - RNA, 14 nt, Human
uaagagcugguguc

SEQ ID NO: 2625500 - RNA, 15 nt, Human
uaagaggcugauaau

SEQ ID NO: 2625501 - RNA, 14 nt, Human
uaagaggcugauaa

SEQ ID NO: 2625502 - RNA, 15 nt, Human
uaagagcaccuuccu

SEQ ID NO: 2625503 - RNA, 22 nt, Human
uaagagcaccuuccucacuucc

SEQ ID NO: 2625504 - RNA, 20 nt, Human
uaagagcaccuuccucacuu

SEQ ID NO: 2625505 - RNA, 19 nt, Human
uaagagcaccuuccucacu

SEQ ID NO: 2625506 - RNA, 18 nt, Human
uaagagcuagcgcugccg

SEQ ID NO: 2625507 - RNA, 20 nt, Human
uaagagcuagcgcugccgca

SEQ ID NO: 2625508 - RNA, 22 nt, Human
uaagagccauuuaggggccacu

SEQ ID NO: 2625509 - RNA, 22 nt, Human
uaagagccauauaaguuugaag

SEQ ID NO: 2625510 - RNA, 16 nt, Human
uaagagcuagcgcugc

SEQ ID NO: 2625511 - RNA, 21 nt, Human
uaagaacuacaaacaaaauuu

SEQ ID NO: 2625512 - RNA, 19 nt, Human
uaagaacugcuuucuuucg

SEQ ID NO: 2625513 - RNA, 21 nt, Human
uaagaagaaaauugcugugcc

SEQ ID NO: 2625514 - RNA, 22 nt, Human
uaagaacugcuuucuuucguuu

SEQ ID NO: 2625515 - RNA, 22 nt, Human
uaagaagaaaauugcugugccu

SEQ ID NO: 2625516 - RNA, 13 nt, Human
uaagaagaaacua

SEQ ID NO: 2625517 - RNA, 14 nt, Human
uaagaagagacugg

SEQ ID NO: 2625518 - RNA, 19 nt, Human
uaagaagagacugggaaga

SEQ ID NO: 2625519 - RNA, 15 nt, Human
uaagagagagagaca

SEQ ID NO: 2625520 - RNA, 13 nt, Human
uaagaagcuguug

SEQ ID NO: 2625521 - RNA, 14 nt, Human
uaagaagacaugaa

SEQ ID NO: 2625522 - RNA, 15 nt, Human
uaagaagacaugaac

SEQ ID NO: 2625523 - RNA, 12 nt, Human
uaagaagagacu

SEQ ID NO: 2625524 - RNA, 22 nt, Human
uaagaaccuuuugagugccuua

SEQ ID NO: 2625525 - RNA, 18 nt, Human
uaagaaauacuguacaau

SEQ ID NO: 2625526 - RNA, 22 nt, Human
uaagaaauaaaacuguuaaagu

SEQ ID NO: 2625527 - RNA, 19 nt, Human
uaagaaauaaaacuguuaa

SEQ ID NO: 2625528 - RNA, 16 nt, Human
uaagaaauaaaacugu

SEQ ID NO: 2625529 - RNA, 16 nt, Human
uaagaaauacuguaca

SEQ ID NO: 2625530 - RNA, 15 nt, Human
uaagaaagugaagca

SEQ ID NO: 2625531 - RNA, 18 nt, Human
uaagaaagugaagcaaau

SEQ ID NO: 2625532 - RNA, 22 nt, Human
uaagaaagugaagcaaaucaga

SEQ ID NO: 2625533 - RNA, 21 nt, Human
uaacuuuuauaaacuuuaccu

SEQ ID NO: 2625534 - RNA, 22 nt, Human
uaacuuuuauaaacuuuaccuu

SEQ ID NO: 2625535 - RNA, 13 nt, Human
uaacugugaaguu

SEQ ID NO: 2625536 - RNA, 19 nt, Human
uaacuuuuauaaacuuuac

SEQ ID NO: 2625537 - RNA, 24 nt, Human
uaagaaagacuaucuaaauguuga

SEQ ID NO: 2625538 - RNA, 23 nt, Human
uaagagggauuagggagagaaga

SEQ ID NO: 2625539 - RNA, 23 nt, Human
uaagagggagggagggcuccaga

SEQ ID NO: 2625540 - RNA, 22 nt, Human
uaagagggagggagggcuccag

SEQ ID NO: 2625541 - RNA, 12 nt, Human
uaagagggaggg

SEQ ID NO: 2625542 - RNA, 18 nt, Human
uaagagggcacacacugu

SEQ ID NO: 2625543 - RNA, 17 nt, Human
uaagagggcacacacug

SEQ ID NO: 2625544 - RNA, 14 nt, Human
uaagagugcugggc

SEQ ID NO: 2625545 - RNA, 18 nt, Human
uaagagugaaaauugucu

SEQ ID NO: 2625546 - RNA, 20 nt, Human
uaagagggcacacacugugu

SEQ ID NO: 2625547 - RNA, 21 nt, Human
uaagaguagaaacugcaggga

SEQ ID NO: 2625548 - RNA, 23 nt, Human
uaagaguguagaagcauuccuuc

SEQ ID NO: 2625549 - RNA, 22 nt, Human
uaagaguguagaagcauuccuu

SEQ ID NO: 2625550 - RNA, 19 nt, Human
uaagaguguagaagcauuc

SEQ ID NO: 2625551 - RNA, 18 nt, Human
uaagaguguagaagcauu

SEQ ID NO: 2625552 - RNA, 16 nt, Human
uaagaguguagaagca

SEQ ID NO: 2625553 - RNA, 13 nt, Human
uaagaguguagaa

SEQ ID NO: 2625554 - RNA, 12 nt, Human
uaagaguguaga

SEQ ID NO: 2625555 - RNA, 19 nt, Human
uaagagugggggagagcag

SEQ ID NO: 2625556 - RNA, 14 nt, Human
uaagauaaaugugc

SEQ ID NO: 2625557 - RNA, 16 nt, Human
uaagauaaaugugcug

SEQ ID NO: 2625558 - RNA, 17 nt, Human
uaagauaaaugugcuga

SEQ ID NO: 2625559 - RNA, 13 nt, Human
uaagauaauuaua

SEQ ID NO: 2625560 - RNA, 23 nt, Human
uaagauaauaguuuacauguagu

SEQ ID NO: 2625561 - RNA, 18 nt, Human
uaagauaauaguuuacau

SEQ ID NO: 2625562 - RNA, 12 nt, Human
uaagauaauuau

SEQ ID NO: 2625563 - RNA, 22 nt, Human
uaagauaauaauauauguuuac

SEQ ID NO: 2625564 - RNA, 15 nt, Human
uaagauaauaauaua

SEQ ID NO: 2625565 - RNA, 14 nt, Human
uaagauaauaauau

SEQ ID NO: 2625566 - RNA, 12 nt, Human
uaagauaauaau

SEQ ID NO: 2625567 - RNA, 21 nt, Human
uaagaguuaguuucuuuggga

SEQ ID NO: 2625568 - RNA, 13 nt, Human
uaagaguguuuaa

SEQ ID NO: 2625569 - RNA, 18 nt, Human
uaagauauuuuucaugau

SEQ ID NO: 2625570 - RNA, 17 nt, Human
uaagauauuuuucauga

SEQ ID NO: 2625571 - RNA, 15 nt, Human
uaagauauuuuucau

SEQ ID NO: 2625572 - RNA, 14 nt, Human
uaagauauuuuuca

SEQ ID NO: 2625573 - RNA, 21 nt, Human
uaagauaugggacauuuuuga

SEQ ID NO: 2625574 - RNA, 19 nt, Human
uaagauaugggacauuuuu

SEQ ID NO: 2625575 - RNA, 19 nt, Human
uaagauauuuuucaugauu

SEQ ID NO: 2625576 - RNA, 18 nt, Human
uaagaucguucucugccu

SEQ ID NO: 2625577 - RNA, 13 nt, Human
uaacagaaaugua

SEQ ID NO: 2625578 - RNA, 20 nt, Human
uaacacagugccuucaauaa

SEQ ID NO: 2625579 - RNA, 19 nt, Human
uaacacagugccuucaaua

SEQ ID NO: 2625580 - RNA, 17 nt, Human
uaacacagcauguguau

SEQ ID NO: 2625581 - RNA, 23 nt, Human
uaacacaaguccugugaauuucu

SEQ ID NO: 2625582 - RNA, 17 nt, Human
uaacacaaguccuguga

SEQ ID NO: 2625583 - RNA, 17 nt, Human
uaacacaagccacagaa

SEQ ID NO: 2625584 - RNA, 16 nt, Human
uaacacaagccacaga

SEQ ID NO: 2625585 - RNA, 18 nt, Human
uaacaauuuuaaugcuau

SEQ ID NO: 2625586 - RNA, 22 nt, Human
uaacaauuucuguccuucagau

SEQ ID NO: 2625587 - RNA, 16 nt, Human
uaacaauuucuguccu

SEQ ID NO: 2625588 - RNA, 14 nt, Human
uaacacacagcucc

SEQ ID NO: 2625589 - RNA, 13 nt, Human
uaacacacagcua

SEQ ID NO: 2625590 - RNA, 12 nt, Human
uaacacacagcu

SEQ ID NO: 2625591 - RNA, 18 nt, Human
uaacacaaguccugugaa

SEQ ID NO: 2625592 - RNA, 17 nt, Human
uaacacacagcucccau

SEQ ID NO: 2625593 - RNA, 15 nt, Human
uaacacacagcuccc

SEQ ID NO: 2625594 - RNA, 14 nt, Human
uaacagaaauguac

SEQ ID NO: 2625595 - RNA, 15 nt, Human
uaacagaaauguaca

SEQ ID NO: 2625596 - RNA, 17 nt, Human
uaacagaacagcuucag

SEQ ID NO: 2625597 - RNA, 16 nt, Human
uaacagaacagcuuca

SEQ ID NO: 2625598 - RNA, 14 nt, Human
uaacagaacagcuu

SEQ ID NO: 2625599 - RNA, 12 nt, Human
uaacagaacagc

SEQ ID NO: 2625600 - RNA, 12 nt, Human
uaacagaaaugu

SEQ ID NO: 2625601 - RNA, 14 nt, Human
uaacacauguccuu

SEQ ID NO: 2625602 - RNA, 21 nt, Human
uaacacagugccuucaauaaa

SEQ ID NO: 2625603 - RNA, 11 nt, Human
uaacacauuau

SEQ ID NO: 2625604 - RNA, 22 nt, Human
uaacagauuuugggguuguguu

SEQ ID NO: 2625605 - RNA, 21 nt, Human
uaacagaugcaaugugcuacu

SEQ ID NO: 2625606 - RNA, 19 nt, Human
uaacagccaggaguguuaa

SEQ ID NO: 2625607 - RNA, 22 nt, Human
uaacagaacagcuucagguuau

SEQ ID NO: 2625608 - RNA, 21 nt, Human
uaacagaacagcuucagguua

SEQ ID NO: 2625609 - RNA, 20 nt, Human
uaacagaacagcuucagguu

SEQ ID NO: 2625610 - RNA, 19 nt, Human
uaacagaacagcuucaggu

SEQ ID NO: 2625611 - RNA, 18 nt, Human
uaacagaacagcuucagg

SEQ ID NO: 2625612 - RNA, 18 nt, Human
uaacagacauuguuuugc

SEQ ID NO: 2625613 - RNA, 14 nt, Human
uaacagacauuguu

SEQ ID NO: 2625614 - RNA, 11 nt, Human
uaacagacauu

SEQ ID NO: 2625615 - RNA, 18 nt, Human
uaacagauaagcaagaga

SEQ ID NO: 2625616 - RNA, 12 nt, Human
uaacagaugcaa

SEQ ID NO: 2625617 - RNA, 15 nt, Human
uaacagaugcaaugu

SEQ ID NO: 2625618 - RNA, 22 nt, Human
uaacagcuccuugggaggaagc

SEQ ID NO: 2625619 - RNA, 20 nt, Human
uaacagcuccuugggaggaa

SEQ ID NO: 2625620 - RNA, 17 nt, Human
uaacagcuccuugggag

SEQ ID NO: 2625621 - RNA, 16 nt, Human
uaacagcuccuuggga

SEQ ID NO: 2625622 - RNA, 15 nt, Human
uaacagcuccuuggg

SEQ ID NO: 2625623 - RNA, 11 nt, Human
uaacagcuccu

SEQ ID NO: 2625624 - RNA, 13 nt, Human
uaacagcucagga

SEQ ID NO: 2625625 - RNA, 14 nt, Human
uaacagcucaggau

SEQ ID NO: 2625626 - RNA, 23 nt, Human
uaacagcuccuugggaggaagca

SEQ ID NO: 2625627 - RNA, 12 nt, Human
uaacagcugaau

SEQ ID NO: 2625628 - RNA, 15 nt, Human
uaacagcugaauuau

SEQ ID NO: 2625629 - RNA, 19 nt, Human
uaacagcugaauuaucuau

SEQ ID NO: 2625630 - RNA, 15 nt, Human
uaacagcugaggucu

SEQ ID NO: 2625631 - RNA, 12 nt, Human
uaacagcugagg

SEQ ID NO: 2625632 - RNA, 12 nt, Human
uaacagcugugg

SEQ ID NO: 2625633 - RNA, 21 nt, Human
uaacaggaagaucuuaaauuu

SEQ ID NO: 2625634 - RNA, 16 nt, Human
uaacaggauuagacag

SEQ ID NO: 2625635 - RNA, 16 nt, Human
uaaauugauguugcug

SEQ ID NO: 2625636 - RNA, 15 nt, Human
uaaauugcuguguau

SEQ ID NO: 2625637 - RNA, 15 nt, Human
uaaauugcuccuuga

SEQ ID NO: 2625638 - RNA, 12 nt, Human
uaaauuguuuga

SEQ ID NO: 2625639 - RNA, 17 nt, Human
uaaauuguauauucacu

SEQ ID NO: 2625640 - RNA, 14 nt, Human
uaaauuguauauuc

SEQ ID NO: 2625641 - RNA, 13 nt, Human
uaaauuguauauu

SEQ ID NO: 2625642 - RNA, 19 nt, Human
uaaauuguauauucacuuu

SEQ ID NO: 2625643 - RNA, 18 nt, Human
uaaauuguauauucacuu

SEQ ID NO: 2625644 - RNA, 23 nt, Human
uaaauuguccguguucauacauu

SEQ ID NO: 2625645 - RNA, 14 nt, Human
uaacaauuucuguc

SEQ ID NO: 2625646 - RNA, 21 nt, Human
uaacaauuuccuuuauauuua

SEQ ID NO: 2625647 - RNA, 15 nt, Human
uaacaauuuccuuua

SEQ ID NO: 2625648 - RNA, 13 nt, Human
uaacaauuuccuu

SEQ ID NO: 2625649 - RNA, 13 nt, Human
uaacaauuccucu

SEQ ID NO: 2625650 - RNA, 15 nt, Human
uaacaauugugaagu

SEQ ID NO: 2625651 - RNA, 14 nt, Human
uaacaauuccucua

SEQ ID NO: 2625652 - RNA, 23 nt, Human
uaacaauguuaaggaaacucuua

SEQ ID NO: 2625653 - RNA, 22 nt, Human
uaacaauguuaaggaaacucuu

SEQ ID NO: 2625654 - RNA, 21 nt, Human
uaacaauguuaaggaaacucu

SEQ ID NO: 2625655 - RNA, 19 nt, Human
uaacaauguuaaggaaacu

SEQ ID NO: 2625656 - RNA, 16 nt, Human
uaacaauguuaaggaa

SEQ ID NO: 2625657 - RNA, 15 nt, Human
uaacaauguuaagga

SEQ ID NO: 2625658 - RNA, 14 nt, Human
uaacaauguuaagg

SEQ ID NO: 2625659 - RNA, 12 nt, Human
uaacaauguuaa

SEQ ID NO: 2625660 - RNA, 13 nt, Human
uaacaauguuaag

SEQ ID NO: 2625661 - RNA, 15 nt, Human
uaacucaucugucac

SEQ ID NO: 2625662 - RNA, 23 nt, Human
uaacucauacugugcuggagcca

SEQ ID NO: 2625663 - RNA, 16 nt, Human
uaacugagugccuuuu

SEQ ID NO: 2625664 - RNA, 11 nt, Human
uaacuccacca

SEQ ID NO: 2625665 - RNA, 16 nt, Human
uaacuccaccaaccca

SEQ ID NO: 2625666 - RNA, 22 nt, Human
uaacuccaccaacccaucagaa

SEQ ID NO: 2625667 - RNA, 14 nt, Human
uaacucaucuguca

SEQ ID NO: 2625668 - RNA, 17 nt, Human
uaacucaucauaaaaua

SEQ ID NO: 2625669 - RNA, 15 nt, Human
uaacucaucauaaaa

SEQ ID NO: 2625670 - RNA, 16 nt, Human
uaacucaucauaaaau

SEQ ID NO: 2625671 - RNA, 19 nt, Human
uaacucauaccuuuaaagg

SEQ ID NO: 2625672 - RNA, 23 nt, Human
uaacucagaucacuacugcaguc

SEQ ID NO: 2625673 - RNA, 21 nt, Human
uaacucagaucacuacugcag

SEQ ID NO: 2625674 - RNA, 14 nt, Human
uaacucaucauaaa

SEQ ID NO: 2625675 - RNA, 20 nt, Human
uaaccguccucgagcaacug

SEQ ID NO: 2625676 - RNA, 14 nt, Human
uaaccucagcucug

SEQ ID NO: 2625677 - RNA, 13 nt, Human
uaaccucagcucu

SEQ ID NO: 2625678 - RNA, 22 nt, Human
uaaccuauuuugaaaaauuccu

SEQ ID NO: 2625679 - RNA, 22 nt, Human
uaaccuauaugauuuauaguuu

SEQ ID NO: 2625680 - RNA, 20 nt, Human
uaaccuauaugauuuauagu

SEQ ID NO: 2625681 - RNA, 20 nt, Human
uaaccuaugauauuuucugu

SEQ ID NO: 2625682 - RNA, 22 nt, Human
uaacucagaaacaucaguuacu

SEQ ID NO: 2625683 - RNA, 20 nt, Human
uaacucagaucacuacugca

SEQ ID NO: 2625684 - RNA, 14 nt, Human
uaacucagaucacu

SEQ ID NO: 2625685 - RNA, 13 nt, Human
uaacucagaucac

SEQ ID NO: 2625686 - RNA, 19 nt, Human
uaaccucagcucugggaga

SEQ ID NO: 2625687 - RNA, 17 nt, Human
uaaccucagcucuggga

SEQ ID NO: 2625688 - RNA, 16 nt, Human
uaaccucagcucuggg

SEQ ID NO: 2625689 - RNA, 15 nt, Human
uaaccucagcucugg

SEQ ID NO: 2625690 - RNA, 14 nt, Human
uaaccucaucuucu

SEQ ID NO: 2625691 - RNA, 19 nt, Human
uaaccucagugucauuuau

SEQ ID NO: 2625692 - RNA, 20 nt, Human
uaaccucagugucauuuaug

SEQ ID NO: 2625693 - RNA, 20 nt, Human
uaacuuuuauaaacuuuacc

SEQ ID NO: 2625694 - RNA, 13 nt, Human
uaacugguauaga

SEQ ID NO: 2625695 - RNA, 24 nt, Human
uaacuggcaguuuuccauugguuu

SEQ ID NO: 2625696 - RNA, 23 nt, Human
uaacuggcaguuuuccauugguu

SEQ ID NO: 2625697 - RNA, 18 nt, Human
uaacugccuuaaaacuuu

SEQ ID NO: 2625698 - RNA, 23 nt, Human
uaacugccaucaagaugagagaa

SEQ ID NO: 2625699 - RNA, 17 nt, Human
uaacugagugccuuuug

SEQ ID NO: 2625700 - RNA, 14 nt, Human
uaacuccagugaag

SEQ ID NO: 2625701 - RNA, 17 nt, Human
uaacugcauugagaacu

SEQ ID NO: 2625702 - RNA, 16 nt, Human
uaacugcauuuuuaga

SEQ ID NO: 2625703 - RNA, 20 nt, Human
uaacugcaauuuuaauugau

SEQ ID NO: 2625704 - RNA, 12 nt, Human
uaacugcaauuu

SEQ ID NO: 2625705 - RNA, 14 nt, Human
uaacaggcuucugg

SEQ ID NO: 2625706 - RNA, 19 nt, Human
uaacaggcagauacaggaa

SEQ ID NO: 2625707 - RNA, 22 nt, Human
uaacaggcucaauauuccugaa

SEQ ID NO: 2625708 - RNA, 23 nt, Human
uaacaggcucaauauuccugaau

SEQ ID NO: 2625709 - RNA, 19 nt, Human
uaacauuaccuuacugugg

SEQ ID NO: 2625710 - RNA, 17 nt, Human
uaacauuaccuuacugu

SEQ ID NO: 2625711 - RNA, 13 nt, Human
uaacauuaccuua

SEQ ID NO: 2625712 - RNA, 12 nt, Human
uaacauuaccuu

SEQ ID NO: 2625713 - RNA, 12 nt, Human
uaacauuauuua

SEQ ID NO: 2625714 - RNA, 18 nt, Human
uaaccaaaggugaaggaa

SEQ ID NO: 2625715 - RNA, 17 nt, Human
uaaccaaaggugaagga

SEQ ID NO: 2625716 - RNA, 11 nt, Human
uaaccaaaggu

SEQ ID NO: 2625717 - RNA, 21 nt, Human
uaaccaaaggugaaggaauau

SEQ ID NO: 2625718 - RNA, 16 nt, Human
uaaccagcagaaaugc

SEQ ID NO: 2625719 - RNA, 19 nt, Human
uaaccagcagaaaugccuu

SEQ ID NO: 2625720 - RNA, 20 nt, Human
uaacccuuugguuuuuuucu

SEQ ID NO: 2625721 - RNA, 20 nt, Human
uaaccagccagauccucuug

SEQ ID NO: 2625722 - RNA, 15 nt, Human
uaaccagcuguaaca

SEQ ID NO: 2625723 - RNA, 13 nt, Human
uaaccacggaaaa

SEQ ID NO: 2625724 - RNA, 14 nt, Human
uaaccagcagaaau

SEQ ID NO: 2625725 - RNA, 24 nt, Human
uaaccacaucaauauugucauucc

SEQ ID NO: 2625726 - RNA, 22 nt, Human
uaaccacaucaauauugucauu

SEQ ID NO: 2625727 - RNA, 21 nt, Human
uaaccaccuaccuuacaguga

SEQ ID NO: 2625728 - RNA, 18 nt, Human
uaaccacaucaauauugu

SEQ ID NO: 2625729 - RNA, 23 nt, Human
uaaccacaaagcacaguuugaac

SEQ ID NO: 2625730 - RNA, 19 nt, Human
uaaccacaaagcacaguuu

SEQ ID NO: 2625731 - RNA, 20 nt, Human
uaaacuuuuuucuuacuguc

SEQ ID NO: 2625732 - RNA, 16 nt, Human
uaaagcauuccaacaa

SEQ ID NO: 2625733 - RNA, 15 nt, Human
uaaagcauuccaaca

SEQ ID NO: 2625734 - RNA, 13 nt, Human
uaaagcauuccaa

SEQ ID NO: 2625735 - RNA, 12 nt, Human
uaaagcauucca

SEQ ID NO: 2625736 - RNA, 23 nt, Human
uaaagcauucaauuuauucaaga

SEQ ID NO: 2625737 - RNA, 22 nt, Human
uaaagcaugaaugguauggaac

SEQ ID NO: 2625738 - RNA, 19 nt, Human
uaaagcaguggacaccagg

SEQ ID NO: 2625739 - RNA, 13 nt, Human
uaaagcaguggac

SEQ ID NO: 2625740 - RNA, 12 nt, Human
uaaagcauuuau

SEQ ID NO: 2625741 - RNA, 20 nt, Human
uaaagccuguauucucaaac

SEQ ID NO: 2625742 - RNA, 21 nt, Human
uaaagccugcuuuuuaagugu

SEQ ID NO: 2625743 - RNA, 16 nt, Human
uaaagccugcuuuuua

SEQ ID NO: 2625744 - RNA, 15 nt, Human
uaaagcuaaaauaac

SEQ ID NO: 2625745 - RNA, 15 nt, Human
uaaagcuagaaauga

SEQ ID NO: 2625746 - RNA, 18 nt, Human
uaaagcucgaaaacaauu

SEQ ID NO: 2625747 - RNA, 17 nt, Human
uaaaggagaaggcauga

SEQ ID NO: 2625748 - RNA, 20 nt, Human
uaaaggaguuaagaguagca

SEQ ID NO: 2625749 - RNA, 22 nt, Human
uaaaggagaaggcaugaaauug

SEQ ID NO: 2625750 - RNA, 16 nt, Human
uaaaggaguuaagagu

SEQ ID NO: 2625751 - RNA, 14 nt, Human
uaaaggaauuuaaa

SEQ ID NO: 2625752 - RNA, 17 nt, Human
uaaagcucgaaaacaau

SEQ ID NO: 2625753 - RNA, 19 nt, Human
uaaagcuacugauuuccuu

SEQ ID NO: 2625754 - RNA, 23 nt, Human
uaaagcuaaaaugauuuuaucug

SEQ ID NO: 2625755 - RNA, 20 nt, Human
uaaagcuaaaaugauuuuau

SEQ ID NO: 2625756 - RNA, 14 nt, Human
uaaagcuagaaaug

SEQ ID NO: 2625757 - RNA, 22 nt, Human
uaaaguguauuuuuuuacuaau

SEQ ID NO: 2625758 - RNA, 23 nt, Human
uaaaguguauuuuuuuacuaaua

SEQ ID NO: 2625759 - RNA, 17 nt, Human
uaaaggauguugguguu

SEQ ID NO: 2625760 - RNA, 19 nt, Human
uaaaggcaccaucuaauag

SEQ ID NO: 2625761 - RNA, 16 nt, Human
uaaaggaugugauugu

SEQ ID NO: 2625762 - RNA, 22 nt, Human
uaaaggaugugauuguggaaug

SEQ ID NO: 2625763 - RNA, 21 nt, Human
uaaaguguauuuuuuuacuaa

SEQ ID NO: 2625764 - RNA, 20 nt, Human
uaaaguguauuuuuuuacua

SEQ ID NO: 2625765 - RNA, 14 nt, Human
uaaaguuugcuuag

SEQ ID NO: 2625766 - RNA, 17 nt, Human
uaaaguuugcuuagaaa

SEQ ID NO: 2625767 - RNA, 14 nt, Human
uaaaguuuguugaa

SEQ ID NO: 2625768 - RNA, 14 nt, Human
uaaaguuucucaga

SEQ ID NO: 2625769 - RNA, 13 nt, Human
uaaaguuucucag

SEQ ID NO: 2625770 - RNA, 17 nt, Human
uaaaguguccauugaca

SEQ ID NO: 2625771 - RNA, 20 nt, Human
uaaaguugaagcuaagauuu

SEQ ID NO: 2625772 - RNA, 13 nt, Human
uaaaguuucuguu

SEQ ID NO: 2625773 - RNA, 17 nt, Human
uaaauaaaaauaauccu

SEQ ID NO: 2625774 - RNA, 14 nt, Human
uaaauaaaaaugga

SEQ ID NO: 2625775 - RNA, 13 nt, Human
uaaauaaaagaaa

SEQ ID NO: 2625776 - RNA, 14 nt, Human
uaaauaaaacccuu

SEQ ID NO: 2625777 - RNA, 21 nt, Human
uaaauaaaacauuuucacaca

SEQ ID NO: 2625778 - RNA, 22 nt, Human
uaaauaaaacauuuucacacaa

SEQ ID NO: 2625779 - RNA, 18 nt, Human
uaaauauauauaaauaua

SEQ ID NO: 2625780 - RNA, 17 nt, Human
uaaauauauauaaauau

SEQ ID NO: 2625781 - RNA, 19 nt, Human
uaaauauauauaaaccuaa

SEQ ID NO: 2625782 - RNA, 18 nt, Human
uaaauauauauaaaccua

SEQ ID NO: 2625783 - RNA, 17 nt, Human
uaaauauauauaaaccu

SEQ ID NO: 2625784 - RNA, 15 nt, Human
uaaauauauauaaac

SEQ ID NO: 2625785 - RNA, 14 nt, Human
uaaauauauauaaa

SEQ ID NO: 2625786 - RNA, 21 nt, Human
uaaauauauauaaauauauau

SEQ ID NO: 2625787 - RNA, 19 nt, Human
uaaauauauauaaauauau

SEQ ID NO: 2625788 - RNA, 13 nt, Human
uaaauauauauaa

SEQ ID NO: 2625789 - RNA, 11 nt, Human
uaaauauauau

SEQ ID NO: 2625790 - RNA, 17 nt, Human
uaaauauauaaauauau

SEQ ID NO: 2625791 - RNA, 16 nt, Human
uaaauauauaaauaua

SEQ ID NO: 2625792 - RNA, 15 nt, Human
uaaauauauaaauau

SEQ ID NO: 2625793 - RNA, 13 nt, Human
uaaauauauaaau

SEQ ID NO: 2625794 - RNA, 14 nt, Human
uaaauauauaaaaa

SEQ ID NO: 2625795 - RNA, 12 nt, Human
uaaauauauaaa

SEQ ID NO: 2625796 - RNA, 20 nt, Human
uaaauaaaauuuguugcaua

SEQ ID NO: 2625797 - RNA, 14 nt, Human
uaaauaaaauuugu

SEQ ID NO: 2625798 - RNA, 13 nt, Human
uaaauaaaauuug

SEQ ID NO: 2625799 - RNA, 22 nt, Human
uaaauaaaccucaaaaugucua

SEQ ID NO: 2625800 - RNA, 13 nt, Human
uaaauaaacccuu

SEQ ID NO: 2625801 - RNA, 15 nt, Human
uaaauaaaaugacca

SEQ ID NO: 2625802 - RNA, 13 nt, Human
uaaauaaaaugac

SEQ ID NO: 2625803 - RNA, 17 nt, Human
uaaauaaaagugaucaa

SEQ ID NO: 2625804 - RNA, 14 nt, Human
uaaauaaaagcagc

SEQ ID NO: 2625805 - RNA, 21 nt, Human
uaaauaaaagaaaaaauaucu

SEQ ID NO: 2625806 - RNA, 15 nt, Human
uaaauaaaagcagca

SEQ ID NO: 2625807 - RNA, 19 nt, Human
uaaauaaaagcagcaucug

SEQ ID NO: 2625808 - RNA, 20 nt, Human
uaaauaaaagcagcaucugc

SEQ ID NO: 2625809 - RNA, 19 nt, Human
uaaauaaaagugaucaaua

SEQ ID NO: 2625810 - RNA, 18 nt, Human
uaaauauaugcuaagucu

SEQ ID NO: 2625811 - RNA, 22 nt, Human
uaaauauauuuaagauaauuau

SEQ ID NO: 2625812 - RNA, 17 nt, Human
uaaauauauuuaagaua

SEQ ID NO: 2625813 - RNA, 21 nt, Human
uaaauauaucuauauuauugu

SEQ ID NO: 2625814 - RNA, 21 nt, Human
uaaauauauauauauauaaaa

SEQ ID NO: 2625815 - RNA, 22 nt, Human
uaaauauauuuuaagacgaaac

SEQ ID NO: 2625816 - RNA, 16 nt, Human
uaaauauauuuuaaga

SEQ ID NO: 2625817 - RNA, 17 nt, Human
uaaauaucuucugauuu

SEQ ID NO: 2625818 - RNA, 18 nt, Human
uaaauaucuucugauuug

SEQ ID NO: 2625819 - RNA, 19 nt, Human
uaaauaugaagcucaccug

SEQ ID NO: 2625820 - RNA, 13 nt, Human
uaaauaugcagug

SEQ ID NO: 2625821 - RNA, 22 nt, Human
uaaauaucuguacuucuucgau

SEQ ID NO: 2625822 - RNA, 11 nt, Human
uaaaucagugg

SEQ ID NO: 2625823 - RNA, 14 nt, Human
uaaaucauuaauac

SEQ ID NO: 2625824 - RNA, 22 nt, Human
uaaauauuuuuucuuuucuauu

SEQ ID NO: 2625825 - RNA, 19 nt, Human
uaaaucaaguuggcuucua

SEQ ID NO: 2625826 - RNA, 23 nt, Human
uaaaucaaugucacuuaaaggcu

SEQ ID NO: 2625827 - RNA, 13 nt, Human
uaaaucaauaaag

SEQ ID NO: 2625828 - RNA, 14 nt, Human
uaaaucaaugucac

SEQ ID NO: 2625829 - RNA, 20 nt, Human
uaaaucagacuaugaaguuu

SEQ ID NO: 2625830 - RNA, 19 nt, Human
uaaaucagccguguaacca

SEQ ID NO: 2625831 - RNA, 19 nt, Human
uaaauauucuauaugaauu

SEQ ID NO: 2625832 - RNA, 15 nt, Human
uaaauauucuauaug

SEQ ID NO: 2625833 - RNA, 19 nt, Human
uaaauauucuauuuucauu

SEQ ID NO: 2625834 - RNA, 18 nt, Human
uaaauauguuuuuuagau

SEQ ID NO: 2625835 - RNA, 13 nt, Human
uaaauauucuaua

SEQ ID NO: 2625836 - RNA, 19 nt, Human
uaaauaugccucuccuuug

SEQ ID NO: 2625837 - RNA, 17 nt, Human
uaaauaugcagugauau

SEQ ID NO: 2625838 - RNA, 16 nt, Human
uaaauaugcagugaua

SEQ ID NO: 2625839 - RNA, 14 nt, Human
uaaauaugcaguga

SEQ ID NO: 2625840 - RNA, 23 nt, Human
uaaauaugccucuccuuuguaua

SEQ ID NO: 2625841 - RNA, 21 nt, Human
uaaauaugccucuccuuugua

SEQ ID NO: 2625842 - RNA, 21 nt, Human
uaaauauguuagcaaagaguu

SEQ ID NO: 2625843 - RNA, 18 nt, Human
uaaauauguuagcaaaga

SEQ ID NO: 2625844 - RNA, 13 nt, Human
uaaauauuucaag

SEQ ID NO: 2625845 - RNA, 12 nt, Human
uaaauauuucaa

SEQ ID NO: 2625846 - RNA, 14 nt, Human
uaaauauuucaaga

SEQ ID NO: 2625847 - RNA, 12 nt, Human
uaaauauuuccu

SEQ ID NO: 2625848 - RNA, 13 nt, Human
uaaauauuuccuu

SEQ ID NO: 2625849 - RNA, 14 nt, Human
uaaauauuuccuua

SEQ ID NO: 2625850 - RNA, 15 nt, Human
uaaauauuuccuuaa

SEQ ID NO: 2625851 - RNA, 11 nt, Human
uaaauauuuac

SEQ ID NO: 2625852 - RNA, 17 nt, Human
uaaauauuuacauauga

SEQ ID NO: 2625853 - RNA, 18 nt, Human
uaaauauuuacauaugaa

SEQ ID NO: 2625854 - RNA, 19 nt, Human
uaaauauuuacauaugaaa

SEQ ID NO: 2625855 - RNA, 21 nt, Human
uaaauauuuacauaugaaauu

SEQ ID NO: 2625856 - RNA, 16 nt, Human
uaaauauuuauguaga

SEQ ID NO: 2625857 - RNA, 17 nt, Human
uaaauauuuauguagau

SEQ ID NO: 2625858 - RNA, 10 nt, Human
uaaauauuua

SEQ ID NO: 2625859 - RNA, 14 nt, Human
uaaacuuaaucuaa

SEQ ID NO: 2625860 - RNA, 13 nt, Human
uaaacuuaaucua

SEQ ID NO: 2625861 - RNA, 18 nt, Human
uaaacuuaaucuaaaugg

SEQ ID NO: 2625862 - RNA, 19 nt, Human
uaaacuuaaucuaaaugga

SEQ ID NO: 2625863 - RNA, 16 nt, Human
uaaacuuuaccuuuuu

SEQ ID NO: 2625864 - RNA, 20 nt, Human
uaaacuuuacccaaaaacua

SEQ ID NO: 2625865 - RNA, 22 nt, Human
uaaacuuuaccuuuuuuauaca

SEQ ID NO: 2625866 - RNA, 12 nt, Human
uaaacuuucaca

SEQ ID NO: 2625867 - RNA, 13 nt, Human
uaaacuuucacac

SEQ ID NO: 2625868 - RNA, 15 nt, Human
uaaacuuagaauaaa

SEQ ID NO: 2625869 - RNA, 18 nt, Human
uaaacuuuagaguagcau

SEQ ID NO: 2625870 - RNA, 20 nt, Human
uaaacugcccccucugcccu

SEQ ID NO: 2625871 - RNA, 21 nt, Human
uaaacugcccccucugcccug

SEQ ID NO: 2625872 - RNA, 17 nt, Human
uaaacauaaauaaauau

SEQ ID NO: 2625873 - RNA, 20 nt, Human
uaaacauaauucuuguauau

SEQ ID NO: 2625874 - RNA, 15 nt, Human
uaaacauaauucuug

SEQ ID NO: 2625875 - RNA, 22 nt, Human
uaaacugcccccucugcccugc

SEQ ID NO: 2625876 - RNA, 23 nt, Human
uaaacugcccccucugcccugcg

SEQ ID NO: 2625877 - RNA, 20 nt, Human
uaaacugguauuuuaucuuu

SEQ ID NO: 2625878 - RNA, 22 nt, Human
uaaacagcaguguuccccaucu

SEQ ID NO: 2625879 - RNA, 17 nt, Human
uaaacagcaguguuccc

SEQ ID NO: 2625880 - RNA, 13 nt, Human
uaaacagcagugu

SEQ ID NO: 2625881 - RNA, 20 nt, Human
uaaacagauuuuuacaaaug

SEQ ID NO: 2625882 - RNA, 19 nt, Human
uaaacagauuuuuacaaau

SEQ ID NO: 2625883 - RNA, 18 nt, Human
uaaacagauuuuuacaaa

SEQ ID NO: 2625884 - RNA, 15 nt, Human
uaaacagauuuuuac

SEQ ID NO: 2625885 - RNA, 19 nt, Human
uaaacagggcaucuccagg

SEQ ID NO: 2625886 - RNA, 23 nt, Human
uaaacaggcccagcauugcuggu

SEQ ID NO: 2625887 - RNA, 15 nt, Human
uaaacaggcccagca

SEQ ID NO: 2625888 - RNA, 14 nt, Human
uaaacaggcccagc

SEQ ID NO: 2625889 - RNA, 13 nt, Human
uaaacaggcccag

SEQ ID NO: 2625890 - RNA, 12 nt, Human
uaaacaggccca

SEQ ID NO: 2625891 - RNA, 18 nt, Human
uaaacaggagacaggaag

SEQ ID NO: 2625892 - RNA, 13 nt, Human
uaaacagugccug

SEQ ID NO: 2625893 - RNA, 17 nt, Human
uaaacagugccugcuga

SEQ ID NO: 2625894 - RNA, 13 nt, Human
uaaacaguucuug

SEQ ID NO: 2625895 - RNA, 18 nt, Human
uaaacagugccugcugaa

SEQ ID NO: 2625896 - RNA, 20 nt, Human
uaaacagggcaucuccagga

SEQ ID NO: 2625897 - RNA, 20 nt, Human
uaaacagugagccugaauuu

SEQ ID NO: 2625898 - RNA, 23 nt, Human
uaaacagugagccugaauuuugu

SEQ ID NO: 2625899 - RNA, 12 nt, Human
uaaacagugccu

SEQ ID NO: 2625900 - RNA, 16 nt, Human
uaaacagauauaaaug

SEQ ID NO: 2625901 - RNA, 21 nt, Human
uaaacagauauaaauggcugg

SEQ ID NO: 2625902 - RNA, 23 nt, Human
uaaacagacuauuuaacuugagg

SEQ ID NO: 2625903 - RNA, 11 nt, Human
uaaacacugug

SEQ ID NO: 2625904 - RNA, 21 nt, Human
uaaacacucuugaaaaaugca

SEQ ID NO: 2625905 - RNA, 23 nt, Human
uaaacaagaccacguuucuaaag

SEQ ID NO: 2625906 - RNA, 15 nt, Human
uaaacaagauuuuaa

SEQ ID NO: 2625907 - RNA, 20 nt, Human
uaaacaagaaucagucuauc

SEQ ID NO: 2625908 - RNA, 21 nt, Human
uaaacaagauuuuaaagacau

SEQ ID NO: 2625909 - RNA, 20 nt, Human
uaaacaagauuuuaaagaca

SEQ ID NO: 2625910 - RNA, 21 nt, Human
uaaacaaugcugauuugguga

SEQ ID NO: 2625911 - RNA, 18 nt, Human
uaaacaauaucagacuuu

SEQ ID NO: 2625912 - RNA, 14 nt, Human
uaaaaugauuuuau

SEQ ID NO: 2625913 - RNA, 22 nt, Human
uaaaaugauuguaaaauagcuu

SEQ ID NO: 2625914 - RNA, 17 nt, Human
uaaaaugauuuuaucug

SEQ ID NO: 2625915 - RNA, 15 nt, Human
uaaaaugauuuuauc

SEQ ID NO: 2625916 - RNA, 18 nt, Human
uaaaaugauuuuaucugu

SEQ ID NO: 2625917 - RNA, 20 nt, Human
uaaaaugcaacauguguacu

SEQ ID NO: 2625918 - RNA, 17 nt, Human
uaaaaugcaacaugugu

SEQ ID NO: 2625919 - RNA, 20 nt, Human
uaaaaugccucaguguauuu

SEQ ID NO: 2625920 - RNA, 17 nt, Human
uaaaaugccucagugua

SEQ ID NO: 2625921 - RNA, 21 nt, Human
uaaaaugccucaguguauuug

SEQ ID NO: 2625922 - RNA, 16 nt, Human
uaaaaugcaugauuuu

SEQ ID NO: 2625923 - RNA, 19 nt, Human
uaaaaugcaugauuuugua

SEQ ID NO: 2625924 - RNA, 18 nt, Human
uaaaaugcaacaugugua

SEQ ID NO: 2625925 - RNA, 12 nt, Human
uaaacaaaugua

SEQ ID NO: 2625926 - RNA, 18 nt, Human
uaaacaagaccacguuuc

SEQ ID NO: 2625927 - RNA, 22 nt, Human
uaaacaaauucauauucugucu

SEQ ID NO: 2625928 - RNA, 21 nt, Human
uaaacaaauucauauucuguc

SEQ ID NO: 2625929 - RNA, 19 nt, Human
uaaacaaauucauauucug

SEQ ID NO: 2625930 - RNA, 17 nt, Human
uaaacaaauucauauuc

SEQ ID NO: 2625931 - RNA, 19 nt, Human
uaaacaaauguaugauuac

SEQ ID NO: 2625932 - RNA, 19 nt, Human
uaaaaaugcaaauccuaug

SEQ ID NO: 2625933 - RNA, 20 nt, Human
uaaaaaugcaaauccuaugu

SEQ ID NO: 2625934 - RNA, 16 nt, Human
uaaaaaugcaaauccu

SEQ ID NO: 2625935 - RNA, 23 nt, Human
uaaaaaugggacuucuuuucaca

SEQ ID NO: 2625936 - RNA, 20 nt, Human
uaaaaaugggacuucuuuuc

SEQ ID NO: 2625937 - RNA, 19 nt, Human
uaaaaaugggacuucuuuu

SEQ ID NO: 2625938 - RNA, 18 nt, Human
uaaaaaugggacuucuuu

SEQ ID NO: 2625939 - RNA, 17 nt, Human
uaaaaaugggacuucuu

SEQ ID NO: 2625940 - RNA, 19 nt, Human
uaaaaauggcucagaugcc

SEQ ID NO: 2625941 - RNA, 15 nt, Human
uaaaaaugguuuaaa

SEQ ID NO: 2625942 - RNA, 21 nt, Human
uaaaagauauaagugcuguau

SEQ ID NO: 2625943 - RNA, 22 nt, Human
uaaaagauauaagugcuguaua

SEQ ID NO: 2625944 - RNA, 13 nt, Human
uaaaagaucgcag

SEQ ID NO: 2625945 - RNA, 14 nt, Human
uaaaagaugaaaau

SEQ ID NO: 2625946 - RNA, 14 nt, Human
uaaaagauccuuuu

SEQ ID NO: 2625947 - RNA, 16 nt, Human
uaaaagaugcaaugua

SEQ ID NO: 2625948 - RNA, 19 nt, Human
uaaaagauggggucuguaa

SEQ ID NO: 2625949 - RNA, 18 nt, Human
uaaaagauggggucugua

SEQ ID NO: 2625950 - RNA, 21 nt, Human
uaaaagauggggucuguaaaa

SEQ ID NO: 2625951 - RNA, 20 nt, Human
uaaaagauggggucuguaaa

SEQ ID NO: 2625952 - RNA, 22 nt, Human
uaaaagauggggucuguaaaau

SEQ ID NO: 2625953 - RNA, 21 nt, Human
uaaaagcagcaucugcuaaua

SEQ ID NO: 2625954 - RNA, 15 nt, Human
uaaaagcauaaaugc

SEQ ID NO: 2625955 - RNA, 21 nt, Human
uaaaagggacugagaaauuua

SEQ ID NO: 2625956 - RNA, 20 nt, Human
uaaaagggacugagaaauuu

SEQ ID NO: 2625957 - RNA, 19 nt, Human
uaaaagggacugagaaauu

SEQ ID NO: 2625958 - RNA, 17 nt, Human
uaaaagggacugagaaa

SEQ ID NO: 2625959 - RNA, 16 nt, Human
uaaaaggaaaagcaaa

SEQ ID NO: 2625960 - RNA, 14 nt, Human
uaaaaggaaaagca

SEQ ID NO: 2625961 - RNA, 17 nt, Human
uaaaagcauaaaugcaa

SEQ ID NO: 2625962 - RNA, 18 nt, Human
uaaaagcauaaaugcaaa

SEQ ID NO: 2625963 - RNA, 13 nt, Human
uaaaauauuuuca

SEQ ID NO: 2625964 - RNA, 16 nt, Human
uaaaauauuuugaauc

SEQ ID NO: 2625965 - RNA, 14 nt, Human
uaaaauauuuugaa

SEQ ID NO: 2625966 - RNA, 13 nt, Human
uaaaauauuuauu

SEQ ID NO: 2625967 - RNA, 20 nt, Human
uaaaaggccaaaccucuguu

SEQ ID NO: 2625968 - RNA, 17 nt, Human
uaaaaucagccaauuau

SEQ ID NO: 2625969 - RNA, 15 nt, Human
uaaaaucagccaauu

SEQ ID NO: 2625970 - RNA, 14 nt, Human
uaaaaucagccaau

SEQ ID NO: 2625971 - RNA, 13 nt, Human
uaaaaucagccaa

SEQ ID NO: 2625972 - RNA, 17 nt, Human
uaaaauauuuuugaaag

SEQ ID NO: 2625973 - RNA, 20 nt, Human
uaaaauauuuugaaucaaua

SEQ ID NO: 2625974 - RNA, 18 nt, Human
uaaaauccauacauuugu

SEQ ID NO: 2625975 - RNA, 19 nt, Human
uaaaauccauacauuugug

SEQ ID NO: 2625976 - RNA, 22 nt, Human
uaaaaucagccaauuauguuaa

SEQ ID NO: 2625977 - RNA, 21 nt, Human
uaaaaucagccaauuauguua

SEQ ID NO: 2625978 - RNA, 15 nt, Human
uaaaauccucaaucc

SEQ ID NO: 2625979 - RNA, 16 nt, Human
uaaaaugagaaaucua

SEQ ID NO: 2625980 - RNA, 15 nt, Human
uaaaaugagaaaucu

SEQ ID NO: 2625981 - RNA, 17 nt, Human
uaaaaugaggacauguu

SEQ ID NO: 2625982 - RNA, 21 nt, Human
uaaaaugaccaguaauuguga

SEQ ID NO: 2625983 - RNA, 20 nt, Human
uaaaaugauuguaaaauagc

SEQ ID NO: 2625984 - RNA, 18 nt, Human
uaaaaugauuguaaaaua

SEQ ID NO: 2625985 - RNA, 17 nt, Human
uaaaaugauuguaaaau

SEQ ID NO: 2625986 - RNA, 16 nt, Human
uaaaaugauuguaaaa

SEQ ID NO: 2625987 - RNA, 15 nt, Human
uaaaaugauuguaaa

SEQ ID NO: 2625988 - RNA, 14 nt, Human
uaaaaugauuguaa

SEQ ID NO: 2625989 - RNA, 20 nt, Human
uaaaaugagguucaacuguu

SEQ ID NO: 2625990 - RNA, 13 nt, Human
uaaaaugagaaau

SEQ ID NO: 2625991 - RNA, 15 nt, Human
uaaaaucuuuucuau

SEQ ID NO: 2625992 - RNA, 14 nt, Human
uaaaaugaaauuac

SEQ ID NO: 2625993 - RNA, 22 nt, Human
uaaaaucuuucuuucuuagaaa

SEQ ID NO: 2625994 - RNA, 21 nt, Human
uaaaaucuuucuuucuuagaa

SEQ ID NO: 2625995 - RNA, 20 nt, Human
uaaaaucuuucuuucuuaga

SEQ ID NO: 2625996 - RNA, 19 nt, Human
uaaaaucuuucuuucuuag

SEQ ID NO: 2625997 - RNA, 18 nt, Human
uaaaaucuuucuuucuua

SEQ ID NO: 2625998 - RNA, 12 nt, Human
guuuuucaauua

SEQ ID NO: 2625999 - RNA, 14 nt, Human
guuuuuauuaguac

SEQ ID NO: 2626000 - RNA, 16 nt, Human
guuuuuauuccuugug

SEQ ID NO: 2626001 - RNA, 23 nt, Human
guuuuuauaaaaaauggugccug

SEQ ID NO: 2626002 - RNA, 21 nt, Human
guuuuuaugaagaaaaaauac

SEQ ID NO: 2626003 - RNA, 16 nt, Human
guuuuuauggggcuga

SEQ ID NO: 2626004 - RNA, 18 nt, Human
guuuuuauggggcugaac

SEQ ID NO: 2626005 - RNA, 21 nt, Human
guuuuucaauuaaacggauua

SEQ ID NO: 2626006 - RNA, 19 nt, Human
guuuuucaauuaaacggau

SEQ ID NO: 2626007 - RNA, 18 nt, Human
guuuuucaauuaaacgga

SEQ ID NO: 2626008 - RNA, 17 nt, Human
guuuuucaauuaaacgg

SEQ ID NO: 2626009 - RNA, 16 nt, Human
guuuuucaauuaaacg

SEQ ID NO: 2626010 - RNA, 15 nt, Human
guuuuucaauuaaac

SEQ ID NO: 2626011 - RNA, 14 nt, Human
guuuuucaauuaaa

SEQ ID NO: 2626012 - RNA, 13 nt, Human
guuuuucaauuaa

SEQ ID NO: 2626013 - RNA, 12 nt, Human
guuuuucacauu

SEQ ID NO: 2626014 - RNA, 14 nt, Human
guuuuucacauuuu

SEQ ID NO: 2626015 - RNA, 16 nt, Human
guuuuucacauuuucc

SEQ ID NO: 2626016 - RNA, 16 nt, Human
uaaaaaaaaaugccuu

SEQ ID NO: 2626017 - RNA, 15 nt, Human
uaaaaaaaaaugccu

SEQ ID NO: 2626018 - RNA, 22 nt, Human
uaaaaaaaaaggcauauugcuu

SEQ ID NO: 2626019 - RNA, 16 nt, Human
uaaaaaaaaaggcaua

SEQ ID NO: 2626020 - RNA, 14 nt, Human
uaaaaaaaaaggca

SEQ ID NO: 2626021 - RNA, 19 nt, Human
uaaaaaaaaagaucuguuu

SEQ ID NO: 2626022 - RNA, 23 nt, Human
guuuuucaauuaaacggauuauu

SEQ ID NO: 2626023 - RNA, 12 nt, Human
guuuuucaguuu

SEQ ID NO: 2626024 - RNA, 23 nt, Human
uaaaaaaaauaguugagccagca

SEQ ID NO: 2626025 - RNA, 16 nt, Human
uaaaaaaaauaguuga

SEQ ID NO: 2626026 - RNA, 14 nt, Human
uaaaaaaaauaguu

SEQ ID NO: 2626027 - RNA, 21 nt, Human
uaaaaaaacaaucauuugcuu

SEQ ID NO: 2626028 - RNA, 15 nt, Human
uaaaaaaaagaaaaa

SEQ ID NO: 2626029 - RNA, 16 nt, Human
uaaaaaaaagaaaaaa

SEQ ID NO: 2626030 - RNA, 17 nt, Human
uaaaaaaaagaaaaaag

SEQ ID NO: 2626031 - RNA, 21 nt, Human
uaaaaaaaacaaaaagaacaa

SEQ ID NO: 2626032 - RNA, 19 nt, Human
uaaaaaaaacaaaaagaac

SEQ ID NO: 2626033 - RNA, 18 nt, Human
uaaaaaaaacaaaaagaa

SEQ ID NO: 2626034 - RNA, 17 nt, Human
uaaaaaaaacaaaaaga

SEQ ID NO: 2626035 - RNA, 13 nt, Human
uaaaaaaaacaaa

SEQ ID NO: 2626036 - RNA, 17 nt, Human
uaaaaaaaaaugccuuu

SEQ ID NO: 2626037 - RNA, 18 nt, Human
uaaaaaaaaaugccuuug

SEQ ID NO: 2626038 - RNA, 22 nt, Human
uaaaaaaaacaaaaagaacaaa

SEQ ID NO: 2626039 - RNA, 11 nt, Human
uaaaaaaaaga

SEQ ID NO: 2626040 - RNA, 14 nt, Human
uaaaaaaaagaaaa

SEQ ID NO: 2626041 - RNA, 12 nt, Human
uaaaaaaaagaa

SEQ ID NO: 2626042 - RNA, 11 nt, Human
uaaaaaacacu

SEQ ID NO: 2626043 - RNA, 16 nt, Human
uaaaaaaauuuaagug

SEQ ID NO: 2626044 - RNA, 15 nt, Human
uaaaaaaauuuaagu

SEQ ID NO: 2626045 - RNA, 12 nt, Human
uaaaaaaauuua

SEQ ID NO: 2626046 - RNA, 13 nt, Human
uaaaaaaauuggu

SEQ ID NO: 2626047 - RNA, 20 nt, Human
uaaaaaaauaauaauaaugu

SEQ ID NO: 2626048 - RNA, 13 nt, Human
uaaaaaaaugaca

SEQ ID NO: 2626049 - RNA, 19 nt, Human
uaaaaaaauaaaacauuuu

SEQ ID NO: 2626050 - RNA, 18 nt, Human
uaaaaaaauaaaacauuu

SEQ ID NO: 2626051 - RNA, 18 nt, Human
uaaaaaaaggcauuguuu

SEQ ID NO: 2626052 - RNA, 17 nt, Human
uaaaaaaauaaaacauu

SEQ ID NO: 2626053 - RNA, 17 nt, Human
uaaaaaauggugccuga

SEQ ID NO: 2626054 - RNA, 15 nt, Human
uaaaaaauggugccu

SEQ ID NO: 2626055 - RNA, 15 nt, Human
uaaaaaauggaaaga

SEQ ID NO: 2626056 - RNA, 17 nt, Human
uaaaaaauaaucuauuu

SEQ ID NO: 2626057 - RNA, 10 nt, Human
uaaaaacaaa

SEQ ID NO: 2626058 - RNA, 13 nt, Human
uaaaaaaugucca

SEQ ID NO: 2626059 - RNA, 18 nt, Human
uaaaaacagcauugcuuu

SEQ ID NO: 2626060 - RNA, 19 nt, Human
uaaaaacagcauugcuuuc

SEQ ID NO: 2626061 - RNA, 17 nt, Human
uaaaaacagcauugcuu

SEQ ID NO: 2626062 - RNA, 23 nt, Human
uaaaaagaaaagauaaagaugau

SEQ ID NO: 2626063 - RNA, 17 nt, Human
uaaaaagaaaagauaaa

SEQ ID NO: 2626064 - RNA, 11 nt, Human
uaaaaaugcaa

SEQ ID NO: 2626065 - RNA, 14 nt, Human
uaaaaacuuugcua

SEQ ID NO: 2626066 - RNA, 16 nt, Human
uaaaaacugacuccuu

SEQ ID NO: 2626067 - RNA, 17 nt, Human
uaaaaacugacuccuua

SEQ ID NO: 2626068 - RNA, 17 nt, Human
uaaaaacuauuuaacuu

SEQ ID NO: 2626069 - RNA, 14 nt, Human
uaaaaaccaagaag

SEQ ID NO: 2626070 - RNA, 20 nt, Human
uaaaaacagcauugcuuucu

SEQ ID NO: 2626071 - RNA, 22 nt, Human
uaaaaacagcauugcuuucuga

SEQ ID NO: 2626072 - RNA, 16 nt, Human
uaaaaaagaaacauuu

SEQ ID NO: 2626073 - RNA, 21 nt, Human
uaaaaaacuaucuuuuugcuu

SEQ ID NO: 2626074 - RNA, 15 nt, Human
uaaaaaacuuguaaa

SEQ ID NO: 2626075 - RNA, 19 nt, Human
uaaaaaagauauauuaaaa

SEQ ID NO: 2626076 - RNA, 15 nt, Human
uaaaaaagcugugug

SEQ ID NO: 2626077 - RNA, 20 nt, Human
uaaaaaacugcugacuguuu

SEQ ID NO: 2626078 - RNA, 23 nt, Human
uaaaaaacugcugacuguuuucu

SEQ ID NO: 2626079 - RNA, 12 nt, Human
uaaaaaacacug

SEQ ID NO: 2626080 - RNA, 14 nt, Human
uaaaaaacaaagaa

SEQ ID NO: 2626081 - RNA, 19 nt, Human
uaaaaaacaaagaagacaa

SEQ ID NO: 2626082 - RNA, 11 nt, Human
uaaaaaacaac

SEQ ID NO: 2626083 - RNA, 17 nt, Human
uaaaaaaauuuaagugc

SEQ ID NO: 2626084 - RNA, 10 nt, Human
guuuguuuca

SEQ ID NO: 2626085 - RNA, 18 nt, Human
guuuguuucucccccugg

SEQ ID NO: 2626086 - RNA, 24 nt, Human
guuuucaggaguggguugauuuca

SEQ ID NO: 2626087 - RNA, 21 nt, Human
guuuguuucucccccugggcu

SEQ ID NO: 2626088 - RNA, 19 nt, Human
guuuguuucucccccuggg

SEQ ID NO: 2626089 - RNA, 20 nt, Human
guuuguuucucccccugggc

SEQ ID NO: 2626090 - RNA, 16 nt, Human
guuuguugugaggauu

SEQ ID NO: 2626091 - RNA, 19 nt, Human
guuuguuggaucuucaaug

SEQ ID NO: 2626092 - RNA, 16 nt, Human
guuuucaguuuguaua

SEQ ID NO: 2626093 - RNA, 14 nt, Human
guuuucauaauaaa

SEQ ID NO: 2626094 - RNA, 14 nt, Human
guuuucaucaagac

SEQ ID NO: 2626095 - RNA, 22 nt, Human
guuuucauaauaaaacuuuaaa

SEQ ID NO: 2626096 - RNA, 17 nt, Human
guuuucaguguacaugg

SEQ ID NO: 2626097 - RNA, 18 nt, Human
guuuucaggcuagaugua

SEQ ID NO: 2626098 - RNA, 16 nt, Human
guuuucaguguacaug

SEQ ID NO: 2626099 - RNA, 16 nt, Human
guuuucauuaucucaa

SEQ ID NO: 2626100 - RNA, 10 nt, Human
guuuucaugg

SEQ ID NO: 2626101 - RNA, 22 nt, Human
guuuucauggugaaaauguacu

SEQ ID NO: 2626102 - RNA, 21 nt, Human
guuuucauggugaaaauguac

SEQ ID NO: 2626103 - RNA, 23 nt, Human
guuuucauggugaaaauguacug

SEQ ID NO: 2626104 - RNA, 17 nt, Human
guuuucauuugguucau

SEQ ID NO: 2626105 - RNA, 16 nt, Human
guuuucauuugguuca

SEQ ID NO: 2626106 - RNA, 14 nt, Human
guuuuccacccugg

SEQ ID NO: 2626107 - RNA, 16 nt, Human
guuuuccacccuggaa

SEQ ID NO: 2626108 - RNA, 16 nt, Human
guuuuccuuucucacc

SEQ ID NO: 2626109 - RNA, 13 nt, Human
guuuucuccuccc

SEQ ID NO: 2626110 - RNA, 16 nt, Human
guuuucuccucccagg

SEQ ID NO: 2626111 - RNA, 18 nt, Human
guuuucuccucccaggaa

SEQ ID NO: 2626112 - RNA, 21 nt, Human
guuuucuccucccaggaacug

SEQ ID NO: 2626113 - RNA, 17 nt, Human
guuuucucucggcuccc

SEQ ID NO: 2626114 - RNA, 23 nt, Human
guuuucgcaccuaccaucaggga

SEQ ID NO: 2626115 - RNA, 20 nt, Human
guuuucgaagcucagcccac

SEQ ID NO: 2626116 - RNA, 23 nt, Human
guuuucgaagcucagcccacccc

SEQ ID NO: 2626117 - RNA, 17 nt, Human
guuuucgaagcucagcc

SEQ ID NO: 2626118 - RNA, 18 nt, Human
guuuucgaagcucagccc

SEQ ID NO: 2626119 - RNA, 19 nt, Human
guuuucgaagcucagccca

SEQ ID NO: 2626120 - RNA, 19 nt, Human
guuuuccuuugucaucauu

SEQ ID NO: 2626121 - RNA, 17 nt, Human
guuuuccuuucucaccg

SEQ ID NO: 2626122 - RNA, 22 nt, Human
guuuuuauggcuuuugugcauu

SEQ ID NO: 2626123 - RNA, 23 nt, Human
guuuuuauggcuuuugugcauua

SEQ ID NO: 2626124 - RNA, 19 nt, Human
guuuuuauggcuuuugugc

SEQ ID NO: 2626125 - RNA, 14 nt, Human
guuuuuacuccagu

SEQ ID NO: 2626126 - RNA, 17 nt, Human
guuuuuacuuucuguug

SEQ ID NO: 2626127 - RNA, 18 nt, Human
guuuuuauaaaaaauggu

SEQ ID NO: 2626128 - RNA, 17 nt, Human
guuuuuaaaauaucuuu

SEQ ID NO: 2626129 - RNA, 18 nt, Human
guuuuuaaaaguuucaau

SEQ ID NO: 2626130 - RNA, 16 nt, Human
guuuuuaaaaguuuca

SEQ ID NO: 2626131 - RNA, 15 nt, Human
guuuuuaaaaguuuc

SEQ ID NO: 2626132 - RNA, 13 nt, Human
guuuuuaaaaguu

SEQ ID NO: 2626133 - RNA, 17 nt, Human
guuuuuaccucugucuu

SEQ ID NO: 2626134 - RNA, 22 nt, Human
guuuuuaccuaccacagugucu

SEQ ID NO: 2626135 - RNA, 16 nt, Human
guuuuuacuacaguug

SEQ ID NO: 2626136 - RNA, 23 nt, Human
guuuuuaaauagaguuugcuauu

SEQ ID NO: 2626137 - RNA, 21 nt, Human
guuuuuaccuaccacaguguc

SEQ ID NO: 2626138 - RNA, 19 nt, Human
guuuuuaacucaauauuuu

SEQ ID NO: 2626139 - RNA, 18 nt, Human
guuuuuaaauagaguuug

SEQ ID NO: 2626140 - RNA, 15 nt, Human
guuuuuaacucaaua

SEQ ID NO: 2626141 - RNA, 17 nt, Human
guuuucugaaaauauaa

SEQ ID NO: 2626142 - RNA, 19 nt, Human
guuuucucucggcucccca

SEQ ID NO: 2626143 - RNA, 12 nt, Human
guuuuguauucu

SEQ ID NO: 2626144 - RNA, 15 nt, Human
guuuuguauucucug

SEQ ID NO: 2626145 - RNA, 12 nt, Human
guuuucucuuga

SEQ ID NO: 2626146 - RNA, 19 nt, Human
guuuucucuugagagggug

SEQ ID NO: 2626147 - RNA, 24 nt, Human
guuuugugacuauauagagauguu

SEQ ID NO: 2626148 - RNA, 17 nt, Human
guuuuguuuuaaaauua

SEQ ID NO: 2626149 - RNA, 14 nt, Human
guuuugucuugaau

SEQ ID NO: 2626150 - RNA, 17 nt, Human
guuuugucaaacuguag

SEQ ID NO: 2626151 - RNA, 24 nt, Human
guuuugucaaacuguagaaaugau

SEQ ID NO: 2626152 - RNA, 18 nt, Human
guuuugugauguuugucc

SEQ ID NO: 2626153 - RNA, 19 nt, Human
guuuuguggaggagcucag

SEQ ID NO: 2626154 - RNA, 20 nt, Human
guuuccuggcacugcuucca

SEQ ID NO: 2626155 - RNA, 16 nt, Human
guuuccuggcacugcu

SEQ ID NO: 2626156 - RNA, 13 nt, Human
guuuccugcccug

SEQ ID NO: 2626157 - RNA, 17 nt, Human
guuuccugcccugggag

SEQ ID NO: 2626158 - RNA, 22 nt, Human
guuuccugaaacaacuuggaaa

SEQ ID NO: 2626159 - RNA, 14 nt, Human
guuuccugcaggcc

SEQ ID NO: 2626160 - RNA, 22 nt, Human
guuuccuggcacugcuuccagu

SEQ ID NO: 2626161 - RNA, 21 nt, Human
guuuccuggcacugcuuccag

SEQ ID NO: 2626162 - RNA, 16 nt, Human
guuuccuuauauuaug

SEQ ID NO: 2626163 - RNA, 22 nt, Human
guuuccugcccugggaggcagu

SEQ ID NO: 2626164 - RNA, 16 nt, Human
guuuccugcaggccag

SEQ ID NO: 2626165 - RNA, 14 nt, Human
guuucagaaaugug

SEQ ID NO: 2626166 - RNA, 18 nt, Human
guuucagaaauguguuau

SEQ ID NO: 2626167 - RNA, 21 nt, Human
guuucagauauauaucauauu

SEQ ID NO: 2626168 - RNA, 17 nt, Human
guuucagauauauauca

SEQ ID NO: 2626169 - RNA, 16 nt, Human
guuucagauauauauc

SEQ ID NO: 2626170 - RNA, 18 nt, Human
guuuaguaaggcugugua

SEQ ID NO: 2626171 - RNA, 18 nt, Human
guuucagcgacuccguug

SEQ ID NO: 2626172 - RNA, 22 nt, Human
guuucaggagagaguugaaccu

SEQ ID NO: 2626173 - RNA, 23 nt, Human
guuucaggagagaguugaaccua

SEQ ID NO: 2626174 - RNA, 19 nt, Human
guuucaggauacaugugcc

SEQ ID NO: 2626175 - RNA, 10 nt, Human
guuucaggug

SEQ ID NO: 2626176 - RNA, 11 nt, Human
guuucauugac

SEQ ID NO: 2626177 - RNA, 19 nt, Human
guuucauuuagucauguga

SEQ ID NO: 2626178 - RNA, 19 nt, Human
guuucauucuccugccugu

SEQ ID NO: 2626179 - RNA, 20 nt, Human
guuucauugcgaaucuuuuu

SEQ ID NO: 2626180 - RNA, 21 nt, Human
guuucauuuagucaugugacc

SEQ ID NO: 2626181 - RNA, 20 nt, Human
guuucauuuagucaugugac

SEQ ID NO: 2626182 - RNA, 23 nt, Human
guuuccaauguuuagcaaauaca

SEQ ID NO: 2626183 - RNA, 16 nt, Human
guuuccacagccugca

SEQ ID NO: 2626184 - RNA, 16 nt, Human
guuuccaaccuggagu

SEQ ID NO: 2626185 - RNA, 19 nt, Human
guuuccagacuuccuugag

SEQ ID NO: 2626186 - RNA, 19 nt, Human
guuucauuucuacugugac

SEQ ID NO: 2626187 - RNA, 22 nt, Human
guuuccacgaugaaaaacuucc

SEQ ID NO: 2626188 - RNA, 20 nt, Human
guuuccagacuuccuugaga

SEQ ID NO: 2626189 - RNA, 17 nt, Human
gguuggcgcacccuccc

SEQ ID NO: 2626190 - RNA, 15 nt, Human
gguuggcgcacccuc

SEQ ID NO: 2626191 - RNA, 14 nt, Human
gguuggcaguaagg

SEQ ID NO: 2626192 - RNA, 14 nt, Human
gguugcaaccacug

SEQ ID NO: 2626193 - RNA, 20 nt, Human
gguuggcgcacccuccccuc

SEQ ID NO: 2626194 - RNA, 18 nt, Human
gguuggcgcacccucccc

SEQ ID NO: 2626195 - RNA, 19 nt, Human
gguuggcugggcccagaag

SEQ ID NO: 2626196 - RNA, 11 nt, Human
gguuggcuggc

SEQ ID NO: 2626197 - RNA, 15 nt, Human
gguuggcugggccca

SEQ ID NO: 2626198 - RNA, 21 nt, Human
gguuggccccugcccggcugc

SEQ ID NO: 2626199 - RNA, 13 nt, Human
gguugcagggagc

SEQ ID NO: 2626200 - RNA, 16 nt, Human
gguugcaaggccgcug

SEQ ID NO: 2626201 - RNA, 13 nt, Human
guuuagaaagcuu

SEQ ID NO: 2626202 - RNA, 17 nt, Human
guuuagaaagcuugccc

SEQ ID NO: 2626203 - RNA, 19 nt, Human
gguugggagaaugucagua

SEQ ID NO: 2626204 - RNA, 14 nt, Human
guuuacuuaaagau

SEQ ID NO: 2626205 - RNA, 18 nt, Human
guuuacuuaucuuaugcc

SEQ ID NO: 2626206 - RNA, 22 nt, Human
guuuacuuaaagauuuaucaaa

SEQ ID NO: 2626207 - RNA, 16 nt, Human
guuuacuuaaagauuu

SEQ ID NO: 2626208 - RNA, 18 nt, Human
guuuaggcugguggccca

SEQ ID NO: 2626209 - RNA, 16 nt, Human
guuuaguaaggcugug

SEQ ID NO: 2626210 - RNA, 21 nt, Human
guuuaggcugguggcccagga

SEQ ID NO: 2626211 - RNA, 16 nt, Human
guuuaguaaucauauu

SEQ ID NO: 2626212 - RNA, 12 nt, Human
guuuagcaaaua

SEQ ID NO: 2626213 - RNA, 17 nt, Human
guuuagcagcagccuuu

SEQ ID NO: 2626214 - RNA, 19 nt, Human
guuuacuuuucagggcauc

SEQ ID NO: 2626215 - RNA, 17 nt, Human
guuuacuuuucagggca

SEQ ID NO: 2626216 - RNA, 20 nt, Human
guuuaggauguugaaaaagu

SEQ ID NO: 2626217 - RNA, 23 nt, Human
guuuagcagcagccuuuaaugca

SEQ ID NO: 2626218 - RNA, 19 nt, Human
guuuguaaauuaacuuuua

SEQ ID NO: 2626219 - RNA, 13 nt, Human
guuuguaaaacua

SEQ ID NO: 2626220 - RNA, 17 nt, Human
guuuguaaauuaacuuu

SEQ ID NO: 2626221 - RNA, 19 nt, Human
guuuguggaaaaugaaaau

SEQ ID NO: 2626222 - RNA, 13 nt, Human
guuugugcuucua

SEQ ID NO: 2626223 - RNA, 12 nt, Human
guuuguggccuc

SEQ ID NO: 2626224 - RNA, 18 nt, Human
guuuguuccccaagacau

SEQ ID NO: 2626225 - RNA, 13 nt, Human
guuuguggccuca

SEQ ID NO: 2626226 - RNA, 14 nt, Human
guuuguggccucag

SEQ ID NO: 2626227 - RNA, 17 nt, Human
guuugucuucuccccag

SEQ ID NO: 2626228 - RNA, 16 nt, Human
guuugucuucucccca

SEQ ID NO: 2626229 - RNA, 15 nt, Human
guuugucuucucccc

SEQ ID NO: 2626230 - RNA, 15 nt, Human
guuugucugucuuca

SEQ ID NO: 2626231 - RNA, 18 nt, Human
guuugucugucuucauag

SEQ ID NO: 2626232 - RNA, 17 nt, Human
guuugauuaaauucuug

SEQ ID NO: 2626233 - RNA, 19 nt, Human
guuugauuaaauucuugca

SEQ ID NO: 2626234 - RNA, 22 nt, Human
guuugauuaaauucuugcaaag

SEQ ID NO: 2626235 - RNA, 20 nt, Human
guuugaugcauuaaaagaaa

SEQ ID NO: 2626236 - RNA, 22 nt, Human
guuugguucacuuacagauagu

SEQ ID NO: 2626237 - RNA, 14 nt, Human
guuugguucugggg

SEQ ID NO: 2626238 - RNA, 19 nt, Human
guuugagguuuuuaagccu

SEQ ID NO: 2626239 - RNA, 16 nt, Human
guuugagguuuuuaag

SEQ ID NO: 2626240 - RNA, 16 nt, Human
guuugaggcugcagcg

SEQ ID NO: 2626241 - RNA, 15 nt, Human
guuugagcugccuuc

SEQ ID NO: 2626242 - RNA, 14 nt, Human
guuugagcugccuu

SEQ ID NO: 2626243 - RNA, 13 nt, Human
guuugagcugccu

SEQ ID NO: 2626244 - RNA, 23 nt, Human
guuugagcucugcagcccaggga

SEQ ID NO: 2626245 - RNA, 18 nt, Human
guuugagcugccuucccu

SEQ ID NO: 2626246 - RNA, 23 nt, Human
guuugaggauauauuuucacuuu

SEQ ID NO: 2626247 - RNA, 13 nt, Human
guuugagcucaga

SEQ ID NO: 2626248 - RNA, 15 nt, Human
guuugagcucagacc

SEQ ID NO: 2626249 - RNA, 20 nt, Human
guuugagcucugcagcccag

SEQ ID NO: 2626250 - RNA, 16 nt, Human
guuugagcucagaccc

SEQ ID NO: 2626251 - RNA, 17 nt, Human
guuugagauggacacac

SEQ ID NO: 2626252 - RNA, 14 nt, Human
guuucuuuguaaug

SEQ ID NO: 2626253 - RNA, 23 nt, Human
guuucuuucuaguggucuuugua

SEQ ID NO: 2626254 - RNA, 17 nt, Human
guuucuuuguaaugaaa

SEQ ID NO: 2626255 - RNA, 16 nt, Human
guuugaaccaagaacu

SEQ ID NO: 2626256 - RNA, 16 nt, Human
guuugaaggaaacagu

SEQ ID NO: 2626257 - RNA, 15 nt, Human
guuugaaggaaacag

SEQ ID NO: 2626258 - RNA, 14 nt, Human
guuugaagccugga

SEQ ID NO: 2626259 - RNA, 21 nt, Human
guuugaagccugcccuugucu

SEQ ID NO: 2626260 - RNA, 15 nt, Human
guuugaagccugccc

SEQ ID NO: 2626261 - RNA, 12 nt, Human
guuugaacuuca

SEQ ID NO: 2626262 - RNA, 14 nt, Human
guuugaauguuaaa

SEQ ID NO: 2626263 - RNA, 17 nt, Human
guuugaauauaaacacu

SEQ ID NO: 2626264 - RNA, 19 nt, Human
guuugaauauaaacacuau

SEQ ID NO: 2626265 - RNA, 17 nt, Human
guuugaaggaggugagg

SEQ ID NO: 2626266 - RNA, 17 nt, Human
guuugaaggaaacaguu

SEQ ID NO: 2626267 - RNA, 13 nt, Human
guuugaauauaaa

SEQ ID NO: 2626268 - RNA, 15 nt, Human
guuucuaaagcugcc

SEQ ID NO: 2626269 - RNA, 14 nt, Human
guuucuaaagcugc

SEQ ID NO: 2626270 - RNA, 16 nt, Human
guuucuaaagcugcca

SEQ ID NO: 2626271 - RNA, 18 nt, Human
guuucuuucuaguggucu

SEQ ID NO: 2626272 - RNA, 21 nt, Human
guuucuuuccugccuucuucu

SEQ ID NO: 2626273 - RNA, 19 nt, Human
guuucuuuccugccuucuu

SEQ ID NO: 2626274 - RNA, 20 nt, Human
guuucuaaagcugccagccg

SEQ ID NO: 2626275 - RNA, 16 nt, Human
guuucguuucuguaua

SEQ ID NO: 2626276 - RNA, 15 nt, Human
guuucguuucuguau

SEQ ID NO: 2626277 - RNA, 14 nt, Human
guuucguuucugua

SEQ ID NO: 2626278 - RNA, 17 nt, Human
guuucgagaagcugcuc

SEQ ID NO: 2626279 - RNA, 23 nt, Human
guuucguggggaggucuaaucua

SEQ ID NO: 2626280 - RNA, 21 nt, Human
guuucgagaagcugcucugga

SEQ ID NO: 2626281 - RNA, 13 nt, Human
guuucgagaagcu

SEQ ID NO: 2626282 - RNA, 18 nt, Human
guuucgaaguugaugcaa

SEQ ID NO: 2626283 - RNA, 15 nt, Human
guuucguggggaggu

SEQ ID NO: 2626284 - RNA, 20 nt, Human
guuucgugaaguauacugua

SEQ ID NO: 2626285 - RNA, 20 nt, Human
guuuccuuucauuuacugug

SEQ ID NO: 2626286 - RNA, 17 nt, Human
guuuccuuucauuuacu

SEQ ID NO: 2626287 - RNA, 23 nt, Human
guuuccuuucauuuacuguggcu

SEQ ID NO: 2626288 - RNA, 14 nt, Human
guuuccuucagugc

SEQ ID NO: 2626289 - RNA, 13 nt, Human
uauuuuuuucuga

SEQ ID NO: 2626290 - RNA, 13 nt, Human
ucaaaaaaugagc

SEQ ID NO: 2626291 - RNA, 15 nt, Human
uauuuuuuuacuaau

SEQ ID NO: 2626292 - RNA, 13 nt, Human
uauuuuuucagac

SEQ ID NO: 2626293 - RNA, 14 nt, Human
uauuuuuuucuacc

SEQ ID NO: 2626294 - RNA, 15 nt, Human
uauuuuuuucuaccu

SEQ ID NO: 2626295 - RNA, 13 nt, Human
ucaaaaauauaac

SEQ ID NO: 2626296 - RNA, 19 nt, Human
ucaaaaaguguuuauuuuu

SEQ ID NO: 2626297 - RNA, 23 nt, Human
ucaaaaaguguuuauuuuucaua

SEQ ID NO: 2626298 - RNA, 19 nt, Human
ucaaaacccaucugggcuc

SEQ ID NO: 2626299 - RNA, 15 nt, Human
ucaaaaaguguuuau

SEQ ID NO: 2626300 - RNA, 14 nt, Human
ucaaaaaguguuua

SEQ ID NO: 2626301 - RNA, 12 nt, Human
ucaaaaaguguu

SEQ ID NO: 2626302 - RNA, 23 nt, Human
ucaaaaagucuacgcucuccuuu

SEQ ID NO: 2626303 - RNA, 22 nt, Human
ucaaaaacuuuggaguccccuc

SEQ ID NO: 2626304 - RNA, 17 nt, Human
ucaaaaacuuuggaguc

SEQ ID NO: 2626305 - RNA, 23 nt, Human
uauuuuuuucuaccuugaggucu

SEQ ID NO: 2626306 - RNA, 13 nt, Human
ucaaaaacuguau

SEQ ID NO: 2626307 - RNA, 23 nt, Human
ucaaaaacacaguguuuuuguaa

SEQ ID NO: 2626308 - RNA, 15 nt, Human
ucaaaaacauucuua

SEQ ID NO: 2626309 - RNA, 13 nt, Human
ucaaaacugcacu

SEQ ID NO: 2626310 - RNA, 23 nt, Human
ucaaacggccucacuaggcuucu

SEQ ID NO: 2626311 - RNA, 17 nt, Human
ucaaaccuguuuaaaua

SEQ ID NO: 2626312 - RNA, 15 nt, Human
ucaaaacucaaaugc

SEQ ID NO: 2626313 - RNA, 18 nt, Human
ucaaaacucauuuccuau

SEQ ID NO: 2626314 - RNA, 22 nt, Human
ucaaaacgguuuuacugcagcu

SEQ ID NO: 2626315 - RNA, 14 nt, Human
ucaaaacucaaaug

SEQ ID NO: 2626316 - RNA, 20 nt, Human
ucaaaaccuuucaaauauca

SEQ ID NO: 2626317 - RNA, 16 nt, Human
ucaaaacuacaaauca

SEQ ID NO: 2626318 - RNA, 15 nt, Human
ucaaaaccuuuugaa

SEQ ID NO: 2626319 - RNA, 18 nt, Human
ucaaaacggggcagccaa

SEQ ID NO: 2626320 - RNA, 19 nt, Human
ucaaaccuguuuaaauauu

SEQ ID NO: 2626321 - RNA, 18 nt, Human
ucaaaccuguuuaaauau

SEQ ID NO: 2626322 - RNA, 16 nt, Human
ucaaacgugaaaaugc

SEQ ID NO: 2626323 - RNA, 15 nt, Human
ucaaacgugaaaaug

SEQ ID NO: 2626324 - RNA, 14 nt, Human
ucaaacucuuaaaa

SEQ ID NO: 2626325 - RNA, 22 nt, Human
ucaaaccuguuuaaauauuuca

SEQ ID NO: 2626326 - RNA, 21 nt, Human
uauuuucaacgcagcccugcu

SEQ ID NO: 2626327 - RNA, 19 nt, Human
uauuuucaacgcagcccug

SEQ ID NO: 2626328 - RNA, 13 nt, Human
uauuuucaagaaa

SEQ ID NO: 2626329 - RNA, 16 nt, Human
uauuuucaagaaacug

SEQ ID NO: 2626330 - RNA, 18 nt, Human
uauuuucauacagcauua

SEQ ID NO: 2626331 - RNA, 17 nt, Human
uauuuucaguauuuugg

SEQ ID NO: 2626332 - RNA, 21 nt, Human
uauuuucaaggcccucagcau

SEQ ID NO: 2626333 - RNA, 13 nt, Human
uauuuucaccauu

SEQ ID NO: 2626334 - RNA, 14 nt, Human
uauuuucaccauuu

SEQ ID NO: 2626335 - RNA, 16 nt, Human
uauuuuauguugcaua

SEQ ID NO: 2626336 - RNA, 15 nt, Human
uauuuuauguugcau

SEQ ID NO: 2626337 - RNA, 14 nt, Human
uauuuuaugcaaau

SEQ ID NO: 2626338 - RNA, 15 nt, Human
uauuuuauccucugg

SEQ ID NO: 2626339 - RNA, 23 nt, Human
uauuuuaucuuugauucuccuuc

SEQ ID NO: 2626340 - RNA, 16 nt, Human
uauuuuauacauuaac

SEQ ID NO: 2626341 - RNA, 15 nt, Human
uauuuugaaucaaua

SEQ ID NO: 2626342 - RNA, 13 nt, Human
uauuuugaaucaa

SEQ ID NO: 2626343 - RNA, 12 nt, Human
uauuuugaauca

SEQ ID NO: 2626344 - RNA, 22 nt, Human
uauuuugaaucaauaauauauu

SEQ ID NO: 2626345 - RNA, 16 nt, Human
uauuuugaaucaauaa

SEQ ID NO: 2626346 - RNA, 23 nt, Human
uauuuugaaucaauaauauauuu
